United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 82

SEQ ID NO: 3464125 - DNA, 23 bp, Homo sapiens
aaagtgcagctccgtttggcagt

SEQ ID NO: 3464126 - DNA, 18 bp, Homo sapiens
aaagtgcatatttatcca

SEQ ID NO: 3464127 - DNA, 11 bp, Homo sapiens
aaagtgctggg

SEQ ID NO: 3464128 - DNA, 14 bp, Homo sapiens
aaagtgctgggatt

SEQ ID NO: 3464129 - DNA, 19 bp, Homo sapiens
aaagtggaaaacaaggaag

SEQ ID NO: 3464130 - DNA, 20 bp, Homo sapiens
aaagtgtcttttgacatttt

SEQ ID NO: 3464131 - DNA, 22 bp, Homo sapiens
aaagtgtcttttgacattttat

SEQ ID NO: 3464132 - DNA, 17 bp, Homo sapiens
aaagtgtgtattaaaaa

SEQ ID NO: 3464133 - DNA, 12 bp, Homo sapiens
aaagtgtttagc

SEQ ID NO: 3464134 - DNA, 15 bp, Homo sapiens
aaagtgtttagctgt

SEQ ID NO: 3464135 - DNA, 15 bp, Homo sapiens
aaagtgttttgtacc

SEQ ID NO: 3464136 - DNA, 15 bp, Homo sapiens
aaagttactaggtaa

SEQ ID NO: 3464137 - DNA, 18 bp, Homo sapiens
aaagttattagtggttta

SEQ ID NO: 3464138 - DNA, 14 bp, Homo sapiens
aaagttctgtactc

SEQ ID NO: 3464139 - DNA, 19 bp, Homo sapiens
aaagttgacacctgagaaa

SEQ ID NO: 3464140 - DNA, 20 bp, Homo sapiens
aaagttgagggaaagagctt

SEQ ID NO: 3464141 - DNA, 19 bp, Homo sapiens
aaagttgccattattctat

SEQ ID NO: 3464142 - DNA, 19 bp, Homo sapiens
aaagttgtaacaaatacag

SEQ ID NO: 3464143 - DNA, 23 bp, Homo sapiens
aaagttgtaacaaatacagatga

SEQ ID NO: 3464144 - DNA, 21 bp, Homo sapiens
aaagttgtagtgaagctctca

SEQ ID NO: 3464145 - DNA, 23 bp, Homo sapiens
aaagtttctcttttcaaaacatt

SEQ ID NO: 3464146 - DNA, 16 bp, Homo sapiens
aaagtttgcttagaaa

SEQ ID NO: 3464147 - DNA, 15 bp, Homo sapiens
aaagttttacaaagg

SEQ ID NO: 3464148 - DNA, 15 bp, Homo sapiens
aaagttttcccttga

SEQ ID NO: 3464149 - DNA, 13 bp, Homo sapiens
aaataaaaagaaa

SEQ ID NO: 3464150 - DNA, 14 bp, Homo sapiens
aaataaaaataaat

SEQ ID NO: 3464151 - DNA, 12 bp, Homo sapiens
aaataaaacagt

SEQ ID NO: 3464152 - DNA, 17 bp, Homo sapiens
aaataaaaggaagccaa

SEQ ID NO: 3464153 - DNA, 19 bp, Homo sapiens
aaataaaaggactctggaa

SEQ ID NO: 3464154 - DNA, 17 bp, Homo sapiens
aaataaaagttttacaa

SEQ ID NO: 3464155 - DNA, 15 bp, Homo sapiens
aaataaaatggattt

SEQ ID NO: 3464156 - DNA, 12 bp, Homo sapiens
aaataaagctgt

SEQ ID NO: 3464157 - DNA, 23 bp, Homo sapiens
aaataaaggatgtgattgtggaa

SEQ ID NO: 3464158 - DNA, 13 bp, Homo sapiens
aaataaatatata

SEQ ID NO: 3464159 - DNA, 14 bp, Homo sapiens
aaataaattctgat

SEQ ID NO: 3464160 - DNA, 19 bp, Homo sapiens
aaataaattctgattcttc

SEQ ID NO: 3464161 - DNA, 14 bp, Homo sapiens
aaataaattgtata

SEQ ID NO: 3464162 - DNA, 19 bp, Homo sapiens
aaataaattgtatattcac

SEQ ID NO: 3464163 - DNA, 14 bp, Homo sapiens
aaataaatttatat

SEQ ID NO: 3464164 - DNA, 16 bp, Homo sapiens
aaataaatttatatga

SEQ ID NO: 3464165 - DNA, 17 bp, Homo sapiens
aaataaatttatatgaa

SEQ ID NO: 3464166 - DNA, 12 bp, Homo sapiens
aaataacaatga

SEQ ID NO: 3464167 - DNA, 13 bp, Homo sapiens
aaataacacacat

SEQ ID NO: 3464168 - DNA, 19 bp, Homo sapiens
aaataaccaatcctggaca

SEQ ID NO: 3464169 - DNA, 17 bp, Homo sapiens
aaataactagtgttgct

SEQ ID NO: 3464170 - DNA, 15 bp, Homo sapiens
aaataacttcaagca

SEQ ID NO: 3464171 - DNA, 18 bp, Homo sapiens
aaataacttcaagcaaac

SEQ ID NO: 3464172 - DNA, 18 bp, Homo sapiens
aaataagggcagagtcac

SEQ ID NO: 3464173 - DNA, 13 bp, Homo sapiens
aaataatatgcat

SEQ ID NO: 3464174 - DNA, 12 bp, Homo sapiens
aaataatgcaaa

SEQ ID NO: 3464175 - DNA, 18 bp, Homo sapiens
aaataatgtaattgtaat

SEQ ID NO: 3464176 - DNA, 13 bp, Homo sapiens
aaataatgtctct

SEQ ID NO: 3464177 - DNA, 12 bp, Homo sapiens
aaatacacatgg

SEQ ID NO: 3464178 - DNA, 23 bp, Homo sapiens
aaatacagattttgatagcaaag

SEQ ID NO: 3464179 - DNA, 22 bp, Homo sapiens
aaatacagtcttccatttgcaa

SEQ ID NO: 3464180 - DNA, 14 bp, Homo sapiens
aaatacattcaaat

SEQ ID NO: 3464181 - DNA, 20 bp, Homo sapiens
aaatacattcaaattctttt

SEQ ID NO: 3464182 - DNA, 18 bp, Homo sapiens
aaatactccaaagatgac

SEQ ID NO: 3464183 - DNA, 15 bp, Homo sapiens
aaatacttttcctta

SEQ ID NO: 3464184 - DNA, 18 bp, Homo sapiens
aaatagaatatagcatct

SEQ ID NO: 3464185 - DNA, 22 bp, Homo sapiens
aaatagaatatagcatctttca

SEQ ID NO: 3464186 - DNA, 23 bp, Homo sapiens
aaatagaatatagcatctttcat

SEQ ID NO: 3464187 - DNA, 13 bp, Homo sapiens
aaatagcaaaact

SEQ ID NO: 3464188 - DNA, 12 bp, Homo sapiens
aaatagcaaaga

SEQ ID NO: 3464189 - DNA, 18 bp, Homo sapiens
aaatagcgctgtttttgt

SEQ ID NO: 3464190 - DNA, 16 bp, Homo sapiens
aaatagtctagtgtag

SEQ ID NO: 3464191 - DNA, 22 bp, Homo sapiens
aaatagtgacataatatattct

SEQ ID NO: 3464192 - DNA, 17 bp, Homo sapiens
aaatagttaatatagtc

SEQ ID NO: 3464193 - DNA, 12 bp, Homo sapiens
aaatataaaact

SEQ ID NO: 3464194 - DNA, 16 bp, Homo sapiens
aaatatagctgtacaa

SEQ ID NO: 3464195 - DNA, 17 bp, Homo sapiens
aaatatagctgtacaaa

SEQ ID NO: 3464196 - DNA, 20 bp, Homo sapiens
aaatatagctgtacaaatat

SEQ ID NO: 3464197 - DNA, 12 bp, Homo sapiens
aaatatataaat

SEQ ID NO: 3464198 - DNA, 17 bp, Homo sapiens
aaatatataaatatata

SEQ ID NO: 3464199 - DNA, 18 bp, Homo sapiens
aaatatataaatatatat

SEQ ID NO: 3464200 - DNA, 19 bp, Homo sapiens
aaatatatatatatataaa

SEQ ID NO: 3464201 - DNA, 22 bp, Homo sapiens
aaatatatgtatttttatataa

SEQ ID NO: 3464202 - DNA, 18 bp, Homo sapiens
aaatatcatttatttttt

SEQ ID NO: 3464203 - DNA, 18 bp, Homo sapiens
aaatatgctcttttgttt

SEQ ID NO: 3464204 - DNA, 16 bp, Homo sapiens
aaatatggaacttaca

SEQ ID NO: 3464205 - DNA, 16 bp, Homo sapiens
aagaagcaaggaacca

SEQ ID NO: 3464206 - DNA, 19 bp, Homo sapiens
aagaagcaggctacactga

SEQ ID NO: 3464207 - DNA, 18 bp, Homo sapiens
aagaaggaatataccttt

SEQ ID NO: 3464208 - DNA, 14 bp, Homo sapiens
aagaaggcaaaaat

SEQ ID NO: 3464209 - DNA, 16 bp, Homo sapiens
aagaaggcaaaaatgt

SEQ ID NO: 3464210 - DNA, 22 bp, Homo sapiens
aagaagggctgcatgatgtttg

SEQ ID NO: 3464211 - DNA, 21 bp, Homo sapiens
aagaagtgagtgtttctatga

SEQ ID NO: 3464212 - DNA, 15 bp, Homo sapiens
aagaataaaatgttg

SEQ ID NO: 3464213 - DNA, 20 bp, Homo sapiens
aagaataatttatagtaatg

SEQ ID NO: 3464214 - DNA, 13 bp, Homo sapiens
aagaatacttgaa

SEQ ID NO: 3464215 - DNA, 15 bp, Homo sapiens
aagaatacttgaact

SEQ ID NO: 3464216 - DNA, 14 bp, Homo sapiens
aagaatatgacttt

SEQ ID NO: 3464217 - DNA, 13 bp, Homo sapiens
aagaatccttttg

SEQ ID NO: 3464218 - DNA, 20 bp, Homo sapiens
aagaatcttggtttgccttc

SEQ ID NO: 3464219 - DNA, 21 bp, Homo sapiens
aagaatcttggtttgccttcc

SEQ ID NO: 3464220 - DNA, 17 bp, Homo sapiens
aagaatgttactgcctt

SEQ ID NO: 3464221 - DNA, 20 bp, Homo sapiens
aagaatgttactgccttaat

SEQ ID NO: 3464222 - DNA, 16 bp, Homo sapiens
aagaattccaaagcaa

SEQ ID NO: 3464223 - DNA, 13 bp, Homo sapiens
aagaattctgtga

SEQ ID NO: 3464224 - DNA, 13 bp, Homo sapiens
aagaatttttaaa

SEQ ID NO: 3464225 - DNA, 12 bp, Homo sapiens
aagacaacatta

SEQ ID NO: 3464226 - DNA, 15 bp, Homo sapiens
aagacaacattaaaa

SEQ ID NO: 3464227 - DNA, 21 bp, Homo sapiens
aagacaaggaaaaaataacaa

SEQ ID NO: 3464228 - DNA, 19 bp, Homo sapiens
aagacaatgtgaaaagaaa

SEQ ID NO: 3464229 - DNA, 20 bp, Homo sapiens
aagacaatgtgaaaagaaaa

SEQ ID NO: 3464230 - DNA, 14 bp, Homo sapiens
aagacacctgcagc

SEQ ID NO: 3464231 - DNA, 19 bp, Homo sapiens
aagacactgcagaaaccct

SEQ ID NO: 3464232 - DNA, 21 bp, Homo sapiens
aagacagggctgataagctaa

SEQ ID NO: 3464233 - DNA, 23 bp, Homo sapiens
aagacagtgaaagaaaataacaa

SEQ ID NO: 3464234 - DNA, 16 bp, Homo sapiens
aagacatgatttcctt

SEQ ID NO: 3464235 - DNA, 13 bp, Homo sapiens
aagaccaaaatga

SEQ ID NO: 3464236 - DNA, 16 bp, Homo sapiens
aagaccccaagaggaa

SEQ ID NO: 3464237 - DNA, 15 bp, Homo sapiens
aagacccctgactca

SEQ ID NO: 3464238 - DNA, 16 bp, Homo sapiens
aagacctcacctagaa

SEQ ID NO: 3464239 - DNA, 21 bp, Homo sapiens
aagacctggcaaggacacaga

SEQ ID NO: 3464240 - DNA, 17 bp, Homo sapiens
aagacctggcagctctg

SEQ ID NO: 3464241 - DNA, 19 bp, Homo sapiens
aagacctggggttgtcagc

SEQ ID NO: 3464242 - DNA, 19 bp, Homo sapiens
aagacggcacggtcttccc

SEQ ID NO: 3464243 - DNA, 15 bp, Homo sapiens
aagacgtgtttgtgt

SEQ ID NO: 3464244 - DNA, 17 bp, Homo sapiens
aagactccagtactatt

SEQ ID NO: 3464245 - DNA, 18 bp, Homo sapiens
aagacttcagtatgttgt

SEQ ID NO: 3464246 - DNA, 12 bp, Homo sapiens
aagacttgtttt

SEQ ID NO: 3464247 - DNA, 19 bp, Homo sapiens
aagagaaaaaagtcaccat

SEQ ID NO: 3464248 - DNA, 20 bp, Homo sapiens
aagagaatattttaagtatt

SEQ ID NO: 3464249 - DNA, 12 bp, Homo sapiens
aagagagaaaaa

SEQ ID NO: 3464250 - DNA, 16 bp, Homo sapiens
aagagattgtggtttc

SEQ ID NO: 3464251 - DNA, 14 bp, Homo sapiens
aagagcagaacaga

SEQ ID NO: 3464252 - DNA, 17 bp, Homo sapiens
aagagcaggactccagg

SEQ ID NO: 3464253 - DNA, 21 bp, Homo sapiens
aagagccatgtagaagctgca

SEQ ID NO: 3464254 - DNA, 12 bp, Homo sapiens
aagagctctggt

SEQ ID NO: 3464255 - DNA, 15 bp, Homo sapiens
aagagctttgtttca

SEQ ID NO: 3464256 - DNA, 16 bp, Homo sapiens
aagaggaagttcagat

SEQ ID NO: 3464257 - DNA, 11 bp, Homo sapiens
aagaggcaggg

SEQ ID NO: 3464258 - DNA, 22 bp, Homo sapiens
aagaggctgaggctggcacagg

SEQ ID NO: 3464259 - DNA, 17 bp, Homo sapiens
aagagggcacacactgt

SEQ ID NO: 3464260 - DNA, 13 bp, Homo sapiens
aagagggtgaggg

SEQ ID NO: 3464261 - DNA, 19 bp, Homo sapiens
aagagggtgagggccttct

SEQ ID NO: 3464262 - DNA, 18 bp, Homo sapiens
aagaggttttaaaaaaat

SEQ ID NO: 3464263 - DNA, 15 bp, Homo sapiens
aagagtagaattgca

SEQ ID NO: 3464264 - DNA, 23 bp, Homo sapiens
aagagtgatagtcttttgctttt

SEQ ID NO: 3464265 - DNA, 16 bp, Homo sapiens
aagatagatcctttta

SEQ ID NO: 3464266 - DNA, 19 bp, Homo sapiens
aagatataagtgctgtata

SEQ ID NO: 3464267 - DNA, 11 bp, Homo sapiens
aagatatatta

SEQ ID NO: 3464268 - DNA, 14 bp, Homo sapiens
aagatatattaaaa

SEQ ID NO: 3464269 - DNA, 15 bp, Homo sapiens
aagatatattaaaaa

SEQ ID NO: 3464270 - DNA, 21 bp, Homo sapiens
aagatatattaaaaatataaa

SEQ ID NO: 3464271 - DNA, 13 bp, Homo sapiens
aagatattatgta

SEQ ID NO: 3464272 - DNA, 18 bp, Homo sapiens
aagatctctgcagggccg

SEQ ID NO: 3464273 - DNA, 19 bp, Homo sapiens
aagatctgtcctcagcctt

SEQ ID NO: 3464274 - DNA, 15 bp, Homo sapiens
aagatgacagctctt

SEQ ID NO: 3464275 - DNA, 16 bp, Homo sapiens
aagatgccccagggat

SEQ ID NO: 3464276 - DNA, 22 bp, Homo sapiens
aagatgcttttaacagagtctg

SEQ ID NO: 3464277 - DNA, 22 bp, Homo sapiens
aagatggggtctgtaaaatctt

SEQ ID NO: 3464278 - DNA, 18 bp, Homo sapiens
aagatgggtgaaggctgg

SEQ ID NO: 3464279 - DNA, 16 bp, Homo sapiens
aagatgtctgtttgct

SEQ ID NO: 3464280 - DNA, 17 bp, Homo sapiens
aagattccaaaaagcac

SEQ ID NO: 3464281 - DNA, 13 bp, Homo sapiens
aagattctttccc

SEQ ID NO: 3464282 - DNA, 22 bp, Homo sapiens
aagatttctgtctactaagtga

SEQ ID NO: 3464283 - DNA, 20 bp, Homo sapiens
aagatttggaagctcttctt

SEQ ID NO: 3464284 - DNA, 14 bp, Homo sapiens
aagattttcattga

SEQ ID NO: 3464285 - DNA, 11 bp, Homo sapiens
aagcaaaagaa

SEQ ID NO: 3464286 - DNA, 13 bp, Homo sapiens
aagcaaaagaaaa

SEQ ID NO: 3464287 - DNA, 13 bp, Homo sapiens
aagcaaacccaga

SEQ ID NO: 3464288 - DNA, 18 bp, Homo sapiens
aagcaaaggggacagctg

SEQ ID NO: 3464289 - DNA, 19 bp, Homo sapiens
aagcaacagcctttgaatg

SEQ ID NO: 3464290 - DNA, 21 bp, Homo sapiens
aagcaacagcctttgaatgta

SEQ ID NO: 3464291 - DNA, 15 bp, Homo sapiens
aagcaagaaagaaac

SEQ ID NO: 3464292 - DNA, 16 bp, Homo sapiens
aagcaagggtctcctt

SEQ ID NO: 3464293 - DNA, 17 bp, Homo sapiens
aagcaatggatatttgt

SEQ ID NO: 3464294 - DNA, 16 bp, Homo sapiens
aagcacaaagctcaag

SEQ ID NO: 3464295 - DNA, 17 bp, Homo sapiens
aagcacagatttgcatt

SEQ ID NO: 3464296 - DNA, 23 bp, Homo sapiens
aagcacatattagtgcagccaag

SEQ ID NO: 3464297 - DNA, 15 bp, Homo sapiens
aagcagacagctcca

SEQ ID NO: 3464298 - DNA, 21 bp, Homo sapiens
aagcagaggaaggagaggaga

SEQ ID NO: 3464299 - DNA, 12 bp, Homo sapiens
aagcagaggagg

SEQ ID NO: 3464300 - DNA, 14 bp, Homo sapiens
aagcagaggagggg

SEQ ID NO: 3464301 - DNA, 22 bp, Homo sapiens
aagcagaggaggggccgctgcc

SEQ ID NO: 3464302 - DNA, 17 bp, Homo sapiens
aagcagcctctccccag

SEQ ID NO: 3464303 - DNA, 16 bp, Homo sapiens
aagcagctaaattttc

SEQ ID NO: 3464304 - DNA, 13 bp, Homo sapiens
aagcagctcaaag

SEQ ID NO: 3464305 - DNA, 16 bp, Homo sapiens
aagcagctcaaaggca

SEQ ID NO: 3464306 - DNA, 19 bp, Homo sapiens
aagcagctcaaaggcacag

SEQ ID NO: 3464307 - DNA, 14 bp, Homo sapiens
aagcagctctcccc

SEQ ID NO: 3464308 - DNA, 22 bp, Homo sapiens
aagcaggaaatgaaaatgtctt

SEQ ID NO: 3464309 - DNA, 16 bp, Homo sapiens
aagcaggaagctcaga

SEQ ID NO: 3464310 - DNA, 23 bp, Homo sapiens
aagcaggactttgaggcaagtgt

SEQ ID NO: 3464311 - DNA, 19 bp, Homo sapiens
aagcaggttcccaagctca

SEQ ID NO: 3464312 - DNA, 20 bp, Homo sapiens
aagcagtagaaataatatgc

SEQ ID NO: 3464313 - DNA, 15 bp, Homo sapiens
aagcataaaaacatt

SEQ ID NO: 3464314 - DNA, 12 bp, Homo sapiens
aagcatctactt

SEQ ID NO: 3464315 - DNA, 13 bp, Homo sapiens
aagcatctacttc

SEQ ID NO: 3464316 - DNA, 13 bp, Homo sapiens
aagcatttgaatg

SEQ ID NO: 3464317 - DNA, 15 bp, Homo sapiens
aagcatttgaatgca

SEQ ID NO: 3464318 - DNA, 18 bp, Homo sapiens
aagcatttgaatgcattt

SEQ ID NO: 3464319 - DNA, 13 bp, Homo sapiens
aagccaagcagcc

SEQ ID NO: 3464320 - DNA, 17 bp, Homo sapiens
aagccaagcagccaagc

SEQ ID NO: 3464321 - DNA, 17 bp, Homo sapiens
aagccaaggcagcgacc

SEQ ID NO: 3464322 - DNA, 24 bp, Homo sapiens
aagccaaggcagcgaccccaggac

SEQ ID NO: 3464323 - DNA, 18 bp, Homo sapiens
aagccaagggaacctgtg

SEQ ID NO: 3464324 - DNA, 14 bp, Homo sapiens
aagccacaggcctg

SEQ ID NO: 3464325 - DNA, 15 bp, Homo sapiens
aagccacaggcctga

SEQ ID NO: 3464326 - DNA, 22 bp, Homo sapiens
aagccacaggcctgagatttca

SEQ ID NO: 3464327 - DNA, 12 bp, Homo sapiens
aagccagaagct

SEQ ID NO: 3464328 - DNA, 13 bp, Homo sapiens
aagccagaagctg

SEQ ID NO: 3464329 - DNA, 17 bp, Homo sapiens
aagccagcgtcctcctc

SEQ ID NO: 3464330 - DNA, 11 bp, Homo sapiens
aagccagctgc

SEQ ID NO: 3464331 - DNA, 12 bp, Homo sapiens
aagccagctgcc

SEQ ID NO: 3464332 - DNA, 20 bp, Homo sapiens
aagccaggaatttcccagga

SEQ ID NO: 3464333 - DNA, 18 bp, Homo sapiens
aagcccaatattataatt

SEQ ID NO: 3464334 - DNA, 12 bp, Homo sapiens
aagccctggccc

SEQ ID NO: 3464335 - DNA, 22 bp, Homo sapiens
aagccgtgctcgccccagcagg

SEQ ID NO: 3464336 - DNA, 22 bp, Homo sapiens
aagcctagtgaaggcttctctc

SEQ ID NO: 3464337 - DNA, 22 bp, Homo sapiens
aagcctcaactagtcatttttt

SEQ ID NO: 3464338 - DNA, 19 bp, Homo sapiens
aagcctcctccagccgcca

SEQ ID NO: 3464339 - DNA, 13 bp, Homo sapiens
aagcctgtgcaaa

SEQ ID NO: 3464340 - DNA, 18 bp, Homo sapiens
aagcctgtgcaaaaaaat

SEQ ID NO: 3464341 - DNA, 12 bp, Homo sapiens
aagcctgtggct

SEQ ID NO: 3464342 - DNA, 17 bp, Homo sapiens
aagcctttagttcctac

SEQ ID NO: 3464343 - DNA, 23 bp, Homo sapiens
aaccttagatgttctaagtcttt

SEQ ID NO: 3464344 - DNA, 15 bp, Homo sapiens
aaccttggccttctc

SEQ ID NO: 3464345 - DNA, 16 bp, Homo sapiens
aaccttggccttctcc

SEQ ID NO: 3464346 - DNA, 17 bp, Homo sapiens
aaccttgttatttctca

SEQ ID NO: 3464347 - DNA, 18 bp, Homo sapiens
aaccttgttatttctcag

SEQ ID NO: 3464348 - DNA, 15 bp, Homo sapiens
aacctttaagaattt

SEQ ID NO: 3464349 - DNA, 12 bp, Homo sapiens
aacctttttaaa

SEQ ID NO: 3464350 - DNA, 15 bp, Homo sapiens
aacgaaccttggcct

SEQ ID NO: 3464351 - DNA, 14 bp, Homo sapiens
aacgattaagtcca

SEQ ID NO: 3464352 - DNA, 13 bp, Homo sapiens
aacgccctcaaga

SEQ ID NO: 3464353 - DNA, 17 bp, Homo sapiens
aacgccctcaagaacat

SEQ ID NO: 3464354 - DNA, 14 bp, Homo sapiens
aacgctcctttgtg

SEQ ID NO: 3464355 - DNA, 14 bp, Homo sapiens
aacgctgcctgccc

SEQ ID NO: 3464356 - DNA, 13 bp, Homo sapiens
aacggatcagaaa

SEQ ID NO: 3464357 - DNA, 15 bp, Homo sapiens
aacggattccaaaga

SEQ ID NO: 3464358 - DNA, 15 bp, Homo sapiens
aacgtgcaaagccaa

SEQ ID NO: 3464359 - DNA, 14 bp, Homo sapiens
aacgtgcattgtgc

SEQ ID NO: 3464360 - DNA, 17 bp, Homo sapiens
aactaaactcatttata

SEQ ID NO: 3464361 - DNA, 18 bp, Homo sapiens
aactaaactcatttataa

SEQ ID NO: 3464362 - DNA, 18 bp, Homo sapiens
aactaattgactttagaa

SEQ ID NO: 3464363 - DNA, 20 bp, Homo sapiens
aactacaaccaatggaatgt

SEQ ID NO: 3464364 - DNA, 13 bp, Homo sapiens
aactacatgagaa

SEQ ID NO: 3464365 - DNA, 16 bp, Homo sapiens
aactacccaaaacaag

SEQ ID NO: 3464366 - DNA, 17 bp, Homo sapiens
aactactgcctttagaa

SEQ ID NO: 3464367 - DNA, 16 bp, Homo sapiens
aactagcccctggggt

SEQ ID NO: 3464368 - DNA, 23 bp, Homo sapiens
aactagtggggtttcctggcact

SEQ ID NO: 3464369 - DNA, 14 bp, Homo sapiens
aactagttttgttt

SEQ ID NO: 3464370 - DNA, 17 bp, Homo sapiens
aactatattttgtcata

SEQ ID NO: 3464371 - DNA, 17 bp, Homo sapiens
aactatgcatggtgccc

SEQ ID NO: 3464372 - DNA, 22 bp, Homo sapiens
aactatgcatggtgccccagga

SEQ ID NO: 3464373 - DNA, 23 bp, Homo sapiens
aactatgcatggtgccccaggac

SEQ ID NO: 3464374 - DNA, 14 bp, Homo sapiens
aactattgcccagg

SEQ ID NO: 3464375 - DNA, 14 bp, Homo sapiens
aactatttcttcag

SEQ ID NO: 3464376 - DNA, 13 bp, Homo sapiens
aactattttcaga

SEQ ID NO: 3464377 - DNA, 16 bp, Homo sapiens
aactattttcagatgt

SEQ ID NO: 3464378 - DNA, 21 bp, Homo sapiens
aactcaaatggggccagatcc

SEQ ID NO: 3464379 - DNA, 15 bp, Homo sapiens
aactcacctggggct

SEQ ID NO: 3464380 - DNA, 13 bp, Homo sapiens
aactcagatccag

SEQ ID NO: 3464381 - DNA, 22 bp, Homo sapiens
aactcagatccagggacagagg

SEQ ID NO: 3464382 - DNA, 22 bp, Homo sapiens
aactcatccctaatgctgcaga

SEQ ID NO: 3464383 - DNA, 15 bp, Homo sapiens
aactcattccagatc

SEQ ID NO: 3464384 - DNA, 21 bp, Homo sapiens
aactcattccagatcccaggc

SEQ ID NO: 3464385 - DNA, 22 bp, Homo sapiens
aactcatttcctatgtaactgc

SEQ ID NO: 3464386 - DNA, 10 bp, Homo sapiens
aactccaggg

SEQ ID NO: 3464387 - DNA, 20 bp, Homo sapiens
aactccctttttacacttta

SEQ ID NO: 3464388 - DNA, 19 bp, Homo sapiens
aactcctcgacatcactgt

SEQ ID NO: 3464389 - DNA, 22 bp, Homo sapiens
aactcctcgacatcactgttca

SEQ ID NO: 3464390 - DNA, 22 bp, Homo sapiens
aactctacatgtaactatttct

SEQ ID NO: 3464391 - DNA, 18 bp, Homo sapiens
aactctactgttgcaaag

SEQ ID NO: 3464392 - DNA, 12 bp, Homo sapiens
aactctagctgg

SEQ ID NO: 3464393 - DNA, 19 bp, Homo sapiens
aactctctttgggaatgtt

SEQ ID NO: 3464394 - DNA, 12 bp, Homo sapiens
aactctgggctc

SEQ ID NO: 3464395 - DNA, 12 bp, Homo sapiens
aactctggtggc

SEQ ID NO: 3464396 - DNA, 17 bp, Homo sapiens
aactctgtcttcacctg

SEQ ID NO: 3464397 - DNA, 20 bp, Homo sapiens
aactctgtcttcacctgatt

SEQ ID NO: 3464398 - DNA, 23 bp, Homo sapiens
aactctgtcttcacctgattcaa

SEQ ID NO: 3464399 - DNA, 19 bp, Homo sapiens
aactctgttgcaagtgcaa

SEQ ID NO: 3464400 - DNA, 11 bp, Homo sapiens
aactcttgatt

SEQ ID NO: 3464401 - DNA, 21 bp, Homo sapiens
aactgaaggctaaaaagcaac

SEQ ID NO: 3464402 - DNA, 17 bp, Homo sapiens
aactgagacaggcagtt

SEQ ID NO: 3464403 - DNA, 16 bp, Homo sapiens
aactgagcctagctac

SEQ ID NO: 3464404 - DNA, 16 bp, Homo sapiens
aactgagggctgatct

SEQ ID NO: 3464405 - DNA, 13 bp, Homo sapiens
aactgcaggccct

SEQ ID NO: 3464406 - DNA, 17 bp, Homo sapiens
aactgcaggccctggcc

SEQ ID NO: 3464407 - DNA, 23 bp, Homo sapiens
aactgcagttcatccgcactgta

SEQ ID NO: 3464408 - DNA, 22 bp, Homo sapiens
aactgcattaccgcgttgtaaa

SEQ ID NO: 3464409 - DNA, 16 bp, Homo sapiens
aactgcgttaaaggct

SEQ ID NO: 3464410 - DNA, 13 bp, Homo sapiens
aactgctccaagt

SEQ ID NO: 3464411 - DNA, 23 bp, Homo sapiens
aactgctgactgttttctcttga

SEQ ID NO: 3464412 - DNA, 14 bp, Homo sapiens
aactggaccctgtt

SEQ ID NO: 3464413 - DNA, 20 bp, Homo sapiens
aactggaccctgttgctaag

SEQ ID NO: 3464414 - DNA, 22 bp, Homo sapiens
aactggaccctgttgctaagcc

SEQ ID NO: 3464415 - DNA, 21 bp, Homo sapiens
aactgggtacttgtggacaca

SEQ ID NO: 3464416 - DNA, 13 bp, Homo sapiens
aactggtatttta

SEQ ID NO: 3464417 - DNA, 22 bp, Homo sapiens
aactggtattttatctttgatt

SEQ ID NO: 3464418 - DNA, 21 bp, Homo sapiens
aactggtgcactttgtaaatt

SEQ ID NO: 3464419 - DNA, 14 bp, Homo sapiens
aactgtcctttcct

SEQ ID NO: 3464420 - DNA, 18 bp, Homo sapiens
aactgtctttaaaagaga

SEQ ID NO: 3464421 - DNA, 15 bp, Homo sapiens
aactgtgcttctcta

SEQ ID NO: 3464422 - DNA, 18 bp, Homo sapiens
aactgtgcttctctatga

SEQ ID NO: 3464423 - DNA, 21 bp, Homo sapiens
aactgtgcttctctatgataa

SEQ ID NO: 3464424 - DNA, 22 bp, Homo sapiens
aactgtgtttcaagttcaatcc

SEQ ID NO: 3464425 - DNA, 22 bp, Homo sapiens
aacttacattgttcaattagaa

SEQ ID NO: 3464426 - DNA, 22 bp, Homo sapiens
aacttatagttaatattttgtt

SEQ ID NO: 3464427 - DNA, 23 bp, Homo sapiens
aacttatattaatagtaatttgt

SEQ ID NO: 3464428 - DNA, 12 bp, Homo sapiens
aacttcatggat

SEQ ID NO: 3464429 - DNA, 13 bp, Homo sapiens
aacttctgcctgt

SEQ ID NO: 3464430 - DNA, 16 bp, Homo sapiens
aacttcttatggaatt

SEQ ID NO: 3464431 - DNA, 17 bp, Homo sapiens
aacttcttatggaattg

SEQ ID NO: 3464432 - DNA, 24 bp, Homo sapiens
aacttcttatggaattgatttgca

SEQ ID NO: 3464433 - DNA, 11 bp, Homo sapiens
aacttcttcag

SEQ ID NO: 3464434 - DNA, 12 bp, Homo sapiens
aacttcttcata

SEQ ID NO: 3464435 - DNA, 15 bp, Homo sapiens
aacttgaaaaatact

SEQ ID NO: 3464436 - DNA, 13 bp, Homo sapiens
aacttgcctcttt

SEQ ID NO: 3464437 - DNA, 23 bp, Homo sapiens
aacttgcctcttttacctgctgc

SEQ ID NO: 3464438 - DNA, 14 bp, Homo sapiens
aacttggattctct

SEQ ID NO: 3464439 - DNA, 23 bp, Homo sapiens
aacttggctcgaatctctgtgcc

SEQ ID NO: 3464440 - DNA, 18 bp, Homo sapiens
aacttggctgcaggaatc

SEQ ID NO: 3464441 - DNA, 22 bp, Homo sapiens
aacttggggagttaagacctgg

SEQ ID NO: 3464442 - DNA, 23 bp, Homo sapiens
aacttggggagttaagacctggc

SEQ ID NO: 3464443 - DNA, 17 bp, Homo sapiens
aacttgtattaaagaca

SEQ ID NO: 3464444 - DNA, 14 bp, Homo sapiens
aactttcatttttt

SEQ ID NO: 3464445 - DNA, 23 bp, Homo sapiens
aactttgaataaagaatacttga

SEQ ID NO: 3464446 - DNA, 22 bp, Homo sapiens
aactttgcatagcagctgctac

SEQ ID NO: 3464447 - DNA, 15 bp, Homo sapiens
aactttgtggtctaa

SEQ ID NO: 3464448 - DNA, 18 bp, Homo sapiens
aacttttaaacatgagaa

SEQ ID NO: 3464449 - DNA, 11 bp, Homo sapiens
aactttttaca

SEQ ID NO: 3464450 - DNA, 18 bp, Homo sapiens
aactttttacattacaga

SEQ ID NO: 3464451 - DNA, 20 bp, Homo sapiens
aactttttattgccttctca

SEQ ID NO: 3464452 - DNA, 18 bp, Homo sapiens
aagaaaaagaaaaagaaa

SEQ ID NO: 3464453 - DNA, 13 bp, Homo sapiens
aagaaaacatcta

SEQ ID NO: 3464454 - DNA, 12 bp, Homo sapiens
aagaaaagattt

SEQ ID NO: 3464455 - DNA, 15 bp, Homo sapiens
aagaaaatattttgt

SEQ ID NO: 3464456 - DNA, 23 bp, Homo sapiens
aagaaaatcagatggagcatgaa

SEQ ID NO: 3464457 - DNA, 15 bp, Homo sapiens
aagaaaatcatattg

SEQ ID NO: 3464458 - DNA, 20 bp, Homo sapiens
aagaaaatcatattgcttct

SEQ ID NO: 3464459 - DNA, 15 bp, Homo sapiens
aagaaaattcctata

SEQ ID NO: 3464460 - DNA, 18 bp, Homo sapiens
aagaaacccgacagaggg

SEQ ID NO: 3464461 - DNA, 21 bp, Homo sapiens
aagaaacctactgcccaggca

SEQ ID NO: 3464462 - DNA, 15 bp, Homo sapiens
aagaaagaagactgt

SEQ ID NO: 3464463 - DNA, 12 bp, Homo sapiens
aagaaagacatc

SEQ ID NO: 3464464 - DNA, 21 bp, Homo sapiens
aagaaataaaaggaagccaaa

SEQ ID NO: 3464465 - DNA, 13 bp, Homo sapiens
aagaaataaccac

SEQ ID NO: 3464466 - DNA, 22 bp, Homo sapiens
aagaaatccaatcctagccctc

SEQ ID NO: 3464467 - DNA, 21 bp, Homo sapiens
aagaacaatattgactttgtc

SEQ ID NO: 3464468 - DNA, 16 bp, Homo sapiens
aagaacatgcagtttg

SEQ ID NO: 3464469 - DNA, 22 bp, Homo sapiens
aagaacatgcagtttgaaattc

SEQ ID NO: 3464470 - DNA, 13 bp, Homo sapiens
aagaacccctctg

SEQ ID NO: 3464471 - DNA, 14 bp, Homo sapiens
aagaacctggaact

SEQ ID NO: 3464472 - DNA, 17 bp, Homo sapiens
aagaacggggctcttct

SEQ ID NO: 3464473 - DNA, 23 bp, Homo sapiens
aagaacggggctcttctcatttc

SEQ ID NO: 3464474 - DNA, 21 bp, Homo sapiens
aagaacgttttttcctcagtg

SEQ ID NO: 3464475 - DNA, 20 bp, Homo sapiens
aagaactcaaacttctggct

SEQ ID NO: 3464476 - DNA, 16 bp, Homo sapiens
aagaactcatcactgt

SEQ ID NO: 3464477 - DNA, 19 bp, Homo sapiens
aagaactgtcatgtaaaca

SEQ ID NO: 3464478 - DNA, 19 bp, Homo sapiens
aagaagatcctaaaacaaa

SEQ ID NO: 3464479 - DNA, 17 bp, Homo sapiens
aaatatggaacttacat

SEQ ID NO: 3464480 - DNA, 16 bp, Homo sapiens
aaatatggacacttaa

SEQ ID NO: 3464481 - DNA, 13 bp, Homo sapiens
aaatatgtaccaa

SEQ ID NO: 3464482 - DNA, 13 bp, Homo sapiens
aaatatgtattta

SEQ ID NO: 3464483 - DNA, 15 bp, Homo sapiens
aaatatgtcgtagaa

SEQ ID NO: 3464484 - DNA, 22 bp, Homo sapiens
aaatatgtgaagcccagcatct

SEQ ID NO: 3464485 - DNA, 16 bp, Homo sapiens
aaatattatgagatgc

SEQ ID NO: 3464486 - DNA, 17 bp, Homo sapiens
aaatattatgagatgct

SEQ ID NO: 3464487 - DNA, 19 bp, Homo sapiens
aaatattccctagaaactt

SEQ ID NO: 3464488 - DNA, 13 bp, Homo sapiens
aaatattgctggg

SEQ ID NO: 3464489 - DNA, 15 bp, Homo sapiens
aaatattgctgtata

SEQ ID NO: 3464490 - DNA, 14 bp, Homo sapiens
aaatatttaaaaat

SEQ ID NO: 3464491 - DNA, 17 bp, Homo sapiens
aaatattttcctgccac

SEQ ID NO: 3464492 - DNA, 12 bp, Homo sapiens
aaatattttcta

SEQ ID NO: 3464493 - DNA, 19 bp, Homo sapiens
aaatattttctattttaag

SEQ ID NO: 3464494 - DNA, 12 bp, Homo sapiens
aaatattttgtc

SEQ ID NO: 3464495 - DNA, 14 bp, Homo sapiens
aaatattttttctg

SEQ ID NO: 3464496 - DNA, 21 bp, Homo sapiens
aaatcaacaccttaatatgct

SEQ ID NO: 3464497 - DNA, 22 bp, Homo sapiens
aaatcaactttttattgccttc

SEQ ID NO: 3464498 - DNA, 20 bp, Homo sapiens
aaatcaccacaaactgtaat

SEQ ID NO: 3464499 - DNA, 17 bp, Homo sapiens
aaatcagccaattatgt

SEQ ID NO: 3464500 - DNA, 14 bp, Homo sapiens
aaatcagtcaagct

SEQ ID NO: 3464501 - DNA, 23 bp, Homo sapiens
aaatcatcaagaagggctgcatg

SEQ ID NO: 3464502 - DNA, 21 bp, Homo sapiens
aaatcattttatatgtcaaag

SEQ ID NO: 3464503 - DNA, 12 bp, Homo sapiens
aaatccaaagaa

SEQ ID NO: 3464504 - DNA, 19 bp, Homo sapiens
aaatccagtgtgcacccct

SEQ ID NO: 3464505 - DNA, 20 bp, Homo sapiens
aaatccgaacctcctctgtg

SEQ ID NO: 3464506 - DNA, 23 bp, Homo sapiens
aaatcctatgtgattttaactct

SEQ ID NO: 3464507 - DNA, 21 bp, Homo sapiens
aaatccttagatctggcatgt

SEQ ID NO: 3464508 - DNA, 17 bp, Homo sapiens
aaatctcaccccatccc

SEQ ID NO: 3464509 - DNA, 20 bp, Homo sapiens
aaatctgacccagtgccccc

SEQ ID NO: 3464510 - DNA, 14 bp, Homo sapiens
aaatctggcttctg

SEQ ID NO: 3464511 - DNA, 22 bp, Homo sapiens
aaatctgggatgtactgtttgc

SEQ ID NO: 3464512 - DNA, 20 bp, Homo sapiens
aaatctgtcaagagtagtta

SEQ ID NO: 3464513 - DNA, 17 bp, Homo sapiens
aaatcttataatttaaa

SEQ ID NO: 3464514 - DNA, 18 bp, Homo sapiens
aaatctttctttcttaga

SEQ ID NO: 3464515 - DNA, 20 bp, Homo sapiens
aaatctttctttcttagaaa

SEQ ID NO: 3464516 - DNA, 22 bp, Homo sapiens
aaatctttctttcttagaaatt

SEQ ID NO: 3464517 - DNA, 11 bp, Homo sapiens
aaatcttttac

SEQ ID NO: 3464518 - DNA, 16 bp, Homo sapiens
aaatgaaaatgtcttg

SEQ ID NO: 3464519 - DNA, 11 bp, Homo sapiens
aaatgaagcaa

SEQ ID NO: 3464520 - DNA, 19 bp, Homo sapiens
aaatgaggaatgtatatgt

SEQ ID NO: 3464521 - DNA, 19 bp, Homo sapiens
aaatgaggtcagagcctgc

SEQ ID NO: 3464522 - DNA, 18 bp, Homo sapiens
aaatgatgtgtacccaaa

SEQ ID NO: 3464523 - DNA, 12 bp, Homo sapiens
aaatgcattgta

SEQ ID NO: 3464524 - DNA, 21 bp, Homo sapiens
aaatgcatttatagatcattt

SEQ ID NO: 3464525 - DNA, 16 bp, Homo sapiens
aaatgcctcagtgtat

SEQ ID NO: 3464526 - DNA, 21 bp, Homo sapiens
aaatgcctcagtgtatttgta

SEQ ID NO: 3464527 - DNA, 22 bp, Homo sapiens
aaatgcctcagtgtatttgtat

SEQ ID NO: 3464528 - DNA, 20 bp, Homo sapiens
aaatgctttttatttctgca

SEQ ID NO: 3464529 - DNA, 14 bp, Homo sapiens
aaatggaaattttg

SEQ ID NO: 3464530 - DNA, 21 bp, Homo sapiens
aaatggatgccttgaataata

SEQ ID NO: 3464531 - DNA, 23 bp, Homo sapiens
aaatggatgccttgaataataag

SEQ ID NO: 3464532 - DNA, 21 bp, Homo sapiens
aaatggcctcatgtggctgga

SEQ ID NO: 3464533 - DNA, 21 bp, Homo sapiens
aaatggctgtaatcatttgtt

SEQ ID NO: 3464534 - DNA, 16 bp, Homo sapiens
aaatggggccagatcc

SEQ ID NO: 3464535 - DNA, 18 bp, Homo sapiens
aaatggtggaggattgct

SEQ ID NO: 3464536 - DNA, 16 bp, Homo sapiens
aaatggttgtattaga

SEQ ID NO: 3464537 - DNA, 15 bp, Homo sapiens
aaatgtaatagccaa

SEQ ID NO: 3464538 - DNA, 16 bp, Homo sapiens
aaatgtacagacatat

SEQ ID NO: 3464539 - DNA, 17 bp, Homo sapiens
aaatgtacagacatatt

SEQ ID NO: 3464540 - DNA, 16 bp, Homo sapiens
aaatgtagaatattca

SEQ ID NO: 3464541 - DNA, 14 bp, Homo sapiens
aaatgtatatgcac

SEQ ID NO: 3464542 - DNA, 17 bp, Homo sapiens
aaatgtatcttattcac

SEQ ID NO: 3464543 - DNA, 21 bp, Homo sapiens
aaatgtcacgttttgttttgt

SEQ ID NO: 3464544 - DNA, 24 bp, Homo sapiens
aaatgtctagttgtaacaccatga

SEQ ID NO: 3464545 - DNA, 22 bp, Homo sapiens
aaatgtgcattcttttaaaaga

SEQ ID NO: 3464546 - DNA, 22 bp, Homo sapiens
aaatgtgttttgtttattaaat

SEQ ID NO: 3464547 - DNA, 23 bp, Homo sapiens
aaatgtgttttgtttattaaata

SEQ ID NO: 3464548 - DNA, 18 bp, Homo sapiens
aaatgttaactacatatt

SEQ ID NO: 3464549 - DNA, 20 bp, Homo sapiens
aaatgttatcttatactgta

SEQ ID NO: 3464550 - DNA, 10 bp, Homo sapiens
aaatgttctt

SEQ ID NO: 3464551 - DNA, 15 bp, Homo sapiens
aaatgttctttgggg

SEQ ID NO: 3464552 - DNA, 15 bp, Homo sapiens
aaattaagaaggcaa

SEQ ID NO: 3464553 - DNA, 13 bp, Homo sapiens
aaattacaatttt

SEQ ID NO: 3464554 - DNA, 12 bp, Homo sapiens
aaattagaaaat

SEQ ID NO: 3464555 - DNA, 18 bp, Homo sapiens
aaattatatttgtgctat

SEQ ID NO: 3464556 - DNA, 22 bp, Homo sapiens
aaattatatttgtgctatagta

SEQ ID NO: 3464557 - DNA, 21 bp, Homo sapiens
aaattatttttttttttgttc

SEQ ID NO: 3464558 - DNA, 17 bp, Homo sapiens
aaattcaattgtaaatt

SEQ ID NO: 3464559 - DNA, 23 bp, Homo sapiens
aaattcaattgtaaattgaatca

SEQ ID NO: 3464560 - DNA, 14 bp, Homo sapiens
aaattcacaaactt

SEQ ID NO: 3464561 - DNA, 18 bp, Homo sapiens
aaattcacaagttgtgtt

SEQ ID NO: 3464562 - DNA, 15 bp, Homo sapiens
aaattcacataataa

SEQ ID NO: 3464563 - DNA, 18 bp, Homo sapiens
aaattcacataataaacg

SEQ ID NO: 3464564 - DNA, 15 bp, Homo sapiens
aaattcactttcatt

SEQ ID NO: 3464565 - DNA, 17 bp, Homo sapiens
aaattcatattctttta

SEQ ID NO: 3464566 - DNA, 19 bp, Homo sapiens
aaattcctctttgctttgc

SEQ ID NO: 3464567 - DNA, 20 bp, Homo sapiens
aaattcctctttgctttgct

SEQ ID NO: 3464568 - DNA, 21 bp, Homo sapiens
aaattcgctgcaacctgttga

SEQ ID NO: 3464569 - DNA, 22 bp, Homo sapiens
aaattctagaaagtactttggc

SEQ ID NO: 3464570 - DNA, 22 bp, Homo sapiens
aaattctccaacagctgactct

SEQ ID NO: 3464571 - DNA, 21 bp, Homo sapiens
aaattctgaatttgcaaagta

SEQ ID NO: 3464572 - DNA, 22 bp, Homo sapiens
aaattctgaatttgcaaagtac

SEQ ID NO: 3464573 - DNA, 13 bp, Homo sapiens
aaattctgattct

SEQ ID NO: 3464574 - DNA, 13 bp, Homo sapiens
aaattctgtttct

SEQ ID NO: 3464575 - DNA, 12 bp, Homo sapiens
aaattcttgaaa

SEQ ID NO: 3464576 - DNA, 19 bp, Homo sapiens
aaattctttttttattatt

SEQ ID NO: 3464577 - DNA, 14 bp, Homo sapiens
aaattgcaaatctt

SEQ ID NO: 3464578 - DNA, 14 bp, Homo sapiens
aaattgccatattg

SEQ ID NO: 3464579 - DNA, 21 bp, Homo sapiens
aaattgccatattgcacatgt

SEQ ID NO: 3464580 - DNA, 20 bp, Homo sapiens
aaattgcctatcctgctgtt

SEQ ID NO: 3464581 - DNA, 17 bp, Homo sapiens
aaattgtattacaaatc

SEQ ID NO: 3464582 - DNA, 21 bp, Homo sapiens
aaattgtcccttaaacaaaaa

SEQ ID NO: 3464583 - DNA, 11 bp, Homo sapiens
aaattgtgaag

SEQ ID NO: 3464584 - DNA, 17 bp, Homo sapiens
aaatttaattcatgttt

SEQ ID NO: 3464585 - DNA, 13 bp, Homo sapiens
aaatttagaaact

SEQ ID NO: 3464586 - DNA, 14 bp, Homo sapiens
aaatttatatgaaa

SEQ ID NO: 3464587 - DNA, 16 bp, Homo sapiens
aaatttgactaatttt

SEQ ID NO: 3464588 - DNA, 13 bp, Homo sapiens
aaattttcagcat

SEQ ID NO: 3464589 - DNA, 14 bp, Homo sapiens
aaatttttgtaaat

SEQ ID NO: 3464590 - DNA, 13 bp, Homo sapiens
aaatttttttaga

SEQ ID NO: 3464591 - DNA, 20 bp, Homo sapiens
aacaaaaaatgtgctgttca

SEQ ID NO: 3464592 - DNA, 13 bp, Homo sapiens
aacaaaaattagg

SEQ ID NO: 3464593 - DNA, 14 bp, Homo sapiens
aacaaaaattaggt

SEQ ID NO: 3464594 - DNA, 11 bp, Homo sapiens
aacaaaaccag

SEQ ID NO: 3464595 - DNA, 17 bp, Homo sapiens
aacaaaactgcatttca

SEQ ID NO: 3464596 - DNA, 13 bp, Homo sapiens
aacaaaatttcta

SEQ ID NO: 3464597 - DNA, 24 bp, Homo sapiens
aacaaaatttgactaattttacat

SEQ ID NO: 3464598 - DNA, 16 bp, Homo sapiens
aacaaactctctgaac

SEQ ID NO: 3464599 - DNA, 12 bp, Homo sapiens
aacaaagccaga

SEQ ID NO: 3464600 - DNA, 14 bp, Homo sapiens
aacaaagccagaag

SEQ ID NO: 3464601 - DNA, 17 bp, Homo sapiens
aacaaagccagaagctg

SEQ ID NO: 3464602 - DNA, 15 bp, Homo sapiens
aacaaatacattcaa

SEQ ID NO: 3464603 - DNA, 12 bp, Homo sapiens
aacaaatatgca

SEQ ID NO: 3464604 - DNA, 14 bp, Homo sapiens
aacaaatgtgaagg

SEQ ID NO: 3464605 - DNA, 22 bp, Homo sapiens
aacaaattcatcaaatggaaga

SEQ ID NO: 3464606 - DNA, 16 bp, Homo sapiens
aacaacaccagaactg

SEQ ID NO: 3464607 - DNA, 14 bp, Homo sapiens
aacaacattttgag

SEQ ID NO: 3464608 - DNA, 20 bp, Homo sapiens
aacaacgtctttttgtttgt

SEQ ID NO: 3464609 - DNA, 18 bp, Homo sapiens
aacaagccaagaaagatg

SEQ ID NO: 3464610 - DNA, 14 bp, Homo sapiens
aacaaggaagtcaa

SEQ ID NO: 3464611 - DNA, 14 bp, Homo sapiens
aacaataaaatttt

SEQ ID NO: 3464612 - DNA, 15 bp, Homo sapiens
aacaataaatgtgca

SEQ ID NO: 3464613 - DNA, 19 bp, Homo sapiens
aacacaaacgggctcagca

SEQ ID NO: 3464614 - DNA, 20 bp, Homo sapiens
aacacacagatacacacaca

SEQ ID NO: 3464615 - DNA, 20 bp, Homo sapiens
aacacagacattctgccagg

SEQ ID NO: 3464616 - DNA, 19 bp, Homo sapiens
aacaccaagcacagcagcc

SEQ ID NO: 3464617 - DNA, 13 bp, Homo sapiens
aacacccctcagt

SEQ ID NO: 3464618 - DNA, 19 bp, Homo sapiens
aacacctctgcacaagctg

SEQ ID NO: 3464619 - DNA, 15 bp, Homo sapiens
aacaccttaatatgc

SEQ ID NO: 3464620 - DNA, 13 bp, Homo sapiens
aacacgcaggagc

SEQ ID NO: 3464621 - DNA, 13 bp, Homo sapiens
aacactctatatt

SEQ ID NO: 3464622 - DNA, 19 bp, Homo sapiens
aacactcttttgctttatt

SEQ ID NO: 3464623 - DNA, 14 bp, Homo sapiens
aacactgcaagaag

SEQ ID NO: 3464624 - DNA, 18 bp, Homo sapiens
aacactgtgggtgtgtga

SEQ ID NO: 3464625 - DNA, 18 bp, Homo sapiens
aacactttacaatgttca

SEQ ID NO: 3464626 - DNA, 14 bp, Homo sapiens
aacagaagcttcca

SEQ ID NO: 3464627 - DNA, 16 bp, Homo sapiens
aacagaagcttccatt

SEQ ID NO: 3464628 - DNA, 21 bp, Homo sapiens
aacagacaatatgtgagtgcc

SEQ ID NO: 3464629 - DNA, 19 bp, Homo sapiens
aacagactcgattcatatt

SEQ ID NO: 3464630 - DNA, 14 bp, Homo sapiens
aacagagagaatga

SEQ ID NO: 3464631 - DNA, 16 bp, Homo sapiens
aacagatatcttcagt

SEQ ID NO: 3464632 - DNA, 22 bp, Homo sapiens
aacagatatcttcagtttaatg

SEQ ID NO: 3464633 - DNA, 13 bp, Homo sapiens
aacagatctggaa

SEQ ID NO: 3464634 - DNA, 22 bp, Homo sapiens
aacagatctggaacctcagcct

SEQ ID NO: 3464635 - DNA, 17 bp, Homo sapiens
aacagatgtttcttttg

SEQ ID NO: 3464636 - DNA, 20 bp, Homo sapiens
aacagatgtttcttttgtat

SEQ ID NO: 3464637 - DNA, 15 bp, Homo sapiens
aacagcatgacaaaa

SEQ ID NO: 3464638 - DNA, 22 bp, Homo sapiens
aacagcatgacaaaaattattt

SEQ ID NO: 3464639 - DNA, 15 bp, Homo sapiens
aacagcctttgaatg

SEQ ID NO: 3464640 - DNA, 20 bp, Homo sapiens
aacagcctttgggaaatgct

SEQ ID NO: 3464641 - DNA, 22 bp, Homo sapiens
aacagctctcttcaatgacata

SEQ ID NO: 3464642 - DNA, 13 bp, Homo sapiens
aacagctgcctta

SEQ ID NO: 3464643 - DNA, 15 bp, Homo sapiens
aacaggaatctcaga

SEQ ID NO: 3464644 - DNA, 19 bp, Homo sapiens
aacaggaatctcagagaca

SEQ ID NO: 3464645 - DNA, 11 bp, Homo sapiens
aacaggcagat

SEQ ID NO: 3464646 - DNA, 17 bp, Homo sapiens
aacaggccattgtgaac

SEQ ID NO: 3464647 - DNA, 23 bp, Homo sapiens
aacaggctgggcttcagtggcag

SEQ ID NO: 3464648 - DNA, 22 bp, Homo sapiens
aacagggagactgcatctcaaa

SEQ ID NO: 3464649 - DNA, 13 bp, Homo sapiens
aacagtatctctt

SEQ ID NO: 3464650 - DNA, 17 bp, Homo sapiens
aacagtcacgcctgaaa

SEQ ID NO: 3464651 - DNA, 17 bp, Homo sapiens
aacagtcttcaggcaaa

SEQ ID NO: 3464652 - DNA, 16 bp, Homo sapiens
aacagtgaagacagaa

SEQ ID NO: 3464653 - DNA, 17 bp, Homo sapiens
aacagtgaagacagaag

SEQ ID NO: 3464654 - DNA, 20 bp, Homo sapiens
aacagtgcttgccacagagc

SEQ ID NO: 3464655 - DNA, 12 bp, Homo sapiens
aacagtggggaa

SEQ ID NO: 3464656 - DNA, 16 bp, Homo sapiens
aacagtggggaagagt

SEQ ID NO: 3464657 - DNA, 14 bp, Homo sapiens
aacagttcaaagaa

SEQ ID NO: 3464658 - DNA, 20 bp, Homo sapiens
aacagttttcctatgctttg

SEQ ID NO: 3464659 - DNA, 15 bp, Homo sapiens
aacataccaacatgt

SEQ ID NO: 3464660 - DNA, 14 bp, Homo sapiens
aacatatggtctcc

SEQ ID NO: 3464661 - DNA, 18 bp, Homo sapiens
aacatcagttactctgaa

SEQ ID NO: 3464662 - DNA, 21 bp, Homo sapiens
aacatcagttactctgaaggg

SEQ ID NO: 3464663 - DNA, 14 bp, Homo sapiens
aacatcatcaaggc

SEQ ID NO: 3464664 - DNA, 22 bp, Homo sapiens
aacatcatcaaggcactgcctg

SEQ ID NO: 3464665 - DNA, 19 bp, Homo sapiens
aacatcattactataagaa

SEQ ID NO: 3464666 - DNA, 17 bp, Homo sapiens
aacatccaaccttccca

SEQ ID NO: 3464667 - DNA, 15 bp, Homo sapiens
aacatccaatatttt

SEQ ID NO: 3464668 - DNA, 20 bp, Homo sapiens
aacatgaccctaaatcttga

SEQ ID NO: 3464669 - DNA, 15 bp, Homo sapiens
aacatgatgggcctg

SEQ ID NO: 3464670 - DNA, 13 bp, Homo sapiens
aacatgcagtttg

SEQ ID NO: 3464671 - DNA, 22 bp, Homo sapiens
aacatgcagtttgaaattctga

SEQ ID NO: 3464672 - DNA, 16 bp, Homo sapiens
aacatgtggctcctcc

SEQ ID NO: 3464673 - DNA, 22 bp, Homo sapiens
aacattacagggaatgcctgag

SEQ ID NO: 3464674 - DNA, 15 bp, Homo sapiens
aacattagttgcact

SEQ ID NO: 3464675 - DNA, 13 bp, Homo sapiens
aacattccaagaa

SEQ ID NO: 3464676 - DNA, 18 bp, Homo sapiens
aacattgcctttgaatgt

SEQ ID NO: 3464677 - DNA, 15 bp, Homo sapiens
aacattgtgatgtat

SEQ ID NO: 3464678 - DNA, 15 bp, Homo sapiens
aacattgttttgtgt

SEQ ID NO: 3464679 - DNA, 14 bp, Homo sapiens
aacatttaatttag

SEQ ID NO: 3464680 - DNA, 17 bp, Homo sapiens
aacatttaatttagata

SEQ ID NO: 3464681 - DNA, 18 bp, Homo sapiens
aacatttaatttagatat

SEQ ID NO: 3464682 - DNA, 14 bp, Homo sapiens
aacatttattttga

SEQ ID NO: 3464683 - DNA, 19 bp, Homo sapiens
aacattttactgttgtaca

SEQ ID NO: 3464684 - DNA, 20 bp, Homo sapiens
aaccaaaatactccaaagat

SEQ ID NO: 3464685 - DNA, 21 bp, Homo sapiens
aaccaaaggtgaaggaatata

SEQ ID NO: 3464686 - DNA, 15 bp, Homo sapiens
aaccaaatctggaag

SEQ ID NO: 3464687 - DNA, 23 bp, Homo sapiens
aaccaatcctactaataaaccag

SEQ ID NO: 3464688 - DNA, 15 bp, Homo sapiens
aaccacacaaagaca

SEQ ID NO: 3464689 - DNA, 13 bp, Homo sapiens
aaccacagctgct

SEQ ID NO: 3464690 - DNA, 14 bp, Homo sapiens
aaccacagctgctg

SEQ ID NO: 3464691 - DNA, 20 bp, Homo sapiens
aaccacatcttgctctgctg

SEQ ID NO: 3464692 - DNA, 16 bp, Homo sapiens
aaccactgcaagtcct

SEQ ID NO: 3464693 - DNA, 22 bp, Homo sapiens
aaccactggaaagtttatggtt

SEQ ID NO: 3464694 - DNA, 20 bp, Homo sapiens
aaccagctggtctgggtgta

SEQ ID NO: 3464695 - DNA, 23 bp, Homo sapiens
aaccagtatttttgctgcttctg

SEQ ID NO: 3464696 - DNA, 14 bp, Homo sapiens
aaccataaaagaag

SEQ ID NO: 3464697 - DNA, 22 bp, Homo sapiens
aaccatccagtgacaaaccatc

SEQ ID NO: 3464698 - DNA, 19 bp, Homo sapiens
aaccatcccctccgtggca

SEQ ID NO: 3464699 - DNA, 23 bp, Homo sapiens
aaccatgaatgaacccctggctc

SEQ ID NO: 3464700 - DNA, 17 bp, Homo sapiens
aaccatgtagaaaattt

SEQ ID NO: 3464701 - DNA, 21 bp, Homo sapiens
aaccatgtcagcaaaaagcaa

SEQ ID NO: 3464702 - DNA, 23 bp, Homo sapiens
aaccatgtcagcaaaaagcaaaa

SEQ ID NO: 3464703 - DNA, 17 bp, Homo sapiens
aaccattaaccagatct

SEQ ID NO: 3464704 - DNA, 19 bp, Homo sapiens
aacccaccagcctaagaag

SEQ ID NO: 3464705 - DNA, 23 bp, Homo sapiens
aacccaccagcctaagaagctct

SEQ ID NO: 3464706 - DNA, 19 bp, Homo sapiens
aacccagtctcctctccat

SEQ ID NO: 3464707 - DNA, 15 bp, Homo sapiens
aacccatgagattca

SEQ ID NO: 3464708 - DNA, 15 bp, Homo sapiens
aacccatggctctat

SEQ ID NO: 3464709 - DNA, 21 bp, Homo sapiens
aacccatggctctatttcttc

SEQ ID NO: 3464710 - DNA, 24 bp, Homo sapiens
aacccatggctctatttcttcttc

SEQ ID NO: 3464711 - DNA, 20 bp, Homo sapiens
aacccatttgtctctacttt

SEQ ID NO: 3464712 - DNA, 12 bp, Homo sapiens
aacccccactgg

SEQ ID NO: 3464713 - DNA, 16 bp, Homo sapiens
aacccccactggactg

SEQ ID NO: 3464714 - DNA, 13 bp, Homo sapiens
aacccccagcctg

SEQ ID NO: 3464715 - DNA, 11 bp, Homo sapiens
aaccccccagc

SEQ ID NO: 3464716 - DNA, 14 bp, Homo sapiens
aaccccccagcact

SEQ ID NO: 3464717 - DNA, 20 bp, Homo sapiens
aaccccggggtgcccacagg

SEQ ID NO: 3464718 - DNA, 20 bp, Homo sapiens
aaccccttaagccctggccc

SEQ ID NO: 3464719 - DNA, 23 bp, Homo sapiens
aacccgagtcattcgttctgtgg

SEQ ID NO: 3464720 - DNA, 18 bp, Homo sapiens
aacccggtgctccctctg

SEQ ID NO: 3464721 - DNA, 13 bp, Homo sapiens
aaccctatatgct

SEQ ID NO: 3464722 - DNA, 15 bp, Homo sapiens
aaccctcagccttga

SEQ ID NO: 3464723 - DNA, 21 bp, Homo sapiens
aaccctgccatggaactgttt

SEQ ID NO: 3464724 - DNA, 19 bp, Homo sapiens
aaccctggggaaggagcca

SEQ ID NO: 3464725 - DNA, 20 bp, Homo sapiens
aaccctggggcctgactgct

SEQ ID NO: 3464726 - DNA, 19 bp, Homo sapiens
aacccttcatcttcctgtg

SEQ ID NO: 3464727 - DNA, 21 bp, Homo sapiens
aaccgcaggaagctgctccgt

SEQ ID NO: 3464728 - DNA, 16 bp, Homo sapiens
aaccgtggtatgtctg

SEQ ID NO: 3464729 - DNA, 17 bp, Homo sapiens
aaccgttttgaagctac

SEQ ID NO: 3464730 - DNA, 14 bp, Homo sapiens
aacctaaaaaagat

SEQ ID NO: 3464731 - DNA, 15 bp, Homo sapiens
aacctaaaaaagata

SEQ ID NO: 3464732 - DNA, 12 bp, Homo sapiens
aacctaggcagt

SEQ ID NO: 3464733 - DNA, 20 bp, Homo sapiens
aacctaggcagtgggaggca

SEQ ID NO: 3464734 - DNA, 15 bp, Homo sapiens
aacctattttgaagt

SEQ ID NO: 3464735 - DNA, 14 bp, Homo sapiens
aacctcagcctggc

SEQ ID NO: 3464736 - DNA, 16 bp, Homo sapiens
aacctcatcttcttca

SEQ ID NO: 3464737 - DNA, 16 bp, Homo sapiens
aacctccccagcctgc

SEQ ID NO: 3464738 - DNA, 23 bp, Homo sapiens
aacctccccagcctgcgcctgct

SEQ ID NO: 3464739 - DNA, 17 bp, Homo sapiens
aacctccgcctcttggg

SEQ ID NO: 3464740 - DNA, 12 bp, Homo sapiens
aacctcctctgt

SEQ ID NO: 3464741 - DNA, 13 bp, Homo sapiens
aacctcctctgtg

SEQ ID NO: 3464742 - DNA, 17 bp, Homo sapiens
aacctcgagtactgtgg

SEQ ID NO: 3464743 - DNA, 14 bp, Homo sapiens
aacctcgccctctc

SEQ ID NO: 3464744 - DNA, 14 bp, Homo sapiens
aacctcgctggact

SEQ ID NO: 3464745 - DNA, 14 bp, Homo sapiens
aacctctctatttt

SEQ ID NO: 3464746 - DNA, 18 bp, Homo sapiens
aacctctgttcagtgtaa

SEQ ID NO: 3464747 - DNA, 17 bp, Homo sapiens
aacctgacgtagctgca

SEQ ID NO: 3464748 - DNA, 17 bp, Homo sapiens
aacctgatgcagtcacg

SEQ ID NO: 3464749 - DNA, 14 bp, Homo sapiens
aacctgcaaaaaat

SEQ ID NO: 3464750 - DNA, 12 bp, Homo sapiens
aacctggggggc

SEQ ID NO: 3464751 - DNA, 23 bp, Homo sapiens
aacctgtttctacctatatgcag

SEQ ID NO: 3464752 - DNA, 19 bp, Homo sapiens
aacctgtttttttttcatt

SEQ ID NO: 3464753 - DNA, 16 bp, Homo sapiens
aggcttgcctgcaggc

SEQ ID NO: 3464754 - DNA, 19 bp, Homo sapiens
aggcttgtcactagcagct

SEQ ID NO: 3464755 - DNA, 15 bp, Homo sapiens
aggcttgttgtgctt

SEQ ID NO: 3464756 - DNA, 22 bp, Homo sapiens
aggctttgggagagcaggaatg

SEQ ID NO: 3464757 - DNA, 19 bp, Homo sapiens
agggaaaaaaaacaggagg

SEQ ID NO: 3464758 - DNA, 17 bp, Homo sapiens
agggaaaaggggctcct

SEQ ID NO: 3464759 - DNA, 12 bp, Homo sapiens
agggaaagaaaa

SEQ ID NO: 3464760 - DNA, 14 bp, Homo sapiens
agggaaatgaaaga

SEQ ID NO: 3464761 - DNA, 22 bp, Homo sapiens
agggaagtaacagtaacgcagg

SEQ ID NO: 3464762 - DNA, 15 bp, Homo sapiens
agggaatcctcctcc

SEQ ID NO: 3464763 - DNA, 16 bp, Homo sapiens
agggaatcctcctcca

SEQ ID NO: 3464764 - DNA, 21 bp, Homo sapiens
agggacacctgggagaaatct

SEQ ID NO: 3464765 - DNA, 20 bp, Homo sapiens
agggacagaggccccagcct

SEQ ID NO: 3464766 - DNA, 17 bp, Homo sapiens
agggacaggagaagaga

SEQ ID NO: 3464767 - DNA, 15 bp, Homo sapiens
agggacccctgccct

SEQ ID NO: 3464768 - DNA, 23 bp, Homo sapiens
agggacccctgcccttgtcccac

SEQ ID NO: 3464769 - DNA, 13 bp, Homo sapiens
agggacctctccc

SEQ ID NO: 3464770 - DNA, 15 bp, Homo sapiens
agggacgcctggggg

SEQ ID NO: 3464771 - DNA, 18 bp, Homo sapiens
agggacgcctgggggtgc

SEQ ID NO: 3464772 - DNA, 21 bp, Homo sapiens
agggagacctggacacaggcc

SEQ ID NO: 3464773 - DNA, 21 bp, Homo sapiens
agggagacgccgggctagagc

SEQ ID NO: 3464774 - DNA, 15 bp, Homo sapiens
agggagcattttcct

SEQ ID NO: 3464775 - DNA, 16 bp, Homo sapiens
agggagccatgtttca

SEQ ID NO: 3464776 - DNA, 17 bp, Homo sapiens
agggagcccctttgatg

SEQ ID NO: 3464777 - DNA, 14 bp, Homo sapiens
agggagcggaaagc

SEQ ID NO: 3464778 - DNA, 23 bp, Homo sapiens
agggagctagccagaggactgtg

SEQ ID NO: 3464779 - DNA, 14 bp, Homo sapiens
agggaggagtggag

SEQ ID NO: 3464780 - DNA, 16 bp, Homo sapiens
agggaggcaagccctg

SEQ ID NO: 3464781 - DNA, 15 bp, Homo sapiens
agggagggcttctgc

SEQ ID NO: 3464782 - DNA, 19 bp, Homo sapiens
agggaggggcctaggcctc

SEQ ID NO: 3464783 - DNA, 15 bp, Homo sapiens
agggatccctcatct

SEQ ID NO: 3464784 - DNA, 21 bp, Homo sapiens
agggatgagcatggagctggc

SEQ ID NO: 3464785 - DNA, 18 bp, Homo sapiens
agggatgattcaagccat

SEQ ID NO: 3464786 - DNA, 19 bp, Homo sapiens
agggatgattcaagccatt

SEQ ID NO: 3464787 - DNA, 19 bp, Homo sapiens
agggatgccctggaggtgg

SEQ ID NO: 3464788 - DNA, 13 bp, Homo sapiens
agggatggtgccc

SEQ ID NO: 3464789 - DNA, 18 bp, Homo sapiens
agggattcacatctgcat

SEQ ID NO: 3464790 - DNA, 19 bp, Homo sapiens
agggattttagtcacacgt

SEQ ID NO: 3464791 - DNA, 20 bp, Homo sapiens
agggcaagctccgcaggact

SEQ ID NO: 3464792 - DNA, 21 bp, Homo sapiens
agggcaagctccgcaggactt

SEQ ID NO: 3464793 - DNA, 16 bp, Homo sapiens
agggcacaaagatggg

SEQ ID NO: 3464794 - DNA, 14 bp, Homo sapiens
agggcacacactgt

SEQ ID NO: 3464795 - DNA, 20 bp, Homo sapiens
agggcacaccgggcactcag

SEQ ID NO: 3464796 - DNA, 20 bp, Homo sapiens
agggcacattccttgcctgc

SEQ ID NO: 3464797 - DNA, 21 bp, Homo sapiens
agggcacattccttgcctgca

SEQ ID NO: 3464798 - DNA, 19 bp, Homo sapiens
agggcaccaggggtttctc

SEQ ID NO: 3464799 - DNA, 14 bp, Homo sapiens
agggcagaatgaat

SEQ ID NO: 3464800 - DNA, 17 bp, Homo sapiens
agggcagagtcacacgg

SEQ ID NO: 3464801 - DNA, 12 bp, Homo sapiens
agggcagagtga

SEQ ID NO: 3464802 - DNA, 14 bp, Homo sapiens
agggcagcgccagg

SEQ ID NO: 3464803 - DNA, 11 bp, Homo sapiens
agggcaggtgg

SEQ ID NO: 3464804 - DNA, 15 bp, Homo sapiens
agggcaggtggggtg

SEQ ID NO: 3464805 - DNA, 20 bp, Homo sapiens
agggcagtcgatagagctgt

SEQ ID NO: 3464806 - DNA, 13 bp, Homo sapiens
agggcagttttct

SEQ ID NO: 3464807 - DNA, 17 bp, Homo sapiens
agggccaacccttctcc

SEQ ID NO: 3464808 - DNA, 20 bp, Homo sapiens
agggccacatgggaggctca

SEQ ID NO: 3464809 - DNA, 21 bp, Homo sapiens
agggccacatgggaggctcac

SEQ ID NO: 3464810 - DNA, 13 bp, Homo sapiens
agggccagacaga

SEQ ID NO: 3464811 - DNA, 18 bp, Homo sapiens
agggccagacagaccttc

SEQ ID NO: 3464812 - DNA, 16 bp, Homo sapiens
agggccagagccaggg

SEQ ID NO: 3464813 - DNA, 12 bp, Homo sapiens
agggcccagaga

SEQ ID NO: 3464814 - DNA, 13 bp, Homo sapiens
agggcccagagcc

SEQ ID NO: 3464815 - DNA, 17 bp, Homo sapiens
agggcccagagcccagc

SEQ ID NO: 3464816 - DNA, 18 bp, Homo sapiens
agggcccagagcccagct

SEQ ID NO: 3464817 - DNA, 20 bp, Homo sapiens
agggcccagagcccagctcc

SEQ ID NO: 3464818 - DNA, 21 bp, Homo sapiens
agggcccagagcccagctcca

SEQ ID NO: 3464819 - DNA, 13 bp, Homo sapiens
agggcccccacag

SEQ ID NO: 3464820 - DNA, 14 bp, Homo sapiens
agggcccccacagg

SEQ ID NO: 3464821 - DNA, 22 bp, Homo sapiens
agggcctgagcctggccagcct

SEQ ID NO: 3464822 - DNA, 16 bp, Homo sapiens
agggcctgctggaggc

SEQ ID NO: 3464823 - DNA, 22 bp, Homo sapiens
agggcctgctggaggcctcagg

SEQ ID NO: 3464824 - DNA, 19 bp, Homo sapiens
agggcctggaagacagaga

SEQ ID NO: 3464825 - DNA, 15 bp, Homo sapiens
agggcgcaaagggca

SEQ ID NO: 3464826 - DNA, 16 bp, Homo sapiens
agggcggcaggggcct

SEQ ID NO: 3464827 - DNA, 18 bp, Homo sapiens
agggcggcaggggcctgg

SEQ ID NO: 3464828 - DNA, 19 bp, Homo sapiens
agggcggcaggggcctgga

SEQ ID NO: 3464829 - DNA, 19 bp, Homo sapiens
agggcgggcagagggctgg

SEQ ID NO: 3464830 - DNA, 21 bp, Homo sapiens
agggctaccctgagctgaggc

SEQ ID NO: 3464831 - DNA, 19 bp, Homo sapiens
agggctatggtgtggactg

SEQ ID NO: 3464832 - DNA, 11 bp, Homo sapiens
agggctcctgc

SEQ ID NO: 3464833 - DNA, 17 bp, Homo sapiens
agggctgaaccctcagc

SEQ ID NO: 3464834 - DNA, 12 bp, Homo sapiens
agggctgcatga

SEQ ID NO: 3464835 - DNA, 15 bp, Homo sapiens
agggctggactgagg

SEQ ID NO: 3464836 - DNA, 18 bp, Homo sapiens
agggctggactgaggcct

SEQ ID NO: 3464837 - DNA, 13 bp, Homo sapiens
agggctggctggc

SEQ ID NO: 3464838 - DNA, 17 bp, Homo sapiens
agggctggctggcctca

SEQ ID NO: 3464839 - DNA, 20 bp, Homo sapiens
agggctggctggcctcaccc

SEQ ID NO: 3464840 - DNA, 20 bp, Homo sapiens
agggctgtcatctgtgcact

SEQ ID NO: 3464841 - DNA, 21 bp, Homo sapiens
agggctgtgcttgaaggccct

SEQ ID NO: 3464842 - DNA, 22 bp, Homo sapiens
agggctgtgcttgaaggccctg

SEQ ID NO: 3464843 - DNA, 23 bp, Homo sapiens
agggctgtgcttgaaggccctgc

SEQ ID NO: 3464844 - DNA, 13 bp, Homo sapiens
agggcttcctctt

SEQ ID NO: 3464845 - DNA, 15 bp, Homo sapiens
aggggaatcagaact

SEQ ID NO: 3464846 - DNA, 19 bp, Homo sapiens
aggggaatgtttgcctctg

SEQ ID NO: 3464847 - DNA, 15 bp, Homo sapiens
aggggacaaggaagg

SEQ ID NO: 3464848 - DNA, 14 bp, Homo sapiens
aggggacccccgcc

SEQ ID NO: 3464849 - DNA, 21 bp, Homo sapiens
aggggactaattcactggcga

SEQ ID NO: 3464850 - DNA, 18 bp, Homo sapiens
aggggagggggatccgac

SEQ ID NO: 3464851 - DNA, 18 bp, Homo sapiens
aggggatggagtgagccc

SEQ ID NO: 3464852 - DNA, 14 bp, Homo sapiens
aggggatgggaggt

SEQ ID NO: 3464853 - DNA, 13 bp, Homo sapiens
aggggccagaggc

SEQ ID NO: 3464854 - DNA, 14 bp, Homo sapiens
aggggccagaggct

SEQ ID NO: 3464855 - DNA, 22 bp, Homo sapiens
aggggcccccctgccctgtggg

SEQ ID NO: 3464856 - DNA, 19 bp, Homo sapiens
aggggcccggccagccatg

SEQ ID NO: 3464857 - DNA, 21 bp, Homo sapiens
aggggcccggccagccatgtc

SEQ ID NO: 3464858 - DNA, 16 bp, Homo sapiens
aggggcctaggcctca

SEQ ID NO: 3464859 - DNA, 18 bp, Homo sapiens
aggggcctggagatcctc

SEQ ID NO: 3464860 - DNA, 22 bp, Homo sapiens
aggggcctggagatcctcctgc

SEQ ID NO: 3464861 - DNA, 21 bp, Homo sapiens
aggggcgtctgttcccccttc

SEQ ID NO: 3464862 - DNA, 15 bp, Homo sapiens
aggggctcagttctg

SEQ ID NO: 3464863 - DNA, 15 bp, Homo sapiens
aggggctgcttcctc

SEQ ID NO: 3464864 - DNA, 12 bp, Homo sapiens
aggggcttcagg

SEQ ID NO: 3464865 - DNA, 15 bp, Homo sapiens
aggggcttcaggtcc

SEQ ID NO: 3464866 - DNA, 16 bp, Homo sapiens
agggggcaaatgagcc

SEQ ID NO: 3464867 - DNA, 21 bp, Homo sapiens
agggggctcttttactgggtt

SEQ ID NO: 3464868 - DNA, 19 bp, Homo sapiens
agggggggaaatgcattta

SEQ ID NO: 3464869 - DNA, 21 bp, Homo sapiens
aggggtcgacttcgggctggc

SEQ ID NO: 3464870 - DNA, 21 bp, Homo sapiens
aggggtctgggagtcaggccc

SEQ ID NO: 3464871 - DNA, 23 bp, Homo sapiens
aggggtctgggagtcaggcccgg

SEQ ID NO: 3464872 - DNA, 20 bp, Homo sapiens
aggggtggctgcctcattta

SEQ ID NO: 3464873 - DNA, 14 bp, Homo sapiens
aggggtgtcttggg

SEQ ID NO: 3464874 - DNA, 24 bp, Homo sapiens
aggggtgtcttgggcagagctggc

SEQ ID NO: 3464875 - DNA, 21 bp, Homo sapiens
agggtatcaggtgctgccatc

SEQ ID NO: 3464876 - DNA, 19 bp, Homo sapiens
agggtcagaaacaggaccg

SEQ ID NO: 3464877 - DNA, 21 bp, Homo sapiens
agggtcagacgcctgaggaac

SEQ ID NO: 3464878 - DNA, 23 bp, Homo sapiens
agggtccacaggaagtgaagaat

SEQ ID NO: 3464879 - DNA, 12 bp, Homo sapiens
agggtccctctg

SEQ ID NO: 3464880 - DNA, 18 bp, Homo sapiens
agggtccctctgtgtatt

SEQ ID NO: 3464881 - DNA, 18 bp, Homo sapiens
agggtcctctacttcagg

SEQ ID NO: 3464882 - DNA, 23 bp, Homo sapiens
agggtctcactatgttgcccagg

SEQ ID NO: 3464883 - DNA, 13 bp, Homo sapiens
agggtctgcctcc

SEQ ID NO: 3464884 - DNA, 15 bp, Homo sapiens
agggtctgcctccag

SEQ ID NO: 3464885 - DNA, 16 bp, Homo sapiens
agggtctgcctccagc

SEQ ID NO: 3464886 - DNA, 17 bp, Homo sapiens
agggtctgtttggactg

SEQ ID NO: 3464887 - DNA, 23 bp, Homo sapiens
agggtgattttatgatcagtgtt

SEQ ID NO: 3464888 - DNA, 24 bp, Homo sapiens
agggtgcccttttccagcctcagc

SEQ ID NO: 3464889 - DNA, 18 bp, Homo sapiens
agctgcaccctcaggcag

SEQ ID NO: 3464890 - DNA, 22 bp, Homo sapiens
agctgcaccctcaggcaggtgg

SEQ ID NO: 3464891 - DNA, 11 bp, Homo sapiens
agctgcactga

SEQ ID NO: 3464892 - DNA, 17 bp, Homo sapiens
agctgcactgatgctgc

SEQ ID NO: 3464893 - DNA, 19 bp, Homo sapiens
agctgcactgatgctgccc

SEQ ID NO: 3464894 - DNA, 14 bp, Homo sapiens
agctgccccagcca

SEQ ID NO: 3464895 - DNA, 16 bp, Homo sapiens
agctgccccagccaga

SEQ ID NO: 3464896 - DNA, 16 bp, Homo sapiens
agctgcccctctctgg

SEQ ID NO: 3464897 - DNA, 10 bp, Homo sapiens
agctgcctgt

SEQ ID NO: 3464898 - DNA, 13 bp, Homo sapiens
agctgcctgttca

SEQ ID NO: 3464899 - DNA, 18 bp, Homo sapiens
agctgcctgttcagctcc

SEQ ID NO: 3464900 - DNA, 19 bp, Homo sapiens
agctgcctgttcagctcca

SEQ ID NO: 3464901 - DNA, 21 bp, Homo sapiens
agctgcctgttcagctccagc

SEQ ID NO: 3464902 - DNA, 22 bp, Homo sapiens
agctgcctgttcagctccagct

SEQ ID NO: 3464903 - DNA, 18 bp, Homo sapiens
agctgccttagcttcagg

SEQ ID NO: 3464904 - DNA, 21 bp, Homo sapiens
agctgcggtccacccaggagc

SEQ ID NO: 3464905 - DNA, 14 bp, Homo sapiens
agctgctaccttct

SEQ ID NO: 3464906 - DNA, 15 bp, Homo sapiens
agctgctatagcctg

SEQ ID NO: 3464907 - DNA, 17 bp, Homo sapiens
agctgctcctagaggga

SEQ ID NO: 3464908 - DNA, 20 bp, Homo sapiens
agctgctcctagagggaggg

SEQ ID NO: 3464909 - DNA, 15 bp, Homo sapiens
agctgctctgagcca

SEQ ID NO: 3464910 - DNA, 18 bp, Homo sapiens
agctgctctgagccacag

SEQ ID NO: 3464911 - DNA, 13 bp, Homo sapiens
agctgctgacagt

SEQ ID NO: 3464912 - DNA, 14 bp, Homo sapiens
agctgctgtctcta

SEQ ID NO: 3464913 - DNA, 16 bp, Homo sapiens
agctggagcccgtgcc

SEQ ID NO: 3464914 - DNA, 14 bp, Homo sapiens
agctggatgagaat

SEQ ID NO: 3464915 - DNA, 16 bp, Homo sapiens
agctggcagcagagtg

SEQ ID NO: 3464916 - DNA, 18 bp, Homo sapiens
agctggccaaagagcctt

SEQ ID NO: 3464917 - DNA, 21 bp, Homo sapiens
agctggccaaagagcctttcc

SEQ ID NO: 3464918 - DNA, 22 bp, Homo sapiens
agctggccaaagagcctttcca

SEQ ID NO: 3464919 - DNA, 15 bp, Homo sapiens
agctggccccgccgc

SEQ ID NO: 3464920 - DNA, 18 bp, Homo sapiens
agctggccccgccgcctg

SEQ ID NO: 3464921 - DNA, 19 bp, Homo sapiens
agctggccccgccgcctgg

SEQ ID NO: 3464922 - DNA, 16 bp, Homo sapiens
agctggccgtgggcct

SEQ ID NO: 3464923 - DNA, 19 bp, Homo sapiens
agctggctctgagcgcctc

SEQ ID NO: 3464924 - DNA, 13 bp, Homo sapiens
agctggctggggt

SEQ ID NO: 3464925 - DNA, 16 bp, Homo sapiens
agctgggactacaggt

SEQ ID NO: 3464926 - DNA, 20 bp, Homo sapiens
agctgggtaatcgatggggg

SEQ ID NO: 3464927 - DNA, 16 bp, Homo sapiens
agctgggtcaggcagg

SEQ ID NO: 3464928 - DNA, 19 bp, Homo sapiens
agctgggtggcactgccat

SEQ ID NO: 3464929 - DNA, 20 bp, Homo sapiens
agctgggtggcactgccatg

SEQ ID NO: 3464930 - DNA, 18 bp, Homo sapiens
agctggtcccactcagtc

SEQ ID NO: 3464931 - DNA, 17 bp, Homo sapiens
agctggtggaacatatg

SEQ ID NO: 3464932 - DNA, 22 bp, Homo sapiens
agctgtatcttgatgtttagaa

SEQ ID NO: 3464933 - DNA, 20 bp, Homo sapiens
agctgtattcatatattgca

SEQ ID NO: 3464934 - DNA, 23 bp, Homo sapiens
agctgtcccatctggtcatttgg

SEQ ID NO: 3464935 - DNA, 10 bp, Homo sapiens
agctgtgcag

SEQ ID NO: 3464936 - DNA, 12 bp, Homo sapiens
agctgtgcaggt

SEQ ID NO: 3464937 - DNA, 18 bp, Homo sapiens
agctgtgctctggacagg

SEQ ID NO: 3464938 - DNA, 19 bp, Homo sapiens
agctgtgctctggacaggc

SEQ ID NO: 3464939 - DNA, 21 bp, Homo sapiens
agctgtgctctggacaggcat

SEQ ID NO: 3464940 - DNA, 16 bp, Homo sapiens
agctgttcctgttcag

SEQ ID NO: 3464941 - DNA, 15 bp, Homo sapiens
agctgttctcattcc

SEQ ID NO: 3464942 - DNA, 15 bp, Homo sapiens
agcttaattttctgt

SEQ ID NO: 3464943 - DNA, 16 bp, Homo sapiens
agcttacacaaatcta

SEQ ID NO: 3464944 - DNA, 17 bp, Homo sapiens
agcttatctcttttata

SEQ ID NO: 3464945 - DNA, 23 bp, Homo sapiens
agcttatgtacaaaactttttaa

SEQ ID NO: 3464946 - DNA, 18 bp, Homo sapiens
agcttcaaccctcagcct

SEQ ID NO: 3464947 - DNA, 18 bp, Homo sapiens
agcttcactgtaaaataa

SEQ ID NO: 3464948 - DNA, 20 bp, Homo sapiens
agcttcatgtggcttccctt

SEQ ID NO: 3464949 - DNA, 22 bp, Homo sapiens
agcttccccaacacgcaggagc

SEQ ID NO: 3464950 - DNA, 17 bp, Homo sapiens
agcttcccctctctcct

SEQ ID NO: 3464951 - DNA, 22 bp, Homo sapiens
agcttctagaggctcatggccc

SEQ ID NO: 3464952 - DNA, 23 bp, Homo sapiens
agcttctagaggctcatggccct

SEQ ID NO: 3464953 - DNA, 16 bp, Homo sapiens
agcttctcctgtgtga

SEQ ID NO: 3464954 - DNA, 21 bp, Homo sapiens
agcttctcctgtgtgattgac

SEQ ID NO: 3464955 - DNA, 14 bp, Homo sapiens
agcttctctgtgaa

SEQ ID NO: 3464956 - DNA, 13 bp, Homo sapiens
agcttgcaagaag

SEQ ID NO: 3464957 - DNA, 16 bp, Homo sapiens
agcttgccagatgctg

SEQ ID NO: 3464958 - DNA, 15 bp, Homo sapiens
agcttgctgtcactt

SEQ ID NO: 3464959 - DNA, 20 bp, Homo sapiens
agcttgctgtcacttcttca

SEQ ID NO: 3464960 - DNA, 23 bp, Homo sapiens
agcttgctgtcacttcttcacct

SEQ ID NO: 3464961 - DNA, 14 bp, Homo sapiens
agcttggacatcag

SEQ ID NO: 3464962 - DNA, 20 bp, Homo sapiens
agcttgggaaaggtggtgtt

SEQ ID NO: 3464963 - DNA, 17 bp, Homo sapiens
agcttggggcaacattg

SEQ ID NO: 3464964 - DNA, 15 bp, Homo sapiens
agctttaaaagaaaa

SEQ ID NO: 3464965 - DNA, 15 bp, Homo sapiens
agctttactgtttgt

SEQ ID NO: 3464966 - DNA, 15 bp, Homo sapiens
agctttcaattccgt

SEQ ID NO: 3464967 - DNA, 13 bp, Homo sapiens
agctttctgccac

SEQ ID NO: 3464968 - DNA, 19 bp, Homo sapiens
agctttgaaaattcagtgg

SEQ ID NO: 3464969 - DNA, 19 bp, Homo sapiens
agctttgtttcaaccaagt

SEQ ID NO: 3464970 - DNA, 21 bp, Homo sapiens
agctttgtttgttgtcagctg

SEQ ID NO: 3464971 - DNA, 22 bp, Homo sapiens
agctttgtttgttgtcagctga

SEQ ID NO: 3464972 - DNA, 12 bp, Homo sapiens
agcttttcacct

SEQ ID NO: 3464973 - DNA, 22 bp, Homo sapiens
agcttttcacctttactttaga

SEQ ID NO: 3464974 - DNA, 18 bp, Homo sapiens
agcttttgaataaaaact

SEQ ID NO: 3464975 - DNA, 22 bp, Homo sapiens
aggaaaaaaatcgtccagggag

SEQ ID NO: 3464976 - DNA, 14 bp, Homo sapiens
aggaaaaatattta

SEQ ID NO: 3464977 - DNA, 14 bp, Homo sapiens
aggaaaagcacaag

SEQ ID NO: 3464978 - DNA, 18 bp, Homo sapiens
aggaaaaggtgatatcca

SEQ ID NO: 3464979 - DNA, 22 bp, Homo sapiens
aggaaaataatgtaattgtaat

SEQ ID NO: 3464980 - DNA, 15 bp, Homo sapiens
aggaaacaacagctt

SEQ ID NO: 3464981 - DNA, 16 bp, Homo sapiens
aggaaaccacagctgc

SEQ ID NO: 3464982 - DNA, 17 bp, Homo sapiens
aggaaataacagagaga

SEQ ID NO: 3464983 - DNA, 19 bp, Homo sapiens
aggaaataacagagagaat

SEQ ID NO: 3464984 - DNA, 23 bp, Homo sapiens
aggaaatgtcacagaagcagcta

SEQ ID NO: 3464985 - DNA, 23 bp, Homo sapiens
aggaaattgtacataagtacctc

SEQ ID NO: 3464986 - DNA, 18 bp, Homo sapiens
aggaacctcgagtactgt

SEQ ID NO: 3464987 - DNA, 20 bp, Homo sapiens
aggaacggtaaatttctgtg

SEQ ID NO: 3464988 - DNA, 21 bp, Homo sapiens
aggaagaacaccctctaaatg

SEQ ID NO: 3464989 - DNA, 18 bp, Homo sapiens
aggaagaacggggctctt

SEQ ID NO: 3464990 - DNA, 16 bp, Homo sapiens
aggaagaacgtttttt

SEQ ID NO: 3464991 - DNA, 21 bp, Homo sapiens
aggaagacatctgtagggaat

SEQ ID NO: 3464992 - DNA, 21 bp, Homo sapiens
aggaagatctctgcagggccg

SEQ ID NO: 3464993 - DNA, 20 bp, Homo sapiens
aggaagccgtgccctgcccc

SEQ ID NO: 3464994 - DNA, 21 bp, Homo sapiens
aggaagccgtgccctgccccc

SEQ ID NO: 3464995 - DNA, 17 bp, Homo sapiens
aggaagctgctccgtgc

SEQ ID NO: 3464996 - DNA, 22 bp, Homo sapiens
aggaagctttggtgagaacctg

SEQ ID NO: 3464997 - DNA, 20 bp, Homo sapiens
aggaaggctcttctccccag

SEQ ID NO: 3464998 - DNA, 21 bp, Homo sapiens
aggaaggctcttctccccaga

SEQ ID NO: 3464999 - DNA, 22 bp, Homo sapiens
aggaaggcttgttgtgctttta

SEQ ID NO: 3465000 - DNA, 16 bp, Homo sapiens
aggaaggggccagagg

SEQ ID NO: 3465001 - DNA, 18 bp, Homo sapiens
aggaagtcaaagcaagga

SEQ ID NO: 3465002 - DNA, 21 bp, Homo sapiens
aggaagtgttgaagggaggtg

SEQ ID NO: 3465003 - DNA, 22 bp, Homo sapiens
aggaataaagtttttttcctta

SEQ ID NO: 3465004 - DNA, 23 bp, Homo sapiens
aggaataatgggcttagagcagt

SEQ ID NO: 3465005 - DNA, 20 bp, Homo sapiens
aggaatattttccaaagagt

SEQ ID NO: 3465006 - DNA, 22 bp, Homo sapiens
aggaatcagcaagaagatccta

SEQ ID NO: 3465007 - DNA, 17 bp, Homo sapiens
aggaatccactcccagg

SEQ ID NO: 3465008 - DNA, 23 bp, Homo sapiens
aggaatccagacccggctgcgtg

SEQ ID NO: 3465009 - DNA, 14 bp, Homo sapiens
aggaatctcagaga

SEQ ID NO: 3465010 - DNA, 15 bp, Homo sapiens
aggaatctcagagac

SEQ ID NO: 3465011 - DNA, 19 bp, Homo sapiens
aggaatctgtgggtctggg

SEQ ID NO: 3465012 - DNA, 22 bp, Homo sapiens
aggaatctgtgggtctgggagt

SEQ ID NO: 3465013 - DNA, 12 bp, Homo sapiens
aggaatggacag

SEQ ID NO: 3465014 - DNA, 11 bp, Homo sapiens
aggaatttaaa

SEQ ID NO: 3465015 - DNA, 21 bp, Homo sapiens
aggaatttcccaggaccctga

SEQ ID NO: 3465016 - DNA, 13 bp, Homo sapiens
aggacacagtcag

SEQ ID NO: 3465017 - DNA, 17 bp, Homo sapiens
aggacacctggccgcct

SEQ ID NO: 3465018 - DNA, 19 bp, Homo sapiens
aggacactaaccacgctgg

SEQ ID NO: 3465019 - DNA, 16 bp, Homo sapiens
aggacactggggtctg

SEQ ID NO: 3465020 - DNA, 17 bp, Homo sapiens
aggacactggggtctgt

SEQ ID NO: 3465021 - DNA, 19 bp, Homo sapiens
aggacagatccagggactg

SEQ ID NO: 3465022 - DNA, 20 bp, Homo sapiens
aggacataatggggtcctgg

SEQ ID NO: 3465023 - DNA, 20 bp, Homo sapiens
aggacatccccccgccaaaa

SEQ ID NO: 3465024 - DNA, 16 bp, Homo sapiens
agggtggtgacctctg

SEQ ID NO: 3465025 - DNA, 18 bp, Homo sapiens
agggtggtgacctctgcc

SEQ ID NO: 3465026 - DNA, 17 bp, Homo sapiens
agggtgtatctagctct

SEQ ID NO: 3465027 - DNA, 17 bp, Homo sapiens
agggtgtggcatttgga

SEQ ID NO: 3465028 - DNA, 15 bp, Homo sapiens
agggttaaggcctga

SEQ ID NO: 3465029 - DNA, 16 bp, Homo sapiens
agggttaaggcctgaa

SEQ ID NO: 3465030 - DNA, 16 bp, Homo sapiens
agggttgaccccagag

SEQ ID NO: 3465031 - DNA, 17 bp, Homo sapiens
agggttgaccccagagg

SEQ ID NO: 3465032 - DNA, 13 bp, Homo sapiens
agggttggcccct

SEQ ID NO: 3465033 - DNA, 14 bp, Homo sapiens
agggttggcccctg

SEQ ID NO: 3465034 - DNA, 17 bp, Homo sapiens
agggttggcccctgccc

SEQ ID NO: 3465035 - DNA, 17 bp, Homo sapiens
agggttgggctggtgtc

SEQ ID NO: 3465036 - DNA, 20 bp, Homo sapiens
agggtttggctgtgtctaaa

SEQ ID NO: 3465037 - DNA, 14 bp, Homo sapiens
agggtttttagaga

SEQ ID NO: 3465038 - DNA, 17 bp, Homo sapiens
agggtttttagagaatg

SEQ ID NO: 3465039 - DNA, 13 bp, Homo sapiens
aggtaaaacaaaa

SEQ ID NO: 3465040 - DNA, 20 bp, Homo sapiens
aggtaaaagcatcacatgaa

SEQ ID NO: 3465041 - DNA, 13 bp, Homo sapiens
aggtaaaatgcca

SEQ ID NO: 3465042 - DNA, 15 bp, Homo sapiens
aggtaaaatgccatg

SEQ ID NO: 3465043 - DNA, 21 bp, Homo sapiens
aggtaatccaagatattttaa

SEQ ID NO: 3465044 - DNA, 16 bp, Homo sapiens
aggtaatttcttgtgc

SEQ ID NO: 3465045 - DNA, 22 bp, Homo sapiens
aggtacagcaacaggaatctca

SEQ ID NO: 3465046 - DNA, 23 bp, Homo sapiens
aggtacccaatagctgcccattt

SEQ ID NO: 3465047 - DNA, 22 bp, Homo sapiens
aggtaccttgacctttgtacag

SEQ ID NO: 3465048 - DNA, 15 bp, Homo sapiens
aggtactaaatacct

SEQ ID NO: 3465049 - DNA, 14 bp, Homo sapiens
aggtagctgcccct

SEQ ID NO: 3465050 - DNA, 19 bp, Homo sapiens
aggtagctgcccctggctc

SEQ ID NO: 3465051 - DNA, 15 bp, Homo sapiens
aggtagggtttaatc

SEQ ID NO: 3465052 - DNA, 13 bp, Homo sapiens
aggtatgggctgg

SEQ ID NO: 3465053 - DNA, 17 bp, Homo sapiens
aggtatgggctgggggc

SEQ ID NO: 3465054 - DNA, 14 bp, Homo sapiens
aggtcagagcctgc

SEQ ID NO: 3465055 - DNA, 18 bp, Homo sapiens
aggtcagagcctgcagtt

SEQ ID NO: 3465056 - DNA, 16 bp, Homo sapiens
aggtcaggagttccta

SEQ ID NO: 3465057 - DNA, 13 bp, Homo sapiens
aggtccagctctg

SEQ ID NO: 3465058 - DNA, 15 bp, Homo sapiens
aggtccagctctgga

SEQ ID NO: 3465059 - DNA, 17 bp, Homo sapiens
aggtccagctctggagg

SEQ ID NO: 3465060 - DNA, 16 bp, Homo sapiens
aggtcccccaagcatg

SEQ ID NO: 3465061 - DNA, 18 bp, Homo sapiens
aggtcctcccctctcttg

SEQ ID NO: 3465062 - DNA, 14 bp, Homo sapiens
aggtcctctgtcag

SEQ ID NO: 3465063 - DNA, 21 bp, Homo sapiens
aggtcctgaaagtaactcata

SEQ ID NO: 3465064 - DNA, 20 bp, Homo sapiens
aggtctctccactgctctca

SEQ ID NO: 3465065 - DNA, 21 bp, Homo sapiens
aggtctctgttgactggctgt

SEQ ID NO: 3465066 - DNA, 16 bp, Homo sapiens
aggtcttgaactcctg

SEQ ID NO: 3465067 - DNA, 21 bp, Homo sapiens
aggtcttgaactcctggcctc

SEQ ID NO: 3465068 - DNA, 20 bp, Homo sapiens
aggtctttgtaagaactaaa

SEQ ID NO: 3465069 - DNA, 23 bp, Homo sapiens
aggtctttgtaagaactaaagaa

SEQ ID NO: 3465070 - DNA, 22 bp, Homo sapiens
aggtgaacagtcacgcctgaaa

SEQ ID NO: 3465071 - DNA, 13 bp, Homo sapiens
aggtgacagagtg

SEQ ID NO: 3465072 - DNA, 18 bp, Homo sapiens
aggtgatatatttaaaaa

SEQ ID NO: 3465073 - DNA, 22 bp, Homo sapiens
aggtgatatccattctttctga

SEQ ID NO: 3465074 - DNA, 22 bp, Homo sapiens
aggtgcaacaaggtcctctgtc

SEQ ID NO: 3465075 - DNA, 14 bp, Homo sapiens
aggtgcagccagag

SEQ ID NO: 3465076 - DNA, 16 bp, Homo sapiens
aggtgcagccagaggc

SEQ ID NO: 3465077 - DNA, 13 bp, Homo sapiens
aggtgcagctcct

SEQ ID NO: 3465078 - DNA, 17 bp, Homo sapiens
aggtgccatggaagagg

SEQ ID NO: 3465079 - DNA, 21 bp, Homo sapiens
aggtgccatggaagaggctac

SEQ ID NO: 3465080 - DNA, 19 bp, Homo sapiens
aggtgcccttggaggccag

SEQ ID NO: 3465081 - DNA, 22 bp, Homo sapiens
aggtgcccttggaggccagcca

SEQ ID NO: 3465082 - DNA, 12 bp, Homo sapiens
aggtgcctgcca

SEQ ID NO: 3465083 - DNA, 17 bp, Homo sapiens
aggtgcctgccatagcc

SEQ ID NO: 3465084 - DNA, 22 bp, Homo sapiens
aggtgcctgccatagccaggag

SEQ ID NO: 3465085 - DNA, 13 bp, Homo sapiens
aggtgccttcttc

SEQ ID NO: 3465086 - DNA, 17 bp, Homo sapiens
aggtgccttcttcaggg

SEQ ID NO: 3465087 - DNA, 20 bp, Homo sapiens
aggtgccttcttcagggcct

SEQ ID NO: 3465088 - DNA, 21 bp, Homo sapiens
aggtgccttcttcagggcctg

SEQ ID NO: 3465089 - DNA, 15 bp, Homo sapiens
aggtgcctttcaaat

SEQ ID NO: 3465090 - DNA, 21 bp, Homo sapiens
aggtgctacacccttttccag

SEQ ID NO: 3465091 - DNA, 17 bp, Homo sapiens
aggtgctcccctgacag

SEQ ID NO: 3465092 - DNA, 20 bp, Homo sapiens
aggtgctggagcactgggct

SEQ ID NO: 3465093 - DNA, 13 bp, Homo sapiens
aggtggaaaaact

SEQ ID NO: 3465094 - DNA, 21 bp, Homo sapiens
aggtggaaaaactgagacagg

SEQ ID NO: 3465095 - DNA, 19 bp, Homo sapiens
aggtggaaggaccctgtgc

SEQ ID NO: 3465096 - DNA, 16 bp, Homo sapiens
aggtggactggaaggg

SEQ ID NO: 3465097 - DNA, 14 bp, Homo sapiens
aggtggcaaggctg

SEQ ID NO: 3465098 - DNA, 16 bp, Homo sapiens
aggtggcaaggctgtg

SEQ ID NO: 3465099 - DNA, 14 bp, Homo sapiens
aggtggctgagccc

SEQ ID NO: 3465100 - DNA, 15 bp, Homo sapiens
aggtggctgagcccc

SEQ ID NO: 3465101 - DNA, 19 bp, Homo sapiens
aggtggctgagcccctgtc

SEQ ID NO: 3465102 - DNA, 22 bp, Homo sapiens
aggtgggctgggccctctcttc

SEQ ID NO: 3465103 - DNA, 17 bp, Homo sapiens
aggtggggacagggatg

SEQ ID NO: 3465104 - DNA, 19 bp, Homo sapiens
aggtggggagactgggctg

SEQ ID NO: 3465105 - DNA, 21 bp, Homo sapiens
aggtggggagactgggctgag

SEQ ID NO: 3465106 - DNA, 15 bp, Homo sapiens
aggtgggggttgctg

SEQ ID NO: 3465107 - DNA, 15 bp, Homo sapiens
aggtggggtgagaat

SEQ ID NO: 3465108 - DNA, 14 bp, Homo sapiens
aggtgggtcccggc

SEQ ID NO: 3465109 - DNA, 16 bp, Homo sapiens
aggtgggtcccggctc

SEQ ID NO: 3465110 - DNA, 13 bp, Homo sapiens
aggtggtgtttct

SEQ ID NO: 3465111 - DNA, 17 bp, Homo sapiens
aggtggttatggagagg

SEQ ID NO: 3465112 - DNA, 19 bp, Homo sapiens
aggtgtccagcattgctgg

SEQ ID NO: 3465113 - DNA, 20 bp, Homo sapiens
aggtgtccagcattgctgga

SEQ ID NO: 3465114 - DNA, 20 bp, Homo sapiens
aggtgtccctgcacttgcag

SEQ ID NO: 3465115 - DNA, 23 bp, Homo sapiens
aggtgtgaaccaccacacccagc

SEQ ID NO: 3465116 - DNA, 14 bp, Homo sapiens
aggtgtgagtcacc

SEQ ID NO: 3465117 - DNA, 20 bp, Homo sapiens
aggtgtgagtcaccaagccc

SEQ ID NO: 3465118 - DNA, 15 bp, Homo sapiens
aggtgtgctctgatc

SEQ ID NO: 3465119 - DNA, 16 bp, Homo sapiens
aggtgttactgtaatt

SEQ ID NO: 3465120 - DNA, 24 bp, Homo sapiens
aggttaaggctgaggaaaggccag

SEQ ID NO: 3465121 - DNA, 17 bp, Homo sapiens
aggttaataaagatgat

SEQ ID NO: 3465122 - DNA, 17 bp, Homo sapiens
aggttatatgaatatat

SEQ ID NO: 3465123 - DNA, 16 bp, Homo sapiens
aggttatctgtcccag

SEQ ID NO: 3465124 - DNA, 16 bp, Homo sapiens
aggttcacgtgcagct

SEQ ID NO: 3465125 - DNA, 16 bp, Homo sapiens
aggttcactaaagcag

SEQ ID NO: 3465126 - DNA, 12 bp, Homo sapiens
aggttcatggat

SEQ ID NO: 3465127 - DNA, 14 bp, Homo sapiens
aggttccattcagt

SEQ ID NO: 3465128 - DNA, 15 bp, Homo sapiens
aggttcccaagctca

SEQ ID NO: 3465129 - DNA, 18 bp, Homo sapiens
aggttccgcttggagcag

SEQ ID NO: 3465130 - DNA, 23 bp, Homo sapiens
aggttccgcttggagcagagggg

SEQ ID NO: 3465131 - DNA, 21 bp, Homo sapiens
aggttctccgttagctcctgt

SEQ ID NO: 3465132 - DNA, 22 bp, Homo sapiens
aggttctccgttagctcctgtg

SEQ ID NO: 3465133 - DNA, 14 bp, Homo sapiens
aggttctctcctcc

SEQ ID NO: 3465134 - DNA, 14 bp, Homo sapiens
aggttgaagcacca

SEQ ID NO: 3465135 - DNA, 16 bp, Homo sapiens
aggttgctgtttcaca

SEQ ID NO: 3465136 - DNA, 15 bp, Homo sapiens
aggttggagcccagg

SEQ ID NO: 3465137 - DNA, 16 bp, Homo sapiens
aggttggagcccaggg

SEQ ID NO: 3465138 - DNA, 14 bp, Homo sapiens
aggttgggatggga

SEQ ID NO: 3465139 - DNA, 14 bp, Homo sapiens
aggttggtgggggc

SEQ ID NO: 3465140 - DNA, 22 bp, Homo sapiens
aggttggtttaatgcaatagaa

SEQ ID NO: 3465141 - DNA, 18 bp, Homo sapiens
aggtttaggctggtggcc

SEQ ID NO: 3465142 - DNA, 18 bp, Homo sapiens
aggtttctggtctctagg

SEQ ID NO: 3465143 - DNA, 14 bp, Homo sapiens
aggtttgagtagag

SEQ ID NO: 3465144 - DNA, 15 bp, Homo sapiens
aggtttttattagta

SEQ ID NO: 3465145 - DNA, 22 bp, Homo sapiens
aggtttttttgtatagtaaagt

SEQ ID NO: 3465146 - DNA, 11 bp, Homo sapiens
agtaaaagaaa

SEQ ID NO: 3465147 - DNA, 13 bp, Homo sapiens
agtaaaagaaacc

SEQ ID NO: 3465148 - DNA, 14 bp, Homo sapiens
agtaaaattgccat

SEQ ID NO: 3465149 - DNA, 17 bp, Homo sapiens
agtaaaattgccatatt

SEQ ID NO: 3465150 - DNA, 22 bp, Homo sapiens
agtaaaattgccatattgcaca

SEQ ID NO: 3465151 - DNA, 15 bp, Homo sapiens
agtaaactgcagtcc

SEQ ID NO: 3465152 - DNA, 19 bp, Homo sapiens
agtaaagtgataatttctg

SEQ ID NO: 3465153 - DNA, 22 bp, Homo sapiens
agtaaatatcccaaactgtgat

SEQ ID NO: 3465154 - DNA, 22 bp, Homo sapiens
agtaaatggcttatccagctgg

SEQ ID NO: 3465155 - DNA, 17 bp, Homo sapiens
agtaacatgaggggaca

SEQ ID NO: 3465156 - DNA, 20 bp, Homo sapiens
agtaacattaactcagtgga

SEQ ID NO: 3465157 - DNA, 12 bp, Homo sapiens
agtaacctgggt

SEQ ID NO: 3465158 - DNA, 19 bp, Homo sapiens
agtaacttcttatggaatt

SEQ ID NO: 3465159 - DNA, 13 bp, Homo sapiens
agtaagaaaatat

SEQ ID NO: 3465160 - DNA, 14 bp, Homo sapiens
agtaagaaaatatt

SEQ ID NO: 3465161 - DNA, 11 bp, Homo sapiens
agtaagagctt

SEQ ID NO: 3465162 - DNA, 12 bp, Homo sapiens
agtaagcctcat

SEQ ID NO: 3465163 - DNA, 19 bp, Homo sapiens
agtaatattttactttgag

SEQ ID NO: 3465164 - DNA, 19 bp, Homo sapiens
agtaatctaatatggccac

SEQ ID NO: 3465165 - DNA, 17 bp, Homo sapiens
agtaatgagtttaaaaa

SEQ ID NO: 3465166 - DNA, 14 bp, Homo sapiens
agtaattctcaggc

SEQ ID NO: 3465167 - DNA, 14 bp, Homo sapiens
agtacaggcagcac

SEQ ID NO: 3465168 - DNA, 17 bp, Homo sapiens
agtacaggcagcacaga

SEQ ID NO: 3465169 - DNA, 18 bp, Homo sapiens
agtacaggcagcacagag

SEQ ID NO: 3465170 - DNA, 19 bp, Homo sapiens
agtacaggcagcacagaga

SEQ ID NO: 3465171 - DNA, 22 bp, Homo sapiens
agtaccaccaaaaaagctgtat

SEQ ID NO: 3465172 - DNA, 22 bp, Homo sapiens
agtacctcctgtctctggcctg

SEQ ID NO: 3465173 - DNA, 14 bp, Homo sapiens
agtaccttgcttct

SEQ ID NO: 3465174 - DNA, 18 bp, Homo sapiens
agtacctttcctacattt

SEQ ID NO: 3465175 - DNA, 12 bp, Homo sapiens
agtacctttgga

SEQ ID NO: 3465176 - DNA, 19 bp, Homo sapiens
agtactgtgggcaatttag

SEQ ID NO: 3465177 - DNA, 20 bp, Homo sapiens
agtactgtgggcaatttaga

SEQ ID NO: 3465178 - DNA, 23 bp, Homo sapiens
agtactgtgggcaatttagaaaa

SEQ ID NO: 3465179 - DNA, 23 bp, Homo sapiens
agtacttagctagttttattctt

SEQ ID NO: 3465180 - DNA, 15 bp, Homo sapiens
agtacttttttaaat

SEQ ID NO: 3465181 - DNA, 16 bp, Homo sapiens
agtacttttttaaata

SEQ ID NO: 3465182 - DNA, 17 bp, Homo sapiens
agtagaaaggcctttaa

SEQ ID NO: 3465183 - DNA, 18 bp, Homo sapiens
agtagaaaggcctttaaa

SEQ ID NO: 3465184 - DNA, 18 bp, Homo sapiens
agtagaccaaatcttgtt

SEQ ID NO: 3465185 - DNA, 21 bp, Homo sapiens
agtagaccttgttacttctga

SEQ ID NO: 3465186 - DNA, 15 bp, Homo sapiens
agtagaggcttagag

SEQ ID NO: 3465187 - DNA, 21 bp, Homo sapiens
agtagcagggggggaaatgca

SEQ ID NO: 3465188 - DNA, 13 bp, Homo sapiens
agtaggagcccag

SEQ ID NO: 3465189 - DNA, 17 bp, Homo sapiens
agtaggcatttttacca

SEQ ID NO: 3465190 - DNA, 22 bp, Homo sapiens
agtaggcatttttaccatcact

SEQ ID NO: 3465191 - DNA, 12 bp, Homo sapiens
agtagtcctgtg

SEQ ID NO: 3465192 - DNA, 13 bp, Homo sapiens
agtagttatataa

SEQ ID NO: 3465193 - DNA, 18 bp, Homo sapiens
agtagttatataattgtt

SEQ ID NO: 3465194 - DNA, 21 bp, Homo sapiens
agtataaaatacaacaaagga

SEQ ID NO: 3465195 - DNA, 17 bp, Homo sapiens
agtataaacaaagttac

SEQ ID NO: 3465196 - DNA, 19 bp, Homo sapiens
agtataaacaaagttacta

SEQ ID NO: 3465197 - DNA, 22 bp, Homo sapiens
agtatatttcttcgttcttttt

SEQ ID NO: 3465198 - DNA, 13 bp, Homo sapiens
agtatcactgtct

SEQ ID NO: 3465199 - DNA, 23 bp, Homo sapiens
agtatgaatttgagcaggtctca

SEQ ID NO: 3465200 - DNA, 14 bp, Homo sapiens
agtatggtacattt

SEQ ID NO: 3465201 - DNA, 16 bp, Homo sapiens
agtatggtacattttt

SEQ ID NO: 3465202 - DNA, 17 bp, Homo sapiens
agtatggtggctgggtt

SEQ ID NO: 3465203 - DNA, 16 bp, Homo sapiens
agtatgtgggggcttc

SEQ ID NO: 3465204 - DNA, 20 bp, Homo sapiens
agtatgtgggggcttcatct

SEQ ID NO: 3465205 - DNA, 18 bp, Homo sapiens
agtatgttgtcaaagaga

SEQ ID NO: 3465206 - DNA, 15 bp, Homo sapiens
agtattatcattgct

SEQ ID NO: 3465207 - DNA, 17 bp, Homo sapiens
agtattgcatctgtata

SEQ ID NO: 3465208 - DNA, 22 bp, Homo sapiens
agtattgcatctgtataagtaa

SEQ ID NO: 3465209 - DNA, 15 bp, Homo sapiens
agtattgtaaattat

SEQ ID NO: 3465210 - DNA, 11 bp, Homo sapiens
agtatttaatt

SEQ ID NO: 3465211 - DNA, 15 bp, Homo sapiens
agtatttaattagtg

SEQ ID NO: 3465212 - DNA, 19 bp, Homo sapiens
agtatttgattcaaaatat

SEQ ID NO: 3465213 - DNA, 20 bp, Homo sapiens
agtatttgattcaaaatatt

SEQ ID NO: 3465214 - DNA, 18 bp, Homo sapiens
agtatttttcctttttaa

SEQ ID NO: 3465215 - DNA, 14 bp, Homo sapiens
agtatttttgctgc

SEQ ID NO: 3465216 - DNA, 16 bp, Homo sapiens
agtatttttgctgctt

SEQ ID NO: 3465217 - DNA, 14 bp, Homo sapiens
agtcaaattaataa

SEQ ID NO: 3465218 - DNA, 18 bp, Homo sapiens
agtcaaattaataatctt

SEQ ID NO: 3465219 - DNA, 21 bp, Homo sapiens
agtcaacagttcaaagaagtc

SEQ ID NO: 3465220 - DNA, 15 bp, Homo sapiens
agtcaacctgcctga

SEQ ID NO: 3465221 - DNA, 14 bp, Homo sapiens
agtcaagctcctcc

SEQ ID NO: 3465222 - DNA, 22 bp, Homo sapiens
agtcaagctcctcctccctgca

SEQ ID NO: 3465223 - DNA, 22 bp, Homo sapiens
agtcaagctgttgaagtctcag

SEQ ID NO: 3465224 - DNA, 17 bp, Homo sapiens
agtcaatatttttagat

SEQ ID NO: 3465225 - DNA, 12 bp, Homo sapiens
agtcaatcaagt

SEQ ID NO: 3465226 - DNA, 18 bp, Homo sapiens
agtcaatcaagtctgttt

SEQ ID NO: 3465227 - DNA, 16 bp, Homo sapiens
agtcacacgggggcag

SEQ ID NO: 3465228 - DNA, 16 bp, Homo sapiens
agtcacatctcttcct

SEQ ID NO: 3465229 - DNA, 14 bp, Homo sapiens
agtcacattctgct

SEQ ID NO: 3465230 - DNA, 14 bp, Homo sapiens
agtcaccaagccca

SEQ ID NO: 3465231 - DNA, 16 bp, Homo sapiens
agtcaccattctgcat

SEQ ID NO: 3465232 - DNA, 17 bp, Homo sapiens
agtcaccattctgcatt

SEQ ID NO: 3465233 - DNA, 21 bp, Homo sapiens
agtcaccattctgcatttagc

SEQ ID NO: 3465234 - DNA, 14 bp, Homo sapiens
agtcacgcctgaaa

SEQ ID NO: 3465235 - DNA, 16 bp, Homo sapiens
agtcacgcctgaaact

SEQ ID NO: 3465236 - DNA, 17 bp, Homo sapiens
agtcagctctctgccct

SEQ ID NO: 3465237 - DNA, 18 bp, Homo sapiens
agtcagctctctgccctg

SEQ ID NO: 3465238 - DNA, 17 bp, Homo sapiens
agtcagctcttcatctg

SEQ ID NO: 3465239 - DNA, 11 bp, Homo sapiens
agtcaggcccg

SEQ ID NO: 3465240 - DNA, 16 bp, Homo sapiens
agtcaggcccggccta

SEQ ID NO: 3465241 - DNA, 13 bp, Homo sapiens
agtcagtgctgga

SEQ ID NO: 3465242 - DNA, 21 bp, Homo sapiens
agtcagtgctggagaaatctt

SEQ ID NO: 3465243 - DNA, 23 bp, Homo sapiens
agtcataccaatgaaaaaatgta

SEQ ID NO: 3465244 - DNA, 14 bp, Homo sapiens
agtcatctatagtt

SEQ ID NO: 3465245 - DNA, 22 bp, Homo sapiens
agtcatctatagttgatatgtt

SEQ ID NO: 3465246 - DNA, 19 bp, Homo sapiens
agtcatctgttagggcctt

SEQ ID NO: 3465247 - DNA, 20 bp, Homo sapiens
agtcatcttgaccaagcagg

SEQ ID NO: 3465248 - DNA, 21 bp, Homo sapiens
agtcatcttgaccaagcagga

SEQ ID NO: 3465249 - DNA, 18 bp, Homo sapiens
agtcatgcaaaggctggg

SEQ ID NO: 3465250 - DNA, 19 bp, Homo sapiens
agtcatgcaaaggctggga

SEQ ID NO: 3465251 - DNA, 20 bp, Homo sapiens
agtcatgcaaaggctgggac

SEQ ID NO: 3465252 - DNA, 23 bp, Homo sapiens
agtcattcagcagcaaattttca

SEQ ID NO: 3465253 - DNA, 16 bp, Homo sapiens
agtcattgctgtagga

SEQ ID NO: 3465254 - DNA, 15 bp, Homo sapiens
agtcattggctttat

SEQ ID NO: 3465255 - DNA, 22 bp, Homo sapiens
agtcattggctttatcctcttt

SEQ ID NO: 3465256 - DNA, 13 bp, Homo sapiens
agtcattgtatgt

SEQ ID NO: 3465257 - DNA, 18 bp, Homo sapiens
agtcattgtatgttatta

SEQ ID NO: 3465258 - DNA, 18 bp, Homo sapiens
agtccaagcaacagcctt

SEQ ID NO: 3465259 - DNA, 11 bp, Homo sapiens
agtccaagctg

SEQ ID NO: 3465260 - DNA, 14 bp, Homo sapiens
agtccaagctggga

SEQ ID NO: 3465261 - DNA, 16 bp, Homo sapiens
agtccaagctgggaga

SEQ ID NO: 3465262 - DNA, 19 bp, Homo sapiens
agtccaattttaatttagt

SEQ ID NO: 3465263 - DNA, 21 bp, Homo sapiens
agtccagatcttgcctccaga

SEQ ID NO: 3465264 - DNA, 16 bp, Homo sapiens
agtccagccagctcct

SEQ ID NO: 3465265 - DNA, 15 bp, Homo sapiens
agtccagcctggaga

SEQ ID NO: 3465266 - DNA, 17 bp, Homo sapiens
agtccaggctgccgtgg

SEQ ID NO: 3465267 - DNA, 18 bp, Homo sapiens
agtccaggctgccgtggg

SEQ ID NO: 3465268 - DNA, 14 bp, Homo sapiens
agtcccaaccccag

SEQ ID NO: 3465269 - DNA, 23 bp, Homo sapiens
agtcccaccctgctgctgctcct

SEQ ID NO: 3465270 - DNA, 15 bp, Homo sapiens
agtcccaccttggct

SEQ ID NO: 3465271 - DNA, 16 bp, Homo sapiens
agtcccaccttggctg

SEQ ID NO: 3465272 - DNA, 16 bp, Homo sapiens
agtccccaggccccag

SEQ ID NO: 3465273 - DNA, 21 bp, Homo sapiens
agtccctgccacgaatttctg

SEQ ID NO: 3465274 - DNA, 22 bp, Homo sapiens
agtccctgccacgaatttctgt

SEQ ID NO: 3465275 - DNA, 16 bp, Homo sapiens
agtccctgtcacctct

SEQ ID NO: 3465276 - DNA, 19 bp, Homo sapiens
agtccctgtcacctcttcc

SEQ ID NO: 3465277 - DNA, 12 bp, Homo sapiens
agtccgcctggc

SEQ ID NO: 3465278 - DNA, 18 bp, Homo sapiens
agtccgcctggccggctc

SEQ ID NO: 3465279 - DNA, 19 bp, Homo sapiens
agtccgcctggccggctcc

SEQ ID NO: 3465280 - DNA, 22 bp, Homo sapiens
agtccgcctggccggctccagt

SEQ ID NO: 3465281 - DNA, 23 bp, Homo sapiens
agtccgtgctgacagctgctcct

SEQ ID NO: 3465282 - DNA, 18 bp, Homo sapiens
agtcctattcaaattcct

SEQ ID NO: 3465283 - DNA, 17 bp, Homo sapiens
agtcctccctgactttt

SEQ ID NO: 3465284 - DNA, 19 bp, Homo sapiens
agtcctccctgacttttct

SEQ ID NO: 3465285 - DNA, 14 bp, Homo sapiens
agtcctctgaatga

SEQ ID NO: 3465286 - DNA, 22 bp, Homo sapiens
agtcctgccaccaccctgtctt

SEQ ID NO: 3465287 - DNA, 23 bp, Homo sapiens
agtcctgccaccaccctgtcttc

SEQ ID NO: 3465288 - DNA, 16 bp, Homo sapiens
agtcctgcctcagcct

SEQ ID NO: 3465289 - DNA, 21 bp, Homo sapiens
agtcctgtatgtctgtcattg

SEQ ID NO: 3465290 - DNA, 20 bp, Homo sapiens
agtcctgtgaatgccactgc

SEQ ID NO: 3465291 - DNA, 21 bp, Homo sapiens
agtccttaaaaatcacactgt

SEQ ID NO: 3465292 - DNA, 20 bp, Homo sapiens
agtccttttactacagctat

SEQ ID NO: 3465293 - DNA, 14 bp, Homo sapiens
agtccttttgtaaa

SEQ ID NO: 3465294 - DNA, 13 bp, Homo sapiens
agtcgtgcctgtg

SEQ ID NO: 3465295 - DNA, 14 bp, Homo sapiens
agtcgtgcctgtgt

SEQ ID NO: 3465296 - DNA, 17 bp, Homo sapiens
agtcgtggggtgtgctg

SEQ ID NO: 3465297 - DNA, 21 bp, Homo sapiens
agtcgtggggtgtgctgggag

SEQ ID NO: 3465298 - DNA, 18 bp, Homo sapiens
agtctagatggctcctct

SEQ ID NO: 3465299 - DNA, 20 bp, Homo sapiens
agtctagatggctcctctca

SEQ ID NO: 3465300 - DNA, 19 bp, Homo sapiens
agtctatgttcaaagactg

SEQ ID NO: 3465301 - DNA, 14 bp, Homo sapiens
agtctattagccac

SEQ ID NO: 3465302 - DNA, 17 bp, Homo sapiens
agtctcactgttgccca

SEQ ID NO: 3465303 - DNA, 14 bp, Homo sapiens
agtctccaccagga

SEQ ID NO: 3465304 - DNA, 15 bp, Homo sapiens
agtctccaccaggaa

SEQ ID NO: 3465305 - DNA, 13 bp, Homo sapiens
agtctcctctcca

SEQ ID NO: 3465306 - DNA, 13 bp, Homo sapiens
agtctctgagcag

SEQ ID NO: 3465307 - DNA, 17 bp, Homo sapiens
agtctctgccttgcctt

SEQ ID NO: 3465308 - DNA, 17 bp, Homo sapiens
agtctctgctggcccag

SEQ ID NO: 3465309 - DNA, 14 bp, Homo sapiens
agtctcttcccttt

SEQ ID NO: 3465310 - DNA, 20 bp, Homo sapiens
agtctctttattttactaga

SEQ ID NO: 3465311 - DNA, 21 bp, Homo sapiens
agtctgaagcagatgcaaaga

SEQ ID NO: 3465312 - DNA, 19 bp, Homo sapiens
agtctgatgatttcttgaa

SEQ ID NO: 3465313 - DNA, 18 bp, Homo sapiens
agtctgattcccaagctc

SEQ ID NO: 3465314 - DNA, 21 bp, Homo sapiens
agtctgattcccaagctctgc

SEQ ID NO: 3465315 - DNA, 18 bp, Homo sapiens
agtctggaatgcagtggt

SEQ ID NO: 3465316 - DNA, 21 bp, Homo sapiens
agtctgtatttttaaagcatg

SEQ ID NO: 3465317 - DNA, 13 bp, Homo sapiens
agtctgtcctgtg

SEQ ID NO: 3465318 - DNA, 15 bp, Homo sapiens
agtctgtcctgtgac

SEQ ID NO: 3465319 - DNA, 20 bp, Homo sapiens
agtctgtgccacgtgtttgt

SEQ ID NO: 3465320 - DNA, 17 bp, Homo sapiens
agtctgtggatcagaga

SEQ ID NO: 3465321 - DNA, 20 bp, Homo sapiens
agtcttccacaaagaaaatt

SEQ ID NO: 3465322 - DNA, 21 bp, Homo sapiens
agtcttccacaaagaaaattc

SEQ ID NO: 3465323 - DNA, 16 bp, Homo sapiens
agtcttccatttgcaa

SEQ ID NO: 3465324 - DNA, 19 bp, Homo sapiens
agtcttccatttgcaaggg

SEQ ID NO: 3465325 - DNA, 19 bp, Homo sapiens
agtctttaggtctttgtaa

SEQ ID NO: 3465326 - DNA, 22 bp, Homo sapiens
agtctttgccagtcattcagca

SEQ ID NO: 3465327 - DNA, 18 bp, Homo sapiens
agtcttttgcttttggca

SEQ ID NO: 3465328 - DNA, 11 bp, Homo sapiens
agtgaaaaagg

SEQ ID NO: 3465329 - DNA, 14 bp, Homo sapiens
agtgaagacagaag

SEQ ID NO: 3465330 - DNA, 16 bp, Homo sapiens
agtgaagactggaagc

SEQ ID NO: 3465331 - DNA, 18 bp, Homo sapiens
agtgaaggtttacaattt

SEQ ID NO: 3465332 - DNA, 16 bp, Homo sapiens
agtgaatgattcagtg

SEQ ID NO: 3465333 - DNA, 20 bp, Homo sapiens
agtgaatttttctctaactc

SEQ ID NO: 3465334 - DNA, 15 bp, Homo sapiens
agtgaatttttgcaa

SEQ ID NO: 3465335 - DNA, 18 bp, Homo sapiens
agtgaatttttgcaataa

SEQ ID NO: 3465336 - DNA, 20 bp, Homo sapiens
agtgacacccaagagggctg

SEQ ID NO: 3465337 - DNA, 18 bp, Homo sapiens
agtgacagagacccagat

SEQ ID NO: 3465338 - DNA, 16 bp, Homo sapiens
agtgacagaggcagcc

SEQ ID NO: 3465339 - DNA, 19 bp, Homo sapiens
agtgacagaggcagcccca

SEQ ID NO: 3465340 - DNA, 20 bp, Homo sapiens
agtgacataatatattctat

SEQ ID NO: 3465341 - DNA, 22 bp, Homo sapiens
agtgacataatatattctattt

SEQ ID NO: 3465342 - DNA, 14 bp, Homo sapiens
agtgacctgaggaa

SEQ ID NO: 3465343 - DNA, 15 bp, Homo sapiens
agtgacctgaggaag

SEQ ID NO: 3465344 - DNA, 17 bp, Homo sapiens
agtgacctgaggaagcg

SEQ ID NO: 3465345 - DNA, 14 bp, Homo sapiens
agtgacctgtttat

SEQ ID NO: 3465346 - DNA, 15 bp, Homo sapiens
agtgactaatggcat

SEQ ID NO: 3465347 - DNA, 15 bp, Homo sapiens
agtgactctccaggg

SEQ ID NO: 3465348 - DNA, 17 bp, Homo sapiens
agtgactgttcaagagc

SEQ ID NO: 3465349 - DNA, 21 bp, Homo sapiens
agtgagacccagccctcatcc

SEQ ID NO: 3465350 - DNA, 16 bp, Homo sapiens
agtgagactctgtctc

SEQ ID NO: 3465351 - DNA, 14 bp, Homo sapiens
agtgagagctgggt

SEQ ID NO: 3465352 - DNA, 12 bp, Homo sapiens
agtgagatgcat

SEQ ID NO: 3465353 - DNA, 16 bp, Homo sapiens
agtgagatgcattctt

SEQ ID NO: 3465354 - DNA, 14 bp, Homo sapiens
agtgagcactaagg

SEQ ID NO: 3465355 - DNA, 22 bp, Homo sapiens
agtgagcactaaggtgtgctct

SEQ ID NO: 3465356 - DNA, 15 bp, Homo sapiens
agtgagccactccgg

SEQ ID NO: 3465357 - DNA, 23 bp, Homo sapiens
agtgagctggtttttagcggaga

SEQ ID NO: 3465358 - DNA, 16 bp, Homo sapiens
agtgagtcgaggacag

SEQ ID NO: 3465359 - DNA, 20 bp, Homo sapiens
agtgatagtcttttgctttt

SEQ ID NO: 3465360 - DNA, 15 bp, Homo sapiens
agtgatcacagcagc

SEQ ID NO: 3465361 - DNA, 13 bp, Homo sapiens
agtgatcctccca

SEQ ID NO: 3465362 - DNA, 20 bp, Homo sapiens
agtgatcctcccacctcagc

SEQ ID NO: 3465363 - DNA, 16 bp, Homo sapiens
agtgatgtaccatgaa

SEQ ID NO: 3465364 - DNA, 14 bp, Homo sapiens
agtgattatgggag

SEQ ID NO: 3465365 - DNA, 20 bp, Homo sapiens
agtgattctcctgcctcagc

SEQ ID NO: 3465366 - DNA, 17 bp, Homo sapiens
agtgattgggacagagg

SEQ ID NO: 3465367 - DNA, 17 bp, Homo sapiens
agtgcaaatcatagctg

SEQ ID NO: 3465368 - DNA, 13 bp, Homo sapiens
agtgcaacctctg

SEQ ID NO: 3465369 - DNA, 17 bp, Homo sapiens
agtgcaagcccctgctc

SEQ ID NO: 3465370 - DNA, 16 bp, Homo sapiens
agtgcagtcctgatca

SEQ ID NO: 3465371 - DNA, 13 bp, Homo sapiens
agtgccatctcaa

SEQ ID NO: 3465372 - DNA, 17 bp, Homo sapiens
agtgcccaactgttata

SEQ ID NO: 3465373 - DNA, 20 bp, Homo sapiens
agtgccccattcttttgtaa

SEQ ID NO: 3465374 - DNA, 10 bp, Homo sapiens
agtgcctaca

SEQ ID NO: 3465375 - DNA, 16 bp, Homo sapiens
agtgccttctaaaggt

SEQ ID NO: 3465376 - DNA, 17 bp, Homo sapiens
agtgccttctgtgggga

SEQ ID NO: 3465377 - DNA, 18 bp, Homo sapiens
agtgccttctgtggggac

SEQ ID NO: 3465378 - DNA, 22 bp, Homo sapiens
agtgccttttgcagaagagggt

SEQ ID NO: 3465379 - DNA, 16 bp, Homo sapiens
agtgctaagtgtgaac

SEQ ID NO: 3465380 - DNA, 15 bp, Homo sapiens
agtgctatgaagaca

SEQ ID NO: 3465381 - DNA, 17 bp, Homo sapiens
agtgctcagggaaatgg

SEQ ID NO: 3465382 - DNA, 19 bp, Homo sapiens
agtgctcagggaaatggcc

SEQ ID NO: 3465383 - DNA, 11 bp, Homo sapiens
agtgctccctc

SEQ ID NO: 3465384 - DNA, 21 bp, Homo sapiens
agtgctcgagtcacattctgc

SEQ ID NO: 3465385 - DNA, 16 bp, Homo sapiens
agtgctcgctgttgct

SEQ ID NO: 3465386 - DNA, 19 bp, Homo sapiens
agtgctcgctgttgctgaa

SEQ ID NO: 3465387 - DNA, 17 bp, Homo sapiens
agtgctctaggctgccc

SEQ ID NO: 3465388 - DNA, 18 bp, Homo sapiens
agtgctgcagctccctgg

SEQ ID NO: 3465389 - DNA, 14 bp, Homo sapiens
agtgctggagaaat

SEQ ID NO: 3465390 - DNA, 20 bp, Homo sapiens
agtgctgggattacaggtgt

SEQ ID NO: 3465391 - DNA, 16 bp, Homo sapiens
agtgctgtataaaatc

SEQ ID NO: 3465392 - DNA, 17 bp, Homo sapiens
agtgcttgccacagagc

SEQ ID NO: 3465393 - DNA, 18 bp, Homo sapiens
agtggaaaaatagcctgc

SEQ ID NO: 3465394 - DNA, 19 bp, Homo sapiens
agtggaaaaatagcctgcc

SEQ ID NO: 3465395 - DNA, 20 bp, Homo sapiens
agtggaccttaggccttcct

SEQ ID NO: 3465396 - DNA, 13 bp, Homo sapiens
agtggactcaggg

SEQ ID NO: 3465397 - DNA, 16 bp, Homo sapiens
agtggactcagggcag

SEQ ID NO: 3465398 - DNA, 22 bp, Homo sapiens
agtggaggttaaggctgaggaa

SEQ ID NO: 3465399 - DNA, 14 bp, Homo sapiens
agtggaggtttgtc

SEQ ID NO: 3465400 - DNA, 14 bp, Homo sapiens
agtggcagctgctt

SEQ ID NO: 3465401 - DNA, 11 bp, Homo sapiens
agtggcagggg

SEQ ID NO: 3465402 - DNA, 19 bp, Homo sapiens
agtggccactaagcagagg

SEQ ID NO: 3465403 - DNA, 22 bp, Homo sapiens
agtggccactaagcagaggagg

SEQ ID NO: 3465404 - DNA, 23 bp, Homo sapiens
agtggcctctttgtctaaaacaa

SEQ ID NO: 3465405 - DNA, 23 bp, Homo sapiens
agtggctgcctcatatagcactt

SEQ ID NO: 3465406 - DNA, 16 bp, Homo sapiens
agtgggagctgcctgt

SEQ ID NO: 3465407 - DNA, 22 bp, Homo sapiens
agtgggcttgattctgcagtaa

SEQ ID NO: 3465408 - DNA, 20 bp, Homo sapiens
agtggggctctctgagtcct

SEQ ID NO: 3465409 - DNA, 18 bp, Homo sapiens
agtgggggatcacagcct

SEQ ID NO: 3465410 - DNA, 14 bp, Homo sapiens
agtgggtcccagat

SEQ ID NO: 3465411 - DNA, 13 bp, Homo sapiens
agtgggtgaataa

SEQ ID NO: 3465412 - DNA, 15 bp, Homo sapiens
agtgggtttcacaag

SEQ ID NO: 3465413 - DNA, 18 bp, Homo sapiens
agtggtagtaatttcctt

SEQ ID NO: 3465414 - DNA, 13 bp, Homo sapiens
agtggtcctagag

SEQ ID NO: 3465415 - DNA, 21 bp, Homo sapiens
agtggtgcgatctcggctcag

SEQ ID NO: 3465416 - DNA, 17 bp, Homo sapiens
agtggtgcgatctgggt

SEQ ID NO: 3465417 - DNA, 19 bp, Homo sapiens
agtggtggtatgtaatgga

SEQ ID NO: 3465418 - DNA, 15 bp, Homo sapiens
agtggtgtgatctca

SEQ ID NO: 3465419 - DNA, 20 bp, Homo sapiens
agtggttttaggatacttaa

SEQ ID NO: 3465420 - DNA, 21 bp, Homo sapiens
agtgtaaatagttactccagt

SEQ ID NO: 3465421 - DNA, 14 bp, Homo sapiens
agtgtaggcagaca

SEQ ID NO: 3465422 - DNA, 23 bp, Homo sapiens
agtgtaggcagacacagggactt

SEQ ID NO: 3465423 - DNA, 18 bp, Homo sapiens
agtgtatgactgcacatg

SEQ ID NO: 3465424 - DNA, 14 bp, Homo sapiens
agtgtatttgtatt

SEQ ID NO: 3465425 - DNA, 21 bp, Homo sapiens
agtgtatttttcaataaagca

SEQ ID NO: 3465426 - DNA, 14 bp, Homo sapiens
agtgtccaaagcag

SEQ ID NO: 3465427 - DNA, 21 bp, Homo sapiens
agtgtccaaagcagggtctgg

SEQ ID NO: 3465428 - DNA, 15 bp, Homo sapiens
agtgtctgtgtgtgt

SEQ ID NO: 3465429 - DNA, 19 bp, Homo sapiens
agtgtcttcacggcaggac

SEQ ID NO: 3465430 - DNA, 13 bp, Homo sapiens
agtgtctttccac

SEQ ID NO: 3465431 - DNA, 23 bp, Homo sapiens
agtgtctttccacggagccactc

SEQ ID NO: 3465432 - DNA, 14 bp, Homo sapiens
agtgtctttcggaa

SEQ ID NO: 3465433 - DNA, 19 bp, Homo sapiens
agtgtctttcggaattttt

SEQ ID NO: 3465434 - DNA, 21 bp, Homo sapiens
agtgtctttctggtgttttat

SEQ ID NO: 3465435 - DNA, 22 bp, Homo sapiens
agtgtgaactggaccctgttgc

SEQ ID NO: 3465436 - DNA, 13 bp, Homo sapiens
agtgtgcccatct

SEQ ID NO: 3465437 - DNA, 20 bp, Homo sapiens
agtgtgcctgaagtcccaga

SEQ ID NO: 3465438 - DNA, 18 bp, Homo sapiens
agtgtgggacaggctctt

SEQ ID NO: 3465439 - DNA, 19 bp, Homo sapiens
agtgtgtattaaaaaaaac

SEQ ID NO: 3465440 - DNA, 20 bp, Homo sapiens
agtgtgtattaaaaaaaaca

SEQ ID NO: 3465441 - DNA, 23 bp, Homo sapiens
agtgtgtattaaaaaaaacaaaa

SEQ ID NO: 3465442 - DNA, 23 bp, Homo sapiens
agtgttagggaagggcctgccac

SEQ ID NO: 3465443 - DNA, 16 bp, Homo sapiens
agtgttccccttccac

SEQ ID NO: 3465444 - DNA, 17 bp, Homo sapiens
agtgttctgcaaaaata

SEQ ID NO: 3465445 - DNA, 17 bp, Homo sapiens
agtgtttctaataaact

SEQ ID NO: 3465446 - DNA, 16 bp, Homo sapiens
agtgttttctttgagg

SEQ ID NO: 3465447 - DNA, 23 bp, Homo sapiens
agtgttttggactccatctctca

SEQ ID NO: 3465448 - DNA, 15 bp, Homo sapiens
agttaacatcatgaa

SEQ ID NO: 3465449 - DNA, 21 bp, Homo sapiens
agttaacatcatgaatttatt

SEQ ID NO: 3465450 - DNA, 18 bp, Homo sapiens
agttaacgtattagttgc

SEQ ID NO: 3465451 - DNA, 22 bp, Homo sapiens
agttaacgtattagttgccaat

SEQ ID NO: 3465452 - DNA, 20 bp, Homo sapiens
agttaagacatgatttcctt

SEQ ID NO: 3465453 - DNA, 16 bp, Homo sapiens
agttaaggtgggcccg

SEQ ID NO: 3465454 - DNA, 22 bp, Homo sapiens
agttacacagaaatgctgctgg

SEQ ID NO: 3465455 - DNA, 21 bp, Homo sapiens
agttactccagtgccaacaat

SEQ ID NO: 3465456 - DNA, 13 bp, Homo sapiens
agttactttagat

SEQ ID NO: 3465457 - DNA, 12 bp, Homo sapiens
agttagactgtt

SEQ ID NO: 3465458 - DNA, 16 bp, Homo sapiens
agttaggaatgagaag

SEQ ID NO: 3465459 - DNA, 12 bp, Homo sapiens
agttaggcctgg

SEQ ID NO: 3465460 - DNA, 19 bp, Homo sapiens
agttatatttcagatgtaa

SEQ ID NO: 3465461 - DNA, 16 bp, Homo sapiens
agttatcaaaaagtat

SEQ ID NO: 3465462 - DNA, 17 bp, Homo sapiens
agttatcaaaaagtatt

SEQ ID NO: 3465463 - DNA, 23 bp, Homo sapiens
agttatgaacacttaaattatga

SEQ ID NO: 3465464 - DNA, 19 bp, Homo sapiens
agttattgagattgtcctc

SEQ ID NO: 3465465 - DNA, 15 bp, Homo sapiens
agttatttttgtaca

SEQ ID NO: 3465466 - DNA, 13 bp, Homo sapiens
agttcaaacaaga

SEQ ID NO: 3465467 - DNA, 13 bp, Homo sapiens
agttcaaagaagt

SEQ ID NO: 3465468 - DNA, 16 bp, Homo sapiens
agttcaattctcattt

SEQ ID NO: 3465469 - DNA, 13 bp, Homo sapiens
agttcagatctta

SEQ ID NO: 3465470 - DNA, 21 bp, Homo sapiens
agttcagcatccgcaggtgct

SEQ ID NO: 3465471 - DNA, 20 bp, Homo sapiens
agttcaggtaacaggcagat

SEQ ID NO: 3465472 - DNA, 20 bp, Homo sapiens
agttcaggtagctgcccctg

SEQ ID NO: 3465473 - DNA, 17 bp, Homo sapiens
agttcatccgcactgta

SEQ ID NO: 3465474 - DNA, 18 bp, Homo sapiens
agttcatctatggcagtc

SEQ ID NO: 3465475 - DNA, 17 bp, Homo sapiens
agttcgcctggagccct

SEQ ID NO: 3465476 - DNA, 19 bp, Homo sapiens
agttcgcctggagccctcc

SEQ ID NO: 3465477 - DNA, 19 bp, Homo sapiens
agttcggtgagctacaaat

SEQ ID NO: 3465478 - DNA, 20 bp, Homo sapiens
agttcggtgagctacaaatg

SEQ ID NO: 3465479 - DNA, 12 bp, Homo sapiens
agttctgtagaa

SEQ ID NO: 3465480 - DNA, 18 bp, Homo sapiens
agttctgtagaaatggtt

SEQ ID NO: 3465481 - DNA, 17 bp, Homo sapiens
agttctttaaaatgtaa

SEQ ID NO: 3465482 - DNA, 19 bp, Homo sapiens
agttctttgttcatagccc

SEQ ID NO: 3465483 - DNA, 17 bp, Homo sapiens
agttgaaaaacagctga

SEQ ID NO: 3465484 - DNA, 18 bp, Homo sapiens
agttgaaaaacagctgag

SEQ ID NO: 3465485 - DNA, 22 bp, Homo sapiens
agttgaaaatcttataatttaa

SEQ ID NO: 3465486 - DNA, 23 bp, Homo sapiens
agttgaaaatcttataatttaaa

SEQ ID NO: 3465487 - DNA, 17 bp, Homo sapiens
agttgaagactttgttt

SEQ ID NO: 3465488 - DNA, 15 bp, Homo sapiens
agttgaagtttagga

SEQ ID NO: 3465489 - DNA, 15 bp, Homo sapiens
agttgacaattctgc

SEQ ID NO: 3465490 - DNA, 13 bp, Homo sapiens
agttgagaaggtg

SEQ ID NO: 3465491 - DNA, 23 bp, Homo sapiens
agttgagggaaagagcttataaa

SEQ ID NO: 3465492 - DNA, 21 bp, Homo sapiens
agttgatatgttttatttcat

SEQ ID NO: 3465493 - DNA, 20 bp, Homo sapiens
agttgatctggaacccagac

SEQ ID NO: 3465494 - DNA, 21 bp, Homo sapiens
agttgatctggaacccagact

SEQ ID NO: 3465495 - DNA, 15 bp, Homo sapiens
agttgatgaaatgga

SEQ ID NO: 3465496 - DNA, 14 bp, Homo sapiens
agttgattcagctc

SEQ ID NO: 3465497 - DNA, 23 bp, Homo sapiens
agttgattcagctctgcaagaat

SEQ ID NO: 3465498 - DNA, 15 bp, Homo sapiens
agttgcaatagaaca

SEQ ID NO: 3465499 - DNA, 15 bp, Homo sapiens
agttgcacggctgct

SEQ ID NO: 3465500 - DNA, 18 bp, Homo sapiens
agttgcactaactgctgg

SEQ ID NO: 3465501 - DNA, 22 bp, Homo sapiens
agttgcataggtttaataattt

SEQ ID NO: 3465502 - DNA, 17 bp, Homo sapiens
agttgccccgtctctgt

SEQ ID NO: 3465503 - DNA, 18 bp, Homo sapiens
agttggaccagaggaagc

SEQ ID NO: 3465504 - DNA, 21 bp, Homo sapiens
agttggcagaaatacagtctt

SEQ ID NO: 3465505 - DNA, 16 bp, Homo sapiens
agttggctaggacccc

SEQ ID NO: 3465506 - DNA, 13 bp, Homo sapiens
agttgggcttcct

SEQ ID NO: 3465507 - DNA, 17 bp, Homo sapiens
agttggggtctggcagc

SEQ ID NO: 3465508 - DNA, 21 bp, Homo sapiens
agttggggtctggcagcctcc

SEQ ID NO: 3465509 - DNA, 16 bp, Homo sapiens
agttggttgaattttt

SEQ ID NO: 3465510 - DNA, 13 bp, Homo sapiens
agttgtaaatata

SEQ ID NO: 3465511 - DNA, 14 bp, Homo sapiens
agttgtaaatatat

SEQ ID NO: 3465512 - DNA, 18 bp, Homo sapiens
agttgtaaatatataaat

SEQ ID NO: 3465513 - DNA, 15 bp, Homo sapiens
agttgtacatgaaat

SEQ ID NO: 3465514 - DNA, 22 bp, Homo sapiens
agttgtacatgaaatttttgta

SEQ ID NO: 3465515 - DNA, 18 bp, Homo sapiens
agttgttactaactaaac

SEQ ID NO: 3465516 - DNA, 22 bp, Homo sapiens
agttgttactaactaaactctc

SEQ ID NO: 3465517 - DNA, 23 bp, Homo sapiens
agttgttactaactaaactctct

SEQ ID NO: 3465518 - DNA, 16 bp, Homo sapiens
agtttaaaaatcaact

SEQ ID NO: 3465519 - DNA, 12 bp, Homo sapiens
agtttaatgcaa

SEQ ID NO: 3465520 - DNA, 20 bp, Homo sapiens
agtttaatgcaagagaacat

SEQ ID NO: 3465521 - DNA, 13 bp, Homo sapiens
agtttatttccac

SEQ ID NO: 3465522 - DNA, 16 bp, Homo sapiens
agtttatttttaaaga

SEQ ID NO: 3465523 - DNA, 13 bp, Homo sapiens
agtttcagagatg

SEQ ID NO: 3465524 - DNA, 14 bp, Homo sapiens
agtttcagagatgg

SEQ ID NO: 3465525 - DNA, 18 bp, Homo sapiens
agtttcatgttggtttat

SEQ ID NO: 3465526 - DNA, 18 bp, Homo sapiens
agtttccaattatttgac

SEQ ID NO: 3465527 - DNA, 19 bp, Homo sapiens
agtttccttccagcccaga

SEQ ID NO: 3465528 - DNA, 23 bp, Homo sapiens
agtttccttttctgtctctctct

SEQ ID NO: 3465529 - DNA, 12 bp, Homo sapiens
agtttgaaattc

SEQ ID NO: 3465530 - DNA, 18 bp, Homo sapiens
agtttgaaattctgaatt

SEQ ID NO: 3465531 - DNA, 21 bp, Homo sapiens
agtttgaatgttaaataaatt

SEQ ID NO: 3465532 - DNA, 15 bp, Homo sapiens
agtttgagaccagcc

SEQ ID NO: 3465533 - DNA, 16 bp, Homo sapiens
agtttgagaccagcct

SEQ ID NO: 3465534 - DNA, 20 bp, Homo sapiens
agtttgagatcagcctgggc

SEQ ID NO: 3465535 - DNA, 14 bp, Homo sapiens
agtttgattattca

SEQ ID NO: 3465536 - DNA, 23 bp, Homo sapiens
agtttgattattcagtgtcactg

SEQ ID NO: 3465537 - DNA, 23 bp, Homo sapiens
agtttgctttttgcgtacacaga

SEQ ID NO: 3465538 - DNA, 21 bp, Homo sapiens
agtttgtcgctcatgtgtgca

SEQ ID NO: 3465539 - DNA, 13 bp, Homo sapiens
agttttacaaagg

SEQ ID NO: 3465540 - DNA, 18 bp, Homo sapiens
agttttccttctcatctg

SEQ ID NO: 3465541 - DNA, 23 bp, Homo sapiens
agttttccttctcatctgtgatt

SEQ ID NO: 3465542 - DNA, 14 bp, Homo sapiens
agttttgttgcccc

SEQ ID NO: 3465543 - DNA, 18 bp, Homo sapiens
agtttttacagctgtgtt

SEQ ID NO: 3465544 - DNA, 22 bp, Homo sapiens
agtttttctgttttgtttggca

SEQ ID NO: 3465545 - DNA, 16 bp, Homo sapiens
agttttttgttttaca

SEQ ID NO: 3465546 - DNA, 14 bp, Homo sapiens
agttttttttctgg

SEQ ID NO: 3465547 - DNA, 15 bp, Homo sapiens
ataaaaaacaaatat

SEQ ID NO: 3465548 - DNA, 15 bp, Homo sapiens
ataaaaacaaaaaca

SEQ ID NO: 3465549 - DNA, 12 bp, Homo sapiens
ataaaaagcaaa

SEQ ID NO: 3465550 - DNA, 16 bp, Homo sapiens
ataaaaagcaaaacaa

SEQ ID NO: 3465551 - DNA, 21 bp, Homo sapiens
ataaaaagcttccatgattct

SEQ ID NO: 3465552 - DNA, 12 bp, Homo sapiens
ataaaacaggta

SEQ ID NO: 3465553 - DNA, 11 bp, Homo sapiens
ataaaacagta

SEQ ID NO: 3465554 - DNA, 17 bp, Homo sapiens
ataaaacagtatctctt

SEQ ID NO: 3465555 - DNA, 17 bp, Homo sapiens
ataaaacattaagaaaa

SEQ ID NO: 3465556 - DNA, 17 bp, Homo sapiens
ataaaactttgctgcca

SEQ ID NO: 3465557 - DNA, 21 bp, Homo sapiens
ataaaagatggggtctgtaaa

SEQ ID NO: 3465558 - DNA, 17 bp, Homo sapiens
ataaaaggaagccaaag

SEQ ID NO: 3465559 - DNA, 20 bp, Homo sapiens
ataaaaggaagccaaagagt

SEQ ID NO: 3465560 - DNA, 14 bp, Homo sapiens
ataaaataaatata

SEQ ID NO: 3465561 - DNA, 15 bp, Homo sapiens
ataaaataaatatat

SEQ ID NO: 3465562 - DNA, 16 bp, Homo sapiens
ataaaataaatatata

SEQ ID NO: 3465563 - DNA, 13 bp, Homo sapiens
ataaaataatgca

SEQ ID NO: 3465564 - DNA, 16 bp, Homo sapiens
ataaaatattattgaa

SEQ ID NO: 3465565 - DNA, 22 bp, Homo sapiens
ataaaatcagccaattatgtta

SEQ ID NO: 3465566 - DNA, 12 bp, Homo sapiens
ataaaatgttga

SEQ ID NO: 3465567 - DNA, 16 bp, Homo sapiens
ataaaatgttgaaaag

SEQ ID NO: 3465568 - DNA, 17 bp, Homo sapiens
ataaaatgttgaaaagt

SEQ ID NO: 3465569 - DNA, 13 bp, Homo sapiens
ataaaattatgcc

SEQ ID NO: 3465570 - DNA, 18 bp, Homo sapiens
aggacatgaaactccacc

SEQ ID NO: 3465571 - DNA, 22 bp, Homo sapiens
aggacatgcggtagccagcaca

SEQ ID NO: 3465572 - DNA, 17 bp, Homo sapiens
aggacatgctgaagcca

SEQ ID NO: 3465573 - DNA, 15 bp, Homo sapiens
aggacattgcggaca

SEQ ID NO: 3465574 - DNA, 23 bp, Homo sapiens
aggacattgcggacagccacggc

SEQ ID NO: 3465575 - DNA, 14 bp, Homo sapiens
aggacatttctcta

SEQ ID NO: 3465576 - DNA, 17 bp, Homo sapiens
aggaccaagcatcttgg

SEQ ID NO: 3465577 - DNA, 13 bp, Homo sapiens
aggaccagctcag

SEQ ID NO: 3465578 - DNA, 15 bp, Homo sapiens
aggaccagctcagga

SEQ ID NO: 3465579 - DNA, 23 bp, Homo sapiens
aggaccagctcaggacagatgcc

SEQ ID NO: 3465580 - DNA, 18 bp, Homo sapiens
aggaccaggatccagcct

SEQ ID NO: 3465581 - DNA, 20 bp, Homo sapiens
aggaccagtcaacctgggca

SEQ ID NO: 3465582 - DNA, 18 bp, Homo sapiens
aggacccaagcagagaag

SEQ ID NO: 3465583 - DNA, 20 bp, Homo sapiens
aggaccccttaatcttgctt

SEQ ID NO: 3465584 - DNA, 23 bp, Homo sapiens
aggaccccttaatcttgctttct

SEQ ID NO: 3465585 - DNA, 15 bp, Homo sapiens
aggaccctgaagggg

SEQ ID NO: 3465586 - DNA, 14 bp, Homo sapiens
aggacctcaggtga

SEQ ID NO: 3465587 - DNA, 15 bp, Homo sapiens
aggacctccaagcca

SEQ ID NO: 3465588 - DNA, 18 bp, Homo sapiens
aggacctctgaaaccctg

SEQ ID NO: 3465589 - DNA, 13 bp, Homo sapiens
aggacctgcctgt

SEQ ID NO: 3465590 - DNA, 18 bp, Homo sapiens
aggaccttcgggctgtgc

SEQ ID NO: 3465591 - DNA, 21 bp, Homo sapiens
aggacctttccaccacagcca

SEQ ID NO: 3465592 - DNA, 15 bp, Homo sapiens
aggacgtgggctggg

SEQ ID NO: 3465593 - DNA, 19 bp, Homo sapiens
aggacgtgggctgggccca

SEQ ID NO: 3465594 - DNA, 18 bp, Homo sapiens
aggactaatccaatacct

SEQ ID NO: 3465595 - DNA, 13 bp, Homo sapiens
aggactcagctcc

SEQ ID NO: 3465596 - DNA, 15 bp, Homo sapiens
aggactccaggccca

SEQ ID NO: 3465597 - DNA, 20 bp, Homo sapiens
aggactccaggcccaaggct

SEQ ID NO: 3465598 - DNA, 23 bp, Homo sapiens
aggactccaggcccaaggctccc

SEQ ID NO: 3465599 - DNA, 12 bp, Homo sapiens
aggactctcagg

SEQ ID NO: 3465600 - DNA, 19 bp, Homo sapiens
aggactgagcaccctctgg

SEQ ID NO: 3465601 - DNA, 21 bp, Homo sapiens
aggactgcacagcgtcctgtc

SEQ ID NO: 3465602 - DNA, 23 bp, Homo sapiens
aggactgcacagcgtcctgtcca

SEQ ID NO: 3465603 - DNA, 11 bp, Homo sapiens
aggactgggcc

SEQ ID NO: 3465604 - DNA, 12 bp, Homo sapiens
aggactgggcca

SEQ ID NO: 3465605 - DNA, 15 bp, Homo sapiens
aggactgggccactt

SEQ ID NO: 3465606 - DNA, 20 bp, Homo sapiens
aggacttccccggagggctg

SEQ ID NO: 3465607 - DNA, 21 bp, Homo sapiens
aggacttcctgtccagctcca

SEQ ID NO: 3465608 - DNA, 22 bp, Homo sapiens
aggacttcctgtccagctccaa

SEQ ID NO: 3465609 - DNA, 20 bp, Homo sapiens
aggacttcggggtagaggct

SEQ ID NO: 3465610 - DNA, 22 bp, Homo sapiens
aggacttcggggtagaggctgg

SEQ ID NO: 3465611 - DNA, 18 bp, Homo sapiens
aggactttgaggcaagtg

SEQ ID NO: 3465612 - DNA, 23 bp, Homo sapiens
aggactttgaggcaagtgtgggc

SEQ ID NO: 3465613 - DNA, 22 bp, Homo sapiens
aggagaaccaaatctggaagcc

SEQ ID NO: 3465614 - DNA, 14 bp, Homo sapiens
aggagaagccagga

SEQ ID NO: 3465615 - DNA, 20 bp, Homo sapiens
aggagaatctcttgaacctg

SEQ ID NO: 3465616 - DNA, 11 bp, Homo sapiens
aggagacacaa

SEQ ID NO: 3465617 - DNA, 13 bp, Homo sapiens
aggagacaggcag

SEQ ID NO: 3465618 - DNA, 16 bp, Homo sapiens
aggagagaaaatatat

SEQ ID NO: 3465619 - DNA, 17 bp, Homo sapiens
aggagagaaaatatatg

SEQ ID NO: 3465620 - DNA, 17 bp, Homo sapiens
aggagagagacagagag

SEQ ID NO: 3465621 - DNA, 15 bp, Homo sapiens
aggagagagccttgg

SEQ ID NO: 3465622 - DNA, 22 bp, Homo sapiens
aggagagagccttgggagccac

SEQ ID NO: 3465623 - DNA, 19 bp, Homo sapiens
aggagagcatcggcctagg

SEQ ID NO: 3465624 - DNA, 15 bp, Homo sapiens
aggagatcagaaaaa

SEQ ID NO: 3465625 - DNA, 22 bp, Homo sapiens
aggagatgctccttgggccctt

SEQ ID NO: 3465626 - DNA, 22 bp, Homo sapiens
aggagcaaaggctgagaacact

SEQ ID NO: 3465627 - DNA, 15 bp, Homo sapiens
aggagcacacccagc

SEQ ID NO: 3465628 - DNA, 18 bp, Homo sapiens
aggagcattttttaaaaa

SEQ ID NO: 3465629 - DNA, 15 bp, Homo sapiens
aggagccccattcct

SEQ ID NO: 3465630 - DNA, 22 bp, Homo sapiens
aggagccccgaggccttctctg

SEQ ID NO: 3465631 - DNA, 15 bp, Homo sapiens
aggagcccctggaca

SEQ ID NO: 3465632 - DNA, 23 bp, Homo sapiens
aggagcccctggacatgcctgtc

SEQ ID NO: 3465633 - DNA, 18 bp, Homo sapiens
aggagctgccttggctca

SEQ ID NO: 3465634 - DNA, 19 bp, Homo sapiens
aggagctgccttggctcag

SEQ ID NO: 3465635 - DNA, 13 bp, Homo sapiens
aggagctgctata

SEQ ID NO: 3465636 - DNA, 20 bp, Homo sapiens
aggagcttcctgtcctccca

SEQ ID NO: 3465637 - DNA, 19 bp, Homo sapiens
aggagcttcttgtttcctt

SEQ ID NO: 3465638 - DNA, 16 bp, Homo sapiens
aggagcttgcaagaag

SEQ ID NO: 3465639 - DNA, 14 bp, Homo sapiens
aggaggcaggacct

SEQ ID NO: 3465640 - DNA, 13 bp, Homo sapiens
aggaggctccaga

SEQ ID NO: 3465641 - DNA, 19 bp, Homo sapiens
aggaggctccagagggcac

SEQ ID NO: 3465642 - DNA, 13 bp, Homo sapiens
aggaggctggctt

SEQ ID NO: 3465643 - DNA, 14 bp, Homo sapiens
aggagggcagcaga

SEQ ID NO: 3465644 - DNA, 16 bp, Homo sapiens
aggagggcgttcttag

SEQ ID NO: 3465645 - DNA, 19 bp, Homo sapiens
aggaggggcccccctgccc

SEQ ID NO: 3465646 - DNA, 14 bp, Homo sapiens
aggagtgagcacta

SEQ ID NO: 3465647 - DNA, 13 bp, Homo sapiens
aggagttagccaa

SEQ ID NO: 3465648 - DNA, 21 bp, Homo sapiens
aggagtttgagaccaacctgg

SEQ ID NO: 3465649 - DNA, 22 bp, Homo sapiens
aggataaattgccataatatga

SEQ ID NO: 3465650 - DNA, 15 bp, Homo sapiens
aggataactttttaa

SEQ ID NO: 3465651 - DNA, 16 bp, Homo sapiens
aggataactttttaaa

SEQ ID NO: 3465652 - DNA, 18 bp, Homo sapiens
aggatactgtaacacttt

SEQ ID NO: 3465653 - DNA, 14 bp, Homo sapiens
aggatacttaacaa

SEQ ID NO: 3465654 - DNA, 14 bp, Homo sapiens
aggatagagactgg

SEQ ID NO: 3465655 - DNA, 22 bp, Homo sapiens
aggatagatgctggcccagggc

SEQ ID NO: 3465656 - DNA, 20 bp, Homo sapiens
aggatattccaaaataaaag

SEQ ID NO: 3465657 - DNA, 19 bp, Homo sapiens
aggatattttgtcaccaga

SEQ ID NO: 3465658 - DNA, 13 bp, Homo sapiens
aggatcaagggct

SEQ ID NO: 3465659 - DNA, 16 bp, Homo sapiens
aggatccctctctgga

SEQ ID NO: 3465660 - DNA, 22 bp, Homo sapiens
aggatcgaagggtttttagaga

SEQ ID NO: 3465661 - DNA, 14 bp, Homo sapiens
aggatctagagggg

SEQ ID NO: 3465662 - DNA, 17 bp, Homo sapiens
aggatctcttgagcctg

SEQ ID NO: 3465663 - DNA, 22 bp, Homo sapiens
aggatctcttgagcctgggagg

SEQ ID NO: 3465664 - DNA, 15 bp, Homo sapiens
aggatctttgtggcc

SEQ ID NO: 3465665 - DNA, 20 bp, Homo sapiens
aggatctttgtggccaagga

SEQ ID NO: 3465666 - DNA, 14 bp, Homo sapiens
aggatgagcagagc

SEQ ID NO: 3465667 - DNA, 19 bp, Homo sapiens
aggatgagctctacccagg

SEQ ID NO: 3465668 - DNA, 23 bp, Homo sapiens
aggatgcagcgccgtgtcctctc

SEQ ID NO: 3465669 - DNA, 22 bp, Homo sapiens
aggatggcaggacgtgggctgg

SEQ ID NO: 3465670 - DNA, 17 bp, Homo sapiens
aggatggcctggccagg

SEQ ID NO: 3465671 - DNA, 21 bp, Homo sapiens
aggatgtaaggccttagccat

SEQ ID NO: 3465672 - DNA, 18 bp, Homo sapiens
aggatgtagcttttcacc

SEQ ID NO: 3465673 - DNA, 12 bp, Homo sapiens
aggcaaaaggag

SEQ ID NO: 3465674 - DNA, 19 bp, Homo sapiens
aggcaaaattgcaaatctt

SEQ ID NO: 3465675 - DNA, 15 bp, Homo sapiens
aggcaaatggcactg

SEQ ID NO: 3465676 - DNA, 12 bp, Homo sapiens
aggcaagagaat

SEQ ID NO: 3465677 - DNA, 14 bp, Homo sapiens
aggcaagcacctcc

SEQ ID NO: 3465678 - DNA, 11 bp, Homo sapiens
aggcacacagc

SEQ ID NO: 3465679 - DNA, 16 bp, Homo sapiens
aggcaccagtccctgt

SEQ ID NO: 3465680 - DNA, 13 bp, Homo sapiens
aggcactgaagcc

SEQ ID NO: 3465681 - DNA, 19 bp, Homo sapiens
aggcactgcaaaccgccac

SEQ ID NO: 3465682 - DNA, 11 bp, Homo sapiens
aggcagacaca

SEQ ID NO: 3465683 - DNA, 14 bp, Homo sapiens
aggcagacacaggg

SEQ ID NO: 3465684 - DNA, 22 bp, Homo sapiens
aggcagacttccctgaatgtat

SEQ ID NO: 3465685 - DNA, 13 bp, Homo sapiens
aggcagaggctgc

SEQ ID NO: 3465686 - DNA, 19 bp, Homo sapiens
aggcagcagtgtgaggcca

SEQ ID NO: 3465687 - DNA, 20 bp, Homo sapiens
aggcagcagtgtgaggccag

SEQ ID NO: 3465688 - DNA, 21 bp, Homo sapiens
aggcagccccattctgcctgc

SEQ ID NO: 3465689 - DNA, 19 bp, Homo sapiens
aggcaggacatgctgaagc

SEQ ID NO: 3465690 - DNA, 22 bp, Homo sapiens
aggcaggaccttcgggctgtgc

SEQ ID NO: 3465691 - DNA, 12 bp, Homo sapiens
aggcaggatggc

SEQ ID NO: 3465692 - DNA, 23 bp, Homo sapiens
aggcaggctaaggcgtggagctg

SEQ ID NO: 3465693 - DNA, 15 bp, Homo sapiens
aggcaggctcccagg

SEQ ID NO: 3465694 - DNA, 13 bp, Homo sapiens
aggcagggaagtc

SEQ ID NO: 3465695 - DNA, 23 bp, Homo sapiens
aggcagggaagtccccaggcccc

SEQ ID NO: 3465696 - DNA, 14 bp, Homo sapiens
aggcaggtccaggg

SEQ ID NO: 3465697 - DNA, 21 bp, Homo sapiens
aggcaggtcttgaactcctgg

SEQ ID NO: 3465698 - DNA, 19 bp, Homo sapiens
aggcagtattttgtgtcct

SEQ ID NO: 3465699 - DNA, 14 bp, Homo sapiens
aggcagtgggaggc

SEQ ID NO: 3465700 - DNA, 22 bp, Homo sapiens
aggcagtttcagagatggacag

SEQ ID NO: 3465701 - DNA, 21 bp, Homo sapiens
aggcatacaagggggtaactc

SEQ ID NO: 3465702 - DNA, 20 bp, Homo sapiens
aggcatacgagagcagaggt

SEQ ID NO: 3465703 - DNA, 14 bp, Homo sapiens
aggcatcacagcta

SEQ ID NO: 3465704 - DNA, 21 bp, Homo sapiens
aggcatcatggaaagactggg

SEQ ID NO: 3465705 - DNA, 14 bp, Homo sapiens
aggcatcctctgac

SEQ ID NO: 3465706 - DNA, 21 bp, Homo sapiens
aggcatcctctgactccactc

SEQ ID NO: 3465707 - DNA, 21 bp, Homo sapiens
aggcatctctgtactttgctt

SEQ ID NO: 3465708 - DNA, 19 bp, Homo sapiens
aggcatgggtgcaaggaaa

SEQ ID NO: 3465709 - DNA, 18 bp, Homo sapiens
aggcatgtgtgaaacata

SEQ ID NO: 3465710 - DNA, 12 bp, Homo sapiens
aggcatgttctc

SEQ ID NO: 3465711 - DNA, 17 bp, Homo sapiens
aggcatgttctctgagg

SEQ ID NO: 3465712 - DNA, 12 bp, Homo sapiens
aggcatttcctg

SEQ ID NO: 3465713 - DNA, 22 bp, Homo sapiens
aggccaaacctctgttcagtgt

SEQ ID NO: 3465714 - DNA, 17 bp, Homo sapiens
aggccaagaaacgtctt

SEQ ID NO: 3465715 - DNA, 18 bp, Homo sapiens
aggccaaggcgggtggat

SEQ ID NO: 3465716 - DNA, 17 bp, Homo sapiens
aggccacctccccagca

SEQ ID NO: 3465717 - DNA, 23 bp, Homo sapiens
aggccacgtgatgtggagggcac

SEQ ID NO: 3465718 - DNA, 20 bp, Homo sapiens
aggccagagggagtgacaga

SEQ ID NO: 3465719 - DNA, 16 bp, Homo sapiens
aggccagcctgcggga

SEQ ID NO: 3465720 - DNA, 15 bp, Homo sapiens
aggccagctatctgc

SEQ ID NO: 3465721 - DNA, 13 bp, Homo sapiens
aggccaggccagc

SEQ ID NO: 3465722 - DNA, 19 bp, Homo sapiens
aggccagggacagtaataa

SEQ ID NO: 3465723 - DNA, 15 bp, Homo sapiens
aggccagggcagagt

SEQ ID NO: 3465724 - DNA, 21 bp, Homo sapiens
aggccatccttccctgtctgc

SEQ ID NO: 3465725 - DNA, 18 bp, Homo sapiens
aggccatggagagctgga

SEQ ID NO: 3465726 - DNA, 22 bp, Homo sapiens
aggccatggagagctggagcct

SEQ ID NO: 3465727 - DNA, 13 bp, Homo sapiens
aggccattattgt

SEQ ID NO: 3465728 - DNA, 14 bp, Homo sapiens
aggccattgtgaac

SEQ ID NO: 3465729 - DNA, 18 bp, Homo sapiens
aggccattgtgaaccaat

SEQ ID NO: 3465730 - DNA, 19 bp, Homo sapiens
aggccattgtgaaccaatg

SEQ ID NO: 3465731 - DNA, 14 bp, Homo sapiens
aggcccaacctcct

SEQ ID NO: 3465732 - DNA, 16 bp, Homo sapiens
aggcccaggctgggaa

SEQ ID NO: 3465733 - DNA, 17 bp, Homo sapiens
aggcccagtgagatgca

SEQ ID NO: 3465734 - DNA, 13 bp, Homo sapiens
aggccccagcctc

SEQ ID NO: 3465735 - DNA, 14 bp, Homo sapiens
aggccccagcctcc

SEQ ID NO: 3465736 - DNA, 16 bp, Homo sapiens
aggccccaggaagccg

SEQ ID NO: 3465737 - DNA, 13 bp, Homo sapiens
aggcccccacttg

SEQ ID NO: 3465738 - DNA, 18 bp, Homo sapiens
aggccccccgcagcaccc

SEQ ID NO: 3465739 - DNA, 19 bp, Homo sapiens
aggccccccgcagcaccct

SEQ ID NO: 3465740 - DNA, 16 bp, Homo sapiens
aggcccctctcctccg

SEQ ID NO: 3465741 - DNA, 12 bp, Homo sapiens
aggcccctgcca

SEQ ID NO: 3465742 - DNA, 15 bp, Homo sapiens
aggcccctgccaccc

SEQ ID NO: 3465743 - DNA, 17 bp, Homo sapiens
aggcccctgccaccctg

SEQ ID NO: 3465744 - DNA, 21 bp, Homo sapiens
aggcccctgccaccctgggga

SEQ ID NO: 3465745 - DNA, 20 bp, Homo sapiens
aggcccctggaggctgcctc

SEQ ID NO: 3465746 - DNA, 17 bp, Homo sapiens
aggcccggctccaggct

SEQ ID NO: 3465747 - DNA, 13 bp, Homo sapiens
aggccctctggag

SEQ ID NO: 3465748 - DNA, 15 bp, Homo sapiens
aggccctctggagtg

SEQ ID NO: 3465749 - DNA, 20 bp, Homo sapiens
aggccctctggagtggccac

SEQ ID NO: 3465750 - DNA, 10 bp, Homo sapiens
aggccctgcc

SEQ ID NO: 3465751 - DNA, 20 bp, Homo sapiens
aggccctgccagagcagggg

SEQ ID NO: 3465752 - DNA, 16 bp, Homo sapiens
aggccctgctgagtca

SEQ ID NO: 3465753 - DNA, 17 bp, Homo sapiens
aggcccttcctctttgg

SEQ ID NO: 3465754 - DNA, 15 bp, Homo sapiens
aggccctttgctgtc

SEQ ID NO: 3465755 - DNA, 13 bp, Homo sapiens
aggccgctgcccc

SEQ ID NO: 3465756 - DNA, 18 bp, Homo sapiens
aggccgctgccccagccc

SEQ ID NO: 3465757 - DNA, 22 bp, Homo sapiens
aggcctaccccgcagacacctt

SEQ ID NO: 3465758 - DNA, 22 bp, Homo sapiens
aggcctaggtgcagctcctcag

SEQ ID NO: 3465759 - DNA, 18 bp, Homo sapiens
aggcctatgttgatccat

SEQ ID NO: 3465760 - DNA, 20 bp, Homo sapiens
aggcctcaactcctcccata

SEQ ID NO: 3465761 - DNA, 13 bp, Homo sapiens
aggcctcagccag

SEQ ID NO: 3465762 - DNA, 15 bp, Homo sapiens
aggcctcagccagag

SEQ ID NO: 3465763 - DNA, 14 bp, Homo sapiens
aggcctcctggccc

SEQ ID NO: 3465764 - DNA, 19 bp, Homo sapiens
aggcctgaatcatgagcct

SEQ ID NO: 3465765 - DNA, 23 bp, Homo sapiens
aggcctgagatttcatctgctct

SEQ ID NO: 3465766 - DNA, 18 bp, Homo sapiens
aggcctgagcgctcctgc

SEQ ID NO: 3465767 - DNA, 21 bp, Homo sapiens
aggcctgagcgctcctgccgc

SEQ ID NO: 3465768 - DNA, 12 bp, Homo sapiens
aggcctgagctg

SEQ ID NO: 3465769 - DNA, 14 bp, Homo sapiens
aggcctgagctgct

SEQ ID NO: 3465770 - DNA, 17 bp, Homo sapiens
aggcctgcctccagggc

SEQ ID NO: 3465771 - DNA, 21 bp, Homo sapiens
aggcctgcctccagggctgga

SEQ ID NO: 3465772 - DNA, 12 bp, Homo sapiens
aggcctggccag

SEQ ID NO: 3465773 - DNA, 22 bp, Homo sapiens
aggcctggctcattctgcacct

SEQ ID NO: 3465774 - DNA, 21 bp, Homo sapiens
aggcctgggccgctgccacgt

SEQ ID NO: 3465775 - DNA, 14 bp, Homo sapiens
aggcctgtctgtga

SEQ ID NO: 3465776 - DNA, 17 bp, Homo sapiens
aggcctgtctgtgacct

SEQ ID NO: 3465777 - DNA, 16 bp, Homo sapiens
aggccttagccatgat

SEQ ID NO: 3465778 - DNA, 18 bp, Homo sapiens
aggccttatgagggtcct

SEQ ID NO: 3465779 - DNA, 20 bp, Homo sapiens
aggcgatcacaacgtgcatt

SEQ ID NO: 3465780 - DNA, 21 bp, Homo sapiens
aggcgatcacaacgtgcattg

SEQ ID NO: 3465781 - DNA, 22 bp, Homo sapiens
aggcgcactgtgacccccagct

SEQ ID NO: 3465782 - DNA, 17 bp, Homo sapiens
aggcggagcccagccct

SEQ ID NO: 3465783 - DNA, 18 bp, Homo sapiens
aggcgggacagtgctgca

SEQ ID NO: 3465784 - DNA, 15 bp, Homo sapiens
aggcgggagctctcc

SEQ ID NO: 3465785 - DNA, 14 bp, Homo sapiens
aggcgggaggaggt

SEQ ID NO: 3465786 - DNA, 15 bp, Homo sapiens
aggcgtggagctgcc

SEQ ID NO: 3465787 - DNA, 14 bp, Homo sapiens
aggctaaaaagcaa

SEQ ID NO: 3465788 - DNA, 15 bp, Homo sapiens
aggctaaaaagcaac

SEQ ID NO: 3465789 - DNA, 23 bp, Homo sapiens
aggctaaggcgtggagctgcctg

SEQ ID NO: 3465790 - DNA, 18 bp, Homo sapiens
aggctacactgacactgg

SEQ ID NO: 3465791 - DNA, 19 bp, Homo sapiens
aggctacactgacactggt

SEQ ID NO: 3465792 - DNA, 22 bp, Homo sapiens
aggctcactgcaacttctgcct

SEQ ID NO: 3465793 - DNA, 16 bp, Homo sapiens
aggctcatggccctgt

SEQ ID NO: 3465794 - DNA, 14 bp, Homo sapiens
aggctcgattttgt

SEQ ID NO: 3465795 - DNA, 15 bp, Homo sapiens
aggctcgattttgta

SEQ ID NO: 3465796 - DNA, 23 bp, Homo sapiens
aggctcgattttgtatctgcagg

SEQ ID NO: 3465797 - DNA, 18 bp, Homo sapiens
aggctcgccaaggcctag

SEQ ID NO: 3465798 - DNA, 23 bp, Homo sapiens
aggctctctcataacccctctat

SEQ ID NO: 3465799 - DNA, 22 bp, Homo sapiens
aggctctgccttcgaggtcaga

SEQ ID NO: 3465800 - DNA, 17 bp, Homo sapiens
aggctcttctttcccaa

SEQ ID NO: 3465801 - DNA, 18 bp, Homo sapiens
aggctcttctttcccaaa

SEQ ID NO: 3465802 - DNA, 13 bp, Homo sapiens
aggctgaaaagaa

SEQ ID NO: 3465803 - DNA, 16 bp, Homo sapiens
aggctgacgtgtgagg

SEQ ID NO: 3465804 - DNA, 20 bp, Homo sapiens
aggctgacgtgtgagggagg

SEQ ID NO: 3465805 - DNA, 14 bp, Homo sapiens
aggctgagcacctt

SEQ ID NO: 3465806 - DNA, 18 bp, Homo sapiens
aggctgaggctggcacag

SEQ ID NO: 3465807 - DNA, 21 bp, Homo sapiens
aggctgatgtcaatttctgtg

SEQ ID NO: 3465808 - DNA, 23 bp, Homo sapiens
aggctgccccgggtccccagctc

SEQ ID NO: 3465809 - DNA, 14 bp, Homo sapiens
aggctgcctcccaa

SEQ ID NO: 3465810 - DNA, 16 bp, Homo sapiens
aggctgcctcccaaca

SEQ ID NO: 3465811 - DNA, 22 bp, Homo sapiens
aggctgctgggatggtgggctt

SEQ ID NO: 3465812 - DNA, 22 bp, Homo sapiens
aggctgcttagaatccaaactt

SEQ ID NO: 3465813 - DNA, 17 bp, Homo sapiens
aggctggaatgcagtgg

SEQ ID NO: 3465814 - DNA, 18 bp, Homo sapiens
aggctggagcccagggag

SEQ ID NO: 3465815 - DNA, 18 bp, Homo sapiens
aggctggagttgtcactg

SEQ ID NO: 3465816 - DNA, 22 bp, Homo sapiens
aggctggattttgaattttctt

SEQ ID NO: 3465817 - DNA, 18 bp, Homo sapiens
aggctggccagtccaggc

SEQ ID NO: 3465818 - DNA, 19 bp, Homo sapiens
aggctggccagtccaggct

SEQ ID NO: 3465819 - DNA, 21 bp, Homo sapiens
aggctggccagtccaggctgc

SEQ ID NO: 3465820 - DNA, 20 bp, Homo sapiens
aggctggcgagagtctggcc

SEQ ID NO: 3465821 - DNA, 16 bp, Homo sapiens
aggctgggaggagccc

SEQ ID NO: 3465822 - DNA, 21 bp, Homo sapiens
aggctgggaggagcccctgga

SEQ ID NO: 3465823 - DNA, 13 bp, Homo sapiens
aggctgggcaagg

SEQ ID NO: 3465824 - DNA, 14 bp, Homo sapiens
aggctgggcttcag

SEQ ID NO: 3465825 - DNA, 22 bp, Homo sapiens
aggctgggcttcagtggcagct

SEQ ID NO: 3465826 - DNA, 21 bp, Homo sapiens
aggctggggaagtcctctggg

SEQ ID NO: 3465827 - DNA, 22 bp, Homo sapiens
aggctggggaagtcctctgggt

SEQ ID NO: 3465828 - DNA, 17 bp, Homo sapiens
aggctgggggaagaagc

SEQ ID NO: 3465829 - DNA, 15 bp, Homo sapiens
aggctggtggcccag

SEQ ID NO: 3465830 - DNA, 13 bp, Homo sapiens
aggctgtatccca

SEQ ID NO: 3465831 - DNA, 23 bp, Homo sapiens
aggctgtatcccatgagcctcag

SEQ ID NO: 3465832 - DNA, 21 bp, Homo sapiens
aggctgtccttacccatctgc

SEQ ID NO: 3465833 - DNA, 15 bp, Homo sapiens
aggctgtgactcttc

SEQ ID NO: 3465834 - DNA, 23 bp, Homo sapiens
aggctgtgactcttctctcaacc

SEQ ID NO: 3465835 - DNA, 13 bp, Homo sapiens
aggctgtgctccc

SEQ ID NO: 3465836 - DNA, 14 bp, Homo sapiens
aggctgtgctccct

SEQ ID NO: 3465837 - DNA, 22 bp, Homo sapiens
aggctgtgtccctcttctcttc

SEQ ID NO: 3465838 - DNA, 18 bp, Homo sapiens
aggctgtgtttggctttc

SEQ ID NO: 3465839 - DNA, 19 bp, Homo sapiens
aggcttagctttgctctgc

SEQ ID NO: 3465840 - DNA, 20 bp, Homo sapiens
aggcttagctttgctctgcc

SEQ ID NO: 3465841 - DNA, 15 bp, Homo sapiens
aggcttgcctgcagg

SEQ ID NO: 3465842 - DNA, 20 bp, Homo sapiens
agccatgtacagacagagaa

SEQ ID NO: 3465843 - DNA, 22 bp, Homo sapiens
agccatgtagaagctgcatctt

SEQ ID NO: 3465844 - DNA, 15 bp, Homo sapiens
agccatgtttcacaa

SEQ ID NO: 3465845 - DNA, 16 bp, Homo sapiens
agccattgcacccagc

SEQ ID NO: 3465846 - DNA, 12 bp, Homo sapiens
agccatttgaga

SEQ ID NO: 3465847 - DNA, 16 bp, Homo sapiens
agccatttttcaaagc

SEQ ID NO: 3465848 - DNA, 20 bp, Homo sapiens
agccatttttcaaagcaatt

SEQ ID NO: 3465849 - DNA, 14 bp, Homo sapiens
agcccaagcttccc

SEQ ID NO: 3465850 - DNA, 16 bp, Homo sapiens
agcccaagcttccctc

SEQ ID NO: 3465851 - DNA, 16 bp, Homo sapiens
agcccaagggatctgg

SEQ ID NO: 3465852 - DNA, 21 bp, Homo sapiens
agcccaagggatctggtccta

SEQ ID NO: 3465853 - DNA, 16 bp, Homo sapiens
agcccaatattataat

SEQ ID NO: 3465854 - DNA, 15 bp, Homo sapiens
agcccactgtcctgg

SEQ ID NO: 3465855 - DNA, 17 bp, Homo sapiens
agcccactgtcctgggc

SEQ ID NO: 3465856 - DNA, 21 bp, Homo sapiens
agcccagagacatacttgaag

SEQ ID NO: 3465857 - DNA, 20 bp, Homo sapiens
agcccagattcccctgtgtc

SEQ ID NO: 3465858 - DNA, 13 bp, Homo sapiens
agcccagctgggt

SEQ ID NO: 3465859 - DNA, 19 bp, Homo sapiens
agcccagctgggtcaggca

SEQ ID NO: 3465860 - DNA, 22 bp, Homo sapiens
agcccagggagcggaaagcagc

SEQ ID NO: 3465861 - DNA, 19 bp, Homo sapiens
agcccagggcatcttgctg

SEQ ID NO: 3465862 - DNA, 17 bp, Homo sapiens
agcccagggctcctgca

SEQ ID NO: 3465863 - DNA, 22 bp, Homo sapiens
agcccagtgttttctttgagga

SEQ ID NO: 3465864 - DNA, 19 bp, Homo sapiens
agcccatggccctcccagt

SEQ ID NO: 3465865 - DNA, 14 bp, Homo sapiens
agccccagtgccca

SEQ ID NO: 3465866 - DNA, 16 bp, Homo sapiens
agccccagtgcccaca

SEQ ID NO: 3465867 - DNA, 13 bp, Homo sapiens
agccccatctgtc

SEQ ID NO: 3465868 - DNA, 16 bp, Homo sapiens
agccccatctgtgcat

SEQ ID NO: 3465869 - DNA, 14 bp, Homo sapiens
agccccatcttcac

SEQ ID NO: 3465870 - DNA, 13 bp, Homo sapiens
agccccattctgc

SEQ ID NO: 3465871 - DNA, 22 bp, Homo sapiens
agccccattctgcctgcccagg

SEQ ID NO: 3465872 - DNA, 22 bp, Homo sapiens
agcccccagctaagaacctgga

SEQ ID NO: 3465873 - DNA, 14 bp, Homo sapiens
agccccctggcctc

SEQ ID NO: 3465874 - DNA, 15 bp, Homo sapiens
agccccctggcctct

SEQ ID NO: 3465875 - DNA, 19 bp, Homo sapiens
agccccctggcctctgtgc

SEQ ID NO: 3465876 - DNA, 15 bp, Homo sapiens
agccccgacttcctg

SEQ ID NO: 3465877 - DNA, 14 bp, Homo sapiens
agccccgaggcctt

SEQ ID NO: 3465878 - DNA, 16 bp, Homo sapiens
agccccgaggccttct

SEQ ID NO: 3465879 - DNA, 22 bp, Homo sapiens
agccccgaggccttctctgaag

SEQ ID NO: 3465880 - DNA, 17 bp, Homo sapiens
agcccctactgctgtga

SEQ ID NO: 3465881 - DNA, 16 bp, Homo sapiens
agcccctcccaagctg

SEQ ID NO: 3465882 - DNA, 19 bp, Homo sapiens
agcccctcccaagctggct

SEQ ID NO: 3465883 - DNA, 20 bp, Homo sapiens
agcccctcccaagctggctg

SEQ ID NO: 3465884 - DNA, 14 bp, Homo sapiens
agcccctcggctct

SEQ ID NO: 3465885 - DNA, 17 bp, Homo sapiens
agcccctcggctctgga

SEQ ID NO: 3465886 - DNA, 13 bp, Homo sapiens
agcccctctggtc

SEQ ID NO: 3465887 - DNA, 21 bp, Homo sapiens
agcccctctggtcgctcctgc

SEQ ID NO: 3465888 - DNA, 22 bp, Homo sapiens
agcccctctggtcgctcctgcc

SEQ ID NO: 3465889 - DNA, 20 bp, Homo sapiens
agcccctgatcctgtgaagt

SEQ ID NO: 3465890 - DNA, 20 bp, Homo sapiens
agcccctggacatgcctgtc

SEQ ID NO: 3465891 - DNA, 24 bp, Homo sapiens
agcccctggacatgcctgtcctga

SEQ ID NO: 3465892 - DNA, 21 bp, Homo sapiens
agcccctggggtggccaccag

SEQ ID NO: 3465893 - DNA, 23 bp, Homo sapiens
agcccctgtctagagagggaggc

SEQ ID NO: 3465894 - DNA, 22 bp, Homo sapiens
agccccttactatgatctcagg

SEQ ID NO: 3465895 - DNA, 23 bp, Homo sapiens
agccccttactatgatctcagga

SEQ ID NO: 3465896 - DNA, 19 bp, Homo sapiens
agccccttctgctcagctc

SEQ ID NO: 3465897 - DNA, 22 bp, Homo sapiens
agccccttctgctcagctctgg

SEQ ID NO: 3465898 - DNA, 13 bp, Homo sapiens
agcccggagctcc

SEQ ID NO: 3465899 - DNA, 17 bp, Homo sapiens
agcccgtgccctaccac

SEQ ID NO: 3465900 - DNA, 22 bp, Homo sapiens
agccctcacccctggttctcat

SEQ ID NO: 3465901 - DNA, 23 bp, Homo sapiens
agccctcacccctggttctcatc

SEQ ID NO: 3465902 - DNA, 19 bp, Homo sapiens
agccctccccatggagcca

SEQ ID NO: 3465903 - DNA, 15 bp, Homo sapiens
agccctccgccttca

SEQ ID NO: 3465904 - DNA, 19 bp, Homo sapiens
agccctgcggagccggcac

SEQ ID NO: 3465905 - DNA, 15 bp, Homo sapiens
agccctggccccctg

SEQ ID NO: 3465906 - DNA, 15 bp, Homo sapiens
agccctggtggcagt

SEQ ID NO: 3465907 - DNA, 22 bp, Homo sapiens
agccctggtggcagtgggagct

SEQ ID NO: 3465908 - DNA, 14 bp, Homo sapiens
agccctgtcgggct

SEQ ID NO: 3465909 - DNA, 18 bp, Homo sapiens
agccctgtcgggctttgt

SEQ ID NO: 3465910 - DNA, 18 bp, Homo sapiens
agcccttatctgtgctca

SEQ ID NO: 3465911 - DNA, 22 bp, Homo sapiens
agccgacaactatttcggcctt

SEQ ID NO: 3465912 - DNA, 17 bp, Homo sapiens
agccgagatcacgccac

SEQ ID NO: 3465913 - DNA, 21 bp, Homo sapiens
agccgagatcacgccactgca

SEQ ID NO: 3465914 - DNA, 18 bp, Homo sapiens
agccgccagtacttgtca

SEQ ID NO: 3465915 - DNA, 21 bp, Homo sapiens
agccgccatgctcctggccca

SEQ ID NO: 3465916 - DNA, 19 bp, Homo sapiens
agccgctgagcgaggagat

SEQ ID NO: 3465917 - DNA, 13 bp, Homo sapiens
agccgtgagcatg

SEQ ID NO: 3465918 - DNA, 18 bp, Homo sapiens
agccgtgctcgccccagc

SEQ ID NO: 3465919 - DNA, 16 bp, Homo sapiens
agccgtggtcctttgg

SEQ ID NO: 3465920 - DNA, 14 bp, Homo sapiens
agcctaccccctga

SEQ ID NO: 3465921 - DNA, 22 bp, Homo sapiens
agcctagctaccttctctaccc

SEQ ID NO: 3465922 - DNA, 13 bp, Homo sapiens
agcctattcctga

SEQ ID NO: 3465923 - DNA, 17 bp, Homo sapiens
agcctcaaaaacgccct

SEQ ID NO: 3465924 - DNA, 20 bp, Homo sapiens
agcctcaaaaacgccctcaa

SEQ ID NO: 3465925 - DNA, 21 bp, Homo sapiens
agcctcaaaaacgccctcaag

SEQ ID NO: 3465926 - DNA, 16 bp, Homo sapiens
agcctcagcatcctgg

SEQ ID NO: 3465927 - DNA, 22 bp, Homo sapiens
agcctcagcatcctggcacccg

SEQ ID NO: 3465928 - DNA, 23 bp, Homo sapiens
agcctcagcatcctggcacccgg

SEQ ID NO: 3465929 - DNA, 22 bp, Homo sapiens
agcctcagcgcggccctcccga

SEQ ID NO: 3465930 - DNA, 15 bp, Homo sapiens
agcctcatcatcaga

SEQ ID NO: 3465931 - DNA, 19 bp, Homo sapiens
agcctcccaaagtgctggg

SEQ ID NO: 3465932 - DNA, 21 bp, Homo sapiens
agcctcccaaagtgctgggat

SEQ ID NO: 3465933 - DNA, 18 bp, Homo sapiens
agcctcccatccagggcc

SEQ ID NO: 3465934 - DNA, 14 bp, Homo sapiens
agcctcccctgcca

SEQ ID NO: 3465935 - DNA, 15 bp, Homo sapiens
agcctcccctgccag

SEQ ID NO: 3465936 - DNA, 16 bp, Homo sapiens
agcctcccctgccagg

SEQ ID NO: 3465937 - DNA, 18 bp, Homo sapiens
agcctcccctgccagggc

SEQ ID NO: 3465938 - DNA, 20 bp, Homo sapiens
agcctcccgaatagctggga

SEQ ID NO: 3465939 - DNA, 19 bp, Homo sapiens
agcctcccgagtagctggg

SEQ ID NO: 3465940 - DNA, 15 bp, Homo sapiens
agcctccctgaagcc

SEQ ID NO: 3465941 - DNA, 16 bp, Homo sapiens
agcctcgaggtgcctt

SEQ ID NO: 3465942 - DNA, 22 bp, Homo sapiens
agcctcgaggtgccttcttcag

SEQ ID NO: 3465943 - DNA, 16 bp, Homo sapiens
agcctctgcctcccta

SEQ ID NO: 3465944 - DNA, 23 bp, Homo sapiens
agcctcttggggaaggggcacct

SEQ ID NO: 3465945 - DNA, 21 bp, Homo sapiens
agcctctttctgtcccttctg

SEQ ID NO: 3465946 - DNA, 22 bp, Homo sapiens
agcctgaaggggcgtctgttcc

SEQ ID NO: 3465947 - DNA, 16 bp, Homo sapiens
agcctgagcaactctt

SEQ ID NO: 3465948 - DNA, 17 bp, Homo sapiens
agcctgagtagaaaggc

SEQ ID NO: 3465949 - DNA, 22 bp, Homo sapiens
agcctgagtagaaaggccttta

SEQ ID NO: 3465950 - DNA, 19 bp, Homo sapiens
agcctgagtcacctgcaga

SEQ ID NO: 3465951 - DNA, 14 bp, Homo sapiens
agcctgcagcagga

SEQ ID NO: 3465952 - DNA, 21 bp, Homo sapiens
agcctgcgccaccgcccagag

SEQ ID NO: 3465953 - DNA, 15 bp, Homo sapiens
agcctgcgcctgctg

SEQ ID NO: 3465954 - DNA, 16 bp, Homo sapiens
agcctgcgggaagctg

SEQ ID NO: 3465955 - DNA, 21 bp, Homo sapiens
agcctgcgggaagctgacctt

SEQ ID NO: 3465956 - DNA, 17 bp, Homo sapiens
agcctgctccagctgtt

SEQ ID NO: 3465957 - DNA, 12 bp, Homo sapiens
agcctgctggaa

SEQ ID NO: 3465958 - DNA, 15 bp, Homo sapiens
agcctggccagacac

SEQ ID NO: 3465959 - DNA, 17 bp, Homo sapiens
agcctggccagcctaca

SEQ ID NO: 3465960 - DNA, 23 bp, Homo sapiens
agcctggggtggggtcatgccct

SEQ ID NO: 3465961 - DNA, 14 bp, Homo sapiens
agcctggtgctgct

SEQ ID NO: 3465962 - DNA, 16 bp, Homo sapiens
agcctggtgctgctgc

SEQ ID NO: 3465963 - DNA, 15 bp, Homo sapiens
agcctgtctttcagc

SEQ ID NO: 3465964 - DNA, 16 bp, Homo sapiens
agcctgtgcaaaaaaa

SEQ ID NO: 3465965 - DNA, 15 bp, Homo sapiens
agcctgtggccctgt

SEQ ID NO: 3465966 - DNA, 13 bp, Homo sapiens
agcctgtggcctt

SEQ ID NO: 3465967 - DNA, 17 bp, Homo sapiens
agcctgtggcctttgca

SEQ ID NO: 3465968 - DNA, 15 bp, Homo sapiens
agcctgtggctgtgg

SEQ ID NO: 3465969 - DNA, 22 bp, Homo sapiens
agccttagaagtcacacagtat

SEQ ID NO: 3465970 - DNA, 15 bp, Homo sapiens
agccttgaaaaacaa

SEQ ID NO: 3465971 - DNA, 13 bp, Homo sapiens
agccttgccagag

SEQ ID NO: 3465972 - DNA, 14 bp, Homo sapiens
agccttgccagaga

SEQ ID NO: 3465973 - DNA, 19 bp, Homo sapiens
agccttgccagagatccaa

SEQ ID NO: 3465974 - DNA, 18 bp, Homo sapiens
agccttgggagccactgc

SEQ ID NO: 3465975 - DNA, 19 bp, Homo sapiens
agccttgggagccactgcc

SEQ ID NO: 3465976 - DNA, 22 bp, Homo sapiens
agccttgggagccactgccact

SEQ ID NO: 3465977 - DNA, 23 bp, Homo sapiens
agccttgggagccactgccactc

SEQ ID NO: 3465978 - DNA, 15 bp, Homo sapiens
agcctttaatgcatc

SEQ ID NO: 3465979 - DNA, 22 bp, Homo sapiens
agcctttactgaccctggggct

SEQ ID NO: 3465980 - DNA, 23 bp, Homo sapiens
agcctttcctcaaaactggagtc

SEQ ID NO: 3465981 - DNA, 15 bp, Homo sapiens
agcctttcttttgga

SEQ ID NO: 3465982 - DNA, 20 bp, Homo sapiens
agcctttgcccaaaactgtc

SEQ ID NO: 3465983 - DNA, 19 bp, Homo sapiens
agcgagccctggtggcagt

SEQ ID NO: 3465984 - DNA, 20 bp, Homo sapiens
agcgaggagatgctccttgg

SEQ ID NO: 3465985 - DNA, 17 bp, Homo sapiens
agcgattcttctgcttc

SEQ ID NO: 3465986 - DNA, 19 bp, Homo sapiens
agcgattcttctgcttcag

SEQ ID NO: 3465987 - DNA, 14 bp, Homo sapiens
agcgcccagttggg

SEQ ID NO: 3465988 - DNA, 18 bp, Homo sapiens
agcgcctccatccaaggc

SEQ ID NO: 3465989 - DNA, 15 bp, Homo sapiens
agcgcctgcccctcc

SEQ ID NO: 3465990 - DNA, 20 bp, Homo sapiens
agcgctcctgccgcagagct

SEQ ID NO: 3465991 - DNA, 13 bp, Homo sapiens
agcggaaagcagc

SEQ ID NO: 3465992 - DNA, 17 bp, Homo sapiens
agcggaaagcagctcaa

SEQ ID NO: 3465993 - DNA, 18 bp, Homo sapiens
agcggagacggagtccca

SEQ ID NO: 3465994 - DNA, 17 bp, Homo sapiens
agcggagtctgtcctgt

SEQ ID NO: 3465995 - DNA, 16 bp, Homo sapiens
agcggatcacaaggtc

SEQ ID NO: 3465996 - DNA, 19 bp, Homo sapiens
agcgggcaggttctgcctg

SEQ ID NO: 3465997 - DNA, 23 bp, Homo sapiens
agcgggcaggttctgcctgcttt

SEQ ID NO: 3465998 - DNA, 16 bp, Homo sapiens
agcggggacagctcct

SEQ ID NO: 3465999 - DNA, 22 bp, Homo sapiens
agcggggacagctccttctgtc

SEQ ID NO: 3466000 - DNA, 20 bp, Homo sapiens
agcgggggaggcccgcagag

SEQ ID NO: 3466001 - DNA, 22 bp, Homo sapiens
agcggtgctgtcctcaggtggc

SEQ ID NO: 3466002 - DNA, 19 bp, Homo sapiens
agcgtgagccactgcaccg

SEQ ID NO: 3466003 - DNA, 15 bp, Homo sapiens
agcgtggacaggtgt

SEQ ID NO: 3466004 - DNA, 18 bp, Homo sapiens
agctaaacggattccaaa

SEQ ID NO: 3466005 - DNA, 18 bp, Homo sapiens
agctaaactccttcctgg

SEQ ID NO: 3466006 - DNA, 19 bp, Homo sapiens
agctaacacacagctccca

SEQ ID NO: 3466007 - DNA, 16 bp, Homo sapiens
agctaactgtaaatca

SEQ ID NO: 3466008 - DNA, 12 bp, Homo sapiens
agctaagaacct

SEQ ID NO: 3466009 - DNA, 23 bp, Homo sapiens
agctaaggaggggaaaaaaatgt

SEQ ID NO: 3466010 - DNA, 13 bp, Homo sapiens
agctacaaatgca

SEQ ID NO: 3466011 - DNA, 21 bp, Homo sapiens
agctacacctttctcctttgt

SEQ ID NO: 3466012 - DNA, 22 bp, Homo sapiens
agctacacctttctcctttgta

SEQ ID NO: 3466013 - DNA, 20 bp, Homo sapiens
agctacgaaaggatgagcag

SEQ ID NO: 3466014 - DNA, 19 bp, Homo sapiens
agctactaattttaaaatg

SEQ ID NO: 3466015 - DNA, 22 bp, Homo sapiens
agctactctccccacgagggct

SEQ ID NO: 3466016 - DNA, 20 bp, Homo sapiens
agctactctgatccctctgg

SEQ ID NO: 3466017 - DNA, 23 bp, Homo sapiens
agctactgccgtcagtgctgtgc

SEQ ID NO: 3466018 - DNA, 15 bp, Homo sapiens
agctactgtgtgtgt

SEQ ID NO: 3466019 - DNA, 19 bp, Homo sapiens
agctactgtgtgtgtgaat

SEQ ID NO: 3466020 - DNA, 23 bp, Homo sapiens
agctactgtgtgtgtgaatgaac

SEQ ID NO: 3466021 - DNA, 17 bp, Homo sapiens
agctacttgggaggctg

SEQ ID NO: 3466022 - DNA, 12 bp, Homo sapiens
agctagccagag

SEQ ID NO: 3466023 - DNA, 18 bp, Homo sapiens
agctaggaagagcaggac

SEQ ID NO: 3466024 - DNA, 21 bp, Homo sapiens
agctaggaagagcaggactcc

SEQ ID NO: 3466025 - DNA, 12 bp, Homo sapiens
agctaggcctgg

SEQ ID NO: 3466026 - DNA, 14 bp, Homo sapiens
agctaggcctggcc

SEQ ID NO: 3466027 - DNA, 15 bp, Homo sapiens
agctagtaatgcttt

SEQ ID NO: 3466028 - DNA, 21 bp, Homo sapiens
agctagtgtacctcctctcag

SEQ ID NO: 3466029 - DNA, 17 bp, Homo sapiens
agctagttggttgaatt

SEQ ID NO: 3466030 - DNA, 17 bp, Homo sapiens
agctatacctgtgcctc

SEQ ID NO: 3466031 - DNA, 13 bp, Homo sapiens
agctatctgcctg

SEQ ID NO: 3466032 - DNA, 20 bp, Homo sapiens
agctatgttatattgaaaaa

SEQ ID NO: 3466033 - DNA, 18 bp, Homo sapiens
agctcaagatgacagctc

SEQ ID NO: 3466034 - DNA, 18 bp, Homo sapiens
agctcacagtgctgtgtg

SEQ ID NO: 3466035 - DNA, 13 bp, Homo sapiens
agctcaccagccc

SEQ ID NO: 3466036 - DNA, 20 bp, Homo sapiens
agctcaccagccccagtgcc

SEQ ID NO: 3466037 - DNA, 21 bp, Homo sapiens
agctcaccagccccagtgccc

SEQ ID NO: 3466038 - DNA, 22 bp, Homo sapiens
agctcaccagccccagtgccca

SEQ ID NO: 3466039 - DNA, 15 bp, Homo sapiens
agctcacgcttcaca

SEQ ID NO: 3466040 - DNA, 19 bp, Homo sapiens
agctcagacattttctttt

SEQ ID NO: 3466041 - DNA, 14 bp, Homo sapiens
agctcagagagggc

SEQ ID NO: 3466042 - DNA, 16 bp, Homo sapiens
agctcagagagggcag

SEQ ID NO: 3466043 - DNA, 17 bp, Homo sapiens
agctcagagagggcagg

SEQ ID NO: 3466044 - DNA, 14 bp, Homo sapiens
agctcaggaccagg

SEQ ID NO: 3466045 - DNA, 13 bp, Homo sapiens
agctcaggatctc

SEQ ID NO: 3466046 - DNA, 22 bp, Homo sapiens
agctcaggtgtccctgcacttg

SEQ ID NO: 3466047 - DNA, 23 bp, Homo sapiens
agctcattcccaacgtgcaaagc

SEQ ID NO: 3466048 - DNA, 16 bp, Homo sapiens
agctccaacctgcaaa

SEQ ID NO: 3466049 - DNA, 11 bp, Homo sapiens
agctccactct

SEQ ID NO: 3466050 - DNA, 13 bp, Homo sapiens
agctccactctgc

SEQ ID NO: 3466051 - DNA, 19 bp, Homo sapiens
agctccactctgcttctct

SEQ ID NO: 3466052 - DNA, 22 bp, Homo sapiens
agctccactctgcttctctgac

SEQ ID NO: 3466053 - DNA, 24 bp, Homo sapiens
agctccactctgcttctctgactt

SEQ ID NO: 3466054 - DNA, 18 bp, Homo sapiens
agctcccaagggatggtg

SEQ ID NO: 3466055 - DNA, 15 bp, Homo sapiens
agctcccaggtgcag

SEQ ID NO: 3466056 - DNA, 13 bp, Homo sapiens
agctccccaggac

SEQ ID NO: 3466057 - DNA, 22 bp, Homo sapiens
agctccccaggactcaccctca

SEQ ID NO: 3466058 - DNA, 14 bp, Homo sapiens
agctccctggcttc

SEQ ID NO: 3466059 - DNA, 23 bp, Homo sapiens
agctccctggcttctgtggggcc

SEQ ID NO: 3466060 - DNA, 23 bp, Homo sapiens
agctccgctttctacccagcgag

SEQ ID NO: 3466061 - DNA, 18 bp, Homo sapiens
agctccggcctgctgtca

SEQ ID NO: 3466062 - DNA, 18 bp, Homo sapiens
agctcctcagcggctcca

SEQ ID NO: 3466063 - DNA, 15 bp, Homo sapiens
agctcctcatccagg

SEQ ID NO: 3466064 - DNA, 18 bp, Homo sapiens
agctcctcatccagggct

SEQ ID NO: 3466065 - DNA, 19 bp, Homo sapiens
agctcctcatccagggctc

SEQ ID NO: 3466066 - DNA, 23 bp, Homo sapiens
agctcctcctccctgcatctgac

SEQ ID NO: 3466067 - DNA, 21 bp, Homo sapiens
agctcctctccccagcccaga

SEQ ID NO: 3466068 - DNA, 24 bp, Homo sapiens
agctcctctccccagcccagagac

SEQ ID NO: 3466069 - DNA, 14 bp, Homo sapiens
agctcctgggcagc

SEQ ID NO: 3466070 - DNA, 19 bp, Homo sapiens
agctcctgtggccccaccc

SEQ ID NO: 3466071 - DNA, 13 bp, Homo sapiens
agctccttcctgg

SEQ ID NO: 3466072 - DNA, 15 bp, Homo sapiens
agctccttcctggag

SEQ ID NO: 3466073 - DNA, 19 bp, Homo sapiens
agctccttcctggagactg

SEQ ID NO: 3466074 - DNA, 13 bp, Homo sapiens
agctccttctgtc

SEQ ID NO: 3466075 - DNA, 15 bp, Homo sapiens
agctccttgggaggc

SEQ ID NO: 3466076 - DNA, 19 bp, Homo sapiens
agctccttgggaggcccca

SEQ ID NO: 3466077 - DNA, 15 bp, Homo sapiens
agctctcccctcaga

SEQ ID NO: 3466078 - DNA, 23 bp, Homo sapiens
agctctcggaactgcatgctgct

SEQ ID NO: 3466079 - DNA, 19 bp, Homo sapiens
agctctgaaaccagtgtta

SEQ ID NO: 3466080 - DNA, 18 bp, Homo sapiens
agctctggaggggagggg

SEQ ID NO: 3466081 - DNA, 20 bp, Homo sapiens
agctctggccccaggcttgt

SEQ ID NO: 3466082 - DNA, 14 bp, Homo sapiens
agctctgtcctggg

SEQ ID NO: 3466083 - DNA, 21 bp, Homo sapiens
agctctgtcctgggagtgagc

SEQ ID NO: 3466084 - DNA, 17 bp, Homo sapiens
agctctgtttataaaaa

SEQ ID NO: 3466085 - DNA, 19 bp, Homo sapiens
agctcttactctttcctat

SEQ ID NO: 3466086 - DNA, 19 bp, Homo sapiens
agctcttcatctgcccaac

SEQ ID NO: 3466087 - DNA, 23 bp, Homo sapiens
agctcttcatctgcccaactgtg

SEQ ID NO: 3466088 - DNA, 15 bp, Homo sapiens
agctcttctccaggc

SEQ ID NO: 3466089 - DNA, 18 bp, Homo sapiens
agctcttctccaggctgt

SEQ ID NO: 3466090 - DNA, 21 bp, Homo sapiens
agctcttctgccggccctggg

SEQ ID NO: 3466091 - DNA, 17 bp, Homo sapiens
agctcttgacagaaagc

SEQ ID NO: 3466092 - DNA, 19 bp, Homo sapiens
agctcttgacagaaagcag

SEQ ID NO: 3466093 - DNA, 13 bp, Homo sapiens
agctctttcctcc

SEQ ID NO: 3466094 - DNA, 22 bp, Homo sapiens
agctctttcctccttccatgga

SEQ ID NO: 3466095 - DNA, 14 bp, Homo sapiens
agctctttgagata

SEQ ID NO: 3466096 - DNA, 20 bp, Homo sapiens
agctgaaatatgctggctgg

SEQ ID NO: 3466097 - DNA, 22 bp, Homo sapiens
agctgaacaataggctgttccc

SEQ ID NO: 3466098 - DNA, 18 bp, Homo sapiens
agctgaatacattctgct

SEQ ID NO: 3466099 - DNA, 14 bp, Homo sapiens
agctgacacaaacc

SEQ ID NO: 3466100 - DNA, 22 bp, Homo sapiens
agctgaccagccgtgagcatgt

SEQ ID NO: 3466101 - DNA, 21 bp, Homo sapiens
agctgacttttctgtccgagc

SEQ ID NO: 3466102 - DNA, 16 bp, Homo sapiens
agctgagcaaatcacc

SEQ ID NO: 3466103 - DNA, 20 bp, Homo sapiens
agctgagcaaatcaccacaa

SEQ ID NO: 3466104 - DNA, 15 bp, Homo sapiens
agctgagcaccaggg

SEQ ID NO: 3466105 - DNA, 14 bp, Homo sapiens
agctgagcgccagg

SEQ ID NO: 3466106 - DNA, 17 bp, Homo sapiens
agctgagcgccaggatg

SEQ ID NO: 3466107 - DNA, 21 bp, Homo sapiens
agctgaggccacactcagcac

SEQ ID NO: 3466108 - DNA, 22 bp, Homo sapiens
agctgaggccacactcagcaca

SEQ ID NO: 3466109 - DNA, 21 bp, Homo sapiens
agctgatacaaattgcagact

SEQ ID NO: 3466110 - DNA, 11 bp, Homo sapiens
agctgcaaagt

SEQ ID NO: 3466111 - DNA, 14 bp, Homo sapiens
agctgcaaagtgtt

SEQ ID NO: 3466112 - DNA, 21 bp, Homo sapiens
actatgcatggtgccccagga

SEQ ID NO: 3466113 - DNA, 15 bp, Homo sapiens
actatggtatttgag

SEQ ID NO: 3466114 - DNA, 19 bp, Homo sapiens
actatgtctagagcctctt

SEQ ID NO: 3466115 - DNA, 15 bp, Homo sapiens
actatgttgcccagg

SEQ ID NO: 3466116 - DNA, 16 bp, Homo sapiens
actatgttgcccaggc

SEQ ID NO: 3466117 - DNA, 18 bp, Homo sapiens
actatgttgcccaggcag

SEQ ID NO: 3466118 - DNA, 20 bp, Homo sapiens
actatgttgcccaggcaggt

SEQ ID NO: 3466119 - DNA, 15 bp, Homo sapiens
actattgcattttac

SEQ ID NO: 3466120 - DNA, 13 bp, Homo sapiens
actattgcccagg

SEQ ID NO: 3466121 - DNA, 14 bp, Homo sapiens
actatttcggcctt

SEQ ID NO: 3466122 - DNA, 14 bp, Homo sapiens
actatttcttcaga

SEQ ID NO: 3466123 - DNA, 15 bp, Homo sapiens
actattttaatttgt

SEQ ID NO: 3466124 - DNA, 15 bp, Homo sapiens
actattttcaaagaa

SEQ ID NO: 3466125 - DNA, 12 bp, Homo sapiens
actattttcaga

SEQ ID NO: 3466126 - DNA, 18 bp, Homo sapiens
actcaaaagctgggcagg

SEQ ID NO: 3466127 - DNA, 16 bp, Homo sapiens
actcaaacttctggct

SEQ ID NO: 3466128 - DNA, 16 bp, Homo sapiens
actcaagaagcaggct

SEQ ID NO: 3466129 - DNA, 19 bp, Homo sapiens
actcaagccaagcagccaa

SEQ ID NO: 3466130 - DNA, 22 bp, Homo sapiens
actcaagccaagcagccaagct

SEQ ID NO: 3466131 - DNA, 21 bp, Homo sapiens
actcacaacctgaacctagga

SEQ ID NO: 3466132 - DNA, 19 bp, Homo sapiens
actcacatttattctgctc

SEQ ID NO: 3466133 - DNA, 20 bp, Homo sapiens
actcacatttattctgctca

SEQ ID NO: 3466134 - DNA, 15 bp, Homo sapiens
actcaccatctgtgc

SEQ ID NO: 3466135 - DNA, 22 bp, Homo sapiens
actcactggggcctacagcttt

SEQ ID NO: 3466136 - DNA, 13 bp, Homo sapiens
actcagaaagcca

SEQ ID NO: 3466137 - DNA, 16 bp, Homo sapiens
actcagaagacactga

SEQ ID NO: 3466138 - DNA, 17 bp, Homo sapiens
actcagaagacactgat

SEQ ID NO: 3466139 - DNA, 18 bp, Homo sapiens
actcagaagacactgatg

SEQ ID NO: 3466140 - DNA, 16 bp, Homo sapiens
actcagaagcctctgg

SEQ ID NO: 3466141 - DNA, 17 bp, Homo sapiens
actcagaagggagctag

SEQ ID NO: 3466142 - DNA, 17 bp, Homo sapiens
actcagggcagcgccag

SEQ ID NO: 3466143 - DNA, 22 bp, Homo sapiens
actcagttttaactagaattta

SEQ ID NO: 3466144 - DNA, 23 bp, Homo sapiens
actcataagttggaccagaggaa

SEQ ID NO: 3466145 - DNA, 15 bp, Homo sapiens
actcatacatctggc

SEQ ID NO: 3466146 - DNA, 13 bp, Homo sapiens
actcatcactgtg

SEQ ID NO: 3466147 - DNA, 12 bp, Homo sapiens
actcatcttagg

SEQ ID NO: 3466148 - DNA, 18 bp, Homo sapiens
actcattgctgagcctct

SEQ ID NO: 3466149 - DNA, 20 bp, Homo sapiens
actcattgctgagcctctgc

SEQ ID NO: 3466150 - DNA, 13 bp, Homo sapiens
actccaaagatga

SEQ ID NO: 3466151 - DNA, 14 bp, Homo sapiens
actccaaagatgac

SEQ ID NO: 3466152 - DNA, 23 bp, Homo sapiens
actccaaagatgacttcccctgc

SEQ ID NO: 3466153 - DNA, 19 bp, Homo sapiens
actccaggcccaaggctcc

SEQ ID NO: 3466154 - DNA, 21 bp, Homo sapiens
actccaggcccaaggctcccg

SEQ ID NO: 3466155 - DNA, 16 bp, Homo sapiens
actccagtcctgccac

SEQ ID NO: 3466156 - DNA, 20 bp, Homo sapiens
actcccattcctgaagaacc

SEQ ID NO: 3466157 - DNA, 22 bp, Homo sapiens
actcccattcctgaagaaccag

SEQ ID NO: 3466158 - DNA, 16 bp, Homo sapiens
actccctcctggagct

SEQ ID NO: 3466159 - DNA, 14 bp, Homo sapiens
actcccttgggctc

SEQ ID NO: 3466160 - DNA, 17 bp, Homo sapiens
actccctttttacactt

SEQ ID NO: 3466161 - DNA, 16 bp, Homo sapiens
actccgagtgaactgg

SEQ ID NO: 3466162 - DNA, 15 bp, Homo sapiens
actccggagacaggg

SEQ ID NO: 3466163 - DNA, 16 bp, Homo sapiens
actccggctgtgctgg

SEQ ID NO: 3466164 - DNA, 15 bp, Homo sapiens
actccgttggccact

SEQ ID NO: 3466165 - DNA, 21 bp, Homo sapiens
actccgttggccactccgaga

SEQ ID NO: 3466166 - DNA, 20 bp, Homo sapiens
actcctaggcaggacatgct

SEQ ID NO: 3466167 - DNA, 11 bp, Homo sapiens
actcctccctc

SEQ ID NO: 3466168 - DNA, 12 bp, Homo sapiens
actcctggcctc

SEQ ID NO: 3466169 - DNA, 13 bp, Homo sapiens
actcctggcctca

SEQ ID NO: 3466170 - DNA, 23 bp, Homo sapiens
actccttccagtgtccttagaac

SEQ ID NO: 3466171 - DNA, 19 bp, Homo sapiens
actccttccccacttctgt

SEQ ID NO: 3466172 - DNA, 14 bp, Homo sapiens
actccttcctggcc

SEQ ID NO: 3466173 - DNA, 15 bp, Homo sapiens
actccttcctggcct

SEQ ID NO: 3466174 - DNA, 19 bp, Homo sapiens
actccttcctggcctgaga

SEQ ID NO: 3466175 - DNA, 20 bp, Homo sapiens
actccttcctggcctgagag

SEQ ID NO: 3466176 - DNA, 16 bp, Homo sapiens
actccttctctcactg

SEQ ID NO: 3466177 - DNA, 16 bp, Homo sapiens
actccttctgttttga

SEQ ID NO: 3466178 - DNA, 23 bp, Homo sapiens
actccttctgttttgagttttgt

SEQ ID NO: 3466179 - DNA, 21 bp, Homo sapiens
actccttgagagaccaggcaa

SEQ ID NO: 3466180 - DNA, 23 bp, Homo sapiens
actccttgagagaccaggcaaag

SEQ ID NO: 3466181 - DNA, 13 bp, Homo sapiens
actcgagaacttt

SEQ ID NO: 3466182 - DNA, 17 bp, Homo sapiens
actctacaattcctctg

SEQ ID NO: 3466183 - DNA, 18 bp, Homo sapiens
actctaccctcttagaaa

SEQ ID NO: 3466184 - DNA, 16 bp, Homo sapiens
actctcagtctctgag

SEQ ID NO: 3466185 - DNA, 17 bp, Homo sapiens
actctcagtctctgagc

SEQ ID NO: 3466186 - DNA, 21 bp, Homo sapiens
actctccccacgagggctggc

SEQ ID NO: 3466187 - DNA, 14 bp, Homo sapiens
actctcccccaccc

SEQ ID NO: 3466188 - DNA, 15 bp, Homo sapiens
actctcctcatctct

SEQ ID NO: 3466189 - DNA, 17 bp, Homo sapiens
actctcgcatcttccca

SEQ ID NO: 3466190 - DNA, 18 bp, Homo sapiens
actctcgtgcatttcaac

SEQ ID NO: 3466191 - DNA, 19 bp, Homo sapiens
actctctgaacccctccct

SEQ ID NO: 3466192 - DNA, 17 bp, Homo sapiens
actctcttcttctcata

SEQ ID NO: 3466193 - DNA, 18 bp, Homo sapiens
actctgaaatatcccggg

SEQ ID NO: 3466194 - DNA, 14 bp, Homo sapiens
actctgatagaatt

SEQ ID NO: 3466195 - DNA, 13 bp, Homo sapiens
actctgccccccc

SEQ ID NO: 3466196 - DNA, 14 bp, Homo sapiens
actctgcctgcctg

SEQ ID NO: 3466197 - DNA, 15 bp, Homo sapiens
actctgcttctctga

SEQ ID NO: 3466198 - DNA, 17 bp, Homo sapiens
actctgcttctctgact

SEQ ID NO: 3466199 - DNA, 18 bp, Homo sapiens
actctgcttctctgactt

SEQ ID NO: 3466200 - DNA, 19 bp, Homo sapiens
actctggaagattttcatt

SEQ ID NO: 3466201 - DNA, 14 bp, Homo sapiens
actctggcaaagct

SEQ ID NO: 3466202 - DNA, 15 bp, Homo sapiens
actctggcaaagctt

SEQ ID NO: 3466203 - DNA, 17 bp, Homo sapiens
actctggcaaagctttt

SEQ ID NO: 3466204 - DNA, 14 bp, Homo sapiens
actctgggctccag

SEQ ID NO: 3466205 - DNA, 16 bp, Homo sapiens
actctgggctccagag

SEQ ID NO: 3466206 - DNA, 19 bp, Homo sapiens
actctgggtccttcctgaa

SEQ ID NO: 3466207 - DNA, 19 bp, Homo sapiens
actctggtggcacaggagt

SEQ ID NO: 3466208 - DNA, 19 bp, Homo sapiens
actctgtcgcccagtctgg

SEQ ID NO: 3466209 - DNA, 19 bp, Homo sapiens
actctgtctcaaaaaaaca

SEQ ID NO: 3466210 - DNA, 21 bp, Homo sapiens
actctgtgtcaggtggggcag

SEQ ID NO: 3466211 - DNA, 17 bp, Homo sapiens
actctgttccttcacat

SEQ ID NO: 3466212 - DNA, 22 bp, Homo sapiens
actctgttccttcacatcctgt

SEQ ID NO: 3466213 - DNA, 19 bp, Homo sapiens
actcttaggaagagaaacc

SEQ ID NO: 3466214 - DNA, 20 bp, Homo sapiens
actcttaggaagagaaacca

SEQ ID NO: 3466215 - DNA, 16 bp, Homo sapiens
actcttattgcccacg

SEQ ID NO: 3466216 - DNA, 15 bp, Homo sapiens
actcttcactcttca

SEQ ID NO: 3466217 - DNA, 17 bp, Homo sapiens
actcttcagttaattct

SEQ ID NO: 3466218 - DNA, 21 bp, Homo sapiens
actcttcagttaattcttaga

SEQ ID NO: 3466219 - DNA, 14 bp, Homo sapiens
actcttgacctcag

SEQ ID NO: 3466220 - DNA, 15 bp, Homo sapiens
actcttgacctcagg

SEQ ID NO: 3466221 - DNA, 17 bp, Homo sapiens
actctttatgcttgcaa

SEQ ID NO: 3466222 - DNA, 18 bp, Homo sapiens
actctttatgcttgcaaa

SEQ ID NO: 3466223 - DNA, 14 bp, Homo sapiens
actctttctgtata

SEQ ID NO: 3466224 - DNA, 18 bp, Homo sapiens
actctttgagaaacaaca

SEQ ID NO: 3466225 - DNA, 12 bp, Homo sapiens
actcttttgctt

SEQ ID NO: 3466226 - DNA, 20 bp, Homo sapiens
actcttttgctttattccag

SEQ ID NO: 3466227 - DNA, 15 bp, Homo sapiens
actgaaaacctctcc

SEQ ID NO: 3466228 - DNA, 19 bp, Homo sapiens
actgaacattagttgcact

SEQ ID NO: 3466229 - DNA, 22 bp, Homo sapiens
actgaactgtgtgtaattgttc

SEQ ID NO: 3466230 - DNA, 20 bp, Homo sapiens
actgaaggctaaaaagcaac

SEQ ID NO: 3466231 - DNA, 21 bp, Homo sapiens
actgaatgggatcatgaaagt

SEQ ID NO: 3466232 - DNA, 23 bp, Homo sapiens
actgacacaaaaagtagattaag

SEQ ID NO: 3466233 - DNA, 13 bp, Homo sapiens
actgaccctgggg

SEQ ID NO: 3466234 - DNA, 15 bp, Homo sapiens
actgaccctggggct

SEQ ID NO: 3466235 - DNA, 22 bp, Homo sapiens
actgacctggtccacagggcac

SEQ ID NO: 3466236 - DNA, 19 bp, Homo sapiens
actgagaatgtaagaacta

SEQ ID NO: 3466237 - DNA, 19 bp, Homo sapiens
actgagataccagcgagga

SEQ ID NO: 3466238 - DNA, 17 bp, Homo sapiens
actgagcttctctgtga

SEQ ID NO: 3466239 - DNA, 12 bp, Homo sapiens
actgaggcaggg

SEQ ID NO: 3466240 - DNA, 14 bp, Homo sapiens
actgaggcctgagc

SEQ ID NO: 3466241 - DNA, 23 bp, Homo sapiens
actgagggcagtcgatagagctg

SEQ ID NO: 3466242 - DNA, 22 bp, Homo sapiens
actgagtgaaggaagagagaca

SEQ ID NO: 3466243 - DNA, 15 bp, Homo sapiens
actgatcacaaaaac

SEQ ID NO: 3466244 - DNA, 23 bp, Homo sapiens
actgatgataggttaataaagat

SEQ ID NO: 3466245 - DNA, 24 bp, Homo sapiens
actgatgataggttaataaagatg

SEQ ID NO: 3466246 - DNA, 12 bp, Homo sapiens
actgatgggcaa

SEQ ID NO: 3466247 - DNA, 22 bp, Homo sapiens
actgatgggcaacccccagcct

SEQ ID NO: 3466248 - DNA, 13 bp, Homo sapiens
actgattaaatat

SEQ ID NO: 3466249 - DNA, 17 bp, Homo sapiens
actgattaaatatttga

SEQ ID NO: 3466250 - DNA, 22 bp, Homo sapiens
actgcaacctccgcctcttggg

SEQ ID NO: 3466251 - DNA, 16 bp, Homo sapiens
actgcaagaaaatgat

SEQ ID NO: 3466252 - DNA, 22 bp, Homo sapiens
actgcaagtccttttgtaaagt

SEQ ID NO: 3466253 - DNA, 16 bp, Homo sapiens
actgcacagcgtcctg

SEQ ID NO: 3466254 - DNA, 20 bp, Homo sapiens
actgcactatagcctaggtg

SEQ ID NO: 3466255 - DNA, 17 bp, Homo sapiens
actgcactccagcctgg

SEQ ID NO: 3466256 - DNA, 18 bp, Homo sapiens
actgcactccagcctggg

SEQ ID NO: 3466257 - DNA, 19 bp, Homo sapiens
actgcagaaaccctgagca

SEQ ID NO: 3466258 - DNA, 13 bp, Homo sapiens
actgcagaagcaa

SEQ ID NO: 3466259 - DNA, 13 bp, Homo sapiens
actgcagagcaga

SEQ ID NO: 3466260 - DNA, 19 bp, Homo sapiens
actgcagcctcaacctcct

SEQ ID NO: 3466261 - DNA, 21 bp, Homo sapiens
actgcagcctcaacctcctgg

SEQ ID NO: 3466262 - DNA, 22 bp, Homo sapiens
actgcagcctcaacctcctggg

SEQ ID NO: 3466263 - DNA, 19 bp, Homo sapiens
actgcaggcatcacagcta

SEQ ID NO: 3466264 - DNA, 23 bp, Homo sapiens
actgcattaccgcgttgtaaaat

SEQ ID NO: 3466265 - DNA, 15 bp, Homo sapiens
actgcattgagaact

SEQ ID NO: 3466266 - DNA, 12 bp, Homo sapiens
actgcattttag

SEQ ID NO: 3466267 - DNA, 18 bp, Homo sapiens
actgccaaaatgctctag

SEQ ID NO: 3466268 - DNA, 17 bp, Homo sapiens
actgccactccagtcct

SEQ ID NO: 3466269 - DNA, 18 bp, Homo sapiens
actgccactccagtcctg

SEQ ID NO: 3466270 - DNA, 19 bp, Homo sapiens
actgccactccagtcctgc

SEQ ID NO: 3466271 - DNA, 21 bp, Homo sapiens
actgccactccagtcctgcca

SEQ ID NO: 3466272 - DNA, 15 bp, Homo sapiens
actgccataaaacat

SEQ ID NO: 3466273 - DNA, 20 bp, Homo sapiens
actgccatgcaccaggactg

SEQ ID NO: 3466274 - DNA, 14 bp, Homo sapiens
actgccatgccagc

SEQ ID NO: 3466275 - DNA, 16 bp, Homo sapiens
actgcccatggacagg

SEQ ID NO: 3466276 - DNA, 19 bp, Homo sapiens
actgcccatggacaggctg

SEQ ID NO: 3466277 - DNA, 21 bp, Homo sapiens
actgcccatggacaggctggc

SEQ ID NO: 3466278 - DNA, 15 bp, Homo sapiens
actgcccggcagggt

SEQ ID NO: 3466279 - DNA, 18 bp, Homo sapiens
actgcctaaggccctttg

SEQ ID NO: 3466280 - DNA, 23 bp, Homo sapiens
actgccttaataaaaaatgaaaa

SEQ ID NO: 3466281 - DNA, 17 bp, Homo sapiens
actgccttcgcttcttg

SEQ ID NO: 3466282 - DNA, 22 bp, Homo sapiens
actgccttcgcttcttgcctct

SEQ ID NO: 3466283 - DNA, 13 bp, Homo sapiens
actgcctttagaa

SEQ ID NO: 3466284 - DNA, 19 bp, Homo sapiens
actgcctttagaaaatata

SEQ ID NO: 3466285 - DNA, 18 bp, Homo sapiens
actgcgactttctgcctg

SEQ ID NO: 3466286 - DNA, 23 bp, Homo sapiens
actgctacaaatactcttaggaa

SEQ ID NO: 3466287 - DNA, 12 bp, Homo sapiens
actgctctcagc

SEQ ID NO: 3466288 - DNA, 18 bp, Homo sapiens
actgctgagatacataca

SEQ ID NO: 3466289 - DNA, 22 bp, Homo sapiens
actgctgagatacatacagaat

SEQ ID NO: 3466290 - DNA, 15 bp, Homo sapiens
actgcttcatttttg

SEQ ID NO: 3466291 - DNA, 23 bp, Homo sapiens
actgcttcatttttgtaataaca

SEQ ID NO: 3466292 - DNA, 15 bp, Homo sapiens
actgcttgaggaaaa

SEQ ID NO: 3466293 - DNA, 18 bp, Homo sapiens
actgcttgaggaaaacaa

SEQ ID NO: 3466294 - DNA, 18 bp, Homo sapiens
actgcttggagctgagca

SEQ ID NO: 3466295 - DNA, 14 bp, Homo sapiens
actgcttttggcct

SEQ ID NO: 3466296 - DNA, 15 bp, Homo sapiens
actgcttttggtctg

SEQ ID NO: 3466297 - DNA, 15 bp, Homo sapiens
actggaagcacagct

SEQ ID NO: 3466298 - DNA, 16 bp, Homo sapiens
actggaagcacagctt

SEQ ID NO: 3466299 - DNA, 19 bp, Homo sapiens
actggaagcacagcttcat

SEQ ID NO: 3466300 - DNA, 19 bp, Homo sapiens
actggaagctaatttgcat

SEQ ID NO: 3466301 - DNA, 14 bp, Homo sapiens
actggacaaagaat

SEQ ID NO: 3466302 - DNA, 18 bp, Homo sapiens
actggactccggccctcc

SEQ ID NO: 3466303 - DNA, 18 bp, Homo sapiens
actggatgcagaaacagt

SEQ ID NO: 3466304 - DNA, 12 bp, Homo sapiens
actggcaaaagg

SEQ ID NO: 3466305 - DNA, 22 bp, Homo sapiens
actggcagttttccattggttt

SEQ ID NO: 3466306 - DNA, 22 bp, Homo sapiens
actggctgcaaagggtatcagg

SEQ ID NO: 3466307 - DNA, 21 bp, Homo sapiens
actggctgtgtgaccttaggc

SEQ ID NO: 3466308 - DNA, 17 bp, Homo sapiens
actgggatcacaggtgt

SEQ ID NO: 3466309 - DNA, 16 bp, Homo sapiens
actgggccctgagcca

SEQ ID NO: 3466310 - DNA, 17 bp, Homo sapiens
actggggattgggtggg

SEQ ID NO: 3466311 - DNA, 17 bp, Homo sapiens
actggggcctccagaac

SEQ ID NO: 3466312 - DNA, 23 bp, Homo sapiens
actgggtacttgtggacacagct

SEQ ID NO: 3466313 - DNA, 13 bp, Homo sapiens
actgggttgactt

SEQ ID NO: 3466314 - DNA, 20 bp, Homo sapiens
actgggtttctctgtatagt

SEQ ID NO: 3466315 - DNA, 18 bp, Homo sapiens
actggtattcctgcctcc

SEQ ID NO: 3466316 - DNA, 20 bp, Homo sapiens
actggtgcactttgtaaatt

SEQ ID NO: 3466317 - DNA, 21 bp, Homo sapiens
actggtgttatcaccgtgggc

SEQ ID NO: 3466318 - DNA, 19 bp, Homo sapiens
actggtgtttgaaagtagg

SEQ ID NO: 3466319 - DNA, 14 bp, Homo sapiens
actggtttctcaga

SEQ ID NO: 3466320 - DNA, 13 bp, Homo sapiens
actggtttgcagt

SEQ ID NO: 3466321 - DNA, 14 bp, Homo sapiens
actggttttcacat

SEQ ID NO: 3466322 - DNA, 17 bp, Homo sapiens
actgtaaatatgaatct

SEQ ID NO: 3466323 - DNA, 10 bp, Homo sapiens
actgtaacac

SEQ ID NO: 3466324 - DNA, 22 bp, Homo sapiens
actgtaactgtgtcatgattca

SEQ ID NO: 3466325 - DNA, 14 bp, Homo sapiens
actgtaagaataat

SEQ ID NO: 3466326 - DNA, 23 bp, Homo sapiens
actgtaagaataatttatagtaa

SEQ ID NO: 3466327 - DNA, 13 bp, Homo sapiens
actgtaagacatt

SEQ ID NO: 3466328 - DNA, 21 bp, Homo sapiens
actgtaagacgtatgtaacat

SEQ ID NO: 3466329 - DNA, 16 bp, Homo sapiens
actgtaataaagatga

SEQ ID NO: 3466330 - DNA, 13 bp, Homo sapiens
actgtagggaggg

SEQ ID NO: 3466331 - DNA, 23 bp, Homo sapiens
actgtatctaggcaacatagtat

SEQ ID NO: 3466332 - DNA, 16 bp, Homo sapiens
actgtatgttatagaa

SEQ ID NO: 3466333 - DNA, 21 bp, Homo sapiens
actgtatgttatagaacttca

SEQ ID NO: 3466334 - DNA, 20 bp, Homo sapiens
actgtcaaggctgcttagaa

SEQ ID NO: 3466335 - DNA, 21 bp, Homo sapiens
actgtcaaggctgcttagaat

SEQ ID NO: 3466336 - DNA, 14 bp, Homo sapiens
actgtcactcattg

SEQ ID NO: 3466337 - DNA, 15 bp, Homo sapiens
actgtcactcattgc

SEQ ID NO: 3466338 - DNA, 17 bp, Homo sapiens
actgtcctacccaccct

SEQ ID NO: 3466339 - DNA, 18 bp, Homo sapiens
actgtcctacccaccctc

SEQ ID NO: 3466340 - DNA, 18 bp, Homo sapiens
actgtcctccaagccagc

SEQ ID NO: 3466341 - DNA, 17 bp, Homo sapiens
actgtcctgggcctgca

SEQ ID NO: 3466342 - DNA, 14 bp, Homo sapiens
actgtcctttcctt

SEQ ID NO: 3466343 - DNA, 14 bp, Homo sapiens
actgtctctgcctc

SEQ ID NO: 3466344 - DNA, 16 bp, Homo sapiens
actgtctctgcctctt

SEQ ID NO: 3466345 - DNA, 12 bp, Homo sapiens
actgtcttcagt

SEQ ID NO: 3466346 - DNA, 17 bp, Homo sapiens
actgtctttaaaagaga

SEQ ID NO: 3466347 - DNA, 18 bp, Homo sapiens
actgtctttaaaagagag

SEQ ID NO: 3466348 - DNA, 15 bp, Homo sapiens
actgtgaaggaccct

SEQ ID NO: 3466349 - DNA, 16 bp, Homo sapiens
actgtgaaggaccctt

SEQ ID NO: 3466350 - DNA, 21 bp, Homo sapiens
actgtgagctcccaggtgcag

SEQ ID NO: 3466351 - DNA, 21 bp, Homo sapiens
actgtgatgaagccgacctta

SEQ ID NO: 3466352 - DNA, 15 bp, Homo sapiens
actgtgcacatctgt

SEQ ID NO: 3466353 - DNA, 21 bp, Homo sapiens
actgtgcacatctgtgtcttg

SEQ ID NO: 3466354 - DNA, 18 bp, Homo sapiens
actgtgcaccaagcagga

SEQ ID NO: 3466355 - DNA, 12 bp, Homo sapiens
actgtgccacaa

SEQ ID NO: 3466356 - DNA, 14 bp, Homo sapiens
actgtgggcaattt

SEQ ID NO: 3466357 - DNA, 20 bp, Homo sapiens
actgtgggcaatttagaaaa

SEQ ID NO: 3466358 - DNA, 18 bp, Homo sapiens
actgtgtgtgtgaatgaa

SEQ ID NO: 3466359 - DNA, 14 bp, Homo sapiens
actgtgtgttgcca

SEQ ID NO: 3466360 - DNA, 20 bp, Homo sapiens
actgtgtgttgccacaggac

SEQ ID NO: 3466361 - DNA, 21 bp, Homo sapiens
actgttaatagttcaggtaac

SEQ ID NO: 3466362 - DNA, 18 bp, Homo sapiens
actgttctgggactccag

SEQ ID NO: 3466363 - DNA, 17 bp, Homo sapiens
actgttgcaaagcttcc

SEQ ID NO: 3466364 - DNA, 22 bp, Homo sapiens
actgtttgtttttatttaaatt

SEQ ID NO: 3466365 - DNA, 18 bp, Homo sapiens
actgttttttggcttgct

SEQ ID NO: 3466366 - DNA, 13 bp, Homo sapiens
acttaaaagagct

SEQ ID NO: 3466367 - DNA, 15 bp, Homo sapiens
acttaacaaatacat

SEQ ID NO: 3466368 - DNA, 12 bp, Homo sapiens
acttaactgttt

SEQ ID NO: 3466369 - DNA, 13 bp, Homo sapiens
acttaagagaata

SEQ ID NO: 3466370 - DNA, 14 bp, Homo sapiens
acttaagcaaaaga

SEQ ID NO: 3466371 - DNA, 17 bp, Homo sapiens
acttaatactaccttga

SEQ ID NO: 3466372 - DNA, 18 bp, Homo sapiens
acttaatactaccttgaa

SEQ ID NO: 3466373 - DNA, 19 bp, Homo sapiens
acttaatactaccttgaaa

SEQ ID NO: 3466374 - DNA, 14 bp, Homo sapiens
acttaattgctttc

SEQ ID NO: 3466375 - DNA, 23 bp, Homo sapiens
acttacccaggtgggtcccggct

SEQ ID NO: 3466376 - DNA, 17 bp, Homo sapiens
acttactgtaagacatt

SEQ ID NO: 3466377 - DNA, 14 bp, Homo sapiens
acttacttgcttat

SEQ ID NO: 3466378 - DNA, 22 bp, Homo sapiens
acttagccatttttcaaagcaa

SEQ ID NO: 3466379 - DNA, 23 bp, Homo sapiens
acttagccatttttcaaagcaat

SEQ ID NO: 3466380 - DNA, 16 bp, Homo sapiens
acttagctagttttat

SEQ ID NO: 3466381 - DNA, 16 bp, Homo sapiens
acttagggcaccaggg

SEQ ID NO: 3466382 - DNA, 17 bp, Homo sapiens
acttagggtttggagct

SEQ ID NO: 3466383 - DNA, 15 bp, Homo sapiens
acttagtagattaaa

SEQ ID NO: 3466384 - DNA, 20 bp, Homo sapiens
acttagtagattaaaaatta

SEQ ID NO: 3466385 - DNA, 16 bp, Homo sapiens
agaacatgcagtttga

SEQ ID NO: 3466386 - DNA, 19 bp, Homo sapiens
agaacatgcagtttgaaat

SEQ ID NO: 3466387 - DNA, 13 bp, Homo sapiens
agaacatgtgaga

SEQ ID NO: 3466388 - DNA, 22 bp, Homo sapiens
agaacatgtgagaggtttgact

SEQ ID NO: 3466389 - DNA, 11 bp, Homo sapiens
agaacattgta

SEQ ID NO: 3466390 - DNA, 13 bp, Homo sapiens
agaacattttaat

SEQ ID NO: 3466391 - DNA, 13 bp, Homo sapiens
agaacattttact

SEQ ID NO: 3466392 - DNA, 14 bp, Homo sapiens
agaacattttactg

SEQ ID NO: 3466393 - DNA, 16 bp, Homo sapiens
agaacattttactgtt

SEQ ID NO: 3466394 - DNA, 19 bp, Homo sapiens
agaacattttactgttgta

SEQ ID NO: 3466395 - DNA, 13 bp, Homo sapiens
agaaccaaattaa

SEQ ID NO: 3466396 - DNA, 23 bp, Homo sapiens
agaaccactgacccaaatgaatt

SEQ ID NO: 3466397 - DNA, 20 bp, Homo sapiens
agaaccagtccccccaccct

SEQ ID NO: 3466398 - DNA, 16 bp, Homo sapiens
agaaccctgccatgga

SEQ ID NO: 3466399 - DNA, 22 bp, Homo sapiens
agaacctcacgcacctcccatc

SEQ ID NO: 3466400 - DNA, 21 bp, Homo sapiens
agaacctggaacttggggagt

SEQ ID NO: 3466401 - DNA, 20 bp, Homo sapiens
agaacggggctcttctcatt

SEQ ID NO: 3466402 - DNA, 16 bp, Homo sapiens
agaacgttttttcctc

SEQ ID NO: 3466403 - DNA, 12 bp, Homo sapiens
agaactaaactc

SEQ ID NO: 3466404 - DNA, 17 bp, Homo sapiens
agaactattttattcta

SEQ ID NO: 3466405 - DNA, 14 bp, Homo sapiens
agaactcactgggg

SEQ ID NO: 3466406 - DNA, 19 bp, Homo sapiens
agaactcactggggcctac

SEQ ID NO: 3466407 - DNA, 17 bp, Homo sapiens
agaactcagttttaact

SEQ ID NO: 3466408 - DNA, 19 bp, Homo sapiens
agaactcatcactgtggct

SEQ ID NO: 3466409 - DNA, 23 bp, Homo sapiens
agaactcatcactgtggctgtct

SEQ ID NO: 3466410 - DNA, 15 bp, Homo sapiens
agaactgcaggccct

SEQ ID NO: 3466411 - DNA, 18 bp, Homo sapiens
agaactgcaggccctggc

SEQ ID NO: 3466412 - DNA, 19 bp, Homo sapiens
agaactgcatatgtttcgc

SEQ ID NO: 3466413 - DNA, 14 bp, Homo sapiens
agaacttcatggat

SEQ ID NO: 3466414 - DNA, 18 bp, Homo sapiens
agaacttgcagtgtcttt

SEQ ID NO: 3466415 - DNA, 23 bp, Homo sapiens
agaacttggatgtacctgccccc

SEQ ID NO: 3466416 - DNA, 14 bp, Homo sapiens
agaactttattttg

SEQ ID NO: 3466417 - DNA, 17 bp, Homo sapiens
agaactttattttggat

SEQ ID NO: 3466418 - DNA, 15 bp, Homo sapiens
agaagaaaacatcta

SEQ ID NO: 3466419 - DNA, 23 bp, Homo sapiens
agaagaaaacatctattctctcc

SEQ ID NO: 3466420 - DNA, 22 bp, Homo sapiens
agaagaaaatggaaccaggctt

SEQ ID NO: 3466421 - DNA, 23 bp, Homo sapiens
agaagaaaatggaaccaggcttg

SEQ ID NO: 3466422 - DNA, 22 bp, Homo sapiens
agaagagaatattagctttact

SEQ ID NO: 3466423 - DNA, 18 bp, Homo sapiens
agaagagactctttgcat

SEQ ID NO: 3466424 - DNA, 15 bp, Homo sapiens
agaagagggtgtgtt

SEQ ID NO: 3466425 - DNA, 15 bp, Homo sapiens
agaagattaagacag

SEQ ID NO: 3466426 - DNA, 16 bp, Homo sapiens
agaagcagaggaagga

SEQ ID NO: 3466427 - DNA, 13 bp, Homo sapiens
agaagcaggaagg

SEQ ID NO: 3466428 - DNA, 17 bp, Homo sapiens
agaagccacaggcctga

SEQ ID NO: 3466429 - DNA, 21 bp, Homo sapiens
agaagccacaggcctgagatt

SEQ ID NO: 3466430 - DNA, 22 bp, Homo sapiens
agaagccatggaaaaacttcct

SEQ ID NO: 3466431 - DNA, 14 bp, Homo sapiens
agaagcccccagct

SEQ ID NO: 3466432 - DNA, 24 bp, Homo sapiens
agaagcccccagctaagaacctgg

SEQ ID NO: 3466433 - DNA, 23 bp, Homo sapiens
agaagcctctgggtcagtggtcc

SEQ ID NO: 3466434 - DNA, 17 bp, Homo sapiens
agaagcctgatgctgac

SEQ ID NO: 3466435 - DNA, 14 bp, Homo sapiens
agaagctcctctcc

SEQ ID NO: 3466436 - DNA, 18 bp, Homo sapiens
agaagctcctctccccag

SEQ ID NO: 3466437 - DNA, 23 bp, Homo sapiens
agaagctctggccccaggcttgt

SEQ ID NO: 3466438 - DNA, 15 bp, Homo sapiens
agaagctgagcacca

SEQ ID NO: 3466439 - DNA, 20 bp, Homo sapiens
agaagctgagcaccagggga

SEQ ID NO: 3466440 - DNA, 22 bp, Homo sapiens
agaagcttttgaataaaaactt

SEQ ID NO: 3466441 - DNA, 16 bp, Homo sapiens
agaaggaaaaatgtgt

SEQ ID NO: 3466442 - DNA, 18 bp, Homo sapiens
agaaggaaaaatgtgtaa

SEQ ID NO: 3466443 - DNA, 17 bp, Homo sapiens
agaaggatgtacatttc

SEQ ID NO: 3466444 - DNA, 15 bp, Homo sapiens
agaaggccgctgccc

SEQ ID NO: 3466445 - DNA, 22 bp, Homo sapiens
agaaggctatgtaaacaaacca

SEQ ID NO: 3466446 - DNA, 18 bp, Homo sapiens
agaagggaatcctcctcc

SEQ ID NO: 3466447 - DNA, 21 bp, Homo sapiens
agaagggctgaaccctcagcc

SEQ ID NO: 3466448 - DNA, 16 bp, Homo sapiens
agaagggctgcatgat

SEQ ID NO: 3466449 - DNA, 20 bp, Homo sapiens
agaagggctgcatgatgttt

SEQ ID NO: 3466450 - DNA, 20 bp, Homo sapiens
agaagggggtggtgtctcca

SEQ ID NO: 3466451 - DNA, 14 bp, Homo sapiens
agaaggtgcctgcc

SEQ ID NO: 3466452 - DNA, 22 bp, Homo sapiens
agaaggtgggttttcatcaaga

SEQ ID NO: 3466453 - DNA, 14 bp, Homo sapiens
agaagtaacttact

SEQ ID NO: 3466454 - DNA, 14 bp, Homo sapiens
agaagtcaaagtaa

SEQ ID NO: 3466455 - DNA, 15 bp, Homo sapiens
agaagtccttatgtt

SEQ ID NO: 3466456 - DNA, 18 bp, Homo sapiens
agaagtctggtcagagcc

SEQ ID NO: 3466457 - DNA, 14 bp, Homo sapiens
agaagtctttcaga

SEQ ID NO: 3466458 - DNA, 15 bp, Homo sapiens
agaagtctttcagat

SEQ ID NO: 3466459 - DNA, 17 bp, Homo sapiens
agaagtctttcagatga

SEQ ID NO: 3466460 - DNA, 17 bp, Homo sapiens
agaagtgaatgctggga

SEQ ID NO: 3466461 - DNA, 18 bp, Homo sapiens
agaagtgagaataggcag

SEQ ID NO: 3466462 - DNA, 17 bp, Homo sapiens
agaagtgagtgtttcta

SEQ ID NO: 3466463 - DNA, 15 bp, Homo sapiens
agaagtgccatctca

SEQ ID NO: 3466464 - DNA, 18 bp, Homo sapiens
agaagttgatatagaaca

SEQ ID NO: 3466465 - DNA, 13 bp, Homo sapiens
agaagtttgcact

SEQ ID NO: 3466466 - DNA, 16 bp, Homo sapiens
agaagtttgcactatc

SEQ ID NO: 3466467 - DNA, 16 bp, Homo sapiens
agaagttttaaatttt

SEQ ID NO: 3466468 - DNA, 16 bp, Homo sapiens
agaataacctttcaga

SEQ ID NO: 3466469 - DNA, 19 bp, Homo sapiens
agaatagccacatttggaa

SEQ ID NO: 3466470 - DNA, 16 bp, Homo sapiens
agaatatagcatcttt

SEQ ID NO: 3466471 - DNA, 18 bp, Homo sapiens
agaatatagcatctttca

SEQ ID NO: 3466472 - DNA, 21 bp, Homo sapiens
agaatatagcatctttcatat

SEQ ID NO: 3466473 - DNA, 22 bp, Homo sapiens
agaatatgaatgagaatgtgcc

SEQ ID NO: 3466474 - DNA, 19 bp, Homo sapiens
agaatatttattacctctg

SEQ ID NO: 3466475 - DNA, 19 bp, Homo sapiens
agaatatttctattgaatt

SEQ ID NO: 3466476 - DNA, 20 bp, Homo sapiens
agaatattttaagtattgca

SEQ ID NO: 3466477 - DNA, 12 bp, Homo sapiens
agaatccaaact

SEQ ID NO: 3466478 - DNA, 16 bp, Homo sapiens
agaatccaaacttgga

SEQ ID NO: 3466479 - DNA, 20 bp, Homo sapiens
agaatccagcaccggcccca

SEQ ID NO: 3466480 - DNA, 18 bp, Homo sapiens
agaatcccaaatttgatt

SEQ ID NO: 3466481 - DNA, 16 bp, Homo sapiens
agaatccctagacttt

SEQ ID NO: 3466482 - DNA, 17 bp, Homo sapiens
agaatctcattactgct

SEQ ID NO: 3466483 - DNA, 23 bp, Homo sapiens
agaatctcattactgcttcattt

SEQ ID NO: 3466484 - DNA, 16 bp, Homo sapiens
agaatctttattgaga

SEQ ID NO: 3466485 - DNA, 21 bp, Homo sapiens
agaatctttattgagaaagag

SEQ ID NO: 3466486 - DNA, 15 bp, Homo sapiens
agaatgaaatgtatg

SEQ ID NO: 3466487 - DNA, 17 bp, Homo sapiens
agaatgagagcgacaca

SEQ ID NO: 3466488 - DNA, 18 bp, Homo sapiens
agaatgagagcgacacag

SEQ ID NO: 3466489 - DNA, 21 bp, Homo sapiens
agaatgagagcgacacagacg

SEQ ID NO: 3466490 - DNA, 13 bp, Homo sapiens
agaatgctgtaca

SEQ ID NO: 3466491 - DNA, 14 bp, Homo sapiens
agaatgctgtacat

SEQ ID NO: 3466492 - DNA, 20 bp, Homo sapiens
agaatgctgtacatctattt

SEQ ID NO: 3466493 - DNA, 15 bp, Homo sapiens
agaatgtaagaacta

SEQ ID NO: 3466494 - DNA, 14 bp, Homo sapiens
agaatgtgccatgt

SEQ ID NO: 3466495 - DNA, 19 bp, Homo sapiens
agaatgtgtttcaaaacca

SEQ ID NO: 3466496 - DNA, 17 bp, Homo sapiens
agaattactgagttttt

SEQ ID NO: 3466497 - DNA, 13 bp, Homo sapiens
agacacaggccct

SEQ ID NO: 3466498 - DNA, 21 bp, Homo sapiens
agacacatgctatgttctgtc

SEQ ID NO: 3466499 - DNA, 15 bp, Homo sapiens
agacacccaggactt

SEQ ID NO: 3466500 - DNA, 16 bp, Homo sapiens
agacacccaggactta

SEQ ID NO: 3466501 - DNA, 19 bp, Homo sapiens
agacaccctcaacctcttc

SEQ ID NO: 3466502 - DNA, 17 bp, Homo sapiens
agacaccttgacagggc

SEQ ID NO: 3466503 - DNA, 20 bp, Homo sapiens
agacacggatctgagaatct

SEQ ID NO: 3466504 - DNA, 15 bp, Homo sapiens
agacagaccctctgc

SEQ ID NO: 3466505 - DNA, 19 bp, Homo sapiens
agacagagaatatgtctgc

SEQ ID NO: 3466506 - DNA, 21 bp, Homo sapiens
agacagagacctcctgcctcc

SEQ ID NO: 3466507 - DNA, 18 bp, Homo sapiens
agacagccaaaggctggc

SEQ ID NO: 3466508 - DNA, 17 bp, Homo sapiens
agacagctccaccctgg

SEQ ID NO: 3466509 - DNA, 20 bp, Homo sapiens
agacaggcaagcacctcctg

SEQ ID NO: 3466510 - DNA, 16 bp, Homo sapiens
agacagggtttggctg

SEQ ID NO: 3466511 - DNA, 17 bp, Homo sapiens
agacaggtggaaaaact

SEQ ID NO: 3466512 - DNA, 17 bp, Homo sapiens
agacagtccagcctgga

SEQ ID NO: 3466513 - DNA, 16 bp, Homo sapiens
agacagttttgagaac

SEQ ID NO: 3466514 - DNA, 16 bp, Homo sapiens
agacatacttgaaggg

SEQ ID NO: 3466515 - DNA, 19 bp, Homo sapiens
agacatacttgaagggcca

SEQ ID NO: 3466516 - DNA, 20 bp, Homo sapiens
agacatacttgaagggccag

SEQ ID NO: 3466517 - DNA, 23 bp, Homo sapiens
agacatacttgaagggccagagc

SEQ ID NO: 3466518 - DNA, 15 bp, Homo sapiens
agacatatttaactg

SEQ ID NO: 3466519 - DNA, 12 bp, Homo sapiens
agacatctgtag

SEQ ID NO: 3466520 - DNA, 13 bp, Homo sapiens
agacatctttctc

SEQ ID NO: 3466521 - DNA, 22 bp, Homo sapiens
agacatgatttccttgaatgtg

SEQ ID NO: 3466522 - DNA, 18 bp, Homo sapiens
agacatgttttccgtgaa

SEQ ID NO: 3466523 - DNA, 15 bp, Homo sapiens
agacattggcaccta

SEQ ID NO: 3466524 - DNA, 14 bp, Homo sapiens
agacattttctttt

SEQ ID NO: 3466525 - DNA, 16 bp, Homo sapiens
agaccaccacttcgaa

SEQ ID NO: 3466526 - DNA, 21 bp, Homo sapiens
agaccacgcccgtcctgcctg

SEQ ID NO: 3466527 - DNA, 13 bp, Homo sapiens
agaccagcctggc

SEQ ID NO: 3466528 - DNA, 15 bp, Homo sapiens
agaccagcctggcca

SEQ ID NO: 3466529 - DNA, 22 bp, Homo sapiens
agaccagcctggccagtatggt

SEQ ID NO: 3466530 - DNA, 13 bp, Homo sapiens
agaccagctcttc

SEQ ID NO: 3466531 - DNA, 17 bp, Homo sapiens
agaccaggcaaagcaag

SEQ ID NO: 3466532 - DNA, 17 bp, Homo sapiens
agacccagatctcatgg

SEQ ID NO: 3466533 - DNA, 17 bp, Homo sapiens
agacccagccctcatcc

SEQ ID NO: 3466534 - DNA, 19 bp, Homo sapiens
agacccagccctcatcccg

SEQ ID NO: 3466535 - DNA, 18 bp, Homo sapiens
agacctaatgctccttgt

SEQ ID NO: 3466536 - DNA, 19 bp, Homo sapiens
agacctgatcctggaggcc

SEQ ID NO: 3466537 - DNA, 21 bp, Homo sapiens
agacctgatcctggaggccca

SEQ ID NO: 3466538 - DNA, 22 bp, Homo sapiens
agacctgatcctggaggcccag

SEQ ID NO: 3466539 - DNA, 16 bp, Homo sapiens
agacctggcagctctg

SEQ ID NO: 3466540 - DNA, 18 bp, Homo sapiens
agacctggcagctctgga

SEQ ID NO: 3466541 - DNA, 15 bp, Homo sapiens
agacctgtcaccctg

SEQ ID NO: 3466542 - DNA, 13 bp, Homo sapiens
agaccttcacaga

SEQ ID NO: 3466543 - DNA, 16 bp, Homo sapiens
agaccttcacagatgc

SEQ ID NO: 3466544 - DNA, 20 bp, Homo sapiens
agaccttttttttttttcca

SEQ ID NO: 3466545 - DNA, 21 bp, Homo sapiens
agaccttttttttttttccaa

SEQ ID NO: 3466546 - DNA, 15 bp, Homo sapiens
agacgcctgaggaac

SEQ ID NO: 3466547 - DNA, 18 bp, Homo sapiens
agacggagtcccaccttg

SEQ ID NO: 3466548 - DNA, 21 bp, Homo sapiens
agacggtgttttgccatgttg

SEQ ID NO: 3466549 - DNA, 15 bp, Homo sapiens
agactatcagcccaa

SEQ ID NO: 3466550 - DNA, 13 bp, Homo sapiens
agactcaaatgct

SEQ ID NO: 3466551 - DNA, 15 bp, Homo sapiens
agactcattcttctg

SEQ ID NO: 3466552 - DNA, 17 bp, Homo sapiens
agactcattcttctgta

SEQ ID NO: 3466553 - DNA, 17 bp, Homo sapiens
agactcccattcctgaa

SEQ ID NO: 3466554 - DNA, 15 bp, Homo sapiens
agactcgagaacttt

SEQ ID NO: 3466555 - DNA, 20 bp, Homo sapiens
agactcgattcatattgaat

SEQ ID NO: 3466556 - DNA, 14 bp, Homo sapiens
agactcggggtgct

SEQ ID NO: 3466557 - DNA, 19 bp, Homo sapiens
agactctacagaggccatg

SEQ ID NO: 3466558 - DNA, 20 bp, Homo sapiens
agactctcgcatcttcccaa

SEQ ID NO: 3466559 - DNA, 18 bp, Homo sapiens
agactctgtctcaaaaaa

SEQ ID NO: 3466560 - DNA, 14 bp, Homo sapiens
agactctttatgct

SEQ ID NO: 3466561 - DNA, 17 bp, Homo sapiens
agactgatcaggacctc

SEQ ID NO: 3466562 - DNA, 17 bp, Homo sapiens
agactgcatctcaaaaa

SEQ ID NO: 3466563 - DNA, 17 bp, Homo sapiens
agactggaagcacagct

SEQ ID NO: 3466564 - DNA, 19 bp, Homo sapiens
agactggaagcacagcttc

SEQ ID NO: 3466565 - DNA, 21 bp, Homo sapiens
agactggaagctaatttgcat

SEQ ID NO: 3466566 - DNA, 11 bp, Homo sapiens
agactggaagg

SEQ ID NO: 3466567 - DNA, 21 bp, Homo sapiens
agactggactggaccagacaa

SEQ ID NO: 3466568 - DNA, 16 bp, Homo sapiens
agactgggctgaggga

SEQ ID NO: 3466569 - DNA, 20 bp, Homo sapiens
agactgtgaacagcttgctg

SEQ ID NO: 3466570 - DNA, 23 bp, Homo sapiens
agacttaatagaaacattgaaga

SEQ ID NO: 3466571 - DNA, 17 bp, Homo sapiens
agacttagggcaccagg

SEQ ID NO: 3466572 - DNA, 16 bp, Homo sapiens
agacttccttgagaca

SEQ ID NO: 3466573 - DNA, 17 bp, Homo sapiens
agactttaggctttcag

SEQ ID NO: 3466574 - DNA, 20 bp, Homo sapiens
agactttaggctttcagctt

SEQ ID NO: 3466575 - DNA, 22 bp, Homo sapiens
agactttaggctttcagcttac

SEQ ID NO: 3466576 - DNA, 21 bp, Homo sapiens
agactttggaaaatgcattgt

SEQ ID NO: 3466577 - DNA, 22 bp, Homo sapiens
agactttggaaaatgcattgta

SEQ ID NO: 3466578 - DNA, 23 bp, Homo sapiens
agactttggaaaatgcattgtat

SEQ ID NO: 3466579 - DNA, 18 bp, Homo sapiens
agagaaaaaaaaaatagt

SEQ ID NO: 3466580 - DNA, 22 bp, Homo sapiens
agagaaaaaagtcaccattctg

SEQ ID NO: 3466581 - DNA, 13 bp, Homo sapiens
agagaaaaacaaa

SEQ ID NO: 3466582 - DNA, 12 bp, Homo sapiens
agagaaaaagag

SEQ ID NO: 3466583 - DNA, 12 bp, Homo sapiens
agagaaaatata

SEQ ID NO: 3466584 - DNA, 15 bp, Homo sapiens
agagaaaatatatgt

SEQ ID NO: 3466585 - DNA, 13 bp, Homo sapiens
agagaaacagaca

SEQ ID NO: 3466586 - DNA, 23 bp, Homo sapiens
agagaaaggggagcccactgtcc

SEQ ID NO: 3466587 - DNA, 14 bp, Homo sapiens
agagaaatatggaa

SEQ ID NO: 3466588 - DNA, 22 bp, Homo sapiens
agagaacctcacgcacctccca

SEQ ID NO: 3466589 - DNA, 14 bp, Homo sapiens
agagaactttattt

SEQ ID NO: 3466590 - DNA, 16 bp, Homo sapiens
agagaactttattttg

SEQ ID NO: 3466591 - DNA, 21 bp, Homo sapiens
agagaagagattgtggtttca

SEQ ID NO: 3466592 - DNA, 15 bp, Homo sapiens
agagaatatgtctgc

SEQ ID NO: 3466593 - DNA, 14 bp, Homo sapiens
agagaatgagaaat

SEQ ID NO: 3466594 - DNA, 16 bp, Homo sapiens
agagaatgatgctcaa

SEQ ID NO: 3466595 - DNA, 16 bp, Homo sapiens
agagacggtgtcttgt

SEQ ID NO: 3466596 - DNA, 22 bp, Homo sapiens
agagactccttgagagaccagg

SEQ ID NO: 3466597 - DNA, 13 bp, Homo sapiens
agagagaaaaaca

SEQ ID NO: 3466598 - DNA, 14 bp, Homo sapiens
agagagaatgagag

SEQ ID NO: 3466599 - DNA, 12 bp, Homo sapiens
agagagagaaaa

SEQ ID NO: 3466600 - DNA, 14 bp, Homo sapiens
agagagagagaaaa

SEQ ID NO: 3466601 - DNA, 18 bp, Homo sapiens
agagagccttgggagcca

SEQ ID NO: 3466602 - DNA, 18 bp, Homo sapiens
agagagcttaatgataat

SEQ ID NO: 3466603 - DNA, 15 bp, Homo sapiens
agagaggcaatggct

SEQ ID NO: 3466604 - DNA, 14 bp, Homo sapiens
agagagggcaggca

SEQ ID NO: 3466605 - DNA, 20 bp, Homo sapiens
agagagggtggtgacctctg

SEQ ID NO: 3466606 - DNA, 22 bp, Homo sapiens
agagagggtggtgacctctgcc

SEQ ID NO: 3466607 - DNA, 23 bp, Homo sapiens
agagagggtggtgacctctgcct

SEQ ID NO: 3466608 - DNA, 15 bp, Homo sapiens
agagatagcctgtgg

SEQ ID NO: 3466609 - DNA, 16 bp, Homo sapiens
agagatagcctgtggc

SEQ ID NO: 3466610 - DNA, 17 bp, Homo sapiens
agagatagcctgtggcc

SEQ ID NO: 3466611 - DNA, 15 bp, Homo sapiens
agagatattttgggc

SEQ ID NO: 3466612 - DNA, 23 bp, Homo sapiens
agagatattttgggcatgtgggc

SEQ ID NO: 3466613 - DNA, 21 bp, Homo sapiens
agagatcccaagtagaatctc

SEQ ID NO: 3466614 - DNA, 18 bp, Homo sapiens
agagatggacagagaact

SEQ ID NO: 3466615 - DNA, 15 bp, Homo sapiens
agagattcattttct

SEQ ID NO: 3466616 - DNA, 21 bp, Homo sapiens
agagattggaatgggcagctc

SEQ ID NO: 3466617 - DNA, 12 bp, Homo sapiens
agagcactgcca

SEQ ID NO: 3466618 - DNA, 14 bp, Homo sapiens
agagcactgccacc

SEQ ID NO: 3466619 - DNA, 20 bp, Homo sapiens
agagcacttaagagaatatt

SEQ ID NO: 3466620 - DNA, 22 bp, Homo sapiens
agagcacttaagagaatatttt

SEQ ID NO: 3466621 - DNA, 15 bp, Homo sapiens
agagcaggactccag

SEQ ID NO: 3466622 - DNA, 16 bp, Homo sapiens
agagcagggggaccta

SEQ ID NO: 3466623 - DNA, 16 bp, Homo sapiens
agagcatcggcctagg

SEQ ID NO: 3466624 - DNA, 17 bp, Homo sapiens
agagcattttttatgat

SEQ ID NO: 3466625 - DNA, 16 bp, Homo sapiens
agagccacagggtctg

SEQ ID NO: 3466626 - DNA, 22 bp, Homo sapiens
agagccacagggtctgcctcca

SEQ ID NO: 3466627 - DNA, 19 bp, Homo sapiens
agagcccaccttggctcaa

SEQ ID NO: 3466628 - DNA, 12 bp, Homo sapiens
agagcccagctc

SEQ ID NO: 3466629 - DNA, 16 bp, Homo sapiens
agagcccggagctccg

SEQ ID NO: 3466630 - DNA, 18 bp, Homo sapiens
agagcccggagctccggc

SEQ ID NO: 3466631 - DNA, 16 bp, Homo sapiens
agagccgtggtccctg

SEQ ID NO: 3466632 - DNA, 15 bp, Homo sapiens
agagcctcagtgagc

SEQ ID NO: 3466633 - DNA, 11 bp, Homo sapiens
agagcctgagg

SEQ ID NO: 3466634 - DNA, 16 bp, Homo sapiens
agagcctggtgctgct

SEQ ID NO: 3466635 - DNA, 18 bp, Homo sapiens
agagcctggtgctgctgc

SEQ ID NO: 3466636 - DNA, 13 bp, Homo sapiens
agagcctgtcttt

SEQ ID NO: 3466637 - DNA, 19 bp, Homo sapiens
agagcctttcctcaaaact

SEQ ID NO: 3466638 - DNA, 14 bp, Homo sapiens
agagcgacacagac

SEQ ID NO: 3466639 - DNA, 21 bp, Homo sapiens
agagcgcctgcccctcccaga

SEQ ID NO: 3466640 - DNA, 23 bp, Homo sapiens
agagcgcctgcccctcccagaac

SEQ ID NO: 3466641 - DNA, 20 bp, Homo sapiens
agagctaaactccttcctgg

SEQ ID NO: 3466642 - DNA, 20 bp, Homo sapiens
agagctagcagcagggaggg

SEQ ID NO: 3466643 - DNA, 18 bp, Homo sapiens
agagctgacacaaacctg

SEQ ID NO: 3466644 - DNA, 23 bp, Homo sapiens
agagctgacacaggatgaaggca

SEQ ID NO: 3466645 - DNA, 18 bp, Homo sapiens
agagctggagcctggtgc

SEQ ID NO: 3466646 - DNA, 21 bp, Homo sapiens
agagcttaatgataatattgt

SEQ ID NO: 3466647 - DNA, 13 bp, Homo sapiens
agagcttccctga

SEQ ID NO: 3466648 - DNA, 22 bp, Homo sapiens
agagcttcttccaggtgcccag

SEQ ID NO: 3466649 - DNA, 14 bp, Homo sapiens
agagcttggactgg

SEQ ID NO: 3466650 - DNA, 22 bp, Homo sapiens
agagctttcttcccgaacccca

SEQ ID NO: 3466651 - DNA, 19 bp, Homo sapiens
agaggaaatattgctgggg

SEQ ID NO: 3466652 - DNA, 14 bp, Homo sapiens
agaggaaccaaccc

SEQ ID NO: 3466653 - DNA, 13 bp, Homo sapiens
agaggaagagaca

SEQ ID NO: 3466654 - DNA, 15 bp, Homo sapiens
agaggaaggggccag

SEQ ID NO: 3466655 - DNA, 18 bp, Homo sapiens
agaggaaggggccagagg

SEQ ID NO: 3466656 - DNA, 20 bp, Homo sapiens
agaggaaggggccagaggct

SEQ ID NO: 3466657 - DNA, 23 bp, Homo sapiens
agaggaaggggccagaggctcgt

SEQ ID NO: 3466658 - DNA, 22 bp, Homo sapiens
agaggacttcggggtagaggct

SEQ ID NO: 3466659 - DNA, 13 bp, Homo sapiens
agaggagaggggc

SEQ ID NO: 3466660 - DNA, 20 bp, Homo sapiens
agaggaggatgtaaggcctt

SEQ ID NO: 3466661 - DNA, 22 bp, Homo sapiens
agaggaggggccgctgccaccc

SEQ ID NO: 3466662 - DNA, 20 bp, Homo sapiens
agaggatgagctctacccag

SEQ ID NO: 3466663 - DNA, 18 bp, Homo sapiens
agaggcaatggctccttc

SEQ ID NO: 3466664 - DNA, 13 bp, Homo sapiens
agaggcagcccca

SEQ ID NO: 3466665 - DNA, 21 bp, Homo sapiens
agaggcagggtctcactctgt

SEQ ID NO: 3466666 - DNA, 19 bp, Homo sapiens
agaggccaacactgtgggt

SEQ ID NO: 3466667 - DNA, 15 bp, Homo sapiens
agaggccccagcctc

SEQ ID NO: 3466668 - DNA, 14 bp, Homo sapiens
agaggcccccagcc

SEQ ID NO: 3466669 - DNA, 19 bp, Homo sapiens
agaggccctcgctgccagc

SEQ ID NO: 3466670 - DNA, 14 bp, Homo sapiens
agaggccctctgga

SEQ ID NO: 3466671 - DNA, 20 bp, Homo sapiens
agaggcctcttttcctgaag

SEQ ID NO: 3466672 - DNA, 22 bp, Homo sapiens
agaggcctcttttcctgaagaa

SEQ ID NO: 3466673 - DNA, 22 bp, Homo sapiens
agaggcctgcctccagggctgg

SEQ ID NO: 3466674 - DNA, 21 bp, Homo sapiens
agaggctaaattactcaggaa

SEQ ID NO: 3466675 - DNA, 16 bp, Homo sapiens
agaggctcatggccct

SEQ ID NO: 3466676 - DNA, 22 bp, Homo sapiens
agaggctcatggccctgtagtt

SEQ ID NO: 3466677 - DNA, 14 bp, Homo sapiens
agaggctgcacttg

SEQ ID NO: 3466678 - DNA, 18 bp, Homo sapiens
agaggctgggaggagccc

SEQ ID NO: 3466679 - DNA, 23 bp, Homo sapiens
agaggctgggaggagcccctgga

SEQ ID NO: 3466680 - DNA, 14 bp, Homo sapiens
agagggaagaaaag

SEQ ID NO: 3466681 - DNA, 23 bp, Homo sapiens
agagggaagaaaagagctttctt

SEQ ID NO: 3466682 - DNA, 21 bp, Homo sapiens
agagggacgcctgggggtgcc

SEQ ID NO: 3466683 - DNA, 17 bp, Homo sapiens
agagggaggcaagccct

SEQ ID NO: 3466684 - DNA, 18 bp, Homo sapiens
agagggaggcaagccctg

SEQ ID NO: 3466685 - DNA, 18 bp, Homo sapiens
agagggcaaacccaaaac

SEQ ID NO: 3466686 - DNA, 21 bp, Homo sapiens
agagggcaaacccaaaacctc

SEQ ID NO: 3466687 - DNA, 23 bp, Homo sapiens
agagggtggtgacctctgcctga

SEQ ID NO: 3466688 - DNA, 13 bp, Homo sapiens
agaggtctccaaa

SEQ ID NO: 3466689 - DNA, 23 bp, Homo sapiens
agaggtctccaaactgattaaat

SEQ ID NO: 3466690 - DNA, 13 bp, Homo sapiens
agaggtgcttcac

SEQ ID NO: 3466691 - DNA, 16 bp, Homo sapiens
agagtagaattgcatt

SEQ ID NO: 3466692 - DNA, 14 bp, Homo sapiens
agagtagttatata

SEQ ID NO: 3466693 - DNA, 23 bp, Homo sapiens
agagtagttatataattgttgaa

SEQ ID NO: 3466694 - DNA, 14 bp, Homo sapiens
agagtatggagctc

SEQ ID NO: 3466695 - DNA, 15 bp, Homo sapiens
agagtcagctctctg

SEQ ID NO: 3466696 - DNA, 17 bp, Homo sapiens
agagtcagctctctgcc

SEQ ID NO: 3466697 - DNA, 21 bp, Homo sapiens
agagtcagctctctgccctgt

SEQ ID NO: 3466698 - DNA, 21 bp, Homo sapiens
agagtccaggaggccctggtc

SEQ ID NO: 3466699 - DNA, 14 bp, Homo sapiens
agagtcctctgaat

SEQ ID NO: 3466700 - DNA, 22 bp, Homo sapiens
agagtctcactgttgcccaggc

SEQ ID NO: 3466701 - DNA, 16 bp, Homo sapiens
agagtgagactctgtc

SEQ ID NO: 3466702 - DNA, 20 bp, Homo sapiens
agagtgatagtcttttgctt

SEQ ID NO: 3466703 - DNA, 18 bp, Homo sapiens
agagtgcattgtgagggt

SEQ ID NO: 3466704 - DNA, 11 bp, Homo sapiens
agagtgggagc

SEQ ID NO: 3466705 - DNA, 16 bp, Homo sapiens
agagtgggtttcacaa

SEQ ID NO: 3466706 - DNA, 15 bp, Homo sapiens
agagtgtggaggctg

SEQ ID NO: 3466707 - DNA, 13 bp, Homo sapiens
agagttagactgt

SEQ ID NO: 3466708 - DNA, 17 bp, Homo sapiens
agagttagactgttggg

SEQ ID NO: 3466709 - DNA, 23 bp, Homo sapiens
agagttgccccgtctctgttcca

SEQ ID NO: 3466710 - DNA, 18 bp, Homo sapiens
agagttgtaaatatataa

SEQ ID NO: 3466711 - DNA, 13 bp, Homo sapiens
agagtttcctgaa

SEQ ID NO: 3466712 - DNA, 21 bp, Homo sapiens
agagttttggatgcagtgctc

SEQ ID NO: 3466713 - DNA, 19 bp, Homo sapiens
agataaactcagaaattta

SEQ ID NO: 3466714 - DNA, 19 bp, Homo sapiens
agataactttgactttctt

SEQ ID NO: 3466715 - DNA, 17 bp, Homo sapiens
agataagatttctgtct

SEQ ID NO: 3466716 - DNA, 16 bp, Homo sapiens
agataatacattccga

SEQ ID NO: 3466717 - DNA, 18 bp, Homo sapiens
agataatattaaggaaga

SEQ ID NO: 3466718 - DNA, 20 bp, Homo sapiens
agataatattttacatacac

SEQ ID NO: 3466719 - DNA, 12 bp, Homo sapiens
agatacaataaa

SEQ ID NO: 3466720 - DNA, 13 bp, Homo sapiens
agatacaataaat

SEQ ID NO: 3466721 - DNA, 20 bp, Homo sapiens
agatacagaactctttcaaa

SEQ ID NO: 3466722 - DNA, 19 bp, Homo sapiens
agataccagcgaggaggct

SEQ ID NO: 3466723 - DNA, 14 bp, Homo sapiens
agatacctaaaaca

SEQ ID NO: 3466724 - DNA, 15 bp, Homo sapiens
agatactctcttctt

SEQ ID NO: 3466725 - DNA, 18 bp, Homo sapiens
agatactctcttcttctc

SEQ ID NO: 3466726 - DNA, 15 bp, Homo sapiens
agatagcctgtggcc

SEQ ID NO: 3466727 - DNA, 18 bp, Homo sapiens
agatagcctgtggccctg

SEQ ID NO: 3466728 - DNA, 15 bp, Homo sapiens
agatagggaaaaggg

SEQ ID NO: 3466729 - DNA, 20 bp, Homo sapiens
agatataagtgctgtataaa

SEQ ID NO: 3466730 - DNA, 23 bp, Homo sapiens
agatataagtgctgtataaaatc

SEQ ID NO: 3466731 - DNA, 19 bp, Homo sapiens
agatatattaaaaatataa

SEQ ID NO: 3466732 - DNA, 14 bp, Homo sapiens
agatattatgtata

SEQ ID NO: 3466733 - DNA, 22 bp, Homo sapiens
agatattatgtataaaatgtaa

SEQ ID NO: 3466734 - DNA, 13 bp, Homo sapiens
agatattctgctc

SEQ ID NO: 3466735 - DNA, 23 bp, Homo sapiens
agatatttaagtataaaatacaa

SEQ ID NO: 3466736 - DNA, 14 bp, Homo sapiens
agatattttccata

SEQ ID NO: 3466737 - DNA, 16 bp, Homo sapiens
agatattttccatata

SEQ ID NO: 3466738 - DNA, 18 bp, Homo sapiens
agatattttccatatatt

SEQ ID NO: 3466739 - DNA, 17 bp, Homo sapiens
agatattttgggcatgt

SEQ ID NO: 3466740 - DNA, 14 bp, Homo sapiens
agatcaaccccttc

SEQ ID NO: 3466741 - DNA, 16 bp, Homo sapiens
agatcaaggagaggag

SEQ ID NO: 3466742 - DNA, 15 bp, Homo sapiens
agatcacgccactgc

SEQ ID NO: 3466743 - DNA, 20 bp, Homo sapiens
agatcagaaaaatggagcaa

SEQ ID NO: 3466744 - DNA, 21 bp, Homo sapiens
agatcagtgtaccatttgcct

SEQ ID NO: 3466745 - DNA, 12 bp, Homo sapiens
agatcatttcta

SEQ ID NO: 3466746 - DNA, 13 bp, Homo sapiens
agatcatttctag

SEQ ID NO: 3466747 - DNA, 16 bp, Homo sapiens
agatccagggactgaa

SEQ ID NO: 3466748 - DNA, 13 bp, Homo sapiens
agatcctaaaaca

SEQ ID NO: 3466749 - DNA, 16 bp, Homo sapiens
agatcctaaaacaaaa

SEQ ID NO: 3466750 - DNA, 22 bp, Homo sapiens
agatcctaaaacaaaagctcat

SEQ ID NO: 3466751 - DNA, 14 bp, Homo sapiens
agatcctcttctca

SEQ ID NO: 3466752 - DNA, 13 bp, Homo sapiens
agatctggaacct

SEQ ID NO: 3466753 - DNA, 14 bp, Homo sapiens
agatctggaacctc

SEQ ID NO: 3466754 - DNA, 17 bp, Homo sapiens
agatctggaacctcagc

SEQ ID NO: 3466755 - DNA, 19 bp, Homo sapiens
agatctggaacctcagcct

SEQ ID NO: 3466756 - DNA, 13 bp, Homo sapiens
agatctggcatgt

SEQ ID NO: 3466757 - DNA, 18 bp, Homo sapiens
agatctgttttgaaggca

SEQ ID NO: 3466758 - DNA, 22 bp, Homo sapiens
agatctttattatggaaaacat

SEQ ID NO: 3466759 - DNA, 14 bp, Homo sapiens
agatgaaacacaaa

SEQ ID NO: 3466760 - DNA, 17 bp, Homo sapiens
agatgaaacacaaacaa

SEQ ID NO: 3466761 - DNA, 16 bp, Homo sapiens
agatgaaggagaggca

SEQ ID NO: 3466762 - DNA, 22 bp, Homo sapiens
agatgagttatctaagaataca

SEQ ID NO: 3466763 - DNA, 22 bp, Homo sapiens
agatgatcagtggacagtctgc

SEQ ID NO: 3466764 - DNA, 19 bp, Homo sapiens
agatgatggatgccaatat

SEQ ID NO: 3466765 - DNA, 13 bp, Homo sapiens
agatgattgaatc

SEQ ID NO: 3466766 - DNA, 18 bp, Homo sapiens
agatgatttcccccctcc

SEQ ID NO: 3466767 - DNA, 17 bp, Homo sapiens
agatgcaaagaggcaag

SEQ ID NO: 3466768 - DNA, 20 bp, Homo sapiens
agatgcaatgactcaggaca

SEQ ID NO: 3466769 - DNA, 20 bp, Homo sapiens
agatgcaccaccaagccaag

SEQ ID NO: 3466770 - DNA, 23 bp, Homo sapiens
agatgcaccaccaagccaaggga

SEQ ID NO: 3466771 - DNA, 15 bp, Homo sapiens
agatgcccaaatcct

SEQ ID NO: 3466772 - DNA, 16 bp, Homo sapiens
agatgccccagggatg

SEQ ID NO: 3466773 - DNA, 20 bp, Homo sapiens
agatgcctacttttggcctc

SEQ ID NO: 3466774 - DNA, 19 bp, Homo sapiens
agatgcctcctgatgggac

SEQ ID NO: 3466775 - DNA, 20 bp, Homo sapiens
agatgcgcagccccatctgt

SEQ ID NO: 3466776 - DNA, 23 bp, Homo sapiens
agatgcgcagccccatctgtgca

SEQ ID NO: 3466777 - DNA, 18 bp, Homo sapiens
agatgctggcccagggcc

SEQ ID NO: 3466778 - DNA, 19 bp, Homo sapiens
agatgctggcccagggccc

SEQ ID NO: 3466779 - DNA, 22 bp, Homo sapiens
agatgctggcccagggcccaga

SEQ ID NO: 3466780 - DNA, 23 bp, Homo sapiens
agatgctggcccagggcccagag

SEQ ID NO: 3466781 - DNA, 18 bp, Homo sapiens
agatgctggcttgggcag

SEQ ID NO: 3466782 - DNA, 18 bp, Homo sapiens
agatgcttttaacagagt

SEQ ID NO: 3466783 - DNA, 18 bp, Homo sapiens
agatggaagcttgttgaa

SEQ ID NO: 3466784 - DNA, 13 bp, Homo sapiens
agatggacagaga

SEQ ID NO: 3466785 - DNA, 13 bp, Homo sapiens
agatggcagatgc

SEQ ID NO: 3466786 - DNA, 15 bp, Homo sapiens
agatggctcctctca

SEQ ID NO: 3466787 - DNA, 18 bp, Homo sapiens
agatgggggaaagcacag

SEQ ID NO: 3466788 - DNA, 22 bp, Homo sapiens
agatgggggcagggctgtgctt

SEQ ID NO: 3466789 - DNA, 18 bp, Homo sapiens
agatggggtctgtaaaat

SEQ ID NO: 3466790 - DNA, 23 bp, Homo sapiens
agatggtaagacctctgagacca

SEQ ID NO: 3466791 - DNA, 14 bp, Homo sapiens
agatggtgctgaga

SEQ ID NO: 3466792 - DNA, 17 bp, Homo sapiens
agatggtgctgagaagc

SEQ ID NO: 3466793 - DNA, 14 bp, Homo sapiens
agatggttgtgtat

SEQ ID NO: 3466794 - DNA, 14 bp, Homo sapiens
agatgtaatgtttt

SEQ ID NO: 3466795 - DNA, 23 bp, Homo sapiens
agatgtaatgttttctttgcaaa

SEQ ID NO: 3466796 - DNA, 21 bp, Homo sapiens
agatgtggttgcataaggttt

SEQ ID NO: 3466797 - DNA, 21 bp, Homo sapiens
agatgttctaagtctttccat

SEQ ID NO: 3466798 - DNA, 17 bp, Homo sapiens
agatgttctctatcatt

SEQ ID NO: 3466799 - DNA, 18 bp, Homo sapiens
agatgttctctatcattt

SEQ ID NO: 3466800 - DNA, 19 bp, Homo sapiens
agatgttctctatcattta

SEQ ID NO: 3466801 - DNA, 20 bp, Homo sapiens
agatgttctctatcatttaa

SEQ ID NO: 3466802 - DNA, 14 bp, Homo sapiens
agatgtttcacacc

SEQ ID NO: 3466803 - DNA, 21 bp, Homo sapiens
agatgtttccagacttccttg

SEQ ID NO: 3466804 - DNA, 23 bp, Homo sapiens
agatgtttccagacttccttgag

SEQ ID NO: 3466805 - DNA, 16 bp, Homo sapiens
agattaaaaattatag

SEQ ID NO: 3466806 - DNA, 15 bp, Homo sapiens
agattaagatgcctt

SEQ ID NO: 3466807 - DNA, 20 bp, Homo sapiens
agattaatattgttctctgt

SEQ ID NO: 3466808 - DNA, 17 bp, Homo sapiens
agattaatgctatcaat

SEQ ID NO: 3466809 - DNA, 16 bp, Homo sapiens
agattattgaaatatt

SEQ ID NO: 3466810 - DNA, 17 bp, Homo sapiens
agattcattttctagat

SEQ ID NO: 3466811 - DNA, 16 bp, Homo sapiens
agattgcaacaggctg

SEQ ID NO: 3466812 - DNA, 23 bp, Homo sapiens
agattgcaacaggctgggcttca

SEQ ID NO: 3466813 - DNA, 13 bp, Homo sapiens
agattgcatgtga

SEQ ID NO: 3466814 - DNA, 19 bp, Homo sapiens
agattgcatgtgactctga

SEQ ID NO: 3466815 - DNA, 16 bp, Homo sapiens
agattgcttaaaatag

SEQ ID NO: 3466816 - DNA, 14 bp, Homo sapiens
agattggctcacac

SEQ ID NO: 3466817 - DNA, 23 bp, Homo sapiens
agattggctcacactgagaatgt

SEQ ID NO: 3466818 - DNA, 11 bp, Homo sapiens
agattgtaaac

SEQ ID NO: 3466819 - DNA, 22 bp, Homo sapiens
agattgtaaaccgctttggcct

SEQ ID NO: 3466820 - DNA, 16 bp, Homo sapiens
agattgtggaatgttg

SEQ ID NO: 3466821 - DNA, 21 bp, Homo sapiens
agattgtggaatgttggataa

SEQ ID NO: 3466822 - DNA, 19 bp, Homo sapiens
agatttcagaggctgcagg

SEQ ID NO: 3466823 - DNA, 17 bp, Homo sapiens
agatttcagggagacaa

SEQ ID NO: 3466824 - DNA, 15 bp, Homo sapiens
agatttcatctgctc

SEQ ID NO: 3466825 - DNA, 22 bp, Homo sapiens
agatttgctttaccttcctgat

SEQ ID NO: 3466826 - DNA, 18 bp, Homo sapiens
agattttaagtattgttt

SEQ ID NO: 3466827 - DNA, 19 bp, Homo sapiens
agattttaatcaagttgaa

SEQ ID NO: 3466828 - DNA, 19 bp, Homo sapiens
agatttttattttgaaaaa

SEQ ID NO: 3466829 - DNA, 23 bp, Homo sapiens
agcaaaaaaaacccatgtggtga

SEQ ID NO: 3466830 - DNA, 14 bp, Homo sapiens
agcaaagatttcaa

SEQ ID NO: 3466831 - DNA, 19 bp, Homo sapiens
agcaaaggctgagaacact

SEQ ID NO: 3466832 - DNA, 22 bp, Homo sapiens
agcaaagtggtaggtacttttt

SEQ ID NO: 3466833 - DNA, 11 bp, Homo sapiens
agcaaatcacc

SEQ ID NO: 3466834 - DNA, 21 bp, Homo sapiens
agcaaatcaccacaaactgta

SEQ ID NO: 3466835 - DNA, 22 bp, Homo sapiens
agcaaatcaccacaaactgtaa

SEQ ID NO: 3466836 - DNA, 17 bp, Homo sapiens
agcaaatgttatgcata

SEQ ID NO: 3466837 - DNA, 18 bp, Homo sapiens
agcaacaggaatctcaga

SEQ ID NO: 3466838 - DNA, 16 bp, Homo sapiens
agcaaccccaggctga

SEQ ID NO: 3466839 - DNA, 14 bp, Homo sapiens
agcaactcttgatt

SEQ ID NO: 3466840 - DNA, 18 bp, Homo sapiens
agcaacttgatggaagga

SEQ ID NO: 3466841 - DNA, 21 bp, Homo sapiens
agcaagaagatcctaaaacaa

SEQ ID NO: 3466842 - DNA, 15 bp, Homo sapiens
agcaaggcacagcct

SEQ ID NO: 3466843 - DNA, 14 bp, Homo sapiens
agcaagtgaatttt

SEQ ID NO: 3466844 - DNA, 19 bp, Homo sapiens
agcaatcgggataaaacag

SEQ ID NO: 3466845 - DNA, 24 bp, Homo sapiens
agcaatttccccctaaaccaactg

SEQ ID NO: 3466846 - DNA, 14 bp, Homo sapiens
agcacacagggcag

SEQ ID NO: 3466847 - DNA, 14 bp, Homo sapiens
agcacacaggtaca

SEQ ID NO: 3466848 - DNA, 12 bp, Homo sapiens
agcacagcagcc

SEQ ID NO: 3466849 - DNA, 13 bp, Homo sapiens
agcacagccaaca

SEQ ID NO: 3466850 - DNA, 22 bp, Homo sapiens
agcacagcccctgctgtgtggg

SEQ ID NO: 3466851 - DNA, 21 bp, Homo sapiens
agcacagcttcatttcctgtg

SEQ ID NO: 3466852 - DNA, 18 bp, Homo sapiens
agcacagcttgacctgag

SEQ ID NO: 3466853 - DNA, 20 bp, Homo sapiens
agcacagcttgacctgaggc

SEQ ID NO: 3466854 - DNA, 15 bp, Homo sapiens
agcacaggtgggctt

SEQ ID NO: 3466855 - DNA, 19 bp, Homo sapiens
agcacaggtgggcttccca

SEQ ID NO: 3466856 - DNA, 14 bp, Homo sapiens
agcaccctgcagag

SEQ ID NO: 3466857 - DNA, 20 bp, Homo sapiens
agcaccgtgtcaagctgctc

SEQ ID NO: 3466858 - DNA, 14 bp, Homo sapiens
agcacctccagcct

SEQ ID NO: 3466859 - DNA, 13 bp, Homo sapiens
agcacctcctgcc

SEQ ID NO: 3466860 - DNA, 17 bp, Homo sapiens
agcactatgctttcctt

SEQ ID NO: 3466861 - DNA, 18 bp, Homo sapiens
agcactatgctttccttc

SEQ ID NO: 3466862 - DNA, 20 bp, Homo sapiens
agcactgggatcacaggtgt

SEQ ID NO: 3466863 - DNA, 15 bp, Homo sapiens
agcactgggctcccg

SEQ ID NO: 3466864 - DNA, 17 bp, Homo sapiens
agcactgggttgacttt

SEQ ID NO: 3466865 - DNA, 14 bp, Homo sapiens
agcactgtgctcag

SEQ ID NO: 3466866 - DNA, 18 bp, Homo sapiens
agcactgtgctcagggct

SEQ ID NO: 3466867 - DNA, 19 bp, Homo sapiens
agcactgttctgggactcc

SEQ ID NO: 3466868 - DNA, 13 bp, Homo sapiens
agcacttaagaga

SEQ ID NO: 3466869 - DNA, 19 bp, Homo sapiens
agcacttcatctggctgcc

SEQ ID NO: 3466870 - DNA, 15 bp, Homo sapiens
agcacttctttttct

SEQ ID NO: 3466871 - DNA, 22 bp, Homo sapiens
agcactttctacaatgtgaact

SEQ ID NO: 3466872 - DNA, 15 bp, Homo sapiens
agcactttgcaagga

SEQ ID NO: 3466873 - DNA, 14 bp, Homo sapiens
agcactttgggagg

SEQ ID NO: 3466874 - DNA, 22 bp, Homo sapiens
agcagaaaggaaaagattcctg

SEQ ID NO: 3466875 - DNA, 16 bp, Homo sapiens
agcagaaccagcctca

SEQ ID NO: 3466876 - DNA, 12 bp, Homo sapiens
agcagacaggcc

SEQ ID NO: 3466877 - DNA, 16 bp, Homo sapiens
agcagactgatcagga

SEQ ID NO: 3466878 - DNA, 21 bp, Homo sapiens
agcagagaatgaaagggccca

SEQ ID NO: 3466879 - DNA, 22 bp, Homo sapiens
agcagagaatgaaagggcccag

SEQ ID NO: 3466880 - DNA, 17 bp, Homo sapiens
agcagagcccggagctc

SEQ ID NO: 3466881 - DNA, 17 bp, Homo sapiens
agcagaggaaggagagg

SEQ ID NO: 3466882 - DNA, 14 bp, Homo sapiens
agcagaggggctga

SEQ ID NO: 3466883 - DNA, 13 bp, Homo sapiens
agcagatgcaaag

SEQ ID NO: 3466884 - DNA, 14 bp, Homo sapiens
agcagatgcaaaga

SEQ ID NO: 3466885 - DNA, 20 bp, Homo sapiens
agcagatgcaaagaggcaag

SEQ ID NO: 3466886 - DNA, 21 bp, Homo sapiens
agcagatgcaaagaggcaaga

SEQ ID NO: 3466887 - DNA, 21 bp, Homo sapiens
agcagattttaattttgaata

SEQ ID NO: 3466888 - DNA, 20 bp, Homo sapiens
agcagcaccgttctgtgcac

SEQ ID NO: 3466889 - DNA, 14 bp, Homo sapiens
agcagcagcccaag

SEQ ID NO: 3466890 - DNA, 13 bp, Homo sapiens
agcagcaggtagc

SEQ ID NO: 3466891 - DNA, 20 bp, Homo sapiens
agcagcaggtagcctgctgg

SEQ ID NO: 3466892 - DNA, 22 bp, Homo sapiens
agcagccaagctccttgggagg

SEQ ID NO: 3466893 - DNA, 10 bp, Homo sapiens
agcagccacg

SEQ ID NO: 3466894 - DNA, 18 bp, Homo sapiens
agcagcccaagcttccct

SEQ ID NO: 3466895 - DNA, 18 bp, Homo sapiens
agcagcctctccccaggt

SEQ ID NO: 3466896 - DNA, 21 bp, Homo sapiens
agcagcctctccccaggtcca

SEQ ID NO: 3466897 - DNA, 23 bp, Homo sapiens
agcagcctgagcaactcttgatt

SEQ ID NO: 3466898 - DNA, 16 bp, Homo sapiens
agcagcctggaccctg

SEQ ID NO: 3466899 - DNA, 18 bp, Homo sapiens
agcagcctttaatgcatc

SEQ ID NO: 3466900 - DNA, 14 bp, Homo sapiens
agcagcgcctttcc

SEQ ID NO: 3466901 - DNA, 19 bp, Homo sapiens
agcagctcaaaggcacagt

SEQ ID NO: 3466902 - DNA, 22 bp, Homo sapiens
agcagctgaaatatgctggctg

SEQ ID NO: 3466903 - DNA, 22 bp, Homo sapiens
agcagctggtaatcttgctctg

SEQ ID NO: 3466904 - DNA, 12 bp, Homo sapiens
agcaggaagctc

SEQ ID NO: 3466905 - DNA, 21 bp, Homo sapiens
agcaggaatatatgtgtgcct

SEQ ID NO: 3466906 - DNA, 20 bp, Homo sapiens
agcaggatcgaagggttttt

SEQ ID NO: 3466907 - DNA, 14 bp, Homo sapiens
agcagggaaacagc

SEQ ID NO: 3466908 - DNA, 20 bp, Homo sapiens
agcagggagggcttctgcca

SEQ ID NO: 3466909 - DNA, 22 bp, Homo sapiens
agcagggggggaaatgcattta

SEQ ID NO: 3466910 - DNA, 17 bp, Homo sapiens
agcagtcgtgcctgtgt

SEQ ID NO: 3466911 - DNA, 16 bp, Homo sapiens
agcagtctctgccttg

SEQ ID NO: 3466912 - DNA, 17 bp, Homo sapiens
agcagtctctgccttgc

SEQ ID NO: 3466913 - DNA, 21 bp, Homo sapiens
agcagtgtgaggccagggcag

SEQ ID NO: 3466914 - DNA, 21 bp, Homo sapiens
agcagttttcaagtcaaatta

SEQ ID NO: 3466915 - DNA, 13 bp, Homo sapiens
agcataacatatg

SEQ ID NO: 3466916 - DNA, 14 bp, Homo sapiens
agcatactttgtaa

SEQ ID NO: 3466917 - DNA, 13 bp, Homo sapiens
agcatatacaata

SEQ ID NO: 3466918 - DNA, 20 bp, Homo sapiens
agcatatcgtaaagctgttc

SEQ ID NO: 3466919 - DNA, 16 bp, Homo sapiens
agcatatctgattgtt

SEQ ID NO: 3466920 - DNA, 13 bp, Homo sapiens
agcatatctgcct

SEQ ID NO: 3466921 - DNA, 17 bp, Homo sapiens
agcatatctgcctttat

SEQ ID NO: 3466922 - DNA, 13 bp, Homo sapiens
agcatcaagccac

SEQ ID NO: 3466923 - DNA, 17 bp, Homo sapiens
agcatccccttgaactc

SEQ ID NO: 3466924 - DNA, 18 bp, Homo sapiens
agcatccccttgaactct

SEQ ID NO: 3466925 - DNA, 20 bp, Homo sapiens
agcatccccttgaactcttc

SEQ ID NO: 3466926 - DNA, 14 bp, Homo sapiens
agcatcctggcacc

SEQ ID NO: 3466927 - DNA, 17 bp, Homo sapiens
agcatcctggcacccgg

SEQ ID NO: 3466928 - DNA, 19 bp, Homo sapiens
agcatcggcctagggcccc

SEQ ID NO: 3466929 - DNA, 21 bp, Homo sapiens
agcatcggcctagggccccca

SEQ ID NO: 3466930 - DNA, 21 bp, Homo sapiens
agcatcttgggggggtggccg

SEQ ID NO: 3466931 - DNA, 13 bp, Homo sapiens
agcatctttcata

SEQ ID NO: 3466932 - DNA, 21 bp, Homo sapiens
agcatgacaaaaattattttt

SEQ ID NO: 3466933 - DNA, 14 bp, Homo sapiens
agcatgacatttct

SEQ ID NO: 3466934 - DNA, 15 bp, Homo sapiens
agcatgcatctgttt

SEQ ID NO: 3466935 - DNA, 18 bp, Homo sapiens
agcatggctcaaagtgca

SEQ ID NO: 3466936 - DNA, 17 bp, Homo sapiens
agcatgggggacccctt

SEQ ID NO: 3466937 - DNA, 20 bp, Homo sapiens
agcatgggggaccccttccc

SEQ ID NO: 3466938 - DNA, 16 bp, Homo sapiens
agcatgggttcatcct

SEQ ID NO: 3466939 - DNA, 21 bp, Homo sapiens
agcatggtcacaagcacaaag

SEQ ID NO: 3466940 - DNA, 19 bp, Homo sapiens
agcatgtaacttatattaa

SEQ ID NO: 3466941 - DNA, 20 bp, Homo sapiens
agcattaagctgttcctgtt

SEQ ID NO: 3466942 - DNA, 21 bp, Homo sapiens
agcattagatagtcatgctgc

SEQ ID NO: 3466943 - DNA, 23 bp, Homo sapiens
agcattagatagtcatgctgcta

SEQ ID NO: 3466944 - DNA, 18 bp, Homo sapiens
agcattcacaacttgttt

SEQ ID NO: 3466945 - DNA, 19 bp, Homo sapiens
agcattccagcccctctgg

SEQ ID NO: 3466946 - DNA, 21 bp, Homo sapiens
agcattgggtgaggtaataaa

SEQ ID NO: 3466947 - DNA, 20 bp, Homo sapiens
agcatttcgcgatggacaga

SEQ ID NO: 3466948 - DNA, 17 bp, Homo sapiens
agcatttgaatgcattt

SEQ ID NO: 3466949 - DNA, 15 bp, Homo sapiens
agcatttgatctgtt

SEQ ID NO: 3466950 - DNA, 23 bp, Homo sapiens
agcattttagcaatttatacaat

SEQ ID NO: 3466951 - DNA, 20 bp, Homo sapiens
agcattttccagcactttgc

SEQ ID NO: 3466952 - DNA, 23 bp, Homo sapiens
agcatttttttaaaagaagcttt

SEQ ID NO: 3466953 - DNA, 20 bp, Homo sapiens
agcatttttttattcagcag

SEQ ID NO: 3466954 - DNA, 22 bp, Homo sapiens
agcatttttttattcagcagac

SEQ ID NO: 3466955 - DNA, 21 bp, Homo sapiens
agccaaacatatatatactat

SEQ ID NO: 3466956 - DNA, 18 bp, Homo sapiens
agccaaagctaggcctgg

SEQ ID NO: 3466957 - DNA, 14 bp, Homo sapiens
agccaaattttatc

SEQ ID NO: 3466958 - DNA, 16 bp, Homo sapiens
agccaacatgtggctc

SEQ ID NO: 3466959 - DNA, 16 bp, Homo sapiens
agccaactagcccctg

SEQ ID NO: 3466960 - DNA, 17 bp, Homo sapiens
agccaagaaagatgtat

SEQ ID NO: 3466961 - DNA, 16 bp, Homo sapiens
agccaagggaacctgt

SEQ ID NO: 3466962 - DNA, 17 bp, Homo sapiens
agccaagggaacctgtg

SEQ ID NO: 3466963 - DNA, 20 bp, Homo sapiens
agccaagggaacctgtgtcc

SEQ ID NO: 3466964 - DNA, 22 bp, Homo sapiens
agccaaggttttataaggctga

SEQ ID NO: 3466965 - DNA, 17 bp, Homo sapiens
agccaattatgttaaac

SEQ ID NO: 3466966 - DNA, 18 bp, Homo sapiens
agccaattcagacaggca

SEQ ID NO: 3466967 - DNA, 13 bp, Homo sapiens
agccacaccagga

SEQ ID NO: 3466968 - DNA, 13 bp, Homo sapiens
agccacaggcctg

SEQ ID NO: 3466969 - DNA, 16 bp, Homo sapiens
agccacaggcctgaga

SEQ ID NO: 3466970 - DNA, 17 bp, Homo sapiens
agccacagggtctgcct

SEQ ID NO: 3466971 - DNA, 18 bp, Homo sapiens
agccacagggtctgcctc

SEQ ID NO: 3466972 - DNA, 19 bp, Homo sapiens
agccacagggtctgcctcc

SEQ ID NO: 3466973 - DNA, 13 bp, Homo sapiens
agccacagtggga

SEQ ID NO: 3466974 - DNA, 15 bp, Homo sapiens
agccacatttggaat

SEQ ID NO: 3466975 - DNA, 21 bp, Homo sapiens
agccacatttggaatactttt

SEQ ID NO: 3466976 - DNA, 17 bp, Homo sapiens
agccaccacgtccagct

SEQ ID NO: 3466977 - DNA, 20 bp, Homo sapiens
agccaccgaagccgcctgtg

SEQ ID NO: 3466978 - DNA, 21 bp, Homo sapiens
agccaccgaagccgcctgtgg

SEQ ID NO: 3466979 - DNA, 23 bp, Homo sapiens
agccaccttttgggaatgtttta

SEQ ID NO: 3466980 - DNA, 14 bp, Homo sapiens
agccacggccaggc

SEQ ID NO: 3466981 - DNA, 16 bp, Homo sapiens
agccacggccaggcca

SEQ ID NO: 3466982 - DNA, 12 bp, Homo sapiens
agccactcctct

SEQ ID NO: 3466983 - DNA, 18 bp, Homo sapiens
agccactgcaccgggcca

SEQ ID NO: 3466984 - DNA, 20 bp, Homo sapiens
agccactgcaccgggccaca

SEQ ID NO: 3466985 - DNA, 22 bp, Homo sapiens
agccactgccactccagtcctg

SEQ ID NO: 3466986 - DNA, 18 bp, Homo sapiens
agccagaagcctctgcct

SEQ ID NO: 3466987 - DNA, 12 bp, Homo sapiens
agccagaagctg

SEQ ID NO: 3466988 - DNA, 14 bp, Homo sapiens
agccagaagctgag

SEQ ID NO: 3466989 - DNA, 20 bp, Homo sapiens
agccagaatctcattactgc

SEQ ID NO: 3466990 - DNA, 11 bp, Homo sapiens
agccagaggct

SEQ ID NO: 3466991 - DNA, 22 bp, Homo sapiens
agccagatggactccagcctgc

SEQ ID NO: 3466992 - DNA, 14 bp, Homo sapiens
agccagcacctggc

SEQ ID NO: 3466993 - DNA, 15 bp, Homo sapiens
agccagcacctggca

SEQ ID NO: 3466994 - DNA, 23 bp, Homo sapiens
agccagcacctggcatcgcacca

SEQ ID NO: 3466995 - DNA, 20 bp, Homo sapiens
agccagcacttgtccagctg

SEQ ID NO: 3466996 - DNA, 21 bp, Homo sapiens
agccagcacttgtccagctga

SEQ ID NO: 3466997 - DNA, 16 bp, Homo sapiens
agccagcagcagccca

SEQ ID NO: 3466998 - DNA, 17 bp, Homo sapiens
agccagcgtcctcctct

SEQ ID NO: 3466999 - DNA, 18 bp, Homo sapiens
agccagcgtcctcctctg

SEQ ID NO: 3467000 - DNA, 23 bp, Homo sapiens
agccagcgtcctcctctgtgacc

SEQ ID NO: 3467001 - DNA, 22 bp, Homo sapiens
agccagctccctctatttatgt

SEQ ID NO: 3467002 - DNA, 13 bp, Homo sapiens
agccagctcctgg

SEQ ID NO: 3467003 - DNA, 19 bp, Homo sapiens
agccagctcctgggcagct

SEQ ID NO: 3467004 - DNA, 20 bp, Homo sapiens
agccagctcctgggcagctt

SEQ ID NO: 3467005 - DNA, 12 bp, Homo sapiens
agccagctgcct

SEQ ID NO: 3467006 - DNA, 20 bp, Homo sapiens
agccaggaatttcccaggac

SEQ ID NO: 3467007 - DNA, 21 bp, Homo sapiens
agccaggaatttcccaggacc

SEQ ID NO: 3467008 - DNA, 18 bp, Homo sapiens
agccaggagcgcatctca

SEQ ID NO: 3467009 - DNA, 15 bp, Homo sapiens
agccaggagctgtca

SEQ ID NO: 3467010 - DNA, 14 bp, Homo sapiens
agccaggagtgggt

SEQ ID NO: 3467011 - DNA, 14 bp, Homo sapiens
agccaggccccagg

SEQ ID NO: 3467012 - DNA, 14 bp, Homo sapiens
agccagggctgcta

SEQ ID NO: 3467013 - DNA, 20 bp, Homo sapiens
agccagggggatgccactcc

SEQ ID NO: 3467014 - DNA, 16 bp, Homo sapiens
agccagtaaacagagg

SEQ ID NO: 3467015 - DNA, 21 bp, Homo sapiens
agccagtgacctgaggaagcg

SEQ ID NO: 3467016 - DNA, 23 bp, Homo sapiens
agccatctcatgaggggagagga

SEQ ID NO: 3467017 - DNA, 16 bp, Homo sapiens
agccatgatctgcagg

SEQ ID NO: 3467018 - DNA, 22 bp, Homo sapiens
agccatgatctgcaggggtctg

SEQ ID NO: 3467019 - DNA, 16 bp, Homo sapiens
agccatgcgccccctc

SEQ ID NO: 3467020 - DNA, 13 bp, Homo sapiens
agccatgtacaga

SEQ ID NO: 3467021 - DNA, 14 bp, Homo sapiens
agccatgtacagac

SEQ ID NO: 3467022 - DNA, 16 bp, Homo sapiens
accctggggagaaagt

SEQ ID NO: 3467023 - DNA, 13 bp, Homo sapiens
accctggggcctg

SEQ ID NO: 3467024 - DNA, 22 bp, Homo sapiens
accctggggcctgactgctcag

SEQ ID NO: 3467025 - DNA, 19 bp, Homo sapiens
accctggtggttgctgttt

SEQ ID NO: 3467026 - DNA, 13 bp, Homo sapiens
accctgtcttcct

SEQ ID NO: 3467027 - DNA, 20 bp, Homo sapiens
accctgtcttcctctgcaag

SEQ ID NO: 3467028 - DNA, 21 bp, Homo sapiens
accctgtcttcctctgcaagt

SEQ ID NO: 3467029 - DNA, 17 bp, Homo sapiens
accctgtgccctccttc

SEQ ID NO: 3467030 - DNA, 16 bp, Homo sapiens
acccttaagtcaccct

SEQ ID NO: 3467031 - DNA, 17 bp, Homo sapiens
acccttcatcttcctgt

SEQ ID NO: 3467032 - DNA, 18 bp, Homo sapiens
acccttcatcttcctgtg

SEQ ID NO: 3467033 - DNA, 15 bp, Homo sapiens
acccttctcctcttg

SEQ ID NO: 3467034 - DNA, 19 bp, Homo sapiens
acccttctcctcttgtaaa

SEQ ID NO: 3467035 - DNA, 21 bp, Homo sapiens
acccttctcctcttgtaaata

SEQ ID NO: 3467036 - DNA, 12 bp, Homo sapiens
acccttttccag

SEQ ID NO: 3467037 - DNA, 23 bp, Homo sapiens
acccttttctgggtttgaagctg

SEQ ID NO: 3467038 - DNA, 14 bp, Homo sapiens
accgagagccaaac

SEQ ID NO: 3467039 - DNA, 15 bp, Homo sapiens
accgaggacatgaaa

SEQ ID NO: 3467040 - DNA, 12 bp, Homo sapiens
accgcaggaagc

SEQ ID NO: 3467041 - DNA, 14 bp, Homo sapiens
accgcaggaagctg

SEQ ID NO: 3467042 - DNA, 17 bp, Homo sapiens
accgctgattctcaggg

SEQ ID NO: 3467043 - DNA, 13 bp, Homo sapiens
accgctttggcct

SEQ ID NO: 3467044 - DNA, 15 bp, Homo sapiens
accggacttttctgc

SEQ ID NO: 3467045 - DNA, 13 bp, Homo sapiens
accggatcctggg

SEQ ID NO: 3467046 - DNA, 12 bp, Homo sapiens
accgggcactca

SEQ ID NO: 3467047 - DNA, 19 bp, Homo sapiens
accgggccacagagaaagt

SEQ ID NO: 3467048 - DNA, 16 bp, Homo sapiens
accgtgggcagggagc

SEQ ID NO: 3467049 - DNA, 16 bp, Homo sapiens
accgtggtatgtctgc

SEQ ID NO: 3467050 - DNA, 22 bp, Homo sapiens
acctaaaaggaaatctcacccc

SEQ ID NO: 3467051 - DNA, 15 bp, Homo sapiens
acctaaatggcctca

SEQ ID NO: 3467052 - DNA, 23 bp, Homo sapiens
acctacacactgtcatgcttcat

SEQ ID NO: 3467053 - DNA, 14 bp, Homo sapiens
acctacatccccag

SEQ ID NO: 3467054 - DNA, 12 bp, Homo sapiens
acctaccacatg

SEQ ID NO: 3467055 - DNA, 15 bp, Homo sapiens
acctacctgttgagc

SEQ ID NO: 3467056 - DNA, 17 bp, Homo sapiens
acctacctgttgagcat

SEQ ID NO: 3467057 - DNA, 22 bp, Homo sapiens
acctagagaacaggtggttttt

SEQ ID NO: 3467058 - DNA, 22 bp, Homo sapiens
acctatggtataatggttgact

SEQ ID NO: 3467059 - DNA, 18 bp, Homo sapiens
acctatttcttaaacact

SEQ ID NO: 3467060 - DNA, 23 bp, Homo sapiens
acctatttcttaaacacttgcaa

SEQ ID NO: 3467061 - DNA, 22 bp, Homo sapiens
acctcaacccccatttctattt

SEQ ID NO: 3467062 - DNA, 17 bp, Homo sapiens
acctcacgcacctccca

SEQ ID NO: 3467063 - DNA, 22 bp, Homo sapiens
acctcacgcacctcccatccta

SEQ ID NO: 3467064 - DNA, 14 bp, Homo sapiens
acctcagcctggcc

SEQ ID NO: 3467065 - DNA, 12 bp, Homo sapiens
acctcagggcac

SEQ ID NO: 3467066 - DNA, 14 bp, Homo sapiens
acctcatgacagcc

SEQ ID NO: 3467067 - DNA, 22 bp, Homo sapiens
acctcatgacagccagagcctg

SEQ ID NO: 3467068 - DNA, 17 bp, Homo sapiens
acctccaagccactgag

SEQ ID NO: 3467069 - DNA, 13 bp, Homo sapiens
acctccagcctga

SEQ ID NO: 3467070 - DNA, 15 bp, Homo sapiens
acctccccagcattc

SEQ ID NO: 3467071 - DNA, 21 bp, Homo sapiens
acctccccagcattccagccc

SEQ ID NO: 3467072 - DNA, 16 bp, Homo sapiens
acctccccagcctgcg

SEQ ID NO: 3467073 - DNA, 11 bp, Homo sapiens
acctccctccc

SEQ ID NO: 3467074 - DNA, 21 bp, Homo sapiens
acctcctccctaatgctcacc

SEQ ID NO: 3467075 - DNA, 16 bp, Homo sapiens
acctcctctcagtgtt

SEQ ID NO: 3467076 - DNA, 17 bp, Homo sapiens
acctcctctcagtgttt

SEQ ID NO: 3467077 - DNA, 14 bp, Homo sapiens
acctcctctgtgaa

SEQ ID NO: 3467078 - DNA, 13 bp, Homo sapiens
acctcgccctctc

SEQ ID NO: 3467079 - DNA, 14 bp, Homo sapiens
acctcgccctctcc

SEQ ID NO: 3467080 - DNA, 17 bp, Homo sapiens
acctcgccctctccttt

SEQ ID NO: 3467081 - DNA, 14 bp, Homo sapiens
acctcgctggactc

SEQ ID NO: 3467082 - DNA, 16 bp, Homo sapiens
acctcgctggactctc

SEQ ID NO: 3467083 - DNA, 19 bp, Homo sapiens
acctcggtgccttcctctt

SEQ ID NO: 3467084 - DNA, 16 bp, Homo sapiens
acctctagtagctgaa

SEQ ID NO: 3467085 - DNA, 18 bp, Homo sapiens
acctctccagcctcagct

SEQ ID NO: 3467086 - DNA, 22 bp, Homo sapiens
acctctccagcctcagctctca

SEQ ID NO: 3467087 - DNA, 17 bp, Homo sapiens
acctctccctgaccctg

SEQ ID NO: 3467088 - DNA, 23 bp, Homo sapiens
acctctccctgaccctgtatata

SEQ ID NO: 3467089 - DNA, 16 bp, Homo sapiens
acctctctatttttaa

SEQ ID NO: 3467090 - DNA, 12 bp, Homo sapiens
acctctctgtcc

SEQ ID NO: 3467091 - DNA, 22 bp, Homo sapiens
acctctctgtcccttgctgtat

SEQ ID NO: 3467092 - DNA, 20 bp, Homo sapiens
acctctgaaaccctggacca

SEQ ID NO: 3467093 - DNA, 12 bp, Homo sapiens
acctctgcacaa

SEQ ID NO: 3467094 - DNA, 18 bp, Homo sapiens
acctctgcacaagctgca

SEQ ID NO: 3467095 - DNA, 21 bp, Homo sapiens
acctctgcacaagctgcaccc

SEQ ID NO: 3467096 - DNA, 19 bp, Homo sapiens
acctctgcttcccaggttc

SEQ ID NO: 3467097 - DNA, 15 bp, Homo sapiens
acctctgttcagtgt

SEQ ID NO: 3467098 - DNA, 19 bp, Homo sapiens
acctctgttcagtgtaaat

SEQ ID NO: 3467099 - DNA, 15 bp, Homo sapiens
acctcttcagaggcc

SEQ ID NO: 3467100 - DNA, 11 bp, Homo sapiens
acctcttccac

SEQ ID NO: 3467101 - DNA, 11 bp, Homo sapiens
acctcttctgg

SEQ ID NO: 3467102 - DNA, 19 bp, Homo sapiens
acctgacgtagctgcaaag

SEQ ID NO: 3467103 - DNA, 22 bp, Homo sapiens
acctgattaactgaggcatcca

SEQ ID NO: 3467104 - DNA, 15 bp, Homo sapiens
acctgcagcctttgg

SEQ ID NO: 3467105 - DNA, 17 bp, Homo sapiens
acctgccctaaaccctg

SEQ ID NO: 3467106 - DNA, 13 bp, Homo sapiens
acctgctgcttct

SEQ ID NO: 3467107 - DNA, 14 bp, Homo sapiens
acctggacacaggc

SEQ ID NO: 3467108 - DNA, 17 bp, Homo sapiens
acctggacacaggcctg

SEQ ID NO: 3467109 - DNA, 21 bp, Homo sapiens
acctggcatcgcaccattctg

SEQ ID NO: 3467110 - DNA, 18 bp, Homo sapiens
acctggccgcctccagga

SEQ ID NO: 3467111 - DNA, 18 bp, Homo sapiens
acctggggctgctggcct

SEQ ID NO: 3467112 - DNA, 22 bp, Homo sapiens
acctggggggcagtggtgtgga

SEQ ID NO: 3467113 - DNA, 21 bp, Homo sapiens
acctggggtcatcgattcaaa

SEQ ID NO: 3467114 - DNA, 18 bp, Homo sapiens
acctggggtgtgggaggc

SEQ ID NO: 3467115 - DNA, 19 bp, Homo sapiens
acctgggtaaatgcagcgt

SEQ ID NO: 3467116 - DNA, 16 bp, Homo sapiens
acctggtccacagggc

SEQ ID NO: 3467117 - DNA, 18 bp, Homo sapiens
acctggtccacagggcac

SEQ ID NO: 3467118 - DNA, 19 bp, Homo sapiens
acctgtaacctttcggcaa

SEQ ID NO: 3467119 - DNA, 14 bp, Homo sapiens
acctgtaatcccag

SEQ ID NO: 3467120 - DNA, 15 bp, Homo sapiens
acctgtaatcccagc

SEQ ID NO: 3467121 - DNA, 19 bp, Homo sapiens
acctgtaatcccagcactt

SEQ ID NO: 3467122 - DNA, 23 bp, Homo sapiens
acctgtataagtggaggcacttt

SEQ ID NO: 3467123 - DNA, 14 bp, Homo sapiens
acctgtcattgtat

SEQ ID NO: 3467124 - DNA, 16 bp, Homo sapiens
acctgtcattttgcac

SEQ ID NO: 3467125 - DNA, 18 bp, Homo sapiens
acctgtcattttgcactg

SEQ ID NO: 3467126 - DNA, 20 bp, Homo sapiens
acctgtcattttgcactgta

SEQ ID NO: 3467127 - DNA, 14 bp, Homo sapiens
acctgtctcagcct

SEQ ID NO: 3467128 - DNA, 12 bp, Homo sapiens
acctgtctcctt

SEQ ID NO: 3467129 - DNA, 18 bp, Homo sapiens
acctgtgagtttaaagca

SEQ ID NO: 3467130 - DNA, 19 bp, Homo sapiens
acctgtgagtttaaagcaa

SEQ ID NO: 3467131 - DNA, 15 bp, Homo sapiens
acctgtgcctcggct

SEQ ID NO: 3467132 - DNA, 16 bp, Homo sapiens
acctgtgcctcggctt

SEQ ID NO: 3467133 - DNA, 22 bp, Homo sapiens
acctgtgcttcgggcccttccc

SEQ ID NO: 3467134 - DNA, 17 bp, Homo sapiens
acctgttagcagacagg

SEQ ID NO: 3467135 - DNA, 14 bp, Homo sapiens
acctgttgagcatc

SEQ ID NO: 3467136 - DNA, 19 bp, Homo sapiens
acctgttgagcatcacaga

SEQ ID NO: 3467137 - DNA, 20 bp, Homo sapiens
acctgttgagcatcacagaa

SEQ ID NO: 3467138 - DNA, 19 bp, Homo sapiens
acctgtttttaagctgttt

SEQ ID NO: 3467139 - DNA, 18 bp, Homo sapiens
acctgttttttttctttt

SEQ ID NO: 3467140 - DNA, 16 bp, Homo sapiens
accttaaacacccctc

SEQ ID NO: 3467141 - DNA, 22 bp, Homo sapiens
accttaaacacccctcagttgt

SEQ ID NO: 3467142 - DNA, 13 bp, Homo sapiens
accttaggcaggg

SEQ ID NO: 3467143 - DNA, 18 bp, Homo sapiens
accttaggccttcctctc

SEQ ID NO: 3467144 - DNA, 14 bp, Homo sapiens
accttattgtacct

SEQ ID NO: 3467145 - DNA, 22 bp, Homo sapiens
accttcatttcatgtatagttt

SEQ ID NO: 3467146 - DNA, 19 bp, Homo sapiens
accttccatggctcttttt

SEQ ID NO: 3467147 - DNA, 23 bp, Homo sapiens
accttcgtttactatgcctgtgt

SEQ ID NO: 3467148 - DNA, 23 bp, Homo sapiens
accttctccctcatttcaggagc

SEQ ID NO: 3467149 - DNA, 19 bp, Homo sapiens
accttctctacccatctcc

SEQ ID NO: 3467150 - DNA, 15 bp, Homo sapiens
accttgacagggcac

SEQ ID NO: 3467151 - DNA, 16 bp, Homo sapiens
accttgacagggcaca

SEQ ID NO: 3467152 - DNA, 19 bp, Homo sapiens
accttgacctttgtacagc

SEQ ID NO: 3467153 - DNA, 22 bp, Homo sapiens
accttggcaccagacacccagg

SEQ ID NO: 3467154 - DNA, 13 bp, Homo sapiens
accttggcctggg

SEQ ID NO: 3467155 - DNA, 18 bp, Homo sapiens
accttggctgcagggagt

SEQ ID NO: 3467156 - DNA, 23 bp, Homo sapiens
accttggggccttgatgactgcc

SEQ ID NO: 3467157 - DNA, 22 bp, Homo sapiens
accttgttatttctcagacttt

SEQ ID NO: 3467158 - DNA, 21 bp, Homo sapiens
acctttaagaattttaaatat

SEQ ID NO: 3467159 - DNA, 18 bp, Homo sapiens
acctttccaccacagcca

SEQ ID NO: 3467160 - DNA, 16 bp, Homo sapiens
acctttcctacatttt

SEQ ID NO: 3467161 - DNA, 18 bp, Homo sapiens
acctttcctacattttct

SEQ ID NO: 3467162 - DNA, 15 bp, Homo sapiens
acctttctcctttgt

SEQ ID NO: 3467163 - DNA, 16 bp, Homo sapiens
acctttctcctttgta

SEQ ID NO: 3467164 - DNA, 19 bp, Homo sapiens
acctttctcctttgtactt

SEQ ID NO: 3467165 - DNA, 22 bp, Homo sapiens
acctttgtacagcccagaggcc

SEQ ID NO: 3467166 - DNA, 15 bp, Homo sapiens
accttttatgtagta

SEQ ID NO: 3467167 - DNA, 20 bp, Homo sapiens
accttttatgtagtaattga

SEQ ID NO: 3467168 - DNA, 14 bp, Homo sapiens
acctttttccttcc

SEQ ID NO: 3467169 - DNA, 23 bp, Homo sapiens
accttttttcaacagtgaagaca

SEQ ID NO: 3467170 - DNA, 15 bp, Homo sapiens
accttttttgttcca

SEQ ID NO: 3467171 - DNA, 20 bp, Homo sapiens
accttttttgttttttcaaa

SEQ ID NO: 3467172 - DNA, 18 bp, Homo sapiens
accttttttttttttcca

SEQ ID NO: 3467173 - DNA, 19 bp, Homo sapiens
accttttttttttttccaa

SEQ ID NO: 3467174 - DNA, 14 bp, Homo sapiens
acgaacttccatgg

SEQ ID NO: 3467175 - DNA, 16 bp, Homo sapiens
acgaagctcattccca

SEQ ID NO: 3467176 - DNA, 22 bp, Homo sapiens
acgaatacttttgccctttgat

SEQ ID NO: 3467177 - DNA, 14 bp, Homo sapiens
acgacaaggaaagg

SEQ ID NO: 3467178 - DNA, 14 bp, Homo sapiens
acgagaaaacaata

SEQ ID NO: 3467179 - DNA, 19 bp, Homo sapiens
acgagctgtttactaggga

SEQ ID NO: 3467180 - DNA, 20 bp, Homo sapiens
acgaggaatctgtgggtctg

SEQ ID NO: 3467181 - DNA, 21 bp, Homo sapiens
acgaggggtgtcttgggcaga

SEQ ID NO: 3467182 - DNA, 13 bp, Homo sapiens
acgagtgctaagt

SEQ ID NO: 3467183 - DNA, 15 bp, Homo sapiens
acgcacctgcctcag

SEQ ID NO: 3467184 - DNA, 16 bp, Homo sapiens
acgcacctgcctcagg

SEQ ID NO: 3467185 - DNA, 14 bp, Homo sapiens
acgcagcaggaggc

SEQ ID NO: 3467186 - DNA, 15 bp, Homo sapiens
acgcagcccagagca

SEQ ID NO: 3467187 - DNA, 21 bp, Homo sapiens
acgcagcccagagcagaccct

SEQ ID NO: 3467188 - DNA, 16 bp, Homo sapiens
acgcaggcccctctcc

SEQ ID NO: 3467189 - DNA, 23 bp, Homo sapiens
acgcaggcccctctcctccgtgg

SEQ ID NO: 3467190 - DNA, 12 bp, Homo sapiens
acgccacccagc

SEQ ID NO: 3467191 - DNA, 15 bp, Homo sapiens
acgcccatctcagga

SEQ ID NO: 3467192 - DNA, 20 bp, Homo sapiens
acgcccgtcctgcctgtggc

SEQ ID NO: 3467193 - DNA, 21 bp, Homo sapiens
acgccctttcctcctcaggca

SEQ ID NO: 3467194 - DNA, 18 bp, Homo sapiens
acgcctcttctgtccctg

SEQ ID NO: 3467195 - DNA, 20 bp, Homo sapiens
acgcctgtaatcccagcact

SEQ ID NO: 3467196 - DNA, 23 bp, Homo sapiens
acgcgtgcacacaccagagccca

SEQ ID NO: 3467197 - DNA, 19 bp, Homo sapiens
acgctactataaagagaag

SEQ ID NO: 3467198 - DNA, 15 bp, Homo sapiens
acgctgcctgcccac

SEQ ID NO: 3467199 - DNA, 13 bp, Homo sapiens
acgctggaccttg

SEQ ID NO: 3467200 - DNA, 15 bp, Homo sapiens
acgctggagtgcagt

SEQ ID NO: 3467201 - DNA, 17 bp, Homo sapiens
acgctggagtgcagtga

SEQ ID NO: 3467202 - DNA, 21 bp, Homo sapiens
acgctgggtattaccatgtaa

SEQ ID NO: 3467203 - DNA, 23 bp, Homo sapiens
acgctgtccctagtaaaaataca

SEQ ID NO: 3467204 - DNA, 14 bp, Homo sapiens
acgctttgattcat

SEQ ID NO: 3467205 - DNA, 20 bp, Homo sapiens
acgcttttaatgaaaaggaa

SEQ ID NO: 3467206 - DNA, 19 bp, Homo sapiens
acggaatagttggctagga

SEQ ID NO: 3467207 - DNA, 16 bp, Homo sapiens
acggacaccccctcgc

SEQ ID NO: 3467208 - DNA, 14 bp, Homo sapiens
acggagatgtttca

SEQ ID NO: 3467209 - DNA, 19 bp, Homo sapiens
acggagccactcctctgac

SEQ ID NO: 3467210 - DNA, 20 bp, Homo sapiens
acggagccactcctctgact

SEQ ID NO: 3467211 - DNA, 19 bp, Homo sapiens
acggagtcccaccttggct

SEQ ID NO: 3467212 - DNA, 21 bp, Homo sapiens
acggagtcccaccttggctgc

SEQ ID NO: 3467213 - DNA, 23 bp, Homo sapiens
acggagtcccaccttggctgcag

SEQ ID NO: 3467214 - DNA, 12 bp, Homo sapiens
acggattccaaa

SEQ ID NO: 3467215 - DNA, 22 bp, Homo sapiens
acggcaggacaacgaggaagcc

SEQ ID NO: 3467216 - DNA, 13 bp, Homo sapiens
acggccacatcaa

SEQ ID NO: 3467217 - DNA, 12 bp, Homo sapiens
acggccaggcca

SEQ ID NO: 3467218 - DNA, 18 bp, Homo sapiens
acggccagggagaagctc

SEQ ID NO: 3467219 - DNA, 14 bp, Homo sapiens
acggctcccccagg

SEQ ID NO: 3467220 - DNA, 18 bp, Homo sapiens
acggctcccccaggcctg

SEQ ID NO: 3467221 - DNA, 23 bp, Homo sapiens
acggctcccccaggcctgagctg

SEQ ID NO: 3467222 - DNA, 18 bp, Homo sapiens
acggctcgatttctccag

SEQ ID NO: 3467223 - DNA, 22 bp, Homo sapiens
acggctgggcacacgcctccca

SEQ ID NO: 3467224 - DNA, 18 bp, Homo sapiens
acggggctcttctcattt

SEQ ID NO: 3467225 - DNA, 23 bp, Homo sapiens
acgggttagacagccaaaggctg

SEQ ID NO: 3467226 - DNA, 19 bp, Homo sapiens
acggtgactctgtccagct

SEQ ID NO: 3467227 - DNA, 14 bp, Homo sapiens
acggtgcccaagcc

SEQ ID NO: 3467228 - DNA, 15 bp, Homo sapiens
acggtgctccaggca

SEQ ID NO: 3467229 - DNA, 22 bp, Homo sapiens
acggtgctccaggcaggctaag

SEQ ID NO: 3467230 - DNA, 15 bp, Homo sapiens
acggtgttttgccat

SEQ ID NO: 3467231 - DNA, 12 bp, Homo sapiens
acgtaaagaact

SEQ ID NO: 3467232 - DNA, 20 bp, Homo sapiens
acgtagctgcaaaggacaga

SEQ ID NO: 3467233 - DNA, 22 bp, Homo sapiens
acgtatgtaacatgatgttaac

SEQ ID NO: 3467234 - DNA, 21 bp, Homo sapiens
acgtattagttgccaatatgc

SEQ ID NO: 3467235 - DNA, 12 bp, Homo sapiens
acgtcatctcag

SEQ ID NO: 3467236 - DNA, 13 bp, Homo sapiens
acgtgacacaaac

SEQ ID NO: 3467237 - DNA, 15 bp, Homo sapiens
acgtgagagtgtctt

SEQ ID NO: 3467238 - DNA, 13 bp, Homo sapiens
acgtggaggagca

SEQ ID NO: 3467239 - DNA, 19 bp, Homo sapiens
acgtggctcagccagcact

SEQ ID NO: 3467240 - DNA, 21 bp, Homo sapiens
acgtggctgcgtgcccctgct

SEQ ID NO: 3467241 - DNA, 22 bp, Homo sapiens
acgtggctgcgtgcccctgctg

SEQ ID NO: 3467242 - DNA, 18 bp, Homo sapiens
acgtgtgtgtgtgattgc

SEQ ID NO: 3467243 - DNA, 18 bp, Homo sapiens
acgtttacaagccccccc

SEQ ID NO: 3467244 - DNA, 11 bp, Homo sapiens
actaaaagata

SEQ ID NO: 3467245 - DNA, 21 bp, Homo sapiens
actaaaagatataagtgctgt

SEQ ID NO: 3467246 - DNA, 23 bp, Homo sapiens
actaaaagatataagtgctgtat

SEQ ID NO: 3467247 - DNA, 16 bp, Homo sapiens
actaaaagtttagaac

SEQ ID NO: 3467248 - DNA, 18 bp, Homo sapiens
actaaaagtttagaactt

SEQ ID NO: 3467249 - DNA, 16 bp, Homo sapiens
actaaactctctttgg

SEQ ID NO: 3467250 - DNA, 16 bp, Homo sapiens
actaaagtagagccct

SEQ ID NO: 3467251 - DNA, 18 bp, Homo sapiens
actaaatacttgctccat

SEQ ID NO: 3467252 - DNA, 13 bp, Homo sapiens
actaaccacgctg

SEQ ID NO: 3467253 - DNA, 13 bp, Homo sapiens
actaactaaactc

SEQ ID NO: 3467254 - DNA, 15 bp, Homo sapiens
actaactatgcatgg

SEQ ID NO: 3467255 - DNA, 19 bp, Homo sapiens
actaagcagaggaggggcc

SEQ ID NO: 3467256 - DNA, 22 bp, Homo sapiens
actaagcagaggaggggccgct

SEQ ID NO: 3467257 - DNA, 12 bp, Homo sapiens
actaaggggccc

SEQ ID NO: 3467258 - DNA, 17 bp, Homo sapiens
actaaggtgctaaatct

SEQ ID NO: 3467259 - DNA, 18 bp, Homo sapiens
actaagtagcccataagg

SEQ ID NO: 3467260 - DNA, 22 bp, Homo sapiens
actaagtgatgctgtgatacct

SEQ ID NO: 3467261 - DNA, 12 bp, Homo sapiens
actaataaacca

SEQ ID NO: 3467262 - DNA, 19 bp, Homo sapiens
actaatccaatacctcttg

SEQ ID NO: 3467263 - DNA, 21 bp, Homo sapiens
actaatggcatgagaaataca

SEQ ID NO: 3467264 - DNA, 21 bp, Homo sapiens
actaattttacatgtttataa

SEQ ID NO: 3467265 - DNA, 18 bp, Homo sapiens
actaatttttgtattatt

SEQ ID NO: 3467266 - DNA, 20 bp, Homo sapiens
actacaaacaaaatttctat

SEQ ID NO: 3467267 - DNA, 21 bp, Homo sapiens
actacaaacaaaatttctatt

SEQ ID NO: 3467268 - DNA, 22 bp, Homo sapiens
actacaaacaaaatttctatta

SEQ ID NO: 3467269 - DNA, 18 bp, Homo sapiens
actacagctatgaagaaa

SEQ ID NO: 3467270 - DNA, 13 bp, Homo sapiens
actacattcattt

SEQ ID NO: 3467271 - DNA, 18 bp, Homo sapiens
actaccttggttccccca

SEQ ID NO: 3467272 - DNA, 18 bp, Homo sapiens
actacggaatagttggct

SEQ ID NO: 3467273 - DNA, 21 bp, Homo sapiens
actactgcctttagaaaatat

SEQ ID NO: 3467274 - DNA, 19 bp, Homo sapiens
actacttgattttattgta

SEQ ID NO: 3467275 - DNA, 18 bp, Homo sapiens
actagaaatgggaatcat

SEQ ID NO: 3467276 - DNA, 22 bp, Homo sapiens
actagagggacctctcccaggg

SEQ ID NO: 3467277 - DNA, 19 bp, Homo sapiens
actagcatatctgccttta

SEQ ID NO: 3467278 - DNA, 23 bp, Homo sapiens
actaggcccccacttgcctcttc

SEQ ID NO: 3467279 - DNA, 19 bp, Homo sapiens
actagggagccatgtttca

SEQ ID NO: 3467280 - DNA, 19 bp, Homo sapiens
actagggagccatttgaga

SEQ ID NO: 3467281 - DNA, 20 bp, Homo sapiens
actagggatccctcatctgt

SEQ ID NO: 3467282 - DNA, 14 bp, Homo sapiens
actaggtaacttca

SEQ ID NO: 3467283 - DNA, 16 bp, Homo sapiens
actagtgcaaatcata

SEQ ID NO: 3467284 - DNA, 15 bp, Homo sapiens
actagtgttgcttgg

SEQ ID NO: 3467285 - DNA, 17 bp, Homo sapiens
actagttttagttttct

SEQ ID NO: 3467286 - DNA, 19 bp, Homo sapiens
actataaaatgtcttcaag

SEQ ID NO: 3467287 - DNA, 13 bp, Homo sapiens
actataagaactt

SEQ ID NO: 3467288 - DNA, 18 bp, Homo sapiens
actatattatcatgcaaa

SEQ ID NO: 3467289 - DNA, 16 bp, Homo sapiens
actatctactctcctc

SEQ ID NO: 3467290 - DNA, 19 bp, Homo sapiens
actatctactctcctcatc

SEQ ID NO: 3467291 - DNA, 14 bp, Homo sapiens
actatctgtctggt

SEQ ID NO: 3467292 - DNA, 17 bp, Homo sapiens
actatctgtctggtggc

SEQ ID NO: 3467293 - DNA, 17 bp, Homo sapiens
actatgaagacttaaaa

SEQ ID NO: 3467294 - DNA, 16 bp, Homo sapiens
actatgatctcaggag

SEQ ID NO: 3467295 - DNA, 15 bp, Homo sapiens
acatgaagattcttt

SEQ ID NO: 3467296 - DNA, 17 bp, Homo sapiens
acatgaagattctttcc

SEQ ID NO: 3467297 - DNA, 22 bp, Homo sapiens
acatgaagattctttcccaatt

SEQ ID NO: 3467298 - DNA, 19 bp, Homo sapiens
acatgatgttaactttgtg

SEQ ID NO: 3467299 - DNA, 13 bp, Homo sapiens
acatgatttcctt

SEQ ID NO: 3467300 - DNA, 16 bp, Homo sapiens
acatgatttccttgaa

SEQ ID NO: 3467301 - DNA, 23 bp, Homo sapiens
acatgatttccttgaatgtggct

SEQ ID NO: 3467302 - DNA, 13 bp, Homo sapiens
acatgcacgtgtg

SEQ ID NO: 3467303 - DNA, 17 bp, Homo sapiens
acatgcactcagctctt

SEQ ID NO: 3467304 - DNA, 12 bp, Homo sapiens
acatgcagtttg

SEQ ID NO: 3467305 - DNA, 13 bp, Homo sapiens
acatgcagtttga

SEQ ID NO: 3467306 - DNA, 18 bp, Homo sapiens
acatgcagtttgaaattc

SEQ ID NO: 3467307 - DNA, 23 bp, Homo sapiens
acatgcagtttgaaattctgaat

SEQ ID NO: 3467308 - DNA, 14 bp, Homo sapiens
acatgccaagcact

SEQ ID NO: 3467309 - DNA, 21 bp, Homo sapiens
acatgcctgccccaaacaaat

SEQ ID NO: 3467310 - DNA, 22 bp, Homo sapiens
acatgcctgccccaaacaaata

SEQ ID NO: 3467311 - DNA, 19 bp, Homo sapiens
acatgcctgtcctgaaagc

SEQ ID NO: 3467312 - DNA, 17 bp, Homo sapiens
acatgcggtagccagca

SEQ ID NO: 3467313 - DNA, 15 bp, Homo sapiens
acatgctatgttctg

SEQ ID NO: 3467314 - DNA, 23 bp, Homo sapiens
acatgctatgttctgtcttccca

SEQ ID NO: 3467315 - DNA, 18 bp, Homo sapiens
acatggtgggtccatggg

SEQ ID NO: 3467316 - DNA, 19 bp, Homo sapiens
acatggtgggtccatgggc

SEQ ID NO: 3467317 - DNA, 21 bp, Homo sapiens
acatgtaactatttcttcaga

SEQ ID NO: 3467318 - DNA, 15 bp, Homo sapiens
acatgtataaagtga

SEQ ID NO: 3467319 - DNA, 19 bp, Homo sapiens
acatgtataaagtgattga

SEQ ID NO: 3467320 - DNA, 22 bp, Homo sapiens
acatgtataaagtgattgactt

SEQ ID NO: 3467321 - DNA, 11 bp, Homo sapiens
acatgtatgtg

SEQ ID NO: 3467322 - DNA, 15 bp, Homo sapiens
acatgtcttaatgaa

SEQ ID NO: 3467323 - DNA, 19 bp, Homo sapiens
acatgtggccatggcctct

SEQ ID NO: 3467324 - DNA, 18 bp, Homo sapiens
acattaactcagtggaag

SEQ ID NO: 3467325 - DNA, 14 bp, Homo sapiens
acattagaagacaa

SEQ ID NO: 3467326 - DNA, 15 bp, Homo sapiens
acattagttgcacta

SEQ ID NO: 3467327 - DNA, 13 bp, Homo sapiens
acattcacctgcc

SEQ ID NO: 3467328 - DNA, 17 bp, Homo sapiens
acattcctttgggtatg

SEQ ID NO: 3467329 - DNA, 22 bp, Homo sapiens
acattctagatgcaagtctctt

SEQ ID NO: 3467330 - DNA, 20 bp, Homo sapiens
acattctattgactttctta

SEQ ID NO: 3467331 - DNA, 16 bp, Homo sapiens
acattctctaataaga

SEQ ID NO: 3467332 - DNA, 18 bp, Homo sapiens
acattctctaataagaaa

SEQ ID NO: 3467333 - DNA, 20 bp, Homo sapiens
acattctctaataagaaaac

SEQ ID NO: 3467334 - DNA, 22 bp, Homo sapiens
acattcttggcttaatcatttt

SEQ ID NO: 3467335 - DNA, 17 bp, Homo sapiens
acattgccaaaaaggat

SEQ ID NO: 3467336 - DNA, 17 bp, Homo sapiens
acattgcctttgaatgt

SEQ ID NO: 3467337 - DNA, 23 bp, Homo sapiens
acattgcctttgaatgttaattt

SEQ ID NO: 3467338 - DNA, 22 bp, Homo sapiens
acattggcacctaatccaggca

SEQ ID NO: 3467339 - DNA, 21 bp, Homo sapiens
acattgttcacctttgtagca

SEQ ID NO: 3467340 - DNA, 17 bp, Homo sapiens
acattgtttgctgctat

SEQ ID NO: 3467341 - DNA, 18 bp, Homo sapiens
acattgtttgctgctatt

SEQ ID NO: 3467342 - DNA, 23 bp, Homo sapiens
acatttagatcctggtttcataa

SEQ ID NO: 3467343 - DNA, 16 bp, Homo sapiens
acatttcaccatggcc

SEQ ID NO: 3467344 - DNA, 17 bp, Homo sapiens
acatttgatgcatgtct

SEQ ID NO: 3467345 - DNA, 22 bp, Homo sapiens
acatttgatgcatgtcttttaa

SEQ ID NO: 3467346 - DNA, 17 bp, Homo sapiens
acatttggaatactttt

SEQ ID NO: 3467347 - DNA, 14 bp, Homo sapiens
acatttggagaggg

SEQ ID NO: 3467348 - DNA, 22 bp, Homo sapiens
acatttggaggcaatcctacct

SEQ ID NO: 3467349 - DNA, 20 bp, Homo sapiens
acatttggagtgttcccctt

SEQ ID NO: 3467350 - DNA, 18 bp, Homo sapiens
acattttaaaaacataga

SEQ ID NO: 3467351 - DNA, 15 bp, Homo sapiens
acattttactgttgt

SEQ ID NO: 3467352 - DNA, 23 bp, Homo sapiens
acattttctttttttattaaaca

SEQ ID NO: 3467353 - DNA, 15 bp, Homo sapiens
acattttgagaacaa

SEQ ID NO: 3467354 - DNA, 14 bp, Homo sapiens
acatttttcaactt

SEQ ID NO: 3467355 - DNA, 16 bp, Homo sapiens
acatttttcaactttg

SEQ ID NO: 3467356 - DNA, 21 bp, Homo sapiens
acatttttcaactttgaataa

SEQ ID NO: 3467357 - DNA, 23 bp, Homo sapiens
acatttttcaactttgaataaag

SEQ ID NO: 3467358 - DNA, 12 bp, Homo sapiens
acattttttaaa

SEQ ID NO: 3467359 - DNA, 19 bp, Homo sapiens
accaaaaactgaaagtgaa

SEQ ID NO: 3467360 - DNA, 14 bp, Homo sapiens
accaaaagacactg

SEQ ID NO: 3467361 - DNA, 21 bp, Homo sapiens
accaaaatgatacttactgaa

SEQ ID NO: 3467362 - DNA, 22 bp, Homo sapiens
accaaaattttgtcccatctct

SEQ ID NO: 3467363 - DNA, 17 bp, Homo sapiens
accaaaggtgaaggaat

SEQ ID NO: 3467364 - DNA, 19 bp, Homo sapiens
accaaaggtgaaggaatat

SEQ ID NO: 3467365 - DNA, 21 bp, Homo sapiens
accaaaggtgaaggaatatat

SEQ ID NO: 3467366 - DNA, 21 bp, Homo sapiens
accaaagtgtcttttgacatt

SEQ ID NO: 3467367 - DNA, 23 bp, Homo sapiens
accaaagtgtcttttgacatttt

SEQ ID NO: 3467368 - DNA, 15 bp, Homo sapiens
accaaatctggaagc

SEQ ID NO: 3467369 - DNA, 14 bp, Homo sapiens
accaagaaagcagg

SEQ ID NO: 3467370 - DNA, 11 bp, Homo sapiens
accaagaagat

SEQ ID NO: 3467371 - DNA, 14 bp, Homo sapiens
accaagcaggaagc

SEQ ID NO: 3467372 - DNA, 24 bp, Homo sapiens
accaagcaggaagctcagactggt

SEQ ID NO: 3467373 - DNA, 21 bp, Homo sapiens
accaagctttcaaacatgttg

SEQ ID NO: 3467374 - DNA, 20 bp, Homo sapiens
accaaggaaacgctacctct

SEQ ID NO: 3467375 - DNA, 15 bp, Homo sapiens
accaagggacaggag

SEQ ID NO: 3467376 - DNA, 18 bp, Homo sapiens
accaatcaaatgtctggg

SEQ ID NO: 3467377 - DNA, 12 bp, Homo sapiens
accaatgtcttg

SEQ ID NO: 3467378 - DNA, 14 bp, Homo sapiens
accacaaactgtaa

SEQ ID NO: 3467379 - DNA, 18 bp, Homo sapiens
accacaaactgtaataca

SEQ ID NO: 3467380 - DNA, 14 bp, Homo sapiens
accacacaaagaca

SEQ ID NO: 3467381 - DNA, 12 bp, Homo sapiens
accacacatctg

SEQ ID NO: 3467382 - DNA, 21 bp, Homo sapiens
accacacccagcccacttctg

SEQ ID NO: 3467383 - DNA, 23 bp, Homo sapiens
accacacccagcccacttctgcc

SEQ ID NO: 3467384 - DNA, 13 bp, Homo sapiens
accacacctggct

SEQ ID NO: 3467385 - DNA, 21 bp, Homo sapiens
accacactggactccggccct

SEQ ID NO: 3467386 - DNA, 14 bp, Homo sapiens
accacagctgctgg

SEQ ID NO: 3467387 - DNA, 15 bp, Homo sapiens
accacagctgctgga

SEQ ID NO: 3467388 - DNA, 22 bp, Homo sapiens
accacaggttcatgccaccatg

SEQ ID NO: 3467389 - DNA, 19 bp, Homo sapiens
accacatcttgctctgctg

SEQ ID NO: 3467390 - DNA, 21 bp, Homo sapiens
accacatcttgctctgctgac

SEQ ID NO: 3467391 - DNA, 20 bp, Homo sapiens
accacatgccaagcactgtg

SEQ ID NO: 3467392 - DNA, 18 bp, Homo sapiens
accacatgcggagaacaa

SEQ ID NO: 3467393 - DNA, 15 bp, Homo sapiens
accaccagttaacgt

SEQ ID NO: 3467394 - DNA, 13 bp, Homo sapiens
accaccctgtctt

SEQ ID NO: 3467395 - DNA, 19 bp, Homo sapiens
accacgactggccagggcc

SEQ ID NO: 3467396 - DNA, 18 bp, Homo sapiens
accacgcccgtcctgcct

SEQ ID NO: 3467397 - DNA, 21 bp, Homo sapiens
accacgcccgtcctgcctgtg

SEQ ID NO: 3467398 - DNA, 23 bp, Homo sapiens
accacgcccgtcctgcctgtggc

SEQ ID NO: 3467399 - DNA, 14 bp, Homo sapiens
accacgctggacct

SEQ ID NO: 3467400 - DNA, 17 bp, Homo sapiens
accactgcaagtccttt

SEQ ID NO: 3467401 - DNA, 14 bp, Homo sapiens
accacttcagctga

SEQ ID NO: 3467402 - DNA, 15 bp, Homo sapiens
accacttcagctgac

SEQ ID NO: 3467403 - DNA, 17 bp, Homo sapiens
accactttttgcagctt

SEQ ID NO: 3467404 - DNA, 20 bp, Homo sapiens
accactttttgcagctttct

SEQ ID NO: 3467405 - DNA, 18 bp, Homo sapiens
accagaacagtatgaatt

SEQ ID NO: 3467406 - DNA, 17 bp, Homo sapiens
accagacacccaggact

SEQ ID NO: 3467407 - DNA, 19 bp, Homo sapiens
accagagagagcaaggaag

SEQ ID NO: 3467408 - DNA, 20 bp, Homo sapiens
accagagataatatgagaat

SEQ ID NO: 3467409 - DNA, 12 bp, Homo sapiens
accagagcccac

SEQ ID NO: 3467410 - DNA, 19 bp, Homo sapiens
accagagcccaccttggct

SEQ ID NO: 3467411 - DNA, 22 bp, Homo sapiens
accagagcccaccttggctcaa

SEQ ID NO: 3467412 - DNA, 14 bp, Homo sapiens
accagatgcagctc

SEQ ID NO: 3467413 - DNA, 14 bp, Homo sapiens
accagatggttgtg

SEQ ID NO: 3467414 - DNA, 13 bp, Homo sapiens
accagcagcctgg

SEQ ID NO: 3467415 - DNA, 18 bp, Homo sapiens
accagcagcgcctttccc

SEQ ID NO: 3467416 - DNA, 17 bp, Homo sapiens
accagcattccttttga

SEQ ID NO: 3467417 - DNA, 20 bp, Homo sapiens
accagccccagtgcccacag

SEQ ID NO: 3467418 - DNA, 17 bp, Homo sapiens
accagcctggccaacat

SEQ ID NO: 3467419 - DNA, 21 bp, Homo sapiens
accagcgtatatataagaaag

SEQ ID NO: 3467420 - DNA, 23 bp, Homo sapiens
accagctcaggacagatgccaca

SEQ ID NO: 3467421 - DNA, 14 bp, Homo sapiens
accagctgcaaagt

SEQ ID NO: 3467422 - DNA, 16 bp, Homo sapiens
accagcttagatttta

SEQ ID NO: 3467423 - DNA, 14 bp, Homo sapiens
accaggatagagac

SEQ ID NO: 3467424 - DNA, 17 bp, Homo sapiens
accaggatagagactgg

SEQ ID NO: 3467425 - DNA, 19 bp, Homo sapiens
accaggatccagcctcact

SEQ ID NO: 3467426 - DNA, 14 bp, Homo sapiens
accaggccacctcc

SEQ ID NO: 3467427 - DNA, 12 bp, Homo sapiens
accaggcctggg

SEQ ID NO: 3467428 - DNA, 13 bp, Homo sapiens
accaggctgtgtc

SEQ ID NO: 3467429 - DNA, 18 bp, Homo sapiens
accaggcttgcctgcagg

SEQ ID NO: 3467430 - DNA, 14 bp, Homo sapiens
accaggggtttctc

SEQ ID NO: 3467431 - DNA, 22 bp, Homo sapiens
accaggtgcctttcaaatttag

SEQ ID NO: 3467432 - DNA, 15 bp, Homo sapiens
accagtccccccacc

SEQ ID NO: 3467433 - DNA, 17 bp, Homo sapiens
accagtccccccaccct

SEQ ID NO: 3467434 - DNA, 23 bp, Homo sapiens
accagtgaacttttttttttaat

SEQ ID NO: 3467435 - DNA, 13 bp, Homo sapiens
accagtgaatttt

SEQ ID NO: 3467436 - DNA, 18 bp, Homo sapiens
accagtgaatttttgcaa

SEQ ID NO: 3467437 - DNA, 23 bp, Homo sapiens
accagttaacgtattagttgcca

SEQ ID NO: 3467438 - DNA, 23 bp, Homo sapiens
accatagtaccatttatacaaat

SEQ ID NO: 3467439 - DNA, 16 bp, Homo sapiens
accatcatgtctggct

SEQ ID NO: 3467440 - DNA, 15 bp, Homo sapiens
accatccctttttga

SEQ ID NO: 3467441 - DNA, 14 bp, Homo sapiens
accatctgctgccc

SEQ ID NO: 3467442 - DNA, 20 bp, Homo sapiens
accatctgtcttgccagcca

SEQ ID NO: 3467443 - DNA, 21 bp, Homo sapiens
accatctgtcttgccagccag

SEQ ID NO: 3467444 - DNA, 22 bp, Homo sapiens
accatgaatgaacccctggctc

SEQ ID NO: 3467445 - DNA, 19 bp, Homo sapiens
accatgatggccaggctga

SEQ ID NO: 3467446 - DNA, 22 bp, Homo sapiens
accatgattaaccacttcagct

SEQ ID NO: 3467447 - DNA, 20 bp, Homo sapiens
accatgcccggctaattttt

SEQ ID NO: 3467448 - DNA, 17 bp, Homo sapiens
accatgcctcactaatt

SEQ ID NO: 3467449 - DNA, 11 bp, Homo sapiens
accatgtaaat

SEQ ID NO: 3467450 - DNA, 14 bp, Homo sapiens
accatgtaaataat

SEQ ID NO: 3467451 - DNA, 22 bp, Homo sapiens
accatgtcagcaaaaagcaaaa

SEQ ID NO: 3467452 - DNA, 22 bp, Homo sapiens
accatgtctatgattcgtgtaa

SEQ ID NO: 3467453 - DNA, 13 bp, Homo sapiens
accattaaccaga

SEQ ID NO: 3467454 - DNA, 21 bp, Homo sapiens
accattcagtgattactgtca

SEQ ID NO: 3467455 - DNA, 16 bp, Homo sapiens
accattctgcatttag

SEQ ID NO: 3467456 - DNA, 18 bp, Homo sapiens
accattgaattcttggtt

SEQ ID NO: 3467457 - DNA, 13 bp, Homo sapiens
accatttatacaa

SEQ ID NO: 3467458 - DNA, 19 bp, Homo sapiens
accatttatacaaattaga

SEQ ID NO: 3467459 - DNA, 19 bp, Homo sapiens
acccaactagctctatgtt

SEQ ID NO: 3467460 - DNA, 19 bp, Homo sapiens
acccaagacctcagggcac

SEQ ID NO: 3467461 - DNA, 14 bp, Homo sapiens
acccaagtcttctc

SEQ ID NO: 3467462 - DNA, 13 bp, Homo sapiens
acccaatccaaat

SEQ ID NO: 3467463 - DNA, 22 bp, Homo sapiens
acccacaattgccttggagatc

SEQ ID NO: 3467464 - DNA, 15 bp, Homo sapiens
acccaccagcctaag

SEQ ID NO: 3467465 - DNA, 15 bp, Homo sapiens
acccacctcagcctc

SEQ ID NO: 3467466 - DNA, 16 bp, Homo sapiens
acccacctcagcctcc

SEQ ID NO: 3467467 - DNA, 18 bp, Homo sapiens
acccacctccctgcctcc

SEQ ID NO: 3467468 - DNA, 21 bp, Homo sapiens
acccacgctgggtattaccat

SEQ ID NO: 3467469 - DNA, 10 bp, Homo sapiens
acccactgct

SEQ ID NO: 3467470 - DNA, 11 bp, Homo sapiens
acccactgctc

SEQ ID NO: 3467471 - DNA, 20 bp, Homo sapiens
acccactgcttttggtctgt

SEQ ID NO: 3467472 - DNA, 22 bp, Homo sapiens
acccagacctgttagcagacag

SEQ ID NO: 3467473 - DNA, 17 bp, Homo sapiens
acccagacggctccact

SEQ ID NO: 3467474 - DNA, 21 bp, Homo sapiens
acccagacggctccactagga

SEQ ID NO: 3467475 - DNA, 11 bp, Homo sapiens
acccagactgt

SEQ ID NO: 3467476 - DNA, 12 bp, Homo sapiens
acccagactgtc

SEQ ID NO: 3467477 - DNA, 22 bp, Homo sapiens
acccagaggaaggggccagagg

SEQ ID NO: 3467478 - DNA, 15 bp, Homo sapiens
acccagatctcatgg

SEQ ID NO: 3467479 - DNA, 22 bp, Homo sapiens
acccagatgggggaaagcacag

SEQ ID NO: 3467480 - DNA, 16 bp, Homo sapiens
acccagccccttgaga

SEQ ID NO: 3467481 - DNA, 20 bp, Homo sapiens
acccagccccttgagaaacc

SEQ ID NO: 3467482 - DNA, 15 bp, Homo sapiens
acccagccctcatcc

SEQ ID NO: 3467483 - DNA, 23 bp, Homo sapiens
acccagcgagccctggtggcagt

SEQ ID NO: 3467484 - DNA, 15 bp, Homo sapiens
acccagcgtggcctc

SEQ ID NO: 3467485 - DNA, 19 bp, Homo sapiens
acccaggagccccgaggcc

SEQ ID NO: 3467486 - DNA, 14 bp, Homo sapiens
acccaggctgggca

SEQ ID NO: 3467487 - DNA, 22 bp, Homo sapiens
acccagggaacagccactcccc

SEQ ID NO: 3467488 - DNA, 22 bp, Homo sapiens
acccagggttcccgcggggctg

SEQ ID NO: 3467489 - DNA, 17 bp, Homo sapiens
acccagtctcctctcca

SEQ ID NO: 3467490 - DNA, 18 bp, Homo sapiens
acccagtctcctctccat

SEQ ID NO: 3467491 - DNA, 19 bp, Homo sapiens
acccagtctcctctccatt

SEQ ID NO: 3467492 - DNA, 18 bp, Homo sapiens
acccagtgcccccactga

SEQ ID NO: 3467493 - DNA, 22 bp, Homo sapiens
acccagtgcccccactgaccag

SEQ ID NO: 3467494 - DNA, 14 bp, Homo sapiens
acccatacaccccc

SEQ ID NO: 3467495 - DNA, 13 bp, Homo sapiens
acccatctgcacc

SEQ ID NO: 3467496 - DNA, 13 bp, Homo sapiens
acccatctgggct

SEQ ID NO: 3467497 - DNA, 20 bp, Homo sapiens
acccatgagttggggtctgg

SEQ ID NO: 3467498 - DNA, 17 bp, Homo sapiens
acccatggctctatttc

SEQ ID NO: 3467499 - DNA, 19 bp, Homo sapiens
acccatggctctatttctt

SEQ ID NO: 3467500 - DNA, 17 bp, Homo sapiens
accccaaatgctctctc

SEQ ID NO: 3467501 - DNA, 23 bp, Homo sapiens
accccaaatgctctctcttctta

SEQ ID NO: 3467502 - DNA, 19 bp, Homo sapiens
accccaagatttcagatat

SEQ ID NO: 3467503 - DNA, 24 bp, Homo sapiens
accccagattcttcagcttgatcc

SEQ ID NO: 3467504 - DNA, 21 bp, Homo sapiens
accccaggacctcttctggag

SEQ ID NO: 3467505 - DNA, 17 bp, Homo sapiens
accccaggccctgccag

SEQ ID NO: 3467506 - DNA, 22 bp, Homo sapiens
accccaggccctgccagagcag

SEQ ID NO: 3467507 - DNA, 10 bp, Homo sapiens
accccagggc

SEQ ID NO: 3467508 - DNA, 13 bp, Homo sapiens
accccagggcctg

SEQ ID NO: 3467509 - DNA, 14 bp, Homo sapiens
accccagggcctga

SEQ ID NO: 3467510 - DNA, 15 bp, Homo sapiens
accccatcccacacc

SEQ ID NO: 3467511 - DNA, 18 bp, Homo sapiens
accccatctctacaaaaa

SEQ ID NO: 3467512 - DNA, 23 bp, Homo sapiens
accccatgaccttatccttcctc

SEQ ID NO: 3467513 - DNA, 12 bp, Homo sapiens
acccccagcact

SEQ ID NO: 3467514 - DNA, 13 bp, Homo sapiens
acccccagcctgc

SEQ ID NO: 3467515 - DNA, 17 bp, Homo sapiens
acccccatttctattta

SEQ ID NO: 3467516 - DNA, 13 bp, Homo sapiens
accccccagcact

SEQ ID NO: 3467517 - DNA, 15 bp, Homo sapiens
accccccagcactga

SEQ ID NO: 3467518 - DNA, 19 bp, Homo sapiens
accccccagcactgaggaa

SEQ ID NO: 3467519 - DNA, 12 bp, Homo sapiens
acccccctgggc

SEQ ID NO: 3467520 - DNA, 14 bp, Homo sapiens
acccccgccccctg

SEQ ID NO: 3467521 - DNA, 18 bp, Homo sapiens
acccccgccccctgccct

SEQ ID NO: 3467522 - DNA, 20 bp, Homo sapiens
acccccgccccctgccctcc

SEQ ID NO: 3467523 - DNA, 16 bp, Homo sapiens
accccctccttcagac

SEQ ID NO: 3467524 - DNA, 19 bp, Homo sapiens
accccctccttcagacacc

SEQ ID NO: 3467525 - DNA, 21 bp, Homo sapiens
accccctcttctgagcacaga

SEQ ID NO: 3467526 - DNA, 23 bp, Homo sapiens
accccctgaaagtgacagagacc

SEQ ID NO: 3467527 - DNA, 17 bp, Homo sapiens
accccgcagacaccttg

SEQ ID NO: 3467528 - DNA, 14 bp, Homo sapiens
acccctaaactcca

SEQ ID NO: 3467529 - DNA, 17 bp, Homo sapiens
acccctaaactccaggg

SEQ ID NO: 3467530 - DNA, 20 bp, Homo sapiens
acccctcaacacctctgcac

SEQ ID NO: 3467531 - DNA, 19 bp, Homo sapiens
acccctccatgtgggctag

SEQ ID NO: 3467532 - DNA, 21 bp, Homo sapiens
acccctccccattcacagagc

SEQ ID NO: 3467533 - DNA, 22 bp, Homo sapiens
acccctccctcactcccacctg

SEQ ID NO: 3467534 - DNA, 16 bp, Homo sapiens
acccctccctttctcc

SEQ ID NO: 3467535 - DNA, 18 bp, Homo sapiens
acccctggaagagcccag

SEQ ID NO: 3467536 - DNA, 13 bp, Homo sapiens
acccctggctcct

SEQ ID NO: 3467537 - DNA, 19 bp, Homo sapiens
acccctggctccttcacca

SEQ ID NO: 3467538 - DNA, 14 bp, Homo sapiens
acccctggttctca

SEQ ID NO: 3467539 - DNA, 20 bp, Homo sapiens
accccttaagccctggcccc

SEQ ID NO: 3467540 - DNA, 16 bp, Homo sapiens
acccgacagagggaag

SEQ ID NO: 3467541 - DNA, 13 bp, Homo sapiens
acccgaggaaact

SEQ ID NO: 3467542 - DNA, 14 bp, Homo sapiens
acccggcccctgct

SEQ ID NO: 3467543 - DNA, 16 bp, Homo sapiens
acccggcccctgctgg

SEQ ID NO: 3467544 - DNA, 15 bp, Homo sapiens
acccgtacaacgtgt

SEQ ID NO: 3467545 - DNA, 12 bp, Homo sapiens
accctaaaaaga

SEQ ID NO: 3467546 - DNA, 21 bp, Homo sapiens
accctacttcattttcagagt

SEQ ID NO: 3467547 - DNA, 17 bp, Homo sapiens
accctagccctctccct

SEQ ID NO: 3467548 - DNA, 19 bp, Homo sapiens
accctatatgcttactgtg

SEQ ID NO: 3467549 - DNA, 17 bp, Homo sapiens
accctcattctactgaa

SEQ ID NO: 3467550 - DNA, 13 bp, Homo sapiens
accctcgccggac

SEQ ID NO: 3467551 - DNA, 15 bp, Homo sapiens
accctctaacctcgc

SEQ ID NO: 3467552 - DNA, 16 bp, Homo sapiens
accctctgctgaagac

SEQ ID NO: 3467553 - DNA, 15 bp, Homo sapiens
accctctttgctgca

SEQ ID NO: 3467554 - DNA, 21 bp, Homo sapiens
accctgaagatttcagaggct

SEQ ID NO: 3467555 - DNA, 12 bp, Homo sapiens
accctgaagggg

SEQ ID NO: 3467556 - DNA, 17 bp, Homo sapiens
accctgaaggggccatg

SEQ ID NO: 3467557 - DNA, 18 bp, Homo sapiens
accctgaaggggccatga

SEQ ID NO: 3467558 - DNA, 17 bp, Homo sapiens
accctgagctgaggcag

SEQ ID NO: 3467559 - DNA, 19 bp, Homo sapiens
accctgaggtcactgctag

SEQ ID NO: 3467560 - DNA, 13 bp, Homo sapiens
accctgccctcct

SEQ ID NO: 3467561 - DNA, 22 bp, Homo sapiens
accctgcgcccagtccttccac

SEQ ID NO: 3467562 - DNA, 22 bp, Homo sapiens
accctggccgagtccaagctgg

SEQ ID NO: 3467563 - DNA, 15 bp, Homo sapiens
accctgggccctggg

SEQ ID NO: 3467564 - DNA, 17 bp, Homo sapiens
accctgggccctgggct

SEQ ID NO: 3467565 - DNA, 18 bp, Homo sapiens
accctgggccctgggctg

SEQ ID NO: 3467566 - DNA, 19 bp, Homo sapiens
accctggggaaggagccag

SEQ ID NO: 3467567 - DNA, 20 bp, Homo sapiens
aagcgattctcctgcctcag

SEQ ID NO: 3467568 - DNA, 16 bp, Homo sapiens
aagcgattcttctgct

SEQ ID NO: 3467569 - DNA, 13 bp, Homo sapiens
aagcggctgcctc

SEQ ID NO: 3467570 - DNA, 14 bp, Homo sapiens
aagcggctgcctcc

SEQ ID NO: 3467571 - DNA, 16 bp, Homo sapiens
aagcgtgagccactgc

SEQ ID NO: 3467572 - DNA, 23 bp, Homo sapiens
aagctaatgaccaacctgtttct

SEQ ID NO: 3467573 - DNA, 14 bp, Homo sapiens
aagctaatttgcat

SEQ ID NO: 3467574 - DNA, 15 bp, Homo sapiens
aagctaatttgcatt

SEQ ID NO: 3467575 - DNA, 18 bp, Homo sapiens
aagctaggcctggccaga

SEQ ID NO: 3467576 - DNA, 18 bp, Homo sapiens
aagctataaattcctctt

SEQ ID NO: 3467577 - DNA, 20 bp, Homo sapiens
aagctatagacccgaggaaa

SEQ ID NO: 3467578 - DNA, 17 bp, Homo sapiens
aagctcagactggttga

SEQ ID NO: 3467579 - DNA, 13 bp, Homo sapiens
aagctccaagccc

SEQ ID NO: 3467580 - DNA, 15 bp, Homo sapiens
aagctcctcctccct

SEQ ID NO: 3467581 - DNA, 18 bp, Homo sapiens
aagctcctcctccctgca

SEQ ID NO: 3467582 - DNA, 16 bp, Homo sapiens
aagctcctctccccag

SEQ ID NO: 3467583 - DNA, 18 bp, Homo sapiens
aagctcctctccccagcc

SEQ ID NO: 3467584 - DNA, 21 bp, Homo sapiens
aagctcctctccccagcccag

SEQ ID NO: 3467585 - DNA, 17 bp, Homo sapiens
aagctctgctcctctcc

SEQ ID NO: 3467586 - DNA, 23 bp, Homo sapiens
aagctgaatacattctgctttca

SEQ ID NO: 3467587 - DNA, 11 bp, Homo sapiens
aagctgacctt

SEQ ID NO: 3467588 - DNA, 18 bp, Homo sapiens
aagctgagagtgctatga

SEQ ID NO: 3467589 - DNA, 20 bp, Homo sapiens
aagctgcaccctcaggcagg

SEQ ID NO: 3467590 - DNA, 22 bp, Homo sapiens
aagctgcaccctcaggcaggtg

SEQ ID NO: 3467591 - DNA, 20 bp, Homo sapiens
aagctgccgaaccaaaagaa

SEQ ID NO: 3467592 - DNA, 23 bp, Homo sapiens
aagctgcctcccctctccttcct

SEQ ID NO: 3467593 - DNA, 12 bp, Homo sapiens
aagctgctgtct

SEQ ID NO: 3467594 - DNA, 15 bp, Homo sapiens
aagctgctgtctcta

SEQ ID NO: 3467595 - DNA, 15 bp, Homo sapiens
aagctgggcaggttg

SEQ ID NO: 3467596 - DNA, 18 bp, Homo sapiens
aagctgttactgtcttca

SEQ ID NO: 3467597 - DNA, 15 bp, Homo sapiens
aagctgtttccatag

SEQ ID NO: 3467598 - DNA, 20 bp, Homo sapiens
aagcttccatgattctattt

SEQ ID NO: 3467599 - DNA, 23 bp, Homo sapiens
aagcttctagaggctcatggccc

SEQ ID NO: 3467600 - DNA, 14 bp, Homo sapiens
aagcttgctcacat

SEQ ID NO: 3467601 - DNA, 23 bp, Homo sapiens
aagctttcatgtaaactgtgcac

SEQ ID NO: 3467602 - DNA, 22 bp, Homo sapiens
aagctttggtgagaacctgggt

SEQ ID NO: 3467603 - DNA, 19 bp, Homo sapiens
aaggaaaaaataacaatga

SEQ ID NO: 3467604 - DNA, 16 bp, Homo sapiens
aaggaaaaatgtgtaa

SEQ ID NO: 3467605 - DNA, 13 bp, Homo sapiens
aaggaaactttcc

SEQ ID NO: 3467606 - DNA, 14 bp, Homo sapiens
aaggaacactgaca

SEQ ID NO: 3467607 - DNA, 18 bp, Homo sapiens
aaggaaggtggatggccc

SEQ ID NO: 3467608 - DNA, 21 bp, Homo sapiens
aaggaagtcaaagcaaggaaa

SEQ ID NO: 3467609 - DNA, 13 bp, Homo sapiens
aaggaatataatg

SEQ ID NO: 3467610 - DNA, 22 bp, Homo sapiens
aaggaatatatggcagagttgt

SEQ ID NO: 3467611 - DNA, 21 bp, Homo sapiens
aaggaatccactcccaggcag

SEQ ID NO: 3467612 - DNA, 23 bp, Homo sapiens
aaggaatccactcccaggcagcc

SEQ ID NO: 3467613 - DNA, 22 bp, Homo sapiens
aaggacacagatgaaacacaaa

SEQ ID NO: 3467614 - DNA, 18 bp, Homo sapiens
aaggacactggggtctgt

SEQ ID NO: 3467615 - DNA, 14 bp, Homo sapiens
aaggaccctgtgcc

SEQ ID NO: 3467616 - DNA, 20 bp, Homo sapiens
aaggactgagcaccctctgg

SEQ ID NO: 3467617 - DNA, 17 bp, Homo sapiens
aaggacttcctgtccag

SEQ ID NO: 3467618 - DNA, 21 bp, Homo sapiens
aaggacttcctgtccagctcc

SEQ ID NO: 3467619 - DNA, 14 bp, Homo sapiens
aaggagacaggcag

SEQ ID NO: 3467620 - DNA, 11 bp, Homo sapiens
aaggagagcta

SEQ ID NO: 3467621 - DNA, 13 bp, Homo sapiens
aaggagaggaggc

SEQ ID NO: 3467622 - DNA, 20 bp, Homo sapiens
aaggagaggcaacatccaaa

SEQ ID NO: 3467623 - DNA, 17 bp, Homo sapiens
aaggagccccattcctg

SEQ ID NO: 3467624 - DNA, 19 bp, Homo sapiens
aaggagccccattcctggg

SEQ ID NO: 3467625 - DNA, 20 bp, Homo sapiens
aaggagctgctatagcctgg

SEQ ID NO: 3467626 - DNA, 21 bp, Homo sapiens
aaggaggggaaaaaaatgttg

SEQ ID NO: 3467627 - DNA, 12 bp, Homo sapiens
aaggagggtgag

SEQ ID NO: 3467628 - DNA, 17 bp, Homo sapiens
aaggagtcaaaactaca

SEQ ID NO: 3467629 - DNA, 19 bp, Homo sapiens
aaggatactgtaacacttt

SEQ ID NO: 3467630 - DNA, 17 bp, Homo sapiens
aaggatagaagctgcag

SEQ ID NO: 3467631 - DNA, 13 bp, Homo sapiens
aaggatcatctga

SEQ ID NO: 3467632 - DNA, 16 bp, Homo sapiens
aaggatgtacatttcc

SEQ ID NO: 3467633 - DNA, 17 bp, Homo sapiens
aaggatgtgattgtgga

SEQ ID NO: 3467634 - DNA, 22 bp, Homo sapiens
aaggatgtgattgtggaatgga

SEQ ID NO: 3467635 - DNA, 15 bp, Homo sapiens
aaggattgctactgt

SEQ ID NO: 3467636 - DNA, 15 bp, Homo sapiens
aaggcaaaaatgtaa

SEQ ID NO: 3467637 - DNA, 14 bp, Homo sapiens
aaggcaaaattgca

SEQ ID NO: 3467638 - DNA, 22 bp, Homo sapiens
aaggcacctataaaacaggtca

SEQ ID NO: 3467639 - DNA, 12 bp, Homo sapiens
aaggcactgcct

SEQ ID NO: 3467640 - DNA, 14 bp, Homo sapiens
aaggcactgcctga

SEQ ID NO: 3467641 - DNA, 15 bp, Homo sapiens
aaggcagcgacccca

SEQ ID NO: 3467642 - DNA, 17 bp, Homo sapiens
aaggcagcgaccccagg

SEQ ID NO: 3467643 - DNA, 14 bp, Homo sapiens
aaggcattctctga

SEQ ID NO: 3467644 - DNA, 17 bp, Homo sapiens
aaggcattctctgaaga

SEQ ID NO: 3467645 - DNA, 17 bp, Homo sapiens
aaggccaaacctctgtt

SEQ ID NO: 3467646 - DNA, 19 bp, Homo sapiens
aaggccagctggcagcaga

SEQ ID NO: 3467647 - DNA, 18 bp, Homo sapiens
aaggccataaaacaggta

SEQ ID NO: 3467648 - DNA, 18 bp, Homo sapiens
aaggccatggagagctgg

SEQ ID NO: 3467649 - DNA, 22 bp, Homo sapiens
aaggccatggagagctggagcc

SEQ ID NO: 3467650 - DNA, 14 bp, Homo sapiens
aaggccgagaagca

SEQ ID NO: 3467651 - DNA, 14 bp, Homo sapiens
aaggccgctgcccc

SEQ ID NO: 3467652 - DNA, 20 bp, Homo sapiens
aaggccgctgccccagcccc

SEQ ID NO: 3467653 - DNA, 19 bp, Homo sapiens
aaggcctaggacctatgtt

SEQ ID NO: 3467654 - DNA, 14 bp, Homo sapiens
aaggccttagccat

SEQ ID NO: 3467655 - DNA, 17 bp, Homo sapiens
aaggccttcagacacat

SEQ ID NO: 3467656 - DNA, 19 bp, Homo sapiens
aaggccttgcctggcctga

SEQ ID NO: 3467657 - DNA, 19 bp, Homo sapiens
aaggcgtggagctgcctga

SEQ ID NO: 3467658 - DNA, 17 bp, Homo sapiens
aaggctaaaaagcaaca

SEQ ID NO: 3467659 - DNA, 17 bp, Homo sapiens
aaggctcttctccccag

SEQ ID NO: 3467660 - DNA, 12 bp, Homo sapiens
aaggctgaaaag

SEQ ID NO: 3467661 - DNA, 15 bp, Homo sapiens
aaggctgcttagaat

SEQ ID NO: 3467662 - DNA, 15 bp, Homo sapiens
aaggcttcagtctca

SEQ ID NO: 3467663 - DNA, 17 bp, Homo sapiens
aaggcttctctctgtgg

SEQ ID NO: 3467664 - DNA, 23 bp, Homo sapiens
aaggctttgattagttttcttgt

SEQ ID NO: 3467665 - DNA, 20 bp, Homo sapiens
aagggacaggagaagagagg

SEQ ID NO: 3467666 - DNA, 20 bp, Homo sapiens
aagggacttggaagctccgc

SEQ ID NO: 3467667 - DNA, 15 bp, Homo sapiens
aagggatctggtcct

SEQ ID NO: 3467668 - DNA, 22 bp, Homo sapiens
aagggatgttattatccttggg

SEQ ID NO: 3467669 - DNA, 20 bp, Homo sapiens
aagggattttagtcacacgt

SEQ ID NO: 3467670 - DNA, 13 bp, Homo sapiens
aagggcagaatga

SEQ ID NO: 3467671 - DNA, 18 bp, Homo sapiens
aagggcatgggtcgggag

SEQ ID NO: 3467672 - DNA, 20 bp, Homo sapiens
aagggcatgggtcgggagag

SEQ ID NO: 3467673 - DNA, 13 bp, Homo sapiens
aagggccagagcc

SEQ ID NO: 3467674 - DNA, 15 bp, Homo sapiens
aagggctgaaccctc

SEQ ID NO: 3467675 - DNA, 22 bp, Homo sapiens
aaggggaatgtttgcctctgcc

SEQ ID NO: 3467676 - DNA, 18 bp, Homo sapiens
aaggggcgtctgttcccc

SEQ ID NO: 3467677 - DNA, 16 bp, Homo sapiens
aaggggtctgaaattt

SEQ ID NO: 3467678 - DNA, 13 bp, Homo sapiens
aaggggtgtgcat

SEQ ID NO: 3467679 - DNA, 16 bp, Homo sapiens
aagggtatcaggtgct

SEQ ID NO: 3467680 - DNA, 19 bp, Homo sapiens
aagggtatcaggtgctgcc

SEQ ID NO: 3467681 - DNA, 19 bp, Homo sapiens
aagggtttttagagaatgt

SEQ ID NO: 3467682 - DNA, 17 bp, Homo sapiens
aaggtaatttcttgtgc

SEQ ID NO: 3467683 - DNA, 22 bp, Homo sapiens
acaaggttcttcccttttacat

SEQ ID NO: 3467684 - DNA, 20 bp, Homo sapiens
acaagtgccgcaaattgtac

SEQ ID NO: 3467685 - DNA, 14 bp, Homo sapiens
acaagttgtgtttg

SEQ ID NO: 3467686 - DNA, 14 bp, Homo sapiens
acaataaaattttt

SEQ ID NO: 3467687 - DNA, 21 bp, Homo sapiens
acaataaaattttttttcatg

SEQ ID NO: 3467688 - DNA, 14 bp, Homo sapiens
acaataaggaagga

SEQ ID NO: 3467689 - DNA, 18 bp, Homo sapiens
acaatacaaaggttccat

SEQ ID NO: 3467690 - DNA, 20 bp, Homo sapiens
acaatacaaaggttccattc

SEQ ID NO: 3467691 - DNA, 19 bp, Homo sapiens
acaatagccgatatcagaa

SEQ ID NO: 3467692 - DNA, 14 bp, Homo sapiens
acaatattgtttct

SEQ ID NO: 3467693 - DNA, 15 bp, Homo sapiens
acaatattgtttcta

SEQ ID NO: 3467694 - DNA, 18 bp, Homo sapiens
acaatcagctccttcctg

SEQ ID NO: 3467695 - DNA, 15 bp, Homo sapiens
acaatcctagtgctt

SEQ ID NO: 3467696 - DNA, 16 bp, Homo sapiens
acaatcctagtgcttt

SEQ ID NO: 3467697 - DNA, 17 bp, Homo sapiens
acaatgctgatttggtg

SEQ ID NO: 3467698 - DNA, 16 bp, Homo sapiens
acaatggtttttaaat

SEQ ID NO: 3467699 - DNA, 22 bp, Homo sapiens
acaatgtcatatactgccatgt

SEQ ID NO: 3467700 - DNA, 16 bp, Homo sapiens
acaatgtctgcagccc

SEQ ID NO: 3467701 - DNA, 17 bp, Homo sapiens
acaatgtgaaaagaaaa

SEQ ID NO: 3467702 - DNA, 17 bp, Homo sapiens
acaatgtgaactttatt

SEQ ID NO: 3467703 - DNA, 16 bp, Homo sapiens
acaatgttgtgtttgg

SEQ ID NO: 3467704 - DNA, 22 bp, Homo sapiens
acaattcctctactaacaatca

SEQ ID NO: 3467705 - DNA, 17 bp, Homo sapiens
acaattcctctgataat

SEQ ID NO: 3467706 - DNA, 13 bp, Homo sapiens
acaattctgcatg

SEQ ID NO: 3467707 - DNA, 14 bp, Homo sapiens
acaattctgcatgt

SEQ ID NO: 3467708 - DNA, 15 bp, Homo sapiens
acaattctgcatgta

SEQ ID NO: 3467709 - DNA, 15 bp, Homo sapiens
acaattctgttttta

SEQ ID NO: 3467710 - DNA, 21 bp, Homo sapiens
acaattctgtttttaatgcta

SEQ ID NO: 3467711 - DNA, 19 bp, Homo sapiens
acaatttacaaagtgtgta

SEQ ID NO: 3467712 - DNA, 16 bp, Homo sapiens
acacaaacctgcctgg

SEQ ID NO: 3467713 - DNA, 19 bp, Homo sapiens
acacaaactgtaaataaaa

SEQ ID NO: 3467714 - DNA, 16 bp, Homo sapiens
acacaatggtttttaa

SEQ ID NO: 3467715 - DNA, 22 bp, Homo sapiens
acacaatggtttttaaattttg

SEQ ID NO: 3467716 - DNA, 23 bp, Homo sapiens
acacaatggtttttaaattttgt

SEQ ID NO: 3467717 - DNA, 13 bp, Homo sapiens
acacacacaaacc

SEQ ID NO: 3467718 - DNA, 15 bp, Homo sapiens
acacacacacacaca

SEQ ID NO: 3467719 - DNA, 15 bp, Homo sapiens
acacacacagccagg

SEQ ID NO: 3467720 - DNA, 22 bp, Homo sapiens
acacacacgcgtgcacacacca

SEQ ID NO: 3467721 - DNA, 20 bp, Homo sapiens
acacacagctaacacacagc

SEQ ID NO: 3467722 - DNA, 11 bp, Homo sapiens
acacacagctc

SEQ ID NO: 3467723 - DNA, 12 bp, Homo sapiens
acacacagctct

SEQ ID NO: 3467724 - DNA, 13 bp, Homo sapiens
acacacagctctg

SEQ ID NO: 3467725 - DNA, 21 bp, Homo sapiens
acacacatataaacatcacac

SEQ ID NO: 3467726 - DNA, 11 bp, Homo sapiens
acacacccctc

SEQ ID NO: 3467727 - DNA, 13 bp, Homo sapiens
acacacccctcaa

SEQ ID NO: 3467728 - DNA, 20 bp, Homo sapiens
acacagaaaatgttgagaat

SEQ ID NO: 3467729 - DNA, 13 bp, Homo sapiens
acacagaaacctt

SEQ ID NO: 3467730 - DNA, 18 bp, Homo sapiens
acacagaaacctttttaa

SEQ ID NO: 3467731 - DNA, 21 bp, Homo sapiens
acacagaaacctttttaaaaa

SEQ ID NO: 3467732 - DNA, 17 bp, Homo sapiens
acacagaaatgctgctg

SEQ ID NO: 3467733 - DNA, 20 bp, Homo sapiens
acacagaaatgctgctggcc

SEQ ID NO: 3467734 - DNA, 21 bp, Homo sapiens
acacagaaatgctgctggcca

SEQ ID NO: 3467735 - DNA, 17 bp, Homo sapiens
acacagatacacacaca

SEQ ID NO: 3467736 - DNA, 16 bp, Homo sapiens
acacagatagaccttt

SEQ ID NO: 3467737 - DNA, 20 bp, Homo sapiens
acacagctaacacacagctc

SEQ ID NO: 3467738 - DNA, 21 bp, Homo sapiens
acacagctcttctccaggctg

SEQ ID NO: 3467739 - DNA, 22 bp, Homo sapiens
acacagctcttctccaggctgt

SEQ ID NO: 3467740 - DNA, 24 bp, Homo sapiens
acacaggcccggctccaggctcct

SEQ ID NO: 3467741 - DNA, 13 bp, Homo sapiens
acacaggccctcc

SEQ ID NO: 3467742 - DNA, 16 bp, Homo sapiens
acacaggcctgctctc

SEQ ID NO: 3467743 - DNA, 14 bp, Homo sapiens
acacaggtctttcc

SEQ ID NO: 3467744 - DNA, 16 bp, Homo sapiens
acacaggtctttccta

SEQ ID NO: 3467745 - DNA, 16 bp, Homo sapiens
acacaggttcacgtgc

SEQ ID NO: 3467746 - DNA, 18 bp, Homo sapiens
acacagtattacttctgc

SEQ ID NO: 3467747 - DNA, 19 bp, Homo sapiens
acacagtattacttctgct

SEQ ID NO: 3467748 - DNA, 13 bp, Homo sapiens
acacagtgagtcg

SEQ ID NO: 3467749 - DNA, 18 bp, Homo sapiens
acacatagtggcttctcc

SEQ ID NO: 3467750 - DNA, 22 bp, Homo sapiens
acacatataaacatcacacaca

SEQ ID NO: 3467751 - DNA, 13 bp, Homo sapiens
acacatatgaggg

SEQ ID NO: 3467752 - DNA, 14 bp, Homo sapiens
acaccaagcacagc

SEQ ID NO: 3467753 - DNA, 18 bp, Homo sapiens
acaccaagcacagcagcc

SEQ ID NO: 3467754 - DNA, 20 bp, Homo sapiens
acaccaagcacagcagcctg

SEQ ID NO: 3467755 - DNA, 13 bp, Homo sapiens
acaccagagccca

SEQ ID NO: 3467756 - DNA, 16 bp, Homo sapiens
acaccagcattccttt

SEQ ID NO: 3467757 - DNA, 19 bp, Homo sapiens
acaccagcattccttttga

SEQ ID NO: 3467758 - DNA, 20 bp, Homo sapiens
acaccatcgatcatgatgta

SEQ ID NO: 3467759 - DNA, 20 bp, Homo sapiens
acacccagcccacttctgcc

SEQ ID NO: 3467760 - DNA, 17 bp, Homo sapiens
acacccagcccccacat

SEQ ID NO: 3467761 - DNA, 22 bp, Homo sapiens
acacccatgactgaggaccaat

SEQ ID NO: 3467762 - DNA, 19 bp, Homo sapiens
acacctgagaaacatctag

SEQ ID NO: 3467763 - DNA, 23 bp, Homo sapiens
acaccttggacatcctcctccca

SEQ ID NO: 3467764 - DNA, 17 bp, Homo sapiens
acacctttctcctttgt

SEQ ID NO: 3467765 - DNA, 13 bp, Homo sapiens
acacgcacctgcc

SEQ ID NO: 3467766 - DNA, 21 bp, Homo sapiens
acacgcgggcgcgatcccaca

SEQ ID NO: 3467767 - DNA, 23 bp, Homo sapiens
acacgcgggcgcgatcccacaca

SEQ ID NO: 3467768 - DNA, 18 bp, Homo sapiens
acacggagcccagccctc

SEQ ID NO: 3467769 - DNA, 20 bp, Homo sapiens
acacggccacatcaaagagg

SEQ ID NO: 3467770 - DNA, 14 bp, Homo sapiens
acacggctccccca

SEQ ID NO: 3467771 - DNA, 20 bp, Homo sapiens
acacggctcccccaggcctg

SEQ ID NO: 3467772 - DNA, 19 bp, Homo sapiens
acacggtttgaagcctgga

SEQ ID NO: 3467773 - DNA, 14 bp, Homo sapiens
acactaaccacgct

SEQ ID NO: 3467774 - DNA, 16 bp, Homo sapiens
acactaaccacgctgg

SEQ ID NO: 3467775 - DNA, 19 bp, Homo sapiens
acactaaccacgctggacc

SEQ ID NO: 3467776 - DNA, 20 bp, Homo sapiens
acactaccagcgtatatata

SEQ ID NO: 3467777 - DNA, 18 bp, Homo sapiens
acactatggtatttgagt

SEQ ID NO: 3467778 - DNA, 19 bp, Homo sapiens
acactatggtatttgagtg

SEQ ID NO: 3467779 - DNA, 22 bp, Homo sapiens
acactatggtatttgagtgttt

SEQ ID NO: 3467780 - DNA, 20 bp, Homo sapiens
acactcccaaggttggagcc

SEQ ID NO: 3467781 - DNA, 20 bp, Homo sapiens
acactctgggctccagagtg

SEQ ID NO: 3467782 - DNA, 14 bp, Homo sapiens
acactgagctgtca

SEQ ID NO: 3467783 - DNA, 16 bp, Homo sapiens
acactgaggcagggaa

SEQ ID NO: 3467784 - DNA, 17 bp, Homo sapiens
acactgaggcagggaag

SEQ ID NO: 3467785 - DNA, 13 bp, Homo sapiens
acactgcaagaag

SEQ ID NO: 3467786 - DNA, 21 bp, Homo sapiens
acactgctgctccagtgcagg

SEQ ID NO: 3467787 - DNA, 15 bp, Homo sapiens
acactggcagactgt

SEQ ID NO: 3467788 - DNA, 18 bp, Homo sapiens
acactggcagactgtgta

SEQ ID NO: 3467789 - DNA, 14 bp, Homo sapiens
acactgggaaacag

SEQ ID NO: 3467790 - DNA, 20 bp, Homo sapiens
acactgggaggccagtgagc

SEQ ID NO: 3467791 - DNA, 19 bp, Homo sapiens
acactgggtggtggcctgg

SEQ ID NO: 3467792 - DNA, 20 bp, Homo sapiens
acactgtatgttatagaact

SEQ ID NO: 3467793 - DNA, 21 bp, Homo sapiens
acactgtatgttatagaactt

SEQ ID NO: 3467794 - DNA, 17 bp, Homo sapiens
acactgtcatgcttcat

SEQ ID NO: 3467795 - DNA, 22 bp, Homo sapiens
acactgtctggtttcaccgagg

SEQ ID NO: 3467796 - DNA, 21 bp, Homo sapiens
acactgtgcacatctgtgtct

SEQ ID NO: 3467797 - DNA, 15 bp, Homo sapiens
acactgtttcctgat

SEQ ID NO: 3467798 - DNA, 19 bp, Homo sapiens
acactgttttttggcttgc

SEQ ID NO: 3467799 - DNA, 21 bp, Homo sapiens
acactgttttttggcttgctt

SEQ ID NO: 3467800 - DNA, 14 bp, Homo sapiens
acacttaaattatg

SEQ ID NO: 3467801 - DNA, 14 bp, Homo sapiens
acacttaatactac

SEQ ID NO: 3467802 - DNA, 18 bp, Homo sapiens
acacttactgtaagacat

SEQ ID NO: 3467803 - DNA, 19 bp, Homo sapiens
acacttactgtaagacatt

SEQ ID NO: 3467804 - DNA, 21 bp, Homo sapiens
acacttactgtaagacattag

SEQ ID NO: 3467805 - DNA, 12 bp, Homo sapiens
acacttccattg

SEQ ID NO: 3467806 - DNA, 16 bp, Homo sapiens
acacttccattgttta

SEQ ID NO: 3467807 - DNA, 16 bp, Homo sapiens
acacttcgttcgcaga

SEQ ID NO: 3467808 - DNA, 22 bp, Homo sapiens
acacttggcccaagtggcagag

SEQ ID NO: 3467809 - DNA, 14 bp, Homo sapiens
acacttggtaattg

SEQ ID NO: 3467810 - DNA, 13 bp, Homo sapiens
acactttatggta

SEQ ID NO: 3467811 - DNA, 21 bp, Homo sapiens
acactttatggtaagtagcag

SEQ ID NO: 3467812 - DNA, 17 bp, Homo sapiens
acacttttggaaccatg

SEQ ID NO: 3467813 - DNA, 19 bp, Homo sapiens
acagaaaaatatgtaccaa

SEQ ID NO: 3467814 - DNA, 15 bp, Homo sapiens
acagaaaccttttta

SEQ ID NO: 3467815 - DNA, 20 bp, Homo sapiens
acagaaatgctgctggccaa

SEQ ID NO: 3467816 - DNA, 18 bp, Homo sapiens
acagaagattaagacaga

SEQ ID NO: 3467817 - DNA, 18 bp, Homo sapiens
acagaagcacatgcacct

SEQ ID NO: 3467818 - DNA, 22 bp, Homo sapiens
acagaagctcttactctttcct

SEQ ID NO: 3467819 - DNA, 13 bp, Homo sapiens
acagaagtcctgt

SEQ ID NO: 3467820 - DNA, 19 bp, Homo sapiens
acagaatatttctattgaa

SEQ ID NO: 3467821 - DNA, 12 bp, Homo sapiens
acagacacacac

SEQ ID NO: 3467822 - DNA, 17 bp, Homo sapiens
acagacacaggcccggc

SEQ ID NO: 3467823 - DNA, 22 bp, Homo sapiens
acagacacaggcccggctccag

SEQ ID NO: 3467824 - DNA, 21 bp, Homo sapiens
acagacacttggttagtggct

SEQ ID NO: 3467825 - DNA, 17 bp, Homo sapiens
acagacattctgccagg

SEQ ID NO: 3467826 - DNA, 18 bp, Homo sapiens
acagaccttcacagatgc

SEQ ID NO: 3467827 - DNA, 21 bp, Homo sapiens
acagacgttaggcatttcctg

SEQ ID NO: 3467828 - DNA, 20 bp, Homo sapiens
acagactcaaatgctcagac

SEQ ID NO: 3467829 - DNA, 14 bp, Homo sapiens
acagactggaagca

SEQ ID NO: 3467830 - DNA, 18 bp, Homo sapiens
acagagaactttattttg

SEQ ID NO: 3467831 - DNA, 11 bp, Homo sapiens
acagagaccta

SEQ ID NO: 3467832 - DNA, 13 bp, Homo sapiens
acagagagaatga

SEQ ID NO: 3467833 - DNA, 16 bp, Homo sapiens
acagagaggactgtag

SEQ ID NO: 3467834 - DNA, 15 bp, Homo sapiens
acagagcaagactct

SEQ ID NO: 3467835 - DNA, 20 bp, Homo sapiens
acagaggatgagctctaccc

SEQ ID NO: 3467836 - DNA, 15 bp, Homo sapiens
acagaggccccagcc

SEQ ID NO: 3467837 - DNA, 17 bp, Homo sapiens
acagaggccccagcctc

SEQ ID NO: 3467838 - DNA, 17 bp, Homo sapiens
acagagtctcactgttg

SEQ ID NO: 3467839 - DNA, 23 bp, Homo sapiens
acagagtctcactgttgcccagg

SEQ ID NO: 3467840 - DNA, 15 bp, Homo sapiens
acagagtgagactct

SEQ ID NO: 3467841 - DNA, 19 bp, Homo sapiens
acagagtgagactctgtct

SEQ ID NO: 3467842 - DNA, 21 bp, Homo sapiens
acagagtgagactctgtctca

SEQ ID NO: 3467843 - DNA, 15 bp, Homo sapiens
acagatacacacaca

SEQ ID NO: 3467844 - DNA, 16 bp, Homo sapiens
acagatatcttcagtt

SEQ ID NO: 3467845 - DNA, 12 bp, Homo sapiens
acagatctggaa

SEQ ID NO: 3467846 - DNA, 18 bp, Homo sapiens
acagatgcctcctgatgg

SEQ ID NO: 3467847 - DNA, 18 bp, Homo sapiens
acagatgccttttttgta

SEQ ID NO: 3467848 - DNA, 14 bp, Homo sapiens
acagatgctccagg

SEQ ID NO: 3467849 - DNA, 23 bp, Homo sapiens
acagatgtttcttttgtatgtaa

SEQ ID NO: 3467850 - DNA, 15 bp, Homo sapiens
acagattcacactgt

SEQ ID NO: 3467851 - DNA, 17 bp, Homo sapiens
acagattcacactgtct

SEQ ID NO: 3467852 - DNA, 20 bp, Homo sapiens
acagattttgatagcaaagc

SEQ ID NO: 3467853 - DNA, 14 bp, Homo sapiens
acagcatctgtagt

SEQ ID NO: 3467854 - DNA, 15 bp, Homo sapiens
acagcatgacaaaaa

SEQ ID NO: 3467855 - DNA, 16 bp, Homo sapiens
acagcattagatagtc

SEQ ID NO: 3467856 - DNA, 21 bp, Homo sapiens
acagccaacacgcacctgcct

SEQ ID NO: 3467857 - DNA, 22 bp, Homo sapiens
acagccaacacgcacctgcctc

SEQ ID NO: 3467858 - DNA, 24 bp, Homo sapiens
acagccaacacgcacctgcctcag

SEQ ID NO: 3467859 - DNA, 17 bp, Homo sapiens
acagccaactagcccct

SEQ ID NO: 3467860 - DNA, 15 bp, Homo sapiens
acagccacggccagg

SEQ ID NO: 3467861 - DNA, 17 bp, Homo sapiens
acagccacggccaggcc

SEQ ID NO: 3467862 - DNA, 19 bp, Homo sapiens
acagccacggccaggccag

SEQ ID NO: 3467863 - DNA, 20 bp, Homo sapiens
acagccactcccctccactc

SEQ ID NO: 3467864 - DNA, 13 bp, Homo sapiens
acagccagcacct

SEQ ID NO: 3467865 - DNA, 21 bp, Homo sapiens
acagccagtgggagatgttag

SEQ ID NO: 3467866 - DNA, 12 bp, Homo sapiens
acagccccaccc

SEQ ID NO: 3467867 - DNA, 14 bp, Homo sapiens
acagccccaccctg

SEQ ID NO: 3467868 - DNA, 17 bp, Homo sapiens
acagcctattcctgaac

SEQ ID NO: 3467869 - DNA, 15 bp, Homo sapiens
acagcctcccctgcc

SEQ ID NO: 3467870 - DNA, 17 bp, Homo sapiens
acagcctcccctgccag

SEQ ID NO: 3467871 - DNA, 21 bp, Homo sapiens
acagcctcccctgccagggca

SEQ ID NO: 3467872 - DNA, 16 bp, Homo sapiens
acagcctttgaatgta

SEQ ID NO: 3467873 - DNA, 17 bp, Homo sapiens
acagcctttgaatgtaa

SEQ ID NO: 3467874 - DNA, 19 bp, Homo sapiens
acagcctttgaatgtaacc

SEQ ID NO: 3467875 - DNA, 15 bp, Homo sapiens
acagctaatgggaca

SEQ ID NO: 3467876 - DNA, 16 bp, Homo sapiens
acagctaatgggacac

SEQ ID NO: 3467877 - DNA, 21 bp, Homo sapiens
acagctcaggatctcttagca

SEQ ID NO: 3467878 - DNA, 12 bp, Homo sapiens
acagctccttct

SEQ ID NO: 3467879 - DNA, 13 bp, Homo sapiens
acagctccttctg

SEQ ID NO: 3467880 - DNA, 14 bp, Homo sapiens
acagctccttctgt

SEQ ID NO: 3467881 - DNA, 16 bp, Homo sapiens
acagctctgtcctggg

SEQ ID NO: 3467882 - DNA, 14 bp, Homo sapiens
acagctgccttagc

SEQ ID NO: 3467883 - DNA, 17 bp, Homo sapiens
acagctgccttagcttc

SEQ ID NO: 3467884 - DNA, 11 bp, Homo sapiens
acagctgctgg

SEQ ID NO: 3467885 - DNA, 16 bp, Homo sapiens
acagctgggtggcact

SEQ ID NO: 3467886 - DNA, 18 bp, Homo sapiens
acagctgggtggcactgc

SEQ ID NO: 3467887 - DNA, 22 bp, Homo sapiens
acagcttcccctctctcctcct

SEQ ID NO: 3467888 - DNA, 11 bp, Homo sapiens
acagcttcctg

SEQ ID NO: 3467889 - DNA, 21 bp, Homo sapiens
acagcttctcatcctgcaggc

SEQ ID NO: 3467890 - DNA, 15 bp, Homo sapiens
acagcttgacctgag

SEQ ID NO: 3467891 - DNA, 16 bp, Homo sapiens
acagcttgctgtcact

SEQ ID NO: 3467892 - DNA, 11 bp, Homo sapiens
acagcttgtct

SEQ ID NO: 3467893 - DNA, 19 bp, Homo sapiens
acagctttctgaccttcag

SEQ ID NO: 3467894 - DNA, 12 bp, Homo sapiens
acagctttgctg

SEQ ID NO: 3467895 - DNA, 21 bp, Homo sapiens
acagctttgctgctgaaggct

SEQ ID NO: 3467896 - DNA, 20 bp, Homo sapiens
acaggaaaagctgctgacag

SEQ ID NO: 3467897 - DNA, 19 bp, Homo sapiens
acaggaatctcagagacag

SEQ ID NO: 3467898 - DNA, 14 bp, Homo sapiens
acaggagctgggat

SEQ ID NO: 3467899 - DNA, 16 bp, Homo sapiens
acaggagtgagcacta

SEQ ID NO: 3467900 - DNA, 21 bp, Homo sapiens
acaggagtgtcctcttccctc

SEQ ID NO: 3467901 - DNA, 14 bp, Homo sapiens
acaggatcagtctg

SEQ ID NO: 3467902 - DNA, 15 bp, Homo sapiens
acaggatcagtctga

SEQ ID NO: 3467903 - DNA, 18 bp, Homo sapiens
acaggatgtgtttgcttt

SEQ ID NO: 3467904 - DNA, 19 bp, Homo sapiens
acaggatgtgtttgctttc

SEQ ID NO: 3467905 - DNA, 22 bp, Homo sapiens
acaggatgtgtttgctttctga

SEQ ID NO: 3467906 - DNA, 14 bp, Homo sapiens
acaggcaatgctgg

SEQ ID NO: 3467907 - DNA, 13 bp, Homo sapiens
acaggcagcacag

SEQ ID NO: 3467908 - DNA, 14 bp, Homo sapiens
acaggcaggtccag

SEQ ID NO: 3467909 - DNA, 23 bp, Homo sapiens
acaggcagtttcagagatggaca

SEQ ID NO: 3467910 - DNA, 14 bp, Homo sapiens
acaggcatgttctc

SEQ ID NO: 3467911 - DNA, 19 bp, Homo sapiens
acaggcatgttctctgagg

SEQ ID NO: 3467912 - DNA, 19 bp, Homo sapiens
acaggccccccgcagcacc

SEQ ID NO: 3467913 - DNA, 16 bp, Homo sapiens
acaggcccggctccag

SEQ ID NO: 3467914 - DNA, 18 bp, Homo sapiens
acaggcccggctccaggc

SEQ ID NO: 3467915 - DNA, 22 bp, Homo sapiens
acaggcccggctccaggctcct

SEQ ID NO: 3467916 - DNA, 15 bp, Homo sapiens
acaggcctgagattt

SEQ ID NO: 3467917 - DNA, 17 bp, Homo sapiens
acaggcctgagatttca

SEQ ID NO: 3467918 - DNA, 17 bp, Homo sapiens
acaggcgggaggaggtg

SEQ ID NO: 3467919 - DNA, 13 bp, Homo sapiens
acaggctcttctt

SEQ ID NO: 3467920 - DNA, 18 bp, Homo sapiens
acaggctcttctttccca

SEQ ID NO: 3467921 - DNA, 14 bp, Homo sapiens
acaggctggcgggg

SEQ ID NO: 3467922 - DNA, 17 bp, Homo sapiens
acaggctgggcttcagt

SEQ ID NO: 3467923 - DNA, 23 bp, Homo sapiens
acaggctgtgactcttctctcaa

SEQ ID NO: 3467924 - DNA, 17 bp, Homo sapiens
acagggaaacctttttt

SEQ ID NO: 3467925 - DNA, 22 bp, Homo sapiens
acagggaatgcctgagtgcctg

SEQ ID NO: 3467926 - DNA, 20 bp, Homo sapiens
acagggagactgcatctcaa

SEQ ID NO: 3467927 - DNA, 14 bp, Homo sapiens
acagggatgagcat

SEQ ID NO: 3467928 - DNA, 16 bp, Homo sapiens
acagggattctcacaa

SEQ ID NO: 3467929 - DNA, 12 bp, Homo sapiens
acagggcacacc

SEQ ID NO: 3467930 - DNA, 17 bp, Homo sapiens
acagggcacctgccacc

SEQ ID NO: 3467931 - DNA, 21 bp, Homo sapiens
acagggctgataagctaacac

SEQ ID NO: 3467932 - DNA, 17 bp, Homo sapiens
acagggtctgcctccag

SEQ ID NO: 3467933 - DNA, 23 bp, Homo sapiens
acagggtttggctgtgtctaaac

SEQ ID NO: 3467934 - DNA, 15 bp, Homo sapiens
acaggtacagcaaca

SEQ ID NO: 3467935 - DNA, 20 bp, Homo sapiens
acaggtgggcttcccagtgg

SEQ ID NO: 3467936 - DNA, 19 bp, Homo sapiens
acaggtgtgaaccaccaca

SEQ ID NO: 3467937 - DNA, 17 bp, Homo sapiens
acaggtgttggtgacaa

SEQ ID NO: 3467938 - DNA, 17 bp, Homo sapiens
acagtaagtcatttaac

SEQ ID NO: 3467939 - DNA, 12 bp, Homo sapiens
acagtacaggca

SEQ ID NO: 3467940 - DNA, 18 bp, Homo sapiens
acagtacaggcagcacag

SEQ ID NO: 3467941 - DNA, 13 bp, Homo sapiens
acagtaggagccc

SEQ ID NO: 3467942 - DNA, 23 bp, Homo sapiens
acagtagtcttgatgaccaaagt

SEQ ID NO: 3467943 - DNA, 17 bp, Homo sapiens
acagtattacttctgct

SEQ ID NO: 3467944 - DNA, 15 bp, Homo sapiens
acagtcagatttcca

SEQ ID NO: 3467945 - DNA, 18 bp, Homo sapiens
acagtcagctcttcatct

SEQ ID NO: 3467946 - DNA, 16 bp, Homo sapiens
acagtccagcctggag

SEQ ID NO: 3467947 - DNA, 18 bp, Homo sapiens
acagtccttaaaaatcac

SEQ ID NO: 3467948 - DNA, 14 bp, Homo sapiens
acagtcttccattt

SEQ ID NO: 3467949 - DNA, 18 bp, Homo sapiens
acagtgaagacagaagtt

SEQ ID NO: 3467950 - DNA, 17 bp, Homo sapiens
acagtgaaggctgtcct

SEQ ID NO: 3467951 - DNA, 14 bp, Homo sapiens
acagtgcagtgcgc

SEQ ID NO: 3467952 - DNA, 21 bp, Homo sapiens
acagtgcttgccacagagcgg

SEQ ID NO: 3467953 - DNA, 17 bp, Homo sapiens
acagtggattgcatttc

SEQ ID NO: 3467954 - DNA, 17 bp, Homo sapiens
acagtgtctgtgtgtgt

SEQ ID NO: 3467955 - DNA, 18 bp, Homo sapiens
acagtgtgggacaggctc

SEQ ID NO: 3467956 - DNA, 17 bp, Homo sapiens
acagtgtttcttattcc

SEQ ID NO: 3467957 - DNA, 21 bp, Homo sapiens
acagttcaaaattctaaatgt

SEQ ID NO: 3467958 - DNA, 13 bp, Homo sapiens
acagttcaaagaa

SEQ ID NO: 3467959 - DNA, 17 bp, Homo sapiens
acagttcaaagaagtca

SEQ ID NO: 3467960 - DNA, 22 bp, Homo sapiens
acagttcggtgagctacaaatg

SEQ ID NO: 3467961 - DNA, 23 bp, Homo sapiens
acagttcggtgagctacaaatgc

SEQ ID NO: 3467962 - DNA, 17 bp, Homo sapiens
acagttctttgggccag

SEQ ID NO: 3467963 - DNA, 22 bp, Homo sapiens
acagttctttgggccagacatg

SEQ ID NO: 3467964 - DNA, 16 bp, Homo sapiens
acagttgctctatgct

SEQ ID NO: 3467965 - DNA, 19 bp, Homo sapiens
acagttgctctatgctttc

SEQ ID NO: 3467966 - DNA, 14 bp, Homo sapiens
acagttttccttct

SEQ ID NO: 3467967 - DNA, 13 bp, Homo sapiens
acagttttgagaa

SEQ ID NO: 3467968 - DNA, 20 bp, Homo sapiens
acagttttgagaacgtaaag

SEQ ID NO: 3467969 - DNA, 20 bp, Homo sapiens
acataaagactaagtagccc

SEQ ID NO: 3467970 - DNA, 18 bp, Homo sapiens
acataaaggtaaaacaaa

SEQ ID NO: 3467971 - DNA, 14 bp, Homo sapiens
acataagatcactg

SEQ ID NO: 3467972 - DNA, 21 bp, Homo sapiens
acataataaacgatgttgtga

SEQ ID NO: 3467973 - DNA, 17 bp, Homo sapiens
acataatggggtcctgg

SEQ ID NO: 3467974 - DNA, 16 bp, Homo sapiens
acataattcactctga

SEQ ID NO: 3467975 - DNA, 20 bp, Homo sapiens
acataattcactctgagtgt

SEQ ID NO: 3467976 - DNA, 22 bp, Homo sapiens
acatacactgtatgttatagaa

SEQ ID NO: 3467977 - DNA, 18 bp, Homo sapiens
acatacagaattactgta

SEQ ID NO: 3467978 - DNA, 15 bp, Homo sapiens
acatacttgaagggc

SEQ ID NO: 3467979 - DNA, 17 bp, Homo sapiens
acatacttgaagggcca

SEQ ID NO: 3467980 - DNA, 20 bp, Homo sapiens
acatacttgaagggccagag

SEQ ID NO: 3467981 - DNA, 21 bp, Homo sapiens
acatacttgaagggccagagc

SEQ ID NO: 3467982 - DNA, 20 bp, Homo sapiens
acatataaacatcacacaca

SEQ ID NO: 3467983 - DNA, 19 bp, Homo sapiens
acatatggtctccatttta

SEQ ID NO: 3467984 - DNA, 23 bp, Homo sapiens
acatatggtctccattttacagt

SEQ ID NO: 3467985 - DNA, 13 bp, Homo sapiens
acatatgtaaaat

SEQ ID NO: 3467986 - DNA, 21 bp, Homo sapiens
acatattagtgcagccaagta

SEQ ID NO: 3467987 - DNA, 19 bp, Homo sapiens
acatattttattaagaact

SEQ ID NO: 3467988 - DNA, 18 bp, Homo sapiens
acatcaacccgagtcatt

SEQ ID NO: 3467989 - DNA, 13 bp, Homo sapiens
acatcacacacac

SEQ ID NO: 3467990 - DNA, 12 bp, Homo sapiens
acatcactgggg

SEQ ID NO: 3467991 - DNA, 15 bp, Homo sapiens
acatcaggagactgg

SEQ ID NO: 3467992 - DNA, 12 bp, Homo sapiens
acatcagtgttt

SEQ ID NO: 3467993 - DNA, 16 bp, Homo sapiens
acatcagtgtttgttg

SEQ ID NO: 3467994 - DNA, 15 bp, Homo sapiens
acatcattactataa

SEQ ID NO: 3467995 - DNA, 18 bp, Homo sapiens
acatcattactataagaa

SEQ ID NO: 3467996 - DNA, 15 bp, Homo sapiens
acatccaaagcagac

SEQ ID NO: 3467997 - DNA, 16 bp, Homo sapiens
acatccaaagcagaca

SEQ ID NO: 3467998 - DNA, 19 bp, Homo sapiens
acatccaaagcagacagct

SEQ ID NO: 3467999 - DNA, 18 bp, Homo sapiens
acatccccccgccaaaag

SEQ ID NO: 3468000 - DNA, 18 bp, Homo sapiens
acatcccgggcctcagtg

SEQ ID NO: 3468001 - DNA, 19 bp, Homo sapiens
acatcccgggcctcagtgc

SEQ ID NO: 3468002 - DNA, 17 bp, Homo sapiens
acatccctgccagctct

SEQ ID NO: 3468003 - DNA, 15 bp, Homo sapiens
acatcctcctcccac

SEQ ID NO: 3468004 - DNA, 17 bp, Homo sapiens
acatctaacctcatctt

SEQ ID NO: 3468005 - DNA, 15 bp, Homo sapiens
acatctaagcctgaa

SEQ ID NO: 3468006 - DNA, 19 bp, Homo sapiens
acatctattttggattgta

SEQ ID NO: 3468007 - DNA, 12 bp, Homo sapiens
acatctctgctt

SEQ ID NO: 3468008 - DNA, 16 bp, Homo sapiens
acatctgtgtcttgtt

SEQ ID NO: 3468009 - DNA, 15 bp, Homo sapiens
acatcttgctctgct

SEQ ID NO: 3468010 - DNA, 18 bp, Homo sapiens
acatcttttaagacaaat

SEQ ID NO: 3468011 - DNA, 24 bp, Homo sapiens
acatcttttcttgcctctgtcccc

SEQ ID NO: 3468012 - DNA, 23 bp, Homo sapiens
acatgaaacctacacactgtcat

SEQ ID NO: 3468013 - DNA, 18 bp, Homo sapiens
acatgaaatttttgtaaa

SEQ ID NO: 3468014 - DNA, 19 bp, Homo sapiens
acatgaaatttttgtaaat

SEQ ID NO: 3468015 - DNA, 13 bp, Homo sapiens
caaagtactgtaa

SEQ ID NO: 3468016 - DNA, 17 bp, Homo sapiens
caaagtactgtaagaat

SEQ ID NO: 3468017 - DNA, 18 bp, Homo sapiens
caaagtattgtaaattat

SEQ ID NO: 3468018 - DNA, 19 bp, Homo sapiens
caaagtattgtaaattata

SEQ ID NO: 3468019 - DNA, 22 bp, Homo sapiens
caaagtattgtaaattatattt

SEQ ID NO: 3468020 - DNA, 21 bp, Homo sapiens
caaagtcatgcaaaggctggg

SEQ ID NO: 3468021 - DNA, 23 bp, Homo sapiens
caaagtcctttttttccatcttt

SEQ ID NO: 3468022 - DNA, 19 bp, Homo sapiens
caaagtgctgggattacaa

SEQ ID NO: 3468023 - DNA, 23 bp, Homo sapiens
caaagtgctgggattacaagcgt

SEQ ID NO: 3468024 - DNA, 23 bp, Homo sapiens
caaagtgctgggattacaggtgt

SEQ ID NO: 3468025 - DNA, 19 bp, Homo sapiens
caaagtgtcttttgacatt

SEQ ID NO: 3468026 - DNA, 17 bp, Homo sapiens
caaagtgttttgtacca

SEQ ID NO: 3468027 - DNA, 16 bp, Homo sapiens
caaagttactaggtaa

SEQ ID NO: 3468028 - DNA, 20 bp, Homo sapiens
acttcttatggaattgattt

SEQ ID NO: 3468029 - DNA, 13 bp, Homo sapiens
acttcttcacctc

SEQ ID NO: 3468030 - DNA, 15 bp, Homo sapiens
acttcttcacctctt

SEQ ID NO: 3468031 - DNA, 18 bp, Homo sapiens
acttcttcacctcttcca

SEQ ID NO: 3468032 - DNA, 13 bp, Homo sapiens
acttcttcagagc

SEQ ID NO: 3468033 - DNA, 20 bp, Homo sapiens
acttcttcagagctgacaca

SEQ ID NO: 3468034 - DNA, 22 bp, Homo sapiens
acttcttggcttggtgaggaaa

SEQ ID NO: 3468035 - DNA, 20 bp, Homo sapiens
acttctttgctttgcccagc

SEQ ID NO: 3468036 - DNA, 20 bp, Homo sapiens
acttgaacctatgaagcaat

SEQ ID NO: 3468037 - DNA, 15 bp, Homo sapiens
acttgaacttgcctc

SEQ ID NO: 3468038 - DNA, 15 bp, Homo sapiens
acttgaagggccaga

SEQ ID NO: 3468039 - DNA, 17 bp, Homo sapiens
acttgaagggccagagc

SEQ ID NO: 3468040 - DNA, 21 bp, Homo sapiens
acttgaagggccagagccagg

SEQ ID NO: 3468041 - DNA, 22 bp, Homo sapiens
acttgaagtctaaaagcagaaa

SEQ ID NO: 3468042 - DNA, 18 bp, Homo sapiens
acttgaccctgagctgac

SEQ ID NO: 3468043 - DNA, 16 bp, Homo sapiens
acttgactttctagct

SEQ ID NO: 3468044 - DNA, 13 bp, Homo sapiens
acttgcctctttt

SEQ ID NO: 3468045 - DNA, 21 bp, Homo sapiens
acttgccttcctaagcctgtg

SEQ ID NO: 3468046 - DNA, 17 bp, Homo sapiens
acttgctgcctgaagaa

SEQ ID NO: 3468047 - DNA, 23 bp, Homo sapiens
acttgctgcctgaagaacagtaa

SEQ ID NO: 3468048 - DNA, 21 bp, Homo sapiens
acttgcttatcaacttcctaa

SEQ ID NO: 3468049 - DNA, 19 bp, Homo sapiens
acttggctcgaatctctgt

SEQ ID NO: 3468050 - DNA, 22 bp, Homo sapiens
acttggctcgaatctctgtgcc

SEQ ID NO: 3468051 - DNA, 16 bp, Homo sapiens
acttggctgcaggaat

SEQ ID NO: 3468052 - DNA, 20 bp, Homo sapiens
acttggctttttactattaa

SEQ ID NO: 3468053 - DNA, 15 bp, Homo sapiens
acttgggccactgtg

SEQ ID NO: 3468054 - DNA, 23 bp, Homo sapiens
acttggggggctgaggtgggagg

SEQ ID NO: 3468055 - DNA, 19 bp, Homo sapiens
acttgggggttcaggcccg

SEQ ID NO: 3468056 - DNA, 19 bp, Homo sapiens
acttgtaaaggaatttaaa

SEQ ID NO: 3468057 - DNA, 20 bp, Homo sapiens
acttgtaaaggaatttaaaa

SEQ ID NO: 3468058 - DNA, 20 bp, Homo sapiens
acttgtatccaggcctggga

SEQ ID NO: 3468059 - DNA, 17 bp, Homo sapiens
acttgtccccaaatccg

SEQ ID NO: 3468060 - DNA, 22 bp, Homo sapiens
acttgtccccaaatccgaacct

SEQ ID NO: 3468061 - DNA, 16 bp, Homo sapiens
acttgtgattatttat

SEQ ID NO: 3468062 - DNA, 17 bp, Homo sapiens
acttgtgattatttatt

SEQ ID NO: 3468063 - DNA, 18 bp, Homo sapiens
acttgtgccaacactcaa

SEQ ID NO: 3468064 - DNA, 19 bp, Homo sapiens
acttgtggacacagctctt

SEQ ID NO: 3468065 - DNA, 19 bp, Homo sapiens
acttgtggactaaaagata

SEQ ID NO: 3468066 - DNA, 14 bp, Homo sapiens
acttgtttgcactg

SEQ ID NO: 3468067 - DNA, 15 bp, Homo sapiens
acttgtttgcactgt

SEQ ID NO: 3468068 - DNA, 16 bp, Homo sapiens
acttgtttgcactgtg

SEQ ID NO: 3468069 - DNA, 17 bp, Homo sapiens
acttgttttatgctcag

SEQ ID NO: 3468070 - DNA, 14 bp, Homo sapiens
actttaagaggaca

SEQ ID NO: 3468071 - DNA, 15 bp, Homo sapiens
actttacgcccatct

SEQ ID NO: 3468072 - DNA, 17 bp, Homo sapiens
actttaggctttcagct

SEQ ID NO: 3468073 - DNA, 23 bp, Homo sapiens
actttagggctgtaaaatgcatg

SEQ ID NO: 3468074 - DNA, 15 bp, Homo sapiens
actttagtctgcaaa

SEQ ID NO: 3468075 - DNA, 18 bp, Homo sapiens
actttagtctgcaaaatg

SEQ ID NO: 3468076 - DNA, 22 bp, Homo sapiens
actttataagtcattgtatgtt

SEQ ID NO: 3468077 - DNA, 12 bp, Homo sapiens
actttatggtaa

SEQ ID NO: 3468078 - DNA, 12 bp, Homo sapiens
actttattaaat

SEQ ID NO: 3468079 - DNA, 18 bp, Homo sapiens
actttcaggtactaaata

SEQ ID NO: 3468080 - DNA, 17 bp, Homo sapiens
actttcatttttttcca

SEQ ID NO: 3468081 - DNA, 20 bp, Homo sapiens
actttcatttttttccaggc

SEQ ID NO: 3468082 - DNA, 16 bp, Homo sapiens
actttcccccacaccc

SEQ ID NO: 3468083 - DNA, 17 bp, Homo sapiens
actttcctggatgtctg

SEQ ID NO: 3468084 - DNA, 18 bp, Homo sapiens
actttcctggatgtctga

SEQ ID NO: 3468085 - DNA, 23 bp, Homo sapiens
actttcctttaactcccttttta

SEQ ID NO: 3468086 - DNA, 15 bp, Homo sapiens
actttgaataaagaa

SEQ ID NO: 3468087 - DNA, 22 bp, Homo sapiens
actttgaggataactttttaaa

SEQ ID NO: 3468088 - DNA, 12 bp, Homo sapiens
actttgtaaata

SEQ ID NO: 3468089 - DNA, 12 bp, Homo sapiens
actttgtaaatt

SEQ ID NO: 3468090 - DNA, 13 bp, Homo sapiens
actttgtaaattc

SEQ ID NO: 3468091 - DNA, 18 bp, Homo sapiens
actttgtggtctaaagtg

SEQ ID NO: 3468092 - DNA, 18 bp, Homo sapiens
actttgtgttcaccttgt

SEQ ID NO: 3468093 - DNA, 20 bp, Homo sapiens
actttgttaggattttcaca

SEQ ID NO: 3468094 - DNA, 18 bp, Homo sapiens
acttttggaaccatgcct

SEQ ID NO: 3468095 - DNA, 13 bp, Homo sapiens
acttttggcctca

SEQ ID NO: 3468096 - DNA, 14 bp, Homo sapiens
acttttggcctcat

SEQ ID NO: 3468097 - DNA, 12 bp, Homo sapiens
actttttacatt

SEQ ID NO: 3468098 - DNA, 17 bp, Homo sapiens
actttttcttgtattca

SEQ ID NO: 3468099 - DNA, 15 bp, Homo sapiens
actttttgcagcttt

SEQ ID NO: 3468100 - DNA, 16 bp, Homo sapiens
acttttttaaatattt

SEQ ID NO: 3468101 - DNA, 18 bp, Homo sapiens
acttttttaaatattttc

SEQ ID NO: 3468102 - DNA, 22 bp, Homo sapiens
acttttttggtactataaaagc

SEQ ID NO: 3468103 - DNA, 18 bp, Homo sapiens
agaaaaaaaccacacaaa

SEQ ID NO: 3468104 - DNA, 15 bp, Homo sapiens
agaaaaaaattcatg

SEQ ID NO: 3468105 - DNA, 19 bp, Homo sapiens
agaaaaaatattttcccta

SEQ ID NO: 3468106 - DNA, 22 bp, Homo sapiens
agaaaaagaacatgcagtttga

SEQ ID NO: 3468107 - DNA, 19 bp, Homo sapiens
agaaaaaggctgaaaagaa

SEQ ID NO: 3468108 - DNA, 19 bp, Homo sapiens
agaaaaataaaaatctctt

SEQ ID NO: 3468109 - DNA, 12 bp, Homo sapiens
agaaaacatcta

SEQ ID NO: 3468110 - DNA, 16 bp, Homo sapiens
agaaaacctccagtag

SEQ ID NO: 3468111 - DNA, 20 bp, Homo sapiens
agaaaagattttaatcaagt

SEQ ID NO: 3468112 - DNA, 13 bp, Homo sapiens
agaaaagttatta

SEQ ID NO: 3468113 - DNA, 17 bp, Homo sapiens
agaaaatactatttcaa

SEQ ID NO: 3468114 - DNA, 11 bp, Homo sapiens
agaaaatataa

SEQ ID NO: 3468115 - DNA, 20 bp, Homo sapiens
agaaaatggaaccaggcttg

SEQ ID NO: 3468116 - DNA, 16 bp, Homo sapiens
agaaaatgttatttaa

SEQ ID NO: 3468117 - DNA, 18 bp, Homo sapiens
agaaaattcaattgtaaa

SEQ ID NO: 3468118 - DNA, 15 bp, Homo sapiens
agaaaattcctataa

SEQ ID NO: 3468119 - DNA, 14 bp, Homo sapiens
agaaacaatgaatg

SEQ ID NO: 3468120 - DNA, 15 bp, Homo sapiens
agaaacattgaagat

SEQ ID NO: 3468121 - DNA, 18 bp, Homo sapiens
agaaaccacttctggtca

SEQ ID NO: 3468122 - DNA, 18 bp, Homo sapiens
agaaacccaccagcctaa

SEQ ID NO: 3468123 - DNA, 18 bp, Homo sapiens
agaaacccgacagaggga

SEQ ID NO: 3468124 - DNA, 21 bp, Homo sapiens
agaaaccctaaaaagagaaga

SEQ ID NO: 3468125 - DNA, 21 bp, Homo sapiens
agaaacgtcttctaaacttcc

SEQ ID NO: 3468126 - DNA, 17 bp, Homo sapiens
agaaactaattgacttt

SEQ ID NO: 3468127 - DNA, 14 bp, Homo sapiens
agaaacttccaaat

SEQ ID NO: 3468128 - DNA, 12 bp, Homo sapiens
agaaagatgtat

SEQ ID NO: 3468129 - DNA, 14 bp, Homo sapiens
agaaagcatttgaa

SEQ ID NO: 3468130 - DNA, 18 bp, Homo sapiens
agaaagcatttgaatgca

SEQ ID NO: 3468131 - DNA, 20 bp, Homo sapiens
agaaaggaggggatagagag

SEQ ID NO: 3468132 - DNA, 19 bp, Homo sapiens
agaaaggttttgagcatgg

SEQ ID NO: 3468133 - DNA, 21 bp, Homo sapiens
agaaaggttttgagcatgggt

SEQ ID NO: 3468134 - DNA, 23 bp, Homo sapiens
agaaagtacttctccaccctgct

SEQ ID NO: 3468135 - DNA, 17 bp, Homo sapiens
agaaagttgcacggctg

SEQ ID NO: 3468136 - DNA, 15 bp, Homo sapiens
attcagtgattactg

SEQ ID NO: 3468137 - DNA, 19 bp, Homo sapiens
attcagtgattactgtcaa

SEQ ID NO: 3468138 - DNA, 17 bp, Homo sapiens
attcagtgcagcatata

SEQ ID NO: 3468139 - DNA, 14 bp, Homo sapiens
attcagttttcatt

SEQ ID NO: 3468140 - DNA, 12 bp, Homo sapiens
attcatatattg

SEQ ID NO: 3468141 - DNA, 13 bp, Homo sapiens
attcatatattgc

SEQ ID NO: 3468142 - DNA, 14 bp, Homo sapiens
attcatatattgca

SEQ ID NO: 3468143 - DNA, 15 bp, Homo sapiens
attcatatattgcat

SEQ ID NO: 3468144 - DNA, 17 bp, Homo sapiens
attcatatattgcattt

SEQ ID NO: 3468145 - DNA, 17 bp, Homo sapiens
attcatattgaatataa

SEQ ID NO: 3468146 - DNA, 19 bp, Homo sapiens
attcatcaaatggaagaca

SEQ ID NO: 3468147 - DNA, 13 bp, Homo sapiens
attcatgactatg

SEQ ID NO: 3468148 - DNA, 13 bp, Homo sapiens
attcatgcctggc

SEQ ID NO: 3468149 - DNA, 14 bp, Homo sapiens
attcatgcctggct

SEQ ID NO: 3468150 - DNA, 12 bp, Homo sapiens
attcatgtttct

SEQ ID NO: 3468151 - DNA, 12 bp, Homo sapiens
attcattatttg

SEQ ID NO: 3468152 - DNA, 11 bp, Homo sapiens
attcatttcta

SEQ ID NO: 3468153 - DNA, 14 bp, Homo sapiens
attcattttctaga

SEQ ID NO: 3468154 - DNA, 15 bp, Homo sapiens
attcattttctagat

SEQ ID NO: 3468155 - DNA, 13 bp, Homo sapiens
attccaaagcaaa

SEQ ID NO: 3468156 - DNA, 13 bp, Homo sapiens
attccaagcttcc

SEQ ID NO: 3468157 - DNA, 23 bp, Homo sapiens
attccaagcttccatagctgctg

SEQ ID NO: 3468158 - DNA, 14 bp, Homo sapiens
attccagaatgctg

SEQ ID NO: 3468159 - DNA, 18 bp, Homo sapiens
attccagagacatcagca

SEQ ID NO: 3468160 - DNA, 16 bp, Homo sapiens
attccagatcccaggc

SEQ ID NO: 3468161 - DNA, 13 bp, Homo sapiens
attccagcccctc

SEQ ID NO: 3468162 - DNA, 22 bp, Homo sapiens
attccaggaggagttagccaaa

SEQ ID NO: 3468163 - DNA, 16 bp, Homo sapiens
attccatatatccttt

SEQ ID NO: 3468164 - DNA, 14 bp, Homo sapiens
attccattcccttc

SEQ ID NO: 3468165 - DNA, 15 bp, Homo sapiens
attcccaagatgcct

SEQ ID NO: 3468166 - DNA, 15 bp, Homo sapiens
attcccaagctctgc

SEQ ID NO: 3468167 - DNA, 14 bp, Homo sapiens
attcccactgccag

SEQ ID NO: 3468168 - DNA, 20 bp, Homo sapiens
attccccagattgcaacagg

SEQ ID NO: 3468169 - DNA, 20 bp, Homo sapiens
attccctagaaacttccaaa

SEQ ID NO: 3468170 - DNA, 21 bp, Homo sapiens
attccctagaaacttccaaat

SEQ ID NO: 3468171 - DNA, 12 bp, Homo sapiens
attccctcccca

SEQ ID NO: 3468172 - DNA, 16 bp, Homo sapiens
attccctctcatctca

SEQ ID NO: 3468173 - DNA, 23 bp, Homo sapiens
attccgtagccagctgctcccca

SEQ ID NO: 3468174 - DNA, 19 bp, Homo sapiens
attccgttgtctgtggatg

SEQ ID NO: 3468175 - DNA, 17 bp, Homo sapiens
attcctaaagaaaaata

SEQ ID NO: 3468176 - DNA, 16 bp, Homo sapiens
attcctagaattaaac

SEQ ID NO: 3468177 - DNA, 17 bp, Homo sapiens
attcctatatagtttat

SEQ ID NO: 3468178 - DNA, 21 bp, Homo sapiens
attcctcgaagttctaggaaa

SEQ ID NO: 3468179 - DNA, 20 bp, Homo sapiens
attcctctactaacaatcag

SEQ ID NO: 3468180 - DNA, 12 bp, Homo sapiens
attcctctggga

SEQ ID NO: 3468181 - DNA, 15 bp, Homo sapiens
attcctgaagaacca

SEQ ID NO: 3468182 - DNA, 19 bp, Homo sapiens
attcctgaagaaccagtcc

SEQ ID NO: 3468183 - DNA, 22 bp, Homo sapiens
attcctgggaaatattccctag

SEQ ID NO: 3468184 - DNA, 12 bp, Homo sapiens
attccttcctgt

SEQ ID NO: 3468185 - DNA, 17 bp, Homo sapiens
attccttcctgttctga

SEQ ID NO: 3468186 - DNA, 17 bp, Homo sapiens
attccttcgaaaggcct

SEQ ID NO: 3468187 - DNA, 15 bp, Homo sapiens
attccttcttctagt

SEQ ID NO: 3468188 - DNA, 16 bp, Homo sapiens
attcgagacagaacct

SEQ ID NO: 3468189 - DNA, 17 bp, Homo sapiens
attcgagacagaacctt

SEQ ID NO: 3468190 - DNA, 20 bp, Homo sapiens
attcggaactgtcctttcct

SEQ ID NO: 3468191 - DNA, 22 bp, Homo sapiens
attcgtagatattggacaaaga

SEQ ID NO: 3468192 - DNA, 13 bp, Homo sapiens
attcgttctgtgg

SEQ ID NO: 3468193 - DNA, 14 bp, Homo sapiens
attctaaaaccatt

SEQ ID NO: 3468194 - DNA, 12 bp, Homo sapiens
attctaaatgta

SEQ ID NO: 3468195 - DNA, 19 bp, Homo sapiens
attctaggcctcctggccc

SEQ ID NO: 3468196 - DNA, 20 bp, Homo sapiens
attctaggcctcctggccca

SEQ ID NO: 3468197 - DNA, 20 bp, Homo sapiens
attctatcttttgtttcctt

SEQ ID NO: 3468198 - DNA, 19 bp, Homo sapiens
attctatgtagtggtttta

SEQ ID NO: 3468199 - DNA, 22 bp, Homo sapiens
attctatttatatgtacatgag

SEQ ID NO: 3468200 - DNA, 16 bp, Homo sapiens
attctcagggtctctg

SEQ ID NO: 3468201 - DNA, 17 bp, Homo sapiens
attctcagggtctctgc

SEQ ID NO: 3468202 - DNA, 21 bp, Homo sapiens
attctcagggtctctgctgcc

SEQ ID NO: 3468203 - DNA, 22 bp, Homo sapiens
attctcagggtctctgctgccg

SEQ ID NO: 3468204 - DNA, 16 bp, Homo sapiens
attctccacagcaacc

SEQ ID NO: 3468205 - DNA, 19 bp, Homo sapiens
attctcctgcctcagcctc

SEQ ID NO: 3468206 - DNA, 13 bp, Homo sapiens
attctcctgcctt

SEQ ID NO: 3468207 - DNA, 19 bp, Homo sapiens
attctcctggatgcttaga

SEQ ID NO: 3468208 - DNA, 13 bp, Homo sapiens
attctccttcagc

SEQ ID NO: 3468209 - DNA, 14 bp, Homo sapiens
attctccttcagcc

SEQ ID NO: 3468210 - DNA, 17 bp, Homo sapiens
attctcgcttccctgaa

SEQ ID NO: 3468211 - DNA, 15 bp, Homo sapiens
attctctccaaaaat

SEQ ID NO: 3468212 - DNA, 13 bp, Homo sapiens
attctctgagctg

SEQ ID NO: 3468213 - DNA, 17 bp, Homo sapiens
attctctgagctgtgca

SEQ ID NO: 3468214 - DNA, 12 bp, Homo sapiens
attctctgtctc

SEQ ID NO: 3468215 - DNA, 17 bp, Homo sapiens
attctctgtctcatcca

SEQ ID NO: 3468216 - DNA, 14 bp, Homo sapiens
attctcttgcattg

SEQ ID NO: 3468217 - DNA, 16 bp, Homo sapiens
attctgaatttgcaaa

SEQ ID NO: 3468218 - DNA, 18 bp, Homo sapiens
attctgactcggtttctc

SEQ ID NO: 3468219 - DNA, 14 bp, Homo sapiens
attctgcaagtata

SEQ ID NO: 3468220 - DNA, 16 bp, Homo sapiens
attctgcaccttgcca

SEQ ID NO: 3468221 - DNA, 14 bp, Homo sapiens
attctgcatgtact

SEQ ID NO: 3468222 - DNA, 15 bp, Homo sapiens
attctgcatttagct

SEQ ID NO: 3468223 - DNA, 19 bp, Homo sapiens
attctgcatttagctgtat

SEQ ID NO: 3468224 - DNA, 17 bp, Homo sapiens
attctgcctgcccaggc

SEQ ID NO: 3468225 - DNA, 18 bp, Homo sapiens
attctgcctgcccaggcc

SEQ ID NO: 3468226 - DNA, 18 bp, Homo sapiens
attctgctcacatatctg

SEQ ID NO: 3468227 - DNA, 22 bp, Homo sapiens
attctgctcacatatctgtcat

SEQ ID NO: 3468228 - DNA, 22 bp, Homo sapiens
attctggacaggatgtgtttgc

SEQ ID NO: 3468229 - DNA, 21 bp, Homo sapiens
attctggattttgtcaagcag

SEQ ID NO: 3468230 - DNA, 23 bp, Homo sapiens
attctggttccagggtccctctg

SEQ ID NO: 3468231 - DNA, 14 bp, Homo sapiens
attctgttggccag

SEQ ID NO: 3468232 - DNA, 15 bp, Homo sapiens
attcttaaaaaaaga

SEQ ID NO: 3468233 - DNA, 13 bp, Homo sapiens
attcttcagcttg

SEQ ID NO: 3468234 - DNA, 20 bp, Homo sapiens
attcttcccttttaaacaca

SEQ ID NO: 3468235 - DNA, 14 bp, Homo sapiens
attcttctgcttca

SEQ ID NO: 3468236 - DNA, 20 bp, Homo sapiens
attcttctgcttcagcctcc

SEQ ID NO: 3468237 - DNA, 22 bp, Homo sapiens
attcttctgtacgtctgacagg

SEQ ID NO: 3468238 - DNA, 15 bp, Homo sapiens
attcttctgtcctga

SEQ ID NO: 3468239 - DNA, 17 bp, Homo sapiens
attcttggttggctggc

SEQ ID NO: 3468240 - DNA, 20 bp, Homo sapiens
attcttggttggctggcctt

SEQ ID NO: 3468241 - DNA, 18 bp, Homo sapiens
attcttgtaaggctttga

SEQ ID NO: 3468242 - DNA, 19 bp, Homo sapiens
attctttaaatatatatta

SEQ ID NO: 3468243 - DNA, 21 bp, Homo sapiens
attctttaaatatatattatt

SEQ ID NO: 3468244 - DNA, 21 bp, Homo sapiens
attctttataatcctctgtaa

SEQ ID NO: 3468245 - DNA, 13 bp, Homo sapiens
attctttattctt

SEQ ID NO: 3468246 - DNA, 13 bp, Homo sapiens
attctttgtacca

SEQ ID NO: 3468247 - DNA, 18 bp, Homo sapiens
attcttttaaaagacaag

SEQ ID NO: 3468248 - DNA, 16 bp, Homo sapiens
attcttttgaattgtt

SEQ ID NO: 3468249 - DNA, 16 bp, Homo sapiens
attgaaagaattatcc

SEQ ID NO: 3468250 - DNA, 16 bp, Homo sapiens
attgaacacaaactgt

SEQ ID NO: 3468251 - DNA, 18 bp, Homo sapiens
attgaaggatcatctgaa

SEQ ID NO: 3468252 - DNA, 23 bp, Homo sapiens
attgaattcttggttgaggaaac

SEQ ID NO: 3468253 - DNA, 17 bp, Homo sapiens
attgacaacagttacat

SEQ ID NO: 3468254 - DNA, 15 bp, Homo sapiens
attgacaagtgtctt

SEQ ID NO: 3468255 - DNA, 19 bp, Homo sapiens
attgacaagtgtctttttg

SEQ ID NO: 3468256 - DNA, 13 bp, Homo sapiens
attgacaataaaa

SEQ ID NO: 3468257 - DNA, 15 bp, Homo sapiens
attgacaataaaata

SEQ ID NO: 3468258 - DNA, 16 bp, Homo sapiens
attgacaataaaatat

SEQ ID NO: 3468259 - DNA, 14 bp, Homo sapiens
attgacacagaaaa

SEQ ID NO: 3468260 - DNA, 17 bp, Homo sapiens
attgacacagaaaatgt

SEQ ID NO: 3468261 - DNA, 15 bp, Homo sapiens
attgacagctttgct

SEQ ID NO: 3468262 - DNA, 17 bp, Homo sapiens
attgaccgcgactaatt

SEQ ID NO: 3468263 - DNA, 16 bp, Homo sapiens
attgactctgggtcct

SEQ ID NO: 3468264 - DNA, 21 bp, Homo sapiens
attgactttagaaagctgaca

SEQ ID NO: 3468265 - DNA, 17 bp, Homo sapiens
attgactttcttaaaaa

SEQ ID NO: 3468266 - DNA, 13 bp, Homo sapiens
attgactttgtct

SEQ ID NO: 3468267 - DNA, 22 bp, Homo sapiens
attgagaaagagcacttaagag

SEQ ID NO: 3468268 - DNA, 14 bp, Homo sapiens
attgagaactgcat

SEQ ID NO: 3468269 - DNA, 18 bp, Homo sapiens
attgagaactgcatatgt

SEQ ID NO: 3468270 - DNA, 14 bp, Homo sapiens
attgaggataaatt

SEQ ID NO: 3468271 - DNA, 18 bp, Homo sapiens
attgaggataaattgcca

SEQ ID NO: 3468272 - DNA, 19 bp, Homo sapiens
attgaggataaattgccat

SEQ ID NO: 3468273 - DNA, 16 bp, Homo sapiens
attgataattcaacat

SEQ ID NO: 3468274 - DNA, 18 bp, Homo sapiens
atgtaaaaggccaaacct

SEQ ID NO: 3468275 - DNA, 14 bp, Homo sapiens
atgtaaactgtgca

SEQ ID NO: 3468276 - DNA, 13 bp, Homo sapiens
atgtaaagccatg

SEQ ID NO: 3468277 - DNA, 20 bp, Homo sapiens
atgtaaaggagtcaaaacta

SEQ ID NO: 3468278 - DNA, 14 bp, Homo sapiens
atgtaaataatctg

SEQ ID NO: 3468279 - DNA, 12 bp, Homo sapiens
atgtaaatgtgc

SEQ ID NO: 3468280 - DNA, 16 bp, Homo sapiens
atgtaagcatactttg

SEQ ID NO: 3468281 - DNA, 22 bp, Homo sapiens
atgtaagcatactttgtaaata

SEQ ID NO: 3468282 - DNA, 12 bp, Homo sapiens
atgtaaggcctt

SEQ ID NO: 3468283 - DNA, 14 bp, Homo sapiens
atgtaataaacttt

SEQ ID NO: 3468284 - DNA, 15 bp, Homo sapiens
atgtaataaacttta

SEQ ID NO: 3468285 - DNA, 16 bp, Homo sapiens
atgtaataaactttaa

SEQ ID NO: 3468286 - DNA, 23 bp, Homo sapiens
atgtaatgttttctttgcaaagt

SEQ ID NO: 3468287 - DNA, 20 bp, Homo sapiens
atgtaattgtttgtctttaa

SEQ ID NO: 3468288 - DNA, 19 bp, Homo sapiens
atgtaatttagtctaacac

SEQ ID NO: 3468289 - DNA, 19 bp, Homo sapiens
atgtacagacatatttaac

SEQ ID NO: 3468290 - DNA, 23 bp, Homo sapiens
atgtacagacatatttaactggt

SEQ ID NO: 3468291 - DNA, 18 bp, Homo sapiens
atgtactagtgttctgtt

SEQ ID NO: 3468292 - DNA, 22 bp, Homo sapiens
atgtactagtgttctgtttgtt

SEQ ID NO: 3468293 - DNA, 14 bp, Homo sapiens
atgtactgtttgct

SEQ ID NO: 3468294 - DNA, 15 bp, Homo sapiens
atgtactgtttgctg

SEQ ID NO: 3468295 - DNA, 19 bp, Homo sapiens
atgtacttgtttctctgtt

SEQ ID NO: 3468296 - DNA, 14 bp, Homo sapiens
atgtactttttagt

SEQ ID NO: 3468297 - DNA, 15 bp, Homo sapiens
atgtactttttagta

SEQ ID NO: 3468298 - DNA, 17 bp, Homo sapiens
atgtagaatattcagac

SEQ ID NO: 3468299 - DNA, 21 bp, Homo sapiens
atgtagcaaaatacatgacat

SEQ ID NO: 3468300 - DNA, 19 bp, Homo sapiens
atgtagcagcttcttagtt

SEQ ID NO: 3468301 - DNA, 13 bp, Homo sapiens
atgtagcccatcc

SEQ ID NO: 3468302 - DNA, 20 bp, Homo sapiens
atgtagcccatccttccctt

SEQ ID NO: 3468303 - DNA, 18 bp, Homo sapiens
atgtagccccctggcctc

SEQ ID NO: 3468304 - DNA, 21 bp, Homo sapiens
atgtagccccctggcctctgt

SEQ ID NO: 3468305 - DNA, 17 bp, Homo sapiens
atgtagtaattgacatg

SEQ ID NO: 3468306 - DNA, 15 bp, Homo sapiens
atgtagtggttttag

SEQ ID NO: 3468307 - DNA, 22 bp, Homo sapiens
atgtataaaatgtaacactgat

SEQ ID NO: 3468308 - DNA, 19 bp, Homo sapiens
atgtataaagtgattgact

SEQ ID NO: 3468309 - DNA, 14 bp, Homo sapiens
atgtataatttttt

SEQ ID NO: 3468310 - DNA, 19 bp, Homo sapiens
atgtatatatatatatgca

SEQ ID NO: 3468311 - DNA, 19 bp, Homo sapiens
atgtatatatatgtatgta

SEQ ID NO: 3468312 - DNA, 22 bp, Homo sapiens
atgtatggaatcccactgtatg

SEQ ID NO: 3468313 - DNA, 15 bp, Homo sapiens
atgtattataacttt

SEQ ID NO: 3468314 - DNA, 19 bp, Homo sapiens
atgtcaccggatcctgggt

SEQ ID NO: 3468315 - DNA, 17 bp, Homo sapiens
atgtcagtaccttcaaa

SEQ ID NO: 3468316 - DNA, 14 bp, Homo sapiens
atgtccagagctgg

SEQ ID NO: 3468317 - DNA, 19 bp, Homo sapiens
atgtcctaattcttctgtc

SEQ ID NO: 3468318 - DNA, 17 bp, Homo sapiens
atgtcgtagaattcctt

SEQ ID NO: 3468319 - DNA, 20 bp, Homo sapiens
atgtctactcagcatttgat

SEQ ID NO: 3468320 - DNA, 19 bp, Homo sapiens
atgtctagagcctcttggg

SEQ ID NO: 3468321 - DNA, 20 bp, Homo sapiens
atgtctagagcctcttgggg

SEQ ID NO: 3468322 - DNA, 21 bp, Homo sapiens
atgtctatgattcgtgtaatt

SEQ ID NO: 3468323 - DNA, 17 bp, Homo sapiens
atgtctattaaggtgat

SEQ ID NO: 3468324 - DNA, 14 bp, Homo sapiens
atgtctattccatt

SEQ ID NO: 3468325 - DNA, 19 bp, Homo sapiens
atgtctattccattccctt

SEQ ID NO: 3468326 - DNA, 14 bp, Homo sapiens
atgtctctgcaaac

SEQ ID NO: 3468327 - DNA, 23 bp, Homo sapiens
atgtctctttaatgtcacaggca

SEQ ID NO: 3468328 - DNA, 13 bp, Homo sapiens
atgtctgaacttt

SEQ ID NO: 3468329 - DNA, 18 bp, Homo sapiens
atgtctgaactttgggaa

SEQ ID NO: 3468330 - DNA, 13 bp, Homo sapiens
atgtctgcagccc

SEQ ID NO: 3468331 - DNA, 14 bp, Homo sapiens
atgtctgcagccct

SEQ ID NO: 3468332 - DNA, 15 bp, Homo sapiens
atgtctgtttgctga

SEQ ID NO: 3468333 - DNA, 24 bp, Homo sapiens
atgtctgtttgctgatggtctggt

SEQ ID NO: 3468334 - DNA, 13 bp, Homo sapiens
atgtcttaatgaa

SEQ ID NO: 3468335 - DNA, 22 bp, Homo sapiens
atgtcttctcacaagccagcca

SEQ ID NO: 3468336 - DNA, 19 bp, Homo sapiens
atgtcttgctgttgacata

SEQ ID NO: 3468337 - DNA, 11 bp, Homo sapiens
atgtcttgtgt

SEQ ID NO: 3468338 - DNA, 21 bp, Homo sapiens
atgtgaaaatggtccaggaga

SEQ ID NO: 3468339 - DNA, 22 bp, Homo sapiens
atgtgaaaatggtccaggagaa

SEQ ID NO: 3468340 - DNA, 23 bp, Homo sapiens
atgtgacattcttaaaaaaagaa

SEQ ID NO: 3468341 - DNA, 20 bp, Homo sapiens
atgtgacctttaattcaggt

SEQ ID NO: 3468342 - DNA, 17 bp, Homo sapiens
atgtgagaggtttgact

SEQ ID NO: 3468343 - DNA, 13 bp, Homo sapiens
atgtgagcacaat

SEQ ID NO: 3468344 - DNA, 23 bp, Homo sapiens
atgtgagctaggagaagggctga

SEQ ID NO: 3468345 - DNA, 14 bp, Homo sapiens
atgtgattttaact

SEQ ID NO: 3468346 - DNA, 15 bp, Homo sapiens
atgtgattttaactc

SEQ ID NO: 3468347 - DNA, 19 bp, Homo sapiens
atgtgattttaactctgtc

SEQ ID NO: 3468348 - DNA, 17 bp, Homo sapiens
atgtgccaatcaatagc

SEQ ID NO: 3468349 - DNA, 20 bp, Homo sapiens
atgtgccagggcaatgatga

SEQ ID NO: 3468350 - DNA, 22 bp, Homo sapiens
atgtgccaggtttttggtctga

SEQ ID NO: 3468351 - DNA, 15 bp, Homo sapiens
atgtgccatgtataa

SEQ ID NO: 3468352 - DNA, 16 bp, Homo sapiens
atgtgccatgtataat

SEQ ID NO: 3468353 - DNA, 22 bp, Homo sapiens
atgtgccccttcgcagctgaag

SEQ ID NO: 3468354 - DNA, 13 bp, Homo sapiens
atgtggctcctcc

SEQ ID NO: 3468355 - DNA, 13 bp, Homo sapiens
atgtggctggaag

SEQ ID NO: 3468356 - DNA, 16 bp, Homo sapiens
atgtggcttgagaaat

SEQ ID NO: 3468357 - DNA, 20 bp, Homo sapiens
atgtgggctagttgggcttc

SEQ ID NO: 3468358 - DNA, 13 bp, Homo sapiens
atgtggggctgag

SEQ ID NO: 3468359 - DNA, 14 bp, Homo sapiens
atgtgggggcttca

SEQ ID NO: 3468360 - DNA, 17 bp, Homo sapiens
atgtggttttcttaagg

SEQ ID NO: 3468361 - DNA, 17 bp, Homo sapiens
atgtgtaggtgaacagt

SEQ ID NO: 3468362 - DNA, 16 bp, Homo sapiens
atgtgtatttcttata

SEQ ID NO: 3468363 - DNA, 22 bp, Homo sapiens
atgtgtgcaacagggtatggac

SEQ ID NO: 3468364 - DNA, 15 bp, Homo sapiens
atgtgtgccaaggct

SEQ ID NO: 3468365 - DNA, 14 bp, Homo sapiens
atgtgtgtgtgtgt

SEQ ID NO: 3468366 - DNA, 15 bp, Homo sapiens
atgtgtttgctttct

SEQ ID NO: 3468367 - DNA, 16 bp, Homo sapiens
atgtgtttgctttctg

SEQ ID NO: 3468368 - DNA, 18 bp, Homo sapiens
atgtgttttgtttattaa

SEQ ID NO: 3468369 - DNA, 16 bp, Homo sapiens
atgttaaacaccattt

SEQ ID NO: 3468370 - DNA, 19 bp, Homo sapiens
atgttaaactagcatatct

SEQ ID NO: 3468371 - DNA, 16 bp, Homo sapiens
atgttaaataaattgt

SEQ ID NO: 3468372 - DNA, 18 bp, Homo sapiens
atgttaaataaattgtat

SEQ ID NO: 3468373 - DNA, 19 bp, Homo sapiens
atgttaattttttggtaca

SEQ ID NO: 3468374 - DNA, 22 bp, Homo sapiens
atgttaattttttggtacaaaa

SEQ ID NO: 3468375 - DNA, 14 bp, Homo sapiens
atgttacattgttt

SEQ ID NO: 3468376 - DNA, 14 bp, Homo sapiens
atgttactgcctta

SEQ ID NO: 3468377 - DNA, 22 bp, Homo sapiens
atgttagactcatggtgtgtta

SEQ ID NO: 3468378 - DNA, 23 bp, Homo sapiens
atgttagaggatccctctctgga

SEQ ID NO: 3468379 - DNA, 14 bp, Homo sapiens
atgttatagaactt

SEQ ID NO: 3468380 - DNA, 15 bp, Homo sapiens
atgttatagaacttc

SEQ ID NO: 3468381 - DNA, 18 bp, Homo sapiens
atgttatatcatatgtat

SEQ ID NO: 3468382 - DNA, 18 bp, Homo sapiens
atgttatgcataaagtca

SEQ ID NO: 3468383 - DNA, 13 bp, Homo sapiens
atgttatttaaca

SEQ ID NO: 3468384 - DNA, 22 bp, Homo sapiens
atgttcaactggagacactatt

SEQ ID NO: 3468385 - DNA, 17 bp, Homo sapiens
atgttccagacattctc

SEQ ID NO: 3468386 - DNA, 15 bp, Homo sapiens
atgttcgggtgtggg

SEQ ID NO: 3468387 - DNA, 15 bp, Homo sapiens
atgttctctatcatt

SEQ ID NO: 3468388 - DNA, 21 bp, Homo sapiens
atgttctctatcatttaataa

SEQ ID NO: 3468389 - DNA, 17 bp, Homo sapiens
atgttctctcttctcca

SEQ ID NO: 3468390 - DNA, 18 bp, Homo sapiens
atgttctctgaggacact

SEQ ID NO: 3468391 - DNA, 12 bp, Homo sapiens
atgttctgggac

SEQ ID NO: 3468392 - DNA, 13 bp, Homo sapiens
atgttctgggaca

SEQ ID NO: 3468393 - DNA, 18 bp, Homo sapiens
atgttctgtgatacagaa

SEQ ID NO: 3468394 - DNA, 21 bp, Homo sapiens
atgttctgtgcctgtaaacat

SEQ ID NO: 3468395 - DNA, 15 bp, Homo sapiens
atgttgaatactttt

SEQ ID NO: 3468396 - DNA, 19 bp, Homo sapiens
atgttgaccatgtctatga

SEQ ID NO: 3468397 - DNA, 18 bp, Homo sapiens
atgttgatcatgtacttt

SEQ ID NO: 3468398 - DNA, 24 bp, Homo sapiens
atgttgatccatccagcttgccag

SEQ ID NO: 3468399 - DNA, 15 bp, Homo sapiens
atgttgctggatcag

SEQ ID NO: 3468400 - DNA, 17 bp, Homo sapiens
atgttgctgttattata

SEQ ID NO: 3468401 - DNA, 19 bp, Homo sapiens
atgttgctgttattatatt

SEQ ID NO: 3468402 - DNA, 14 bp, Homo sapiens
atgttggccaggct

SEQ ID NO: 3468403 - DNA, 12 bp, Homo sapiens
atgttggctggg

SEQ ID NO: 3468404 - DNA, 13 bp, Homo sapiens
atgttggctggga

SEQ ID NO: 3468405 - DNA, 14 bp, Homo sapiens
atgttgtcaaagag

SEQ ID NO: 3468406 - DNA, 19 bp, Homo sapiens
atgttgtgatgtacacatt

SEQ ID NO: 3468407 - DNA, 23 bp, Homo sapiens
atgttgtttcctaatatcaaatg

SEQ ID NO: 3468408 - DNA, 14 bp, Homo sapiens
atgtttaaacattt

SEQ ID NO: 3468409 - DNA, 23 bp, Homo sapiens
atgtttagaaaagtattcgttac

SEQ ID NO: 3468410 - DNA, 20 bp, Homo sapiens
atgtttataaatcttatgct

SEQ ID NO: 3468411 - DNA, 19 bp, Homo sapiens
atgtttccagcagaagaca

SEQ ID NO: 3468412 - DNA, 24 bp, Homo sapiens
atgtttccagcagaagacaaaaag

SEQ ID NO: 3468413 - DNA, 22 bp, Homo sapiens
atgtttcgctgatatatgtgtt

SEQ ID NO: 3468414 - DNA, 23 bp, Homo sapiens
atgtttcgtgaagtatactgtat

SEQ ID NO: 3468415 - DNA, 21 bp, Homo sapiens
atgtttcttttgtatgtaaat

SEQ ID NO: 3468416 - DNA, 15 bp, Homo sapiens
atgtttgcctctgcc

SEQ ID NO: 3468417 - DNA, 22 bp, Homo sapiens
atgtttgcctctgcctctgaca

SEQ ID NO: 3468418 - DNA, 24 bp, Homo sapiens
atgtttgtaactttttacattaca

SEQ ID NO: 3468419 - DNA, 16 bp, Homo sapiens
atgttttaagaggcag

SEQ ID NO: 3468420 - DNA, 16 bp, Homo sapiens
atgttttctttgcaaa

SEQ ID NO: 3468421 - DNA, 17 bp, Homo sapiens
atgttttctttgcaaag

SEQ ID NO: 3468422 - DNA, 21 bp, Homo sapiens
atgttttctttgcaaagtatt

SEQ ID NO: 3468423 - DNA, 11 bp, Homo sapiens
atgttttggtg

SEQ ID NO: 3468424 - DNA, 20 bp, Homo sapiens
attaaaaaaaaagatctgtt

SEQ ID NO: 3468425 - DNA, 15 bp, Homo sapiens
attaaaaaaaacaaa

SEQ ID NO: 3468426 - DNA, 23 bp, Homo sapiens
attaaaaaaaacaaaaagaacaa

SEQ ID NO: 3468427 - DNA, 12 bp, Homo sapiens
attaaaaatata

SEQ ID NO: 3468428 - DNA, 16 bp, Homo sapiens
attaaaatattttgga

SEQ ID NO: 3468429 - DNA, 16 bp, Homo sapiens
attaaaatcctcaatc

SEQ ID NO: 3468430 - DNA, 17 bp, Homo sapiens
attaaaattctgaattt

SEQ ID NO: 3468431 - DNA, 16 bp, Homo sapiens
attaaacagatatctt

SEQ ID NO: 3468432 - DNA, 23 bp, Homo sapiens
attaaactcttcacaaaatctgt

SEQ ID NO: 3468433 - DNA, 16 bp, Homo sapiens
attaaatatttgaaga

SEQ ID NO: 3468434 - DNA, 14 bp, Homo sapiens
attaaattcacaaa

SEQ ID NO: 3468435 - DNA, 18 bp, Homo sapiens
attaaattcacaaacttt

SEQ ID NO: 3468436 - DNA, 12 bp, Homo sapiens
attaacatgatg

SEQ ID NO: 3468437 - DNA, 14 bp, Homo sapiens
attaacatgatgta

SEQ ID NO: 3468438 - DNA, 15 bp, Homo sapiens
attaacatgatgtac

SEQ ID NO: 3468439 - DNA, 18 bp, Homo sapiens
attaaccacttcagctga

SEQ ID NO: 3468440 - DNA, 15 bp, Homo sapiens
attaaccatagatgt

SEQ ID NO: 3468441 - DNA, 13 bp, Homo sapiens
attaacctctcac

SEQ ID NO: 3468442 - DNA, 22 bp, Homo sapiens
attaactgagtagctctcctga

SEQ ID NO: 3468443 - DNA, 15 bp, Homo sapiens
attaagaaaatcata

SEQ ID NO: 3468444 - DNA, 16 bp, Homo sapiens
attaagatgccttgaa

SEQ ID NO: 3468445 - DNA, 17 bp, Homo sapiens
attaagatgccttgaat

SEQ ID NO: 3468446 - DNA, 22 bp, Homo sapiens
attaagctgttcctgttcagta

SEQ ID NO: 3468447 - DNA, 18 bp, Homo sapiens
attaaggatgtagctttt

SEQ ID NO: 3468448 - DNA, 16 bp, Homo sapiens
attaataatcttatta

SEQ ID NO: 3468449 - DNA, 21 bp, Homo sapiens
attaatagtaatttgtaaagt

SEQ ID NO: 3468450 - DNA, 20 bp, Homo sapiens
attaatctaccttgcagtgt

SEQ ID NO: 3468451 - DNA, 20 bp, Homo sapiens
attaatgacacttgtcccca

SEQ ID NO: 3468452 - DNA, 16 bp, Homo sapiens
attaatgtacttgttt

SEQ ID NO: 3468453 - DNA, 23 bp, Homo sapiens
attaatgtacttgtttctctgtt

SEQ ID NO: 3468454 - DNA, 13 bp, Homo sapiens
attaattctataa

SEQ ID NO: 3468455 - DNA, 13 bp, Homo sapiens
attacaatacaaa

SEQ ID NO: 3468456 - DNA, 22 bp, Homo sapiens
attacaatacaaaggttccatt

SEQ ID NO: 3468457 - DNA, 23 bp, Homo sapiens
attacaatacaaaggttccattc

SEQ ID NO: 3468458 - DNA, 18 bp, Homo sapiens
attacaattttatctgtt

SEQ ID NO: 3468459 - DNA, 16 bp, Homo sapiens
attacaggtgtgaacc

SEQ ID NO: 3468460 - DNA, 16 bp, Homo sapiens
attacatgtaatttga

SEQ ID NO: 3468461 - DNA, 13 bp, Homo sapiens
attaccatgtaaa

SEQ ID NO: 3468462 - DNA, 15 bp, Homo sapiens
attaccatgtaaata

SEQ ID NO: 3468463 - DNA, 16 bp, Homo sapiens
attaccatgtaaataa

SEQ ID NO: 3468464 - DNA, 19 bp, Homo sapiens
attaccccctccttcagac

SEQ ID NO: 3468465 - DNA, 21 bp, Homo sapiens
attaccccctccttcagacac

SEQ ID NO: 3468466 - DNA, 18 bp, Homo sapiens
attaccgcgttgtaaaat

SEQ ID NO: 3468467 - DNA, 13 bp, Homo sapiens
attacctcctgag

SEQ ID NO: 3468468 - DNA, 17 bp, Homo sapiens
attacctcctgagaaaa

SEQ ID NO: 3468469 - DNA, 12 bp, Homo sapiens
attaccttctcc

SEQ ID NO: 3468470 - DNA, 16 bp, Homo sapiens
attactgcttcatttt

SEQ ID NO: 3468471 - DNA, 21 bp, Homo sapiens
attagaaaaatagcaacttgt

SEQ ID NO: 3468472 - DNA, 13 bp, Homo sapiens
attagaaaatgtt

SEQ ID NO: 3468473 - DNA, 17 bp, Homo sapiens
attagagtgtctttcca

SEQ ID NO: 3468474 - DNA, 23 bp, Homo sapiens
attagagtgtctttccacggagc

SEQ ID NO: 3468475 - DNA, 19 bp, Homo sapiens
attagatgattatatattg

SEQ ID NO: 3468476 - DNA, 16 bp, Homo sapiens
attagatgttctctat

SEQ ID NO: 3468477 - DNA, 23 bp, Homo sapiens
attagatgttctctatcatttaa

SEQ ID NO: 3468478 - DNA, 18 bp, Homo sapiens
attagccgggcatggtgg

SEQ ID NO: 3468479 - DNA, 14 bp, Homo sapiens
attagcctgagtag

SEQ ID NO: 3468480 - DNA, 16 bp, Homo sapiens
attagcctgagtagaa

SEQ ID NO: 3468481 - DNA, 15 bp, Homo sapiens
attagctttttcatc

SEQ ID NO: 3468482 - DNA, 18 bp, Homo sapiens
attagggagaaaattcaa

SEQ ID NO: 3468483 - DNA, 16 bp, Homo sapiens
attaggtatgtttgta

SEQ ID NO: 3468484 - DNA, 13 bp, Homo sapiens
attaggtattttg

SEQ ID NO: 3468485 - DNA, 18 bp, Homo sapiens
attaggtttcagcagagc

SEQ ID NO: 3468486 - DNA, 13 bp, Homo sapiens
attagtaacatgt

SEQ ID NO: 3468487 - DNA, 16 bp, Homo sapiens
attagtaacatgtgtt

SEQ ID NO: 3468488 - DNA, 17 bp, Homo sapiens
attagtaacatgtgtta

SEQ ID NO: 3468489 - DNA, 17 bp, Homo sapiens
attagttgccaatatgc

SEQ ID NO: 3468490 - DNA, 18 bp, Homo sapiens
attagttgccaatatgcc

SEQ ID NO: 3468491 - DNA, 16 bp, Homo sapiens
attagttttcttgttg

SEQ ID NO: 3468492 - DNA, 19 bp, Homo sapiens
attagttttcttgttgctt

SEQ ID NO: 3468493 - DNA, 17 bp, Homo sapiens
attataacaagtgtgtc

SEQ ID NO: 3468494 - DNA, 17 bp, Homo sapiens
attatcatgcaaatgct

SEQ ID NO: 3468495 - DNA, 17 bp, Homo sapiens
attatccatattgagtc

SEQ ID NO: 3468496 - DNA, 15 bp, Homo sapiens
attatccattcccaa

SEQ ID NO: 3468497 - DNA, 16 bp, Homo sapiens
attatccattcccaag

SEQ ID NO: 3468498 - DNA, 22 bp, Homo sapiens
attatccattcccaagatgcct

SEQ ID NO: 3468499 - DNA, 14 bp, Homo sapiens
attatctatacata

SEQ ID NO: 3468500 - DNA, 20 bp, Homo sapiens
attatctatacatatcttta

SEQ ID NO: 3468501 - DNA, 16 bp, Homo sapiens
attatgtataaaatgt

SEQ ID NO: 3468502 - DNA, 18 bp, Homo sapiens
attatgtataaaatgtaa

SEQ ID NO: 3468503 - DNA, 21 bp, Homo sapiens
attatgtataaaatgtaacac

SEQ ID NO: 3468504 - DNA, 11 bp, Homo sapiens
attatgttaaa

SEQ ID NO: 3468505 - DNA, 12 bp, Homo sapiens
attatgttaaac

SEQ ID NO: 3468506 - DNA, 13 bp, Homo sapiens
attatgttaaact

SEQ ID NO: 3468507 - DNA, 23 bp, Homo sapiens
attatgttaaactagcatatctg

SEQ ID NO: 3468508 - DNA, 13 bp, Homo sapiens
attattaattgca

SEQ ID NO: 3468509 - DNA, 22 bp, Homo sapiens
attattatttatttgattaggt

SEQ ID NO: 3468510 - DNA, 13 bp, Homo sapiens
attattcagtgtc

SEQ ID NO: 3468511 - DNA, 14 bp, Homo sapiens
attattcagtgtca

SEQ ID NO: 3468512 - DNA, 17 bp, Homo sapiens
attattctcatttagtg

SEQ ID NO: 3468513 - DNA, 13 bp, Homo sapiens
attatttattatt

SEQ ID NO: 3468514 - DNA, 22 bp, Homo sapiens
attatttatttgattaggtatg

SEQ ID NO: 3468515 - DNA, 18 bp, Homo sapiens
attatttcacaaataata

SEQ ID NO: 3468516 - DNA, 11 bp, Homo sapiens
attatttgcat

SEQ ID NO: 3468517 - DNA, 17 bp, Homo sapiens
attatttgtcaaattgt

SEQ ID NO: 3468518 - DNA, 13 bp, Homo sapiens
attattttccaaa

SEQ ID NO: 3468519 - DNA, 14 bp, Homo sapiens
attcaaaatattta

SEQ ID NO: 3468520 - DNA, 16 bp, Homo sapiens
attcaaactgctccaa

SEQ ID NO: 3468521 - DNA, 17 bp, Homo sapiens
attcaaactgctccaag

SEQ ID NO: 3468522 - DNA, 17 bp, Homo sapiens
attcaaactggggcctc

SEQ ID NO: 3468523 - DNA, 22 bp, Homo sapiens
attcaaactggggcctccagaa

SEQ ID NO: 3468524 - DNA, 20 bp, Homo sapiens
attcaataaagtatttaatt

SEQ ID NO: 3468525 - DNA, 21 bp, Homo sapiens
attcaatattgaatttttcct

SEQ ID NO: 3468526 - DNA, 17 bp, Homo sapiens
attcaattcctctggga

SEQ ID NO: 3468527 - DNA, 13 bp, Homo sapiens
attcaattgtaaa

SEQ ID NO: 3468528 - DNA, 21 bp, Homo sapiens
attcaattgtaaattgaatca

SEQ ID NO: 3468529 - DNA, 22 bp, Homo sapiens
attcaattgtaaattgaatcag

SEQ ID NO: 3468530 - DNA, 22 bp, Homo sapiens
attcacaaacttttatactctt

SEQ ID NO: 3468531 - DNA, 12 bp, Homo sapiens
attcacacaccc

SEQ ID NO: 3468532 - DNA, 14 bp, Homo sapiens
attcacataataaa

SEQ ID NO: 3468533 - DNA, 17 bp, Homo sapiens
attcacatctaacctca

SEQ ID NO: 3468534 - DNA, 20 bp, Homo sapiens
attcacatctaacctcatct

SEQ ID NO: 3468535 - DNA, 19 bp, Homo sapiens
attcacctgccccaactct

SEQ ID NO: 3468536 - DNA, 15 bp, Homo sapiens
attcacctgccctgt

SEQ ID NO: 3468537 - DNA, 14 bp, Homo sapiens
attcacttgcattt

SEQ ID NO: 3468538 - DNA, 14 bp, Homo sapiens
attcagacaaaatg

SEQ ID NO: 3468539 - DNA, 23 bp, Homo sapiens
attcagacaaaatggatacataa

SEQ ID NO: 3468540 - DNA, 13 bp, Homo sapiens
attcagacaggca

SEQ ID NO: 3468541 - DNA, 14 bp, Homo sapiens
attcagcaaaccat

SEQ ID NO: 3468542 - DNA, 18 bp, Homo sapiens
attcagcagcaaattttc

SEQ ID NO: 3468543 - DNA, 20 bp, Homo sapiens
attcagcagcaaattttcag

SEQ ID NO: 3468544 - DNA, 17 bp, Homo sapiens
attcagccatgtacaga

SEQ ID NO: 3468545 - DNA, 18 bp, Homo sapiens
attcagctctgcaagaat

SEQ ID NO: 3468546 - DNA, 21 bp, Homo sapiens
attcaggaatgtgtggcctgc

SEQ ID NO: 3468547 - DNA, 23 bp, Homo sapiens
attcagtccgcctggccggctcc

SEQ ID NO: 3468548 - DNA, 18 bp, Homo sapiens
attgataattcaacattt

SEQ ID NO: 3468549 - DNA, 13 bp, Homo sapiens
attgatggggaag

SEQ ID NO: 3468550 - DNA, 13 bp, Homo sapiens
attgatttgcatt

SEQ ID NO: 3468551 - DNA, 19 bp, Homo sapiens
attgcaaatcttgaaatta

SEQ ID NO: 3468552 - DNA, 17 bp, Homo sapiens
attgcaacaggctgggc

SEQ ID NO: 3468553 - DNA, 19 bp, Homo sapiens
attgcaacaggctgggctt

SEQ ID NO: 3468554 - DNA, 18 bp, Homo sapiens
attgcacaactctactgt

SEQ ID NO: 3468555 - DNA, 18 bp, Homo sapiens
attgcacatgtcttaatg

SEQ ID NO: 3468556 - DNA, 17 bp, Homo sapiens
attgcacgtgcctgtgg

SEQ ID NO: 3468557 - DNA, 15 bp, Homo sapiens
attgcactccagtct

SEQ ID NO: 3468558 - DNA, 22 bp, Homo sapiens
attgcagaactaaactcattta

SEQ ID NO: 3468559 - DNA, 22 bp, Homo sapiens
attgcatctcccagataatgtg

SEQ ID NO: 3468560 - DNA, 13 bp, Homo sapiens
attgcatgtgact

SEQ ID NO: 3468561 - DNA, 13 bp, Homo sapiens
attgccataatat

SEQ ID NO: 3468562 - DNA, 16 bp, Homo sapiens
attgccatattgcaca

SEQ ID NO: 3468563 - DNA, 19 bp, Homo sapiens
attgccatattgcacatgt

SEQ ID NO: 3468564 - DNA, 22 bp, Homo sapiens
attgccatattgcacatgtctt

SEQ ID NO: 3468565 - DNA, 15 bp, Homo sapiens
attgcccaggctggt

SEQ ID NO: 3468566 - DNA, 23 bp, Homo sapiens
attgcctttagtgatcacagcag

SEQ ID NO: 3468567 - DNA, 17 bp, Homo sapiens
attgccttttaattttt

SEQ ID NO: 3468568 - DNA, 16 bp, Homo sapiens
attgcggacagccacg

SEQ ID NO: 3468569 - DNA, 16 bp, Homo sapiens
attgctaatgttgctg

SEQ ID NO: 3468570 - DNA, 15 bp, Homo sapiens
attgctactgtccta

SEQ ID NO: 3468571 - DNA, 21 bp, Homo sapiens
attgctgagagaaatatggaa

SEQ ID NO: 3468572 - DNA, 10 bp, Homo sapiens
attgctgcca

SEQ ID NO: 3468573 - DNA, 15 bp, Homo sapiens
attgctgtctgcagc

SEQ ID NO: 3468574 - DNA, 21 bp, Homo sapiens
attgctgttgtccaactattt

SEQ ID NO: 3468575 - DNA, 14 bp, Homo sapiens
attgcttgagctca

SEQ ID NO: 3468576 - DNA, 13 bp, Homo sapiens
attgcttgggtct

SEQ ID NO: 3468577 - DNA, 18 bp, Homo sapiens
attgcttgggtctctctc

SEQ ID NO: 3468578 - DNA, 12 bp, Homo sapiens
attgctttcctg

SEQ ID NO: 3468579 - DNA, 22 bp, Homo sapiens
attgctttcctgcctccttgaa

SEQ ID NO: 3468580 - DNA, 17 bp, Homo sapiens
attgctttgaaaaagtt

SEQ ID NO: 3468581 - DNA, 18 bp, Homo sapiens
attggaatgcagaggtct

SEQ ID NO: 3468582 - DNA, 22 bp, Homo sapiens
attggaatgcagaggtctccaa

SEQ ID NO: 3468583 - DNA, 19 bp, Homo sapiens
attggacagtaaaatccac

SEQ ID NO: 3468584 - DNA, 15 bp, Homo sapiens
attggacccttccat

SEQ ID NO: 3468585 - DNA, 17 bp, Homo sapiens
attggctcacactgaga

SEQ ID NO: 3468586 - DNA, 14 bp, Homo sapiens
attggctttatcct

SEQ ID NO: 3468587 - DNA, 23 bp, Homo sapiens
attggctttgggttgcaggacct

SEQ ID NO: 3468588 - DNA, 18 bp, Homo sapiens
attgggcggctctgaagc

SEQ ID NO: 3468589 - DNA, 18 bp, Homo sapiens
attgtaaaaaattcacat

SEQ ID NO: 3468590 - DNA, 19 bp, Homo sapiens
attgtaaaaaattcacata

SEQ ID NO: 3468591 - DNA, 15 bp, Homo sapiens
attgtaaattatatt

SEQ ID NO: 3468592 - DNA, 13 bp, Homo sapiens
attgtatattcac

SEQ ID NO: 3468593 - DNA, 14 bp, Homo sapiens
attgtatattcact

SEQ ID NO: 3468594 - DNA, 15 bp, Homo sapiens
attgtatcgatgtta

SEQ ID NO: 3468595 - DNA, 14 bp, Homo sapiens
attgtattacaaat

SEQ ID NO: 3468596 - DNA, 15 bp, Homo sapiens
attgtattacaaatc

SEQ ID NO: 3468597 - DNA, 11 bp, Homo sapiens
attgtatttat

SEQ ID NO: 3468598 - DNA, 23 bp, Homo sapiens
attgtatttattcaataaagtat

SEQ ID NO: 3468599 - DNA, 15 bp, Homo sapiens
attgtcatcaggaga

SEQ ID NO: 3468600 - DNA, 17 bp, Homo sapiens
attgtccctctgcccca

SEQ ID NO: 3468601 - DNA, 18 bp, Homo sapiens
attgtcctcatttctcca

SEQ ID NO: 3468602 - DNA, 20 bp, Homo sapiens
attgtctcctatatatttct

SEQ ID NO: 3468603 - DNA, 13 bp, Homo sapiens
attgtctcttcat

SEQ ID NO: 3468604 - DNA, 14 bp, Homo sapiens
attgtgctttgtat

SEQ ID NO: 3468605 - DNA, 15 bp, Homo sapiens
attgtgtttgtcatt

SEQ ID NO: 3468606 - DNA, 18 bp, Homo sapiens
attgtgtttgtcattagc

SEQ ID NO: 3468607 - DNA, 22 bp, Homo sapiens
attgtgtttgtcattagcctga

SEQ ID NO: 3468608 - DNA, 13 bp, Homo sapiens
attgttaaaataa

SEQ ID NO: 3468609 - DNA, 15 bp, Homo sapiens
attgttaaaataact

SEQ ID NO: 3468610 - DNA, 24 bp, Homo sapiens
attgttccagcagttttcaagtca

SEQ ID NO: 3468611 - DNA, 19 bp, Homo sapiens
attgttggtgttaattgaa

SEQ ID NO: 3468612 - DNA, 15 bp, Homo sapiens
attgtttaaaaatac

SEQ ID NO: 3468613 - DNA, 20 bp, Homo sapiens
attgtttaaaaatacacatg

SEQ ID NO: 3468614 - DNA, 12 bp, Homo sapiens
attgtttacagg

SEQ ID NO: 3468615 - DNA, 13 bp, Homo sapiens
attgtttatgtaa

SEQ ID NO: 3468616 - DNA, 19 bp, Homo sapiens
attgttttctttttctacc

SEQ ID NO: 3468617 - DNA, 16 bp, Homo sapiens
atttaaaaatgtcttg

SEQ ID NO: 3468618 - DNA, 18 bp, Homo sapiens
atttaaaaatgtcttgct

SEQ ID NO: 3468619 - DNA, 15 bp, Homo sapiens
atttaaaagctccta

SEQ ID NO: 3468620 - DNA, 19 bp, Homo sapiens
atttaaacaataaatgtgc

SEQ ID NO: 3468621 - DNA, 13 bp, Homo sapiens
atttaacagcatg

SEQ ID NO: 3468622 - DNA, 14 bp, Homo sapiens
atttaacctctttt

SEQ ID NO: 3468623 - DNA, 16 bp, Homo sapiens
atttaagagacagtca

SEQ ID NO: 3468624 - DNA, 16 bp, Homo sapiens
atttaagcaacatctt

SEQ ID NO: 3468625 - DNA, 18 bp, Homo sapiens
atttaataatatacttgt

SEQ ID NO: 3468626 - DNA, 17 bp, Homo sapiens
atttaatgttttaaatg

SEQ ID NO: 3468627 - DNA, 19 bp, Homo sapiens
atttaatgttttaaatgta

SEQ ID NO: 3468628 - DNA, 21 bp, Homo sapiens
atttaatgttttaaatgtaca

SEQ ID NO: 3468629 - DNA, 13 bp, Homo sapiens
atttaatttagat

SEQ ID NO: 3468630 - DNA, 13 bp, Homo sapiens
atttacaaagtgt

SEQ ID NO: 3468631 - DNA, 14 bp, Homo sapiens
atttacaaagtgtg

SEQ ID NO: 3468632 - DNA, 18 bp, Homo sapiens
atttacaaagtgtgtatt

SEQ ID NO: 3468633 - DNA, 20 bp, Homo sapiens
atttacaaagtgtgtattaa

SEQ ID NO: 3468634 - DNA, 19 bp, Homo sapiens
atttacagatgaatgtatt

SEQ ID NO: 3468635 - DNA, 19 bp, Homo sapiens
atttacgctttgattcata

SEQ ID NO: 3468636 - DNA, 20 bp, Homo sapiens
atttactgagcttctctgtg

SEQ ID NO: 3468637 - DNA, 16 bp, Homo sapiens
atttagagaggaaaag

SEQ ID NO: 3468638 - DNA, 22 bp, Homo sapiens
atttagatattttccatatatt

SEQ ID NO: 3468639 - DNA, 21 bp, Homo sapiens
atttagctaaacggattccaa

SEQ ID NO: 3468640 - DNA, 16 bp, Homo sapiens
atttagggaactgctt

SEQ ID NO: 3468641 - DNA, 18 bp, Homo sapiens
atttaggtttttattagt

SEQ ID NO: 3468642 - DNA, 14 bp, Homo sapiens
atttagtagtgtaa

SEQ ID NO: 3468643 - DNA, 14 bp, Homo sapiens
atttataaaacttc

SEQ ID NO: 3468644 - DNA, 17 bp, Homo sapiens
atttataaagctaaaat

SEQ ID NO: 3468645 - DNA, 21 bp, Homo sapiens
atttataaagctaaaataacc

SEQ ID NO: 3468646 - DNA, 14 bp, Homo sapiens
atttatacaaatta

SEQ ID NO: 3468647 - DNA, 17 bp, Homo sapiens
atttatactgtatatat

SEQ ID NO: 3468648 - DNA, 17 bp, Homo sapiens
atttatagatcatttct

SEQ ID NO: 3468649 - DNA, 23 bp, Homo sapiens
atttatatatctaagttcacagt

SEQ ID NO: 3468650 - DNA, 16 bp, Homo sapiens
atttatatatgtatct

SEQ ID NO: 3468651 - DNA, 16 bp, Homo sapiens
atttatatgtacatga

SEQ ID NO: 3468652 - DNA, 18 bp, Homo sapiens
atttatccaaaatgtgta

SEQ ID NO: 3468653 - DNA, 19 bp, Homo sapiens
atttatccaaaatgtgtat

SEQ ID NO: 3468654 - DNA, 20 bp, Homo sapiens
atttatgcgaacctatgtct

SEQ ID NO: 3468655 - DNA, 16 bp, Homo sapiens
atttattaattgcttt

SEQ ID NO: 3468656 - DNA, 15 bp, Homo sapiens
atttattacctctga

SEQ ID NO: 3468657 - DNA, 21 bp, Homo sapiens
atttattattttcacctgttt

SEQ ID NO: 3468658 - DNA, 11 bp, Homo sapiens
atttattcaat

SEQ ID NO: 3468659 - DNA, 14 bp, Homo sapiens
atttattcaataaa

SEQ ID NO: 3468660 - DNA, 17 bp, Homo sapiens
atttattcaataaagta

SEQ ID NO: 3468661 - DNA, 21 bp, Homo sapiens
atttattcattatttgtcaaa

SEQ ID NO: 3468662 - DNA, 17 bp, Homo sapiens
atttattgcacattgtt

SEQ ID NO: 3468663 - DNA, 24 bp, Homo sapiens
atttattgcagaggatgttcataa

SEQ ID NO: 3468664 - DNA, 13 bp, Homo sapiens
atttatttattat

SEQ ID NO: 3468665 - DNA, 14 bp, Homo sapiens
atttatttattatt

SEQ ID NO: 3468666 - DNA, 13 bp, Homo sapiens
atttatttcctag

SEQ ID NO: 3468667 - DNA, 16 bp, Homo sapiens
atttatttgattaggt

SEQ ID NO: 3468668 - DNA, 17 bp, Homo sapiens
atttatttgattaggta

SEQ ID NO: 3468669 - DNA, 20 bp, Homo sapiens
atttatttgattaggtatgt

SEQ ID NO: 3468670 - DNA, 16 bp, Homo sapiens
atttatttgcttcttc

SEQ ID NO: 3468671 - DNA, 13 bp, Homo sapiens
atttcaaaatgct

SEQ ID NO: 3468672 - DNA, 15 bp, Homo sapiens
atttcaaaatgcttt

SEQ ID NO: 3468673 - DNA, 17 bp, Homo sapiens
atttcaaattggagctt

SEQ ID NO: 3468674 - DNA, 12 bp, Homo sapiens
atttcaagctct

SEQ ID NO: 3468675 - DNA, 22 bp, Homo sapiens
atttcaatcccacgtacttata

SEQ ID NO: 3468676 - DNA, 14 bp, Homo sapiens
atttcacaaataat

SEQ ID NO: 3468677 - DNA, 21 bp, Homo sapiens
atttcacattaatatttgctg

SEQ ID NO: 3468678 - DNA, 12 bp, Homo sapiens
atttcagactcc

SEQ ID NO: 3468679 - DNA, 18 bp, Homo sapiens
atttcagaggctgcagga

SEQ ID NO: 3468680 - DNA, 14 bp, Homo sapiens
atttcagatgtaat

SEQ ID NO: 3468681 - DNA, 11 bp, Homo sapiens
atttcatctgc

SEQ ID NO: 3468682 - DNA, 16 bp, Homo sapiens
atttcatctgctctcc

SEQ ID NO: 3468683 - DNA, 19 bp, Homo sapiens
atttcatctgctctccttc

SEQ ID NO: 3468684 - DNA, 21 bp, Homo sapiens
atttcatctgctctccttcct

SEQ ID NO: 3468685 - DNA, 17 bp, Homo sapiens
atttccaaattcacaag

SEQ ID NO: 3468686 - DNA, 14 bp, Homo sapiens
atttccactatttt

SEQ ID NO: 3468687 - DNA, 18 bp, Homo sapiens
atttccactattttcaaa

SEQ ID NO: 3468688 - DNA, 21 bp, Homo sapiens
atttccactattttcaaagaa

SEQ ID NO: 3468689 - DNA, 17 bp, Homo sapiens
atttccagccaaagcct

SEQ ID NO: 3468690 - DNA, 18 bp, Homo sapiens
atttccagccagggctgc

SEQ ID NO: 3468691 - DNA, 20 bp, Homo sapiens
atttccatgtcccctcccag

SEQ ID NO: 3468692 - DNA, 16 bp, Homo sapiens
atttcccaggaccctg

SEQ ID NO: 3468693 - DNA, 18 bp, Homo sapiens
atttcccccctccgcctc

SEQ ID NO: 3468694 - DNA, 18 bp, Homo sapiens
atttcctagttctgtaga

SEQ ID NO: 3468695 - DNA, 22 bp, Homo sapiens
atttcctagttctgtagaaatg

SEQ ID NO: 3468696 - DNA, 18 bp, Homo sapiens
atttcctatcacctattt

SEQ ID NO: 3468697 - DNA, 20 bp, Homo sapiens
atttcctatgtaactgcatt

SEQ ID NO: 3468698 - DNA, 19 bp, Homo sapiens
atttcctcagcttatctct

SEQ ID NO: 3468699 - DNA, 15 bp, Homo sapiens
atttcctggatgttt

SEQ ID NO: 3468700 - DNA, 12 bp, Homo sapiens
atttcctgtgtc

SEQ ID NO: 3468701 - DNA, 14 bp, Homo sapiens
atttcctgtgtctt

SEQ ID NO: 3468702 - DNA, 22 bp, Homo sapiens
atttcctttattattctgtatc

SEQ ID NO: 3468703 - DNA, 15 bp, Homo sapiens
atttctaaagttgta

SEQ ID NO: 3468704 - DNA, 16 bp, Homo sapiens
atttctaggcaaaatt

SEQ ID NO: 3468705 - DNA, 18 bp, Homo sapiens
atttctaggcaaaattgt

SEQ ID NO: 3468706 - DNA, 19 bp, Homo sapiens
atttctatcttgttccaag

SEQ ID NO: 3468707 - DNA, 14 bp, Homo sapiens
atttctattattaa

SEQ ID NO: 3468708 - DNA, 17 bp, Homo sapiens
atttctatttatttact

SEQ ID NO: 3468709 - DNA, 21 bp, Homo sapiens
atttctcagactttggaaaat

SEQ ID NO: 3468710 - DNA, 20 bp, Homo sapiens
atttctcctccatgggagaa

SEQ ID NO: 3468711 - DNA, 14 bp, Homo sapiens
atttcttaaacact

SEQ ID NO: 3468712 - DNA, 22 bp, Homo sapiens
atttcttatacgcttttctttg

SEQ ID NO: 3468713 - DNA, 22 bp, Homo sapiens
atttcttctcctggagttgcat

SEQ ID NO: 3468714 - DNA, 18 bp, Homo sapiens
atttcttcttcacatcca

SEQ ID NO: 3468715 - DNA, 20 bp, Homo sapiens
atttcttcttcacatccatt

SEQ ID NO: 3468716 - DNA, 21 bp, Homo sapiens
atttcttgagttttgttttaa

SEQ ID NO: 3468717 - DNA, 13 bp, Homo sapiens
atttcttgtgcct

SEQ ID NO: 3468718 - DNA, 22 bp, Homo sapiens
atttctttgctgtaagatgtct

SEQ ID NO: 3468719 - DNA, 14 bp, Homo sapiens
atttgaatcttgtc

SEQ ID NO: 3468720 - DNA, 14 bp, Homo sapiens
atttgaatgcattt

SEQ ID NO: 3468721 - DNA, 14 bp, Homo sapiens
atttgactaatttt

SEQ ID NO: 3468722 - DNA, 14 bp, Homo sapiens
atttgagaatataa

SEQ ID NO: 3468723 - DNA, 21 bp, Homo sapiens
atttgagtctcttaatagcca

SEQ ID NO: 3468724 - DNA, 14 bp, Homo sapiens
atttgattaggtat

SEQ ID NO: 3468725 - DNA, 16 bp, Homo sapiens
atttgattcaaaatat

SEQ ID NO: 3468726 - DNA, 13 bp, Homo sapiens
atttgattgattt

SEQ ID NO: 3468727 - DNA, 16 bp, Homo sapiens
atttgattgatttgaa

SEQ ID NO: 3468728 - DNA, 13 bp, Homo sapiens
atttgcaaagtac

SEQ ID NO: 3468729 - DNA, 17 bp, Homo sapiens
atttgcaaagtactgta

SEQ ID NO: 3468730 - DNA, 16 bp, Homo sapiens
atttgcaccagtttta

SEQ ID NO: 3468731 - DNA, 14 bp, Homo sapiens
atttgcagggtcct

SEQ ID NO: 3468732 - DNA, 23 bp, Homo sapiens
atttgcattaaattcacaaactt

SEQ ID NO: 3468733 - DNA, 22 bp, Homo sapiens
atttgcattgaacacaaactgt

SEQ ID NO: 3468734 - DNA, 11 bp, Homo sapiens
atttgcctcac

SEQ ID NO: 3468735 - DNA, 12 bp, Homo sapiens
atttgcctcacc

SEQ ID NO: 3468736 - DNA, 20 bp, Homo sapiens
atttgcctcaccttggggcc

SEQ ID NO: 3468737 - DNA, 21 bp, Homo sapiens
atttgcctcaccttggggcct

SEQ ID NO: 3468738 - DNA, 22 bp, Homo sapiens
atttgctggaacacaaagacca

SEQ ID NO: 3468739 - DNA, 11 bp, Homo sapiens
atttgcttttt

SEQ ID NO: 3468740 - DNA, 21 bp, Homo sapiens
atttggagtgttccccttcca

SEQ ID NO: 3468741 - DNA, 14 bp, Homo sapiens
atttgggaagtgaa

SEQ ID NO: 3468742 - DNA, 21 bp, Homo sapiens
atttggggtagctagaggaac

SEQ ID NO: 3468743 - DNA, 22 bp, Homo sapiens
atttggtttggccatctctgga

SEQ ID NO: 3468744 - DNA, 16 bp, Homo sapiens
atttgtacatatgtaa

SEQ ID NO: 3468745 - DNA, 18 bp, Homo sapiens
atttgtacatatgtaaaa

SEQ ID NO: 3468746 - DNA, 21 bp, Homo sapiens
atttgtactgtttaatgttct

SEQ ID NO: 3468747 - DNA, 17 bp, Homo sapiens
atttgtatttttttgca

SEQ ID NO: 3468748 - DNA, 21 bp, Homo sapiens
atttgtgctatagtatttgat

SEQ ID NO: 3468749 - DNA, 20 bp, Homo sapiens
atttgtggtgatatagaatt

SEQ ID NO: 3468750 - DNA, 13 bp, Homo sapiens
atttgttctctgt

SEQ ID NO: 3468751 - DNA, 14 bp, Homo sapiens
atttgtttttctct

SEQ ID NO: 3468752 - DNA, 21 bp, Homo sapiens
atttgtttttctcttttcaca

SEQ ID NO: 3468753 - DNA, 16 bp, Homo sapiens
attttaactctgtctt

SEQ ID NO: 3468754 - DNA, 19 bp, Homo sapiens
attttaagacgtgtttgtg

SEQ ID NO: 3468755 - DNA, 19 bp, Homo sapiens
attttaagtattgcatctg

SEQ ID NO: 3468756 - DNA, 20 bp, Homo sapiens
attttaatagggaatatatc

SEQ ID NO: 3468757 - DNA, 23 bp, Homo sapiens
attttaatgaagaaagtggaaaa

SEQ ID NO: 3468758 - DNA, 24 bp, Homo sapiens
attttaattcatcccaactgtctt

SEQ ID NO: 3468759 - DNA, 21 bp, Homo sapiens
attttaatttagtaaatgtta

SEQ ID NO: 3468760 - DNA, 14 bp, Homo sapiens
attttacagttaag

SEQ ID NO: 3468761 - DNA, 14 bp, Homo sapiens
attttacatttcta

SEQ ID NO: 3468762 - DNA, 22 bp, Homo sapiens
attttaccctgaggtcactgct

SEQ ID NO: 3468763 - DNA, 22 bp, Homo sapiens
attttacctgtttttgtttctt

SEQ ID NO: 3468764 - DNA, 23 bp, Homo sapiens
attttactagaaatgggaatcat

SEQ ID NO: 3468765 - DNA, 22 bp, Homo sapiens
attttactgttgtacaatcatg

SEQ ID NO: 3468766 - DNA, 12 bp, Homo sapiens
attttagttact

SEQ ID NO: 3468767 - DNA, 16 bp, Homo sapiens
attttatatgtcaaag

SEQ ID NO: 3468768 - DNA, 20 bp, Homo sapiens
attttatctttgattctcct

SEQ ID NO: 3468769 - DNA, 18 bp, Homo sapiens
attttatgatcagtgttg

SEQ ID NO: 3468770 - DNA, 16 bp, Homo sapiens
attttatggtgcatta

SEQ ID NO: 3468771 - DNA, 19 bp, Homo sapiens
attttcaaaagataatatt

SEQ ID NO: 3468772 - DNA, 24 bp, Homo sapiens
attttcaaaagataatattttaca

SEQ ID NO: 3468773 - DNA, 21 bp, Homo sapiens
attttcaaccataaaagaagt

SEQ ID NO: 3468774 - DNA, 22 bp, Homo sapiens
attttcaaggccttcagtttat

SEQ ID NO: 3468775 - DNA, 15 bp, Homo sapiens
attttcacattcttg

SEQ ID NO: 3468776 - DNA, 15 bp, Homo sapiens
attttcaccccaccc

SEQ ID NO: 3468777 - DNA, 16 bp, Homo sapiens
attttcaccctctgta

SEQ ID NO: 3468778 - DNA, 12 bp, Homo sapiens
attttcagagtg

SEQ ID NO: 3468779 - DNA, 12 bp, Homo sapiens
attttcagcatt

SEQ ID NO: 3468780 - DNA, 19 bp, Homo sapiens
attttcagcattaagctgt

SEQ ID NO: 3468781 - DNA, 22 bp, Homo sapiens
attttcagttattatatttaca

SEQ ID NO: 3468782 - DNA, 22 bp, Homo sapiens
attttccaaaagtggcctcttt

SEQ ID NO: 3468783 - DNA, 17 bp, Homo sapiens
attttccaaatgtaata

SEQ ID NO: 3468784 - DNA, 16 bp, Homo sapiens
attttccatatattgg

SEQ ID NO: 3468785 - DNA, 16 bp, Homo sapiens
attttcctgccaggca

SEQ ID NO: 3468786 - DNA, 18 bp, Homo sapiens
attttctagatacaataa

SEQ ID NO: 3468787 - DNA, 19 bp, Homo sapiens
attttctagatacaataaa

SEQ ID NO: 3468788 - DNA, 16 bp, Homo sapiens
attttctattttaaga

SEQ ID NO: 3468789 - DNA, 19 bp, Homo sapiens
attttcttattgcgctgct

SEQ ID NO: 3468790 - DNA, 11 bp, Homo sapiens
attttcttgaa

SEQ ID NO: 3468791 - DNA, 23 bp, Homo sapiens
attttctttttttattaaacaga

SEQ ID NO: 3468792 - DNA, 12 bp, Homo sapiens
attttgcactgt

SEQ ID NO: 3468793 - DNA, 17 bp, Homo sapiens
attttggaactatgaag

SEQ ID NO: 3468794 - DNA, 16 bp, Homo sapiens
attttggtgagaaatg

SEQ ID NO: 3468795 - DNA, 17 bp, Homo sapiens
attttggttttgttccc

SEQ ID NO: 3468796 - DNA, 23 bp, Homo sapiens
attttggttttgttcccctcctc

SEQ ID NO: 3468797 - DNA, 12 bp, Homo sapiens
attttgtaatga

SEQ ID NO: 3468798 - DNA, 14 bp, Homo sapiens
attttgtatctgca

SEQ ID NO: 3468799 - DNA, 12 bp, Homo sapiens
attttgtctaaa

SEQ ID NO: 3468800 - DNA, 21 bp, Homo sapiens
attttgtctaaaatgcctcag

SEQ ID NO: 3468801 - DNA, 21 bp, Homo sapiens
attttgttctctgggagaaaa

SEQ ID NO: 3468802 - DNA, 14 bp, Homo sapiens
attttgttcttatt

SEQ ID NO: 3468803 - DNA, 18 bp, Homo sapiens
attttgtttggtattgta

SEQ ID NO: 3468804 - DNA, 19 bp, Homo sapiens
attttgtttggtattgtat

SEQ ID NO: 3468805 - DNA, 20 bp, Homo sapiens
attttgtttggtattgtatt

SEQ ID NO: 3468806 - DNA, 22 bp, Homo sapiens
attttgtttggtattgtattta

SEQ ID NO: 3468807 - DNA, 21 bp, Homo sapiens
attttgtttttgtcttaaaaa

SEQ ID NO: 3468808 - DNA, 14 bp, Homo sapiens
atttttaaaaaata

SEQ ID NO: 3468809 - DNA, 20 bp, Homo sapiens
atttttaaaaaatattttct

SEQ ID NO: 3468810 - DNA, 23 bp, Homo sapiens
atttttaaaaaatattttctctg

SEQ ID NO: 3468811 - DNA, 21 bp, Homo sapiens
atttttaaaataaactgtaaa

SEQ ID NO: 3468812 - DNA, 14 bp, Homo sapiens
atttttaaagcatg

SEQ ID NO: 3468813 - DNA, 15 bp, Homo sapiens
atttttaaagcatgg

SEQ ID NO: 3468814 - DNA, 23 bp, Homo sapiens
atttttcaaagcaattgaaatgc

SEQ ID NO: 3468815 - DNA, 23 bp, Homo sapiens
atttttcaactttgaataaagaa

SEQ ID NO: 3468816 - DNA, 21 bp, Homo sapiens
atttttcaataaagcatttat

SEQ ID NO: 3468817 - DNA, 17 bp, Homo sapiens
atttttgcaataatgca

SEQ ID NO: 3468818 - DNA, 20 bp, Homo sapiens
atttttgcaataatgcagta

SEQ ID NO: 3468819 - DNA, 17 bp, Homo sapiens
atttttgtaataacatt

SEQ ID NO: 3468820 - DNA, 19 bp, Homo sapiens
atttttgtaataacattta

SEQ ID NO: 3468821 - DNA, 12 bp, Homo sapiens
atttttgtacat

SEQ ID NO: 3468822 - DNA, 22 bp, Homo sapiens
attttttaaaacaagccaagaa

SEQ ID NO: 3468823 - DNA, 23 bp, Homo sapiens
attttttaaaacaagccaagaaa

SEQ ID NO: 3468824 - DNA, 11 bp, Homo sapiens
attttttcctt

SEQ ID NO: 3468825 - DNA, 23 bp, Homo sapiens
attttttgtttgtattgtaaaaa

SEQ ID NO: 3468826 - DNA, 17 bp, Homo sapiens
atttttttagaaagcat

SEQ ID NO: 3468827 - DNA, 23 bp, Homo sapiens
atttttttagaaagcatttgaat

SEQ ID NO: 3468828 - DNA, 15 bp, Homo sapiens
atttttttcaatatt

SEQ ID NO: 3468829 - DNA, 22 bp, Homo sapiens
atttttttggtacctatttgac

SEQ ID NO: 3468830 - DNA, 16 bp, Homo sapiens
attttttttaatgctt

SEQ ID NO: 3468831 - DNA, 16 bp, Homo sapiens
attttttttcatgttt

SEQ ID NO: 3468832 - DNA, 15 bp, Homo sapiens
caaaaaaaagtctat

SEQ ID NO: 3468833 - DNA, 21 bp, Homo sapiens
caaaaaaatctgcagaaggaa

SEQ ID NO: 3468834 - DNA, 18 bp, Homo sapiens
caaaaaagtccaatttta

SEQ ID NO: 3468835 - DNA, 19 bp, Homo sapiens
caaaaaatactttttctaa

SEQ ID NO: 3468836 - DNA, 15 bp, Homo sapiens
caaaaaatgtgctgt

SEQ ID NO: 3468837 - DNA, 15 bp, Homo sapiens
caaaaaatgttttaa

SEQ ID NO: 3468838 - DNA, 19 bp, Homo sapiens
caaaaacaaaaccagctgc

SEQ ID NO: 3468839 - DNA, 20 bp, Homo sapiens
caaaaacaaaaccagctgct

SEQ ID NO: 3468840 - DNA, 13 bp, Homo sapiens
caaaaagaacaaa

SEQ ID NO: 3468841 - DNA, 19 bp, Homo sapiens
caaaaagaacaaaaaaatc

SEQ ID NO: 3468842 - DNA, 21 bp, Homo sapiens
caaaaagaacaaaaaaatctg

SEQ ID NO: 3468843 - DNA, 12 bp, Homo sapiens
caaaaagcacat

SEQ ID NO: 3468844 - DNA, 17 bp, Homo sapiens
caaaaaggatacataat

SEQ ID NO: 3468845 - DNA, 13 bp, Homo sapiens
caaaaaggttgct

SEQ ID NO: 3468846 - DNA, 14 bp, Homo sapiens
caaaaatatttata

SEQ ID NO: 3468847 - DNA, 16 bp, Homo sapiens
caaaaatctgcctggg

SEQ ID NO: 3468848 - DNA, 17 bp, Homo sapiens
caaaaattagccgggca

SEQ ID NO: 3468849 - DNA, 11 bp, Homo sapiens
caaaaattagg

SEQ ID NO: 3468850 - DNA, 16 bp, Homo sapiens
caaaaattaggtattt

SEQ ID NO: 3468851 - DNA, 17 bp, Homo sapiens
caaaacaaaaattaggt

SEQ ID NO: 3468852 - DNA, 18 bp, Homo sapiens
caaaacaaaaattaggta

SEQ ID NO: 3468853 - DNA, 23 bp, Homo sapiens
caaaacaaaaattaggtattttg

SEQ ID NO: 3468854 - DNA, 15 bp, Homo sapiens
caaaacaacattttg

SEQ ID NO: 3468855 - DNA, 15 bp, Homo sapiens
caaaacccagacctg

SEQ ID NO: 3468856 - DNA, 22 bp, Homo sapiens
caaaacctcatgacagccagag

SEQ ID NO: 3468857 - DNA, 15 bp, Homo sapiens
caaaacggttttact

SEQ ID NO: 3468858 - DNA, 21 bp, Homo sapiens
caaaacggttttactgcagct

SEQ ID NO: 3468859 - DNA, 16 bp, Homo sapiens
caaaactcctgtcttt

SEQ ID NO: 3468860 - DNA, 12 bp, Homo sapiens
caaaagaactta

SEQ ID NO: 3468861 - DNA, 17 bp, Homo sapiens
caaaagaagcccccagc

SEQ ID NO: 3468862 - DNA, 14 bp, Homo sapiens
caaaagacactgca

SEQ ID NO: 3468863 - DNA, 20 bp, Homo sapiens
caaaagataatattttacat

SEQ ID NO: 3468864 - DNA, 15 bp, Homo sapiens
caaaagctgggcagg

SEQ ID NO: 3468865 - DNA, 19 bp, Homo sapiens
caaaaggatctttgtggcc

SEQ ID NO: 3468866 - DNA, 24 bp, Homo sapiens
caaaaggatctttgtggccaagga

SEQ ID NO: 3468867 - DNA, 17 bp, Homo sapiens
caaaagtggcctctttg

SEQ ID NO: 3468868 - DNA, 15 bp, Homo sapiens
caaaataaaaaccaa

SEQ ID NO: 3468869 - DNA, 13 bp, Homo sapiens
caaaataaaacaa

SEQ ID NO: 3468870 - DNA, 20 bp, Homo sapiens
caaaataaaaggactctgga

SEQ ID NO: 3468871 - DNA, 15 bp, Homo sapiens
caaaatactccaaag

SEQ ID NO: 3468872 - DNA, 13 bp, Homo sapiens
caaaatatttaaa

SEQ ID NO: 3468873 - DNA, 19 bp, Homo sapiens
caaaatcattttatatgtc

SEQ ID NO: 3468874 - DNA, 22 bp, Homo sapiens
caaaatcattttatatgtcaaa

SEQ ID NO: 3468875 - DNA, 23 bp, Homo sapiens
caaaatcattttatatgtcaaag

SEQ ID NO: 3468876 - DNA, 17 bp, Homo sapiens
caaaatgaggaatgtat

SEQ ID NO: 3468877 - DNA, 19 bp, Homo sapiens
caaaatgaggaatgtatat

SEQ ID NO: 3468878 - DNA, 18 bp, Homo sapiens
caaaatgctttttatttc

SEQ ID NO: 3468879 - DNA, 20 bp, Homo sapiens
caaaatgctttttatttctg

SEQ ID NO: 3468880 - DNA, 19 bp, Homo sapiens
caaaatggatacataaaga

SEQ ID NO: 3468881 - DNA, 16 bp, Homo sapiens
caaaatgtgtatttct

SEQ ID NO: 3468882 - DNA, 20 bp, Homo sapiens
caaaatgtgtatttcttata

SEQ ID NO: 3468883 - DNA, 15 bp, Homo sapiens
caaaattcatttcta

SEQ ID NO: 3468884 - DNA, 19 bp, Homo sapiens
caaaattcatttctaatta

SEQ ID NO: 3468885 - DNA, 17 bp, Homo sapiens
caaaattgcaaatcttg

SEQ ID NO: 3468886 - DNA, 19 bp, Homo sapiens
caaaatttattttataaga

SEQ ID NO: 3468887 - DNA, 14 bp, Homo sapiens
caaaatttctatta

SEQ ID NO: 3468888 - DNA, 22 bp, Homo sapiens
caaaatttgctgccaaatgcgt

SEQ ID NO: 3468889 - DNA, 21 bp, Homo sapiens
caaaattttgtcccatctcta

SEQ ID NO: 3468890 - DNA, 24 bp, Homo sapiens
caaacaatagtaattctcaggcca

SEQ ID NO: 3468891 - DNA, 18 bp, Homo sapiens
caaacatcctatcaacaa

SEQ ID NO: 3468892 - DNA, 21 bp, Homo sapiens
caaaccatttttaaagtagaa

SEQ ID NO: 3468893 - DNA, 22 bp, Homo sapiens
caaacccaaaaaagaacaagct

SEQ ID NO: 3468894 - DNA, 20 bp, Homo sapiens
caaacccagacggctccact

SEQ ID NO: 3468895 - DNA, 24 bp, Homo sapiens
caaacccagacggctccactagga

SEQ ID NO: 3468896 - DNA, 21 bp, Homo sapiens
caaacccatggctctatttct

SEQ ID NO: 3468897 - DNA, 14 bp, Homo sapiens
caaacctctgttca

SEQ ID NO: 3468898 - DNA, 20 bp, Homo sapiens
caaacctctgttcagtgtaa

SEQ ID NO: 3468899 - DNA, 14 bp, Homo sapiens
caaacctgcctggg

SEQ ID NO: 3468900 - DNA, 15 bp, Homo sapiens
caaacctgcctgggt

SEQ ID NO: 3468901 - DNA, 15 bp, Homo sapiens
caaaccttatctcca

SEQ ID NO: 3468902 - DNA, 21 bp, Homo sapiens
caaaccttatctccacaacct

SEQ ID NO: 3468903 - DNA, 23 bp, Homo sapiens
caaacgccctttcctcctcaggc

SEQ ID NO: 3468904 - DNA, 14 bp, Homo sapiens
caaacgcctcccct

SEQ ID NO: 3468905 - DNA, 17 bp, Homo sapiens
caaacgctgcctgccca

SEQ ID NO: 3468906 - DNA, 16 bp, Homo sapiens
caaacgggagcttttg

SEQ ID NO: 3468907 - DNA, 20 bp, Homo sapiens
caaactaaggtgctaaatct

SEQ ID NO: 3468908 - DNA, 21 bp, Homo sapiens
caaactcttgacctcaggtga

SEQ ID NO: 3468909 - DNA, 23 bp, Homo sapiens
caaactgaagcagcctctcccca

SEQ ID NO: 3468910 - DNA, 13 bp, Homo sapiens
caaactgctccaa

SEQ ID NO: 3468911 - DNA, 21 bp, Homo sapiens
caaactggtattctgttctgg

SEQ ID NO: 3468912 - DNA, 15 bp, Homo sapiens
caaactgtgcttctc

SEQ ID NO: 3468913 - DNA, 20 bp, Homo sapiens
caaactgtgcttctctatga

SEQ ID NO: 3468914 - DNA, 22 bp, Homo sapiens
caaactttattgacaagtgatt

SEQ ID NO: 3468915 - DNA, 18 bp, Homo sapiens
caaacttttatactcttt

SEQ ID NO: 3468916 - DNA, 21 bp, Homo sapiens
caaagaaaagtattgtttgga

SEQ ID NO: 3468917 - DNA, 17 bp, Homo sapiens
caaagaaaattcctata

SEQ ID NO: 3468918 - DNA, 18 bp, Homo sapiens
caaagaaccttctctatg

SEQ ID NO: 3468919 - DNA, 20 bp, Homo sapiens
caaagaatccctagacttta

SEQ ID NO: 3468920 - DNA, 17 bp, Homo sapiens
caaagaattccaaagca

SEQ ID NO: 3468921 - DNA, 18 bp, Homo sapiens
caaagaattccaaagcaa

SEQ ID NO: 3468922 - DNA, 20 bp, Homo sapiens
caaagacaaattctgtttct

SEQ ID NO: 3468923 - DNA, 16 bp, Homo sapiens
caaagagcctttccaa

SEQ ID NO: 3468924 - DNA, 19 bp, Homo sapiens
caaagagcctttccaaaga

SEQ ID NO: 3468925 - DNA, 13 bp, Homo sapiens
caaagaggcaaga

SEQ ID NO: 3468926 - DNA, 14 bp, Homo sapiens
caaagaggttttaa

SEQ ID NO: 3468927 - DNA, 14 bp, Homo sapiens
caaagagtagaatt

SEQ ID NO: 3468928 - DNA, 21 bp, Homo sapiens
caaagatctgtcctcagcctt

SEQ ID NO: 3468929 - DNA, 13 bp, Homo sapiens
caaagatgaccat

SEQ ID NO: 3468930 - DNA, 11 bp, Homo sapiens
caaagatgact

SEQ ID NO: 3468931 - DNA, 15 bp, Homo sapiens
caaagcaaggaaact

SEQ ID NO: 3468932 - DNA, 12 bp, Homo sapiens
caaagcagacag

SEQ ID NO: 3468933 - DNA, 19 bp, Homo sapiens
caaagcagacagctccacc

SEQ ID NO: 3468934 - DNA, 18 bp, Homo sapiens
caaagcaggggagtatgc

SEQ ID NO: 3468935 - DNA, 15 bp, Homo sapiens
caaagcagggtctgg

SEQ ID NO: 3468936 - DNA, 20 bp, Homo sapiens
caaagccaaagctaggcctg

SEQ ID NO: 3468937 - DNA, 12 bp, Homo sapiens
caaagccaaggc

SEQ ID NO: 3468938 - DNA, 21 bp, Homo sapiens
caaagccagcgtcctcctctg

SEQ ID NO: 3468939 - DNA, 23 bp, Homo sapiens
caaagccagcgtcctcctctgtg

SEQ ID NO: 3468940 - DNA, 14 bp, Homo sapiens
caaagcccaaggga

SEQ ID NO: 3468941 - DNA, 17 bp, Homo sapiens
caaagcctcctccagcc

SEQ ID NO: 3468942 - DNA, 15 bp, Homo sapiens
caaagctaggcctgg

SEQ ID NO: 3468943 - DNA, 16 bp, Homo sapiens
caaagcttttagaaat

SEQ ID NO: 3468944 - DNA, 13 bp, Homo sapiens
caaaggatactgt

SEQ ID NO: 3468945 - DNA, 19 bp, Homo sapiens
caaaggattaattgctgca

SEQ ID NO: 3468946 - DNA, 21 bp, Homo sapiens
caaaggccatggagagctgga

SEQ ID NO: 3468947 - DNA, 23 bp, Homo sapiens
caaaggccatggagagctggagc

SEQ ID NO: 3468948 - DNA, 13 bp, Homo sapiens
caaaggctgggac

SEQ ID NO: 3468949 - DNA, 15 bp, Homo sapiens
caaagggaaatatca

SEQ ID NO: 3468950 - DNA, 18 bp, Homo sapiens
caaagggaaatatcattt

SEQ ID NO: 3468951 - DNA, 21 bp, Homo sapiens
caaagggcacagcatctgtag

SEQ ID NO: 3468952 - DNA, 22 bp, Homo sapiens
caaagggcatgggtcgggagag

SEQ ID NO: 3468953 - DNA, 23 bp, Homo sapiens
caaagggcatgggtcgggagagg

SEQ ID NO: 3468954 - DNA, 18 bp, Homo sapiens
caaaggggacagctgtgt

SEQ ID NO: 3468955 - DNA, 16 bp, Homo sapiens
caaagggtatcaggtg

SEQ ID NO: 3468956 - DNA, 14 bp, Homo sapiens
caaagtaaaagaaa

SEQ ID NO: 3468957 - DNA, 22 bp, Homo sapiens
atatgtgtttttcacatttgcg

SEQ ID NO: 3468958 - DNA, 17 bp, Homo sapiens
atatgttgaatactttt

SEQ ID NO: 3468959 - DNA, 18 bp, Homo sapiens
atatgttgctataataaa

SEQ ID NO: 3468960 - DNA, 18 bp, Homo sapiens
atatgttttaagaggcag

SEQ ID NO: 3468961 - DNA, 15 bp, Homo sapiens
atatgttttatttca

SEQ ID NO: 3468962 - DNA, 21 bp, Homo sapiens
atatgttttgtgggaacagat

SEQ ID NO: 3468963 - DNA, 20 bp, Homo sapiens
atatgtttttatttaaaaga

SEQ ID NO: 3468964 - DNA, 16 bp, Homo sapiens
atattaaaaatataaa

SEQ ID NO: 3468965 - DNA, 12 bp, Homo sapiens
atattaaatctg

SEQ ID NO: 3468966 - DNA, 20 bp, Homo sapiens
atattagctttactgtttgt

SEQ ID NO: 3468967 - DNA, 19 bp, Homo sapiens
atattatcatgcaaatgct

SEQ ID NO: 3468968 - DNA, 21 bp, Homo sapiens
atattatcatgcaaatgctgt

SEQ ID NO: 3468969 - DNA, 16 bp, Homo sapiens
atattatgagatgctg

SEQ ID NO: 3468970 - DNA, 16 bp, Homo sapiens
atattatgtataaaat

SEQ ID NO: 3468971 - DNA, 18 bp, Homo sapiens
atattattctcatttagt

SEQ ID NO: 3468972 - DNA, 16 bp, Homo sapiens
atattcagacaaaatg

SEQ ID NO: 3468973 - DNA, 14 bp, Homo sapiens
atattccaaaataa

SEQ ID NO: 3468974 - DNA, 17 bp, Homo sapiens
atattccctagaaactt

SEQ ID NO: 3468975 - DNA, 16 bp, Homo sapiens
atattctaaaaccatt

SEQ ID NO: 3468976 - DNA, 21 bp, Homo sapiens
atattctagtgtaacactgca

SEQ ID NO: 3468977 - DNA, 21 bp, Homo sapiens
atattctgctctattatataa

SEQ ID NO: 3468978 - DNA, 18 bp, Homo sapiens
atattgaatataatatat

SEQ ID NO: 3468979 - DNA, 13 bp, Homo sapiens
atattgaattttt

SEQ ID NO: 3468980 - DNA, 18 bp, Homo sapiens
atattgacaagtgtcttt

SEQ ID NO: 3468981 - DNA, 19 bp, Homo sapiens
atattgacaagtgtctttt

SEQ ID NO: 3468982 - DNA, 17 bp, Homo sapiens
atattgagtcaaatggt

SEQ ID NO: 3468983 - DNA, 21 bp, Homo sapiens
atattgcacaactctactgtt

SEQ ID NO: 3468984 - DNA, 21 bp, Homo sapiens
atattgcacatgtcttaatga

SEQ ID NO: 3468985 - DNA, 16 bp, Homo sapiens
atattgcatttctgta

SEQ ID NO: 3468986 - DNA, 17 bp, Homo sapiens
atattgcttcttctcct

SEQ ID NO: 3468987 - DNA, 18 bp, Homo sapiens
atattggtgtactgtaat

SEQ ID NO: 3468988 - DNA, 13 bp, Homo sapiens
atattgtgtttgt

SEQ ID NO: 3468989 - DNA, 21 bp, Homo sapiens
atattgtgtttgtgtatttac

SEQ ID NO: 3468990 - DNA, 12 bp, Homo sapiens
atattgttttct

SEQ ID NO: 3468991 - DNA, 20 bp, Homo sapiens
atattgttttctcctttctg

SEQ ID NO: 3468992 - DNA, 15 bp, Homo sapiens
atatttaaaaatgtc

SEQ ID NO: 3468993 - DNA, 18 bp, Homo sapiens
atatttaaaaatgtcttg

SEQ ID NO: 3468994 - DNA, 13 bp, Homo sapiens
atatttaactggt

SEQ ID NO: 3468995 - DNA, 18 bp, Homo sapiens
atatttaagcaacatctt

SEQ ID NO: 3468996 - DNA, 13 bp, Homo sapiens
atatttaatgttt

SEQ ID NO: 3468997 - DNA, 19 bp, Homo sapiens
atatttagattgttaaaat

SEQ ID NO: 3468998 - DNA, 17 bp, Homo sapiens
atatttagtattgaata

SEQ ID NO: 3468999 - DNA, 12 bp, Homo sapiens
atatttatccaa

SEQ ID NO: 3469000 - DNA, 14 bp, Homo sapiens
atatttattacctc

SEQ ID NO: 3469001 - DNA, 16 bp, Homo sapiens
atatttattcattatt

SEQ ID NO: 3469002 - DNA, 23 bp, Homo sapiens
atatttattcattatttgtcaaa

SEQ ID NO: 3469003 - DNA, 16 bp, Homo sapiens
atatttgaatcttgtc

SEQ ID NO: 3469004 - DNA, 21 bp, Homo sapiens
atatttgaatcttgtctcaat

SEQ ID NO: 3469005 - DNA, 18 bp, Homo sapiens
atatttgtactgtttaat

SEQ ID NO: 3469006 - DNA, 17 bp, Homo sapiens
atatttgtgctatagta

SEQ ID NO: 3469007 - DNA, 22 bp, Homo sapiens
atatttgtgctatagtatttga

SEQ ID NO: 3469008 - DNA, 17 bp, Homo sapiens
atatttgtgtatttaac

SEQ ID NO: 3469009 - DNA, 14 bp, Homo sapiens
atattttatctcaa

SEQ ID NO: 3469010 - DNA, 15 bp, Homo sapiens
atattttatttttca

SEQ ID NO: 3469011 - DNA, 12 bp, Homo sapiens
atattttccata

SEQ ID NO: 3469012 - DNA, 13 bp, Homo sapiens
atattttccatat

SEQ ID NO: 3469013 - DNA, 16 bp, Homo sapiens
atattttccatatatt

SEQ ID NO: 3469014 - DNA, 14 bp, Homo sapiens
atattttctatttt

SEQ ID NO: 3469015 - DNA, 18 bp, Homo sapiens
atattttctttaatgctt

SEQ ID NO: 3469016 - DNA, 21 bp, Homo sapiens
atattttgtcatatcaaataa

SEQ ID NO: 3469017 - DNA, 13 bp, Homo sapiens
atatttttagata

SEQ ID NO: 3469018 - DNA, 13 bp, Homo sapiens
atatttttataga

SEQ ID NO: 3469019 - DNA, 13 bp, Homo sapiens
atcaaaatgcttt

SEQ ID NO: 3469020 - DNA, 18 bp, Homo sapiens
atcaaacatgggtttagt

SEQ ID NO: 3469021 - DNA, 19 bp, Homo sapiens
atcaaagaggttttaaaaa

SEQ ID NO: 3469022 - DNA, 14 bp, Homo sapiens
atcaaagccacact

SEQ ID NO: 3469023 - DNA, 16 bp, Homo sapiens
atcaaagccacactct

SEQ ID NO: 3469024 - DNA, 23 bp, Homo sapiens
atcaaagttctgctttctcccca

SEQ ID NO: 3469025 - DNA, 23 bp, Homo sapiens
atcaacaatagtaactctttctt

SEQ ID NO: 3469026 - DNA, 16 bp, Homo sapiens
atcaactttttattgc

SEQ ID NO: 3469027 - DNA, 20 bp, Homo sapiens
atcaactttttattgccttc

SEQ ID NO: 3469028 - DNA, 22 bp, Homo sapiens
atcaactttttattgccttctc

SEQ ID NO: 3469029 - DNA, 13 bp, Homo sapiens
atcaagaagggct

SEQ ID NO: 3469030 - DNA, 19 bp, Homo sapiens
atcaagaagggctgcatga

SEQ ID NO: 3469031 - DNA, 22 bp, Homo sapiens
atcaagaagggctgcatgatgt

SEQ ID NO: 3469032 - DNA, 15 bp, Homo sapiens
atcaaggagcccaga

SEQ ID NO: 3469033 - DNA, 23 bp, Homo sapiens
atcaagtctgtttactgcaaggt

SEQ ID NO: 3469034 - DNA, 22 bp, Homo sapiens
atcacaacgtgcattgtgcttc

SEQ ID NO: 3469035 - DNA, 14 bp, Homo sapiens
atcacagcagcttc

SEQ ID NO: 3469036 - DNA, 15 bp, Homo sapiens
atcacatattctagt

SEQ ID NO: 3469037 - DNA, 22 bp, Homo sapiens
atcaccgtgggctccctgactg

SEQ ID NO: 3469038 - DNA, 15 bp, Homo sapiens
atcacctcattctga

SEQ ID NO: 3469039 - DNA, 17 bp, Homo sapiens
atcaccttaggcaggga

SEQ ID NO: 3469040 - DNA, 17 bp, Homo sapiens
atcacgccactgcacta

SEQ ID NO: 3469041 - DNA, 15 bp, Homo sapiens
atcacggctcactgc

SEQ ID NO: 3469042 - DNA, 19 bp, Homo sapiens
atcacggctcactgcagcc

SEQ ID NO: 3469043 - DNA, 15 bp, Homo sapiens
atcactgagttttcc

SEQ ID NO: 3469044 - DNA, 18 bp, Homo sapiens
atcactgagttttccatg

SEQ ID NO: 3469045 - DNA, 14 bp, Homo sapiens
atcactgtctttcc

SEQ ID NO: 3469046 - DNA, 15 bp, Homo sapiens
atcactgtctttcct

SEQ ID NO: 3469047 - DNA, 19 bp, Homo sapiens
atcactgtctttcctagat

SEQ ID NO: 3469048 - DNA, 13 bp, Homo sapiens
atcacttgaaccc

SEQ ID NO: 3469049 - DNA, 14 bp, Homo sapiens
atcagaaatacaga

SEQ ID NO: 3469050 - DNA, 23 bp, Homo sapiens
atcagaactcaaatggggccaga

SEQ ID NO: 3469051 - DNA, 22 bp, Homo sapiens
atcagaatagccacatttggaa

SEQ ID NO: 3469052 - DNA, 22 bp, Homo sapiens
atcagatcatttcaaaactcat

SEQ ID NO: 3469053 - DNA, 21 bp, Homo sapiens
atcagatctggggcagcaccc

SEQ ID NO: 3469054 - DNA, 14 bp, Homo sapiens
atcagatctgtctt

SEQ ID NO: 3469055 - DNA, 21 bp, Homo sapiens
atcagatgttttggtcaagta

SEQ ID NO: 3469056 - DNA, 14 bp, Homo sapiens
atcagattgcatgt

SEQ ID NO: 3469057 - DNA, 15 bp, Homo sapiens
atcagattgcatgtg

SEQ ID NO: 3469058 - DNA, 18 bp, Homo sapiens
atcagattgcatgtgact

SEQ ID NO: 3469059 - DNA, 17 bp, Homo sapiens
atcagattttaacagct

SEQ ID NO: 3469060 - DNA, 13 bp, Homo sapiens
atcagcaaaaaag

SEQ ID NO: 3469061 - DNA, 12 bp, Homo sapiens
atcagccaatta

SEQ ID NO: 3469062 - DNA, 20 bp, Homo sapiens
atcagcctgctccagctgtt

SEQ ID NO: 3469063 - DNA, 15 bp, Homo sapiens
atcagctatttactg

SEQ ID NO: 3469064 - DNA, 17 bp, Homo sapiens
atcagctccttcctgga

SEQ ID NO: 3469065 - DNA, 16 bp, Homo sapiens
atcaggacccagagga

SEQ ID NO: 3469066 - DNA, 20 bp, Homo sapiens
atcaggacccagaggaaggg

SEQ ID NO: 3469067 - DNA, 22 bp, Homo sapiens
atcaggagactgggctctggct

SEQ ID NO: 3469068 - DNA, 19 bp, Homo sapiens
atcagggcattgcctgtga

SEQ ID NO: 3469069 - DNA, 14 bp, Homo sapiens
atcaggtgctgcca

SEQ ID NO: 3469070 - DNA, 17 bp, Homo sapiens
atcaggtgctgccatcc

SEQ ID NO: 3469071 - DNA, 13 bp, Homo sapiens
atcaggtggggag

SEQ ID NO: 3469072 - DNA, 13 bp, Homo sapiens
atcagtcaagctg

SEQ ID NO: 3469073 - DNA, 13 bp, Homo sapiens
atcagtcaatatt

SEQ ID NO: 3469074 - DNA, 21 bp, Homo sapiens
atcagtcctctttcaaaggta

SEQ ID NO: 3469075 - DNA, 15 bp, Homo sapiens
atcagtgctccctca

SEQ ID NO: 3469076 - DNA, 23 bp, Homo sapiens
atcagtgtagttaaggagcctaa

SEQ ID NO: 3469077 - DNA, 13 bp, Homo sapiens
atcagtgtttgtt

SEQ ID NO: 3469078 - DNA, 15 bp, Homo sapiens
atcagtgtttgttgg

SEQ ID NO: 3469079 - DNA, 14 bp, Homo sapiens
atcataattaccaa

SEQ ID NO: 3469080 - DNA, 23 bp, Homo sapiens
atcatagtggcttaaaacaacac

SEQ ID NO: 3469081 - DNA, 12 bp, Homo sapiens
atcatcaagaag

SEQ ID NO: 3469082 - DNA, 16 bp, Homo sapiens
atcatcaagaagggct

SEQ ID NO: 3469083 - DNA, 21 bp, Homo sapiens
atcatcaagaagggctgcatg

SEQ ID NO: 3469084 - DNA, 22 bp, Homo sapiens
atcatcaagaagggctgcatga

SEQ ID NO: 3469085 - DNA, 12 bp, Homo sapiens
atcatcctactg

SEQ ID NO: 3469086 - DNA, 24 bp, Homo sapiens
atcatcggagtcagccaggagctg

SEQ ID NO: 3469087 - DNA, 23 bp, Homo sapiens
atcatctgaaggggcaaattctt

SEQ ID NO: 3469088 - DNA, 13 bp, Homo sapiens
atcatctgccgtg

SEQ ID NO: 3469089 - DNA, 16 bp, Homo sapiens
atcatgagcctgctgg

SEQ ID NO: 3469090 - DNA, 16 bp, Homo sapiens
atcatgttgatcatgt

SEQ ID NO: 3469091 - DNA, 17 bp, Homo sapiens
atcatgttttggtgaaa

SEQ ID NO: 3469092 - DNA, 13 bp, Homo sapiens
atcattccctctc

SEQ ID NO: 3469093 - DNA, 22 bp, Homo sapiens
atcattccctctcatctcaggt

SEQ ID NO: 3469094 - DNA, 17 bp, Homo sapiens
ataaacatcacacacac

SEQ ID NO: 3469095 - DNA, 13 bp, Homo sapiens
ataaactgtaaac

SEQ ID NO: 3469096 - DNA, 15 bp, Homo sapiens
ataaactgtaaacta

SEQ ID NO: 3469097 - DNA, 13 bp, Homo sapiens
ataaagaatactt

SEQ ID NO: 3469098 - DNA, 14 bp, Homo sapiens
ataaagatgattga

SEQ ID NO: 3469099 - DNA, 15 bp, Homo sapiens
ataaagctaccattt

SEQ ID NO: 3469100 - DNA, 13 bp, Homo sapiens
ataaaggatgtga

SEQ ID NO: 3469101 - DNA, 14 bp, Homo sapiens
ataaaggatgtgat

SEQ ID NO: 3469102 - DNA, 21 bp, Homo sapiens
ataaaggatgtgattgtggaa

SEQ ID NO: 3469103 - DNA, 14 bp, Homo sapiens
ataaagtatttaat

SEQ ID NO: 3469104 - DNA, 13 bp, Homo sapiens
ataaagtgattga

SEQ ID NO: 3469105 - DNA, 12 bp, Homo sapiens
ataaagtttgct

SEQ ID NO: 3469106 - DNA, 13 bp, Homo sapiens
ataaataaaaata

SEQ ID NO: 3469107 - DNA, 14 bp, Homo sapiens
ataaataaaaataa

SEQ ID NO: 3469108 - DNA, 20 bp, Homo sapiens
ataaataaaatcatgtagtt

SEQ ID NO: 3469109 - DNA, 15 bp, Homo sapiens
ataaatatatataaa

SEQ ID NO: 3469110 - DNA, 15 bp, Homo sapiens
ataaatcagtcaagc

SEQ ID NO: 3469111 - DNA, 15 bp, Homo sapiens
ataaatctgacccag

SEQ ID NO: 3469112 - DNA, 22 bp, Homo sapiens
ataaatgtaatagccaaaccca

SEQ ID NO: 3469113 - DNA, 13 bp, Homo sapiens
ataaattataagt

SEQ ID NO: 3469114 - DNA, 13 bp, Homo sapiens
ataaattcctctt

SEQ ID NO: 3469115 - DNA, 13 bp, Homo sapiens
ataaattctgatt

SEQ ID NO: 3469116 - DNA, 14 bp, Homo sapiens
ataaattctgattc

SEQ ID NO: 3469117 - DNA, 12 bp, Homo sapiens
ataaattgccat

SEQ ID NO: 3469118 - DNA, 14 bp, Homo sapiens
ataaattgccataa

SEQ ID NO: 3469119 - DNA, 17 bp, Homo sapiens
ataaattgccataatat

SEQ ID NO: 3469120 - DNA, 20 bp, Homo sapiens
ataaattgccataatatgat

SEQ ID NO: 3469121 - DNA, 13 bp, Homo sapiens
ataaattgtatat

SEQ ID NO: 3469122 - DNA, 14 bp, Homo sapiens
ataaattgtatatt

SEQ ID NO: 3469123 - DNA, 18 bp, Homo sapiens
ataaattgtatattcact

SEQ ID NO: 3469124 - DNA, 14 bp, Homo sapiens
ataacaattcctct

SEQ ID NO: 3469125 - DNA, 13 bp, Homo sapiens
ataacacctgcca

SEQ ID NO: 3469126 - DNA, 14 bp, Homo sapiens
ataacagagagaat

SEQ ID NO: 3469127 - DNA, 21 bp, Homo sapiens
ataacatttaatttagatatt

SEQ ID NO: 3469128 - DNA, 14 bp, Homo sapiens
ataaccactgaagg

SEQ ID NO: 3469129 - DNA, 16 bp, Homo sapiens
ataactaagcatcctt

SEQ ID NO: 3469130 - DNA, 19 bp, Homo sapiens
ataactactccggagacag

SEQ ID NO: 3469131 - DNA, 20 bp, Homo sapiens
ataactactccggagacagg

SEQ ID NO: 3469132 - DNA, 22 bp, Homo sapiens
ataactctgtggcattattgca

SEQ ID NO: 3469133 - DNA, 12 bp, Homo sapiens
ataactgaggag

SEQ ID NO: 3469134 - DNA, 11 bp, Homo sapiens
ataagaaaaac

SEQ ID NO: 3469135 - DNA, 15 bp, Homo sapiens
ataagaaaaactttt

SEQ ID NO: 3469136 - DNA, 23 bp, Homo sapiens
ataagaaaaccaccccttagatt

SEQ ID NO: 3469137 - DNA, 13 bp, Homo sapiens
ataagaaagacat

SEQ ID NO: 3469138 - DNA, 15 bp, Homo sapiens
ataagaataaaatgt

SEQ ID NO: 3469139 - DNA, 16 bp, Homo sapiens
ataagagacagacact

SEQ ID NO: 3469140 - DNA, 17 bp, Homo sapiens
ataagagggcacacact

SEQ ID NO: 3469141 - DNA, 12 bp, Homo sapiens
ataagattccaa

SEQ ID NO: 3469142 - DNA, 19 bp, Homo sapiens
ataagattccaaaaagcac

SEQ ID NO: 3469143 - DNA, 22 bp, Homo sapiens
ataaggaaatcaacttgcttat

SEQ ID NO: 3469144 - DNA, 10 bp, Homo sapiens
ataaggaatt

SEQ ID NO: 3469145 - DNA, 17 bp, Homo sapiens
ataaggaattatagacc

SEQ ID NO: 3469146 - DNA, 19 bp, Homo sapiens
ataaggacatgatgctttt

SEQ ID NO: 3469147 - DNA, 15 bp, Homo sapiens
ataagggcagagtca

SEQ ID NO: 3469148 - DNA, 14 bp, Homo sapiens
ataagtaagaaaat

SEQ ID NO: 3469149 - DNA, 15 bp, Homo sapiens
ataagtaagaaaata

SEQ ID NO: 3469150 - DNA, 17 bp, Homo sapiens
ataagtacctcagcatt

SEQ ID NO: 3469151 - DNA, 19 bp, Homo sapiens
ataagtatttcaaattgga

SEQ ID NO: 3469152 - DNA, 13 bp, Homo sapiens
ataagtgctgtat

SEQ ID NO: 3469153 - DNA, 15 bp, Homo sapiens
ataagtgctgtataa

SEQ ID NO: 3469154 - DNA, 18 bp, Homo sapiens
ataagtggaggcacttta

SEQ ID NO: 3469155 - DNA, 17 bp, Homo sapiens
ataagtggtgcttagaa

SEQ ID NO: 3469156 - DNA, 16 bp, Homo sapiens
ataagtgtatttttca

SEQ ID NO: 3469157 - DNA, 20 bp, Homo sapiens
ataagttatttttgtacatg

SEQ ID NO: 3469158 - DNA, 21 bp, Homo sapiens
ataagttgagaaggtgcctgc

SEQ ID NO: 3469159 - DNA, 12 bp, Homo sapiens
ataataaaggaa

SEQ ID NO: 3469160 - DNA, 21 bp, Homo sapiens
ataatactgctgagatacata

SEQ ID NO: 3469161 - DNA, 23 bp, Homo sapiens
ataatatattctatttttatact

SEQ ID NO: 3469162 - DNA, 19 bp, Homo sapiens
ataatatctaaagttatat

SEQ ID NO: 3469163 - DNA, 18 bp, Homo sapiens
ataatcctaaacatatga

SEQ ID NO: 3469164 - DNA, 15 bp, Homo sapiens
ataatcttattaggg

SEQ ID NO: 3469165 - DNA, 22 bp, Homo sapiens
ataatgatggatttaacagcat

SEQ ID NO: 3469166 - DNA, 19 bp, Homo sapiens
ataatgcaaagaatcccta

SEQ ID NO: 3469167 - DNA, 13 bp, Homo sapiens
ataatgcagtatg

SEQ ID NO: 3469168 - DNA, 14 bp, Homo sapiens
ataatgcagtatgg

SEQ ID NO: 3469169 - DNA, 20 bp, Homo sapiens
ataatggacagattaatatt

SEQ ID NO: 3469170 - DNA, 21 bp, Homo sapiens
ataatgggccactgaaatctg

SEQ ID NO: 3469171 - DNA, 18 bp, Homo sapiens
ataatgggcttagagcag

SEQ ID NO: 3469172 - DNA, 18 bp, Homo sapiens
ataatggttgactgggtt

SEQ ID NO: 3469173 - DNA, 15 bp, Homo sapiens
ataatgtaattgtaa

SEQ ID NO: 3469174 - DNA, 15 bp, Homo sapiens
ataatgtaatttagt

SEQ ID NO: 3469175 - DNA, 11 bp, Homo sapiens
ataatgtctct

SEQ ID NO: 3469176 - DNA, 15 bp, Homo sapiens
ataatgtctctgtga

SEQ ID NO: 3469177 - DNA, 12 bp, Homo sapiens
ataatgtcttta

SEQ ID NO: 3469178 - DNA, 15 bp, Homo sapiens
ataattacaatacaa

SEQ ID NO: 3469179 - DNA, 12 bp, Homo sapiens
ataattgttgaa

SEQ ID NO: 3469180 - DNA, 18 bp, Homo sapiens
ataatttacaggttctta

SEQ ID NO: 3469181 - DNA, 22 bp, Homo sapiens
ataatttttttcaatatttatt

SEQ ID NO: 3469182 - DNA, 15 bp, Homo sapiens
atacaaattagaaaa

SEQ ID NO: 3469183 - DNA, 17 bp, Homo sapiens
atacaaattagaaaatg

SEQ ID NO: 3469184 - DNA, 17 bp, Homo sapiens
atacaagatattatgta

SEQ ID NO: 3469185 - DNA, 16 bp, Homo sapiens
atacaataatgtaatt

SEQ ID NO: 3469186 - DNA, 19 bp, Homo sapiens
atacaccagagataatatg

SEQ ID NO: 3469187 - DNA, 22 bp, Homo sapiens
atacaccccctcttctgagcac

SEQ ID NO: 3469188 - DNA, 15 bp, Homo sapiens
atacagaactctttc

SEQ ID NO: 3469189 - DNA, 17 bp, Homo sapiens
atacagattttgatagc

SEQ ID NO: 3469190 - DNA, 14 bp, Homo sapiens
atacaggaaaagct

SEQ ID NO: 3469191 - DNA, 16 bp, Homo sapiens
atacagtacaggcagc

SEQ ID NO: 3469192 - DNA, 19 bp, Homo sapiens
atacagtacaggcagcaca

SEQ ID NO: 3469193 - DNA, 18 bp, Homo sapiens
atacagtcttccacaaag

SEQ ID NO: 3469194 - DNA, 22 bp, Homo sapiens
atacagtcttccacaaagaaaa

SEQ ID NO: 3469195 - DNA, 20 bp, Homo sapiens
atacagtcttccatttgcaa

SEQ ID NO: 3469196 - DNA, 22 bp, Homo sapiens
atacagtttgtcacatgaaaca

SEQ ID NO: 3469197 - DNA, 17 bp, Homo sapiens
atacataaacttttgca

SEQ ID NO: 3469198 - DNA, 12 bp, Homo sapiens
atacatacagaa

SEQ ID NO: 3469199 - DNA, 17 bp, Homo sapiens
atacatatctttattaa

SEQ ID NO: 3469200 - DNA, 21 bp, Homo sapiens
atacatatctttattaatcac

SEQ ID NO: 3469201 - DNA, 20 bp, Homo sapiens
atacattcaaattctttttt

SEQ ID NO: 3469202 - DNA, 13 bp, Homo sapiens
atacattctagat

SEQ ID NO: 3469203 - DNA, 12 bp, Homo sapiens
atacatttctga

SEQ ID NO: 3469204 - DNA, 16 bp, Homo sapiens
ataccacccaatgctg

SEQ ID NO: 3469205 - DNA, 16 bp, Homo sapiens
ataccagcgaggaggc

SEQ ID NO: 3469206 - DNA, 22 bp, Homo sapiens
ataccagcgaggaggctccaga

SEQ ID NO: 3469207 - DNA, 18 bp, Homo sapiens
ataccagcttagatttta

SEQ ID NO: 3469208 - DNA, 15 bp, Homo sapiens
ataccatctgctgcc

SEQ ID NO: 3469209 - DNA, 17 bp, Homo sapiens
ataccatttcctcagct

SEQ ID NO: 3469210 - DNA, 13 bp, Homo sapiens
atacccagagcac

SEQ ID NO: 3469211 - DNA, 14 bp, Homo sapiens
atacctaaaacata

SEQ ID NO: 3469212 - DNA, 18 bp, Homo sapiens
atacctcaacctatggta

SEQ ID NO: 3469213 - DNA, 17 bp, Homo sapiens
atacgagagcagaggtc

SEQ ID NO: 3469214 - DNA, 24 bp, Homo sapiens
atacgcttttctttgttataccat

SEQ ID NO: 3469215 - DNA, 17 bp, Homo sapiens
atactctagatgaagtt

SEQ ID NO: 3469216 - DNA, 22 bp, Homo sapiens
atactctttctgtatatacttt

SEQ ID NO: 3469217 - DNA, 14 bp, Homo sapiens
atactgcaagaaaa

SEQ ID NO: 3469218 - DNA, 19 bp, Homo sapiens
atactgctactgtaatttt

SEQ ID NO: 3469219 - DNA, 22 bp, Homo sapiens
atactgctactgtaattttata

SEQ ID NO: 3469220 - DNA, 10 bp, Homo sapiens
atactgcttg

SEQ ID NO: 3469221 - DNA, 20 bp, Homo sapiens
atactgcttggagctgagca

SEQ ID NO: 3469222 - DNA, 21 bp, Homo sapiens
atactgcttggagctgagcaa

SEQ ID NO: 3469223 - DNA, 23 bp, Homo sapiens
atactgcttgtcatctgcatgtc

SEQ ID NO: 3469224 - DNA, 12 bp, Homo sapiens
atactgtaacac

SEQ ID NO: 3469225 - DNA, 20 bp, Homo sapiens
atactgtacaataaaaacat

SEQ ID NO: 3469226 - DNA, 14 bp, Homo sapiens
atactgtacagggg

SEQ ID NO: 3469227 - DNA, 19 bp, Homo sapiens
atactgtattttgtattgt

SEQ ID NO: 3469228 - DNA, 23 bp, Homo sapiens
atacttacattctctaataagaa

SEQ ID NO: 3469229 - DNA, 17 bp, Homo sapiens
atacttgaagggccaga

SEQ ID NO: 3469230 - DNA, 20 bp, Homo sapiens
atacttgaagggccagagcc

SEQ ID NO: 3469231 - DNA, 22 bp, Homo sapiens
atacttgaagggccagagccag

SEQ ID NO: 3469232 - DNA, 13 bp, Homo sapiens
atacttgtggact

SEQ ID NO: 3469233 - DNA, 19 bp, Homo sapiens
atactttaatgttttaact

SEQ ID NO: 3469234 - DNA, 16 bp, Homo sapiens
atacttttgccctttg

SEQ ID NO: 3469235 - DNA, 10 bp, Homo sapiens
atagaaaaat

SEQ ID NO: 3469236 - DNA, 13 bp, Homo sapiens
atagaaaagttat

SEQ ID NO: 3469237 - DNA, 14 bp, Homo sapiens
atagaaaagttatt

SEQ ID NO: 3469238 - DNA, 19 bp, Homo sapiens
atagaaatgccaagcactt

SEQ ID NO: 3469239 - DNA, 13 bp, Homo sapiens
atagaacagtgct

SEQ ID NO: 3469240 - DNA, 21 bp, Homo sapiens
atagaactcagttttaactag

SEQ ID NO: 3469241 - DNA, 23 bp, Homo sapiens
atagaagctgcagtggtattaat

SEQ ID NO: 3469242 - DNA, 16 bp, Homo sapiens
atagaagttttaaatt

SEQ ID NO: 3469243 - DNA, 13 bp, Homo sapiens
atagaatatagca

SEQ ID NO: 3469244 - DNA, 17 bp, Homo sapiens
atagaatatagcatctt

SEQ ID NO: 3469245 - DNA, 21 bp, Homo sapiens
atagaatatagcatctttcat

SEQ ID NO: 3469246 - DNA, 22 bp, Homo sapiens
atagaatatagcatctttcata

SEQ ID NO: 3469247 - DNA, 13 bp, Homo sapiens
atagaatatttat

SEQ ID NO: 3469248 - DNA, 21 bp, Homo sapiens
atagacagaatagatagcact

SEQ ID NO: 3469249 - DNA, 18 bp, Homo sapiens
atagacctctagtagctg

SEQ ID NO: 3469250 - DNA, 14 bp, Homo sapiens
atagagaatgttcc

SEQ ID NO: 3469251 - DNA, 14 bp, Homo sapiens
atagagagagacca

SEQ ID NO: 3469252 - DNA, 14 bp, Homo sapiens
atagagctgtatta

SEQ ID NO: 3469253 - DNA, 14 bp, Homo sapiens
atagagtatatgca

SEQ ID NO: 3469254 - DNA, 20 bp, Homo sapiens
atagataagagtagaaactg

SEQ ID NO: 3469255 - DNA, 17 bp, Homo sapiens
atagatgctggcccagg

SEQ ID NO: 3469256 - DNA, 20 bp, Homo sapiens
atagatgctggcccagggcc

SEQ ID NO: 3469257 - DNA, 22 bp, Homo sapiens
atagcaaagcgacgttagtcgt

SEQ ID NO: 3469258 - DNA, 17 bp, Homo sapiens
atagcaagattgcttaa

SEQ ID NO: 3469259 - DNA, 22 bp, Homo sapiens
atagcaagtgaatttttctcta

SEQ ID NO: 3469260 - DNA, 14 bp, Homo sapiens
atagcagctgctac

SEQ ID NO: 3469261 - DNA, 14 bp, Homo sapiens
atagcatctgtaca

SEQ ID NO: 3469262 - DNA, 17 bp, Homo sapiens
atagcatctttcatatg

SEQ ID NO: 3469263 - DNA, 21 bp, Homo sapiens
atagccacatttggaatactt

SEQ ID NO: 3469264 - DNA, 12 bp, Homo sapiens
atagccaggagc

SEQ ID NO: 3469265 - DNA, 23 bp, Homo sapiens
atagccatgtatcataattacca

SEQ ID NO: 3469266 - DNA, 13 bp, Homo sapiens
atagcctgtggcc

SEQ ID NO: 3469267 - DNA, 16 bp, Homo sapiens
atagctaactgtaaat

SEQ ID NO: 3469268 - DNA, 22 bp, Homo sapiens
atagctcaggtgtccctgcact

SEQ ID NO: 3469269 - DNA, 21 bp, Homo sapiens
atagctgcccatttcgtgagc

SEQ ID NO: 3469270 - DNA, 12 bp, Homo sapiens
atagctgggact

SEQ ID NO: 3469271 - DNA, 23 bp, Homo sapiens
atagctgtacaaatataagaata

SEQ ID NO: 3469272 - DNA, 22 bp, Homo sapiens
atagcttcaccccaatcccagc

SEQ ID NO: 3469273 - DNA, 21 bp, Homo sapiens
ataggaaagtatttttttaag

SEQ ID NO: 3469274 - DNA, 14 bp, Homo sapiens
ataggacctttcca

SEQ ID NO: 3469275 - DNA, 22 bp, Homo sapiens
ataggactcaaagtttcagaga

SEQ ID NO: 3469276 - DNA, 16 bp, Homo sapiens
ataggatttttagaat

SEQ ID NO: 3469277 - DNA, 16 bp, Homo sapiens
ataggcttttgttctt

SEQ ID NO: 3469278 - DNA, 13 bp, Homo sapiens
ataggtagaaaca

SEQ ID NO: 3469279 - DNA, 18 bp, Homo sapiens
ataggtccagaagtcctt

SEQ ID NO: 3469280 - DNA, 18 bp, Homo sapiens
ataggtgagaaaaaaaca

SEQ ID NO: 3469281 - DNA, 22 bp, Homo sapiens
ataggttcttcttgttctgaga

SEQ ID NO: 3469282 - DNA, 22 bp, Homo sapiens
ataggttgagcaatttccccct

SEQ ID NO: 3469283 - DNA, 16 bp, Homo sapiens
atagtaacctgggtaa

SEQ ID NO: 3469284 - DNA, 17 bp, Homo sapiens
atagtaatgagtttaaa

SEQ ID NO: 3469285 - DNA, 13 bp, Homo sapiens
atagtaatttgta

SEQ ID NO: 3469286 - DNA, 16 bp, Homo sapiens
atagtaatttgtaaag

SEQ ID NO: 3469287 - DNA, 14 bp, Homo sapiens
atagtactggcatg

SEQ ID NO: 3469288 - DNA, 21 bp, Homo sapiens
atagtagagtgatatggagca

SEQ ID NO: 3469289 - DNA, 20 bp, Homo sapiens
atagtatttgattcaaaata

SEQ ID NO: 3469290 - DNA, 21 bp, Homo sapiens
atagtcatgctgctagatctt

SEQ ID NO: 3469291 - DNA, 22 bp, Homo sapiens
atagtcatgctgctagatcttt

SEQ ID NO: 3469292 - DNA, 12 bp, Homo sapiens
atagtccctgcc

SEQ ID NO: 3469293 - DNA, 20 bp, Homo sapiens
atagtctagatggctcctct

SEQ ID NO: 3469294 - DNA, 14 bp, Homo sapiens
atagtcttttgctt

SEQ ID NO: 3469295 - DNA, 18 bp, Homo sapiens
atagtgcaactgttttga

SEQ ID NO: 3469296 - DNA, 16 bp, Homo sapiens
atagtggggagacttc

SEQ ID NO: 3469297 - DNA, 22 bp, Homo sapiens
atagtgttctgcaaaaatattt

SEQ ID NO: 3469298 - DNA, 20 bp, Homo sapiens
atagttactccagtgccaac

SEQ ID NO: 3469299 - DNA, 14 bp, Homo sapiens
atagtttattgaca

SEQ ID NO: 3469300 - DNA, 22 bp, Homo sapiens
atagtttgggcttcagcctagt

SEQ ID NO: 3469301 - DNA, 14 bp, Homo sapiens
atataaaaaacttt

SEQ ID NO: 3469302 - DNA, 22 bp, Homo sapiens
atataaaactgcgttaaaggct

SEQ ID NO: 3469303 - DNA, 19 bp, Homo sapiens
atataaatgttaagaaaaa

SEQ ID NO: 3469304 - DNA, 17 bp, Homo sapiens
atataatatatttgtgt

SEQ ID NO: 3469305 - DNA, 17 bp, Homo sapiens
atataatatctaaagtt

SEQ ID NO: 3469306 - DNA, 20 bp, Homo sapiens
atataatatctaaagttata

SEQ ID NO: 3469307 - DNA, 17 bp, Homo sapiens
atataatctttcaaacc

SEQ ID NO: 3469308 - DNA, 18 bp, Homo sapiens
atatacaataacataatt

SEQ ID NO: 3469309 - DNA, 13 bp, Homo sapiens
atatacaataatg

SEQ ID NO: 3469310 - DNA, 15 bp, Homo sapiens
atatacaataatgta

SEQ ID NO: 3469311 - DNA, 22 bp, Homo sapiens
atatactctagatgaagtttta

SEQ ID NO: 3469312 - DNA, 21 bp, Homo sapiens
atatacttgtggactaaaaga

SEQ ID NO: 3469313 - DNA, 11 bp, Homo sapiens
atatacttttt

SEQ ID NO: 3469314 - DNA, 14 bp, Homo sapiens
atatagcatctttc

SEQ ID NO: 3469315 - DNA, 16 bp, Homo sapiens
atatagcccagccagg

SEQ ID NO: 3469316 - DNA, 14 bp, Homo sapiens
atatagctgtacaa

SEQ ID NO: 3469317 - DNA, 18 bp, Homo sapiens
atatagctgtacaaatat

SEQ ID NO: 3469318 - DNA, 19 bp, Homo sapiens
atataggtttctattcttg

SEQ ID NO: 3469319 - DNA, 13 bp, Homo sapiens
atatataaaataa

SEQ ID NO: 3469320 - DNA, 14 bp, Homo sapiens
atatataaaataaa

SEQ ID NO: 3469321 - DNA, 20 bp, Homo sapiens
atatataaaataaatatata

SEQ ID NO: 3469322 - DNA, 21 bp, Homo sapiens
atatataaacctaaaaaagat

SEQ ID NO: 3469323 - DNA, 14 bp, Homo sapiens
atatataaatatat

SEQ ID NO: 3469324 - DNA, 14 bp, Homo sapiens
atatataagaaaga

SEQ ID NO: 3469325 - DNA, 17 bp, Homo sapiens
atatataagaaagacat

SEQ ID NO: 3469326 - DNA, 13 bp, Homo sapiens
atatatatataaa

SEQ ID NO: 3469327 - DNA, 15 bp, Homo sapiens
atatatatatatgca

SEQ ID NO: 3469328 - DNA, 13 bp, Homo sapiens
atatatatatgta

SEQ ID NO: 3469329 - DNA, 17 bp, Homo sapiens
atatatattattctcat

SEQ ID NO: 3469330 - DNA, 18 bp, Homo sapiens
atatatattattctcatt

SEQ ID NO: 3469331 - DNA, 23 bp, Homo sapiens
atatatccttttcttctatgtag

SEQ ID NO: 3469332 - DNA, 19 bp, Homo sapiens
atatatgcactatgtatat

SEQ ID NO: 3469333 - DNA, 13 bp, Homo sapiens
atatatgctaagt

SEQ ID NO: 3469334 - DNA, 13 bp, Homo sapiens
atatatggcagag

SEQ ID NO: 3469335 - DNA, 17 bp, Homo sapiens
atatatggcagagttgt

SEQ ID NO: 3469336 - DNA, 18 bp, Homo sapiens
atatattattctcattta

SEQ ID NO: 3469337 - DNA, 21 bp, Homo sapiens
atatattattctcatttagtg

SEQ ID NO: 3469338 - DNA, 16 bp, Homo sapiens
atatattgcatttctg

SEQ ID NO: 3469339 - DNA, 20 bp, Homo sapiens
atatattggcactgctaaaa

SEQ ID NO: 3469340 - DNA, 12 bp, Homo sapiens
atatatttaaaa

SEQ ID NO: 3469341 - DNA, 22 bp, Homo sapiens
atatatttgtgtatttaacagg

SEQ ID NO: 3469342 - DNA, 17 bp, Homo sapiens
atatatttttttttgga

SEQ ID NO: 3469343 - DNA, 13 bp, Homo sapiens
atatcaaatgcag

SEQ ID NO: 3469344 - DNA, 21 bp, Homo sapiens
atatcaaatgcagtatatttc

SEQ ID NO: 3469345 - DNA, 17 bp, Homo sapiens
atatccattctttctga

SEQ ID NO: 3469346 - DNA, 20 bp, Homo sapiens
atatcccaaactgtgatgaa

SEQ ID NO: 3469347 - DNA, 17 bp, Homo sapiens
atatcccgggggtgggg

SEQ ID NO: 3469348 - DNA, 20 bp, Homo sapiens
atatctaaagttatatttca

SEQ ID NO: 3469349 - DNA, 15 bp, Homo sapiens
atatctaagttcaca

SEQ ID NO: 3469350 - DNA, 20 bp, Homo sapiens
atatctaattattttgcagt

SEQ ID NO: 3469351 - DNA, 14 bp, Homo sapiens
atatctgattgttg

SEQ ID NO: 3469352 - DNA, 18 bp, Homo sapiens
atatcttcagtttaatgc

SEQ ID NO: 3469353 - DNA, 13 bp, Homo sapiens
atatgaatctgct

SEQ ID NO: 3469354 - DNA, 13 bp, Homo sapiens
atatgactcacat

SEQ ID NO: 3469355 - DNA, 20 bp, Homo sapiens
atatgatagcgggaaaagga

SEQ ID NO: 3469356 - DNA, 20 bp, Homo sapiens
atatgatttaaatcagccgt

SEQ ID NO: 3469357 - DNA, 17 bp, Homo sapiens
atatgcagtctctttat

SEQ ID NO: 3469358 - DNA, 19 bp, Homo sapiens
atatggcagagttgtaaat

SEQ ID NO: 3469359 - DNA, 20 bp, Homo sapiens
atatggcagagttgtaaata

SEQ ID NO: 3469360 - DNA, 13 bp, Homo sapiens
atatggccacagt

SEQ ID NO: 3469361 - DNA, 14 bp, Homo sapiens
atatgtaaaataaa

SEQ ID NO: 3469362 - DNA, 11 bp, Homo sapiens
atatgtatttt

SEQ ID NO: 3469363 - DNA, 17 bp, Homo sapiens
atatgtatttttatata

SEQ ID NO: 3469364 - DNA, 19 bp, Homo sapiens
atatgtcgtagaattcctt

SEQ ID NO: 3469365 - DNA, 20 bp, Homo sapiens
atatgtgagtgccttttgca

SEQ ID NO: 3469366 - DNA, 21 bp, Homo sapiens
atatgtgtgcctatttgtgtg

SEQ ID NO: 3469367 - DNA, 12 bp, Homo sapiens
atatgtgtgtgt

SEQ ID NO: 3469368 - DNA, 17 bp, Homo sapiens
atatgtgtttttcacat

SEQ ID NO: 3469369 - DNA, 12 bp, Homo sapiens
atcattctctgt

SEQ ID NO: 3469370 - DNA, 15 bp, Homo sapiens
atcattgctcccctg

SEQ ID NO: 3469371 - DNA, 16 bp, Homo sapiens
atcattgctgtctgca

SEQ ID NO: 3469372 - DNA, 21 bp, Homo sapiens
atcattgctgtctgcagcctt

SEQ ID NO: 3469373 - DNA, 23 bp, Homo sapiens
atcattgttggtgttaattgaaa

SEQ ID NO: 3469374 - DNA, 21 bp, Homo sapiens
atcatttaataatatacttgt

SEQ ID NO: 3469375 - DNA, 22 bp, Homo sapiens
atcatttattttttacattatt

SEQ ID NO: 3469376 - DNA, 15 bp, Homo sapiens
atcatttctatttct

SEQ ID NO: 3469377 - DNA, 17 bp, Homo sapiens
atcattttatatgtcaa

SEQ ID NO: 3469378 - DNA, 19 bp, Homo sapiens
atccaaaatgtgtatttct

SEQ ID NO: 3469379 - DNA, 20 bp, Homo sapiens
atccaaacttggatttttga

SEQ ID NO: 3469380 - DNA, 21 bp, Homo sapiens
atccaaagaaaaagggctgcc

SEQ ID NO: 3469381 - DNA, 22 bp, Homo sapiens
atccaatgctcaagaaacaact

SEQ ID NO: 3469382 - DNA, 20 bp, Homo sapiens
atccaatgggtttttccctg

SEQ ID NO: 3469383 - DNA, 16 bp, Homo sapiens
atccacccacctcagc

SEQ ID NO: 3469384 - DNA, 18 bp, Homo sapiens
atccacccacctcagcct

SEQ ID NO: 3469385 - DNA, 13 bp, Homo sapiens
atccacctgtctc

SEQ ID NO: 3469386 - DNA, 18 bp, Homo sapiens
atccacctgtctcagcct

SEQ ID NO: 3469387 - DNA, 19 bp, Homo sapiens
atccactagtgcaaatcat

SEQ ID NO: 3469388 - DNA, 16 bp, Homo sapiens
atccactcccaggcag

SEQ ID NO: 3469389 - DNA, 21 bp, Homo sapiens
atccactgtgccatgtgccag

SEQ ID NO: 3469390 - DNA, 19 bp, Homo sapiens
atccagcagtctctgcctt

SEQ ID NO: 3469391 - DNA, 14 bp, Homo sapiens
atccagctggtgag

SEQ ID NO: 3469392 - DNA, 14 bp, Homo sapiens
atccagggacagag

SEQ ID NO: 3469393 - DNA, 20 bp, Homo sapiens
atccagggacagaggcccca

SEQ ID NO: 3469394 - DNA, 19 bp, Homo sapiens
atccagggctctgaccagt

SEQ ID NO: 3469395 - DNA, 14 bp, Homo sapiens
atccataaagacaa

SEQ ID NO: 3469396 - DNA, 23 bp, Homo sapiens
atccataaagacaatcactgcca

SEQ ID NO: 3469397 - DNA, 23 bp, Homo sapiens
atccataatgatggatttaacag

SEQ ID NO: 3469398 - DNA, 18 bp, Homo sapiens
atccatattgagtcaaat

SEQ ID NO: 3469399 - DNA, 18 bp, Homo sapiens
atccatcatcatgtgtgt

SEQ ID NO: 3469400 - DNA, 16 bp, Homo sapiens
atccattcccaagatg

SEQ ID NO: 3469401 - DNA, 15 bp, Homo sapiens
atccattctttctga

SEQ ID NO: 3469402 - DNA, 16 bp, Homo sapiens
atccattctttctgat

SEQ ID NO: 3469403 - DNA, 18 bp, Homo sapiens
atcccaacaagcaagggt

SEQ ID NO: 3469404 - DNA, 23 bp, Homo sapiens
atcccaactgtctttttttccct

SEQ ID NO: 3469405 - DNA, 17 bp, Homo sapiens
atcccaagtagaatctc

SEQ ID NO: 3469406 - DNA, 14 bp, Homo sapiens
atcccacaccctgg

SEQ ID NO: 3469407 - DNA, 22 bp, Homo sapiens
atcccagctacttgggaggctg

SEQ ID NO: 3469408 - DNA, 23 bp, Homo sapiens
atcccaggatcgcaagagccatg

SEQ ID NO: 3469409 - DNA, 18 bp, Homo sapiens
atcccaggcccctggagg

SEQ ID NO: 3469410 - DNA, 24 bp, Homo sapiens
atcccaggcccctggaggctgcct

SEQ ID NO: 3469411 - DNA, 16 bp, Homo sapiens
atcccattctgcgtca

SEQ ID NO: 3469412 - DNA, 13 bp, Homo sapiens
atcccattcttta

SEQ ID NO: 3469413 - DNA, 14 bp, Homo sapiens
atcccatttaaaaa

SEQ ID NO: 3469414 - DNA, 12 bp, Homo sapiens
atccccaataat

SEQ ID NO: 3469415 - DNA, 13 bp, Homo sapiens
atccccaggtctc

SEQ ID NO: 3469416 - DNA, 18 bp, Homo sapiens
atcccccactgccacacc

SEQ ID NO: 3469417 - DNA, 15 bp, Homo sapiens
atccccccatcttgc

SEQ ID NO: 3469418 - DNA, 18 bp, Homo sapiens
atccccgcagtgtgcact

SEQ ID NO: 3469419 - DNA, 17 bp, Homo sapiens
atcccgagcacctccac

SEQ ID NO: 3469420 - DNA, 22 bp, Homo sapiens
atccctagactttaggctttca

SEQ ID NO: 3469421 - DNA, 13 bp, Homo sapiens
atccctcatctgt

SEQ ID NO: 3469422 - DNA, 19 bp, Homo sapiens
atccctcccccccatgcac

SEQ ID NO: 3469423 - DNA, 21 bp, Homo sapiens
atccctctacagagcttccct

SEQ ID NO: 3469424 - DNA, 22 bp, Homo sapiens
atccctctacagagcttccctg

SEQ ID NO: 3469425 - DNA, 14 bp, Homo sapiens
atccctctcctccc

SEQ ID NO: 3469426 - DNA, 14 bp, Homo sapiens
atccctctctggat

SEQ ID NO: 3469427 - DNA, 16 bp, Homo sapiens
atccctctctggattg

SEQ ID NO: 3469428 - DNA, 15 bp, Homo sapiens
atccctctgggggct

SEQ ID NO: 3469429 - DNA, 22 bp, Homo sapiens
atcccttgaccaggcctgggcc

SEQ ID NO: 3469430 - DNA, 13 bp, Homo sapiens
atccctttattac

SEQ ID NO: 3469431 - DNA, 16 bp, Homo sapiens
atccgaacctcctctg

SEQ ID NO: 3469432 - DNA, 22 bp, Homo sapiens
atccggcaacatcaacccgagt

SEQ ID NO: 3469433 - DNA, 23 bp, Homo sapiens
atccgtgttgcaggttcatggat

SEQ ID NO: 3469434 - DNA, 19 bp, Homo sapiens
atcctaaaacaaaagctca

SEQ ID NO: 3469435 - DNA, 16 bp, Homo sapiens
atcctacctgttttgt

SEQ ID NO: 3469436 - DNA, 16 bp, Homo sapiens
atcctagcacatgctt

SEQ ID NO: 3469437 - DNA, 19 bp, Homo sapiens
atcctatcaacaacaaggt

SEQ ID NO: 3469438 - DNA, 12 bp, Homo sapiens
atcctatgtgat

SEQ ID NO: 3469439 - DNA, 14 bp, Homo sapiens
atcctatgtgattt

SEQ ID NO: 3469440 - DNA, 17 bp, Homo sapiens
atcctatgtgattttaa

SEQ ID NO: 3469441 - DNA, 23 bp, Homo sapiens
atcctatgtgattttaactctgt

SEQ ID NO: 3469442 - DNA, 20 bp, Homo sapiens
atcctatgtttttgttcaaa

SEQ ID NO: 3469443 - DNA, 15 bp, Homo sapiens
atcctcaaacactgc

SEQ ID NO: 3469444 - DNA, 15 bp, Homo sapiens
atcctcaatccagct

SEQ ID NO: 3469445 - DNA, 19 bp, Homo sapiens
atcctcagtttttgtgaaa

SEQ ID NO: 3469446 - DNA, 21 bp, Homo sapiens
atcctccagtaccttgcttct

SEQ ID NO: 3469447 - DNA, 18 bp, Homo sapiens
atcctcccacctcagcct

SEQ ID NO: 3469448 - DNA, 19 bp, Homo sapiens
atcctcccacctcagcctc

SEQ ID NO: 3469449 - DNA, 16 bp, Homo sapiens
atcctcctgttctgaa

SEQ ID NO: 3469450 - DNA, 19 bp, Homo sapiens
atcctctctggggctgtgt

SEQ ID NO: 3469451 - DNA, 16 bp, Homo sapiens
atcctctttagagtta

SEQ ID NO: 3469452 - DNA, 19 bp, Homo sapiens
atcctctttagagttagac

SEQ ID NO: 3469453 - DNA, 20 bp, Homo sapiens
atcctctttagagttagact

SEQ ID NO: 3469454 - DNA, 14 bp, Homo sapiens
atcctctttttcca

SEQ ID NO: 3469455 - DNA, 22 bp, Homo sapiens
atcctgcggcaggactgcagag

SEQ ID NO: 3469456 - DNA, 21 bp, Homo sapiens
atcctggaggtcttttctagt

SEQ ID NO: 3469457 - DNA, 22 bp, Homo sapiens
atcctggcacccggcccctgct

SEQ ID NO: 3469458 - DNA, 23 bp, Homo sapiens
atcctggcacccggcccctgctg

SEQ ID NO: 3469459 - DNA, 21 bp, Homo sapiens
atcctgggggacccaatgtag

SEQ ID NO: 3469460 - DNA, 23 bp, Homo sapiens
atcctggtttcataacttcctgt

SEQ ID NO: 3469461 - DNA, 18 bp, Homo sapiens
atcctgtgtttctaggga

SEQ ID NO: 3469462 - DNA, 18 bp, Homo sapiens
atcctgtttgtatgaaat

SEQ ID NO: 3469463 - DNA, 19 bp, Homo sapiens
atcctgtttgtatgaaatt

SEQ ID NO: 3469464 - DNA, 23 bp, Homo sapiens
atccttcccaagtaagaggctgg

SEQ ID NO: 3469465 - DNA, 16 bp, Homo sapiens
atccttccctttggag

SEQ ID NO: 3469466 - DNA, 17 bp, Homo sapiens
atccttgggggctccca

SEQ ID NO: 3469467 - DNA, 18 bp, Homo sapiens
atccttgggggctcccag

SEQ ID NO: 3469468 - DNA, 17 bp, Homo sapiens
atcctttacgtgtttaa

SEQ ID NO: 3469469 - DNA, 19 bp, Homo sapiens
atcctttagggttctgcct

SEQ ID NO: 3469470 - DNA, 19 bp, Homo sapiens
atcctttcctcattaaatt

SEQ ID NO: 3469471 - DNA, 17 bp, Homo sapiens
atcgaagggtttttaga

SEQ ID NO: 3469472 - DNA, 23 bp, Homo sapiens
atcgaagggtttttagagaatgt

SEQ ID NO: 3469473 - DNA, 16 bp, Homo sapiens
atcgagatggagctac

SEQ ID NO: 3469474 - DNA, 20 bp, Homo sapiens
atcgccagaggtgcttcacc

SEQ ID NO: 3469475 - DNA, 12 bp, Homo sapiens
atcgcctttccc

SEQ ID NO: 3469476 - DNA, 22 bp, Homo sapiens
atcggcctagggcccccacagt

SEQ ID NO: 3469477 - DNA, 19 bp, Homo sapiens
atctaaaagaaatgtctat

SEQ ID NO: 3469478 - DNA, 18 bp, Homo sapiens
atctaaagttatatttca

SEQ ID NO: 3469479 - DNA, 15 bp, Homo sapiens
atctaaatcaccaga

SEQ ID NO: 3469480 - DNA, 13 bp, Homo sapiens
atctaacctcatc

SEQ ID NO: 3469481 - DNA, 18 bp, Homo sapiens
atctaacctcatcttctt

SEQ ID NO: 3469482 - DNA, 19 bp, Homo sapiens
atctaagaatacagctttc

SEQ ID NO: 3469483 - DNA, 17 bp, Homo sapiens
atctaaggctgtttgct

SEQ ID NO: 3469484 - DNA, 14 bp, Homo sapiens
atctaatatttcta

SEQ ID NO: 3469485 - DNA, 17 bp, Homo sapiens
atctaatatttctagta

SEQ ID NO: 3469486 - DNA, 16 bp, Homo sapiens
atctaattattttgca

SEQ ID NO: 3469487 - DNA, 21 bp, Homo sapiens
atctacccaaaggatactgta

SEQ ID NO: 3469488 - DNA, 19 bp, Homo sapiens
atctatgctggtgaaaaca

SEQ ID NO: 3469489 - DNA, 15 bp, Homo sapiens
atctatggcagtcca

SEQ ID NO: 3469490 - DNA, 20 bp, Homo sapiens
atctatggcagtccagccag

SEQ ID NO: 3469491 - DNA, 17 bp, Homo sapiens
atctatggtcgggagac

SEQ ID NO: 3469492 - DNA, 16 bp, Homo sapiens
atctatttgtgtgtgt

SEQ ID NO: 3469493 - DNA, 18 bp, Homo sapiens
atctcaattgtgctttgt

SEQ ID NO: 3469494 - DNA, 16 bp, Homo sapiens
atctcaccccatccca

SEQ ID NO: 3469495 - DNA, 22 bp, Homo sapiens
atctcaccccatcccacaccct

SEQ ID NO: 3469496 - DNA, 14 bp, Homo sapiens
atctcactctgccc

SEQ ID NO: 3469497 - DNA, 14 bp, Homo sapiens
atctcagagacagg

SEQ ID NO: 3469498 - DNA, 22 bp, Homo sapiens
atctcagagacaggtggcctag

SEQ ID NO: 3469499 - DNA, 12 bp, Homo sapiens
atctcaggagct

SEQ ID NO: 3469500 - DNA, 21 bp, Homo sapiens
atctcaggagcttgcaagaag

SEQ ID NO: 3469501 - DNA, 14 bp, Homo sapiens
atctcagggcctgg

SEQ ID NO: 3469502 - DNA, 18 bp, Homo sapiens
atctcagggtccagaccc

SEQ ID NO: 3469503 - DNA, 19 bp, Homo sapiens
atctcagttgattttctgg

SEQ ID NO: 3469504 - DNA, 21 bp, Homo sapiens
atctcatgcccctggctggga

SEQ ID NO: 3469505 - DNA, 14 bp, Homo sapiens
atctcattactgct

SEQ ID NO: 3469506 - DNA, 14 bp, Homo sapiens
atctcattggaccc

SEQ ID NO: 3469507 - DNA, 19 bp, Homo sapiens
atctccacaacctcttccc

SEQ ID NO: 3469508 - DNA, 14 bp, Homo sapiens
atctccggctccca

SEQ ID NO: 3469509 - DNA, 20 bp, Homo sapiens
atctcctgccttcctcctgg

SEQ ID NO: 3469510 - DNA, 19 bp, Homo sapiens
atctcgctccctcccagga

SEQ ID NO: 3469511 - DNA, 15 bp, Homo sapiens
atctcggctcagtgc

SEQ ID NO: 3469512 - DNA, 17 bp, Homo sapiens
atctctcatcctccagt

SEQ ID NO: 3469513 - DNA, 21 bp, Homo sapiens
atctctcatcctccagtacct

SEQ ID NO: 3469514 - DNA, 23 bp, Homo sapiens
atctctccctcccctgccatttt

SEQ ID NO: 3469515 - DNA, 18 bp, Homo sapiens
atctctcttgggccaagc

SEQ ID NO: 3469516 - DNA, 23 bp, Homo sapiens
atctctcttgggccaagccagct

SEQ ID NO: 3469517 - DNA, 18 bp, Homo sapiens
atctctgtgccttcgtct

SEQ ID NO: 3469518 - DNA, 12 bp, Homo sapiens
atctcttccttg

SEQ ID NO: 3469519 - DNA, 15 bp, Homo sapiens
atctcttgagcctgg

SEQ ID NO: 3469520 - DNA, 13 bp, Homo sapiens
atctctttagaga

SEQ ID NO: 3469521 - DNA, 17 bp, Homo sapiens
atctctttcacattgtt

SEQ ID NO: 3469522 - DNA, 19 bp, Homo sapiens
atctctttcacattgtttg

SEQ ID NO: 3469523 - DNA, 11 bp, Homo sapiens
atctcttttat

SEQ ID NO: 3469524 - DNA, 19 bp, Homo sapiens
atctctttttgctttcgaa

SEQ ID NO: 3469525 - DNA, 21 bp, Homo sapiens
atctgaaggggcaaattcttt

SEQ ID NO: 3469526 - DNA, 18 bp, Homo sapiens
atctgacatgattccttc

SEQ ID NO: 3469527 - DNA, 19 bp, Homo sapiens
atctgacatgattccttcc

SEQ ID NO: 3469528 - DNA, 14 bp, Homo sapiens
atctgaccagcagc

SEQ ID NO: 3469529 - DNA, 13 bp, Homo sapiens
atctgacccagtg

SEQ ID NO: 3469530 - DNA, 20 bp, Homo sapiens
atctgacccagtgcccccac

SEQ ID NO: 3469531 - DNA, 23 bp, Homo sapiens
atctgagaaacctgttgaagatt

SEQ ID NO: 3469532 - DNA, 18 bp, Homo sapiens
atctgaggcatcctctga

SEQ ID NO: 3469533 - DNA, 14 bp, Homo sapiens
atctgatggcttct

SEQ ID NO: 3469534 - DNA, 15 bp, Homo sapiens
atctgcacccccctg

SEQ ID NO: 3469535 - DNA, 17 bp, Homo sapiens
atctgcaggcagacacg

SEQ ID NO: 3469536 - DNA, 19 bp, Homo sapiens
atctgcaggcagacacgga

SEQ ID NO: 3469537 - DNA, 16 bp, Homo sapiens
atctgcaggggtctgg

SEQ ID NO: 3469538 - DNA, 23 bp, Homo sapiens
atctgcattttcaccccaccctt

SEQ ID NO: 3469539 - DNA, 19 bp, Homo sapiens
atctgcctgacaggctgtg

SEQ ID NO: 3469540 - DNA, 14 bp, Homo sapiens
atctgctcacttta

SEQ ID NO: 3469541 - DNA, 15 bp, Homo sapiens
atctgctctccttcc

SEQ ID NO: 3469542 - DNA, 16 bp, Homo sapiens
atctgctctccttcct

SEQ ID NO: 3469543 - DNA, 17 bp, Homo sapiens
atctgctctccttcctg

SEQ ID NO: 3469544 - DNA, 18 bp, Homo sapiens
atctgctggagtttcatg

SEQ ID NO: 3469545 - DNA, 11 bp, Homo sapiens
atctggaaccc

SEQ ID NO: 3469546 - DNA, 18 bp, Homo sapiens
atctggaacctcagcctg

SEQ ID NO: 3469547 - DNA, 19 bp, Homo sapiens
atctggaacctcagcctgg

SEQ ID NO: 3469548 - DNA, 21 bp, Homo sapiens
atctggaacctcagcctggcc

SEQ ID NO: 3469549 - DNA, 22 bp, Homo sapiens
atctggaacctcagcctggcca

SEQ ID NO: 3469550 - DNA, 18 bp, Homo sapiens
atctggaatctgaggcat

SEQ ID NO: 3469551 - DNA, 23 bp, Homo sapiens
atctggaatctgaggcatcctct

SEQ ID NO: 3469552 - DNA, 21 bp, Homo sapiens
atctggagaccagggagcctt

SEQ ID NO: 3469553 - DNA, 12 bp, Homo sapiens
atctggcttctg

SEQ ID NO: 3469554 - DNA, 22 bp, Homo sapiens
atctggcttctggccaggaagc

SEQ ID NO: 3469555 - DNA, 22 bp, Homo sapiens
atctgggctcctaaccttcctg

SEQ ID NO: 3469556 - DNA, 22 bp, Homo sapiens
atctggggcagcaccctataaa

SEQ ID NO: 3469557 - DNA, 16 bp, Homo sapiens
atctggggctctggga

SEQ ID NO: 3469558 - DNA, 17 bp, Homo sapiens
atctgggttcactgcaa

SEQ ID NO: 3469559 - DNA, 20 bp, Homo sapiens
atctggtagggggaaaatgt

SEQ ID NO: 3469560 - DNA, 18 bp, Homo sapiens
atctggtcctacccatcc

SEQ ID NO: 3469561 - DNA, 17 bp, Homo sapiens
atctgtataagtaagaa

SEQ ID NO: 3469562 - DNA, 19 bp, Homo sapiens
atctgtataagtaagaaaa

SEQ ID NO: 3469563 - DNA, 20 bp, Homo sapiens
atctgtataagtaagaaaat

SEQ ID NO: 3469564 - DNA, 21 bp, Homo sapiens
atctgtataagtaagaaaata

SEQ ID NO: 3469565 - DNA, 23 bp, Homo sapiens
atctgtataagtaagaaaatatt

SEQ ID NO: 3469566 - DNA, 20 bp, Homo sapiens
atctgtatatacaataacat

SEQ ID NO: 3469567 - DNA, 13 bp, Homo sapiens
atctgtctaaaga

SEQ ID NO: 3469568 - DNA, 16 bp, Homo sapiens
atctgtcttgccagcc

SEQ ID NO: 3469569 - DNA, 18 bp, Homo sapiens
atctgtcttgccagccag

SEQ ID NO: 3469570 - DNA, 21 bp, Homo sapiens
atctgtcttgccagccagaag

SEQ ID NO: 3469571 - DNA, 20 bp, Homo sapiens
atctgtgagtgaaagttgcc

SEQ ID NO: 3469572 - DNA, 24 bp, Homo sapiens
atctgtgagtgaaagttgccatta

SEQ ID NO: 3469573 - DNA, 19 bp, Homo sapiens
atctgtgctcaggactcag

SEQ ID NO: 3469574 - DNA, 23 bp, Homo sapiens
atctgtgggtctgggagtcacac

SEQ ID NO: 3469575 - DNA, 12 bp, Homo sapiens
atctgtgtcttg

SEQ ID NO: 3469576 - DNA, 13 bp, Homo sapiens
atctgtgtcttgt

SEQ ID NO: 3469577 - DNA, 14 bp, Homo sapiens
atctgtgtcttgtt

SEQ ID NO: 3469578 - DNA, 14 bp, Homo sapiens
atctgttagggcct

SEQ ID NO: 3469579 - DNA, 15 bp, Homo sapiens
atctgttagggcctt

SEQ ID NO: 3469580 - DNA, 14 bp, Homo sapiens
atctgttctaacat

SEQ ID NO: 3469581 - DNA, 17 bp, Homo sapiens
atctgttttgaaggcaa

SEQ ID NO: 3469582 - DNA, 14 bp, Homo sapiens
atcttaatataaat

SEQ ID NO: 3469583 - DNA, 14 bp, Homo sapiens
atcttacttggctt

SEQ ID NO: 3469584 - DNA, 15 bp, Homo sapiens
atcttataatttaaa

SEQ ID NO: 3469585 - DNA, 22 bp, Homo sapiens
atcttataatttaaaatatgct

SEQ ID NO: 3469586 - DNA, 16 bp, Homo sapiens
atcttatactgtacaa

SEQ ID NO: 3469587 - DNA, 19 bp, Homo sapiens
atcttccaactcaaactct

SEQ ID NO: 3469588 - DNA, 14 bp, Homo sapiens
atcttctgtaccaa

SEQ ID NO: 3469589 - DNA, 15 bp, Homo sapiens
atcttctttttcagg

SEQ ID NO: 3469590 - DNA, 12 bp, Homo sapiens
atcttgaaatta

SEQ ID NO: 3469591 - DNA, 19 bp, Homo sapiens
atcttgaccaagcaggaag

SEQ ID NO: 3469592 - DNA, 21 bp, Homo sapiens
atcttgaccaagcaggaagct

SEQ ID NO: 3469593 - DNA, 22 bp, Homo sapiens
atcttgaccaagcaggaagctc

SEQ ID NO: 3469594 - DNA, 13 bp, Homo sapiens
atcttgatgttta

SEQ ID NO: 3469595 - DNA, 16 bp, Homo sapiens
atcttgatgtttagaa

SEQ ID NO: 3469596 - DNA, 14 bp, Homo sapiens
atcttgctctgctg

SEQ ID NO: 3469597 - DNA, 19 bp, Homo sapiens
atcttgctctgctgacaga

SEQ ID NO: 3469598 - DNA, 15 bp, Homo sapiens
atcttgctctgcttg

SEQ ID NO: 3469599 - DNA, 21 bp, Homo sapiens
atcttggactcatgaggaggg

SEQ ID NO: 3469600 - DNA, 21 bp, Homo sapiens
atcttggcctaaacctcagtt

SEQ ID NO: 3469601 - DNA, 13 bp, Homo sapiens
atcttggctatgt

SEQ ID NO: 3469602 - DNA, 21 bp, Homo sapiens
atcttggctatgtaattcttg

SEQ ID NO: 3469603 - DNA, 22 bp, Homo sapiens
atcttggctatgtaattcttgt

SEQ ID NO: 3469604 - DNA, 17 bp, Homo sapiens
atcttggtttgccttcc

SEQ ID NO: 3469605 - DNA, 16 bp, Homo sapiens
atcttgtctcaatgct

SEQ ID NO: 3469606 - DNA, 23 bp, Homo sapiens
atcttgtctcaatgctcataacg

SEQ ID NO: 3469607 - DNA, 21 bp, Homo sapiens
atcttgttattgaagtgttct

SEQ ID NO: 3469608 - DNA, 19 bp, Homo sapiens
atcttgttccaaggccagg

SEQ ID NO: 3469609 - DNA, 13 bp, Homo sapiens
atctttattaatc

SEQ ID NO: 3469610 - DNA, 14 bp, Homo sapiens
atctttattaatca

SEQ ID NO: 3469611 - DNA, 19 bp, Homo sapiens
atctttattgaacttgaaa

SEQ ID NO: 3469612 - DNA, 17 bp, Homo sapiens
atctttcaaaccagctt

SEQ ID NO: 3469613 - DNA, 13 bp, Homo sapiens
atctttcttgatc

SEQ ID NO: 3469614 - DNA, 18 bp, Homo sapiens
atctttcttgatcaacat

SEQ ID NO: 3469615 - DNA, 21 bp, Homo sapiens
atctttctttcttagaaattt

SEQ ID NO: 3469616 - DNA, 15 bp, Homo sapiens
atctttgattctcct

SEQ ID NO: 3469617 - DNA, 16 bp, Homo sapiens
atctttgattctcctt

SEQ ID NO: 3469618 - DNA, 17 bp, Homo sapiens
atcttttattttggaac

SEQ ID NO: 3469619 - DNA, 16 bp, Homo sapiens
atgaaaaaatgtatat

SEQ ID NO: 3469620 - DNA, 18 bp, Homo sapiens
atgaaaacattcagagga

SEQ ID NO: 3469621 - DNA, 12 bp, Homo sapiens
atgaaaaggaat

SEQ ID NO: 3469622 - DNA, 16 bp, Homo sapiens
atgaaaatgtcttgtg

SEQ ID NO: 3469623 - DNA, 19 bp, Homo sapiens
atgaaaatgttacaagcta

SEQ ID NO: 3469624 - DNA, 15 bp, Homo sapiens
atgaaaggagagcat

SEQ ID NO: 3469625 - DNA, 18 bp, Homo sapiens
atgaaagggcccagagag

SEQ ID NO: 3469626 - DNA, 13 bp, Homo sapiens
atgaaaggtgcca

SEQ ID NO: 3469627 - DNA, 18 bp, Homo sapiens
atgaaatcttacagctgg

SEQ ID NO: 3469628 - DNA, 21 bp, Homo sapiens
atgaaatggagtcatttgagt

SEQ ID NO: 3469629 - DNA, 16 bp, Homo sapiens
atgaaatttttgtaaa

SEQ ID NO: 3469630 - DNA, 13 bp, Homo sapiens
atgaaccacatct

SEQ ID NO: 3469631 - DNA, 17 bp, Homo sapiens
atgaacccctggctcct

SEQ ID NO: 3469632 - DNA, 17 bp, Homo sapiens
atgaaccttctggcctc

SEQ ID NO: 3469633 - DNA, 19 bp, Homo sapiens
atgaagccgaccttagatt

SEQ ID NO: 3469634 - DNA, 23 bp, Homo sapiens
atgaagtttccttggctggtgca

SEQ ID NO: 3469635 - DNA, 18 bp, Homo sapiens
atgaagtttgaatgttaa

SEQ ID NO: 3469636 - DNA, 14 bp, Homo sapiens
atgaagttttacat

SEQ ID NO: 3469637 - DNA, 16 bp, Homo sapiens
atgaagttttacattg

SEQ ID NO: 3469638 - DNA, 17 bp, Homo sapiens
atgaatctgctcacttt

SEQ ID NO: 3469639 - DNA, 23 bp, Homo sapiens
atgaatgaacccctggctccttc

SEQ ID NO: 3469640 - DNA, 16 bp, Homo sapiens
atgaatgagaatctac

SEQ ID NO: 3469641 - DNA, 19 bp, Homo sapiens
atgaatgagaatgtgccat

SEQ ID NO: 3469642 - DNA, 17 bp, Homo sapiens
atgaatgatttgcatat

SEQ ID NO: 3469643 - DNA, 17 bp, Homo sapiens
atgaatgtatttatttg

SEQ ID NO: 3469644 - DNA, 13 bp, Homo sapiens
atgaattgtacag

SEQ ID NO: 3469645 - DNA, 21 bp, Homo sapiens
atgaatttattgcacattgtt

SEQ ID NO: 3469646 - DNA, 12 bp, Homo sapiens
atgacagccaga

SEQ ID NO: 3469647 - DNA, 13 bp, Homo sapiens
atgacagccagag

SEQ ID NO: 3469648 - DNA, 18 bp, Homo sapiens
atgacagctcttctaagg

SEQ ID NO: 3469649 - DNA, 23 bp, Homo sapiens
atgacatacgcttttaatgaaaa

SEQ ID NO: 3469650 - DNA, 18 bp, Homo sapiens
atgacattcatgcctggc

SEQ ID NO: 3469651 - DNA, 18 bp, Homo sapiens
atgacatttatttttcat

SEQ ID NO: 3469652 - DNA, 21 bp, Homo sapiens
atgacatttctttgtgctttg

SEQ ID NO: 3469653 - DNA, 16 bp, Homo sapiens
atgaccaacctgtttc

SEQ ID NO: 3469654 - DNA, 16 bp, Homo sapiens
atgacccaggctgggc

SEQ ID NO: 3469655 - DNA, 18 bp, Homo sapiens
atgacctcttcctttagg

SEQ ID NO: 3469656 - DNA, 17 bp, Homo sapiens
atgaccttatccttcct

SEQ ID NO: 3469657 - DNA, 21 bp, Homo sapiens
atgaccttatccttcctctcc

SEQ ID NO: 3469658 - DNA, 13 bp, Homo sapiens
atgactgcacatg

SEQ ID NO: 3469659 - DNA, 17 bp, Homo sapiens
atgactgccttgcctcc

SEQ ID NO: 3469660 - DNA, 23 bp, Homo sapiens
atgactgccttgcctcctcagta

SEQ ID NO: 3469661 - DNA, 13 bp, Homo sapiens
atgactgtagaat

SEQ ID NO: 3469662 - DNA, 13 bp, Homo sapiens
atgactttttata

SEQ ID NO: 3469663 - DNA, 15 bp, Homo sapiens
atgagaaagccttct

SEQ ID NO: 3469664 - DNA, 19 bp, Homo sapiens
atgagaaagccttcttttg

SEQ ID NO: 3469665 - DNA, 21 bp, Homo sapiens
atgagaaaggttgaagcacca

SEQ ID NO: 3469666 - DNA, 22 bp, Homo sapiens
atgagaaatacaaaaatactca

SEQ ID NO: 3469667 - DNA, 14 bp, Homo sapiens
atgagaactctgag

SEQ ID NO: 3469668 - DNA, 20 bp, Homo sapiens
atgagagttttggatgcagt

SEQ ID NO: 3469669 - DNA, 12 bp, Homo sapiens
atgagatgctgg

SEQ ID NO: 3469670 - DNA, 14 bp, Homo sapiens
atgagatgctggct

SEQ ID NO: 3469671 - DNA, 15 bp, Homo sapiens
atgagatgctggctt

SEQ ID NO: 3469672 - DNA, 19 bp, Homo sapiens
atgagatgctggcttgggc

SEQ ID NO: 3469673 - DNA, 22 bp, Homo sapiens
atgagatgctggcttgggcagc

SEQ ID NO: 3469674 - DNA, 15 bp, Homo sapiens
atgagcctcagcatc

SEQ ID NO: 3469675 - DNA, 16 bp, Homo sapiens
atgagcctcagcatcc

SEQ ID NO: 3469676 - DNA, 13 bp, Homo sapiens
atgagcctggcaa

SEQ ID NO: 3469677 - DNA, 15 bp, Homo sapiens
atgagctctacccag

SEQ ID NO: 3469678 - DNA, 21 bp, Homo sapiens
atgaggaaaataatgtaattg

SEQ ID NO: 3469679 - DNA, 15 bp, Homo sapiens
atgaggaatgtatat

SEQ ID NO: 3469680 - DNA, 12 bp, Homo sapiens
atgaggggagag

SEQ ID NO: 3469681 - DNA, 16 bp, Homo sapiens
atgaggtatcttcttt

SEQ ID NO: 3469682 - DNA, 15 bp, Homo sapiens
atgaggtcagagcct

SEQ ID NO: 3469683 - DNA, 13 bp, Homo sapiens
atgagtgtgaatg

SEQ ID NO: 3469684 - DNA, 18 bp, Homo sapiens
atgatactcatttcttat

SEQ ID NO: 3469685 - DNA, 17 bp, Homo sapiens
atgataggttaataaag

SEQ ID NO: 3469686 - DNA, 15 bp, Homo sapiens
atgatatcattgttg

SEQ ID NO: 3469687 - DNA, 15 bp, Homo sapiens
atgatcacggctcac

SEQ ID NO: 3469688 - DNA, 19 bp, Homo sapiens
atgatcacggctcactgca

SEQ ID NO: 3469689 - DNA, 13 bp, Homo sapiens
atgatcagtgttg

SEQ ID NO: 3469690 - DNA, 17 bp, Homo sapiens
atgatctttgcagacag

SEQ ID NO: 3469691 - DNA, 19 bp, Homo sapiens
atgatctttgcagacaggc

SEQ ID NO: 3469692 - DNA, 15 bp, Homo sapiens
atgatgaatgagaat

SEQ ID NO: 3469693 - DNA, 17 bp, Homo sapiens
atgatgacaaaaaatgt

SEQ ID NO: 3469694 - DNA, 21 bp, Homo sapiens
atgatgctgccggcacagctg

SEQ ID NO: 3469695 - DNA, 23 bp, Homo sapiens
atgatgctgccggcacagctggg

SEQ ID NO: 3469696 - DNA, 19 bp, Homo sapiens
atgatggatgccaatatta

SEQ ID NO: 3469697 - DNA, 20 bp, Homo sapiens
atgatggatttaacagcatg

SEQ ID NO: 3469698 - DNA, 15 bp, Homo sapiens
atgatgtactaaagt

SEQ ID NO: 3469699 - DNA, 19 bp, Homo sapiens
atgatgtgtacccaaacgt

SEQ ID NO: 3469700 - DNA, 20 bp, Homo sapiens
atgattaaccacttcagctg

SEQ ID NO: 3469701 - DNA, 15 bp, Homo sapiens
atgattcaagccatt

SEQ ID NO: 3469702 - DNA, 16 bp, Homo sapiens
atgattcaagccattc

SEQ ID NO: 3469703 - DNA, 22 bp, Homo sapiens
atgattcaggtgcagaggaagt

SEQ ID NO: 3469704 - DNA, 18 bp, Homo sapiens
atgattcgtgtaattact

SEQ ID NO: 3469705 - DNA, 23 bp, Homo sapiens
atgattctatttatatgtacatg

SEQ ID NO: 3469706 - DNA, 15 bp, Homo sapiens
atgatttccttgaat

SEQ ID NO: 3469707 - DNA, 17 bp, Homo sapiens
atgatttccttgaatgt

SEQ ID NO: 3469708 - DNA, 19 bp, Homo sapiens
atgatttccttgaatgtgg

SEQ ID NO: 3469709 - DNA, 20 bp, Homo sapiens
atgatttccttgaatgtggc

SEQ ID NO: 3469710 - DNA, 21 bp, Homo sapiens
atgcaaactgtgcttctctat

SEQ ID NO: 3469711 - DNA, 16 bp, Homo sapiens
atgcaaagaggcaaga

SEQ ID NO: 3469712 - DNA, 14 bp, Homo sapiens
atgcaaaggctggg

SEQ ID NO: 3469713 - DNA, 18 bp, Homo sapiens
atgcaagggactgtgtgt

SEQ ID NO: 3469714 - DNA, 24 bp, Homo sapiens
atgcaatgtaagcatactttgtaa

SEQ ID NO: 3469715 - DNA, 21 bp, Homo sapiens
atgcacatgttggaggagaga

SEQ ID NO: 3469716 - DNA, 22 bp, Homo sapiens
atgcaccagcccttagcaggga

SEQ ID NO: 3469717 - DNA, 19 bp, Homo sapiens
atgcactgtgaaggaccct

SEQ ID NO: 3469718 - DNA, 20 bp, Homo sapiens
atgcactgtgaaggaccctt

SEQ ID NO: 3469719 - DNA, 21 bp, Homo sapiens
atgcagaatgttgattacagt

SEQ ID NO: 3469720 - DNA, 19 bp, Homo sapiens
atgcaggatttgttctctg

SEQ ID NO: 3469721 - DNA, 18 bp, Homo sapiens
atgcaggtgaaacccagt

SEQ ID NO: 3469722 - DNA, 22 bp, Homo sapiens
atgcagtatggtacatttttca

SEQ ID NO: 3469723 - DNA, 19 bp, Homo sapiens
atgcagtctgtccaggctc

SEQ ID NO: 3469724 - DNA, 13 bp, Homo sapiens
atgcagtgctcgc

SEQ ID NO: 3469725 - DNA, 19 bp, Homo sapiens
atgcagtgctcgctgttgc

SEQ ID NO: 3469726 - DNA, 21 bp, Homo sapiens
atgcagtgctcgctgttgctg

SEQ ID NO: 3469727 - DNA, 24 bp, Homo sapiens
atgcagtgctcgctgttgctgaat

SEQ ID NO: 3469728 - DNA, 15 bp, Homo sapiens
atgcagttctgagca

SEQ ID NO: 3469729 - DNA, 13 bp, Homo sapiens
atgcagtttgaaa

SEQ ID NO: 3469730 - DNA, 17 bp, Homo sapiens
atgcagtttgaaattct

SEQ ID NO: 3469731 - DNA, 21 bp, Homo sapiens
atgcagtttgaaattctgaat

SEQ ID NO: 3469732 - DNA, 23 bp, Homo sapiens
atgcagtttgaaattctgaattt

SEQ ID NO: 3469733 - DNA, 16 bp, Homo sapiens
atgcatggtgccccag

SEQ ID NO: 3469734 - DNA, 21 bp, Homo sapiens
atgcatggtgccccaggacca

SEQ ID NO: 3469735 - DNA, 18 bp, Homo sapiens
atgcatgtcttttaaaat

SEQ ID NO: 3469736 - DNA, 20 bp, Homo sapiens
atgcatgttttccagctcct

SEQ ID NO: 3469737 - DNA, 21 bp, Homo sapiens
atgcattcttggttggctggc

SEQ ID NO: 3469738 - DNA, 19 bp, Homo sapiens
atgcattttgtttggtatt

SEQ ID NO: 3469739 - DNA, 22 bp, Homo sapiens
atgcattttgtttggtattgta

SEQ ID NO: 3469740 - DNA, 17 bp, Homo sapiens
atgccaagcactgtgct

SEQ ID NO: 3469741 - DNA, 16 bp, Homo sapiens
atgccacaaggacttc

SEQ ID NO: 3469742 - DNA, 19 bp, Homo sapiens
atgccacaaggacttcctg

SEQ ID NO: 3469743 - DNA, 15 bp, Homo sapiens
atgccacccacatct

SEQ ID NO: 3469744 - DNA, 14 bp, Homo sapiens
atgccactcctccc

SEQ ID NO: 3469745 - DNA, 16 bp, Homo sapiens
atgccactcctccctc

SEQ ID NO: 3469746 - DNA, 14 bp, Homo sapiens
atgccactgccttc

SEQ ID NO: 3469747 - DNA, 19 bp, Homo sapiens
atgccagcttggacatcag

SEQ ID NO: 3469748 - DNA, 15 bp, Homo sapiens
atgccaggatttctc

SEQ ID NO: 3469749 - DNA, 14 bp, Homo sapiens
atgccatcatctcc

SEQ ID NO: 3469750 - DNA, 15 bp, Homo sapiens
atgccatcatctcct

SEQ ID NO: 3469751 - DNA, 12 bp, Homo sapiens
atgccatcctca

SEQ ID NO: 3469752 - DNA, 23 bp, Homo sapiens
atgcccaggatttgactcgggcc

SEQ ID NO: 3469753 - DNA, 20 bp, Homo sapiens
atgcccctgtactccagcct

SEQ ID NO: 3469754 - DNA, 17 bp, Homo sapiens
atgcccggctaattttt

SEQ ID NO: 3469755 - DNA, 23 bp, Homo sapiens
atgccctcctctcccattgtccc

SEQ ID NO: 3469756 - DNA, 10 bp, Homo sapiens
atgccctctc

SEQ ID NO: 3469757 - DNA, 14 bp, Homo sapiens
atgccctggaggtg

SEQ ID NO: 3469758 - DNA, 16 bp, Homo sapiens
atgccgatttctgtaa

SEQ ID NO: 3469759 - DNA, 15 bp, Homo sapiens
atgcctcactaattt

SEQ ID NO: 3469760 - DNA, 16 bp, Homo sapiens
atgcctcactaatttt

SEQ ID NO: 3469761 - DNA, 21 bp, Homo sapiens
atgcctgattgccaagctcag

SEQ ID NO: 3469762 - DNA, 13 bp, Homo sapiens
atgcctggtggca

SEQ ID NO: 3469763 - DNA, 14 bp, Homo sapiens
atgcctggtggcag

SEQ ID NO: 3469764 - DNA, 15 bp, Homo sapiens
atgcctggtggcagc

SEQ ID NO: 3469765 - DNA, 16 bp, Homo sapiens
atgcctggtggcagct

SEQ ID NO: 3469766 - DNA, 21 bp, Homo sapiens
atgcctggtggcagctgcggt

SEQ ID NO: 3469767 - DNA, 16 bp, Homo sapiens
atgcctgtcctgaaag

SEQ ID NO: 3469768 - DNA, 18 bp, Homo sapiens
atgcctgtcctgaaagcg

SEQ ID NO: 3469769 - DNA, 12 bp, Homo sapiens
atgcgcagcccc

SEQ ID NO: 3469770 - DNA, 16 bp, Homo sapiens
atgcgcattctaacct

SEQ ID NO: 3469771 - DNA, 21 bp, Homo sapiens
atgcgcattctaacctggagg

SEQ ID NO: 3469772 - DNA, 13 bp, Homo sapiens
atgcgccccctcc

SEQ ID NO: 3469773 - DNA, 21 bp, Homo sapiens
atgctaagaatgcattattga

SEQ ID NO: 3469774 - DNA, 17 bp, Homo sapiens
atgctaatttaaagaga

SEQ ID NO: 3469775 - DNA, 16 bp, Homo sapiens
atgctacccagccatt

SEQ ID NO: 3469776 - DNA, 15 bp, Homo sapiens
atgctatgttctgtc

SEQ ID NO: 3469777 - DNA, 18 bp, Homo sapiens
atgctatgttctgtcttc

SEQ ID NO: 3469778 - DNA, 17 bp, Homo sapiens
atgctattgacaataaa

SEQ ID NO: 3469779 - DNA, 18 bp, Homo sapiens
atgctattgacaataaaa

SEQ ID NO: 3469780 - DNA, 13 bp, Homo sapiens
atgctatttgaac

SEQ ID NO: 3469781 - DNA, 15 bp, Homo sapiens
atgctatttgaacaa

SEQ ID NO: 3469782 - DNA, 14 bp, Homo sapiens
atgctcatctgctg

SEQ ID NO: 3469783 - DNA, 14 bp, Homo sapiens
atgctcctggccca

SEQ ID NO: 3469784 - DNA, 19 bp, Homo sapiens
atgctcctggcccactgca

SEQ ID NO: 3469785 - DNA, 17 bp, Homo sapiens
atgctctagtgccttct

SEQ ID NO: 3469786 - DNA, 13 bp, Homo sapiens
atgctctctcttc

SEQ ID NO: 3469787 - DNA, 18 bp, Homo sapiens
atgctctctcttcttatt

SEQ ID NO: 3469788 - DNA, 20 bp, Homo sapiens
atgctgacattcacctgccc

SEQ ID NO: 3469789 - DNA, 20 bp, Homo sapiens
atgctgagggtgtttcttcc

SEQ ID NO: 3469790 - DNA, 23 bp, Homo sapiens
atgctgagggtgtttcttcctgc

SEQ ID NO: 3469791 - DNA, 12 bp, Homo sapiens
atgctgatcatc

SEQ ID NO: 3469792 - DNA, 22 bp, Homo sapiens
atgctgatcatcgccagaggtg

SEQ ID NO: 3469793 - DNA, 24 bp, Homo sapiens
atgctgatcatcgccagaggtgct

SEQ ID NO: 3469794 - DNA, 15 bp, Homo sapiens
atgctgcaacaaaat

SEQ ID NO: 3469795 - DNA, 12 bp, Homo sapiens
atgctgcccctc

SEQ ID NO: 3469796 - DNA, 17 bp, Homo sapiens
atgctgccggcacagct

SEQ ID NO: 3469797 - DNA, 15 bp, Homo sapiens
atgctgctagatctt

SEQ ID NO: 3469798 - DNA, 17 bp, Homo sapiens
atgctgctagatcttta

SEQ ID NO: 3469799 - DNA, 13 bp, Homo sapiens
atgctgctggaca

SEQ ID NO: 3469800 - DNA, 14 bp, Homo sapiens
atgctgctggccaa

SEQ ID NO: 3469801 - DNA, 17 bp, Homo sapiens
atgctggaacctgcaaa

SEQ ID NO: 3469802 - DNA, 18 bp, Homo sapiens
atgctggaacctgcaaaa

SEQ ID NO: 3469803 - DNA, 23 bp, Homo sapiens
atgctggcatttgcacctacctc

SEQ ID NO: 3469804 - DNA, 22 bp, Homo sapiens
atgctggctgttggctgggggc

SEQ ID NO: 3469805 - DNA, 16 bp, Homo sapiens
atgctgtacatctatt

SEQ ID NO: 3469806 - DNA, 18 bp, Homo sapiens
atgctgtggagtcccaac

SEQ ID NO: 3469807 - DNA, 13 bp, Homo sapiens
atgcttaagattt

SEQ ID NO: 3469808 - DNA, 18 bp, Homo sapiens
atgcttacatctggaatc

SEQ ID NO: 3469809 - DNA, 21 bp, Homo sapiens
atgcttacatctggaatctga

SEQ ID NO: 3469810 - DNA, 23 bp, Homo sapiens
atgcttacgtgatcctctcacct

SEQ ID NO: 3469811 - DNA, 20 bp, Homo sapiens
atgcttagagggatttcttt

SEQ ID NO: 3469812 - DNA, 19 bp, Homo sapiens
atgcttatcatctaaagat

SEQ ID NO: 3469813 - DNA, 13 bp, Homo sapiens
atgcttctcactg

SEQ ID NO: 3469814 - DNA, 16 bp, Homo sapiens
atgcttctcactgcca

SEQ ID NO: 3469815 - DNA, 18 bp, Homo sapiens
atgctttagaaaggtttt

SEQ ID NO: 3469816 - DNA, 15 bp, Homo sapiens
atgctttccaaacct

SEQ ID NO: 3469817 - DNA, 12 bp, Homo sapiens
atgctttccttc

SEQ ID NO: 3469818 - DNA, 14 bp, Homo sapiens
atgctttccttctt

SEQ ID NO: 3469819 - DNA, 16 bp, Homo sapiens
atgctttgaaacagaa

SEQ ID NO: 3469820 - DNA, 13 bp, Homo sapiens
atgcttttgtcta

SEQ ID NO: 3469821 - DNA, 16 bp, Homo sapiens
atgctttttatttctg

SEQ ID NO: 3469822 - DNA, 18 bp, Homo sapiens
atggaaacatcactgggg

SEQ ID NO: 3469823 - DNA, 21 bp, Homo sapiens
atggaaagactgggacagccc

SEQ ID NO: 3469824 - DNA, 17 bp, Homo sapiens
atggaaccaggcttgga

SEQ ID NO: 3469825 - DNA, 16 bp, Homo sapiens
atggaaccgcaggaag

SEQ ID NO: 3469826 - DNA, 14 bp, Homo sapiens
atggaagacacatt

SEQ ID NO: 3469827 - DNA, 14 bp, Homo sapiens
atggaagccaacac

SEQ ID NO: 3469828 - DNA, 14 bp, Homo sapiens
atggaaggggcttc

SEQ ID NO: 3469829 - DNA, 18 bp, Homo sapiens
atggaaggggcttctgga

SEQ ID NO: 3469830 - DNA, 15 bp, Homo sapiens
atggaattgatttgc

SEQ ID NO: 3469831 - DNA, 16 bp, Homo sapiens
atggacagattaatat

SEQ ID NO: 3469832 - DNA, 14 bp, Homo sapiens
atggacaggctggc

SEQ ID NO: 3469833 - DNA, 15 bp, Homo sapiens
atggacggtgctcca

SEQ ID NO: 3469834 - DNA, 20 bp, Homo sapiens
atggacggtgctccaggcag

SEQ ID NO: 3469835 - DNA, 18 bp, Homo sapiens
atggagagaaaacagacc

SEQ ID NO: 3469836 - DNA, 13 bp, Homo sapiens
atggagcaagaga

SEQ ID NO: 3469837 - DNA, 17 bp, Homo sapiens
atggagctacgaaagga

SEQ ID NO: 3469838 - DNA, 22 bp, Homo sapiens
atggagctcagagagggcaggc

SEQ ID NO: 3469839 - DNA, 13 bp, Homo sapiens
atggagctggccg

SEQ ID NO: 3469840 - DNA, 22 bp, Homo sapiens
atggatgtgttattcttgccct

SEQ ID NO: 3469841 - DNA, 15 bp, Homo sapiens
atggatttaacagca

SEQ ID NO: 3469842 - DNA, 14 bp, Homo sapiens
atggcaacagatct

SEQ ID NO: 3469843 - DNA, 16 bp, Homo sapiens
atggcaacagatctgg

SEQ ID NO: 3469844 - DNA, 17 bp, Homo sapiens
atggcagagttgtaaat

SEQ ID NO: 3469845 - DNA, 18 bp, Homo sapiens
atggcagagttgtaaata

SEQ ID NO: 3469846 - DNA, 16 bp, Homo sapiens
atggcaggatggcctg

SEQ ID NO: 3469847 - DNA, 15 bp, Homo sapiens
atggccccagcacag

SEQ ID NO: 3469848 - DNA, 18 bp, Homo sapiens
atggccccagcacagctt

SEQ ID NO: 3469849 - DNA, 18 bp, Homo sapiens
atggccggagaggaccgg

SEQ ID NO: 3469850 - DNA, 21 bp, Homo sapiens
atggccgggcgcggtggctca

SEQ ID NO: 3469851 - DNA, 20 bp, Homo sapiens
atggcctcatgtggctggaa

SEQ ID NO: 3469852 - DNA, 16 bp, Homo sapiens
atggcctcttgaagag

SEQ ID NO: 3469853 - DNA, 12 bp, Homo sapiens
atggcctggcca

SEQ ID NO: 3469854 - DNA, 18 bp, Homo sapiens
atggctacctaaaaagat

SEQ ID NO: 3469855 - DNA, 11 bp, Homo sapiens
atggctgcctg

SEQ ID NO: 3469856 - DNA, 18 bp, Homo sapiens
atggcttatccagctggt

SEQ ID NO: 3469857 - DNA, 19 bp, Homo sapiens
atggcttatccagctggtg

SEQ ID NO: 3469858 - DNA, 13 bp, Homo sapiens
atgggaaagtatt

SEQ ID NO: 3469859 - DNA, 21 bp, Homo sapiens
atgggaaagtattctgtactc

SEQ ID NO: 3469860 - DNA, 19 bp, Homo sapiens
atgggacaaattgcacaga

SEQ ID NO: 3469861 - DNA, 12 bp, Homo sapiens
atgggaccacaa

SEQ ID NO: 3469862 - DNA, 19 bp, Homo sapiens
atgggaggtatgggctggg

SEQ ID NO: 3469863 - DNA, 20 bp, Homo sapiens
atgggaggtatgggctgggg

SEQ ID NO: 3469864 - DNA, 18 bp, Homo sapiens
atgggcaacccccagcct

SEQ ID NO: 3469865 - DNA, 19 bp, Homo sapiens
atgggcaacccccagcctg

SEQ ID NO: 3469866 - DNA, 21 bp, Homo sapiens
atgggcaacccccagcctgct

SEQ ID NO: 3469867 - DNA, 20 bp, Homo sapiens
atgggcaattccagaaatct

SEQ ID NO: 3469868 - DNA, 14 bp, Homo sapiens
atgggcagagccca

SEQ ID NO: 3469869 - DNA, 17 bp, Homo sapiens
atgggcctcctgtgtgt

SEQ ID NO: 3469870 - DNA, 22 bp, Homo sapiens
atgggcctgaactcggacaagt

SEQ ID NO: 3469871 - DNA, 22 bp, Homo sapiens
atgggcctgccgggctgagggc

SEQ ID NO: 3469872 - DNA, 13 bp, Homo sapiens
atgggctgggggc

SEQ ID NO: 3469873 - DNA, 16 bp, Homo sapiens
atgggcttagagcagt

SEQ ID NO: 3469874 - DNA, 22 bp, Homo sapiens
atggggagacagttgagagcgg

SEQ ID NO: 3469875 - DNA, 11 bp, Homo sapiens
atggggagggg

SEQ ID NO: 3469876 - DNA, 14 bp, Homo sapiens
atggggccagatcc

SEQ ID NO: 3469877 - DNA, 22 bp, Homo sapiens
atggggccagatccagcctggg

SEQ ID NO: 3469878 - DNA, 20 bp, Homo sapiens
atggggctgcgggacagagg

SEQ ID NO: 3469879 - DNA, 16 bp, Homo sapiens
atgggggaaagcacag

SEQ ID NO: 3469880 - DNA, 19 bp, Homo sapiens
atgggggaactcagatcca

SEQ ID NO: 3469881 - DNA, 21 bp, Homo sapiens
atgggggaactcagatccagg

SEQ ID NO: 3469882 - DNA, 21 bp, Homo sapiens
atgggggagtctgaagcagat

SEQ ID NO: 3469883 - DNA, 16 bp, Homo sapiens
atgggggcagggctgt

SEQ ID NO: 3469884 - DNA, 17 bp, Homo sapiens
atggggtctgtaaaatc

SEQ ID NO: 3469885 - DNA, 18 bp, Homo sapiens
atggggtctgtaaaatct

SEQ ID NO: 3469886 - DNA, 17 bp, Homo sapiens
atgggtgaaggctggca

SEQ ID NO: 3469887 - DNA, 16 bp, Homo sapiens
atgggttttatgagat

SEQ ID NO: 3469888 - DNA, 16 bp, Homo sapiens
atggtaagacctctga

SEQ ID NO: 3469889 - DNA, 18 bp, Homo sapiens
atggtaggcatttcctat

SEQ ID NO: 3469890 - DNA, 14 bp, Homo sapiens
atggtcacacactg

SEQ ID NO: 3469891 - DNA, 20 bp, Homo sapiens
atggtcacacactgatgctt

SEQ ID NO: 3469892 - DNA, 19 bp, Homo sapiens
atggtccaggagaaggcca

SEQ ID NO: 3469893 - DNA, 16 bp, Homo sapiens
atggtctggtctatgt

SEQ ID NO: 3469894 - DNA, 24 bp, Homo sapiens
atggtgaaaccccgtctctactaa

SEQ ID NO: 3469895 - DNA, 14 bp, Homo sapiens
atggtgccccagga

SEQ ID NO: 3469896 - DNA, 15 bp, Homo sapiens
atggtgccccaggac

SEQ ID NO: 3469897 - DNA, 20 bp, Homo sapiens
atggtgctacgcctgcatgt

SEQ ID NO: 3469898 - DNA, 14 bp, Homo sapiens
atggtgctgagaag

SEQ ID NO: 3469899 - DNA, 23 bp, Homo sapiens
atggtggaggattgctgccagag

SEQ ID NO: 3469900 - DNA, 22 bp, Homo sapiens
atggtggcacattcctttgggt

SEQ ID NO: 3469901 - DNA, 13 bp, Homo sapiens
atggtggctgggt

SEQ ID NO: 3469902 - DNA, 17 bp, Homo sapiens
atggtggctgggttgga

SEQ ID NO: 3469903 - DNA, 17 bp, Homo sapiens
atggtgggcttcagggc

SEQ ID NO: 3469904 - DNA, 23 bp, Homo sapiens
atggtgggcttcagggcaggtgg

SEQ ID NO: 3469905 - DNA, 18 bp, Homo sapiens
atggtgtctcttctttag

SEQ ID NO: 3469906 - DNA, 20 bp, Homo sapiens
atggtgtgggtgtcctgcct

SEQ ID NO: 3469907 - DNA, 14 bp, Homo sapiens
atggtgtgttacac

SEQ ID NO: 3469908 - DNA, 13 bp, Homo sapiens
atggttctgtgcc

SEQ ID NO: 3469909 - DNA, 21 bp, Homo sapiens
atggttgtattagatgttctc

SEQ ID NO: 3469910 - DNA, 23 bp, Homo sapiens
atggttgtgtatgggtagcacta

SEQ ID NO: 3469911 - DNA, 15 bp, Homo sapiens
atggtttgtcctgat

SEQ ID NO: 3469912 - DNA, 21 bp, Homo sapiens
atggtttttaaattttgtaat

SEQ ID NO: 3469913 - DNA, 15 bp, Homo sapiens
tgtgagcccagctgg

SEQ ID NO: 3469914 - DNA, 13 bp, Homo sapiens
tgtgaggccaggg

SEQ ID NO: 3469915 - DNA, 15 bp, Homo sapiens
tgtgagtcaccaagc

SEQ ID NO: 3469916 - DNA, 19 bp, Homo sapiens
tgtgagtcaccaagcccag

SEQ ID NO: 3469917 - DNA, 17 bp, Homo sapiens
tgtgagtgaaagttgcc

SEQ ID NO: 3469918 - DNA, 19 bp, Homo sapiens
tgtgagtgaaagttgccat

SEQ ID NO: 3469919 - DNA, 17 bp, Homo sapiens
tgtgatacatttctgaa

SEQ ID NO: 3469920 - DNA, 18 bp, Homo sapiens
tgtgatacatttctgaat

SEQ ID NO: 3469921 - DNA, 14 bp, Homo sapiens
tgtgatattaacag

SEQ ID NO: 3469922 - DNA, 16 bp, Homo sapiens
tgtgatgaatactgta

SEQ ID NO: 3469923 - DNA, 18 bp, Homo sapiens
tgtgatgaatactgtatt

SEQ ID NO: 3469924 - DNA, 16 bp, Homo sapiens
tgtgatgtacacattt

SEQ ID NO: 3469925 - DNA, 15 bp, Homo sapiens
tgtgatgtgaagcca

SEQ ID NO: 3469926 - DNA, 19 bp, Homo sapiens
tgtgattgcacgtgcctgt

SEQ ID NO: 3469927 - DNA, 21 bp, Homo sapiens
tgtgattgcacgtgcctgtgg

SEQ ID NO: 3469928 - DNA, 14 bp, Homo sapiens
tgtgattttaactc

SEQ ID NO: 3469929 - DNA, 20 bp, Homo sapiens
tgtgattttaactctgtctt

SEQ ID NO: 3469930 - DNA, 18 bp, Homo sapiens
tgtgcaacagggtatgga

SEQ ID NO: 3469931 - DNA, 20 bp, Homo sapiens
tgtgcaacagggtatggact

SEQ ID NO: 3469932 - DNA, 20 bp, Homo sapiens
tgtgcacatctctgcttgag

SEQ ID NO: 3469933 - DNA, 20 bp, Homo sapiens
tgtgcacatctgtgtcttgt

SEQ ID NO: 3469934 - DNA, 13 bp, Homo sapiens
tgtgcacatcttc

SEQ ID NO: 3469935 - DNA, 14 bp, Homo sapiens
tgtgcaccagggtt

SEQ ID NO: 3469936 - DNA, 21 bp, Homo sapiens
tgtgcactgcccatggacagg

SEQ ID NO: 3469937 - DNA, 19 bp, Homo sapiens
tgtgcagccgctgagcgag

SEQ ID NO: 3469938 - DNA, 20 bp, Homo sapiens
tgtgcatatgcatgtgtgtg

SEQ ID NO: 3469939 - DNA, 22 bp, Homo sapiens
tgtgcattcttttaaaagacaa

SEQ ID NO: 3469940 - DNA, 23 bp, Homo sapiens
ttcgtgagccccatcttcaccca

SEQ ID NO: 3469941 - DNA, 13 bp, Homo sapiens
ttcgtggggaggt

SEQ ID NO: 3469942 - DNA, 17 bp, Homo sapiens
ttcgttcgcagagcttt

SEQ ID NO: 3469943 - DNA, 12 bp, Homo sapiens
ttcgttctgtgg

SEQ ID NO: 3469944 - DNA, 14 bp, Homo sapiens
ttcgttctttttaa

SEQ ID NO: 3469945 - DNA, 19 bp, Homo sapiens
ttctaaacccaatccaaat

SEQ ID NO: 3469946 - DNA, 12 bp, Homo sapiens
ttctaatagaac

SEQ ID NO: 3469947 - DNA, 22 bp, Homo sapiens
ttctaattaaccttactaatta

SEQ ID NO: 3469948 - DNA, 18 bp, Homo sapiens
ttctacaatgtgaacttt

SEQ ID NO: 3469949 - DNA, 19 bp, Homo sapiens
ttctacaatgtgaacttta

SEQ ID NO: 3469950 - DNA, 19 bp, Homo sapiens
ttctagaaagtactttggc

SEQ ID NO: 3469951 - DNA, 21 bp, Homo sapiens
ttctagaggctcatggccctg

SEQ ID NO: 3469952 - DNA, 22 bp, Homo sapiens
ttctagaggctcatggccctgt

SEQ ID NO: 3469953 - DNA, 18 bp, Homo sapiens
ttctagatacaataaatt

SEQ ID NO: 3469954 - DNA, 21 bp, Homo sapiens
ttctagctgttgagctgtttt

SEQ ID NO: 3469955 - DNA, 21 bp, Homo sapiens
ttctaggcaaaattgtgaagc

SEQ ID NO: 3469956 - DNA, 21 bp, Homo sapiens
ttctagtgtaacactgcaaga

SEQ ID NO: 3469957 - DNA, 23 bp, Homo sapiens
ttctagttttcagtttgtatata

SEQ ID NO: 3469958 - DNA, 13 bp, Homo sapiens
ttctataaggcca

SEQ ID NO: 3469959 - DNA, 14 bp, Homo sapiens
ttctataatttaaa

SEQ ID NO: 3469960 - DNA, 22 bp, Homo sapiens
ttctatgtagtggttttaggat

SEQ ID NO: 3469961 - DNA, 14 bp, Homo sapiens
ttctattgaattcg

SEQ ID NO: 3469962 - DNA, 17 bp, Homo sapiens
ttctattgactttctta

SEQ ID NO: 3469963 - DNA, 19 bp, Homo sapiens
ttctattgactttcttaaa

SEQ ID NO: 3469964 - DNA, 19 bp, Homo sapiens
ttctatttctcctccatgg

SEQ ID NO: 3469965 - DNA, 16 bp, Homo sapiens
ttctcaccagctgcaa

SEQ ID NO: 3469966 - DNA, 23 bp, Homo sapiens
ttctcagaatctacccaaaggat

SEQ ID NO: 3469967 - DNA, 19 bp, Homo sapiens
ttctcagggtctctgctgc

SEQ ID NO: 3469968 - DNA, 21 bp, Homo sapiens
ttctcattaacaatattttat

SEQ ID NO: 3469969 - DNA, 16 bp, Homo sapiens
ttctcattcctgttct

SEQ ID NO: 3469970 - DNA, 11 bp, Homo sapiens
ttctcatttag

SEQ ID NO: 3469971 - DNA, 16 bp, Homo sapiens
ttctccaccctgctct

SEQ ID NO: 3469972 - DNA, 21 bp, Homo sapiens
ttctccacctcccacaaagga

SEQ ID NO: 3469973 - DNA, 17 bp, Homo sapiens
ttctccactcagttgca

SEQ ID NO: 3469974 - DNA, 11 bp, Homo sapiens
ttctccaggct

SEQ ID NO: 3469975 - DNA, 18 bp, Homo sapiens
ttctccatggccctgcca

SEQ ID NO: 3469976 - DNA, 22 bp, Homo sapiens
ttctccccaatgagacttgcct

SEQ ID NO: 3469977 - DNA, 16 bp, Homo sapiens
ttctcccctgccccca

SEQ ID NO: 3469978 - DNA, 18 bp, Homo sapiens
ttctcccctgcccccagg

SEQ ID NO: 3469979 - DNA, 17 bp, Homo sapiens
ttctccgttagctcctg

SEQ ID NO: 3469980 - DNA, 14 bp, Homo sapiens
ttctcctaaagctt

SEQ ID NO: 3469981 - DNA, 15 bp, Homo sapiens
ttctcctatgtgtaa

SEQ ID NO: 3469982 - DNA, 14 bp, Homo sapiens
ttctcctcttgtaa

SEQ ID NO: 3469983 - DNA, 19 bp, Homo sapiens
ttctcctcttgtaaataaa

SEQ ID NO: 3469984 - DNA, 22 bp, Homo sapiens
ttctcctcttgtaaataaagcc

SEQ ID NO: 3469985 - DNA, 10 bp, Homo sapiens
ttctcctgga

SEQ ID NO: 3469986 - DNA, 20 bp, Homo sapiens
ttctccttcagccctcaccc

SEQ ID NO: 3469987 - DNA, 13 bp, Homo sapiens
ttctccttggagg

SEQ ID NO: 3469988 - DNA, 12 bp, Homo sapiens
ttctcctttgta

SEQ ID NO: 3469989 - DNA, 22 bp, Homo sapiens
ttctcgctcccgccagcagcat

SEQ ID NO: 3469990 - DNA, 17 bp, Homo sapiens
ttctctactctagggaa

SEQ ID NO: 3469991 - DNA, 16 bp, Homo sapiens
ttctctataaaaaata

SEQ ID NO: 3469992 - DNA, 15 bp, Homo sapiens
ttctctatgataatt

SEQ ID NO: 3469993 - DNA, 19 bp, Homo sapiens
ttctctcaaccttggcctt

SEQ ID NO: 3469994 - DNA, 21 bp, Homo sapiens
ttctctcaaccttggccttct

SEQ ID NO: 3469995 - DNA, 22 bp, Homo sapiens
ttctctcaaccttggccttctc

SEQ ID NO: 3469996 - DNA, 22 bp, Homo sapiens
ttctctcctgtcctccctcacc

SEQ ID NO: 3469997 - DNA, 11 bp, Homo sapiens
ttctctgactt

SEQ ID NO: 3469998 - DNA, 12 bp, Homo sapiens
ttctctgacttc

SEQ ID NO: 3469999 - DNA, 16 bp, Homo sapiens
ttctctgagctgtgca

SEQ ID NO: 3470000 - DNA, 17 bp, Homo sapiens
ttctctgagctgtgcag

SEQ ID NO: 3470001 - DNA, 21 bp, Homo sapiens
ttctctgccgctacctccctc

SEQ ID NO: 3470002 - DNA, 17 bp, Homo sapiens
ttctctgctcacagaag

SEQ ID NO: 3470003 - DNA, 15 bp, Homo sapiens
ttctctgggagaaaa

SEQ ID NO: 3470004 - DNA, 16 bp, Homo sapiens
ttctctgggagaaaat

SEQ ID NO: 3470005 - DNA, 21 bp, Homo sapiens
ttctctgtacttttcattctc

SEQ ID NO: 3470006 - DNA, 22 bp, Homo sapiens
ttctcttgcattgtgacaagaa

SEQ ID NO: 3470007 - DNA, 16 bp, Homo sapiens
ttctcttttcaaaaca

SEQ ID NO: 3470008 - DNA, 23 bp, Homo sapiens
ttctgaaagtaaaacaatttatg

SEQ ID NO: 3470009 - DNA, 13 bp, Homo sapiens
ttctgaatttgca

SEQ ID NO: 3470010 - DNA, 14 bp, Homo sapiens
ttctgaatttgcaa

SEQ ID NO: 3470011 - DNA, 19 bp, Homo sapiens
ttctgaatttgcaaagtac

SEQ ID NO: 3470012 - DNA, 22 bp, Homo sapiens
ttctgaatttgcaaagtactgt

SEQ ID NO: 3470013 - DNA, 21 bp, Homo sapiens
ttctgacagtttttctgtttt

SEQ ID NO: 3470014 - DNA, 19 bp, Homo sapiens
ttctgactcggtttctcca

SEQ ID NO: 3470015 - DNA, 14 bp, Homo sapiens
ttctgagacagctt

SEQ ID NO: 3470016 - DNA, 19 bp, Homo sapiens
ttctgagattcaatattga

SEQ ID NO: 3470017 - DNA, 15 bp, Homo sapiens
ttctgagtgccttct

SEQ ID NO: 3470018 - DNA, 18 bp, Homo sapiens
ttctgagtgccttctgtg

SEQ ID NO: 3470019 - DNA, 22 bp, Homo sapiens
ttctgatcaaggccttattgga

SEQ ID NO: 3470020 - DNA, 10 bp, Homo sapiens
ttctgattct

SEQ ID NO: 3470021 - DNA, 22 bp, Homo sapiens
ttctgcaagcacatctgcattt

SEQ ID NO: 3470022 - DNA, 12 bp, Homo sapiens
ttctgcacagct

SEQ ID NO: 3470023 - DNA, 17 bp, Homo sapiens
ttctgcacagcttttcc

SEQ ID NO: 3470024 - DNA, 16 bp, Homo sapiens
ttctgcaccttgccag

SEQ ID NO: 3470025 - DNA, 17 bp, Homo sapiens
ttctgcaccttgccagg

SEQ ID NO: 3470026 - DNA, 12 bp, Homo sapiens
ttctgcagaaga

SEQ ID NO: 3470027 - DNA, 22 bp, Homo sapiens
ttctgcatatgttgaatacttt

SEQ ID NO: 3470028 - DNA, 23 bp, Homo sapiens
ttctgcatatgttgaatactttt

SEQ ID NO: 3470029 - DNA, 13 bp, Homo sapiens
ttctgcatttagc

SEQ ID NO: 3470030 - DNA, 14 bp, Homo sapiens
ttctgcatttagct

SEQ ID NO: 3470031 - DNA, 19 bp, Homo sapiens
ttctgcatttagctgtatt

SEQ ID NO: 3470032 - DNA, 20 bp, Homo sapiens
ttctgcatttagctgtattc

SEQ ID NO: 3470033 - DNA, 17 bp, Homo sapiens
ttctgcctcctttagta

SEQ ID NO: 3470034 - DNA, 17 bp, Homo sapiens
ttctgcctgccagctgc

SEQ ID NO: 3470035 - DNA, 18 bp, Homo sapiens
ttctgcctgcccaggccc

SEQ ID NO: 3470036 - DNA, 10 bp, Homo sapiens
ttctgccttt

SEQ ID NO: 3470037 - DNA, 15 bp, Homo sapiens
ttctgcctttgatgt

SEQ ID NO: 3470038 - DNA, 23 bp, Homo sapiens
ttctgcctttgatgttacagatt

SEQ ID NO: 3470039 - DNA, 13 bp, Homo sapiens
ttctgctcatcat

SEQ ID NO: 3470040 - DNA, 16 bp, Homo sapiens
ttctgcttcagcctcc

SEQ ID NO: 3470041 - DNA, 15 bp, Homo sapiens
ttctgctttcatctt

SEQ ID NO: 3470042 - DNA, 14 bp, Homo sapiens
ttctgctttctccc

SEQ ID NO: 3470043 - DNA, 17 bp, Homo sapiens
ttctggaaatgttcttt

SEQ ID NO: 3470044 - DNA, 14 bp, Homo sapiens
ttctggaatttgtt

SEQ ID NO: 3470045 - DNA, 20 bp, Homo sapiens
ttctggaatttgttcaagtt

SEQ ID NO: 3470046 - DNA, 21 bp, Homo sapiens
ttctggaatttgttcaagttt

SEQ ID NO: 3470047 - DNA, 22 bp, Homo sapiens
ttctggaatttgttcaagtttt

SEQ ID NO: 3470048 - DNA, 17 bp, Homo sapiens
ttctggagatggaagct

SEQ ID NO: 3470049 - DNA, 23 bp, Homo sapiens
ttctggagatggaagcttgttga

SEQ ID NO: 3470050 - DNA, 18 bp, Homo sapiens
ttctggatggtgtgcctt

SEQ ID NO: 3470051 - DNA, 20 bp, Homo sapiens
ttctggatggtgtgccttcc

SEQ ID NO: 3470052 - DNA, 23 bp, Homo sapiens
ttctggatggtgtgccttccaga

SEQ ID NO: 3470053 - DNA, 22 bp, Homo sapiens
ttctgggacacagttcaattct

SEQ ID NO: 3470054 - DNA, 15 bp, Homo sapiens
ttctgggcctgacca

SEQ ID NO: 3470055 - DNA, 20 bp, Homo sapiens
ttctgggtttgaagctgctg

SEQ ID NO: 3470056 - DNA, 15 bp, Homo sapiens
ttctgggttttctga

SEQ ID NO: 3470057 - DNA, 19 bp, Homo sapiens
ttctgtaagaaacctactg

SEQ ID NO: 3470058 - DNA, 18 bp, Homo sapiens
ttctgtacttagaaagta

SEQ ID NO: 3470059 - DNA, 13 bp, Homo sapiens
ttctgtagaaatg

SEQ ID NO: 3470060 - DNA, 18 bp, Homo sapiens
ttctgtagaaatggttgt

SEQ ID NO: 3470061 - DNA, 22 bp, Homo sapiens
ttctgtagaaatggttgtatta

SEQ ID NO: 3470062 - DNA, 16 bp, Homo sapiens
ttctgtatatactttt

SEQ ID NO: 3470063 - DNA, 17 bp, Homo sapiens
ttctgtcctactctgtg

SEQ ID NO: 3470064 - DNA, 15 bp, Homo sapiens
ttctgtctctctctt

SEQ ID NO: 3470065 - DNA, 14 bp, Homo sapiens
ttctgtcttcccaa

SEQ ID NO: 3470066 - DNA, 21 bp, Homo sapiens
ttctgtcttgttcattttgag

SEQ ID NO: 3470067 - DNA, 18 bp, Homo sapiens
ttctgtggggactccggc

SEQ ID NO: 3470068 - DNA, 16 bp, Homo sapiens
ttctgtggggcccctc

SEQ ID NO: 3470069 - DNA, 22 bp, Homo sapiens
ttctgtggggcccctcacctac

SEQ ID NO: 3470070 - DNA, 16 bp, Homo sapiens
ttctgttctggaggaa

SEQ ID NO: 3470071 - DNA, 13 bp, Homo sapiens
ttctgtttcctgt

SEQ ID NO: 3470072 - DNA, 18 bp, Homo sapiens
ttctgtttcctgtaccag

SEQ ID NO: 3470073 - DNA, 16 bp, Homo sapiens
ttctgtttggaggagc

SEQ ID NO: 3470074 - DNA, 23 bp, Homo sapiens
ttctgttttgtttggcaaggaaa

SEQ ID NO: 3470075 - DNA, 23 bp, Homo sapiens
ttcttaacaaactcttcagttaa

SEQ ID NO: 3470076 - DNA, 15 bp, Homo sapiens
ttccacaccttttat

SEQ ID NO: 3470077 - DNA, 15 bp, Homo sapiens
ttccaccacagccag

SEQ ID NO: 3470078 - DNA, 16 bp, Homo sapiens
ttccaccacagccagc

SEQ ID NO: 3470079 - DNA, 21 bp, Homo sapiens
ttccaccacagccagcacctg

SEQ ID NO: 3470080 - DNA, 24 bp, Homo sapiens
ttccacggagccactcctctgact

SEQ ID NO: 3470081 - DNA, 15 bp, Homo sapiens
ttccactattttcaa

SEQ ID NO: 3470082 - DNA, 16 bp, Homo sapiens
ttccactgagggcagt

SEQ ID NO: 3470083 - DNA, 12 bp, Homo sapiens
ttccacttggct

SEQ ID NO: 3470084 - DNA, 11 bp, Homo sapiens
ttccagaatcc

SEQ ID NO: 3470085 - DNA, 15 bp, Homo sapiens
ttccagaatgctgta

SEQ ID NO: 3470086 - DNA, 15 bp, Homo sapiens
ttccagatcccaggc

SEQ ID NO: 3470087 - DNA, 16 bp, Homo sapiens
ttccagatcctctctg

SEQ ID NO: 3470088 - DNA, 22 bp, Homo sapiens
ttccagcagaagacaaaaagac

SEQ ID NO: 3470089 - DNA, 12 bp, Homo sapiens
ttccagccaggg

SEQ ID NO: 3470090 - DNA, 17 bp, Homo sapiens
ttccagcccctctggtc

SEQ ID NO: 3470091 - DNA, 13 bp, Homo sapiens
ttccagcttagaa

SEQ ID NO: 3470092 - DNA, 21 bp, Homo sapiens
ttccaggaggagttagccaaa

SEQ ID NO: 3470093 - DNA, 21 bp, Homo sapiens
ttccaggctaaacatccaata

SEQ ID NO: 3470094 - DNA, 19 bp, Homo sapiens
ttccagggatttgcctcac

SEQ ID NO: 3470095 - DNA, 23 bp, Homo sapiens
ttccagggatttgcctcaccttg

SEQ ID NO: 3470096 - DNA, 16 bp, Homo sapiens
ttccagggtccctctg

SEQ ID NO: 3470097 - DNA, 20 bp, Homo sapiens
ttccagtaggaaaagcaatg

SEQ ID NO: 3470098 - DNA, 21 bp, Homo sapiens
ttccagttcatctatggcagt

SEQ ID NO: 3470099 - DNA, 17 bp, Homo sapiens
ttccatagctgctgccc

SEQ ID NO: 3470100 - DNA, 11 bp, Homo sapiens
ttccatatatt

SEQ ID NO: 3470101 - DNA, 18 bp, Homo sapiens
ttccatctttacaaaact

SEQ ID NO: 3470102 - DNA, 18 bp, Homo sapiens
ttccatgatgctgggatt

SEQ ID NO: 3470103 - DNA, 17 bp, Homo sapiens
ttccatggcaggaaggc

SEQ ID NO: 3470104 - DNA, 19 bp, Homo sapiens
ttccatggcaggaaggctt

SEQ ID NO: 3470105 - DNA, 17 bp, Homo sapiens
ttccatggccctcatta

SEQ ID NO: 3470106 - DNA, 20 bp, Homo sapiens
ttccattctggattttgtca

SEQ ID NO: 3470107 - DNA, 21 bp, Homo sapiens
ttccattgctttgaaaaagtt

SEQ ID NO: 3470108 - DNA, 17 bp, Homo sapiens
ttccattggatctcatt

SEQ ID NO: 3470109 - DNA, 15 bp, Homo sapiens
ttcccaacgtgcaaa

SEQ ID NO: 3470110 - DNA, 18 bp, Homo sapiens
ttcccaactctagctggg

SEQ ID NO: 3470111 - DNA, 16 bp, Homo sapiens
ttcccaagatgcctga

SEQ ID NO: 3470112 - DNA, 11 bp, Homo sapiens
ttcccaagctc

SEQ ID NO: 3470113 - DNA, 18 bp, Homo sapiens
ttcccaagctctgctcct

SEQ ID NO: 3470114 - DNA, 10 bp, Homo sapiens
ttcccactgc

SEQ ID NO: 3470115 - DNA, 22 bp, Homo sapiens
ttcccagcagtggactcaaaac

SEQ ID NO: 3470116 - DNA, 12 bp, Homo sapiens
ttcccaggaccc

SEQ ID NO: 3470117 - DNA, 21 bp, Homo sapiens
ttcccataccacccaatgctg

SEQ ID NO: 3470118 - DNA, 18 bp, Homo sapiens
ttcccatgacccaggctg

SEQ ID NO: 3470119 - DNA, 21 bp, Homo sapiens
ttccccactgacagcctccca

SEQ ID NO: 3470120 - DNA, 11 bp, Homo sapiens
ttccccagaga

SEQ ID NO: 3470121 - DNA, 14 bp, Homo sapiens
ttcccccctaagct

SEQ ID NO: 3470122 - DNA, 20 bp, Homo sapiens
ttccccgaagagtcagcccc

SEQ ID NO: 3470123 - DNA, 11 bp, Homo sapiens
ttcccctgtgt

SEQ ID NO: 3470124 - DNA, 13 bp, Homo sapiens
ttcccctgtgtca

SEQ ID NO: 3470125 - DNA, 17 bp, Homo sapiens
ttcccgccggaggccag

SEQ ID NO: 3470126 - DNA, 18 bp, Homo sapiens
ttcccgccggaggccagc

SEQ ID NO: 3470127 - DNA, 19 bp, Homo sapiens
ttcccgccggaggccagct

SEQ ID NO: 3470128 - DNA, 20 bp, Homo sapiens
ttcccgccggaggccagcta

SEQ ID NO: 3470129 - DNA, 17 bp, Homo sapiens
ttcccgggccagggctg

SEQ ID NO: 3470130 - DNA, 15 bp, Homo sapiens
ttccctattagagaa

SEQ ID NO: 3470131 - DNA, 23 bp, Homo sapiens
ttccctccatccccctttaccct

SEQ ID NO: 3470132 - DNA, 13 bp, Homo sapiens
ttccctgactcat

SEQ ID NO: 3470133 - DNA, 14 bp, Homo sapiens
ttccctgtgtcttt

SEQ ID NO: 3470134 - DNA, 15 bp, Homo sapiens
ttccctgtgtctttt

SEQ ID NO: 3470135 - DNA, 15 bp, Homo sapiens
ttccctttgtgcaca

SEQ ID NO: 3470136 - DNA, 22 bp, Homo sapiens
ttccgactctttctgagtgcct

SEQ ID NO: 3470137 - DNA, 13 bp, Homo sapiens
ttccgcttggagc

SEQ ID NO: 3470138 - DNA, 22 bp, Homo sapiens
ttccgggcagaaacaataaaac

SEQ ID NO: 3470139 - DNA, 21 bp, Homo sapiens
ttccgtcaacgttgtactgta

SEQ ID NO: 3470140 - DNA, 17 bp, Homo sapiens
ttcctaagcctgtggct

SEQ ID NO: 3470141 - DNA, 19 bp, Homo sapiens
ttcctaagcctgtggctgt

SEQ ID NO: 3470142 - DNA, 15 bp, Homo sapiens
ttcctaataaagttc

SEQ ID NO: 3470143 - DNA, 16 bp, Homo sapiens
ttcctaataaagttct

SEQ ID NO: 3470144 - DNA, 19 bp, Homo sapiens
ttcctaataaagttctgta

SEQ ID NO: 3470145 - DNA, 22 bp, Homo sapiens
ttcctaataaagttctgtactc

SEQ ID NO: 3470146 - DNA, 19 bp, Homo sapiens
ttcctaatatcaaatgcag

SEQ ID NO: 3470147 - DNA, 20 bp, Homo sapiens
ttcctagttctgtagaaatg

SEQ ID NO: 3470148 - DNA, 22 bp, Homo sapiens
ttcctatatagtttattgacaa

SEQ ID NO: 3470149 - DNA, 18 bp, Homo sapiens
ttcctatgacacagttat

SEQ ID NO: 3470150 - DNA, 18 bp, Homo sapiens
ttcctatgctattgacaa

SEQ ID NO: 3470151 - DNA, 16 bp, Homo sapiens
ttcctatgctttgaaa

SEQ ID NO: 3470152 - DNA, 19 bp, Homo sapiens
ttcctattccaagcttcca

SEQ ID NO: 3470153 - DNA, 16 bp, Homo sapiens
ttcctatttttaaata

SEQ ID NO: 3470154 - DNA, 22 bp, Homo sapiens
ttcctatttttaaataatttcc

SEQ ID NO: 3470155 - DNA, 21 bp, Homo sapiens
ttcctcacaccaggcttgcct

SEQ ID NO: 3470156 - DNA, 17 bp, Homo sapiens
ttcctcattaaattacc

SEQ ID NO: 3470157 - DNA, 22 bp, Homo sapiens
ttcctccctgcttaaaaatgta

SEQ ID NO: 3470158 - DNA, 12 bp, Homo sapiens
ttcctcccttct

SEQ ID NO: 3470159 - DNA, 11 bp, Homo sapiens
ttcctcctgga

SEQ ID NO: 3470160 - DNA, 17 bp, Homo sapiens
ttcctctagttctttgt

SEQ ID NO: 3470161 - DNA, 15 bp, Homo sapiens
ttcctctctatattt

SEQ ID NO: 3470162 - DNA, 16 bp, Homo sapiens
ttcctctctatatttc

SEQ ID NO: 3470163 - DNA, 14 bp, Homo sapiens
ttcctctctccaga

SEQ ID NO: 3470164 - DNA, 15 bp, Homo sapiens
ttcctctctccagat

SEQ ID NO: 3470165 - DNA, 13 bp, Homo sapiens
ttcctctgcaagt

SEQ ID NO: 3470166 - DNA, 16 bp, Homo sapiens
ttcctctgcaagtgct

SEQ ID NO: 3470167 - DNA, 19 bp, Homo sapiens
ttcctctgcaagtgctcag

SEQ ID NO: 3470168 - DNA, 12 bp, Homo sapiens
ttcctctgggaa

SEQ ID NO: 3470169 - DNA, 22 bp, Homo sapiens
ttcctctttttatttagttcct

SEQ ID NO: 3470170 - DNA, 15 bp, Homo sapiens
ttcctgaaatgcagt

SEQ ID NO: 3470171 - DNA, 16 bp, Homo sapiens
ttcctgaagaaccagt

SEQ ID NO: 3470172 - DNA, 19 bp, Homo sapiens
ttcctgaagaaccagtccc

SEQ ID NO: 3470173 - DNA, 15 bp, Homo sapiens
ttcctgacattgtct

SEQ ID NO: 3470174 - DNA, 14 bp, Homo sapiens
ttcctgataataaa

SEQ ID NO: 3470175 - DNA, 16 bp, Homo sapiens
ttcctggagcccagag

SEQ ID NO: 3470176 - DNA, 19 bp, Homo sapiens
ttcctggaggtcagcattt

SEQ ID NO: 3470177 - DNA, 14 bp, Homo sapiens
ttcctggcctgaga

SEQ ID NO: 3470178 - DNA, 17 bp, Homo sapiens
ttcctgggaaatattcc

SEQ ID NO: 3470179 - DNA, 22 bp, Homo sapiens
ttcctgtccagctccaacctgc

SEQ ID NO: 3470180 - DNA, 23 bp, Homo sapiens
ttcctgtcccaccatacgagcac

SEQ ID NO: 3470181 - DNA, 18 bp, Homo sapiens
ttcctgtccccatctgtc

SEQ ID NO: 3470182 - DNA, 23 bp, Homo sapiens
ttcctgtccctgcgcctttcctt

SEQ ID NO: 3470183 - DNA, 17 bp, Homo sapiens
ttcctgtgatacatttc

SEQ ID NO: 3470184 - DNA, 21 bp, Homo sapiens
ttcctgtgtgtccaaaactgc

SEQ ID NO: 3470185 - DNA, 19 bp, Homo sapiens
ttcctgttcagtaataaaa

SEQ ID NO: 3470186 - DNA, 17 bp, Homo sapiens
ttccttcacatcctgtg

SEQ ID NO: 3470187 - DNA, 21 bp, Homo sapiens
ttccttcgaaaggccttcaga

SEQ ID NO: 3470188 - DNA, 21 bp, Homo sapiens
ttccttgacctgcattgtaaa

SEQ ID NO: 3470189 - DNA, 20 bp, Homo sapiens
ttccttgagttgattcagct

SEQ ID NO: 3470190 - DNA, 13 bp, Homo sapiens
ttccttgcctgca

SEQ ID NO: 3470191 - DNA, 15 bp, Homo sapiens
ttccttggctttatg

SEQ ID NO: 3470192 - DNA, 14 bp, Homo sapiens
ttccttggggcagg

SEQ ID NO: 3470193 - DNA, 17 bp, Homo sapiens
ttccttggggcaggcag

SEQ ID NO: 3470194 - DNA, 19 bp, Homo sapiens
ttccttgttacccatgaaa

SEQ ID NO: 3470195 - DNA, 23 bp, Homo sapiens
ttcctttccaacgtttggaagat

SEQ ID NO: 3470196 - DNA, 22 bp, Homo sapiens
ttcgaaacctgggattcaggaa

SEQ ID NO: 3470197 - DNA, 17 bp, Homo sapiens
ttcgaaaggccttcaga

SEQ ID NO: 3470198 - DNA, 22 bp, Homo sapiens
ttcgagatcatcacttccttgc

SEQ ID NO: 3470199 - DNA, 11 bp, Homo sapiens
ttcgaggcctg

SEQ ID NO: 3470200 - DNA, 23 bp, Homo sapiens
ttcgatggtacgtgaccctctgc

SEQ ID NO: 3470201 - DNA, 20 bp, Homo sapiens
ttcgcatggtcacacactga

SEQ ID NO: 3470202 - DNA, 21 bp, Homo sapiens
ttcgcatggtcacacactgat

SEQ ID NO: 3470203 - DNA, 13 bp, Homo sapiens
ttcgcctttcctc

SEQ ID NO: 3470204 - DNA, 24 bp, Homo sapiens
ttcgctgtcccccaacactgagca

SEQ ID NO: 3470205 - DNA, 22 bp, Homo sapiens
ttcgcttcttgcctctgtgctg

SEQ ID NO: 3470206 - DNA, 16 bp, Homo sapiens
ttcggccagagctgaa

SEQ ID NO: 3470207 - DNA, 13 bp, Homo sapiens
ttcgggctgtgcc

SEQ ID NO: 3470208 - DNA, 14 bp, Homo sapiens
ttcgggctgtgccc

SEQ ID NO: 3470209 - DNA, 13 bp, Homo sapiens
ttcggtgtgcacc

SEQ ID NO: 3470210 - DNA, 15 bp, Homo sapiens
ttcgtagatattgga

SEQ ID NO: 3470211 - DNA, 18 bp, Homo sapiens
ttcgtccacagcttcctg

SEQ ID NO: 3470212 - DNA, 19 bp, Homo sapiens
ttcgtccacagcttcctgt

SEQ ID NO: 3470213 - DNA, 12 bp, Homo sapiens
ttattctcattt

SEQ ID NO: 3470214 - DNA, 15 bp, Homo sapiens
ttattctttactatt

SEQ ID NO: 3470215 - DNA, 18 bp, Homo sapiens
ttattgacaataatttca

SEQ ID NO: 3470216 - DNA, 14 bp, Homo sapiens
ttattgacacagaa

SEQ ID NO: 3470217 - DNA, 22 bp, Homo sapiens
ttattgactctgggtccttcct

SEQ ID NO: 3470218 - DNA, 18 bp, Homo sapiens
ttattgagaaagagcact

SEQ ID NO: 3470219 - DNA, 15 bp, Homo sapiens
ttattgcacattgtt

SEQ ID NO: 3470220 - DNA, 12 bp, Homo sapiens
ttattgcatttg

SEQ ID NO: 3470221 - DNA, 12 bp, Homo sapiens
ttattgccttct

SEQ ID NO: 3470222 - DNA, 20 bp, Homo sapiens
ttattgccttctcaccagct

SEQ ID NO: 3470223 - DNA, 20 bp, Homo sapiens
ttattgtgtttgtcattagc

SEQ ID NO: 3470224 - DNA, 12 bp, Homo sapiens
ttatttaaatta

SEQ ID NO: 3470225 - DNA, 22 bp, Homo sapiens
ttatttactgagcttctctgtg

SEQ ID NO: 3470226 - DNA, 18 bp, Homo sapiens
ttatttatttgattaggt

SEQ ID NO: 3470227 - DNA, 17 bp, Homo sapiens
ttatttctaaagttgta

SEQ ID NO: 3470228 - DNA, 12 bp, Homo sapiens
ttatttctgcat

SEQ ID NO: 3470229 - DNA, 22 bp, Homo sapiens
ttatttctgcatatgttgaata

SEQ ID NO: 3470230 - DNA, 22 bp, Homo sapiens
ttatttgattaggtatgtttgt

SEQ ID NO: 3470231 - DNA, 12 bp, Homo sapiens
ttattttaagac

SEQ ID NO: 3470232 - DNA, 14 bp, Homo sapiens
ttattttcacctgt

SEQ ID NO: 3470233 - DNA, 18 bp, Homo sapiens
ttattttttacattatta

SEQ ID NO: 3470234 - DNA, 21 bp, Homo sapiens
ttcaaactggggcctccagaa

SEQ ID NO: 3470235 - DNA, 19 bp, Homo sapiens
ttcaaagcaattgaaatgc

SEQ ID NO: 3470236 - DNA, 21 bp, Homo sapiens
ttcaaagccagcgtcctcctc

SEQ ID NO: 3470237 - DNA, 15 bp, Homo sapiens
ttcaaatatttacag

SEQ ID NO: 3470238 - DNA, 16 bp, Homo sapiens
ttcaaatctcttcctt

SEQ ID NO: 3470239 - DNA, 22 bp, Homo sapiens
ttcaaattctttttttattatt

SEQ ID NO: 3470240 - DNA, 11 bp, Homo sapiens
ttcaaatttag

SEQ ID NO: 3470241 - DNA, 19 bp, Homo sapiens
ttcaacttattaacaatta

SEQ ID NO: 3470242 - DNA, 21 bp, Homo sapiens
ttcaagcgattcttctgcttc

SEQ ID NO: 3470243 - DNA, 20 bp, Homo sapiens
ttcaaggaacttgaaaaata

SEQ ID NO: 3470244 - DNA, 13 bp, Homo sapiens
ttcaaggccttca

SEQ ID NO: 3470245 - DNA, 12 bp, Homo sapiens
ttcaaggcttca

SEQ ID NO: 3470246 - DNA, 20 bp, Homo sapiens
ttcaagttttgggtatgttt

SEQ ID NO: 3470247 - DNA, 16 bp, Homo sapiens
ttcaataaagcattta

SEQ ID NO: 3470248 - DNA, 20 bp, Homo sapiens
ttcaataaagcatttataaa

SEQ ID NO: 3470249 - DNA, 18 bp, Homo sapiens
ttcaatagttcaaggaac

SEQ ID NO: 3470250 - DNA, 16 bp, Homo sapiens
ttcaatattgaatttt

SEQ ID NO: 3470251 - DNA, 17 bp, Homo sapiens
ttcaattcaacactccc

SEQ ID NO: 3470252 - DNA, 12 bp, Homo sapiens
ttcaattcctct

SEQ ID NO: 3470253 - DNA, 16 bp, Homo sapiens
ttcaattcctctggga

SEQ ID NO: 3470254 - DNA, 19 bp, Homo sapiens
ttcaattgcatctcccaga

SEQ ID NO: 3470255 - DNA, 22 bp, Homo sapiens
ttcacaaacttttatactcttt

SEQ ID NO: 3470256 - DNA, 15 bp, Homo sapiens
ttcacaaagcccaag

SEQ ID NO: 3470257 - DNA, 15 bp, Homo sapiens
ttcacagcaacattt

SEQ ID NO: 3470258 - DNA, 21 bp, Homo sapiens
ttcacagtgatcgatgattca

SEQ ID NO: 3470259 - DNA, 20 bp, Homo sapiens
ttcacagttctttgggccag

SEQ ID NO: 3470260 - DNA, 15 bp, Homo sapiens
ttcacattagaagac

SEQ ID NO: 3470261 - DNA, 16 bp, Homo sapiens
ttcacattagaagaca

SEQ ID NO: 3470262 - DNA, 19 bp, Homo sapiens
ttcacattgtttgctgcta

SEQ ID NO: 3470263 - DNA, 24 bp, Homo sapiens
ttcaccatttggcaatgccatcat

SEQ ID NO: 3470264 - DNA, 17 bp, Homo sapiens
ttcaccccagggcctga

SEQ ID NO: 3470265 - DNA, 22 bp, Homo sapiens
ttcaccccagggcctgagcctg

SEQ ID NO: 3470266 - DNA, 14 bp, Homo sapiens
ttcaccgaggacat

SEQ ID NO: 3470267 - DNA, 16 bp, Homo sapiens
ttcacctccttcaatt

SEQ ID NO: 3470268 - DNA, 13 bp, Homo sapiens
ttcacctcttcca

SEQ ID NO: 3470269 - DNA, 20 bp, Homo sapiens
ttcacctttcccactttctt

SEQ ID NO: 3470270 - DNA, 13 bp, Homo sapiens
ttcacctttgtag

SEQ ID NO: 3470271 - DNA, 18 bp, Homo sapiens
ttcacggaagagccttgc

SEQ ID NO: 3470272 - DNA, 22 bp, Homo sapiens
ttcacggaagttttcaatgatg

SEQ ID NO: 3470273 - DNA, 22 bp, Homo sapiens
ttcactagggaatcctgcggca

SEQ ID NO: 3470274 - DNA, 13 bp, Homo sapiens
ttcagaaatttaa

SEQ ID NO: 3470275 - DNA, 14 bp, Homo sapiens
ttcagacttgtcaa

SEQ ID NO: 3470276 - DNA, 15 bp, Homo sapiens
ttcagacttgtcaag

SEQ ID NO: 3470277 - DNA, 23 bp, Homo sapiens
ttcagaggccctcgctgccagct

SEQ ID NO: 3470278 - DNA, 13 bp, Homo sapiens
ttcagatcttaat

SEQ ID NO: 3470279 - DNA, 16 bp, Homo sapiens
ttcagatgtaatgttt

SEQ ID NO: 3470280 - DNA, 18 bp, Homo sapiens
ttcagatgtaatgttttc

SEQ ID NO: 3470281 - DNA, 16 bp, Homo sapiens
ttcagatgtgaaccat

SEQ ID NO: 3470282 - DNA, 19 bp, Homo sapiens
ttcagcagcaaattttcag

SEQ ID NO: 3470283 - DNA, 19 bp, Homo sapiens
ttcagcatccgcaggtgct

SEQ ID NO: 3470284 - DNA, 16 bp, Homo sapiens
ttcagccatgtacaga

SEQ ID NO: 3470285 - DNA, 15 bp, Homo sapiens
ttcagcctctttctg

SEQ ID NO: 3470286 - DNA, 19 bp, Homo sapiens
ttcagctcacgcttcacag

SEQ ID NO: 3470287 - DNA, 15 bp, Homo sapiens
ttcagctccagctca

SEQ ID NO: 3470288 - DNA, 24 bp, Homo sapiens
ttcagctctgcaagaattgaagca

SEQ ID NO: 3470289 - DNA, 11 bp, Homo sapiens
ttcaggaacct

SEQ ID NO: 3470290 - DNA, 18 bp, Homo sapiens
ttcaggctcgccaaggcc

SEQ ID NO: 3470291 - DNA, 19 bp, Homo sapiens
ttcaggctcgccaaggcct

SEQ ID NO: 3470292 - DNA, 13 bp, Homo sapiens
ttcagggcctggt

SEQ ID NO: 3470293 - DNA, 16 bp, Homo sapiens
ttcagggttggcccct

SEQ ID NO: 3470294 - DNA, 22 bp, Homo sapiens
ttcagggttggcccctgcccgg

SEQ ID NO: 3470295 - DNA, 16 bp, Homo sapiens
ttcaggtaacaggcag

SEQ ID NO: 3470296 - DNA, 17 bp, Homo sapiens
ttcaggtaacaggcaga

SEQ ID NO: 3470297 - DNA, 12 bp, Homo sapiens
ttcagtccgcct

SEQ ID NO: 3470298 - DNA, 22 bp, Homo sapiens
ttcagtccgcctggccggctcc

SEQ ID NO: 3470299 - DNA, 22 bp, Homo sapiens
ttcagtgttacctgtgtgcttg

SEQ ID NO: 3470300 - DNA, 19 bp, Homo sapiens
ttcagttaattcttagata

SEQ ID NO: 3470301 - DNA, 23 bp, Homo sapiens
ttcagttattatatttacaaatg

SEQ ID NO: 3470302 - DNA, 16 bp, Homo sapiens
ttcagttgattttaca

SEQ ID NO: 3470303 - DNA, 13 bp, Homo sapiens
ttcagtttgtata

SEQ ID NO: 3470304 - DNA, 23 bp, Homo sapiens
ttcataatgaaaaactatgtcag

SEQ ID NO: 3470305 - DNA, 13 bp, Homo sapiens
ttcatagcccagt

SEQ ID NO: 3470306 - DNA, 20 bp, Homo sapiens
ttcatatattgcatttctgt

SEQ ID NO: 3470307 - DNA, 20 bp, Homo sapiens
ttcatatgacattcatgcct

SEQ ID NO: 3470308 - DNA, 16 bp, Homo sapiens
ttcatcaaatggaaga

SEQ ID NO: 3470309 - DNA, 14 bp, Homo sapiens
ttcatcaagactgg

SEQ ID NO: 3470310 - DNA, 19 bp, Homo sapiens
ttcatcccaactgtctttt

SEQ ID NO: 3470311 - DNA, 16 bp, Homo sapiens
ttcatcccatgatgta

SEQ ID NO: 3470312 - DNA, 18 bp, Homo sapiens
ttcatcccatgatgtagt

SEQ ID NO: 3470313 - DNA, 17 bp, Homo sapiens
ttcatctctttagagaa

SEQ ID NO: 3470314 - DNA, 14 bp, Homo sapiens
ttcatcttcctgtg

SEQ ID NO: 3470315 - DNA, 18 bp, Homo sapiens
ttcatcttcctgtgtcct

SEQ ID NO: 3470316 - DNA, 22 bp, Homo sapiens
ttcatcttggtcacatacaatt

SEQ ID NO: 3470317 - DNA, 16 bp, Homo sapiens
ttcatcttttaaagaa

SEQ ID NO: 3470318 - DNA, 18 bp, Homo sapiens
ttcatcttttattttgga

SEQ ID NO: 3470319 - DNA, 21 bp, Homo sapiens
ttcatcttttattttggaact

SEQ ID NO: 3470320 - DNA, 16 bp, Homo sapiens
ttcatgagtttttccc

SEQ ID NO: 3470321 - DNA, 19 bp, Homo sapiens
ttcatgtaaactgtgcacc

SEQ ID NO: 3470322 - DNA, 15 bp, Homo sapiens
ttcatgttttaacaa

SEQ ID NO: 3470323 - DNA, 13 bp, Homo sapiens
ttcattagagcag

SEQ ID NO: 3470324 - DNA, 9 bp, Homo sapiens
ttcattcag

SEQ ID NO: 3470325 - DNA, 23 bp, Homo sapiens
ttcattcgtcttgttgttattga

SEQ ID NO: 3470326 - DNA, 18 bp, Homo sapiens
ttcattgatttcctgtgt

SEQ ID NO: 3470327 - DNA, 16 bp, Homo sapiens
ttcattggttaatttt

SEQ ID NO: 3470328 - DNA, 17 bp, Homo sapiens
ttcattggttaattttt

SEQ ID NO: 3470329 - DNA, 16 bp, Homo sapiens
ttcatttcctgtgtct

SEQ ID NO: 3470330 - DNA, 23 bp, Homo sapiens
ttcatttgtggtgatatagaatt

SEQ ID NO: 3470331 - DNA, 15 bp, Homo sapiens
ttcattttcagagtg

SEQ ID NO: 3470332 - DNA, 16 bp, Homo sapiens
ttcattttcagagtga

SEQ ID NO: 3470333 - DNA, 20 bp, Homo sapiens
ttcattttctagatacaata

SEQ ID NO: 3470334 - DNA, 22 bp, Homo sapiens
ttcattttctagatacaataaa

SEQ ID NO: 3470335 - DNA, 14 bp, Homo sapiens
ttcatttttaaatg

SEQ ID NO: 3470336 - DNA, 16 bp, Homo sapiens
ttcatttttaaatgtg

SEQ ID NO: 3470337 - DNA, 20 bp, Homo sapiens
ttcatttttgtaataacatt

SEQ ID NO: 3470338 - DNA, 17 bp, Homo sapiens
ttcatttttttccaggc

SEQ ID NO: 3470339 - DNA, 18 bp, Homo sapiens
ttccaaaaaggttgctgt

SEQ ID NO: 3470340 - DNA, 16 bp, Homo sapiens
ttccaaaagtggcctc

SEQ ID NO: 3470341 - DNA, 20 bp, Homo sapiens
ttccaaaccttatctccaca

SEQ ID NO: 3470342 - DNA, 23 bp, Homo sapiens
ttccaaaggccatggagagctgg

SEQ ID NO: 3470343 - DNA, 15 bp, Homo sapiens
ttccaaataaaatgt

SEQ ID NO: 3470344 - DNA, 22 bp, Homo sapiens
ttccaacgtttggaagatcctg

SEQ ID NO: 3470345 - DNA, 23 bp, Homo sapiens
ttccaagaatagcatctgtacaa

SEQ ID NO: 3470346 - DNA, 19 bp, Homo sapiens
ttccaattctatcttttgt

SEQ ID NO: 3470347 - DNA, 21 bp, Homo sapiens
ttccaattctatcttttgttt

SEQ ID NO: 3470348 - DNA, 16 bp, Homo sapiens
ttccacaaagaaaatt

SEQ ID NO: 3470349 - DNA, 14 bp, Homo sapiens
ttactgttgtacaa

SEQ ID NO: 3470350 - DNA, 21 bp, Homo sapiens
ttactgttgtacaatcatgtt

SEQ ID NO: 3470351 - DNA, 18 bp, Homo sapiens
ttacttaggtgtggggga

SEQ ID NO: 3470352 - DNA, 17 bp, Homo sapiens
ttacttatccctgccca

SEQ ID NO: 3470353 - DNA, 24 bp, Homo sapiens
ttacttctctataaaaaatatgta

SEQ ID NO: 3470354 - DNA, 18 bp, Homo sapiens
ttactttttcttgtattc

SEQ ID NO: 3470355 - DNA, 22 bp, Homo sapiens
ttacttttttttttttttggta

SEQ ID NO: 3470356 - DNA, 22 bp, Homo sapiens
ttagaaagaagcccaatattat

SEQ ID NO: 3470357 - DNA, 15 bp, Homo sapiens
ttagaaagcatttga

SEQ ID NO: 3470358 - DNA, 21 bp, Homo sapiens
ttagaaagcatttgaatgcat

SEQ ID NO: 3470359 - DNA, 22 bp, Homo sapiens
ttagaaagctgacattgccaaa

SEQ ID NO: 3470360 - DNA, 21 bp, Homo sapiens
ttagaactttgcatagcagct

SEQ ID NO: 3470361 - DNA, 17 bp, Homo sapiens
ttagaagacaattgaca

SEQ ID NO: 3470362 - DNA, 18 bp, Homo sapiens
ttagaaggttctctcctc

SEQ ID NO: 3470363 - DNA, 13 bp, Homo sapiens
ttagacagagtct

SEQ ID NO: 3470364 - DNA, 20 bp, Homo sapiens
ttagacagagtctcactgtt

SEQ ID NO: 3470365 - DNA, 13 bp, Homo sapiens
ttagacagccaaa

SEQ ID NO: 3470366 - DNA, 23 bp, Homo sapiens
ttagagacagttgggtgagaaca

SEQ ID NO: 3470367 - DNA, 12 bp, Homo sapiens
ttagagttagac

SEQ ID NO: 3470368 - DNA, 13 bp, Homo sapiens
ttagagttagact

SEQ ID NO: 3470369 - DNA, 22 bp, Homo sapiens
ttagatagtcatgctgctagat

SEQ ID NO: 3470370 - DNA, 16 bp, Homo sapiens
ttagatattttccata

SEQ ID NO: 3470371 - DNA, 16 bp, Homo sapiens
ttagatggattctcca

SEQ ID NO: 3470372 - DNA, 22 bp, Homo sapiens
ttagatgttctctatcatttaa

SEQ ID NO: 3470373 - DNA, 21 bp, Homo sapiens
ttagcagcagcctttaatgca

SEQ ID NO: 3470374 - DNA, 14 bp, Homo sapiens
ttagccaaacaaca

SEQ ID NO: 3470375 - DNA, 19 bp, Homo sapiens
ttagccaaacaacaacaaa

SEQ ID NO: 3470376 - DNA, 18 bp, Homo sapiens
ttagccaagtgtggtaga

SEQ ID NO: 3470377 - DNA, 16 bp, Homo sapiens
ttagccatgatctgca

SEQ ID NO: 3470378 - DNA, 18 bp, Homo sapiens
ttagccatttttcaaagc

SEQ ID NO: 3470379 - DNA, 12 bp, Homo sapiens
ttagctaaagga

SEQ ID NO: 3470380 - DNA, 13 bp, Homo sapiens
ttagctcccctcc

SEQ ID NO: 3470381 - DNA, 19 bp, Homo sapiens
ttagctgtattcatatatt

SEQ ID NO: 3470382 - DNA, 14 bp, Homo sapiens
ttagcttcaggaac

SEQ ID NO: 3470383 - DNA, 17 bp, Homo sapiens
ttagctttactgtttgt

SEQ ID NO: 3470384 - DNA, 17 bp, Homo sapiens
ttagctttttcatcccc

SEQ ID NO: 3470385 - DNA, 14 bp, Homo sapiens
ttaggaatgagaag

SEQ ID NO: 3470386 - DNA, 12 bp, Homo sapiens
ttaggagaagcc

SEQ ID NO: 3470387 - DNA, 21 bp, Homo sapiens
ttaggatacttaacaaataca

SEQ ID NO: 3470388 - DNA, 22 bp, Homo sapiens
ttaggatacttaacaaatacat

SEQ ID NO: 3470389 - DNA, 17 bp, Homo sapiens
ttaggcatttcctgctg

SEQ ID NO: 3470390 - DNA, 18 bp, Homo sapiens
ttaggcatttcctgctga

SEQ ID NO: 3470391 - DNA, 18 bp, Homo sapiens
ttaggcctggctcattct

SEQ ID NO: 3470392 - DNA, 17 bp, Homo sapiens
ttaggctgctgggatgg

SEQ ID NO: 3470393 - DNA, 19 bp, Homo sapiens
ttaggctggtggcccagga

SEQ ID NO: 3470394 - DNA, 17 bp, Homo sapiens
ttagggagaaaattcaa

SEQ ID NO: 3470395 - DNA, 19 bp, Homo sapiens
ttagggagctcttgacaga

SEQ ID NO: 3470396 - DNA, 16 bp, Homo sapiens
ttaggtctctgttgac

SEQ ID NO: 3470397 - DNA, 20 bp, Homo sapiens
ttaggtgcgcagtggcatgt

SEQ ID NO: 3470398 - DNA, 18 bp, Homo sapiens
ttaggttggcaaaaaggc

SEQ ID NO: 3470399 - DNA, 13 bp, Homo sapiens
ttagtaaatgtta

SEQ ID NO: 3470400 - DNA, 16 bp, Homo sapiens
ttagtaatttcctaga

SEQ ID NO: 3470401 - DNA, 14 bp, Homo sapiens
ttagtctaacacag

SEQ ID NO: 3470402 - DNA, 19 bp, Homo sapiens
ttagtctaacacagttgac

SEQ ID NO: 3470403 - DNA, 17 bp, Homo sapiens
ttagtctgcaaaatgag

SEQ ID NO: 3470404 - DNA, 12 bp, Homo sapiens
ttagtgctaagt

SEQ ID NO: 3470405 - DNA, 16 bp, Homo sapiens
ttagtgctaagtgtga

SEQ ID NO: 3470406 - DNA, 14 bp, Homo sapiens
ttagttccttgagt

SEQ ID NO: 3470407 - DNA, 20 bp, Homo sapiens
ttagttgcactaactgctgg

SEQ ID NO: 3470408 - DNA, 15 bp, Homo sapiens
ttagttgccaatatg

SEQ ID NO: 3470409 - DNA, 17 bp, Homo sapiens
ttagtttacaatcagcc

SEQ ID NO: 3470410 - DNA, 17 bp, Homo sapiens
ttagtttcaagagtcta

SEQ ID NO: 3470411 - DNA, 16 bp, Homo sapiens
ttataaaatcaagttt

SEQ ID NO: 3470412 - DNA, 21 bp, Homo sapiens
ttataaacagacaatatgtga

SEQ ID NO: 3470413 - DNA, 23 bp, Homo sapiens
ttataaacagacaatatgtgagt

SEQ ID NO: 3470414 - DNA, 15 bp, Homo sapiens
ttataaagtagaaat

SEQ ID NO: 3470415 - DNA, 21 bp, Homo sapiens
ttatacgctggcaacacagag

SEQ ID NO: 3470416 - DNA, 22 bp, Homo sapiens
ttatacgctggcaacacagagg

SEQ ID NO: 3470417 - DNA, 13 bp, Homo sapiens
ttatactgtacaa

SEQ ID NO: 3470418 - DNA, 14 bp, Homo sapiens
ttatactgtacaat

SEQ ID NO: 3470419 - DNA, 18 bp, Homo sapiens
ttatagaacttcatggat

SEQ ID NO: 3470420 - DNA, 15 bp, Homo sapiens
ttatagaatatttat

SEQ ID NO: 3470421 - DNA, 15 bp, Homo sapiens
ttatagatcatttct

SEQ ID NO: 3470422 - DNA, 16 bp, Homo sapiens
ttatagatcatttcta

SEQ ID NO: 3470423 - DNA, 18 bp, Homo sapiens
ttataggtgagaaaaaaa

SEQ ID NO: 3470424 - DNA, 19 bp, Homo sapiens
ttataggtggcctctcctt

SEQ ID NO: 3470425 - DNA, 20 bp, Homo sapiens
ttatataatatctaaagtta

SEQ ID NO: 3470426 - DNA, 21 bp, Homo sapiens
ttatataatatctaaagttat

SEQ ID NO: 3470427 - DNA, 12 bp, Homo sapiens
ttatataattgt

SEQ ID NO: 3470428 - DNA, 19 bp, Homo sapiens
ttatatcagtcctctttca

SEQ ID NO: 3470429 - DNA, 16 bp, Homo sapiens
ttatatcatatgtata

SEQ ID NO: 3470430 - DNA, 16 bp, Homo sapiens
ttatatgaagataagt

SEQ ID NO: 3470431 - DNA, 19 bp, Homo sapiens
ttatattaatgtacttgtt

SEQ ID NO: 3470432 - DNA, 15 bp, Homo sapiens
ttatattgttttctc

SEQ ID NO: 3470433 - DNA, 15 bp, Homo sapiens
ttatatttttataga

SEQ ID NO: 3470434 - DNA, 14 bp, Homo sapiens
ttatcaaaaagtat

SEQ ID NO: 3470435 - DNA, 22 bp, Homo sapiens
ttatcaaaaagtattatcattg

SEQ ID NO: 3470436 - DNA, 15 bp, Homo sapiens
ttatcaacttcctaa

SEQ ID NO: 3470437 - DNA, 18 bp, Homo sapiens
ttatcacccccttgttgt

SEQ ID NO: 3470438 - DNA, 18 bp, Homo sapiens
ttatcaccgtgggctccc

SEQ ID NO: 3470439 - DNA, 21 bp, Homo sapiens
ttatcaccgtgggctccctga

SEQ ID NO: 3470440 - DNA, 18 bp, Homo sapiens
ttatcactgacacaaaaa

SEQ ID NO: 3470441 - DNA, 17 bp, Homo sapiens
ttatccaaaatgtgtat

SEQ ID NO: 3470442 - DNA, 13 bp, Homo sapiens
ttatccctgccca

SEQ ID NO: 3470443 - DNA, 18 bp, Homo sapiens
ttatcctagcacatgctt

SEQ ID NO: 3470444 - DNA, 20 bp, Homo sapiens
ttatcctcctgttctgaaac

SEQ ID NO: 3470445 - DNA, 15 bp, Homo sapiens
ttatcctctttagag

SEQ ID NO: 3470446 - DNA, 18 bp, Homo sapiens
ttatcctctttagagtta

SEQ ID NO: 3470447 - DNA, 20 bp, Homo sapiens
ttatctcttttatatttgta

SEQ ID NO: 3470448 - DNA, 20 bp, Homo sapiens
ttatcttatactgtacaata

SEQ ID NO: 3470449 - DNA, 17 bp, Homo sapiens
ttatcttgtctctgggc

SEQ ID NO: 3470450 - DNA, 19 bp, Homo sapiens
ttatgaacacttaaattat

SEQ ID NO: 3470451 - DNA, 18 bp, Homo sapiens
ttatgatagtggtatgac

SEQ ID NO: 3470452 - DNA, 15 bp, Homo sapiens
ttatgatatcattgt

SEQ ID NO: 3470453 - DNA, 15 bp, Homo sapiens
ttatgatcagtgttg

SEQ ID NO: 3470454 - DNA, 13 bp, Homo sapiens
ttatgctgaaaca

SEQ ID NO: 3470455 - DNA, 20 bp, Homo sapiens
ttatggaattgatttgcatt

SEQ ID NO: 3470456 - DNA, 21 bp, Homo sapiens
ttatggaattgatttgcattg

SEQ ID NO: 3470457 - DNA, 22 bp, Homo sapiens
ttatgtaaaaggccaaacctct

SEQ ID NO: 3470458 - DNA, 16 bp, Homo sapiens
ttatgtagtaattgac

SEQ ID NO: 3470459 - DNA, 14 bp, Homo sapiens
ttatgtataaaatg

SEQ ID NO: 3470460 - DNA, 17 bp, Homo sapiens
ttatgtataaaatgtaa

SEQ ID NO: 3470461 - DNA, 20 bp, Homo sapiens
ttatgtatttcctggatgtt

SEQ ID NO: 3470462 - DNA, 14 bp, Homo sapiens
ttatgtgatcaatt

SEQ ID NO: 3470463 - DNA, 23 bp, Homo sapiens
ttatgtgtaggtgaacagtcacg

SEQ ID NO: 3470464 - DNA, 10 bp, Homo sapiens
ttatgttaaa

SEQ ID NO: 3470465 - DNA, 12 bp, Homo sapiens
ttatgttaaact

SEQ ID NO: 3470466 - DNA, 11 bp, Homo sapiens
ttattaaatag

SEQ ID NO: 3470467 - DNA, 13 bp, Homo sapiens
ttattaatcacta

SEQ ID NO: 3470468 - DNA, 18 bp, Homo sapiens
ttattacatctttcacat

SEQ ID NO: 3470469 - DNA, 15 bp, Homo sapiens
ttattacatgtaatt

SEQ ID NO: 3470470 - DNA, 19 bp, Homo sapiens
ttattaccccctccttcag

SEQ ID NO: 3470471 - DNA, 22 bp, Homo sapiens
ttattaccccctccttcagaca

SEQ ID NO: 3470472 - DNA, 17 bp, Homo sapiens
ttattacttatttgtgc

SEQ ID NO: 3470473 - DNA, 22 bp, Homo sapiens
ttattatttatttgattaggta

SEQ ID NO: 3470474 - DNA, 12 bp, Homo sapiens
ttattcaataaa

SEQ ID NO: 3470475 - DNA, 11 bp, Homo sapiens
ttattcagcag

SEQ ID NO: 3470476 - DNA, 14 bp, Homo sapiens
ttattcagtgtcac

SEQ ID NO: 3470477 - DNA, 12 bp, Homo sapiens
ttattcattatt

SEQ ID NO: 3470478 - DNA, 20 bp, Homo sapiens
ttattccagaatgctgtaca

SEQ ID NO: 3470479 - DNA, 17 bp, Homo sapiens
ttattcccccctaagct

SEQ ID NO: 3470480 - DNA, 21 bp, Homo sapiens
ttattcccccctaagcttcta

SEQ ID NO: 3470481 - DNA, 19 bp, Homo sapiens
ttattccctttcacaaaat

SEQ ID NO: 3470482 - DNA, 20 bp, Homo sapiens
ttattcctatatagtttatt

SEQ ID NO: 3470483 - DNA, 19 bp, Homo sapiens
ttattcgtagatattggac

SEQ ID NO: 3470484 - DNA, 19 bp, Homo sapiens
ttattctaaacagactcat

SEQ ID NO: 3470485 - DNA, 14 bp, Homo sapiens
ttattctatgtagt

SEQ ID NO: 3470486 - DNA, 21 bp, Homo sapiens
ttaacagcatgacaaaaatta

SEQ ID NO: 3470487 - DNA, 12 bp, Homo sapiens
ttaaccaaaggt

SEQ ID NO: 3470488 - DNA, 22 bp, Homo sapiens
ttaaccagatctagtcaatcaa

SEQ ID NO: 3470489 - DNA, 15 bp, Homo sapiens
ttaaccagatggttg

SEQ ID NO: 3470490 - DNA, 15 bp, Homo sapiens
ttaacctaggcagtg

SEQ ID NO: 3470491 - DNA, 21 bp, Homo sapiens
ttaacctctttttaaggacac

SEQ ID NO: 3470492 - DNA, 21 bp, Homo sapiens
ttaaccttactaattatacta

SEQ ID NO: 3470493 - DNA, 21 bp, Homo sapiens
ttaactagaatttattcaatt

SEQ ID NO: 3470494 - DNA, 20 bp, Homo sapiens
ttaactccctttttacactt

SEQ ID NO: 3470495 - DNA, 13 bp, Homo sapiens
ttaactctgtctt

SEQ ID NO: 3470496 - DNA, 13 bp, Homo sapiens
ttaactcttttgg

SEQ ID NO: 3470497 - DNA, 14 bp, Homo sapiens
ttaactcttttgga

SEQ ID NO: 3470498 - DNA, 15 bp, Homo sapiens
ttaactcttttggac

SEQ ID NO: 3470499 - DNA, 21 bp, Homo sapiens
ttaactgagggctgatcttta

SEQ ID NO: 3470500 - DNA, 21 bp, Homo sapiens
ttaactgccaatccttaaata

SEQ ID NO: 3470501 - DNA, 20 bp, Homo sapiens
ttaactggaaggctgctttc

SEQ ID NO: 3470502 - DNA, 21 bp, Homo sapiens
ttaactggtgcactttgtaaa

SEQ ID NO: 3470503 - DNA, 23 bp, Homo sapiens
ttaactggtgcactttgtaaatt

SEQ ID NO: 3470504 - DNA, 21 bp, Homo sapiens
ttaacttcttcataattttag

SEQ ID NO: 3470505 - DNA, 20 bp, Homo sapiens
ttaagaaaaaataacacaca

SEQ ID NO: 3470506 - DNA, 21 bp, Homo sapiens
ttaagaaaaaataacacacat

SEQ ID NO: 3470507 - DNA, 23 bp, Homo sapiens
ttaagaaattttgcctttaagtt

SEQ ID NO: 3470508 - DNA, 18 bp, Homo sapiens
ttaagaaggcaaaaatgt

SEQ ID NO: 3470509 - DNA, 16 bp, Homo sapiens
ttaagacatgatttcc

SEQ ID NO: 3470510 - DNA, 18 bp, Homo sapiens
ttaagacctggcagctct

SEQ ID NO: 3470511 - DNA, 14 bp, Homo sapiens
ttaagactgatttt

SEQ ID NO: 3470512 - DNA, 16 bp, Homo sapiens
ttaagcaaaggggaca

SEQ ID NO: 3470513 - DNA, 23 bp, Homo sapiens
ttaagcaaaggggacagctgtgt

SEQ ID NO: 3470514 - DNA, 19 bp, Homo sapiens
ttaagcaacatctttttaa

SEQ ID NO: 3470515 - DNA, 23 bp, Homo sapiens
ttaaggctgaggaaaggccagct

SEQ ID NO: 3470516 - DNA, 16 bp, Homo sapiens
ttaaggtctttcagta

SEQ ID NO: 3470517 - DNA, 13 bp, Homo sapiens
ttaagtattgcat

SEQ ID NO: 3470518 - DNA, 20 bp, Homo sapiens
ttaagtccctgtcacctctt

SEQ ID NO: 3470519 - DNA, 20 bp, Homo sapiens
ttaagttattttacctgttt

SEQ ID NO: 3470520 - DNA, 14 bp, Homo sapiens
ttaataaaaaggca

SEQ ID NO: 3470521 - DNA, 15 bp, Homo sapiens
ttaataaaaaggcac

SEQ ID NO: 3470522 - DNA, 17 bp, Homo sapiens
ttaataaagatgattga

SEQ ID NO: 3470523 - DNA, 16 bp, Homo sapiens
ttaataatatacttgt

SEQ ID NO: 3470524 - DNA, 22 bp, Homo sapiens
ttaatacagtttatttttaaag

SEQ ID NO: 3470525 - DNA, 22 bp, Homo sapiens
ttaatataaagtagtcctgtga

SEQ ID NO: 3470526 - DNA, 14 bp, Homo sapiens
ttaatataaattca

SEQ ID NO: 3470527 - DNA, 17 bp, Homo sapiens
ttaatatgaaaacttat

SEQ ID NO: 3470528 - DNA, 16 bp, Homo sapiens
ttaatattttatattg

SEQ ID NO: 3470529 - DNA, 17 bp, Homo sapiens
ttaatcactattgttcc

SEQ ID NO: 3470530 - DNA, 12 bp, Homo sapiens
ttaatccaatgg

SEQ ID NO: 3470531 - DNA, 17 bp, Homo sapiens
ttaatccccagtaaaat

SEQ ID NO: 3470532 - DNA, 21 bp, Homo sapiens
ttaatccccagtaaaattgcc

SEQ ID NO: 3470533 - DNA, 12 bp, Homo sapiens
ttaatcttgctt

SEQ ID NO: 3470534 - DNA, 14 bp, Homo sapiens
ttaatgaagaaagt

SEQ ID NO: 3470535 - DNA, 18 bp, Homo sapiens
ttaatgaagaaagtggaa

SEQ ID NO: 3470536 - DNA, 16 bp, Homo sapiens
ttaatgaagtttgaat

SEQ ID NO: 3470537 - DNA, 23 bp, Homo sapiens
ttaatgaagtttgaatgttaaat

SEQ ID NO: 3470538 - DNA, 19 bp, Homo sapiens
ttaatgacacttgtcccca

SEQ ID NO: 3470539 - DNA, 23 bp, Homo sapiens
ttaatgacacttgtccccaaatc

SEQ ID NO: 3470540 - DNA, 20 bp, Homo sapiens
ttaatgcaagagaacatttt

SEQ ID NO: 3470541 - DNA, 20 bp, Homo sapiens
ttaatgcatgttaggaaaat

SEQ ID NO: 3470542 - DNA, 21 bp, Homo sapiens
ttaatgctatttgaacaagtg

SEQ ID NO: 3470543 - DNA, 15 bp, Homo sapiens
ttaatgcttaagatt

SEQ ID NO: 3470544 - DNA, 20 bp, Homo sapiens
ttaatggacacttttcacct

SEQ ID NO: 3470545 - DNA, 18 bp, Homo sapiens
ttaatgtaatctgatggc

SEQ ID NO: 3470546 - DNA, 17 bp, Homo sapiens
ttaatgtcacaggcagg

SEQ ID NO: 3470547 - DNA, 18 bp, Homo sapiens
ttaatgtcacaggcaggt

SEQ ID NO: 3470548 - DNA, 13 bp, Homo sapiens
ttaatgttcacat

SEQ ID NO: 3470549 - DNA, 13 bp, Homo sapiens
ttaatgttctgtg

SEQ ID NO: 3470550 - DNA, 14 bp, Homo sapiens
ttaatgttctgtga

SEQ ID NO: 3470551 - DNA, 13 bp, Homo sapiens
ttaattacaccat

SEQ ID NO: 3470552 - DNA, 23 bp, Homo sapiens
ttaattcaggtatgtaaaagact

SEQ ID NO: 3470553 - DNA, 15 bp, Homo sapiens
ttaattcatgtttct

SEQ ID NO: 3470554 - DNA, 16 bp, Homo sapiens
ttaattgaaagtataa

SEQ ID NO: 3470555 - DNA, 12 bp, Homo sapiens
ttaattgctgca

SEQ ID NO: 3470556 - DNA, 13 bp, Homo sapiens
ttaattgctgcaa

SEQ ID NO: 3470557 - DNA, 15 bp, Homo sapiens
ttaattgctttcctg

SEQ ID NO: 3470558 - DNA, 19 bp, Homo sapiens
ttaatttagatattttcca

SEQ ID NO: 3470559 - DNA, 19 bp, Homo sapiens
ttaatttagtaaatgttat

SEQ ID NO: 3470560 - DNA, 15 bp, Homo sapiens
ttaatttgtattgaa

SEQ ID NO: 3470561 - DNA, 17 bp, Homo sapiens
ttaatttttaatgatga

SEQ ID NO: 3470562 - DNA, 20 bp, Homo sapiens
ttaattttttggtacaaaaa

SEQ ID NO: 3470563 - DNA, 21 bp, Homo sapiens
ttacaaaaggctcgtttggat

SEQ ID NO: 3470564 - DNA, 22 bp, Homo sapiens
ttacaaaaggctcgtttggatc

SEQ ID NO: 3470565 - DNA, 16 bp, Homo sapiens
ttacaaagtgtgtatt

SEQ ID NO: 3470566 - DNA, 22 bp, Homo sapiens
ttacaactgcctcgaaacacag

SEQ ID NO: 3470567 - DNA, 20 bp, Homo sapiens
ttacaagcgtgagccactgc

SEQ ID NO: 3470568 - DNA, 21 bp, Homo sapiens
ttacaagcgtgagccactgca

SEQ ID NO: 3470569 - DNA, 21 bp, Homo sapiens
ttacaataaaactttgctgcc

SEQ ID NO: 3470570 - DNA, 21 bp, Homo sapiens
ttacaatacaaaggttccatt

SEQ ID NO: 3470571 - DNA, 14 bp, Homo sapiens
ttacaattgaaatg

SEQ ID NO: 3470572 - DNA, 20 bp, Homo sapiens
ttacacagaaatgctgctgg

SEQ ID NO: 3470573 - DNA, 16 bp, Homo sapiens
ttacagatttaataca

SEQ ID NO: 3470574 - DNA, 15 bp, Homo sapiens
ttacagcacaaaatg

SEQ ID NO: 3470575 - DNA, 21 bp, Homo sapiens
ttacagctgggtggcactgcc

SEQ ID NO: 3470576 - DNA, 15 bp, Homo sapiens
ttacaggatattcca

SEQ ID NO: 3470577 - DNA, 18 bp, Homo sapiens
ttacagtgtctgtgtgtg

SEQ ID NO: 3470578 - DNA, 17 bp, Homo sapiens
ttacagttaaggaatat

SEQ ID NO: 3470579 - DNA, 20 bp, Homo sapiens
ttacataattcactctgagt

SEQ ID NO: 3470580 - DNA, 14 bp, Homo sapiens
ttacatactgctgt

SEQ ID NO: 3470581 - DNA, 15 bp, Homo sapiens
ttacatctttcacat

SEQ ID NO: 3470582 - DNA, 22 bp, Homo sapiens
ttacatggttaaggtaaagtaa

SEQ ID NO: 3470583 - DNA, 16 bp, Homo sapiens
ttacatgtaatttgat

SEQ ID NO: 3470584 - DNA, 13 bp, Homo sapiens
ttacatgtataaa

SEQ ID NO: 3470585 - DNA, 17 bp, Homo sapiens
ttacatgtataaagtga

SEQ ID NO: 3470586 - DNA, 20 bp, Homo sapiens
ttacatttgatgcatgtctt

SEQ ID NO: 3470587 - DNA, 20 bp, Homo sapiens
ttaccatgtaaataatctgt

SEQ ID NO: 3470588 - DNA, 17 bp, Homo sapiens
ttacccaagtcttctcc

SEQ ID NO: 3470589 - DNA, 21 bp, Homo sapiens
ttaccccatggctgcacagtt

SEQ ID NO: 3470590 - DNA, 17 bp, Homo sapiens
ttaccctctttgctgca

SEQ ID NO: 3470591 - DNA, 19 bp, Homo sapiens
ttaccctgaggtcactgct

SEQ ID NO: 3470592 - DNA, 13 bp, Homo sapiens
ttacccttagaat

SEQ ID NO: 3470593 - DNA, 18 bp, Homo sapiens
ttaccgcgttgtaaaata

SEQ ID NO: 3470594 - DNA, 19 bp, Homo sapiens
ttacctaccacatgccaag

SEQ ID NO: 3470595 - DNA, 19 bp, Homo sapiens
ttacctcctgagaaaaaag

SEQ ID NO: 3470596 - DNA, 13 bp, Homo sapiens
ttacctgtgaaat

SEQ ID NO: 3470597 - DNA, 20 bp, Homo sapiens
ttacggttttccaggtttaa

SEQ ID NO: 3470598 - DNA, 20 bp, Homo sapiens
ttactaactaaactctcttt

SEQ ID NO: 3470599 - DNA, 21 bp, Homo sapiens
ttactagaaatgggaatcatg

SEQ ID NO: 3470600 - DNA, 19 bp, Homo sapiens
ttactaggtaacttcatat

SEQ ID NO: 3470601 - DNA, 15 bp, Homo sapiens
ttactataagaactt

SEQ ID NO: 3470602 - DNA, 23 bp, Homo sapiens
ttactataagaactttgagctac

SEQ ID NO: 3470603 - DNA, 14 bp, Homo sapiens
ttactatgcctgtg

SEQ ID NO: 3470604 - DNA, 18 bp, Homo sapiens
ttactatgcctgtgtctt

SEQ ID NO: 3470605 - DNA, 13 bp, Homo sapiens
ttactattaacat

SEQ ID NO: 3470606 - DNA, 15 bp, Homo sapiens
ttactattaacatga

SEQ ID NO: 3470607 - DNA, 14 bp, Homo sapiens
ttactcaggaagaa

SEQ ID NO: 3470608 - DNA, 17 bp, Homo sapiens
ttactcaggaagaacac

SEQ ID NO: 3470609 - DNA, 21 bp, Homo sapiens
ttactcctcacacttactgta

SEQ ID NO: 3470610 - DNA, 13 bp, Homo sapiens
ttactctgaaggg

SEQ ID NO: 3470611 - DNA, 13 bp, Homo sapiens
ttactctttccta

SEQ ID NO: 3470612 - DNA, 15 bp, Homo sapiens
ttactgaagccttac

SEQ ID NO: 3470613 - DNA, 17 bp, Homo sapiens
ttactgaagccttacaa

SEQ ID NO: 3470614 - DNA, 19 bp, Homo sapiens
ttactgaagccttacaagg

SEQ ID NO: 3470615 - DNA, 13 bp, Homo sapiens
ttactgagcttct

SEQ ID NO: 3470616 - DNA, 17 bp, Homo sapiens
ttactgagcttctctgt

SEQ ID NO: 3470617 - DNA, 18 bp, Homo sapiens
ttactgagcttctctgtg

SEQ ID NO: 3470618 - DNA, 19 bp, Homo sapiens
ttactgagcttctctgtga

SEQ ID NO: 3470619 - DNA, 15 bp, Homo sapiens
ttactgtaagacatt

SEQ ID NO: 3470620 - DNA, 21 bp, Homo sapiens
ttactgtagcctcagatgatt

SEQ ID NO: 3470621 - DNA, 13 bp, Homo sapiens
ttactgttgtaca

SEQ ID NO: 3470622 - DNA, 13 bp, Homo sapiens
tgttcttgaattt

SEQ ID NO: 3470623 - DNA, 22 bp, Homo sapiens
tgttcttgatggagattaagat

SEQ ID NO: 3470624 - DNA, 17 bp, Homo sapiens
tgttctttttattgaat

SEQ ID NO: 3470625 - DNA, 18 bp, Homo sapiens
tgttgaatactttttaca

SEQ ID NO: 3470626 - DNA, 18 bp, Homo sapiens
tgttgacatatttaatgt

SEQ ID NO: 3470627 - DNA, 21 bp, Homo sapiens
tgttgacatatttaatgtttt

SEQ ID NO: 3470628 - DNA, 20 bp, Homo sapiens
tgttgagcatgacagcctgc

SEQ ID NO: 3470629 - DNA, 13 bp, Homo sapiens
tgttgagctgttt

SEQ ID NO: 3470630 - DNA, 19 bp, Homo sapiens
tgttgatcatgtacttttt

SEQ ID NO: 3470631 - DNA, 22 bp, Homo sapiens
tgttgatcatgtactttttagt

SEQ ID NO: 3470632 - DNA, 14 bp, Homo sapiens
tgttgcaaagcttc

SEQ ID NO: 3470633 - DNA, 16 bp, Homo sapiens
tgttgcaagcccctct

SEQ ID NO: 3470634 - DNA, 22 bp, Homo sapiens
tgttgcacacccactcagctcc

SEQ ID NO: 3470635 - DNA, 23 bp, Homo sapiens
tgttgcacacccactcagctccg

SEQ ID NO: 3470636 - DNA, 18 bp, Homo sapiens
tgttgccaagctccaagc

SEQ ID NO: 3470637 - DNA, 17 bp, Homo sapiens
tgttgcccaggcaggtc

SEQ ID NO: 3470638 - DNA, 20 bp, Homo sapiens
tgttgcccctttctcttttc

SEQ ID NO: 3470639 - DNA, 21 bp, Homo sapiens
tgttgctaagccccagcaagc

SEQ ID NO: 3470640 - DNA, 15 bp, Homo sapiens
tgttgctctaggaag

SEQ ID NO: 3470641 - DNA, 17 bp, Homo sapiens
tgttgctctaggaagac

SEQ ID NO: 3470642 - DNA, 13 bp, Homo sapiens
tgttgctgaatag

SEQ ID NO: 3470643 - DNA, 16 bp, Homo sapiens
tgttgctttgttgcac

SEQ ID NO: 3470644 - DNA, 19 bp, Homo sapiens
tgttggataaatcagtggt

SEQ ID NO: 3470645 - DNA, 14 bp, Homo sapiens
tgttggccaggctg

SEQ ID NO: 3470646 - DNA, 22 bp, Homo sapiens
tgttggctgggaactcacctgg

SEQ ID NO: 3470647 - DNA, 19 bp, Homo sapiens
tgttggctgggggcctcag

SEQ ID NO: 3470648 - DNA, 13 bp, Homo sapiens
tgttgtaaaacaa

SEQ ID NO: 3470649 - DNA, 17 bp, Homo sapiens
tgttgtaaaacaaaatt

SEQ ID NO: 3470650 - DNA, 23 bp, Homo sapiens
tgttgtaaaacaaaatttgacta

SEQ ID NO: 3470651 - DNA, 17 bp, Homo sapiens
tgttgtagtaagagctt

SEQ ID NO: 3470652 - DNA, 14 bp, Homo sapiens
tgttgtgtttctgt

SEQ ID NO: 3470653 - DNA, 13 bp, Homo sapiens
tgttgttggttgt

SEQ ID NO: 3470654 - DNA, 21 bp, Homo sapiens
tgttgtttcctaatatcaaat

SEQ ID NO: 3470655 - DNA, 14 bp, Homo sapiens
tgtttaaaaataca

SEQ ID NO: 3470656 - DNA, 12 bp, Homo sapiens
tgtttaaaacat

SEQ ID NO: 3470657 - DNA, 16 bp, Homo sapiens
tgtttaaaacatcatt

SEQ ID NO: 3470658 - DNA, 19 bp, Homo sapiens
tgtttaatgttctgtgata

SEQ ID NO: 3470659 - DNA, 23 bp, Homo sapiens
tgtttacaggatattccaaaata

SEQ ID NO: 3470660 - DNA, 13 bp, Homo sapiens
tgtttactaggga

SEQ ID NO: 3470661 - DNA, 19 bp, Homo sapiens
tgtttataaatcttatgct

SEQ ID NO: 3470662 - DNA, 14 bp, Homo sapiens
tgtttattaaatag

SEQ ID NO: 3470663 - DNA, 20 bp, Homo sapiens
tgtttccagacttccttgag

SEQ ID NO: 3470664 - DNA, 18 bp, Homo sapiens
tgtttccagcagaagaca

SEQ ID NO: 3470665 - DNA, 21 bp, Homo sapiens
tgtttcctgacattgtctcct

SEQ ID NO: 3470666 - DNA, 16 bp, Homo sapiens
tgtttccttttttccc

SEQ ID NO: 3470667 - DNA, 21 bp, Homo sapiens
tgtttctaacaattttcagac

SEQ ID NO: 3470668 - DNA, 18 bp, Homo sapiens
tgtttctacctatatgca

SEQ ID NO: 3470669 - DNA, 13 bp, Homo sapiens
tgtttctgtgggc

SEQ ID NO: 3470670 - DNA, 13 bp, Homo sapiens
tgtttcttcctgc

SEQ ID NO: 3470671 - DNA, 20 bp, Homo sapiens
tgtttcttttgtatgtaaat

SEQ ID NO: 3470672 - DNA, 21 bp, Homo sapiens
tgtttgaccttcagagccagc

SEQ ID NO: 3470673 - DNA, 14 bp, Homo sapiens
tgtttgcaagcagg

SEQ ID NO: 3470674 - DNA, 18 bp, Homo sapiens
tgtttgcactgtgtgctg

SEQ ID NO: 3470675 - DNA, 14 bp, Homo sapiens
tgtttggaaacatt

SEQ ID NO: 3470676 - DNA, 21 bp, Homo sapiens
tgtttggaggagcaaagttaa

SEQ ID NO: 3470677 - DNA, 17 bp, Homo sapiens
tgtttggtattgtattt

SEQ ID NO: 3470678 - DNA, 15 bp, Homo sapiens
tgtttggttttacat

SEQ ID NO: 3470679 - DNA, 22 bp, Homo sapiens
tgtttgtaactttttacattac

SEQ ID NO: 3470680 - DNA, 17 bp, Homo sapiens
tgtttgtcattagcctg

SEQ ID NO: 3470681 - DNA, 13 bp, Homo sapiens
tgtttgtgctgtg

SEQ ID NO: 3470682 - DNA, 11 bp, Homo sapiens
tgtttgtgtgt

SEQ ID NO: 3470683 - DNA, 14 bp, Homo sapiens
tgtttgttctgttt

SEQ ID NO: 3470684 - DNA, 16 bp, Homo sapiens
tgtttgttgtcagctg

SEQ ID NO: 3470685 - DNA, 15 bp, Homo sapiens
tgtttgttttggatt

SEQ ID NO: 3470686 - DNA, 20 bp, Homo sapiens
tgtttgttttggattcttta

SEQ ID NO: 3470687 - DNA, 12 bp, Homo sapiens
tgttttaaagaa

SEQ ID NO: 3470688 - DNA, 15 bp, Homo sapiens
tgttttaaatgtaca

SEQ ID NO: 3470689 - DNA, 16 bp, Homo sapiens
tgttttatgagaaagc

SEQ ID NO: 3470690 - DNA, 19 bp, Homo sapiens
tgttttatgagaaagcctt

SEQ ID NO: 3470691 - DNA, 16 bp, Homo sapiens
tgttttatttcattgg

SEQ ID NO: 3470692 - DNA, 16 bp, Homo sapiens
tgttttcccacgagga

SEQ ID NO: 3470693 - DNA, 19 bp, Homo sapiens
tgttttccgtgaaaacgga

SEQ ID NO: 3470694 - DNA, 21 bp, Homo sapiens
tgttttcctcccttctgctac

SEQ ID NO: 3470695 - DNA, 15 bp, Homo sapiens
tgttttctcttgaga

SEQ ID NO: 3470696 - DNA, 15 bp, Homo sapiens
tgttttctttgagga

SEQ ID NO: 3470697 - DNA, 18 bp, Homo sapiens
tgttttgagttttgtagc

SEQ ID NO: 3470698 - DNA, 11 bp, Homo sapiens
tgttttggatt

SEQ ID NO: 3470699 - DNA, 15 bp, Homo sapiens
tgttttggattcttt

SEQ ID NO: 3470700 - DNA, 22 bp, Homo sapiens
tgttttggattctttaaatata

SEQ ID NO: 3470701 - DNA, 15 bp, Homo sapiens
tgttttgtaccagtg

SEQ ID NO: 3470702 - DNA, 16 bp, Homo sapiens
tgttttgtaccagtga

SEQ ID NO: 3470703 - DNA, 14 bp, Homo sapiens
tgtttttaagctgt

SEQ ID NO: 3470704 - DNA, 15 bp, Homo sapiens
tgtttttaagctgtt

SEQ ID NO: 3470705 - DNA, 13 bp, Homo sapiens
tgtttttaatgct

SEQ ID NO: 3470706 - DNA, 11 bp, Homo sapiens
tgtttttcatt

SEQ ID NO: 3470707 - DNA, 16 bp, Homo sapiens
tgtttttgccactgat

SEQ ID NO: 3470708 - DNA, 18 bp, Homo sapiens
tgtttttgccactgattt

SEQ ID NO: 3470709 - DNA, 14 bp, Homo sapiens
tgtttttgttgtgt

SEQ ID NO: 3470710 - DNA, 16 bp, Homo sapiens
tgttttttcaaaatag

SEQ ID NO: 3470711 - DNA, 14 bp, Homo sapiens
tgttttttcatgtg

SEQ ID NO: 3470712 - DNA, 18 bp, Homo sapiens
ttaaaaaaaaagatctgt

SEQ ID NO: 3470713 - DNA, 23 bp, Homo sapiens
ttaaaaaaaacaaaaagaacaaa

SEQ ID NO: 3470714 - DNA, 21 bp, Homo sapiens
ttaaaaaaattggttggagaa

SEQ ID NO: 3470715 - DNA, 14 bp, Homo sapiens
ttaaaaaatatttt

SEQ ID NO: 3470716 - DNA, 16 bp, Homo sapiens
ttaaaaacatagaaaa

SEQ ID NO: 3470717 - DNA, 18 bp, Homo sapiens
ttaaaaagtggaaaaata

SEQ ID NO: 3470718 - DNA, 14 bp, Homo sapiens
ttaaaaatacacat

SEQ ID NO: 3470719 - DNA, 13 bp, Homo sapiens
ttaaaaatataaa

SEQ ID NO: 3470720 - DNA, 12 bp, Homo sapiens
ttaaaaatgcaa

SEQ ID NO: 3470721 - DNA, 20 bp, Homo sapiens
ttaaaaatgttttttcatgt

SEQ ID NO: 3470722 - DNA, 20 bp, Homo sapiens
ttaaaacaatattgtttcta

SEQ ID NO: 3470723 - DNA, 18 bp, Homo sapiens
ttaaaacactttcaaaac

SEQ ID NO: 3470724 - DNA, 14 bp, Homo sapiens
ttaaaacccaagtg

SEQ ID NO: 3470725 - DNA, 14 bp, Homo sapiens
ttaaaagaagcttt

SEQ ID NO: 3470726 - DNA, 16 bp, Homo sapiens
ttaaaagacaagactt

SEQ ID NO: 3470727 - DNA, 11 bp, Homo sapiens
ttaaaagagag

SEQ ID NO: 3470728 - DNA, 14 bp, Homo sapiens
ttaaaagtaggaaa

SEQ ID NO: 3470729 - DNA, 14 bp, Homo sapiens
ttaaaataaactgt

SEQ ID NO: 3470730 - DNA, 17 bp, Homo sapiens
ttaaaataaactgtaaa

SEQ ID NO: 3470731 - DNA, 17 bp, Homo sapiens
ttaaaatattttggatg

SEQ ID NO: 3470732 - DNA, 18 bp, Homo sapiens
ttaaaatgcaaaataatg

SEQ ID NO: 3470733 - DNA, 19 bp, Homo sapiens
ttaaaatggtttgtcctga

SEQ ID NO: 3470734 - DNA, 16 bp, Homo sapiens
ttaaaatgtaaagcca

SEQ ID NO: 3470735 - DNA, 17 bp, Homo sapiens
ttaaaatgtaaagccat

SEQ ID NO: 3470736 - DNA, 13 bp, Homo sapiens
ttaaaatgttcac

SEQ ID NO: 3470737 - DNA, 21 bp, Homo sapiens
ttaaacagatatcttcagttt

SEQ ID NO: 3470738 - DNA, 17 bp, Homo sapiens
ttaaaccgccaaggctg

SEQ ID NO: 3470739 - DNA, 21 bp, Homo sapiens
ttaaacctgtttttttttcat

SEQ ID NO: 3470740 - DNA, 22 bp, Homo sapiens
ttaaactaggagaaccaaatct

SEQ ID NO: 3470741 - DNA, 19 bp, Homo sapiens
ttaaactcttcacaaaatc

SEQ ID NO: 3470742 - DNA, 13 bp, Homo sapiens
ttaaactggtatt

SEQ ID NO: 3470743 - DNA, 22 bp, Homo sapiens
ttaaactggtattttatctttg

SEQ ID NO: 3470744 - DNA, 20 bp, Homo sapiens
ttaaagaatatgacttttta

SEQ ID NO: 3470745 - DNA, 20 bp, Homo sapiens
ttaaagggagatggtaagaa

SEQ ID NO: 3470746 - DNA, 13 bp, Homo sapiens
ttaaagtgaattg

SEQ ID NO: 3470747 - DNA, 14 bp, Homo sapiens
ttaaagttgtaaca

SEQ ID NO: 3470748 - DNA, 19 bp, Homo sapiens
ttaaatagagtatatgcac

SEQ ID NO: 3470749 - DNA, 15 bp, Homo sapiens
ttaaatataatatgc

SEQ ID NO: 3470750 - DNA, 21 bp, Homo sapiens
ttaaatatatattattctcat

SEQ ID NO: 3470751 - DNA, 22 bp, Homo sapiens
ttaaatattttctattttaaga

SEQ ID NO: 3470752 - DNA, 23 bp, Homo sapiens
ttaaatgggctactttgtccttt

SEQ ID NO: 3470753 - DNA, 11 bp, Homo sapiens
ttaaatgtgtt

SEQ ID NO: 3470754 - DNA, 15 bp, Homo sapiens
ttaaattacaatttt

SEQ ID NO: 3470755 - DNA, 16 bp, Homo sapiens
ttaaattttgtaatga

SEQ ID NO: 3470756 - DNA, 15 bp, Homo sapiens
ttaacaatattttat

SEQ ID NO: 3470757 - DNA, 17 bp, Homo sapiens
ttaacaattaggcagac

SEQ ID NO: 3470758 - DNA, 13 bp, Homo sapiens
ttaacactgagct

SEQ ID NO: 3470759 - DNA, 18 bp, Homo sapiens
ttaacagcatgacaaaaa

SEQ ID NO: 3470760 - DNA, 20 bp, Homo sapiens
tgtgccaggtttttggtctg

SEQ ID NO: 3470761 - DNA, 15 bp, Homo sapiens
tgtgccgacagaagg

SEQ ID NO: 3470762 - DNA, 20 bp, Homo sapiens
tgtgcctgggtggacatggc

SEQ ID NO: 3470763 - DNA, 23 bp, Homo sapiens
tgtgccttcgtctttcccatggg

SEQ ID NO: 3470764 - DNA, 19 bp, Homo sapiens
tgtgcgcctacaggagtga

SEQ ID NO: 3470765 - DNA, 14 bp, Homo sapiens
tgtgctacagatga

SEQ ID NO: 3470766 - DNA, 17 bp, Homo sapiens
tgtgctatagtatttga

SEQ ID NO: 3470767 - DNA, 18 bp, Homo sapiens
tgtgctcaggactcagaa

SEQ ID NO: 3470768 - DNA, 12 bp, Homo sapiens
tgtgctctgatc

SEQ ID NO: 3470769 - DNA, 22 bp, Homo sapiens
tgtgctctgatcatccactgtg

SEQ ID NO: 3470770 - DNA, 23 bp, Homo sapiens
tgtgctctgatcatccactgtgc

SEQ ID NO: 3470771 - DNA, 16 bp, Homo sapiens
tgtgctctggacaggc

SEQ ID NO: 3470772 - DNA, 18 bp, Homo sapiens
tgtgctctggacaggcat

SEQ ID NO: 3470773 - DNA, 19 bp, Homo sapiens
tgtgctgtgctatggtgct

SEQ ID NO: 3470774 - DNA, 14 bp, Homo sapiens
tgtgcttctttctt

SEQ ID NO: 3470775 - DNA, 15 bp, Homo sapiens
tgtgcttgaaggccc

SEQ ID NO: 3470776 - DNA, 17 bp, Homo sapiens
tgtgcttgaaggccctg

SEQ ID NO: 3470777 - DNA, 15 bp, Homo sapiens
tgtgcttggtctgtt

SEQ ID NO: 3470778 - DNA, 20 bp, Homo sapiens
tgtgctttatgctgaaacag

SEQ ID NO: 3470779 - DNA, 20 bp, Homo sapiens
tgtgctttgtatcagtcagt

SEQ ID NO: 3470780 - DNA, 14 bp, Homo sapiens
tgtggacacagctc

SEQ ID NO: 3470781 - DNA, 15 bp, Homo sapiens
tgtggacacagctct

SEQ ID NO: 3470782 - DNA, 19 bp, Homo sapiens
tgtggactaaaagatataa

SEQ ID NO: 3470783 - DNA, 19 bp, Homo sapiens
tgtggagaagccacaggcc

SEQ ID NO: 3470784 - DNA, 13 bp, Homo sapiens
tgtggagggcaca

SEQ ID NO: 3470785 - DNA, 14 bp, Homo sapiens
tgtggatcagagat

SEQ ID NO: 3470786 - DNA, 14 bp, Homo sapiens
tgtggatgataaaa

SEQ ID NO: 3470787 - DNA, 22 bp, Homo sapiens
tgtggatgccgatttctgtaaa

SEQ ID NO: 3470788 - DNA, 17 bp, Homo sapiens
tgtggcaaggaaaaaca

SEQ ID NO: 3470789 - DNA, 15 bp, Homo sapiens
tgtggccaaggagct

SEQ ID NO: 3470790 - DNA, 19 bp, Homo sapiens
tgtggccaaggagctgcta

SEQ ID NO: 3470791 - DNA, 21 bp, Homo sapiens
tgtggccaaggagctgctata

SEQ ID NO: 3470792 - DNA, 14 bp, Homo sapiens
tgtggccatggcct

SEQ ID NO: 3470793 - DNA, 20 bp, Homo sapiens
tgtggccttccatttatatg

SEQ ID NO: 3470794 - DNA, 18 bp, Homo sapiens
tgtggcgccgtctccagg

SEQ ID NO: 3470795 - DNA, 18 bp, Homo sapiens
tgtggggcacagatgcct

SEQ ID NO: 3470796 - DNA, 12 bp, Homo sapiens
tgtggggcccct

SEQ ID NO: 3470797 - DNA, 13 bp, Homo sapiens
tgtgggggcttca

SEQ ID NO: 3470798 - DNA, 16 bp, Homo sapiens
tgtgggggcttcatct

SEQ ID NO: 3470799 - DNA, 19 bp, Homo sapiens
tgtgggggcttcatctctt

SEQ ID NO: 3470800 - DNA, 20 bp, Homo sapiens
tgtggggtgacgggactcag

SEQ ID NO: 3470801 - DNA, 17 bp, Homo sapiens
tgtgggtgatggggagg

SEQ ID NO: 3470802 - DNA, 15 bp, Homo sapiens
tgtggtctaaagtgt

SEQ ID NO: 3470803 - DNA, 21 bp, Homo sapiens
tgtggtctaaagtgtttagct

SEQ ID NO: 3470804 - DNA, 17 bp, Homo sapiens
tgtggtgcagtgtgaaa

SEQ ID NO: 3470805 - DNA, 23 bp, Homo sapiens
tgtggtgtgtccccctctgtcca

SEQ ID NO: 3470806 - DNA, 14 bp, Homo sapiens
tgtgtattaaaaaa

SEQ ID NO: 3470807 - DNA, 19 bp, Homo sapiens
tgtgtattaaaaaaaacaa

SEQ ID NO: 3470808 - DNA, 19 bp, Homo sapiens
tgtgtcagcatagaagtaa

SEQ ID NO: 3470809 - DNA, 15 bp, Homo sapiens
tgtgtcagctgaggc

SEQ ID NO: 3470810 - DNA, 17 bp, Homo sapiens
tgtgtcagctgaggctg

SEQ ID NO: 3470811 - DNA, 22 bp, Homo sapiens
tgtgtcagtggggctctctgag

SEQ ID NO: 3470812 - DNA, 18 bp, Homo sapiens
tgtgtccacgactgtctc

SEQ ID NO: 3470813 - DNA, 17 bp, Homo sapiens
tgtgtcctccaggagct

SEQ ID NO: 3470814 - DNA, 15 bp, Homo sapiens
tgtgtctaaactgca

SEQ ID NO: 3470815 - DNA, 17 bp, Homo sapiens
tgtgtctaaactgcatt

SEQ ID NO: 3470816 - DNA, 21 bp, Homo sapiens
tgtgtcttgcaatggcagcct

SEQ ID NO: 3470817 - DNA, 17 bp, Homo sapiens
tgtgtgaatgaacactc

SEQ ID NO: 3470818 - DNA, 22 bp, Homo sapiens
tgtgtgaatgaacactcttttg

SEQ ID NO: 3470819 - DNA, 23 bp, Homo sapiens
tgtgtgattgcacgtgcctgtgg

SEQ ID NO: 3470820 - DNA, 19 bp, Homo sapiens
tgtgtgcacgtacacacac

SEQ ID NO: 3470821 - DNA, 15 bp, Homo sapiens
tgtgtgctgactgaa

SEQ ID NO: 3470822 - DNA, 18 bp, Homo sapiens
tgtgtgctgactgaacat

SEQ ID NO: 3470823 - DNA, 17 bp, Homo sapiens
tgtgtggccacttctgt

SEQ ID NO: 3470824 - DNA, 11 bp, Homo sapiens
tgtgtggcctg

SEQ ID NO: 3470825 - DNA, 19 bp, Homo sapiens
tgtgtgtccaaaactgcct

SEQ ID NO: 3470826 - DNA, 16 bp, Homo sapiens
tgtgtgtgacaattct

SEQ ID NO: 3470827 - DNA, 14 bp, Homo sapiens
tgtgtgtgtcagct

SEQ ID NO: 3470828 - DNA, 12 bp, Homo sapiens
tgtgtgtgtgca

SEQ ID NO: 3470829 - DNA, 11 bp, Homo sapiens
tgtgtgtgtgt

SEQ ID NO: 3470830 - DNA, 20 bp, Homo sapiens
tgtgtgttgccacaggacac

SEQ ID NO: 3470831 - DNA, 18 bp, Homo sapiens
tgtgtgttgtctcttgag

SEQ ID NO: 3470832 - DNA, 23 bp, Homo sapiens
tgtgttacctgaaaacactgtgc

SEQ ID NO: 3470833 - DNA, 14 bp, Homo sapiens
tgtgttactgcttt

SEQ ID NO: 3470834 - DNA, 15 bp, Homo sapiens
tgtgttgaaggaact

SEQ ID NO: 3470835 - DNA, 22 bp, Homo sapiens
tgtgttgggattgagtctgtgc

SEQ ID NO: 3470836 - DNA, 19 bp, Homo sapiens
tgtgttgtctcttgagttt

SEQ ID NO: 3470837 - DNA, 22 bp, Homo sapiens
tgtgtttcaaaaccatgcctgg

SEQ ID NO: 3470838 - DNA, 16 bp, Homo sapiens
tgtgtttgaaatcatc

SEQ ID NO: 3470839 - DNA, 17 bp, Homo sapiens
tgtgtttgtcattagcc

SEQ ID NO: 3470840 - DNA, 20 bp, Homo sapiens
tgtgtttgttctttttattg

SEQ ID NO: 3470841 - DNA, 19 bp, Homo sapiens
tgttaaactagcatatctg

SEQ ID NO: 3470842 - DNA, 14 bp, Homo sapiens
tgttaaataaattg

SEQ ID NO: 3470843 - DNA, 16 bp, Homo sapiens
tgttaaataaattgta

SEQ ID NO: 3470844 - DNA, 17 bp, Homo sapiens
tgttaacctaggcagtg

SEQ ID NO: 3470845 - DNA, 23 bp, Homo sapiens
tgttaagcagctaaattttctga

SEQ ID NO: 3470846 - DNA, 15 bp, Homo sapiens
tgttaagcttctatt

SEQ ID NO: 3470847 - DNA, 22 bp, Homo sapiens
tgttaaggtcctgaaagtaact

SEQ ID NO: 3470848 - DNA, 15 bp, Homo sapiens
tgttaaggttcaaga

SEQ ID NO: 3470849 - DNA, 15 bp, Homo sapiens
tgttaagtattttca

SEQ ID NO: 3470850 - DNA, 16 bp, Homo sapiens
tgttacacaatggttt

SEQ ID NO: 3470851 - DNA, 22 bp, Homo sapiens
tgttacacaatggtttttaaat

SEQ ID NO: 3470852 - DNA, 16 bp, Homo sapiens
tgttacctgaaaacac

SEQ ID NO: 3470853 - DNA, 18 bp, Homo sapiens
tgttactaactaaactct

SEQ ID NO: 3470854 - DNA, 12 bp, Homo sapiens
tgttactgtaat

SEQ ID NO: 3470855 - DNA, 15 bp, Homo sapiens
tgttactgtaattcc

SEQ ID NO: 3470856 - DNA, 15 bp, Homo sapiens
tgttactgtcttcag

SEQ ID NO: 3470857 - DNA, 16 bp, Homo sapiens
tgttactgtcttcagt

SEQ ID NO: 3470858 - DNA, 15 bp, Homo sapiens
tgttagactcatggt

SEQ ID NO: 3470859 - DNA, 22 bp, Homo sapiens
tgttagaggatccctctctgga

SEQ ID NO: 3470860 - DNA, 19 bp, Homo sapiens
tgttatagaacttcatgga

SEQ ID NO: 3470861 - DNA, 17 bp, Homo sapiens
tgttatatcatatgtat

SEQ ID NO: 3470862 - DNA, 18 bp, Homo sapiens
tgttatggcttaatgaca

SEQ ID NO: 3470863 - DNA, 21 bp, Homo sapiens
tgttattagagattacctcct

SEQ ID NO: 3470864 - DNA, 14 bp, Homo sapiens
tgttattgaagtgt

SEQ ID NO: 3470865 - DNA, 15 bp, Homo sapiens
tgttattgaagtgtt

SEQ ID NO: 3470866 - DNA, 22 bp, Homo sapiens
tgttattgttttgttaattaca

SEQ ID NO: 3470867 - DNA, 19 bp, Homo sapiens
tgttatttaacccatttgt

SEQ ID NO: 3470868 - DNA, 14 bp, Homo sapiens
tgttattttgcaac

SEQ ID NO: 3470869 - DNA, 20 bp, Homo sapiens
tgttcaaacccagtcttgtg

SEQ ID NO: 3470870 - DNA, 20 bp, Homo sapiens
tgttcaaagactgtgaacag

SEQ ID NO: 3470871 - DNA, 22 bp, Homo sapiens
tgttcaaagccagcgtcctcct

SEQ ID NO: 3470872 - DNA, 11 bp, Homo sapiens
tgttcagctgg

SEQ ID NO: 3470873 - DNA, 15 bp, Homo sapiens
tgttcatagcccagt

SEQ ID NO: 3470874 - DNA, 19 bp, Homo sapiens
tgttcatagcccagtagac

SEQ ID NO: 3470875 - DNA, 20 bp, Homo sapiens
tgttcatagcccagtagacc

SEQ ID NO: 3470876 - DNA, 11 bp, Homo sapiens
tgttcatccca

SEQ ID NO: 3470877 - DNA, 15 bp, Homo sapiens
tgttcattttgagta

SEQ ID NO: 3470878 - DNA, 18 bp, Homo sapiens
tgttccaatgtcaatgtg

SEQ ID NO: 3470879 - DNA, 19 bp, Homo sapiens
tgttccacttgtttgcact

SEQ ID NO: 3470880 - DNA, 12 bp, Homo sapiens
tgttccagacat

SEQ ID NO: 3470881 - DNA, 13 bp, Homo sapiens
tgttccccagaga

SEQ ID NO: 3470882 - DNA, 15 bp, Homo sapiens
tgttcccctcctcca

SEQ ID NO: 3470883 - DNA, 17 bp, Homo sapiens
tgttcccctcctccact

SEQ ID NO: 3470884 - DNA, 22 bp, Homo sapiens
tgttccctatttttctctcctg

SEQ ID NO: 3470885 - DNA, 15 bp, Homo sapiens
tgttcctggcagttt

SEQ ID NO: 3470886 - DNA, 17 bp, Homo sapiens
tgttccttggcagtgga

SEQ ID NO: 3470887 - DNA, 20 bp, Homo sapiens
tgttcgcatggtcacacact

SEQ ID NO: 3470888 - DNA, 15 bp, Homo sapiens
tgttcgggtgtgggt

SEQ ID NO: 3470889 - DNA, 16 bp, Homo sapiens
tgttctaacatgtaat

SEQ ID NO: 3470890 - DNA, 14 bp, Homo sapiens
tgttctcattcctg

SEQ ID NO: 3470891 - DNA, 15 bp, Homo sapiens
tgttctctgggagaa

SEQ ID NO: 3470892 - DNA, 13 bp, Homo sapiens
tgttctggaggaa

SEQ ID NO: 3470893 - DNA, 12 bp, Homo sapiens
tgttctgggaca

SEQ ID NO: 3470894 - DNA, 20 bp, Homo sapiens
tgttctggtggtttgattgt

SEQ ID NO: 3470895 - DNA, 21 bp, Homo sapiens
tgttctggtggtttgattgtt

SEQ ID NO: 3470896 - DNA, 17 bp, Homo sapiens
tgttctgtcttcccaaa

SEQ ID NO: 3470897 - DNA, 18 bp, Homo sapiens
tgtccaaagcagggtctg

SEQ ID NO: 3470898 - DNA, 19 bp, Homo sapiens
tgtccaaagcagggtctgg

SEQ ID NO: 3470899 - DNA, 15 bp, Homo sapiens
tgtccacacccagct

SEQ ID NO: 3470900 - DNA, 16 bp, Homo sapiens
tgtccacgactgtctc

SEQ ID NO: 3470901 - DNA, 19 bp, Homo sapiens
tgtccacgactgtctccat

SEQ ID NO: 3470902 - DNA, 20 bp, Homo sapiens
tgtccacgtgtgtgtgtgat

SEQ ID NO: 3470903 - DNA, 17 bp, Homo sapiens
tgtccagagctggccag

SEQ ID NO: 3470904 - DNA, 15 bp, Homo sapiens
tgtccagtgcctaca

SEQ ID NO: 3470905 - DNA, 22 bp, Homo sapiens
tgtccatgcgctcagggccatg

SEQ ID NO: 3470906 - DNA, 17 bp, Homo sapiens
tgtccattgtccaatcc

SEQ ID NO: 3470907 - DNA, 17 bp, Homo sapiens
tgtcccactcaagccaa

SEQ ID NO: 3470908 - DNA, 20 bp, Homo sapiens
tgtcccactcaagccaagca

SEQ ID NO: 3470909 - DNA, 11 bp, Homo sapiens
tgtccccttct

SEQ ID NO: 3470910 - DNA, 20 bp, Homo sapiens
tgtccccttctctcatctct

SEQ ID NO: 3470911 - DNA, 21 bp, Homo sapiens
tgtccctagtaaaaatacaaa

SEQ ID NO: 3470912 - DNA, 14 bp, Homo sapiens
tgtccctctgcccc

SEQ ID NO: 3470913 - DNA, 16 bp, Homo sapiens
tgtccctctgccccat

SEQ ID NO: 3470914 - DNA, 23 bp, Homo sapiens
tgtccctgcacttgcagactcta

SEQ ID NO: 3470915 - DNA, 13 bp, Homo sapiens
tgtccctgttaga

SEQ ID NO: 3470916 - DNA, 22 bp, Homo sapiens
tgctgacagacacaggcccggc

SEQ ID NO: 3470917 - DNA, 18 bp, Homo sapiens
tgctgacattcacctgcc

SEQ ID NO: 3470918 - DNA, 17 bp, Homo sapiens
tgctgacggccagggag

SEQ ID NO: 3470919 - DNA, 21 bp, Homo sapiens
tgctgactgttttctcttgag

SEQ ID NO: 3470920 - DNA, 14 bp, Homo sapiens
tgctgagaagcttt

SEQ ID NO: 3470921 - DNA, 14 bp, Homo sapiens
tgctgagcctctgc

SEQ ID NO: 3470922 - DNA, 12 bp, Homo sapiens
tgctgagggtgt

SEQ ID NO: 3470923 - DNA, 22 bp, Homo sapiens
tgctgagggtgtttcttcctgc

SEQ ID NO: 3470924 - DNA, 19 bp, Homo sapiens
tgctgagtcatctgttagg

SEQ ID NO: 3470925 - DNA, 21 bp, Homo sapiens
tgctgagtcatctgttagggc

SEQ ID NO: 3470926 - DNA, 19 bp, Homo sapiens
tgctgatggtctggtctat

SEQ ID NO: 3470927 - DNA, 14 bp, Homo sapiens
tgctgcatacattc

SEQ ID NO: 3470928 - DNA, 15 bp, Homo sapiens
tgctgcatgccctct

SEQ ID NO: 3470929 - DNA, 12 bp, Homo sapiens
tgctgccatcca

SEQ ID NO: 3470930 - DNA, 22 bp, Homo sapiens
tgctgccatccaggttcagctt

SEQ ID NO: 3470931 - DNA, 18 bp, Homo sapiens
tgctgccccatcagtgct

SEQ ID NO: 3470932 - DNA, 18 bp, Homo sapiens
tgctgctcctccctctga

SEQ ID NO: 3470933 - DNA, 19 bp, Homo sapiens
tgctgctcctccctctgac

SEQ ID NO: 3470934 - DNA, 22 bp, Homo sapiens
tgctgctcctccctctgaccca

SEQ ID NO: 3470935 - DNA, 13 bp, Homo sapiens
tgctgctggacag

SEQ ID NO: 3470936 - DNA, 23 bp, Homo sapiens
tgctgctggacagtatcactgtc

SEQ ID NO: 3470937 - DNA, 13 bp, Homo sapiens
tgctgctggccaa

SEQ ID NO: 3470938 - DNA, 17 bp, Homo sapiens
tgctgcttttccttggg

SEQ ID NO: 3470939 - DNA, 14 bp, Homo sapiens
tgctggaagcccag

SEQ ID NO: 3470940 - DNA, 13 bp, Homo sapiens
tgctggagactcc

SEQ ID NO: 3470941 - DNA, 16 bp, Homo sapiens
tgctggagcactgggc

SEQ ID NO: 3470942 - DNA, 17 bp, Homo sapiens
tgctggaggcctcaggt

SEQ ID NO: 3470943 - DNA, 21 bp, Homo sapiens
tgctggaggcctcaggtgctg

SEQ ID NO: 3470944 - DNA, 15 bp, Homo sapiens
tgtaattgtttgtct

SEQ ID NO: 3470945 - DNA, 15 bp, Homo sapiens
tgtaattttactttt

SEQ ID NO: 3470946 - DNA, 20 bp, Homo sapiens
tgtacaataaaaacattgcc

SEQ ID NO: 3470947 - DNA, 15 bp, Homo sapiens
tgtacagaatatttc

SEQ ID NO: 3470948 - DNA, 22 bp, Homo sapiens
tgtacagacatatttaactggt

SEQ ID NO: 3470949 - DNA, 14 bp, Homo sapiens
tgtacagtagattt

SEQ ID NO: 3470950 - DNA, 18 bp, Homo sapiens
tgtacatatgtaaaataa

SEQ ID NO: 3470951 - DNA, 19 bp, Homo sapiens
tgtacatatgtaaaataaa

SEQ ID NO: 3470952 - DNA, 20 bp, Homo sapiens
tgtacatcctgcagcttatt

SEQ ID NO: 3470953 - DNA, 18 bp, Homo sapiens
tgtacatctattttggat

SEQ ID NO: 3470954 - DNA, 20 bp, Homo sapiens
tgccagccagaagcctctgc

SEQ ID NO: 3470955 - DNA, 23 bp, Homo sapiens
tgccagctctgtatcaggaccca

SEQ ID NO: 3470956 - DNA, 15 bp, Homo sapiens
tgccagctgcactga

SEQ ID NO: 3470957 - DNA, 20 bp, Homo sapiens
tgccaggaccagtcaacctg

SEQ ID NO: 3470958 - DNA, 22 bp, Homo sapiens
tgccagggaggtggaaggaccc

SEQ ID NO: 3470959 - DNA, 24 bp, Homo sapiens
tgccagggaggtggaaggaccctg

SEQ ID NO: 3470960 - DNA, 17 bp, Homo sapiens
tgccagggcaatgatga

SEQ ID NO: 3470961 - DNA, 15 bp, Homo sapiens
tgccagggcagggcc

SEQ ID NO: 3470962 - DNA, 16 bp, Homo sapiens
tgccagggcagggccc

SEQ ID NO: 3470963 - DNA, 17 bp, Homo sapiens
tgccaggtttttggtct

SEQ ID NO: 3470964 - DNA, 23 bp, Homo sapiens
tgccagtcctaggcccctgccct

SEQ ID NO: 3470965 - DNA, 19 bp, Homo sapiens
tgccagtgtgctgatgggc

SEQ ID NO: 3470966 - DNA, 13 bp, Homo sapiens
tgccataaaacat

SEQ ID NO: 3470967 - DNA, 21 bp, Homo sapiens
tgccataaaacattaagaaaa

SEQ ID NO: 3470968 - DNA, 14 bp, Homo sapiens
tgccataatatgat

SEQ ID NO: 3470969 - DNA, 19 bp, Homo sapiens
tgccatagccaggagcgca

SEQ ID NO: 3470970 - DNA, 15 bp, Homo sapiens
tgccatattctgttg

SEQ ID NO: 3470971 - DNA, 21 bp, Homo sapiens
tgccatattctgttggccagt

SEQ ID NO: 3470972 - DNA, 21 bp, Homo sapiens
tgccatattgcacatgtctta

SEQ ID NO: 3470973 - DNA, 16 bp, Homo sapiens
tgccatcatctcctgc

SEQ ID NO: 3470974 - DNA, 12 bp, Homo sapiens
tgccatccaggt

SEQ ID NO: 3470975 - DNA, 11 bp, Homo sapiens
tgccatcctca

SEQ ID NO: 3470976 - DNA, 19 bp, Homo sapiens
tgccatcctcaaacactgc

SEQ ID NO: 3470977 - DNA, 23 bp, Homo sapiens
tgccatcctcaaacactgcaggc

SEQ ID NO: 3470978 - DNA, 17 bp, Homo sapiens
tgccatgatgcctctgt

SEQ ID NO: 3470979 - DNA, 16 bp, Homo sapiens
tgccatgcagggcctc

SEQ ID NO: 3470980 - DNA, 20 bp, Homo sapiens
tgccatggaactgtttcctt

SEQ ID NO: 3470981 - DNA, 23 bp, Homo sapiens
tgccatggaagaggctacagggc

SEQ ID NO: 3470982 - DNA, 21 bp, Homo sapiens
tgccatgttggccaggctggt

SEQ ID NO: 3470983 - DNA, 22 bp, Homo sapiens
tgccattctcttgcattgtgac

SEQ ID NO: 3470984 - DNA, 20 bp, Homo sapiens
tgcccaaatccttagatctg

SEQ ID NO: 3470985 - DNA, 18 bp, Homo sapiens
tgcccaactgtgtagcat

SEQ ID NO: 3470986 - DNA, 11 bp, Homo sapiens
tgcccaagcca

SEQ ID NO: 3470987 - DNA, 13 bp, Homo sapiens
tgcccaagccaga

SEQ ID NO: 3470988 - DNA, 15 bp, Homo sapiens
tgcccaagccagagg

SEQ ID NO: 3470989 - DNA, 18 bp, Homo sapiens
tgcccaagccagaggctg

SEQ ID NO: 3470990 - DNA, 23 bp, Homo sapiens
tgcccaagccagaggctgggttc

SEQ ID NO: 3470991 - DNA, 18 bp, Homo sapiens
tgcccagctatacctgtg

SEQ ID NO: 3470992 - DNA, 14 bp, Homo sapiens
tgcccaggatttga

SEQ ID NO: 3470993 - DNA, 20 bp, Homo sapiens
tgcccaggcaggtcttgaac

SEQ ID NO: 3470994 - DNA, 11 bp, Homo sapiens
tgcccaggccc

SEQ ID NO: 3470995 - DNA, 14 bp, Homo sapiens
tgcccaggcccctg

SEQ ID NO: 3470996 - DNA, 20 bp, Homo sapiens
tgcccaggtttctggtctct

SEQ ID NO: 3470997 - DNA, 24 bp, Homo sapiens
tgcccatggacaggctggctccag

SEQ ID NO: 3470998 - DNA, 22 bp, Homo sapiens
tgccccacatgtggccatggcc

SEQ ID NO: 3470999 - DNA, 16 bp, Homo sapiens
tgccccactctgcctg

SEQ ID NO: 3471000 - DNA, 19 bp, Homo sapiens
tgccccaggaccagctcag

SEQ ID NO: 3471001 - DNA, 19 bp, Homo sapiens
tgccccagggatgggaggt

SEQ ID NO: 3471002 - DNA, 17 bp, Homo sapiens
tgccccatcctccagca

SEQ ID NO: 3471003 - DNA, 18 bp, Homo sapiens
tgccccatcctccagcag

SEQ ID NO: 3471004 - DNA, 11 bp, Homo sapiens
tgcccccagga

SEQ ID NO: 3471005 - DNA, 13 bp, Homo sapiens
tgcccccaggact

SEQ ID NO: 3471006 - DNA, 18 bp, Homo sapiens
tgccccgcttccccacag

SEQ ID NO: 3471007 - DNA, 17 bp, Homo sapiens
tgccccgggtccccagc

SEQ ID NO: 3471008 - DNA, 20 bp, Homo sapiens
tgccccgggtccccagctcc

SEQ ID NO: 3471009 - DNA, 17 bp, Homo sapiens
tgccccgtctctgttcc

SEQ ID NO: 3471010 - DNA, 12 bp, Homo sapiens
tgcccctcccag

SEQ ID NO: 3471011 - DNA, 13 bp, Homo sapiens
tgcccctctctgg

SEQ ID NO: 3471012 - DNA, 21 bp, Homo sapiens
tgcccctctctgggcctcaga

SEQ ID NO: 3471013 - DNA, 12 bp, Homo sapiens
tgcccctgctgc

SEQ ID NO: 3471014 - DNA, 13 bp, Homo sapiens
tgcccctggctgg

SEQ ID NO: 3471015 - DNA, 18 bp, Homo sapiens
tgcccgcagacctctgga

SEQ ID NO: 3471016 - DNA, 14 bp, Homo sapiens
tgcccggctgcgga

SEQ ID NO: 3471017 - DNA, 18 bp, Homo sapiens
tgcccggggaaaggcaag

SEQ ID NO: 3471018 - DNA, 22 bp, Homo sapiens
tgccctaacctctgagtcacca

SEQ ID NO: 3471019 - DNA, 22 bp, Homo sapiens
tgccctactatagcagttttta

SEQ ID NO: 3471020 - DNA, 22 bp, Homo sapiens
tgccctagttttctttcctcct

SEQ ID NO: 3471021 - DNA, 16 bp, Homo sapiens
tgccctatgggcctgc

SEQ ID NO: 3471022 - DNA, 19 bp, Homo sapiens
tgccctccagctctttcct

SEQ ID NO: 3471023 - DNA, 21 bp, Homo sapiens
tgccctccagctctttcctcc

SEQ ID NO: 3471024 - DNA, 14 bp, Homo sapiens
tgccctcccctctc

SEQ ID NO: 3471025 - DNA, 23 bp, Homo sapiens
tgccctcctgacccattgctgtt

SEQ ID NO: 3471026 - DNA, 14 bp, Homo sapiens
tgccctgccctcac

SEQ ID NO: 3471027 - DNA, 13 bp, Homo sapiens
tgccctgtgtact

SEQ ID NO: 3471028 - DNA, 19 bp, Homo sapiens
tgccctgttctctaccaag

SEQ ID NO: 3471029 - DNA, 19 bp, Homo sapiens
tgcccttttttctgcctcc

SEQ ID NO: 3471030 - DNA, 18 bp, Homo sapiens
tgccgatttctgtaaact

SEQ ID NO: 3471031 - DNA, 20 bp, Homo sapiens
tgccgatttctgtaaactct

SEQ ID NO: 3471032 - DNA, 13 bp, Homo sapiens
tgccgcagagctg

SEQ ID NO: 3471033 - DNA, 21 bp, Homo sapiens
tgccgcgtcgccctcccaggc

SEQ ID NO: 3471034 - DNA, 21 bp, Homo sapiens
tgccggagaggaagagacact

SEQ ID NO: 3471035 - DNA, 19 bp, Homo sapiens
tgccggcacagctgggata

SEQ ID NO: 3471036 - DNA, 14 bp, Homo sapiens
tgccggccctgggg

SEQ ID NO: 3471037 - DNA, 15 bp, Homo sapiens
tgccggccctggggc

SEQ ID NO: 3471038 - DNA, 22 bp, Homo sapiens
tgccgggctgagggcctgctgg

SEQ ID NO: 3471039 - DNA, 14 bp, Homo sapiens
tgccgggttttata

SEQ ID NO: 3471040 - DNA, 20 bp, Homo sapiens
tgccggtaaacacgcctgca

SEQ ID NO: 3471041 - DNA, 15 bp, Homo sapiens
tgcctagaggcccca

SEQ ID NO: 3471042 - DNA, 19 bp, Homo sapiens
tgcctaggtcccccaagca

SEQ ID NO: 3471043 - DNA, 17 bp, Homo sapiens
tgcctatcctgctgttc

SEQ ID NO: 3471044 - DNA, 23 bp, Homo sapiens
tgcctatcctgctgttctagcac

SEQ ID NO: 3471045 - DNA, 17 bp, Homo sapiens
tgcagcagggatgccct

SEQ ID NO: 3471046 - DNA, 13 bp, Homo sapiens
tgcagccagaggc

SEQ ID NO: 3471047 - DNA, 14 bp, Homo sapiens
tgcagccagaggca

SEQ ID NO: 3471048 - DNA, 22 bp, Homo sapiens
tgcagccctgagaaagccctgt

SEQ ID NO: 3471049 - DNA, 14 bp, Homo sapiens
tgcagccgctgagc

SEQ ID NO: 3471050 - DNA, 18 bp, Homo sapiens
tgcagcctcaacctcctg

SEQ ID NO: 3471051 - DNA, 19 bp, Homo sapiens
tgcagcctcaacctcctgg

SEQ ID NO: 3471052 - DNA, 23 bp, Homo sapiens
tgcagcctcaacctcctgggcta

SEQ ID NO: 3471053 - DNA, 14 bp, Homo sapiens
tgcagcctgcgcca

SEQ ID NO: 3471054 - DNA, 20 bp, Homo sapiens
tgcagctcaagagatcccaa

SEQ ID NO: 3471055 - DNA, 14 bp, Homo sapiens
tgcaggacctcagg

SEQ ID NO: 3471056 - DNA, 15 bp, Homo sapiens
tgcaggacctcaggt

SEQ ID NO: 3471057 - DNA, 15 bp, Homo sapiens
tgcaggacctgcctg

SEQ ID NO: 3471058 - DNA, 18 bp, Homo sapiens
tgcaggacctgcctgtag

SEQ ID NO: 3471059 - DNA, 19 bp, Homo sapiens
tgcaggacctgcctgtagc

SEQ ID NO: 3471060 - DNA, 13 bp, Homo sapiens
tgcaggcagacac

SEQ ID NO: 3471061 - DNA, 14 bp, Homo sapiens
tgcaggcagacacg

SEQ ID NO: 3471062 - DNA, 16 bp, Homo sapiens
tgcaggcatcacagct

SEQ ID NO: 3471063 - DNA, 21 bp, Homo sapiens
tgcaggcctaggtgcagctcc

SEQ ID NO: 3471064 - DNA, 15 bp, Homo sapiens
tgcagggaaaattat

SEQ ID NO: 3471065 - DNA, 20 bp, Homo sapiens
tgcagggaaaattatttgca

SEQ ID NO: 3471066 - DNA, 14 bp, Homo sapiens
tgcagggcagtcat

SEQ ID NO: 3471067 - DNA, 16 bp, Homo sapiens
tgcaggggtctgggag

SEQ ID NO: 3471068 - DNA, 19 bp, Homo sapiens
tgcagggtcctcttctggg

SEQ ID NO: 3471069 - DNA, 19 bp, Homo sapiens
tgcaggtgagcccatggcc

SEQ ID NO: 3471070 - DNA, 23 bp, Homo sapiens
tgcaggtgagcccatggccctcc

SEQ ID NO: 3471071 - DNA, 13 bp, Homo sapiens
tgcagtaaatctt

SEQ ID NO: 3471072 - DNA, 16 bp, Homo sapiens
tgcagtctctttattt

SEQ ID NO: 3471073 - DNA, 22 bp, Homo sapiens
tgcagtctctttattttactag

SEQ ID NO: 3471074 - DNA, 23 bp, Homo sapiens
tgcagtctctttattttactaga

SEQ ID NO: 3471075 - DNA, 17 bp, Homo sapiens
tgcagtgctcgctgttg

SEQ ID NO: 3471076 - DNA, 19 bp, Homo sapiens
tgcagtgctcgctgttgct

SEQ ID NO: 3471077 - DNA, 20 bp, Homo sapiens
tgcagtgctcgctgttgctg

SEQ ID NO: 3471078 - DNA, 18 bp, Homo sapiens
tgcagtggcgcattctag

SEQ ID NO: 3471079 - DNA, 21 bp, Homo sapiens
tgcagtggcgcattctaggct

SEQ ID NO: 3471080 - DNA, 21 bp, Homo sapiens
tgcagtggggtttcgcagcct

SEQ ID NO: 3471081 - DNA, 23 bp, Homo sapiens
tgcagtggggtttcgcagcctga

SEQ ID NO: 3471082 - DNA, 12 bp, Homo sapiens
tgcagtgtgctc

SEQ ID NO: 3471083 - DNA, 19 bp, Homo sapiens
tgcagtttaagagcagaac

SEQ ID NO: 3471084 - DNA, 20 bp, Homo sapiens
tgcagtttgaaattctgaat

SEQ ID NO: 3471085 - DNA, 17 bp, Homo sapiens
tgcataaagtcagtgcc

SEQ ID NO: 3471086 - DNA, 14 bp, Homo sapiens
tgcataccaacctg

SEQ ID NO: 3471087 - DNA, 16 bp, Homo sapiens
tgcatagcagctgcta

SEQ ID NO: 3471088 - DNA, 13 bp, Homo sapiens
tgcatatgtttcg

SEQ ID NO: 3471089 - DNA, 19 bp, Homo sapiens
tgcatcatcatagaaaaac

SEQ ID NO: 3471090 - DNA, 20 bp, Homo sapiens
tgcatccagagattcatttt

SEQ ID NO: 3471091 - DNA, 13 bp, Homo sapiens
tgcatctcccaga

SEQ ID NO: 3471092 - DNA, 15 bp, Homo sapiens
tgcatctgaccagca

SEQ ID NO: 3471093 - DNA, 17 bp, Homo sapiens
tgcatctgaccagcagc

SEQ ID NO: 3471094 - DNA, 11 bp, Homo sapiens
tgcatctgtat

SEQ ID NO: 3471095 - DNA, 20 bp, Homo sapiens
tgcatctgtataagtaagaa

SEQ ID NO: 3471096 - DNA, 18 bp, Homo sapiens
tgcatcttactgaaggta

SEQ ID NO: 3471097 - DNA, 22 bp, Homo sapiens
tgcatcttactgaaggtaaaat

SEQ ID NO: 3471098 - DNA, 15 bp, Homo sapiens
tgcatgatgtttgcc

SEQ ID NO: 3471099 - DNA, 18 bp, Homo sapiens
tgcatgatgtttgcccaa

SEQ ID NO: 3471100 - DNA, 15 bp, Homo sapiens
tgcatgccctctcag

SEQ ID NO: 3471101 - DNA, 17 bp, Homo sapiens
tgcatgctgctggacag

SEQ ID NO: 3471102 - DNA, 17 bp, Homo sapiens
tgcatggtgccccagga

SEQ ID NO: 3471103 - DNA, 18 bp, Homo sapiens
tgcatggtgccccaggac

SEQ ID NO: 3471104 - DNA, 19 bp, Homo sapiens
tgcatggtgccccaggacc

SEQ ID NO: 3471105 - DNA, 24 bp, Homo sapiens
tgcatgtactagtcctctagaaat

SEQ ID NO: 3471106 - DNA, 14 bp, Homo sapiens
tgcatgtcttttaa

SEQ ID NO: 3471107 - DNA, 15 bp, Homo sapiens
tgcatgtgactctga

SEQ ID NO: 3471108 - DNA, 16 bp, Homo sapiens
tgcatgtgactctgaa

SEQ ID NO: 3471109 - DNA, 22 bp, Homo sapiens
tgcatgtgtgcgtgtctccatg

SEQ ID NO: 3471110 - DNA, 23 bp, Homo sapiens
tgcatgtttgttgtatacttcct

SEQ ID NO: 3471111 - DNA, 13 bp, Homo sapiens
tgcattaaattca

SEQ ID NO: 3471112 - DNA, 14 bp, Homo sapiens
tgcattaaattcac

SEQ ID NO: 3471113 - DNA, 21 bp, Homo sapiens
tgcattaaattcacaaacttt

SEQ ID NO: 3471114 - DNA, 14 bp, Homo sapiens
tgcattcttaacaa

SEQ ID NO: 3471115 - DNA, 22 bp, Homo sapiens
tgcattcttaacaaactcttca

SEQ ID NO: 3471116 - DNA, 22 bp, Homo sapiens
tgcattcttttaaaagacaaga

SEQ ID NO: 3471117 - DNA, 19 bp, Homo sapiens
tgcattgaacacaaactgt

SEQ ID NO: 3471118 - DNA, 21 bp, Homo sapiens
tgcattgaacacaaactgtaa

SEQ ID NO: 3471119 - DNA, 17 bp, Homo sapiens
tgcattgattcagtatt

SEQ ID NO: 3471120 - DNA, 20 bp, Homo sapiens
tgcattgctctggatctgtt

SEQ ID NO: 3471121 - DNA, 15 bp, Homo sapiens
tgcattgggagcatc

SEQ ID NO: 3471122 - DNA, 15 bp, Homo sapiens
tgcattgtgcttctt

SEQ ID NO: 3471123 - DNA, 13 bp, Homo sapiens
tgcattgtttctg

SEQ ID NO: 3471124 - DNA, 18 bp, Homo sapiens
tgcattgtttctgtgggc

SEQ ID NO: 3471125 - DNA, 22 bp, Homo sapiens
tgcatttaaatacagtcttcca

SEQ ID NO: 3471126 - DNA, 14 bp, Homo sapiens
tgcatttctgtatt

SEQ ID NO: 3471127 - DNA, 16 bp, Homo sapiens
tgcatttctgtatttt

SEQ ID NO: 3471128 - DNA, 23 bp, Homo sapiens
tgacacagaaaatgttgagaatc

SEQ ID NO: 3471129 - DNA, 17 bp, Homo sapiens
tgacacatagtttttca

SEQ ID NO: 3471130 - DNA, 19 bp, Homo sapiens
tgacacatcgttttggggg

SEQ ID NO: 3471131 - DNA, 19 bp, Homo sapiens
tgacacccaagagggctgc

SEQ ID NO: 3471132 - DNA, 19 bp, Homo sapiens
tgacactaccttatcaggc

SEQ ID NO: 3471133 - DNA, 20 bp, Homo sapiens
tgacactggtattcctgcct

SEQ ID NO: 3471134 - DNA, 14 bp, Homo sapiens
tgacactgtttcct

SEQ ID NO: 3471135 - DNA, 16 bp, Homo sapiens
tgacactgtttcctga

SEQ ID NO: 3471136 - DNA, 19 bp, Homo sapiens
tgacagaaagcagttctga

SEQ ID NO: 3471137 - DNA, 13 bp, Homo sapiens
tgacagacacagg

SEQ ID NO: 3471138 - DNA, 16 bp, Homo sapiens
tgacagacacaggccc

SEQ ID NO: 3471139 - DNA, 17 bp, Homo sapiens
tgacagacacaggcccg

SEQ ID NO: 3471140 - DNA, 23 bp, Homo sapiens
tgacagacacaggcccggctcca

SEQ ID NO: 3471141 - DNA, 17 bp, Homo sapiens
tgacagagacccagatc

SEQ ID NO: 3471142 - DNA, 18 bp, Homo sapiens
tgacagagcaagactctg

SEQ ID NO: 3471143 - DNA, 18 bp, Homo sapiens
tgacagaggcagccccat

SEQ ID NO: 3471144 - DNA, 22 bp, Homo sapiens
tgacagagtgagactctgtctc

SEQ ID NO: 3471145 - DNA, 12 bp, Homo sapiens
tgacagccagag

SEQ ID NO: 3471146 - DNA, 21 bp, Homo sapiens
tgacagctgctcctagaggga

SEQ ID NO: 3471147 - DNA, 23 bp, Homo sapiens
tgacagctgctcctagagggagg

SEQ ID NO: 3471148 - DNA, 19 bp, Homo sapiens
tgacaggcaatgctggctg

SEQ ID NO: 3471149 - DNA, 16 bp, Homo sapiens
tgacaggctgtgactc

SEQ ID NO: 3471150 - DNA, 11 bp, Homo sapiens
tgacagggcac

SEQ ID NO: 3471151 - DNA, 22 bp, Homo sapiens
tgacagggcacaccgggcactc

SEQ ID NO: 3471152 - DNA, 15 bp, Homo sapiens
tgacagtgtgggaca

SEQ ID NO: 3471153 - DNA, 15 bp, Homo sapiens
tgacataaaaagaag

SEQ ID NO: 3471154 - DNA, 21 bp, Homo sapiens
tgacatacgcttttaatgaaa

SEQ ID NO: 3471155 - DNA, 13 bp, Homo sapiens
tgacatatttaat

SEQ ID NO: 3471156 - DNA, 16 bp, Homo sapiens
tgacatatttaatgtt

SEQ ID NO: 3471157 - DNA, 14 bp, Homo sapiens
tgacatctggaatc

SEQ ID NO: 3471158 - DNA, 15 bp, Homo sapiens
tgacatgattccttc

SEQ ID NO: 3471159 - DNA, 19 bp, Homo sapiens
tgacatgattccttcctgt

SEQ ID NO: 3471160 - DNA, 18 bp, Homo sapiens
tgacatgcactcagctct

SEQ ID NO: 3471161 - DNA, 18 bp, Homo sapiens
tgacatgggtattttata

SEQ ID NO: 3471162 - DNA, 15 bp, Homo sapiens
tgacattcacctgcc

SEQ ID NO: 3471163 - DNA, 19 bp, Homo sapiens
tgacattgccaaaaaggat

SEQ ID NO: 3471164 - DNA, 11 bp, Homo sapiens
tgacattgtct

SEQ ID NO: 3471165 - DNA, 21 bp, Homo sapiens
tgacatttatttttcatttag

SEQ ID NO: 3471166 - DNA, 21 bp, Homo sapiens
tgacatttatttttctcatga

SEQ ID NO: 3471167 - DNA, 21 bp, Homo sapiens
tgacatttggagtgttcccct

SEQ ID NO: 3471168 - DNA, 19 bp, Homo sapiens
tgaccaatttgcaccagtt

SEQ ID NO: 3471169 - DNA, 22 bp, Homo sapiens
tgaccaatttgcaccagtttta

SEQ ID NO: 3471170 - DNA, 16 bp, Homo sapiens
tgaccacagcacagcc

SEQ ID NO: 3471171 - DNA, 17 bp, Homo sapiens
tgaccacagcacagcca

SEQ ID NO: 3471172 - DNA, 19 bp, Homo sapiens
tgaccacagcacagccaac

SEQ ID NO: 3471173 - DNA, 21 bp, Homo sapiens
tgaccacgctttctagctgtt

SEQ ID NO: 3471174 - DNA, 15 bp, Homo sapiens
tgaccagcagcgcct

SEQ ID NO: 3471175 - DNA, 20 bp, Homo sapiens
tgaccagtttaacctgatgc

SEQ ID NO: 3471176 - DNA, 12 bp, Homo sapiens
tgaccatgctca

SEQ ID NO: 3471177 - DNA, 16 bp, Homo sapiens
tgaccatgctcatctg

SEQ ID NO: 3471178 - DNA, 18 bp, Homo sapiens
tgaccatgctcatctgct

SEQ ID NO: 3471179 - DNA, 19 bp, Homo sapiens
tgaccatgctcatctgctg

SEQ ID NO: 3471180 - DNA, 15 bp, Homo sapiens
tgaccatgtctatga

SEQ ID NO: 3471181 - DNA, 18 bp, Homo sapiens
tgacccagccccttgaga

SEQ ID NO: 3471182 - DNA, 21 bp, Homo sapiens
tgacccagccccttgagaaac

SEQ ID NO: 3471183 - DNA, 15 bp, Homo sapiens
tgacccaggctgggc

SEQ ID NO: 3471184 - DNA, 23 bp, Homo sapiens
tgacccagtgcccccactgacca

SEQ ID NO: 3471185 - DNA, 14 bp, Homo sapiens
tgaccctggggctg

SEQ ID NO: 3471186 - DNA, 15 bp, Homo sapiens
tgaccctggggctgg

SEQ ID NO: 3471187 - DNA, 16 bp, Homo sapiens
tgaccggacttttctg

SEQ ID NO: 3471188 - DNA, 22 bp, Homo sapiens
tgacctcaggtgatccacccac

SEQ ID NO: 3471189 - DNA, 14 bp, Homo sapiens
tgacctccctctaa

SEQ ID NO: 3471190 - DNA, 12 bp, Homo sapiens
tgacctctgcct

SEQ ID NO: 3471191 - DNA, 17 bp, Homo sapiens
tgacctgaggctgtggt

SEQ ID NO: 3471192 - DNA, 17 bp, Homo sapiens
tgacctgcatctaagcc

SEQ ID NO: 3471193 - DNA, 18 bp, Homo sapiens
tgacctgcattgtaaata

SEQ ID NO: 3471194 - DNA, 15 bp, Homo sapiens
tgacctggtccacag

SEQ ID NO: 3471195 - DNA, 20 bp, Homo sapiens
tgacctggtccacagggcac

SEQ ID NO: 3471196 - DNA, 22 bp, Homo sapiens
tgaccttatgagaaactgcatg

SEQ ID NO: 3471197 - DNA, 14 bp, Homo sapiens
tgacctttaattca

SEQ ID NO: 3471198 - DNA, 18 bp, Homo sapiens
tgaccttttatgtagtaa

SEQ ID NO: 3471199 - DNA, 19 bp, Homo sapiens
tgacgggactcaggcggga

SEQ ID NO: 3471200 - DNA, 24 bp, Homo sapiens
tgacgtgaccggacttttctgcaa

SEQ ID NO: 3471201 - DNA, 18 bp, Homo sapiens
tgactacagtcaggaaag

SEQ ID NO: 3471202 - DNA, 16 bp, Homo sapiens
tgactcgggggtgggg

SEQ ID NO: 3471203 - DNA, 16 bp, Homo sapiens
tgactcggtttctcca

SEQ ID NO: 3471204 - DNA, 11 bp, Homo sapiens
tgactctccag

SEQ ID NO: 3471205 - DNA, 14 bp, Homo sapiens
tgactctccagggg

SEQ ID NO: 3471206 - DNA, 17 bp, Homo sapiens
tgagtcaccaagcccag

SEQ ID NO: 3471207 - DNA, 18 bp, Homo sapiens
tgagtcaccaagcccagt

SEQ ID NO: 3471208 - DNA, 13 bp, Homo sapiens
tgagtccagaagt

SEQ ID NO: 3471209 - DNA, 14 bp, Homo sapiens
tgagtcgaggacag

SEQ ID NO: 3471210 - DNA, 15 bp, Homo sapiens
tgagtcgaggacagg

SEQ ID NO: 3471211 - DNA, 16 bp, Homo sapiens
tgagtcgaggacaggg

SEQ ID NO: 3471212 - DNA, 19 bp, Homo sapiens
tgagtcgaggacagggagg

SEQ ID NO: 3471213 - DNA, 15 bp, Homo sapiens
tgagtctatgttcaa

SEQ ID NO: 3471214 - DNA, 17 bp, Homo sapiens
tgagtctatgttcaaag

SEQ ID NO: 3471215 - DNA, 20 bp, Homo sapiens
tgagtctatgttcaaagact

SEQ ID NO: 3471216 - DNA, 15 bp, Homo sapiens
tgagtgaaagttgcc

SEQ ID NO: 3471217 - DNA, 17 bp, Homo sapiens
tgagtgaacctgtataa

SEQ ID NO: 3471218 - DNA, 15 bp, Homo sapiens
tgagtgcagtcctga

SEQ ID NO: 3471219 - DNA, 12 bp, Homo sapiens
tgagtgcctggc

SEQ ID NO: 3471220 - DNA, 12 bp, Homo sapiens
tgagtgccttct

SEQ ID NO: 3471221 - DNA, 13 bp, Homo sapiens
tgagtgccttctg

SEQ ID NO: 3471222 - DNA, 22 bp, Homo sapiens
tgagtgccttttgcagaagagg

SEQ ID NO: 3471223 - DNA, 18 bp, Homo sapiens
tgagtggatgatgtttcg

SEQ ID NO: 3471224 - DNA, 21 bp, Homo sapiens
tgagtgggtgaataatacagt

SEQ ID NO: 3471225 - DNA, 15 bp, Homo sapiens
tgagtgtttctatga

SEQ ID NO: 3471226 - DNA, 19 bp, Homo sapiens
tgagtgttttatgagaaag

SEQ ID NO: 3471227 - DNA, 19 bp, Homo sapiens
tgagttaatgtgctgagca

SEQ ID NO: 3471228 - DNA, 17 bp, Homo sapiens
tgagttaggaatgagaa

SEQ ID NO: 3471229 - DNA, 15 bp, Homo sapiens
tgagttatctaagaa

SEQ ID NO: 3471230 - DNA, 19 bp, Homo sapiens
tgagttgattcagctctgc

SEQ ID NO: 3471231 - DNA, 19 bp, Homo sapiens
tgagttggggtctggcagc

SEQ ID NO: 3471232 - DNA, 18 bp, Homo sapiens
tgagtttaaaaatcaact

SEQ ID NO: 3471233 - DNA, 19 bp, Homo sapiens
tgagttttccatggcagga

SEQ ID NO: 3471234 - DNA, 18 bp, Homo sapiens
tgagttttcttctgtgat

SEQ ID NO: 3471235 - DNA, 20 bp, Homo sapiens
tgagttttgttttaaaatta

SEQ ID NO: 3471236 - DNA, 17 bp, Homo sapiens
tgataaatcagtcaagc

SEQ ID NO: 3471237 - DNA, 19 bp, Homo sapiens
tgataagagggcacacact

SEQ ID NO: 3471238 - DNA, 19 bp, Homo sapiens
tgataaggacatgatgctt

SEQ ID NO: 3471239 - DNA, 23 bp, Homo sapiens
tgataagttcctttccttttctt

SEQ ID NO: 3471240 - DNA, 15 bp, Homo sapiens
tgataatgacactgt

SEQ ID NO: 3471241 - DNA, 20 bp, Homo sapiens
tgatacaaattgcagactgt

SEQ ID NO: 3471242 - DNA, 15 bp, Homo sapiens
tgatacagaactctt

SEQ ID NO: 3471243 - DNA, 22 bp, Homo sapiens
tgatacatccaaagcagacagc

SEQ ID NO: 3471244 - DNA, 17 bp, Homo sapiens
tgataccagaagggaaa

SEQ ID NO: 3471245 - DNA, 21 bp, Homo sapiens
tgataccagaagggaaagctt

SEQ ID NO: 3471246 - DNA, 12 bp, Homo sapiens
tgataccttagg

SEQ ID NO: 3471247 - DNA, 16 bp, Homo sapiens
tgatactcatttctta

SEQ ID NO: 3471248 - DNA, 15 bp, Homo sapiens
tgatacttttaagag

SEQ ID NO: 3471249 - DNA, 19 bp, Homo sapiens
tgatagaaatgccaagcac

SEQ ID NO: 3471250 - DNA, 13 bp, Homo sapiens
tgatagcaaagcg

SEQ ID NO: 3471251 - DNA, 22 bp, Homo sapiens
tgatatagaacagtgcttgcca

SEQ ID NO: 3471252 - DNA, 11 bp, Homo sapiens
tgatatagaat

SEQ ID NO: 3471253 - DNA, 14 bp, Homo sapiens
tgatatagaattag

SEQ ID NO: 3471254 - DNA, 17 bp, Homo sapiens
tgatatagaattagctt

SEQ ID NO: 3471255 - DNA, 13 bp, Homo sapiens
tgatatatgtgtt

SEQ ID NO: 3471256 - DNA, 21 bp, Homo sapiens
tgatatatgtgtttttcacat

SEQ ID NO: 3471257 - DNA, 14 bp, Homo sapiens
tgatatcattgttg

SEQ ID NO: 3471258 - DNA, 23 bp, Homo sapiens
tgatatgttttatttcattggtt

SEQ ID NO: 3471259 - DNA, 16 bp, Homo sapiens
tgatattttttctctc

SEQ ID NO: 3471260 - DNA, 18 bp, Homo sapiens
tgatcaaagccacactct

SEQ ID NO: 3471261 - DNA, 18 bp, Homo sapiens
tgatcacggctcactgca

SEQ ID NO: 3471262 - DNA, 21 bp, Homo sapiens
tgatcagagccgtggtccttt

SEQ ID NO: 3471263 - DNA, 12 bp, Homo sapiens
tgatcagtgttg

SEQ ID NO: 3471264 - DNA, 18 bp, Homo sapiens
tgatcagtgttgttgctc

SEQ ID NO: 3471265 - DNA, 13 bp, Homo sapiens
tgatcatccactg

SEQ ID NO: 3471266 - DNA, 24 bp, Homo sapiens
tgatcatccactgtgccatgtgcc

SEQ ID NO: 3471267 - DNA, 13 bp, Homo sapiens
tgatccaagctgg

SEQ ID NO: 3471268 - DNA, 14 bp, Homo sapiens
tgatccaagctggt

SEQ ID NO: 3471269 - DNA, 17 bp, Homo sapiens
tgatccaagctggtccc

SEQ ID NO: 3471270 - DNA, 15 bp, Homo sapiens
tgatccacccacctc

SEQ ID NO: 3471271 - DNA, 18 bp, Homo sapiens
tgatccacccacctcagc

SEQ ID NO: 3471272 - DNA, 19 bp, Homo sapiens
tgatccacccacctcagcc

SEQ ID NO: 3471273 - DNA, 13 bp, Homo sapiens
tcttgaaaatatt

SEQ ID NO: 3471274 - DNA, 18 bp, Homo sapiens
tcttgaactcctggcctc

SEQ ID NO: 3471275 - DNA, 22 bp, Homo sapiens
tcttgaagagaaaaaagtcacc

SEQ ID NO: 3471276 - DNA, 12 bp, Homo sapiens
tcttgaagtcct

SEQ ID NO: 3471277 - DNA, 16 bp, Homo sapiens
tcttgaagtcctggct

SEQ ID NO: 3471278 - DNA, 20 bp, Homo sapiens
tcttgaatactctgccctct

SEQ ID NO: 3471279 - DNA, 15 bp, Homo sapiens
tcttgaatagcttat

SEQ ID NO: 3471280 - DNA, 12 bp, Homo sapiens
tcttgaattttt

SEQ ID NO: 3471281 - DNA, 16 bp, Homo sapiens
tcttgagccagccagg

SEQ ID NO: 3471282 - DNA, 13 bp, Homo sapiens
tcttgagcctggg

SEQ ID NO: 3471283 - DNA, 22 bp, Homo sapiens
tcttgagtttgtcgctcatgtg

SEQ ID NO: 3471284 - DNA, 21 bp, Homo sapiens
tcttgagttttgttttaaaat

SEQ ID NO: 3471285 - DNA, 20 bp, Homo sapiens
tcttgatcaacatcttttct

SEQ ID NO: 3471286 - DNA, 23 bp, Homo sapiens
tcttgatcaacatcttttcttgc

SEQ ID NO: 3471287 - DNA, 12 bp, Homo sapiens
tcttgatgacca

SEQ ID NO: 3471288 - DNA, 21 bp, Homo sapiens
tcttgatggagattaagatgc

SEQ ID NO: 3471289 - DNA, 14 bp, Homo sapiens
tcttgattatccat

SEQ ID NO: 3471290 - DNA, 18 bp, Homo sapiens
tcttgatttatttgcttc

SEQ ID NO: 3471291 - DNA, 13 bp, Homo sapiens
tcttgcaatggca

SEQ ID NO: 3471292 - DNA, 17 bp, Homo sapiens
tcttgcaatggcagcct

SEQ ID NO: 3471293 - DNA, 19 bp, Homo sapiens
tcttgcaatggcagccttg

SEQ ID NO: 3471294 - DNA, 23 bp, Homo sapiens
tcttgcaatggcagccttggcaa

SEQ ID NO: 3471295 - DNA, 13 bp, Homo sapiens
tcttgccagccag

SEQ ID NO: 3471296 - DNA, 15 bp, Homo sapiens
tcttgccagccagaa

SEQ ID NO: 3471297 - DNA, 20 bp, Homo sapiens
tcttgccagccagaagcctc

SEQ ID NO: 3471298 - DNA, 14 bp, Homo sapiens
tcttgccctgggga

SEQ ID NO: 3471299 - DNA, 13 bp, Homo sapiens
tcttgcctctgtg

SEQ ID NO: 3471300 - DNA, 15 bp, Homo sapiens
tcttgctctgctgac

SEQ ID NO: 3471301 - DNA, 11 bp, Homo sapiens
tcttgctggct

SEQ ID NO: 3471302 - DNA, 21 bp, Homo sapiens
tcttgctgttgacatatttaa

SEQ ID NO: 3471303 - DNA, 19 bp, Homo sapiens
tcttggcagcacctgtctc

SEQ ID NO: 3471304 - DNA, 19 bp, Homo sapiens
tcttgggcagagctggctc

SEQ ID NO: 3471305 - DNA, 23 bp, Homo sapiens
tcttgggcagagctggctctgag

SEQ ID NO: 3471306 - DNA, 19 bp, Homo sapiens
tcttgggccaagccagctg

SEQ ID NO: 3471307 - DNA, 23 bp, Homo sapiens
tcttgggccaagccagctgccta

SEQ ID NO: 3471308 - DNA, 18 bp, Homo sapiens
tcttgtaaggctttgatt

SEQ ID NO: 3471309 - DNA, 12 bp, Homo sapiens
tcttgtctctgg

SEQ ID NO: 3471310 - DNA, 23 bp, Homo sapiens
tcttgtggaagtgcatctacttg

SEQ ID NO: 3471311 - DNA, 22 bp, Homo sapiens
tcttgttcattttgagtatttt

SEQ ID NO: 3471312 - DNA, 13 bp, Homo sapiens
tcttgttgctttg

SEQ ID NO: 3471313 - DNA, 14 bp, Homo sapiens
tctttaaaagagag

SEQ ID NO: 3471314 - DNA, 19 bp, Homo sapiens
tctttaaaagatgctttta

SEQ ID NO: 3471315 - DNA, 20 bp, Homo sapiens
tctttaaaatgtaaagccat

SEQ ID NO: 3471316 - DNA, 11 bp, Homo sapiens
tctttaatgct

SEQ ID NO: 3471317 - DNA, 16 bp, Homo sapiens
tctttaatgcttttat

SEQ ID NO: 3471318 - DNA, 15 bp, Homo sapiens
tctttaatgtcacag

SEQ ID NO: 3471319 - DNA, 18 bp, Homo sapiens
tctttaatgtcacaggca

SEQ ID NO: 3471320 - DNA, 19 bp, Homo sapiens
tctttaatgtcacaggcag

SEQ ID NO: 3471321 - DNA, 15 bp, Homo sapiens
tctttactattaaaa

SEQ ID NO: 3471322 - DNA, 18 bp, Homo sapiens
tctttactattaaaatat

SEQ ID NO: 3471323 - DNA, 19 bp, Homo sapiens
tctttactattaaaatatt

SEQ ID NO: 3471324 - DNA, 14 bp, Homo sapiens
tctttagagttaga

SEQ ID NO: 3471325 - DNA, 18 bp, Homo sapiens
tctttagagttagactgt

SEQ ID NO: 3471326 - DNA, 19 bp, Homo sapiens
tctttagagttagactgtt

SEQ ID NO: 3471327 - DNA, 19 bp, Homo sapiens
tctttagccagaatctcat

SEQ ID NO: 3471328 - DNA, 15 bp, Homo sapiens
tctttattgagaaag

SEQ ID NO: 3471329 - DNA, 16 bp, Homo sapiens
tctttattgagaaaga

SEQ ID NO: 3471330 - DNA, 21 bp, Homo sapiens
tctttcaaaaccttttgaaat

SEQ ID NO: 3471331 - DNA, 18 bp, Homo sapiens
tctttcaaaccagcttca

SEQ ID NO: 3471332 - DNA, 22 bp, Homo sapiens
tctttcacattgtttgctgcta

SEQ ID NO: 3471333 - DNA, 23 bp, Homo sapiens
tctttcacattgtttgctgctat

SEQ ID NO: 3471334 - DNA, 22 bp, Homo sapiens
tctttcagatgatttgaaagca

SEQ ID NO: 3471335 - DNA, 12 bp, Homo sapiens
tctttcagcatt

SEQ ID NO: 3471336 - DNA, 23 bp, Homo sapiens
tctttcagtacttttttaaatat

SEQ ID NO: 3471337 - DNA, 13 bp, Homo sapiens
tctttcatatggt

SEQ ID NO: 3471338 - DNA, 13 bp, Homo sapiens
tctttcatccact

SEQ ID NO: 3471339 - DNA, 21 bp, Homo sapiens
tctttcatccactagtgcaaa

SEQ ID NO: 3471340 - DNA, 12 bp, Homo sapiens
tctttcatgagt

SEQ ID NO: 3471341 - DNA, 17 bp, Homo sapiens
tctttccaaataaaatg

SEQ ID NO: 3471342 - DNA, 16 bp, Homo sapiens
tctttccataataaaa

SEQ ID NO: 3471343 - DNA, 16 bp, Homo sapiens
tctttcctatttcagt

SEQ ID NO: 3471344 - DNA, 16 bp, Homo sapiens
tctttcggaattttta

SEQ ID NO: 3471345 - DNA, 21 bp, Homo sapiens
tctttcggaatttttaaaata

SEQ ID NO: 3471346 - DNA, 14 bp, Homo sapiens
tctttctgataact

SEQ ID NO: 3471347 - DNA, 23 bp, Homo sapiens
tctttctgataactagatggtgc

SEQ ID NO: 3471348 - DNA, 23 bp, Homo sapiens
tctttctggtgttttatttccta

SEQ ID NO: 3471349 - DNA, 16 bp, Homo sapiens
tctttctgtcccctct

SEQ ID NO: 3471350 - DNA, 15 bp, Homo sapiens
tctttcttagaaatt

SEQ ID NO: 3471351 - DNA, 19 bp, Homo sapiens
tctttcttagaaatttatt

SEQ ID NO: 3471352 - DNA, 18 bp, Homo sapiens
tctttgagataatacatt

SEQ ID NO: 3471353 - DNA, 22 bp, Homo sapiens
tctttgagataatacattccga

SEQ ID NO: 3471354 - DNA, 16 bp, Homo sapiens
tctttgattctccttc

SEQ ID NO: 3471355 - DNA, 20 bp, Homo sapiens
tctttgattctccttcagcc

SEQ ID NO: 3471356 - DNA, 12 bp, Homo sapiens
tctttgctgcag

SEQ ID NO: 3471357 - DNA, 17 bp, Homo sapiens
tctttggacactcacac

SEQ ID NO: 3471358 - DNA, 13 bp, Homo sapiens
tctttgtctaaaa

SEQ ID NO: 3471359 - DNA, 16 bp, Homo sapiens
tctttgtgctttggct

SEQ ID NO: 3471360 - DNA, 14 bp, Homo sapiens
tctttgtggccaag

SEQ ID NO: 3471361 - DNA, 22 bp, Homo sapiens
tctttgtggccaaggagctgct

SEQ ID NO: 3471362 - DNA, 14 bp, Homo sapiens
tctttgtggcttcc

SEQ ID NO: 3471363 - DNA, 16 bp, Homo sapiens
tctttgttcaagatga

SEQ ID NO: 3471364 - DNA, 14 bp, Homo sapiens
tcttttaaaagaca

SEQ ID NO: 3471365 - DNA, 16 bp, Homo sapiens
tcttttaaaagacaag

SEQ ID NO: 3471366 - DNA, 21 bp, Homo sapiens
tcttttaaaagacaagacttc

SEQ ID NO: 3471367 - DNA, 14 bp, Homo sapiens
tcttttacctgctg

SEQ ID NO: 3471368 - DNA, 15 bp, Homo sapiens
tctggagaccaggga

SEQ ID NO: 3471369 - DNA, 19 bp, Homo sapiens
tctggagaccagggagcct

SEQ ID NO: 3471370 - DNA, 23 bp, Homo sapiens
tctggagcttaattttctgtgga

SEQ ID NO: 3471371 - DNA, 14 bp, Homo sapiens
tctggaggaaaggg

SEQ ID NO: 3471372 - DNA, 16 bp, Homo sapiens
tctggagttgatctgg

SEQ ID NO: 3471373 - DNA, 22 bp, Homo sapiens
tctggattcccaggatgagcat

SEQ ID NO: 3471374 - DNA, 20 bp, Homo sapiens
tctggattccccatctcagg

SEQ ID NO: 3471375 - DNA, 16 bp, Homo sapiens
tctggattctgaatct

SEQ ID NO: 3471376 - DNA, 16 bp, Homo sapiens
tctggcagcctcccat

SEQ ID NO: 3471377 - DNA, 22 bp, Homo sapiens
tctggcaggtcctcccctctct

SEQ ID NO: 3471378 - DNA, 13 bp, Homo sapiens
tctggccaagggc

SEQ ID NO: 3471379 - DNA, 13 bp, Homo sapiens
tctggccccaggc

SEQ ID NO: 3471380 - DNA, 13 bp, Homo sapiens
tctggccctagac

SEQ ID NO: 3471381 - DNA, 22 bp, Homo sapiens
tctggcgacagttttccttctc

SEQ ID NO: 3471382 - DNA, 18 bp, Homo sapiens
tctggcttctggccagga

SEQ ID NO: 3471383 - DNA, 14 bp, Homo sapiens
tctggcttggccta

SEQ ID NO: 3471384 - DNA, 22 bp, Homo sapiens
tctggcttgggcagggtctgtt

SEQ ID NO: 3471385 - DNA, 16 bp, Homo sapiens
tctgggactccaggtc

SEQ ID NO: 3471386 - DNA, 23 bp, Homo sapiens
tctgggagaaaatcatcaagaag

SEQ ID NO: 3471387 - DNA, 19 bp, Homo sapiens
tctgggagggcagcagggc

SEQ ID NO: 3471388 - DNA, 21 bp, Homo sapiens
tctgggagggcagcagggcta

SEQ ID NO: 3471389 - DNA, 15 bp, Homo sapiens
tctgggagtcaggcc

SEQ ID NO: 3471390 - DNA, 12 bp, Homo sapiens
tctgggcctgac

SEQ ID NO: 3471391 - DNA, 14 bp, Homo sapiens
tctgggggctctgg

SEQ ID NO: 3471392 - DNA, 14 bp, Homo sapiens
tctgggttcactgc

SEQ ID NO: 3471393 - DNA, 16 bp, Homo sapiens
tctgggtttgaagctg

SEQ ID NO: 3471394 - DNA, 13 bp, Homo sapiens
tctggtagcctgc

SEQ ID NO: 3471395 - DNA, 14 bp, Homo sapiens
tctggtcagagcca

SEQ ID NO: 3471396 - DNA, 17 bp, Homo sapiens
tctggtcagagccacag

SEQ ID NO: 3471397 - DNA, 23 bp, Homo sapiens
tctggtgccagatcctcttctca

SEQ ID NO: 3471398 - DNA, 19 bp, Homo sapiens
tctggtgttttatttccta

SEQ ID NO: 3471399 - DNA, 12 bp, Homo sapiens
tctggttccagg

SEQ ID NO: 3471400 - DNA, 13 bp, Homo sapiens
tctggttccaggg

SEQ ID NO: 3471401 - DNA, 13 bp, Homo sapiens
tctgtaaaatctt

SEQ ID NO: 3471402 - DNA, 18 bp, Homo sapiens
tctgtaccccatgacctt

SEQ ID NO: 3471403 - DNA, 12 bp, Homo sapiens
tctgtagaaatg

SEQ ID NO: 3471404 - DNA, 17 bp, Homo sapiens
tctgtagaaatggttgt

SEQ ID NO: 3471405 - DNA, 20 bp, Homo sapiens
tctgtagggtaattagtaac

SEQ ID NO: 3471406 - DNA, 16 bp, Homo sapiens
tctgtaggttaaaaaa

SEQ ID NO: 3471407 - DNA, 16 bp, Homo sapiens
tctgtataagtaagaa

SEQ ID NO: 3471408 - DNA, 22 bp, Homo sapiens
tctgtataagtaagaaaatatt

SEQ ID NO: 3471409 - DNA, 20 bp, Homo sapiens
tctgtatcaggacccagagg

SEQ ID NO: 3471410 - DNA, 14 bp, Homo sapiens
tctgtatggcatga

SEQ ID NO: 3471411 - DNA, 15 bp, Homo sapiens
tctgtattttttgtt

SEQ ID NO: 3471412 - DNA, 13 bp, Homo sapiens
tctgtcagtcaca

SEQ ID NO: 3471413 - DNA, 17 bp, Homo sapiens
tctgtcagtcacagcca

SEQ ID NO: 3471414 - DNA, 17 bp, Homo sapiens
tctgtcatcctcaggaa

SEQ ID NO: 3471415 - DNA, 17 bp, Homo sapiens
tctgtcattgtaccctt

SEQ ID NO: 3471416 - DNA, 15 bp, Homo sapiens
tctgtccccttctct

SEQ ID NO: 3471417 - DNA, 22 bp, Homo sapiens
tctgtccccttctctcatctct

SEQ ID NO: 3471418 - DNA, 15 bp, Homo sapiens
tctgtccctcacagc

SEQ ID NO: 3471419 - DNA, 22 bp, Homo sapiens
tctgtcccttctgtccctcaca

SEQ ID NO: 3471420 - DNA, 16 bp, Homo sapiens
tctgtcccttgctgta

SEQ ID NO: 3471421 - DNA, 17 bp, Homo sapiens
tctgtcccttgctgtat

SEQ ID NO: 3471422 - DNA, 14 bp, Homo sapiens
tctgtcctactctg

SEQ ID NO: 3471423 - DNA, 15 bp, Homo sapiens
tctgtcctactctgt

SEQ ID NO: 3471424 - DNA, 19 bp, Homo sapiens
tctgtcctactctgtgtca

SEQ ID NO: 3471425 - DNA, 13 bp, Homo sapiens
tctgtcctcagcc

SEQ ID NO: 3471426 - DNA, 21 bp, Homo sapiens
tctgtcctgggagtgagctgg

SEQ ID NO: 3471427 - DNA, 14 bp, Homo sapiens
tctgtcgcccagtc

SEQ ID NO: 3471428 - DNA, 18 bp, Homo sapiens
tctgtctacttgctcagg

SEQ ID NO: 3471429 - DNA, 13 bp, Homo sapiens
tctgtctcatcca

SEQ ID NO: 3471430 - DNA, 21 bp, Homo sapiens
tctgtctcatccatcatcatg

SEQ ID NO: 3471431 - DNA, 14 bp, Homo sapiens
tctgtctccttaac

SEQ ID NO: 3471432 - DNA, 22 bp, Homo sapiens
tctgtctccttaacactgagct

SEQ ID NO: 3471433 - DNA, 14 bp, Homo sapiens
tctgtcttctggac

SEQ ID NO: 3471434 - DNA, 13 bp, Homo sapiens
tctgtcttgttca

SEQ ID NO: 3471435 - DNA, 17 bp, Homo sapiens
tctgtgaaatgctggca

SEQ ID NO: 3471436 - DNA, 17 bp, Homo sapiens
tctgtgaacgatttaga

SEQ ID NO: 3471437 - DNA, 19 bp, Homo sapiens
tctgtgaccaatgtcttga

SEQ ID NO: 3471438 - DNA, 17 bp, Homo sapiens
tctgtgagactcgagaa

SEQ ID NO: 3471439 - DNA, 18 bp, Homo sapiens
tctgtgagtgaaagttgc

SEQ ID NO: 3471440 - DNA, 22 bp, Homo sapiens
tctgtgagtgaaagttgccatt

SEQ ID NO: 3471441 - DNA, 17 bp, Homo sapiens
tctgtgatacagaactc

SEQ ID NO: 3471442 - DNA, 19 bp, Homo sapiens
tctgtgcacgcagtggcct

SEQ ID NO: 3471443 - DNA, 12 bp, Homo sapiens
tctgtgcattct

SEQ ID NO: 3471444 - DNA, 16 bp, Homo sapiens
tctgtgccttcgtctt

SEQ ID NO: 3471445 - DNA, 22 bp, Homo sapiens
tctgtgccttcttttgattatg

SEQ ID NO: 3471446 - DNA, 12 bp, Homo sapiens
tctgtggagatg

SEQ ID NO: 3471447 - DNA, 15 bp, Homo sapiens
tctgtgtctgtgttt

SEQ ID NO: 3471448 - DNA, 13 bp, Homo sapiens
tctgtgttttaat

SEQ ID NO: 3471449 - DNA, 14 bp, Homo sapiens
tctgttagggcctt

SEQ ID NO: 3471450 - DNA, 12 bp, Homo sapiens
tctgttcagtgt

SEQ ID NO: 3471451 - DNA, 15 bp, Homo sapiens
tctgttctaacatgt

SEQ ID NO: 3471452 - DNA, 17 bp, Homo sapiens
tctgttggccagtgtga

SEQ ID NO: 3471453 - DNA, 18 bp, Homo sapiens
tctgtttataaaaacaaa

SEQ ID NO: 3471454 - DNA, 20 bp, Homo sapiens
tctgtttcctgacattgtct

SEQ ID NO: 3471455 - DNA, 13 bp, Homo sapiens
tctgtttgttatt

SEQ ID NO: 3471456 - DNA, 23 bp, Homo sapiens
tcttaaggtgaggcctgtctgtg

SEQ ID NO: 3471457 - DNA, 20 bp, Homo sapiens
tcttaatgaagtttgaatgt

SEQ ID NO: 3471458 - DNA, 15 bp, Homo sapiens
tcttacatgttttct

SEQ ID NO: 3471459 - DNA, 11 bp, Homo sapiens
tcttagaaatt

SEQ ID NO: 3471460 - DNA, 12 bp, Homo sapiens
tcttagaaattt

SEQ ID NO: 3471461 - DNA, 22 bp, Homo sapiens
tcttagatacactaaaaatctg

SEQ ID NO: 3471462 - DNA, 16 bp, Homo sapiens
tcttaggtgcgcagtg

SEQ ID NO: 3471463 - DNA, 22 bp, Homo sapiens
tcttagttactttggaacacta

SEQ ID NO: 3471464 - DNA, 13 bp, Homo sapiens
tcttataatttaa

SEQ ID NO: 3471465 - DNA, 21 bp, Homo sapiens
tcttatactgtacaataaaaa

SEQ ID NO: 3471466 - DNA, 19 bp, Homo sapiens
tcttatagaatatttatta

SEQ ID NO: 3471467 - DNA, 22 bp, Homo sapiens
tcttatggaattgatttgcatt

SEQ ID NO: 3471468 - DNA, 15 bp, Homo sapiens
tcttattacccaaac

SEQ ID NO: 3471469 - DNA, 19 bp, Homo sapiens
tcttattcccccctaagct

SEQ ID NO: 3471470 - DNA, 14 bp, Homo sapiens
tcttattgcccacg

SEQ ID NO: 3471471 - DNA, 18 bp, Homo sapiens
tcttattgcccacgctgg

SEQ ID NO: 3471472 - DNA, 15 bp, Homo sapiens
tctcttcatgtctat

SEQ ID NO: 3471473 - DNA, 12 bp, Homo sapiens
tctcttccttga

SEQ ID NO: 3471474 - DNA, 16 bp, Homo sapiens
tctcttgaaccccaaa

SEQ ID NO: 3471475 - DNA, 14 bp, Homo sapiens
tctcttgagagggt

SEQ ID NO: 3471476 - DNA, 13 bp, Homo sapiens
tctcttgcattgt

SEQ ID NO: 3471477 - DNA, 16 bp, Homo sapiens
tctcttgggaactgaa

SEQ ID NO: 3471478 - DNA, 23 bp, Homo sapiens
tctcttgggaactgaactcactt

SEQ ID NO: 3471479 - DNA, 22 bp, Homo sapiens
tctctttaatgtcacaggcagg

SEQ ID NO: 3471480 - DNA, 15 bp, Homo sapiens
tctctttattttact

SEQ ID NO: 3471481 - DNA, 22 bp, Homo sapiens
tctctttcacattgtttgctgc

SEQ ID NO: 3471482 - DNA, 22 bp, Homo sapiens
tctctttgtgggtttttcatct

SEQ ID NO: 3471483 - DNA, 16 bp, Homo sapiens
tctcttttcaaaacat

SEQ ID NO: 3471484 - DNA, 22 bp, Homo sapiens
tctcttttcacagcaacatttt

SEQ ID NO: 3471485 - DNA, 9 bp, Homo sapiens
tctgaaaca

SEQ ID NO: 3471486 - DNA, 13 bp, Homo sapiens
tctgaaacagctg

SEQ ID NO: 3471487 - DNA, 23 bp, Homo sapiens
tctgaaaccctggaccagtggtc

SEQ ID NO: 3471488 - DNA, 17 bp, Homo sapiens
tctgaaagttgtacatg

SEQ ID NO: 3471489 - DNA, 21 bp, Homo sapiens
tctgaaagttgtacatgaaat

SEQ ID NO: 3471490 - DNA, 16 bp, Homo sapiens
tctgaaatatcccggg

SEQ ID NO: 3471491 - DNA, 16 bp, Homo sapiens
tctgaactttgggaag

SEQ ID NO: 3471492 - DNA, 21 bp, Homo sapiens
tctgaactttgggaagccttt

SEQ ID NO: 3471493 - DNA, 13 bp, Homo sapiens
tctgaagcaaggc

SEQ ID NO: 3471494 - DNA, 12 bp, Homo sapiens
tctgaagcagat

SEQ ID NO: 3471495 - DNA, 21 bp, Homo sapiens
tctgaagctgacgaacttcca

SEQ ID NO: 3471496 - DNA, 17 bp, Homo sapiens
tctgaatttgcaaagta

SEQ ID NO: 3471497 - DNA, 19 bp, Homo sapiens
tctgaatttgcaaagtact

SEQ ID NO: 3471498 - DNA, 22 bp, Homo sapiens
tctgaattttggggattttcaa

SEQ ID NO: 3471499 - DNA, 12 bp, Homo sapiens
tctgacacacag

SEQ ID NO: 3471500 - DNA, 13 bp, Homo sapiens
tctgacacacagc

SEQ ID NO: 3471501 - DNA, 14 bp, Homo sapiens
tctgacacacagct

SEQ ID NO: 3471502 - DNA, 12 bp, Homo sapiens
tctgacaggcaa

SEQ ID NO: 3471503 - DNA, 21 bp, Homo sapiens
tctgacaggcaatgctggctg

SEQ ID NO: 3471504 - DNA, 17 bp, Homo sapiens
tctgaccagcagcgcct

SEQ ID NO: 3471505 - DNA, 23 bp, Homo sapiens
tctgaccagtttaacctgatgca

SEQ ID NO: 3471506 - DNA, 11 bp, Homo sapiens
tctgacccagt

SEQ ID NO: 3471507 - DNA, 21 bp, Homo sapiens
tctgaccgaaacagcgctggg

SEQ ID NO: 3471508 - DNA, 15 bp, Homo sapiens
tctgaccttcagctc

SEQ ID NO: 3471509 - DNA, 21 bp, Homo sapiens
tctgaccttcagctcacgctt

SEQ ID NO: 3471510 - DNA, 19 bp, Homo sapiens
tctgactcggtttctccaa

SEQ ID NO: 3471511 - DNA, 20 bp, Homo sapiens
tctgacttaagcaaaagaaa

SEQ ID NO: 3471512 - DNA, 12 bp, Homo sapiens
tctgacttctgc

SEQ ID NO: 3471513 - DNA, 20 bp, Homo sapiens
tctgagaaacctgttgaaga

SEQ ID NO: 3471514 - DNA, 21 bp, Homo sapiens
tctgagaaacctgttgaagat

SEQ ID NO: 3471515 - DNA, 14 bp, Homo sapiens
tctgagaaactcta

SEQ ID NO: 3471516 - DNA, 12 bp, Homo sapiens
tctgagaatctt

SEQ ID NO: 3471517 - DNA, 15 bp, Homo sapiens
tctgagaatctttat

SEQ ID NO: 3471518 - DNA, 14 bp, Homo sapiens
tctgagcgcctcca

SEQ ID NO: 3471519 - DNA, 21 bp, Homo sapiens
tctgagcgcctccatccaagg

SEQ ID NO: 3471520 - DNA, 23 bp, Homo sapiens
tctgagctagttggttgaatttt

SEQ ID NO: 3471521 - DNA, 14 bp, Homo sapiens
tctgagctgtatct

SEQ ID NO: 3471522 - DNA, 18 bp, Homo sapiens
tctgaggaatccagaccc

SEQ ID NO: 3471523 - DNA, 22 bp, Homo sapiens
tctgaggaatccagacccggct

SEQ ID NO: 3471524 - DNA, 23 bp, Homo sapiens
tctgaggcctcctctctcagttt

SEQ ID NO: 3471525 - DNA, 16 bp, Homo sapiens
tctgagtcctggccca

SEQ ID NO: 3471526 - DNA, 15 bp, Homo sapiens
tctgagtctatgttc

SEQ ID NO: 3471527 - DNA, 18 bp, Homo sapiens
tctgagtgaacctgtata

SEQ ID NO: 3471528 - DNA, 22 bp, Homo sapiens
tctgataactagatggtgctga

SEQ ID NO: 3471529 - DNA, 23 bp, Homo sapiens
tctgataccttctggctgtgcta

SEQ ID NO: 3471530 - DNA, 12 bp, Homo sapiens
tctgatagaatt

SEQ ID NO: 3471531 - DNA, 15 bp, Homo sapiens
tctgatcaaggcctt

SEQ ID NO: 3471532 - DNA, 21 bp, Homo sapiens
tctgatcatccactgtgccat

SEQ ID NO: 3471533 - DNA, 21 bp, Homo sapiens
tctgatccctctacagagctt

SEQ ID NO: 3471534 - DNA, 23 bp, Homo sapiens
tctgatccctctgggggctctgg

SEQ ID NO: 3471535 - DNA, 16 bp, Homo sapiens
tctgatgatgtgcctg

SEQ ID NO: 3471536 - DNA, 17 bp, Homo sapiens
tctgatgcttacatctg

SEQ ID NO: 3471537 - DNA, 13 bp, Homo sapiens
tctgatggcttct

SEQ ID NO: 3471538 - DNA, 21 bp, Homo sapiens
tctgattcccaagctctgctc

SEQ ID NO: 3471539 - DNA, 19 bp, Homo sapiens
tctgcaaaaatatttataa

SEQ ID NO: 3471540 - DNA, 20 bp, Homo sapiens
tctgcaaaaatatttataaa

SEQ ID NO: 3471541 - DNA, 20 bp, Homo sapiens
tctgcaagaattgaagcagg

SEQ ID NO: 3471542 - DNA, 16 bp, Homo sapiens
tctgcacagcttttcc

SEQ ID NO: 3471543 - DNA, 15 bp, Homo sapiens
tctgcacccccctgg

SEQ ID NO: 3471544 - DNA, 17 bp, Homo sapiens
tctgcacccccctgggc

SEQ ID NO: 3471545 - DNA, 18 bp, Homo sapiens
tctgcacccccctgggct

SEQ ID NO: 3471546 - DNA, 10 bp, Homo sapiens
tctgcagaag

SEQ ID NO: 3471547 - DNA, 15 bp, Homo sapiens
tctgcagaaggaaaa

SEQ ID NO: 3471548 - DNA, 13 bp, Homo sapiens
tctgcaggcagac

SEQ ID NO: 3471549 - DNA, 16 bp, Homo sapiens
tctgcaggcagacacg

SEQ ID NO: 3471550 - DNA, 20 bp, Homo sapiens
tctgcagggccgccagggag

SEQ ID NO: 3471551 - DNA, 21 bp, Homo sapiens
tctgcaggggtctgggagtca

SEQ ID NO: 3471552 - DNA, 16 bp, Homo sapiens
tctgcagtaaatcttt

SEQ ID NO: 3471553 - DNA, 16 bp, Homo sapiens
tctgcatatgttgaat

SEQ ID NO: 3471554 - DNA, 18 bp, Homo sapiens
tctgcatatgttgaatac

SEQ ID NO: 3471555 - DNA, 14 bp, Homo sapiens
tctgcattgcccag

SEQ ID NO: 3471556 - DNA, 18 bp, Homo sapiens
tctgcattgcccagtctt

SEQ ID NO: 3471557 - DNA, 21 bp, Homo sapiens
tctgcatttagctgtattcat

SEQ ID NO: 3471558 - DNA, 17 bp, Homo sapiens
tctgcattttcacccca

SEQ ID NO: 3471559 - DNA, 15 bp, Homo sapiens
tctgcatttttctgc

SEQ ID NO: 3471560 - DNA, 20 bp, Homo sapiens
tctgcatttttctgcagaag

SEQ ID NO: 3471561 - DNA, 22 bp, Homo sapiens
tctgccatattctgttggccag

SEQ ID NO: 3471562 - DNA, 17 bp, Homo sapiens
tctgccccagcccagat

SEQ ID NO: 3471563 - DNA, 19 bp, Homo sapiens
tctgccccatcctccagca

SEQ ID NO: 3471564 - DNA, 19 bp, Homo sapiens
tctgccctctagagccttc

SEQ ID NO: 3471565 - DNA, 20 bp, Homo sapiens
tctgccgctacctccctccc

SEQ ID NO: 3471566 - DNA, 16 bp, Homo sapiens
tctgccggccctgggg

SEQ ID NO: 3471567 - DNA, 15 bp, Homo sapiens
tctgcctcttctggg

SEQ ID NO: 3471568 - DNA, 18 bp, Homo sapiens
tctgcctcttctgggagg

SEQ ID NO: 3471569 - DNA, 20 bp, Homo sapiens
tctgcctgaagtcacacagt

SEQ ID NO: 3471570 - DNA, 16 bp, Homo sapiens
tctgcctgacaaggcc

SEQ ID NO: 3471571 - DNA, 17 bp, Homo sapiens
tctgcctgacaggctgt

SEQ ID NO: 3471572 - DNA, 22 bp, Homo sapiens
tctgcctgacaggctgtgactc

SEQ ID NO: 3471573 - DNA, 16 bp, Homo sapiens
tctgcctgccagctgc

SEQ ID NO: 3471574 - DNA, 22 bp, Homo sapiens
tctgcctgccagctgcactgat

SEQ ID NO: 3471575 - DNA, 13 bp, Homo sapiens
tctgcctgcccag

SEQ ID NO: 3471576 - DNA, 17 bp, Homo sapiens
tctgcctgcccaggccc

SEQ ID NO: 3471577 - DNA, 22 bp, Homo sapiens
tctgcctgcccaggcccctgcc

SEQ ID NO: 3471578 - DNA, 12 bp, Homo sapiens
tctgcctggagt

SEQ ID NO: 3471579 - DNA, 19 bp, Homo sapiens
tctgctcactttaaacctg

SEQ ID NO: 3471580 - DNA, 14 bp, Homo sapiens
tctgctcagcttct

SEQ ID NO: 3471581 - DNA, 22 bp, Homo sapiens
tctgctcatcattctctgtctc

SEQ ID NO: 3471582 - DNA, 19 bp, Homo sapiens
tctcactgttgcccaggct

SEQ ID NO: 3471583 - DNA, 20 bp, Homo sapiens
tctcactgttgcccaggctg

SEQ ID NO: 3471584 - DNA, 19 bp, Homo sapiens
tctcactgtttgtttttat

SEQ ID NO: 3471585 - DNA, 16 bp, Homo sapiens
tctcagaatccaaaga

SEQ ID NO: 3471586 - DNA, 19 bp, Homo sapiens
tctcagaatctacccaaag

SEQ ID NO: 3471587 - DNA, 20 bp, Homo sapiens
tctcagagacaggtggccta

SEQ ID NO: 3471588 - DNA, 21 bp, Homo sapiens
tctcagagacaggtggcctag

SEQ ID NO: 3471589 - DNA, 19 bp, Homo sapiens
tctcagcctcccaacccca

SEQ ID NO: 3471590 - DNA, 20 bp, Homo sapiens
tctcaggcaccagtccctgt

SEQ ID NO: 3471591 - DNA, 20 bp, Homo sapiens
tctcaggccggcagccccag

SEQ ID NO: 3471592 - DNA, 23 bp, Homo sapiens
tctcaggccggcagccccagcct

SEQ ID NO: 3471593 - DNA, 13 bp, Homo sapiens
tctcagggcctgg

SEQ ID NO: 3471594 - DNA, 16 bp, Homo sapiens
tctcagggtccagacc

SEQ ID NO: 3471595 - DNA, 15 bp, Homo sapiens
tctcagggtctctgc

SEQ ID NO: 3471596 - DNA, 19 bp, Homo sapiens
tctcagggtctctgctgcc

SEQ ID NO: 3471597 - DNA, 15 bp, Homo sapiens
tctcagtctctgagc

SEQ ID NO: 3471598 - DNA, 23 bp, Homo sapiens
tctcagtgttttggactccatct

SEQ ID NO: 3471599 - DNA, 10 bp, Homo sapiens
tctcatccca

SEQ ID NO: 3471600 - DNA, 21 bp, Homo sapiens
tctcatcctccagtaccttgc

SEQ ID NO: 3471601 - DNA, 13 bp, Homo sapiens
tctcatcctgcag

SEQ ID NO: 3471602 - DNA, 17 bp, Homo sapiens
tctcatctcttagctcc

SEQ ID NO: 3471603 - DNA, 13 bp, Homo sapiens
tctcatctttctt

SEQ ID NO: 3471604 - DNA, 18 bp, Homo sapiens
tctcatgcccctggctgg

SEQ ID NO: 3471605 - DNA, 21 bp, Homo sapiens
tctcatgggaaggggaggacc

SEQ ID NO: 3471606 - DNA, 17 bp, Homo sapiens
tctcatgttttcaactg

SEQ ID NO: 3471607 - DNA, 19 bp, Homo sapiens
tctcatgttttcaactgcc

SEQ ID NO: 3471608 - DNA, 15 bp, Homo sapiens
tctcattaacaatat

SEQ ID NO: 3471609 - DNA, 23 bp, Homo sapiens
tctcattactgcttcatttttgt

SEQ ID NO: 3471610 - DNA, 14 bp, Homo sapiens
tctcattccgttgt

SEQ ID NO: 3471611 - DNA, 19 bp, Homo sapiens
tctcattggacccttccat

SEQ ID NO: 3471612 - DNA, 12 bp, Homo sapiens
tctcatttagtg

SEQ ID NO: 3471613 - DNA, 16 bp, Homo sapiens
tctcatttcacccctc

SEQ ID NO: 3471614 - DNA, 19 bp, Homo sapiens
tctcatttcacccctccct

SEQ ID NO: 3471615 - DNA, 15 bp, Homo sapiens
tctcatttgtggctt

SEQ ID NO: 3471616 - DNA, 19 bp, Homo sapiens
tctccaaaaatctgcctgg

SEQ ID NO: 3471617 - DNA, 16 bp, Homo sapiens
tctccaaactgattaa

SEQ ID NO: 3471618 - DNA, 18 bp, Homo sapiens
tctccaccaggaacctct

SEQ ID NO: 3471619 - DNA, 16 bp, Homo sapiens
tctccaccctgctctc

SEQ ID NO: 3471620 - DNA, 19 bp, Homo sapiens
tctccactgctctcagcct

SEQ ID NO: 3471621 - DNA, 22 bp, Homo sapiens
tctccactgctctcagcctccc

SEQ ID NO: 3471622 - DNA, 18 bp, Homo sapiens
tctccagatgtttccaga

SEQ ID NO: 3471623 - DNA, 23 bp, Homo sapiens
tctccagccccttctcagaatct

SEQ ID NO: 3471624 - DNA, 13 bp, Homo sapiens
tctccaggcattt

SEQ ID NO: 3471625 - DNA, 11 bp, Homo sapiens
tctccaggctg

SEQ ID NO: 3471626 - DNA, 16 bp, Homo sapiens
tctccaggctgtatcc

SEQ ID NO: 3471627 - DNA, 18 bp, Homo sapiens
tctccaggggctgcttcc

SEQ ID NO: 3471628 - DNA, 20 bp, Homo sapiens
tctccaggggctgcttcctc

SEQ ID NO: 3471629 - DNA, 18 bp, Homo sapiens
tctccagggtcagaaaca

SEQ ID NO: 3471630 - DNA, 20 bp, Homo sapiens
tctccatggccctgccatgc

SEQ ID NO: 3471631 - DNA, 19 bp, Homo sapiens
tctcccactagacaagtcc

SEQ ID NO: 3471632 - DNA, 19 bp, Homo sapiens
tctcccattgtccctctgc

SEQ ID NO: 3471633 - DNA, 23 bp, Homo sapiens
tctccccaatgagacttgccttc

SEQ ID NO: 3471634 - DNA, 19 bp, Homo sapiens
tctccccacgagggctggc

SEQ ID NO: 3471635 - DNA, 12 bp, Homo sapiens
tctccccagagt

SEQ ID NO: 3471636 - DNA, 17 bp, Homo sapiens
tctccccagcccagaga

SEQ ID NO: 3471637 - DNA, 18 bp, Homo sapiens
tctccccagcccagagac

SEQ ID NO: 3471638 - DNA, 15 bp, Homo sapiens
tctcccctcttctga

SEQ ID NO: 3471639 - DNA, 12 bp, Homo sapiens
tctcccctgccc

SEQ ID NO: 3471640 - DNA, 16 bp, Homo sapiens
tctcccctgcccccag

SEQ ID NO: 3471641 - DNA, 21 bp, Homo sapiens
tctcccctgcccccaggactg

SEQ ID NO: 3471642 - DNA, 22 bp, Homo sapiens
tctcccctgcccccaggactgg

SEQ ID NO: 3471643 - DNA, 21 bp, Homo sapiens
tctccctctaggctctgcctt

SEQ ID NO: 3471644 - DNA, 21 bp, Homo sapiens
tctccctgcactccctcctgg

SEQ ID NO: 3471645 - DNA, 20 bp, Homo sapiens
tctccgattttgctctgtct

SEQ ID NO: 3471646 - DNA, 15 bp, Homo sapiens
tctccggctcccagc

SEQ ID NO: 3471647 - DNA, 23 bp, Homo sapiens
tctccgttagctcctgtggcccc

SEQ ID NO: 3471648 - DNA, 13 bp, Homo sapiens
tctcctaaagctt

SEQ ID NO: 3471649 - DNA, 14 bp, Homo sapiens
tctcctaaagcttt

SEQ ID NO: 3471650 - DNA, 18 bp, Homo sapiens
tctcctatatatttctat

SEQ ID NO: 3471651 - DNA, 19 bp, Homo sapiens
tctcctatatatttctatt

SEQ ID NO: 3471652 - DNA, 22 bp, Homo sapiens
tctcctatatatttctattatt

SEQ ID NO: 3471653 - DNA, 23 bp, Homo sapiens
tctcctatatatttctattatta

SEQ ID NO: 3471654 - DNA, 14 bp, Homo sapiens
tctcctcatctcta

SEQ ID NO: 3471655 - DNA, 14 bp, Homo sapiens
tctcctcctgccca

SEQ ID NO: 3471656 - DNA, 23 bp, Homo sapiens
tctcctcttgtaaataaagccct

SEQ ID NO: 3471657 - DNA, 15 bp, Homo sapiens
tctcctgcctcagcc

SEQ ID NO: 3471658 - DNA, 17 bp, Homo sapiens
tctcctgcctcagcctc

SEQ ID NO: 3471659 - DNA, 20 bp, Homo sapiens
tctcctgccttcctcctggg

SEQ ID NO: 3471660 - DNA, 11 bp, Homo sapiens
tctcctggagg

SEQ ID NO: 3471661 - DNA, 15 bp, Homo sapiens
tctccttcagccctc

SEQ ID NO: 3471662 - DNA, 19 bp, Homo sapiens
tctccttgtggcctgggcc

SEQ ID NO: 3471663 - DNA, 23 bp, Homo sapiens
tctcctttcaccccagggcctga

SEQ ID NO: 3471664 - DNA, 19 bp, Homo sapiens
tctcctttgtactttgtgc

SEQ ID NO: 3471665 - DNA, 20 bp, Homo sapiens
tctcctttgtactttgtgct

SEQ ID NO: 3471666 - DNA, 13 bp, Homo sapiens
tctcgagcttggg

SEQ ID NO: 3471667 - DNA, 16 bp, Homo sapiens
tctcgcatcttcccaa

SEQ ID NO: 3471668 - DNA, 18 bp, Homo sapiens
tctcgctccctcccagga

SEQ ID NO: 3471669 - DNA, 23 bp, Homo sapiens
tctcggctcagtgcaacctctgc

SEQ ID NO: 3471670 - DNA, 14 bp, Homo sapiens
tctcgggagaggat

SEQ ID NO: 3471671 - DNA, 21 bp, Homo sapiens
tctctaaagagtttattttaa

SEQ ID NO: 3471672 - DNA, 17 bp, Homo sapiens
tctctaacagctcagga

SEQ ID NO: 3471673 - DNA, 22 bp, Homo sapiens
tctctaacttcaaggcccatat

SEQ ID NO: 3471674 - DNA, 22 bp, Homo sapiens
tctctacttttccctgtacttt

SEQ ID NO: 3471675 - DNA, 18 bp, Homo sapiens
tctctagaagtgccatct

SEQ ID NO: 3471676 - DNA, 16 bp, Homo sapiens
tctctataaaaaatat

SEQ ID NO: 3471677 - DNA, 13 bp, Homo sapiens
tctctatcattta

SEQ ID NO: 3471678 - DNA, 15 bp, Homo sapiens
tctctatcatttaat

SEQ ID NO: 3471679 - DNA, 17 bp, Homo sapiens
tctctatcatttaataa

SEQ ID NO: 3471680 - DNA, 20 bp, Homo sapiens
tctctatcatttaataatat

SEQ ID NO: 3471681 - DNA, 22 bp, Homo sapiens
tctctatcatttaataatatac

SEQ ID NO: 3471682 - DNA, 13 bp, Homo sapiens
tctctcaaccttg

SEQ ID NO: 3471683 - DNA, 13 bp, Homo sapiens
tctctcactgtgt

SEQ ID NO: 3471684 - DNA, 14 bp, Homo sapiens
tctctccactgctc

SEQ ID NO: 3471685 - DNA, 21 bp, Homo sapiens
tctctccactgctctcagcct

SEQ ID NO: 3471686 - DNA, 14 bp, Homo sapiens
tctctcctgcggga

SEQ ID NO: 3471687 - DNA, 15 bp, Homo sapiens
tctctcctgtcctcc

SEQ ID NO: 3471688 - DNA, 22 bp, Homo sapiens
tctctctcctgtactttttcca

SEQ ID NO: 3471689 - DNA, 11 bp, Homo sapiens
tctctctgtgg

SEQ ID NO: 3471690 - DNA, 20 bp, Homo sapiens
tctctcttgggccaagccag

SEQ ID NO: 3471691 - DNA, 23 bp, Homo sapiens
tctctgaagagtgggtttcacaa

SEQ ID NO: 3471692 - DNA, 14 bp, Homo sapiens
tctctgacttctgc

SEQ ID NO: 3471693 - DNA, 16 bp, Homo sapiens
tctctgacttctgcct

SEQ ID NO: 3471694 - DNA, 15 bp, Homo sapiens
tctctgagctgtgca

SEQ ID NO: 3471695 - DNA, 16 bp, Homo sapiens
tctctgagctgtgcag

SEQ ID NO: 3471696 - DNA, 13 bp, Homo sapiens
tctctgaggacac

SEQ ID NO: 3471697 - DNA, 18 bp, Homo sapiens
tctctgcaccgtactgtg

SEQ ID NO: 3471698 - DNA, 21 bp, Homo sapiens
tctctgcatttttctgcagaa

SEQ ID NO: 3471699 - DNA, 16 bp, Homo sapiens
tctctgccgctacctc

SEQ ID NO: 3471700 - DNA, 22 bp, Homo sapiens
tctctgccgctacctccctccc

SEQ ID NO: 3471701 - DNA, 14 bp, Homo sapiens
tcctctgactccac

SEQ ID NO: 3471702 - DNA, 17 bp, Homo sapiens
tcctctgactccactca

SEQ ID NO: 3471703 - DNA, 22 bp, Homo sapiens
tcctctgataatatattttcaa

SEQ ID NO: 3471704 - DNA, 12 bp, Homo sapiens
tcctctgcaagt

SEQ ID NO: 3471705 - DNA, 18 bp, Homo sapiens
tcctctgcaagtgctcag

SEQ ID NO: 3471706 - DNA, 22 bp, Homo sapiens
tcctctgtcagtcacagccacc

SEQ ID NO: 3471707 - DNA, 20 bp, Homo sapiens
tcctctgtgaccaatgtctt

SEQ ID NO: 3471708 - DNA, 21 bp, Homo sapiens
tcctcttctcaaagctgggat

SEQ ID NO: 3471709 - DNA, 15 bp, Homo sapiens
tcctctttgctttgc

SEQ ID NO: 3471710 - DNA, 23 bp, Homo sapiens
tcctctttgctttgctttctgct

SEQ ID NO: 3471711 - DNA, 22 bp, Homo sapiens
tcctgaaacgctcctttgtgtg

SEQ ID NO: 3471712 - DNA, 16 bp, Homo sapiens
tcctgaaactatattt

SEQ ID NO: 3471713 - DNA, 16 bp, Homo sapiens
tcctgaaagcggctgc

SEQ ID NO: 3471714 - DNA, 17 bp, Homo sapiens
tcctgaaagcggctgcc

SEQ ID NO: 3471715 - DNA, 21 bp, Homo sapiens
tcctgaaagcggctgcctcca

SEQ ID NO: 3471716 - DNA, 12 bp, Homo sapiens
tcctgaaatcaa

SEQ ID NO: 3471717 - DNA, 22 bp, Homo sapiens
tcctgacaagttcctaggaaaa

SEQ ID NO: 3471718 - DNA, 17 bp, Homo sapiens
tcctgacccattgctgt

SEQ ID NO: 3471719 - DNA, 18 bp, Homo sapiens
tcctgacccattgctgtt

SEQ ID NO: 3471720 - DNA, 13 bp, Homo sapiens
tcctgactgcccg

SEQ ID NO: 3471721 - DNA, 23 bp, Homo sapiens
tcctgagccagtgtcaggaggaa

SEQ ID NO: 3471722 - DNA, 21 bp, Homo sapiens
tcctgataaagcacagctgta

SEQ ID NO: 3471723 - DNA, 18 bp, Homo sapiens
tcctgataataaaggaac

SEQ ID NO: 3471724 - DNA, 15 bp, Homo sapiens
tcctgatcagagccg

SEQ ID NO: 3471725 - DNA, 14 bp, Homo sapiens
tcctgcagcttatt

SEQ ID NO: 3471726 - DNA, 14 bp, Homo sapiens
tcctgcaggccagg

SEQ ID NO: 3471727 - DNA, 19 bp, Homo sapiens
tcctgcaggccaggccagc

SEQ ID NO: 3471728 - DNA, 19 bp, Homo sapiens
tcctgccaccaccctgtct

SEQ ID NO: 3471729 - DNA, 21 bp, Homo sapiens
tcctgccaccaccctgtcttc

SEQ ID NO: 3471730 - DNA, 13 bp, Homo sapiens
tcctgccaccagc

SEQ ID NO: 3471731 - DNA, 18 bp, Homo sapiens
tcctgccaccagcatcca

SEQ ID NO: 3471732 - DNA, 20 bp, Homo sapiens
tcctgcccgcagacctctgg

SEQ ID NO: 3471733 - DNA, 18 bp, Homo sapiens
tcctgccgcagagctggc

SEQ ID NO: 3471734 - DNA, 18 bp, Homo sapiens
tcctgcctcagcctcccg

SEQ ID NO: 3471735 - DNA, 14 bp, Homo sapiens
tcctgcctccgcct

SEQ ID NO: 3471736 - DNA, 18 bp, Homo sapiens
tcctgcctttgcctccag

SEQ ID NO: 3471737 - DNA, 15 bp, Homo sapiens
tcctgcggcaggact

SEQ ID NO: 3471738 - DNA, 14 bp, Homo sapiens
tcctgctactctgt

SEQ ID NO: 3471739 - DNA, 21 bp, Homo sapiens
tcctggacatgaagattcttt

SEQ ID NO: 3471740 - DNA, 16 bp, Homo sapiens
tcctggactcctgcca

SEQ ID NO: 3471741 - DNA, 18 bp, Homo sapiens
tcctggagcccagaggag

SEQ ID NO: 3471742 - DNA, 15 bp, Homo sapiens
tcctggagctctgtg

SEQ ID NO: 3471743 - DNA, 18 bp, Homo sapiens
tcctggagctctgtgggt

SEQ ID NO: 3471744 - DNA, 14 bp, Homo sapiens
tcctggatgtctga

SEQ ID NO: 3471745 - DNA, 17 bp, Homo sapiens
tcctggatgtttggaaa

SEQ ID NO: 3471746 - DNA, 14 bp, Homo sapiens
tcctggcacccggc

SEQ ID NO: 3471747 - DNA, 19 bp, Homo sapiens
tcctggcacccggcccctg

SEQ ID NO: 3471748 - DNA, 22 bp, Homo sapiens
tcctggcacccggcccctgctg

SEQ ID NO: 3471749 - DNA, 14 bp, Homo sapiens
tcctgggaaatatt

SEQ ID NO: 3471750 - DNA, 20 bp, Homo sapiens
tcctgggaaatattccctag

SEQ ID NO: 3471751 - DNA, 18 bp, Homo sapiens
tcctgggagtgagctggt

SEQ ID NO: 3471752 - DNA, 16 bp, Homo sapiens
tcctgggccctctctg

SEQ ID NO: 3471753 - DNA, 23 bp, Homo sapiens
tcctgggccctctctgctctgcg

SEQ ID NO: 3471754 - DNA, 13 bp, Homo sapiens
tcctgggcctgca

SEQ ID NO: 3471755 - DNA, 13 bp, Homo sapiens
tcctgggctcagg

SEQ ID NO: 3471756 - DNA, 19 bp, Homo sapiens
tcctgggtggtctgcaggc

SEQ ID NO: 3471757 - DNA, 21 bp, Homo sapiens
tcctgggtggtctgcaggcag

SEQ ID NO: 3471758 - DNA, 21 bp, Homo sapiens
tcctgggttttgtattctctg

SEQ ID NO: 3471759 - DNA, 22 bp, Homo sapiens
tcctgggttttgtattctctga

SEQ ID NO: 3471760 - DNA, 23 bp, Homo sapiens
tcctgggttttgtattctctgag

SEQ ID NO: 3471761 - DNA, 15 bp, Homo sapiens
tcctgtatgtctgtc

SEQ ID NO: 3471762 - DNA, 20 bp, Homo sapiens
tcctgtattcagacagatga

SEQ ID NO: 3471763 - DNA, 14 bp, Homo sapiens
tcctgtccagctcc

SEQ ID NO: 3471764 - DNA, 15 bp, Homo sapiens
tcctgtccagctcca

SEQ ID NO: 3471765 - DNA, 17 bp, Homo sapiens
tcctgtccccatctgtc

SEQ ID NO: 3471766 - DNA, 20 bp, Homo sapiens
tcctgtccccatctgtcggc

SEQ ID NO: 3471767 - DNA, 13 bp, Homo sapiens
tcctgtcctccct

SEQ ID NO: 3471768 - DNA, 16 bp, Homo sapiens
tcctgtctttacaaat

SEQ ID NO: 3471769 - DNA, 18 bp, Homo sapiens
tcctgtgaaatattctta

SEQ ID NO: 3471770 - DNA, 22 bp, Homo sapiens
tcctgtgaatgccactgccttc

SEQ ID NO: 3471771 - DNA, 22 bp, Homo sapiens
tcctgtgaggagccccatctgt

SEQ ID NO: 3471772 - DNA, 16 bp, Homo sapiens
tcctgtgtcaatccag

SEQ ID NO: 3471773 - DNA, 14 bp, Homo sapiens
tcctgtgtgtgcgc

SEQ ID NO: 3471774 - DNA, 18 bp, Homo sapiens
tcctgttcagtaataaaa

SEQ ID NO: 3471775 - DNA, 12 bp, Homo sapiens
tccttaaaaatc

SEQ ID NO: 3471776 - DNA, 18 bp, Homo sapiens
tccttaaaaatcacactg

SEQ ID NO: 3471777 - DNA, 21 bp, Homo sapiens
tccttacctttaccccatccc

SEQ ID NO: 3471778 - DNA, 18 bp, Homo sapiens
tccttagacctgagggac

SEQ ID NO: 3471779 - DNA, 23 bp, Homo sapiens
tccttagacctgagggacccttc

SEQ ID NO: 3471780 - DNA, 18 bp, Homo sapiens
tccttagatctggcatgt

SEQ ID NO: 3471781 - DNA, 15 bp, Homo sapiens
tccttcaattccata

SEQ ID NO: 3471782 - DNA, 13 bp, Homo sapiens
tccttcacctttc

SEQ ID NO: 3471783 - DNA, 12 bp, Homo sapiens
tccttcagacac

SEQ ID NO: 3471784 - DNA, 23 bp, Homo sapiens
tccttcatatgaaaggtgccatg

SEQ ID NO: 3471785 - DNA, 21 bp, Homo sapiens
tccttccagtgtccttagaac

SEQ ID NO: 3471786 - DNA, 16 bp, Homo sapiens
tccttcccaatcttct

SEQ ID NO: 3471787 - DNA, 17 bp, Homo sapiens
tccttccctgtgtcttt

SEQ ID NO: 3471788 - DNA, 15 bp, Homo sapiens
tccttcgaaaggcct

SEQ ID NO: 3471789 - DNA, 20 bp, Homo sapiens
tccttcgaaaggccttcaga

SEQ ID NO: 3471790 - DNA, 18 bp, Homo sapiens
tccttctgcggccagagc

SEQ ID NO: 3471791 - DNA, 19 bp, Homo sapiens
tccttctgtcctactctgt

SEQ ID NO: 3471792 - DNA, 18 bp, Homo sapiens
tccttgaagaactgcagg

SEQ ID NO: 3471793 - DNA, 22 bp, Homo sapiens
tccttgacctgcattgtaaata

SEQ ID NO: 3471794 - DNA, 23 bp, Homo sapiens
tccttgagacacggagcccagcc

SEQ ID NO: 3471795 - DNA, 20 bp, Homo sapiens
tccttgagagaccaggcaaa

SEQ ID NO: 3471796 - DNA, 13 bp, Homo sapiens
tccttggaggaca

SEQ ID NO: 3471797 - DNA, 19 bp, Homo sapiens
tccttgttacccatgaaaa

SEQ ID NO: 3471798 - DNA, 14 bp, Homo sapiens
tccttgttgttggt

SEQ ID NO: 3471799 - DNA, 16 bp, Homo sapiens
tcctttacgtgtttaa

SEQ ID NO: 3471800 - DNA, 15 bp, Homo sapiens
tcctttagcgcccag

SEQ ID NO: 3471801 - DNA, 16 bp, Homo sapiens
tcctttccccttcctt

SEQ ID NO: 3471802 - DNA, 20 bp, Homo sapiens
tcctttctagagcactgcca

SEQ ID NO: 3471803 - DNA, 13 bp, Homo sapiens
tcctttgggaaag

SEQ ID NO: 3471804 - DNA, 15 bp, Homo sapiens
tccttttcttctatg

SEQ ID NO: 3471805 - DNA, 12 bp, Homo sapiens
tccttttgtaaa

SEQ ID NO: 3471806 - DNA, 14 bp, Homo sapiens
tccttttgtaaagt

SEQ ID NO: 3471807 - DNA, 19 bp, Homo sapiens
tcctttttaaccattccaa

SEQ ID NO: 3471808 - DNA, 13 bp, Homo sapiens
tcctttttgttat

SEQ ID NO: 3471809 - DNA, 11 bp, Homo sapiens
tccttttttcc

SEQ ID NO: 3471810 - DNA, 12 bp, Homo sapiens
tccttttttccc

SEQ ID NO: 3471811 - DNA, 19 bp, Homo sapiens
tcgaaacctgggattcagg

SEQ ID NO: 3471812 - DNA, 15 bp, Homo sapiens
tcgaaaggccttcag

SEQ ID NO: 3471813 - DNA, 16 bp, Homo sapiens
tcgaatctctgtgcct

SEQ ID NO: 3471814 - DNA, 17 bp, Homo sapiens
tcgaatctctgtgcctt

SEQ ID NO: 3471815 - DNA, 23 bp, Homo sapiens
tcgaccccaaaggaacactgaca

SEQ ID NO: 3471816 - DNA, 15 bp, Homo sapiens
tcgagaactttcatt

SEQ ID NO: 3471817 - DNA, 16 bp, Homo sapiens
tcgagaactttcattt

SEQ ID NO: 3471818 - DNA, 14 bp, Homo sapiens
tcgagaccagcctg

SEQ ID NO: 3471819 - DNA, 17 bp, Homo sapiens
tcgagcagtcctgcctc

SEQ ID NO: 3471820 - DNA, 14 bp, Homo sapiens
tcgagcttggggca

SEQ ID NO: 3471821 - DNA, 14 bp, Homo sapiens
tcgaggacagggag

SEQ ID NO: 3471822 - DNA, 12 bp, Homo sapiens
tcgagtactgtg

SEQ ID NO: 3471823 - DNA, 16 bp, Homo sapiens
tcgagtactgtgggca

SEQ ID NO: 3471824 - DNA, 15 bp, Homo sapiens
tcgagtcacattctg

SEQ ID NO: 3471825 - DNA, 23 bp, Homo sapiens
tcgatggtacgtgaccctctgct

SEQ ID NO: 3471826 - DNA, 15 bp, Homo sapiens
tcgattcatattgaa

SEQ ID NO: 3471827 - DNA, 13 bp, Homo sapiens
tcgattttgtatc

SEQ ID NO: 3471828 - DNA, 13 bp, Homo sapiens
tcgcaagctgggt

SEQ ID NO: 3471829 - DNA, 16 bp, Homo sapiens
tcgcaccattctgact

SEQ ID NO: 3471830 - DNA, 14 bp, Homo sapiens
tcgcagcctgagtc

SEQ ID NO: 3471831 - DNA, 14 bp, Homo sapiens
tcgcatttcctaag

SEQ ID NO: 3471832 - DNA, 15 bp, Homo sapiens
tcgccaaactgtctc

SEQ ID NO: 3471833 - DNA, 22 bp, Homo sapiens
tccacgagctgtttactaggga

SEQ ID NO: 3471834 - DNA, 13 bp, Homo sapiens
tccacgtgtgtgt

SEQ ID NO: 3471835 - DNA, 21 bp, Homo sapiens
tccacgttctgctcatcattc

SEQ ID NO: 3471836 - DNA, 13 bp, Homo sapiens
tccactactgcta

SEQ ID NO: 3471837 - DNA, 18 bp, Homo sapiens
tccactattttcaaagaa

SEQ ID NO: 3471838 - DNA, 15 bp, Homo sapiens
tccactcagttgcaa

SEQ ID NO: 3471839 - DNA, 12 bp, Homo sapiens
tccactccttct

SEQ ID NO: 3471840 - DNA, 13 bp, Homo sapiens
tccactctccccc

SEQ ID NO: 3471841 - DNA, 16 bp, Homo sapiens
tccactctcccccacc

SEQ ID NO: 3471842 - DNA, 17 bp, Homo sapiens
tccactctgatagaatt

SEQ ID NO: 3471843 - DNA, 14 bp, Homo sapiens
tccactctgcttct

SEQ ID NO: 3471844 - DNA, 21 bp, Homo sapiens
tccactctgcttctctgactt

SEQ ID NO: 3471845 - DNA, 23 bp, Homo sapiens
tccactctgcttctctgacttct

SEQ ID NO: 3471846 - DNA, 24 bp, Homo sapiens
tccactctgcttctctgacttctg

SEQ ID NO: 3471847 - DNA, 15 bp, Homo sapiens
tccactgagggcagt

SEQ ID NO: 3471848 - DNA, 20 bp, Homo sapiens
tccacttctttcagcagact

SEQ ID NO: 3471849 - DNA, 16 bp, Homo sapiens
tccacttgtttgcact

SEQ ID NO: 3471850 - DNA, 18 bp, Homo sapiens
tccacttgtttgcactgt

SEQ ID NO: 3471851 - DNA, 19 bp, Homo sapiens
tccacttgtttgcactgtg

SEQ ID NO: 3471852 - DNA, 20 bp, Homo sapiens
tccacttgtttgcactgtgt

SEQ ID NO: 3471853 - DNA, 15 bp, Homo sapiens
tccactttgtttcgt

SEQ ID NO: 3471854 - DNA, 19 bp, Homo sapiens
tccactttgtttcgtgggg

SEQ ID NO: 3471855 - DNA, 20 bp, Homo sapiens
tccacttttttttgtatgtt

SEQ ID NO: 3471856 - DNA, 13 bp, Homo sapiens
tccagaaaacaaa

SEQ ID NO: 3471857 - DNA, 20 bp, Homo sapiens
tccagaacacggctcacgct

SEQ ID NO: 3471858 - DNA, 13 bp, Homo sapiens
tccagaatgctgt

SEQ ID NO: 3471859 - DNA, 15 bp, Homo sapiens
tccagaatgctgtac

SEQ ID NO: 3471860 - DNA, 16 bp, Homo sapiens
tccagaatgctgtaca

SEQ ID NO: 3471861 - DNA, 19 bp, Homo sapiens
tccagacttccttgagaca

SEQ ID NO: 3471862 - DNA, 23 bp, Homo sapiens
tccctgaggatgggtcagagcta

SEQ ID NO: 3471863 - DNA, 19 bp, Homo sapiens
tccctgcactccctcctgg

SEQ ID NO: 3471864 - DNA, 16 bp, Homo sapiens
tccctgcatctgacca

SEQ ID NO: 3471865 - DNA, 20 bp, Homo sapiens
tccctgcatctgaccagcag

SEQ ID NO: 3471866 - DNA, 13 bp, Homo sapiens
tccctgccagctc

SEQ ID NO: 3471867 - DNA, 16 bp, Homo sapiens
tccctgcccatttcat

SEQ ID NO: 3471868 - DNA, 17 bp, Homo sapiens
tccctgcgcctgtgatg

SEQ ID NO: 3471869 - DNA, 21 bp, Homo sapiens
tccctgcgcctgtgatgctgg

SEQ ID NO: 3471870 - DNA, 15 bp, Homo sapiens
tccctgcgcctttcc

SEQ ID NO: 3471871 - DNA, 17 bp, Homo sapiens
tccctgctgctgccagg

SEQ ID NO: 3471872 - DNA, 17 bp, Homo sapiens
tccctggcttctgtggg

SEQ ID NO: 3471873 - DNA, 13 bp, Homo sapiens
tccctgggcctca

SEQ ID NO: 3471874 - DNA, 20 bp, Homo sapiens
tccctggggctagggggagc

SEQ ID NO: 3471875 - DNA, 20 bp, Homo sapiens
tccctggtggctacccaata

SEQ ID NO: 3471876 - DNA, 22 bp, Homo sapiens
tccctgtaacctcttcagaggc

SEQ ID NO: 3471877 - DNA, 23 bp, Homo sapiens
tccctgtagttgacaattctgca

SEQ ID NO: 3471878 - DNA, 14 bp, Homo sapiens
tccctgtcacctct

SEQ ID NO: 3471879 - DNA, 15 bp, Homo sapiens
tccctgtcacctctt

SEQ ID NO: 3471880 - DNA, 17 bp, Homo sapiens
tccctgtcacctcttcc

SEQ ID NO: 3471881 - DNA, 18 bp, Homo sapiens
tccctgtcacctcttccg

SEQ ID NO: 3471882 - DNA, 12 bp, Homo sapiens
tccctgtcccag

SEQ ID NO: 3471883 - DNA, 19 bp, Homo sapiens
tccctgtctttactcctca

SEQ ID NO: 3471884 - DNA, 16 bp, Homo sapiens
tccctgttccccagag

SEQ ID NO: 3471885 - DNA, 18 bp, Homo sapiens
tccctgttggtcggtggg

SEQ ID NO: 3471886 - DNA, 13 bp, Homo sapiens
tcccttctgctac

SEQ ID NO: 3471887 - DNA, 14 bp, Homo sapiens
tcccttctgctact

SEQ ID NO: 3471888 - DNA, 20 bp, Homo sapiens
tcccttgcctttcgaggcct

SEQ ID NO: 3471889 - DNA, 12 bp, Homo sapiens
tcccttgggctc

SEQ ID NO: 3471890 - DNA, 23 bp, Homo sapiens
tcccttgtacctatggctgcctg

SEQ ID NO: 3471891 - DNA, 23 bp, Homo sapiens
tcccttgtccggaggatattaaa

SEQ ID NO: 3471892 - DNA, 21 bp, Homo sapiens
tccctttcacaaaattttatt

SEQ ID NO: 3471893 - DNA, 14 bp, Homo sapiens
tccctttctcccct

SEQ ID NO: 3471894 - DNA, 20 bp, Homo sapiens
tcccttttacatactgctgt

SEQ ID NO: 3471895 - DNA, 20 bp, Homo sapiens
tccctttttatatcccattt

SEQ ID NO: 3471896 - DNA, 21 bp, Homo sapiens
tccgaaagggacttggaagct

SEQ ID NO: 3471897 - DNA, 19 bp, Homo sapiens
tccgaacctcctctgtgaa

SEQ ID NO: 3471898 - DNA, 22 bp, Homo sapiens
tccgaacctcctctgtgaagca

SEQ ID NO: 3471899 - DNA, 17 bp, Homo sapiens
tccgaccagacaccttg

SEQ ID NO: 3471900 - DNA, 15 bp, Homo sapiens
tccgactgctttgga

SEQ ID NO: 3471901 - DNA, 16 bp, Homo sapiens
tccgagaggtgggcca

SEQ ID NO: 3471902 - DNA, 15 bp, Homo sapiens
tccgatgacagtgct

SEQ ID NO: 3471903 - DNA, 12 bp, Homo sapiens
tccgcaggactt

SEQ ID NO: 3471904 - DNA, 18 bp, Homo sapiens
tccgcaggtgctggtccc

SEQ ID NO: 3471905 - DNA, 13 bp, Homo sapiens
tccgccctgccac

SEQ ID NO: 3471906 - DNA, 14 bp, Homo sapiens
tccgcctcttgggt

SEQ ID NO: 3471907 - DNA, 18 bp, Homo sapiens
tccgcctggccggctcca

SEQ ID NO: 3471908 - DNA, 17 bp, Homo sapiens
tccgccttcacattccc

SEQ ID NO: 3471909 - DNA, 16 bp, Homo sapiens
tccgctttctacccag

SEQ ID NO: 3471910 - DNA, 21 bp, Homo sapiens
tccgctttctacccagcgagc

SEQ ID NO: 3471911 - DNA, 16 bp, Homo sapiens
tccggaatgccaccca

SEQ ID NO: 3471912 - DNA, 17 bp, Homo sapiens
tccggaggatattaaaa

SEQ ID NO: 3471913 - DNA, 18 bp, Homo sapiens
tccggcagttctgggtgc

SEQ ID NO: 3471914 - DNA, 21 bp, Homo sapiens
tccggccctcctaccctgcgc

SEQ ID NO: 3471915 - DNA, 23 bp, Homo sapiens
tccggccctcctaccctgcgccc

SEQ ID NO: 3471916 - DNA, 18 bp, Homo sapiens
tccggctcccagcctcag

SEQ ID NO: 3471917 - DNA, 21 bp, Homo sapiens
tccggctcccagcctcagcgc

SEQ ID NO: 3471918 - DNA, 13 bp, Homo sapiens
tccggctgtgctg

SEQ ID NO: 3471919 - DNA, 21 bp, Homo sapiens
tccggcttgacctgtttctct

SEQ ID NO: 3471920 - DNA, 18 bp, Homo sapiens
tccgtgaaaacggagctg

SEQ ID NO: 3471921 - DNA, 18 bp, Homo sapiens
tccgtgctgacagctgct

SEQ ID NO: 3471922 - DNA, 19 bp, Homo sapiens
tccgtgctgacagctgctc

SEQ ID NO: 3471923 - DNA, 21 bp, Homo sapiens
tccgtgctgacagctgctcct

SEQ ID NO: 3471924 - DNA, 17 bp, Homo sapiens
tccgtgggacggtgccc

SEQ ID NO: 3471925 - DNA, 20 bp, Homo sapiens
tccgtttgaccaatttgcac

SEQ ID NO: 3471926 - DNA, 15 bp, Homo sapiens
tccgtttttttttct

SEQ ID NO: 3471927 - DNA, 20 bp, Homo sapiens
tccgtttttttttctttttc

SEQ ID NO: 3471928 - DNA, 15 bp, Homo sapiens
tcctaaaacaaatag

SEQ ID NO: 3471929 - DNA, 17 bp, Homo sapiens
tcctaaaacacctggta

SEQ ID NO: 3471930 - DNA, 14 bp, Homo sapiens
tcctaacttttcaa

SEQ ID NO: 3471931 - DNA, 17 bp, Homo sapiens
tcctaagcctgtggctg

SEQ ID NO: 3471932 - DNA, 14 bp, Homo sapiens
tcctaatatcaaat

SEQ ID NO: 3471933 - DNA, 15 bp, Homo sapiens
tcctaccctgcctcc

SEQ ID NO: 3471934 - DNA, 16 bp, Homo sapiens
tcctactaataaacca

SEQ ID NO: 3471935 - DNA, 14 bp, Homo sapiens
tcctactctgtgtc

SEQ ID NO: 3471936 - DNA, 15 bp, Homo sapiens
tcctactctgtgtca

SEQ ID NO: 3471937 - DNA, 20 bp, Homo sapiens
tcctactttagccactggtt

SEQ ID NO: 3471938 - DNA, 19 bp, Homo sapiens
tcctagaggccctttgctg

SEQ ID NO: 3471939 - DNA, 21 bp, Homo sapiens
tcctagaggccctttgctgtc

SEQ ID NO: 3471940 - DNA, 19 bp, Homo sapiens
tcctagcacatgcttcaat

SEQ ID NO: 3471941 - DNA, 18 bp, Homo sapiens
tcctaggaaaaaaggaat

SEQ ID NO: 3471942 - DNA, 22 bp, Homo sapiens
tcctaggcctcaactcctccca

SEQ ID NO: 3471943 - DNA, 17 bp, Homo sapiens
tcctagggtcttgtgtt

SEQ ID NO: 3471944 - DNA, 19 bp, Homo sapiens
tcctagtaagcatctactt

SEQ ID NO: 3471945 - DNA, 16 bp, Homo sapiens
tcctagttctgtagaa

SEQ ID NO: 3471946 - DNA, 23 bp, Homo sapiens
tcctagttctgtagaaatggttg

SEQ ID NO: 3471947 - DNA, 17 bp, Homo sapiens
tcctataaggaagattt

SEQ ID NO: 3471948 - DNA, 17 bp, Homo sapiens
tcctatatatttctatt

SEQ ID NO: 3471949 - DNA, 20 bp, Homo sapiens
tcctatgctattgacaataa

SEQ ID NO: 3471950 - DNA, 21 bp, Homo sapiens
tcctatgctattgacaataaa

SEQ ID NO: 3471951 - DNA, 22 bp, Homo sapiens
tcctatgctattgacaataaaa

SEQ ID NO: 3471952 - DNA, 23 bp, Homo sapiens
tcctatgtgattttaactctgtc

SEQ ID NO: 3471953 - DNA, 18 bp, Homo sapiens
tcctatgtttttgttcaa

SEQ ID NO: 3471954 - DNA, 17 bp, Homo sapiens
tcctcaagaaataaaag

SEQ ID NO: 3471955 - DNA, 14 bp, Homo sapiens
tcctcaatccagct

SEQ ID NO: 3471956 - DNA, 16 bp, Homo sapiens
tcctcacacttactgt

SEQ ID NO: 3471957 - DNA, 14 bp, Homo sapiens
tcctcaccacatgc

SEQ ID NO: 3471958 - DNA, 21 bp, Homo sapiens
tcctcactcccttcccataag

SEQ ID NO: 3471959 - DNA, 18 bp, Homo sapiens
tcctcagccttgccagag

SEQ ID NO: 3471960 - DNA, 17 bp, Homo sapiens
tcctcaggcacacagct

SEQ ID NO: 3471961 - DNA, 18 bp, Homo sapiens
tcctcaggtggccatgcc

SEQ ID NO: 3471962 - DNA, 17 bp, Homo sapiens
tcctcataaacatttga

SEQ ID NO: 3471963 - DNA, 14 bp, Homo sapiens
tcctcatctctctt

SEQ ID NO: 3471964 - DNA, 12 bp, Homo sapiens
tcctccagcagg

SEQ ID NO: 3471965 - DNA, 15 bp, Homo sapiens
tcctcccacctcagc

SEQ ID NO: 3471966 - DNA, 16 bp, Homo sapiens
tcctcccacctcagcc

SEQ ID NO: 3471967 - DNA, 21 bp, Homo sapiens
tcctcccccctcctctgaaac

SEQ ID NO: 3471968 - DNA, 14 bp, Homo sapiens
tcctcccctctctt

SEQ ID NO: 3471969 - DNA, 18 bp, Homo sapiens
tcctccctgacttttctg

SEQ ID NO: 3471970 - DNA, 15 bp, Homo sapiens
tcctccgaggccagt

SEQ ID NO: 3471971 - DNA, 22 bp, Homo sapiens
tcctccgtccatatcagaactg

SEQ ID NO: 3471972 - DNA, 13 bp, Homo sapiens
tcctccgtggcac

SEQ ID NO: 3471973 - DNA, 13 bp, Homo sapiens
tcctcctccaggg

SEQ ID NO: 3471974 - DNA, 12 bp, Homo sapiens
tcctcctctgtg

SEQ ID NO: 3471975 - DNA, 12 bp, Homo sapiens
tcctcctgccca

SEQ ID NO: 3471976 - DNA, 15 bp, Homo sapiens
tcctcctgggccctc

SEQ ID NO: 3471977 - DNA, 16 bp, Homo sapiens
tcctcctttcctcctc

SEQ ID NO: 3471978 - DNA, 17 bp, Homo sapiens
tcctcctttcctcctct

SEQ ID NO: 3471979 - DNA, 21 bp, Homo sapiens
tcctcgacatcactgttcatg

SEQ ID NO: 3471980 - DNA, 17 bp, Homo sapiens
tcctctactaacaatca

SEQ ID NO: 3471981 - DNA, 23 bp, Homo sapiens
tcctctccattttagcccagtgt

SEQ ID NO: 3471982 - DNA, 12 bp, Homo sapiens
tcctctccccag

SEQ ID NO: 3471983 - DNA, 15 bp, Homo sapiens
tcctctccttccttg

SEQ ID NO: 3471984 - DNA, 12 bp, Homo sapiens
tcctctctctgt

SEQ ID NO: 3471985 - DNA, 22 bp, Homo sapiens
tcatctatggcagtccagccag

SEQ ID NO: 3471986 - DNA, 23 bp, Homo sapiens
tcatctatggcagtccagccagc

SEQ ID NO: 3471987 - DNA, 12 bp, Homo sapiens
tcatctcccacc

SEQ ID NO: 3471988 - DNA, 22 bp, Homo sapiens
tcatctcctgccttcctcctgg

SEQ ID NO: 3471989 - DNA, 23 bp, Homo sapiens
tcatctctgcctgacaaggccag

SEQ ID NO: 3471990 - DNA, 13 bp, Homo sapiens
tcatctgaagggg

SEQ ID NO: 3471991 - DNA, 17 bp, Homo sapiens
tcatctgcatgtctact

SEQ ID NO: 3471992 - DNA, 17 bp, Homo sapiens
tcatctgctctccttcc

SEQ ID NO: 3471993 - DNA, 18 bp, Homo sapiens
tcatctgctctccttcct

SEQ ID NO: 3471994 - DNA, 19 bp, Homo sapiens
tcatctgctggtccgtggg

SEQ ID NO: 3471995 - DNA, 16 bp, Homo sapiens
tcatctgttagggcct

SEQ ID NO: 3471996 - DNA, 12 bp, Homo sapiens
tcatcttcctgt

SEQ ID NO: 3471997 - DNA, 15 bp, Homo sapiens
tcatcttcctgtgtc

SEQ ID NO: 3471998 - DNA, 16 bp, Homo sapiens
tcatcttcctgtgtcc

SEQ ID NO: 3471999 - DNA, 13 bp, Homo sapiens
tcatcttctctgg

SEQ ID NO: 3472000 - DNA, 16 bp, Homo sapiens
tcatcttcttcaccat

SEQ ID NO: 3472001 - DNA, 17 bp, Homo sapiens
tcatcttttattttgga

SEQ ID NO: 3472002 - DNA, 20 bp, Homo sapiens
tcatcttttattttggaact

SEQ ID NO: 3472003 - DNA, 22 bp, Homo sapiens
tcatgaaaactgtttttactaa

SEQ ID NO: 3472004 - DNA, 22 bp, Homo sapiens
tcatgaaagtagacagttttga

SEQ ID NO: 3472005 - DNA, 15 bp, Homo sapiens
tcatgaaatatgcat

SEQ ID NO: 3472006 - DNA, 15 bp, Homo sapiens
tcatgacagccagag

SEQ ID NO: 3472007 - DNA, 16 bp, Homo sapiens
tcatgagcctgctgga

SEQ ID NO: 3472008 - DNA, 20 bp, Homo sapiens
tcatgaggaggggcccccct

SEQ ID NO: 3472009 - DNA, 14 bp, Homo sapiens
tcatgaggggagag

SEQ ID NO: 3472010 - DNA, 22 bp, Homo sapiens
tcatgccaccatggccagccaa

SEQ ID NO: 3472011 - DNA, 13 bp, Homo sapiens
tcatgccctcctc

SEQ ID NO: 3472012 - DNA, 15 bp, Homo sapiens
tcatgccctgtgcaa

SEQ ID NO: 3472013 - DNA, 13 bp, Homo sapiens
tcatgcctggctt

SEQ ID NO: 3472014 - DNA, 18 bp, Homo sapiens
tcatgcctggcttcgcaa

SEQ ID NO: 3472015 - DNA, 19 bp, Homo sapiens
tcatgctgctagatcttta

SEQ ID NO: 3472016 - DNA, 23 bp, Homo sapiens
tcatggatgggggaactcagatc

SEQ ID NO: 3472017 - DNA, 13 bp, Homo sapiens
tcatggattactt

SEQ ID NO: 3472018 - DNA, 18 bp, Homo sapiens
tcatggcccaaatccagt

SEQ ID NO: 3472019 - DNA, 23 bp, Homo sapiens
tcatggccctgtagttaggcctg

SEQ ID NO: 3472020 - DNA, 13 bp, Homo sapiens
tcatggtctcagt

SEQ ID NO: 3472021 - DNA, 16 bp, Homo sapiens
tcatggtgtgttacac

SEQ ID NO: 3472022 - DNA, 14 bp, Homo sapiens
tcatgtaaacatac

SEQ ID NO: 3472023 - DNA, 14 bp, Homo sapiens
tcagcctggccaga

SEQ ID NO: 3472024 - DNA, 17 bp, Homo sapiens
tcagcctggccagacac

SEQ ID NO: 3472025 - DNA, 18 bp, Homo sapiens
tcagcctggccagacaca

SEQ ID NO: 3472026 - DNA, 19 bp, Homo sapiens
tcagcctggccagacacag

SEQ ID NO: 3472027 - DNA, 20 bp, Homo sapiens
tcagcctggccagacacagg

SEQ ID NO: 3472028 - DNA, 10 bp, Homo sapiens
tcagcctggg

SEQ ID NO: 3472029 - DNA, 14 bp, Homo sapiens
tcagccttgccaga

SEQ ID NO: 3472030 - DNA, 16 bp, Homo sapiens
tcagccttgccagaga

SEQ ID NO: 3472031 - DNA, 20 bp, Homo sapiens
tcagcgactccgttggccac

SEQ ID NO: 3472032 - DNA, 21 bp, Homo sapiens
tcagctcacgcttcacagtga

SEQ ID NO: 3472033 - DNA, 17 bp, Homo sapiens
tcagctccccagagtcc

SEQ ID NO: 3472034 - DNA, 16 bp, Homo sapiens
tcagctccttcctgga

SEQ ID NO: 3472035 - DNA, 13 bp, Homo sapiens
tcagctcggctca

SEQ ID NO: 3472036 - DNA, 18 bp, Homo sapiens
tcagctcggctcagctcg

SEQ ID NO: 3472037 - DNA, 15 bp, Homo sapiens
tcagctctcatctga

SEQ ID NO: 3472038 - DNA, 15 bp, Homo sapiens
tcagctctctgccct

SEQ ID NO: 3472039 - DNA, 20 bp, Homo sapiens
tcagctctctgccctgtgta

SEQ ID NO: 3472040 - DNA, 17 bp, Homo sapiens
tcagctctggtccaggc

SEQ ID NO: 3472041 - DNA, 18 bp, Homo sapiens
tcagcttaggggctgctg

SEQ ID NO: 3472042 - DNA, 19 bp, Homo sapiens
tcagctttaagatatcttt

SEQ ID NO: 3472043 - DNA, 22 bp, Homo sapiens
tcaggaagaacaccctctaaat

SEQ ID NO: 3472044 - DNA, 14 bp, Homo sapiens
tcaggacagatgcc

SEQ ID NO: 3472045 - DNA, 20 bp, Homo sapiens
tcaggaccaaagctttcatg

SEQ ID NO: 3472046 - DNA, 13 bp, Homo sapiens
tcaggaccaggca

SEQ ID NO: 3472047 - DNA, 14 bp, Homo sapiens
tcaggaccaggcaa

SEQ ID NO: 3472048 - DNA, 21 bp, Homo sapiens
tcaggactcagaagcctctgg

SEQ ID NO: 3472049 - DNA, 12 bp, Homo sapiens
tcaggcaccagt

SEQ ID NO: 3472050 - DNA, 21 bp, Homo sapiens
tcaggcccggcagggcgggca

SEQ ID NO: 3472051 - DNA, 18 bp, Homo sapiens
tcaggccggcagccccag

SEQ ID NO: 3472052 - DNA, 22 bp, Homo sapiens
tcaggccggcagccccagcctg

SEQ ID NO: 3472053 - DNA, 13 bp, Homo sapiens
tcaggctccccag

SEQ ID NO: 3472054 - DNA, 17 bp, Homo sapiens
tcaggctcgccaaggcc

SEQ ID NO: 3472055 - DNA, 16 bp, Homo sapiens
tcagggaaaagcagct

SEQ ID NO: 3472056 - DNA, 18 bp, Homo sapiens
tcagggaaaagcagctct

SEQ ID NO: 3472057 - DNA, 15 bp, Homo sapiens
tcagggaaatggcct

SEQ ID NO: 3472058 - DNA, 16 bp, Homo sapiens
tcagggaaatggcctt

SEQ ID NO: 3472059 - DNA, 18 bp, Homo sapiens
tcagggaaatggccttcc

SEQ ID NO: 3472060 - DNA, 16 bp, Homo sapiens
tcagggacccctgccc

SEQ ID NO: 3472061 - DNA, 17 bp, Homo sapiens
tcagggacccctgccct

SEQ ID NO: 3472062 - DNA, 15 bp, Homo sapiens
tcagggcagcgccag

SEQ ID NO: 3472063 - DNA, 17 bp, Homo sapiens
tcagggccatgctgagg

SEQ ID NO: 3472064 - DNA, 18 bp, Homo sapiens
tcagggccatgctgaggc

SEQ ID NO: 3472065 - DNA, 20 bp, Homo sapiens
tcagggcctgacagtgtggg

SEQ ID NO: 3472066 - DNA, 19 bp, Homo sapiens
tcaggggtgtgcggccttt

SEQ ID NO: 3472067 - DNA, 23 bp, Homo sapiens
tcagggttggcccctgcccggct

SEQ ID NO: 3472068 - DNA, 21 bp, Homo sapiens
tcaggtaacaggcagatacag

SEQ ID NO: 3472069 - DNA, 23 bp, Homo sapiens
tcaggtgagaagcagaggaagga

SEQ ID NO: 3472070 - DNA, 16 bp, Homo sapiens
tatctcctagggctat

SEQ ID NO: 3472071 - DNA, 18 bp, Homo sapiens
tatctcctcgcaagctgg

SEQ ID NO: 3472072 - DNA, 17 bp, Homo sapiens
tatctctatttgagaat

SEQ ID NO: 3472073 - DNA, 16 bp, Homo sapiens
tatctcttttatattt

SEQ ID NO: 3472074 - DNA, 16 bp, Homo sapiens
tatctgcaggcagaca

SEQ ID NO: 3472075 - DNA, 12 bp, Homo sapiens
tatctgcctgac

SEQ ID NO: 3472076 - DNA, 23 bp, Homo sapiens
tatctgcctgacaggctgtgact

SEQ ID NO: 3472077 - DNA, 20 bp, Homo sapiens
tatctgtcatttgagcaggg

SEQ ID NO: 3472078 - DNA, 21 bp, Homo sapiens
tatctgtcatttgagcagggc

SEQ ID NO: 3472079 - DNA, 20 bp, Homo sapiens
tatctgtttcctgacattgt

SEQ ID NO: 3472080 - DNA, 22 bp, Homo sapiens
tatctgtttcctgacattgtct

SEQ ID NO: 3472081 - DNA, 18 bp, Homo sapiens
tatcttatactgtacaat

SEQ ID NO: 3472082 - DNA, 14 bp, Homo sapiens
tatcttcagtttaa

SEQ ID NO: 3472083 - DNA, 22 bp, Homo sapiens
tatcttgtttttccactactgc

SEQ ID NO: 3472084 - DNA, 19 bp, Homo sapiens
tatctttgattctccttca

SEQ ID NO: 3472085 - DNA, 22 bp, Homo sapiens
tatctttgattctccttcagcc

SEQ ID NO: 3472086 - DNA, 17 bp, Homo sapiens
tatcttttgtttccttt

SEQ ID NO: 3472087 - DNA, 15 bp, Homo sapiens
tatgaaaacttatga

SEQ ID NO: 3472088 - DNA, 19 bp, Homo sapiens
tatgaagataagtgtattt

SEQ ID NO: 3472089 - DNA, 13 bp, Homo sapiens
tatgaattgtaca

SEQ ID NO: 3472090 - DNA, 14 bp, Homo sapiens
tatgacattttggg

SEQ ID NO: 3472091 - DNA, 22 bp, Homo sapiens
tatgactttttataaaatggct

SEQ ID NO: 3472092 - DNA, 15 bp, Homo sapiens
tatgataattacaat

SEQ ID NO: 3472093 - DNA, 19 bp, Homo sapiens
tatgataattacaatacaa

SEQ ID NO: 3472094 - DNA, 20 bp, Homo sapiens
tatgatagcgggaaaaggag

SEQ ID NO: 3472095 - DNA, 14 bp, Homo sapiens
tatgatcacggctc

SEQ ID NO: 3472096 - DNA, 13 bp, Homo sapiens
tatgatcagtgtt

SEQ ID NO: 3472097 - DNA, 15 bp, Homo sapiens
tatgatgctgccggc

SEQ ID NO: 3472098 - DNA, 22 bp, Homo sapiens
tatgatgctgccggcacagctg

SEQ ID NO: 3472099 - DNA, 19 bp, Homo sapiens
tatgatttataaacagaca

SEQ ID NO: 3472100 - DNA, 22 bp, Homo sapiens
tatgcaaaagttctgacttgac

SEQ ID NO: 3472101 - DNA, 19 bp, Homo sapiens
tatgcacttataattttcc

SEQ ID NO: 3472102 - DNA, 14 bp, Homo sapiens
tatgcataaagtca

SEQ ID NO: 3472103 - DNA, 22 bp, Homo sapiens
tatgccatagcaagattgctta

SEQ ID NO: 3472104 - DNA, 17 bp, Homo sapiens
tatgcgaacctatgtct

SEQ ID NO: 3472105 - DNA, 20 bp, Homo sapiens
tatgctattgacaataaaat

SEQ ID NO: 3472106 - DNA, 14 bp, Homo sapiens
tatgctgacagctc

SEQ ID NO: 3472107 - DNA, 15 bp, Homo sapiens
tatgctgatcatcgc

SEQ ID NO: 3472108 - DNA, 21 bp, Homo sapiens
tatgctggtgaaaacaatttt

SEQ ID NO: 3472109 - DNA, 23 bp, Homo sapiens
tatgctgtggagtcccaacccca

SEQ ID NO: 3472110 - DNA, 18 bp, Homo sapiens
tatgcttactgtgcacct

SEQ ID NO: 3472111 - DNA, 13 bp, Homo sapiens
tatgcttctttca

SEQ ID NO: 3472112 - DNA, 13 bp, Homo sapiens
tatgcttgctcta

SEQ ID NO: 3472113 - DNA, 13 bp, Homo sapiens
tatgctttccttc

SEQ ID NO: 3472114 - DNA, 14 bp, Homo sapiens
tatggaattacatg

SEQ ID NO: 3472115 - DNA, 18 bp, Homo sapiens
tatggaattacatgtaaa

SEQ ID NO: 3472116 - DNA, 11 bp, Homo sapiens
tatggaattga

SEQ ID NO: 3472117 - DNA, 18 bp, Homo sapiens
tatggaattgatttgcat

SEQ ID NO: 3472118 - DNA, 13 bp, Homo sapiens
tatggactatctg

SEQ ID NO: 3472119 - DNA, 15 bp, Homo sapiens
tatggagagaaaaca

SEQ ID NO: 3472120 - DNA, 17 bp, Homo sapiens
tatggagctcagagagg

SEQ ID NO: 3472121 - DNA, 19 bp, Homo sapiens
tatggcagagttgtaaata

SEQ ID NO: 3472122 - DNA, 20 bp, Homo sapiens
tatggcagtccagccagctc

SEQ ID NO: 3472123 - DNA, 22 bp, Homo sapiens
tatggcagtccagccagctcct

SEQ ID NO: 3472124 - DNA, 11 bp, Homo sapiens
tatgggctggg

SEQ ID NO: 3472125 - DNA, 14 bp, Homo sapiens
tatgggctgggggc

SEQ ID NO: 3472126 - DNA, 23 bp, Homo sapiens
tatgggtagcactactaaaagtt

SEQ ID NO: 3472127 - DNA, 13 bp, Homo sapiens
tatggtataatgg

SEQ ID NO: 3472128 - DNA, 15 bp, Homo sapiens
tatggtgctctgtct

SEQ ID NO: 3472129 - DNA, 21 bp, Homo sapiens
tatgtaaaaggccaaacctct

SEQ ID NO: 3472130 - DNA, 23 bp, Homo sapiens
tatgtaaaaggccaaacctctgt

SEQ ID NO: 3472131 - DNA, 12 bp, Homo sapiens
tatgtaaaataa

SEQ ID NO: 3472132 - DNA, 10 bp, Homo sapiens
tatgtaaatg

SEQ ID NO: 3472133 - DNA, 16 bp, Homo sapiens
tatgtaacaattgttt

SEQ ID NO: 3472134 - DNA, 11 bp, Homo sapiens
tatgtaacatg

SEQ ID NO: 3472135 - DNA, 19 bp, Homo sapiens
tatgtaacatgatgttaac

SEQ ID NO: 3472136 - DNA, 20 bp, Homo sapiens
tatgtaacatgatgttaact

SEQ ID NO: 3472137 - DNA, 12 bp, Homo sapiens
tatgtaacatgt

SEQ ID NO: 3472138 - DNA, 14 bp, Homo sapiens
tatgtaactgcatt

SEQ ID NO: 3472139 - DNA, 21 bp, Homo sapiens
tatgtaagaattcagaagacc

SEQ ID NO: 3472140 - DNA, 19 bp, Homo sapiens
tatgtagccttcacacaga

SEQ ID NO: 3472141 - DNA, 23 bp, Homo sapiens
tatgtagccttcacacagataga

SEQ ID NO: 3472142 - DNA, 15 bp, Homo sapiens
tatgtagtggtttta

SEQ ID NO: 3472143 - DNA, 14 bp, Homo sapiens
tatgtataaaatgt

SEQ ID NO: 3472144 - DNA, 17 bp, Homo sapiens
tatgtataaaatgtaac

SEQ ID NO: 3472145 - DNA, 22 bp, Homo sapiens
tatgtataaaatgtaacactga

SEQ ID NO: 3472146 - DNA, 19 bp, Homo sapiens
tatgtatatatatgtatgt

SEQ ID NO: 3472147 - DNA, 14 bp, Homo sapiens
tatgtcaaagcagg

SEQ ID NO: 3472148 - DNA, 15 bp, Homo sapiens
tatgtcccttgctgt

SEQ ID NO: 3472149 - DNA, 18 bp, Homo sapiens
tatgtcgagagctggcca

SEQ ID NO: 3472150 - DNA, 21 bp, Homo sapiens
tatgtgattttaactctgtct

SEQ ID NO: 3472151 - DNA, 18 bp, Homo sapiens
tatttcttatacgctttt

SEQ ID NO: 3472152 - DNA, 12 bp, Homo sapiens
tatttcttcttc

SEQ ID NO: 3472153 - DNA, 20 bp, Homo sapiens
tatttcttcttcacatccat

SEQ ID NO: 3472154 - DNA, 12 bp, Homo sapiens
tatttgaaactt

SEQ ID NO: 3472155 - DNA, 11 bp, Homo sapiens
tatttgaagag

SEQ ID NO: 3472156 - DNA, 14 bp, Homo sapiens
tatttgaatcttgt

SEQ ID NO: 3472157 - DNA, 20 bp, Homo sapiens
tatttgaatcttgtctcaat

SEQ ID NO: 3472158 - DNA, 21 bp, Homo sapiens
tatttgacaacgtttcagcga

SEQ ID NO: 3472159 - DNA, 20 bp, Homo sapiens
tatttgagcaagtaacatta

SEQ ID NO: 3472160 - DNA, 21 bp, Homo sapiens
tatttgattcaaaatatttaa

SEQ ID NO: 3472161 - DNA, 21 bp, Homo sapiens
tatttgcataacaattcctct

SEQ ID NO: 3472162 - DNA, 23 bp, Homo sapiens
tatttgccagagccaaattttat

SEQ ID NO: 3472163 - DNA, 14 bp, Homo sapiens
tatttgggaagtga

SEQ ID NO: 3472164 - DNA, 15 bp, Homo sapiens
tatttgggaagtgaa

SEQ ID NO: 3472165 - DNA, 10 bp, Homo sapiens
tatttgtcaa

SEQ ID NO: 3472166 - DNA, 18 bp, Homo sapiens
tatttgtgctatagtatt

SEQ ID NO: 3472167 - DNA, 15 bp, Homo sapiens
tatttgtgtatttaa

SEQ ID NO: 3472168 - DNA, 18 bp, Homo sapiens
tatttgtgtatttaacag

SEQ ID NO: 3472169 - DNA, 16 bp, Homo sapiens
tatttgttatggcaga

SEQ ID NO: 3472170 - DNA, 18 bp, Homo sapiens
tattttaaaatctgtcac

SEQ ID NO: 3472171 - DNA, 22 bp, Homo sapiens
tattttaaaggggtctgaaatt

SEQ ID NO: 3472172 - DNA, 11 bp, Homo sapiens
tattttccagg

SEQ ID NO: 3472173 - DNA, 16 bp, Homo sapiens
tattttccatatattg

SEQ ID NO: 3472174 - DNA, 20 bp, Homo sapiens
tattttctctgtacttttca

SEQ ID NO: 3472175 - DNA, 14 bp, Homo sapiens
tattttctttaatg

SEQ ID NO: 3472176 - DNA, 16 bp, Homo sapiens
tattttcttttgtaaa

SEQ ID NO: 3472177 - DNA, 12 bp, Homo sapiens
tattttgtctaa

SEQ ID NO: 3472178 - DNA, 14 bp, Homo sapiens
tattttgtctaaaa

SEQ ID NO: 3472179 - DNA, 22 bp, Homo sapiens
tatttttatataatatctaaag

SEQ ID NO: 3472180 - DNA, 14 bp, Homo sapiens
tatttttccttttt

SEQ ID NO: 3472181 - DNA, 14 bp, Homo sapiens
tatttttgtagtga

SEQ ID NO: 3472182 - DNA, 14 bp, Homo sapiens
tattttttcctttt

SEQ ID NO: 3472183 - DNA, 15 bp, Homo sapiens
tattttttgtttgta

SEQ ID NO: 3472184 - DNA, 16 bp, Homo sapiens
tattttttgtttgtat

SEQ ID NO: 3472185 - DNA, 16 bp, Homo sapiens
tatttttttgcaagtg

SEQ ID NO: 3472186 - DNA, 19 bp, Homo sapiens
tatttttttgcaagtgaag

SEQ ID NO: 3472187 - DNA, 15 bp, Homo sapiens
tcaaaaaaagaaaaa

SEQ ID NO: 3472188 - DNA, 16 bp, Homo sapiens
tcaaaaacgccctcaa

SEQ ID NO: 3472189 - DNA, 19 bp, Homo sapiens
tcaaaacccatctgggctc

SEQ ID NO: 3472190 - DNA, 21 bp, Homo sapiens
tcaaaaggaaccaggaggttt

SEQ ID NO: 3472191 - DNA, 15 bp, Homo sapiens
tcaaaagttgaaatt

SEQ ID NO: 3472192 - DNA, 16 bp, Homo sapiens
tcaaaagttgaaatta

SEQ ID NO: 3472193 - DNA, 15 bp, Homo sapiens
tcaaaatatttaaaa

SEQ ID NO: 3472194 - DNA, 23 bp, Homo sapiens
tcaaaatatttaaaaatgtcttg

SEQ ID NO: 3472195 - DNA, 19 bp, Homo sapiens
tcaaaatgctttttatttc

SEQ ID NO: 3472196 - DNA, 23 bp, Homo sapiens
tcaaaatttgctgccaaatgcgt

SEQ ID NO: 3472197 - DNA, 17 bp, Homo sapiens
tcaaacaaagccagaag

SEQ ID NO: 3472198 - DNA, 21 bp, Homo sapiens
tcaaacaaagccagaagctga

SEQ ID NO: 3472199 - DNA, 12 bp, Homo sapiens
tcaaacactgca

SEQ ID NO: 3472200 - DNA, 13 bp, Homo sapiens
tcaaacctccaaa

SEQ ID NO: 3472201 - DNA, 14 bp, Homo sapiens
tcaaactcttaaaa

SEQ ID NO: 3472202 - DNA, 22 bp, Homo sapiens
tcaaactcttgacctcaggtga

SEQ ID NO: 3472203 - DNA, 22 bp, Homo sapiens
tcaaactggggcctccagaact

SEQ ID NO: 3472204 - DNA, 16 bp, Homo sapiens
tcaaagagggtgaggg

SEQ ID NO: 3472205 - DNA, 21 bp, Homo sapiens
tcaaagagggtgagggccttc

SEQ ID NO: 3472206 - DNA, 22 bp, Homo sapiens
tcaaagagggtgagggccttct

SEQ ID NO: 3472207 - DNA, 23 bp, Homo sapiens
tcaaagagggtgagggccttctt

SEQ ID NO: 3472208 - DNA, 12 bp, Homo sapiens
tcaaagaggttt

SEQ ID NO: 3472209 - DNA, 16 bp, Homo sapiens
tcaaagcaaggaaact

SEQ ID NO: 3472210 - DNA, 20 bp, Homo sapiens
tcaaagcaaggaaactatgt

SEQ ID NO: 3472211 - DNA, 21 bp, Homo sapiens
tcaaagcaattgaaatgcatt

SEQ ID NO: 3472212 - DNA, 19 bp, Homo sapiens
tcaaagcaggggagtatgc

SEQ ID NO: 3472213 - DNA, 22 bp, Homo sapiens
tcaaagccagcgtcctcctctg

SEQ ID NO: 3472214 - DNA, 15 bp, Homo sapiens
agggacctctcccag

SEQ ID NO: 3472215 - DNA, 13 bp, Homo sapiens
agggacgcctggg

SEQ ID NO: 3472216 - DNA, 22 bp, Homo sapiens
agggacgcctgggggtgccagg

SEQ ID NO: 3472217 - DNA, 23 bp, Homo sapiens
agggacgcctgggggtgccagga

SEQ ID NO: 3472218 - DNA, 21 bp, Homo sapiens
agggactgtgagactgagagg

SEQ ID NO: 3472219 - DNA, 16 bp, Homo sapiens
agggagacctggacac

SEQ ID NO: 3472220 - DNA, 22 bp, Homo sapiens
agggagacctggacacaggcct

SEQ ID NO: 3472221 - DNA, 22 bp, Homo sapiens
agggagatatttaagtataaaa

SEQ ID NO: 3472222 - DNA, 13 bp, Homo sapiens
agggagcactggg

SEQ ID NO: 3472223 - DNA, 19 bp, Homo sapiens
agggagcaggcggtgggca

SEQ ID NO: 3472224 - DNA, 15 bp, Homo sapiens
agggagccatttgag

SEQ ID NO: 3472225 - DNA, 17 bp, Homo sapiens
agggagccatttgagag

SEQ ID NO: 3472226 - DNA, 22 bp, Homo sapiens
agggagcggccggccagcccct

SEQ ID NO: 3472227 - DNA, 15 bp, Homo sapiens
agggagctagccaga

SEQ ID NO: 3472228 - DNA, 23 bp, Homo sapiens
agggagctcttgacagaaagcag

SEQ ID NO: 3472229 - DNA, 13 bp, Homo sapiens
agggaggcaagcc

SEQ ID NO: 3472230 - DNA, 15 bp, Homo sapiens
agggagggctgtcat

SEQ ID NO: 3472231 - DNA, 22 bp, Homo sapiens
agggaggtggaaggaccctgtg

SEQ ID NO: 3472232 - DNA, 20 bp, Homo sapiens
agggagtccgaaagggactt

SEQ ID NO: 3472233 - DNA, 23 bp, Homo sapiens
tagagctgacacaaacctgcctg

SEQ ID NO: 3472234 - DNA, 20 bp, Homo sapiens
tagagctgtattaagccact

SEQ ID NO: 3472235 - DNA, 13 bp, Homo sapiens
tagaggaaaagaa

SEQ ID NO: 3472236 - DNA, 14 bp, Homo sapiens
tagaggctgggagg

SEQ ID NO: 3472237 - DNA, 17 bp, Homo sapiens
tagaggctgggaggagc

SEQ ID NO: 3472238 - DNA, 23 bp, Homo sapiens
tagaggggggatttccagccagg

SEQ ID NO: 3472239 - DNA, 12 bp, Homo sapiens
tagagtgggagc

SEQ ID NO: 3472240 - DNA, 15 bp, Homo sapiens
tagagtgtctttcca

SEQ ID NO: 3472241 - DNA, 13 bp, Homo sapiens
tagagttagactg

SEQ ID NO: 3472242 - DNA, 17 bp, Homo sapiens
tagagttagactgttgg

SEQ ID NO: 3472243 - DNA, 13 bp, Homo sapiens
tagatacaataaa

SEQ ID NO: 3472244 - DNA, 16 bp, Homo sapiens
tagatacaataaattg

SEQ ID NO: 3472245 - DNA, 16 bp, Homo sapiens
tagatagtcatgctgc

SEQ ID NO: 3472246 - DNA, 16 bp, Homo sapiens
tagatattggacaaag

SEQ ID NO: 3472247 - DNA, 23 bp, Homo sapiens
tagatcatttctaggcaaaattg

SEQ ID NO: 3472248 - DNA, 17 bp, Homo sapiens
tagatgcgcagccccat

SEQ ID NO: 3472249 - DNA, 14 bp, Homo sapiens
tagatgctggccca

SEQ ID NO: 3472250 - DNA, 14 bp, Homo sapiens
tagatggattctcc

SEQ ID NO: 3472251 - DNA, 20 bp, Homo sapiens
tagatggcaagcatgtaact

SEQ ID NO: 3472252 - DNA, 14 bp, Homo sapiens
tagatggtgctgag

SEQ ID NO: 3472253 - DNA, 15 bp, Homo sapiens
tagatggtgctgaga

SEQ ID NO: 3472254 - DNA, 23 bp, Homo sapiens
tagatgtagataaactcagaaat

SEQ ID NO: 3472255 - DNA, 18 bp, Homo sapiens
tagatgttccagtaatct

SEQ ID NO: 3472256 - DNA, 14 bp, Homo sapiens
tagatgttctctat

SEQ ID NO: 3472257 - DNA, 18 bp, Homo sapiens
tagatgttctctatcatt

SEQ ID NO: 3472258 - DNA, 13 bp, Homo sapiens
tagatgtttcaca

SEQ ID NO: 3472259 - DNA, 16 bp, Homo sapiens
tagattatggagcttt

SEQ ID NO: 3472260 - DNA, 17 bp, Homo sapiens
tagattatggagctttt

SEQ ID NO: 3472261 - DNA, 16 bp, Homo sapiens
tagattgttaaaataa

SEQ ID NO: 3472262 - DNA, 22 bp, Homo sapiens
tagcaagtgaatttttctctaa

SEQ ID NO: 3472263 - DNA, 16 bp, Homo sapiens
tagcactaccactcct

SEQ ID NO: 3472264 - DNA, 19 bp, Homo sapiens
tagcagacaggccccgtga

SEQ ID NO: 3472265 - DNA, 14 bp, Homo sapiens
agcctccctgaagc

SEQ ID NO: 3472266 - DNA, 18 bp, Homo sapiens
agcctccgacgctgcctc

SEQ ID NO: 3472267 - DNA, 23 bp, Homo sapiens
agcctccggagtagctgggacca

SEQ ID NO: 3472268 - DNA, 18 bp, Homo sapiens
agcctcgaggtgccttct

SEQ ID NO: 3472269 - DNA, 16 bp, Homo sapiens
agcctctccccaggtc

SEQ ID NO: 3472270 - DNA, 18 bp, Homo sapiens
agcctctccccaggtcca

SEQ ID NO: 3472271 - DNA, 23 bp, Homo sapiens
agcctctccccaggtccagctct

SEQ ID NO: 3472272 - DNA, 12 bp, Homo sapiens
agcctctgcagt

SEQ ID NO: 3472273 - DNA, 13 bp, Homo sapiens
agcctctgctccc

SEQ ID NO: 3472274 - DNA, 18 bp, Homo sapiens
agcctctttctgtccctt

SEQ ID NO: 3472275 - DNA, 21 bp, Homo sapiens
agcctgagcaactcttgatta

SEQ ID NO: 3472276 - DNA, 13 bp, Homo sapiens
agcctgagtagaa

SEQ ID NO: 3472277 - DNA, 14 bp, Homo sapiens
agcctgcattctta

SEQ ID NO: 3472278 - DNA, 16 bp, Homo sapiens
agcctgcctcttctct

SEQ ID NO: 3472279 - DNA, 17 bp, Homo sapiens
agcctgcgggaagctga

SEQ ID NO: 3472280 - DNA, 12 bp, Homo sapiens
agcctgctagct

SEQ ID NO: 3472281 - DNA, 17 bp, Homo sapiens
agcctgctagctagctc

SEQ ID NO: 3472282 - DNA, 18 bp, Homo sapiens
agcctgctagctagctca

SEQ ID NO: 3472283 - DNA, 15 bp, Homo sapiens
agcctgctccagctg

SEQ ID NO: 3472284 - DNA, 22 bp, Homo sapiens
agcctgctccagctgttcagct

SEQ ID NO: 3472285 - DNA, 14 bp, Homo sapiens
agcctgctggaagc

SEQ ID NO: 3472286 - DNA, 14 bp, Homo sapiens
agcctggaccctgt

SEQ ID NO: 3472287 - DNA, 14 bp, Homo sapiens
agcctggccagaca

SEQ ID NO: 3472288 - DNA, 16 bp, Homo sapiens
agcctggccccatggt

SEQ ID NO: 3472289 - DNA, 19 bp, Homo sapiens
agcctggggtggggtcatg

SEQ ID NO: 3472290 - DNA, 20 bp, Homo sapiens
agcctggggtggggtcatgc

SEQ ID NO: 3472291 - DNA, 19 bp, Homo sapiens
agcctgggtgacaaagcga

SEQ ID NO: 3472292 - DNA, 20 bp, Homo sapiens
agcctgtgcaaaaaaattaa

SEQ ID NO: 3472293 - DNA, 11 bp, Homo sapiens
agcctgtggct

SEQ ID NO: 3472294 - DNA, 16 bp, Homo sapiens
agccttaagaaatggt

SEQ ID NO: 3472295 - DNA, 22 bp, Homo sapiens
agccttccagggatttgcctca

SEQ ID NO: 3472296 - DNA, 17 bp, Homo sapiens
agccttgggagccactg

SEQ ID NO: 3472297 - DNA, 20 bp, Homo sapiens
agccttgggagccactgcca

SEQ ID NO: 3472298 - DNA, 21 bp, Homo sapiens
agccttgggagccactgccac

SEQ ID NO: 3472299 - DNA, 13 bp, Homo sapiens
agcctttaatgca

SEQ ID NO: 3472300 - DNA, 14 bp, Homo sapiens
agcctttaatgcat

SEQ ID NO: 3472301 - DNA, 14 bp, Homo sapiens
agcctttgaatgta

SEQ ID NO: 3472302 - DNA, 15 bp, Homo sapiens
agcctttgcctcccc

SEQ ID NO: 3472303 - DNA, 12 bp, Homo sapiens
agcctttttcac

SEQ ID NO: 3472304 - DNA, 14 bp, Homo sapiens
agcgacagcctggg

SEQ ID NO: 3472305 - DNA, 20 bp, Homo sapiens
agcgactccgttggccactc

SEQ ID NO: 3472306 - DNA, 13 bp, Homo sapiens
agcgagccctggt

SEQ ID NO: 3472307 - DNA, 22 bp, Homo sapiens
agcgattcttctgcttcagcct

SEQ ID NO: 3472308 - DNA, 12 bp, Homo sapiens
agcgccaggctg

SEQ ID NO: 3472309 - DNA, 21 bp, Homo sapiens
agcgccaggctgaccacagca

SEQ ID NO: 3472310 - DNA, 22 bp, Homo sapiens
agcgcccagttgggtggatgcc

SEQ ID NO: 3472311 - DNA, 22 bp, Homo sapiens
agcgcctccatccaaggccagg

SEQ ID NO: 3472312 - DNA, 23 bp, Homo sapiens
agcgcctccatccaaggccaggt

SEQ ID NO: 3472313 - DNA, 22 bp, Homo sapiens
agcgctcctgccgcagagctgg

SEQ ID NO: 3472314 - DNA, 16 bp, Homo sapiens
agcgcttttccttggc

SEQ ID NO: 3472315 - DNA, 19 bp, Homo sapiens
agcggacatcagctggtca

SEQ ID NO: 3472316 - DNA, 18 bp, Homo sapiens
agcggccggccagcccct

SEQ ID NO: 3472317 - DNA, 12 bp, Homo sapiens
agcggctgcctc

SEQ ID NO: 3472318 - DNA, 20 bp, Homo sapiens
agcggggacagctccttctg

SEQ ID NO: 3472319 - DNA, 14 bp, Homo sapiens
agcgggggaggccc

SEQ ID NO: 3472320 - DNA, 20 bp, Homo sapiens
agcggtgggggaggagggtt

SEQ ID NO: 3472321 - DNA, 21 bp, Homo sapiens
agcgtatatataagaaagaca

SEQ ID NO: 3472322 - DNA, 15 bp, Homo sapiens
agcgtcctcctctgt

SEQ ID NO: 3472323 - DNA, 16 bp, Homo sapiens
agcgtcctcctctgtg

SEQ ID NO: 3472324 - DNA, 17 bp, Homo sapiens
agcgtcctcctctgtga

SEQ ID NO: 3472325 - DNA, 13 bp, Homo sapiens
agcgtgagccact

SEQ ID NO: 3472326 - DNA, 15 bp, Homo sapiens
agcgtgagccactgc

SEQ ID NO: 3472327 - DNA, 22 bp, Homo sapiens
agcgtgagccactgcaccgggc

SEQ ID NO: 3472328 - DNA, 17 bp, Homo sapiens
agcgtgctttaaaaaat

SEQ ID NO: 3472329 - DNA, 23 bp, Homo sapiens
agctaaactccttcctggcctga

SEQ ID NO: 3472330 - DNA, 23 bp, Homo sapiens
agctaaataaatgtaatagccaa

SEQ ID NO: 3472331 - DNA, 15 bp, Homo sapiens
agctaactgtaaatc

SEQ ID NO: 3472332 - DNA, 13 bp, Homo sapiens
agctaagaacctg

SEQ ID NO: 3472333 - DNA, 14 bp, Homo sapiens
agctaagaacctgg

SEQ ID NO: 3472334 - DNA, 22 bp, Homo sapiens
agctaatacccagagcacccag

SEQ ID NO: 3472335 - DNA, 14 bp, Homo sapiens
agctaatgaccaac

SEQ ID NO: 3472336 - DNA, 13 bp, Homo sapiens
agctaatttactg

SEQ ID NO: 3472337 - DNA, 22 bp, Homo sapiens
agctaatttgcattaaattcac

SEQ ID NO: 3472338 - DNA, 12 bp, Homo sapiens
agctacaaatgc

SEQ ID NO: 3472339 - DNA, 18 bp, Homo sapiens
agctaccattttacattt

SEQ ID NO: 3472340 - DNA, 14 bp, Homo sapiens
aaaaattcacataa

SEQ ID NO: 3472341 - DNA, 21 bp, Homo sapiens
aaaaattttgtgacattcctt

SEQ ID NO: 3472342 - DNA, 10 bp, Homo sapiens
aaaacaaaaa

SEQ ID NO: 3472343 - DNA, 16 bp, Homo sapiens
aaaacaaaaagaacaa

SEQ ID NO: 3472344 - DNA, 13 bp, Homo sapiens
aaaacaaaaccag

SEQ ID NO: 3472345 - DNA, 11 bp, Homo sapiens
aaaacaaatat

SEQ ID NO: 3472346 - DNA, 18 bp, Homo sapiens
aaaacaatattgtttcta

SEQ ID NO: 3472347 - DNA, 19 bp, Homo sapiens
aaaacaatctggaagaaaa

SEQ ID NO: 3472348 - DNA, 13 bp, Homo sapiens
aaaacactgtgca

SEQ ID NO: 3472349 - DNA, 13 bp, Homo sapiens
aaaacagaagcct

SEQ ID NO: 3472350 - DNA, 16 bp, Homo sapiens
aaaacatccagataca

SEQ ID NO: 3472351 - DNA, 14 bp, Homo sapiens
aaaacattaagaaa

SEQ ID NO: 3472352 - DNA, 23 bp, Homo sapiens
aaaacattaagaaaatcatattg

SEQ ID NO: 3472353 - DNA, 17 bp, Homo sapiens
aaaacatttcaagttta

SEQ ID NO: 3472354 - DNA, 13 bp, Homo sapiens
aaaaccagctgct

SEQ ID NO: 3472355 - DNA, 20 bp, Homo sapiens
aaaaccatgcctggtatttt

SEQ ID NO: 3472356 - DNA, 12 bp, Homo sapiens
aaaacccagact

SEQ ID NO: 3472357 - DNA, 13 bp, Homo sapiens
aaaacctgacaaa

SEQ ID NO: 3472358 - DNA, 16 bp, Homo sapiens
aaaactattcatgcta

SEQ ID NO: 3472359 - DNA, 12 bp, Homo sapiens
aaaactctactt

SEQ ID NO: 3472360 - DNA, 18 bp, Homo sapiens
aaaactctacttaatcca

SEQ ID NO: 3472361 - DNA, 19 bp, Homo sapiens
aaaactctacttaatccaa

SEQ ID NO: 3472362 - DNA, 16 bp, Homo sapiens
aaaagaaaaatgaaga

SEQ ID NO: 3472363 - DNA, 17 bp, Homo sapiens
aaaagaacaatattgac

SEQ ID NO: 3472364 - DNA, 16 bp, Homo sapiens
aaaagaacatgcagtt

SEQ ID NO: 3472365 - DNA, 22 bp, Homo sapiens
aaaagaacatgcagtttgaaat

SEQ ID NO: 3472366 - DNA, 16 bp, Homo sapiens
aaaagaagtttcagtt

SEQ ID NO: 3472367 - DNA, 13 bp, Homo sapiens
aaaagacagggct

SEQ ID NO: 3472368 - DNA, 20 bp, Homo sapiens
aaaagactccagtactattt

SEQ ID NO: 3472369 - DNA, 21 bp, Homo sapiens
aaaagactccagtactatttt

SEQ ID NO: 3472370 - DNA, 13 bp, Homo sapiens
aaaagagaatgat

SEQ ID NO: 3472371 - DNA, 23 bp, Homo sapiens
aaaagatataagtgctgtataaa

SEQ ID NO: 3472372 - DNA, 16 bp, Homo sapiens
aaaagatatattaaaa

SEQ ID NO: 3472373 - DNA, 19 bp, Homo sapiens
aaaagatgcttttaacaga

SEQ ID NO: 3472374 - DNA, 15 bp, Homo sapiens
aaaagattttaatca

SEQ ID NO: 3472375 - DNA, 15 bp, Homo sapiens
aaaagatttttattt

SEQ ID NO: 3472376 - DNA, 18 bp, Homo sapiens
aaaagcagagcatttttt

SEQ ID NO: 3472377 - DNA, 21 bp, Homo sapiens
aaaagccaaggtgtcatttat

SEQ ID NO: 3472378 - DNA, 21 bp, Homo sapiens
aaaagctagtgtacctcctct

SEQ ID NO: 3472379 - DNA, 14 bp, Homo sapiens
aaaagctgggcagg

SEQ ID NO: 3472380 - DNA, 14 bp, Homo sapiens
aaaagcttccatga

SEQ ID NO: 3472381 - DNA, 20 bp, Homo sapiens
aaaaggatctttgtggccaa

SEQ ID NO: 3472382 - DNA, 15 bp, Homo sapiens
aaaaggctgaaaaga

SEQ ID NO: 3472383 - DNA, 17 bp, Homo sapiens
aaaaggtgtcaactttt

SEQ ID NO: 3472384 - DNA, 19 bp, Homo sapiens
aaaaggttcactaaagcag

SEQ ID NO: 3472385 - DNA, 14 bp, Homo sapiens
aaaagtattatttt

SEQ ID NO: 3472386 - DNA, 22 bp, Homo sapiens
aaaagtattattttccaaaagt

SEQ ID NO: 3472387 - DNA, 16 bp, Homo sapiens
aaaagtcaccattctg

SEQ ID NO: 3472388 - DNA, 15 bp, Homo sapiens
aaaagtgcttcattc

SEQ ID NO: 3472389 - DNA, 12 bp, Homo sapiens
aaaagttgaaat

SEQ ID NO: 3472390 - DNA, 20 bp, Homo sapiens
aaaataaaaggactctggaa

SEQ ID NO: 3472391 - DNA, 11 bp, Homo sapiens
aaaataaactg

SEQ ID NO: 3472392 - DNA, 12 bp, Homo sapiens
aaaataaactgt

SEQ ID NO: 3472393 - DNA, 22 bp, Homo sapiens
aaaataaagctaccattttaca

SEQ ID NO: 3472394 - DNA, 15 bp, Homo sapiens
aaaataaatatatat

SEQ ID NO: 3472395 - DNA, 20 bp, Homo sapiens
aaaataaatttatatgaaaa

SEQ ID NO: 3472396 - DNA, 19 bp, Homo sapiens
aaaataaccggatatatac

SEQ ID NO: 3472397 - DNA, 16 bp, Homo sapiens
aaaatacaaacacatg

SEQ ID NO: 3472398 - DNA, 16 bp, Homo sapiens
aaaatacttttcctta

SEQ ID NO: 3472399 - DNA, 12 bp, Homo sapiens
aaaatagaatat

SEQ ID NO: 3472400 - DNA, 20 bp, Homo sapiens
aaaatagaatatagcatctt

SEQ ID NO: 3472401 - DNA, 13 bp, Homo sapiens
aaaatagacactc

SEQ ID NO: 3472402 - DNA, 21 bp, Homo sapiens
aaaatatagctgtacaaatat

SEQ ID NO: 3472403 - DNA, 12 bp, Homo sapiens
aaaatatcttgg

SEQ ID NO: 3472404 - DNA, 21 bp, Homo sapiens
aaaatatttataaaacttctc

SEQ ID NO: 3472405 - DNA, 23 bp, Homo sapiens
aaaatattttctctgtacttttc

SEQ ID NO: 3472406 - DNA, 16 bp, Homo sapiens
aaaatattttgtctaa

SEQ ID NO: 3472407 - DNA, 12 bp, Homo sapiens
aaaatcaacttt

SEQ ID NO: 3472408 - DNA, 20 bp, Homo sapiens
aaaatcaactttttattgcc

SEQ ID NO: 3472409 - DNA, 21 bp, Homo sapiens
aaaatcaactttttattgcct

SEQ ID NO: 3472410 - DNA, 18 bp, Homo sapiens
aaaatcagccaattatgt

SEQ ID NO: 3472411 - DNA, 20 bp, Homo sapiens
aaaatcagccaattatgtta

SEQ ID NO: 3472412 - DNA, 22 bp, Homo sapiens
aaaatcagccaattatgttaaa

SEQ ID NO: 3472413 - DNA, 19 bp, Homo sapiens
aaaatcattttatatgtca

SEQ ID NO: 3472414 - DNA, 20 bp, Homo sapiens
aaaatcattttatatgtcaa

SEQ ID NO: 3472415 - DNA, 22 bp, Homo sapiens
aaaatcattttatatgtcaaag

SEQ ID NO: 3472416 - DNA, 22 bp, Homo sapiens
aaaatcccttacctcggtgcct

SEQ ID NO: 3472417 - DNA, 16 bp, Homo sapiens
aaaatctgagaaactc

SEQ ID NO: 3472418 - DNA, 18 bp, Homo sapiens
aaaatctgagaaactcta

SEQ ID NO: 3472419 - DNA, 22 bp, Homo sapiens
aaaatctgagaaactctacatg

SEQ ID NO: 3472420 - DNA, 19 bp, Homo sapiens
aaaatctgcagaaggaaaa

SEQ ID NO: 3472421 - DNA, 23 bp, Homo sapiens
aaaatctttctttcttagaaatt

SEQ ID NO: 3472422 - DNA, 16 bp, Homo sapiens
aaaatgaggaatgtat

SEQ ID NO: 3472423 - DNA, 18 bp, Homo sapiens
aaaatgaggaatgtatat

SEQ ID NO: 3472424 - DNA, 18 bp, Homo sapiens
aaaatgcaaatcctatgt

SEQ ID NO: 3472425 - DNA, 20 bp, Homo sapiens
aaaatgcacaaacaatgcaa

SEQ ID NO: 3472426 - DNA, 16 bp, Homo sapiens
aaaatgcctcagtgta

SEQ ID NO: 3472427 - DNA, 16 bp, Homo sapiens
aaaatggaaccaggct

SEQ ID NO: 3472428 - DNA, 20 bp, Homo sapiens
aaaatggaagccaacacatc

SEQ ID NO: 3472429 - DNA, 13 bp, Homo sapiens
aaaatggatacat

SEQ ID NO: 3472430 - DNA, 21 bp, Homo sapiens
aaaatggatgccttgaataat

SEQ ID NO: 3472431 - DNA, 14 bp, Homo sapiens
aaaatggcagtgat

SEQ ID NO: 3472432 - DNA, 19 bp, Homo sapiens
aaaatgtaaaggagtcaaa

SEQ ID NO: 3472433 - DNA, 16 bp, Homo sapiens
aaaatgtgtaattttg

SEQ ID NO: 3472434 - DNA, 20 bp, Homo sapiens
aaaatgtgtaattttgttct

SEQ ID NO: 3472435 - DNA, 17 bp, Homo sapiens
aaaatgttgaaaagtca

SEQ ID NO: 3472436 - DNA, 12 bp, Homo sapiens
aaaatgttttaa

SEQ ID NO: 3472437 - DNA, 12 bp, Homo sapiens
aaaattaaaatg

SEQ ID NO: 3472438 - DNA, 18 bp, Homo sapiens
aaaattagatgcatgttg

SEQ ID NO: 3472439 - DNA, 13 bp, Homo sapiens
aaaattatttgca

SEQ ID NO: 3472440 - DNA, 14 bp, Homo sapiens
aaaattatttgcat

SEQ ID NO: 3472441 - DNA, 20 bp, Homo sapiens
aaaattatttttttttttgt

SEQ ID NO: 3472442 - DNA, 21 bp, Homo sapiens
aaaattcaagcatttaggaat

SEQ ID NO: 3472443 - DNA, 19 bp, Homo sapiens
aaatctaatatttctagta

SEQ ID NO: 3472444 - DNA, 19 bp, Homo sapiens
aaatctatttaattaggaa

SEQ ID NO: 3472445 - DNA, 14 bp, Homo sapiens
aaatctcttccttc

SEQ ID NO: 3472446 - DNA, 18 bp, Homo sapiens
aaatctgacccagtgccc

SEQ ID NO: 3472447 - DNA, 23 bp, Homo sapiens
aaatctgcagaaggaaaaatgtg

SEQ ID NO: 3472448 - DNA, 13 bp, Homo sapiens
aaatctgcctggg

SEQ ID NO: 3472449 - DNA, 20 bp, Homo sapiens
aaatctgctggagtttcatg

SEQ ID NO: 3472450 - DNA, 15 bp, Homo sapiens
aaatctgttctaaca

SEQ ID NO: 3472451 - DNA, 15 bp, Homo sapiens
aaatctgttggtttt

SEQ ID NO: 3472452 - DNA, 13 bp, Homo sapiens
aaatcttacaaca

SEQ ID NO: 3472453 - DNA, 16 bp, Homo sapiens
aaatctttctttctta

SEQ ID NO: 3472454 - DNA, 23 bp, Homo sapiens
aaatctttctttcttagaaattt

SEQ ID NO: 3472455 - DNA, 17 bp, Homo sapiens
aaatgaaaatcgtgaca

SEQ ID NO: 3472456 - DNA, 15 bp, Homo sapiens
aaatgaaaatgtctt

SEQ ID NO: 3472457 - DNA, 17 bp, Homo sapiens
aaatgaaaatgtcttgt

SEQ ID NO: 3472458 - DNA, 12 bp, Homo sapiens
aaatgaaagaaa

SEQ ID NO: 3472459 - DNA, 22 bp, Homo sapiens
aaatgactaaaaaacaaagaag

SEQ ID NO: 3472460 - DNA, 18 bp, Homo sapiens
aaatgcatgattttgtaa

SEQ ID NO: 3472461 - DNA, 20 bp, Homo sapiens
aaatgcatgattttgtaacc

SEQ ID NO: 3472462 - DNA, 21 bp, Homo sapiens
aaatgcatgattttgtaaccc

SEQ ID NO: 3472463 - DNA, 13 bp, Homo sapiens
aaatgcattgtat

SEQ ID NO: 3472464 - DNA, 20 bp, Homo sapiens
aaatgcattgtatcgatgtt

SEQ ID NO: 3472465 - DNA, 20 bp, Homo sapiens
aaatgcatttatagatcatt

SEQ ID NO: 3472466 - DNA, 24 bp, Homo sapiens
aaatgcatttatagatcatttcta

SEQ ID NO: 3472467 - DNA, 13 bp, Homo sapiens
aaatgcccagctt

SEQ ID NO: 3472468 - DNA, 17 bp, Homo sapiens
aaatgcctcagtgtatt

SEQ ID NO: 3472469 - DNA, 18 bp, Homo sapiens
aaatgcctcagtgtattt

SEQ ID NO: 3472470 - DNA, 19 bp, Homo sapiens
aaatgcctcagtgtatttg

SEQ ID NO: 3472471 - DNA, 23 bp, Homo sapiens
aaatgcctcagtgtatttgtatt

SEQ ID NO: 3472472 - DNA, 18 bp, Homo sapiens
aaatgctctctcttctta

SEQ ID NO: 3472473 - DNA, 19 bp, Homo sapiens
aaatggacataggactcaa

SEQ ID NO: 3472474 - DNA, 16 bp, Homo sapiens
aaatggagaagctctg

SEQ ID NO: 3472475 - DNA, 23 bp, Homo sapiens
aaatggagtcatttgagtctctt

SEQ ID NO: 3472476 - DNA, 11 bp, Homo sapiens
aaatggccttc

SEQ ID NO: 3472477 - DNA, 16 bp, Homo sapiens
aaatgggacttaactc

SEQ ID NO: 3472478 - DNA, 13 bp, Homo sapiens
aaatggggccaga

SEQ ID NO: 3472479 - DNA, 17 bp, Homo sapiens
aaatggggccagatcca

SEQ ID NO: 3472480 - DNA, 19 bp, Homo sapiens
aaatggtaggcatttccta

SEQ ID NO: 3472481 - DNA, 14 bp, Homo sapiens
aaatggtccaggag

SEQ ID NO: 3472482 - DNA, 20 bp, Homo sapiens
aaatggtggaggattgctgc

SEQ ID NO: 3472483 - DNA, 14 bp, Homo sapiens
aaatggttgtatta

SEQ ID NO: 3472484 - DNA, 13 bp, Homo sapiens
aaatgtaaagcca

SEQ ID NO: 3472485 - DNA, 18 bp, Homo sapiens
aaatgtaactgtgccagt

SEQ ID NO: 3472486 - DNA, 19 bp, Homo sapiens
aaatgtacagacatattta

SEQ ID NO: 3472487 - DNA, 20 bp, Homo sapiens
aaatgtaggcttagtttgtg

SEQ ID NO: 3472488 - DNA, 19 bp, Homo sapiens
aaatgtctagttgtaacac

SEQ ID NO: 3472489 - DNA, 16 bp, Homo sapiens
aaatgtctattaaggt

SEQ ID NO: 3472490 - DNA, 12 bp, Homo sapiens
aaatgtcttgtg

SEQ ID NO: 3472491 - DNA, 21 bp, Homo sapiens
aaatgtgatgaatactgtatt

SEQ ID NO: 3472492 - DNA, 23 bp, Homo sapiens
aaatgttatcttatactgtacaa

SEQ ID NO: 3472493 - DNA, 15 bp, Homo sapiens
aaatgttatttaaca

SEQ ID NO: 3472494 - DNA, 16 bp, Homo sapiens
aaatgttcacttttga

SEQ ID NO: 3472495 - DNA, 20 bp, Homo sapiens
aaatgtttgttaaaaataaa

SEQ ID NO: 3472496 - DNA, 13 bp, Homo sapiens
aaatgttttctgg

SEQ ID NO: 3472497 - DNA, 20 bp, Homo sapiens
aaattaaccatagatgtaga

SEQ ID NO: 3472498 - DNA, 14 bp, Homo sapiens
aaattaagaaggca

SEQ ID NO: 3472499 - DNA, 13 bp, Homo sapiens
aaattaataatct

SEQ ID NO: 3472500 - DNA, 15 bp, Homo sapiens
aaattacaattttat

SEQ ID NO: 3472501 - DNA, 23 bp, Homo sapiens
aaattagggttggttcctttcca

SEQ ID NO: 3472502 - DNA, 15 bp, Homo sapiens
aaattcaattgtaaa

SEQ ID NO: 3472503 - DNA, 18 bp, Homo sapiens
aaattcacaaacttttat

SEQ ID NO: 3472504 - DNA, 19 bp, Homo sapiens
aaattcacaagttgtgttt

SEQ ID NO: 3472505 - DNA, 21 bp, Homo sapiens
aaattcagcaaaccattttta

SEQ ID NO: 3472506 - DNA, 21 bp, Homo sapiens
aaattcatcaaatggaagaca

SEQ ID NO: 3472507 - DNA, 14 bp, Homo sapiens
aaattcctctttgc

SEQ ID NO: 3472508 - DNA, 18 bp, Homo sapiens
aaattcctctttgctttg

SEQ ID NO: 3472509 - DNA, 16 bp, Homo sapiens
aaattctcctggaggt

SEQ ID NO: 3472510 - DNA, 13 bp, Homo sapiens
aaattctgaattt

SEQ ID NO: 3472511 - DNA, 16 bp, Homo sapiens
aaattctgaatttgca

SEQ ID NO: 3472512 - DNA, 17 bp, Homo sapiens
aaattctgaatttgcaa

SEQ ID NO: 3472513 - DNA, 14 bp, Homo sapiens
aaattctgtttctt

SEQ ID NO: 3472514 - DNA, 20 bp, Homo sapiens
aaattgaaaggcattctctg

SEQ ID NO: 3472515 - DNA, 22 bp, Homo sapiens
aaattgaaaggcattctctgaa

SEQ ID NO: 3472516 - DNA, 19 bp, Homo sapiens
aaattgatttccatatttt

SEQ ID NO: 3472517 - DNA, 19 bp, Homo sapiens
aaattgcaaatcttgaaat

SEQ ID NO: 3472518 - DNA, 17 bp, Homo sapiens
aaattgccataatatga

SEQ ID NO: 3472519 - DNA, 15 bp, Homo sapiens
aaattgccatattgc

SEQ ID NO: 3472520 - DNA, 16 bp, Homo sapiens
aaattgccatattgca

SEQ ID NO: 3472521 - DNA, 19 bp, Homo sapiens
aaattgccatattgcacat

SEQ ID NO: 3472522 - DNA, 23 bp, Homo sapiens
aaattgccatattgcacatgtct

SEQ ID NO: 3472523 - DNA, 19 bp, Homo sapiens
aaattgctggcagatgctt

SEQ ID NO: 3472524 - DNA, 15 bp, Homo sapiens
aaattgggaaaggag

SEQ ID NO: 3472525 - DNA, 20 bp, Homo sapiens
aaattgggaaaggagtagaa

SEQ ID NO: 3472526 - DNA, 17 bp, Homo sapiens
aaattgtatattcactt

SEQ ID NO: 3472527 - DNA, 13 bp, Homo sapiens
aaattgtgtgtgc

SEQ ID NO: 3472528 - DNA, 14 bp, Homo sapiens
aaatttattaaata

SEQ ID NO: 3472529 - DNA, 20 bp, Homo sapiens
aaatttatttcctagttctg

SEQ ID NO: 3472530 - DNA, 18 bp, Homo sapiens
aaatttattttataagaa

SEQ ID NO: 3472531 - DNA, 17 bp, Homo sapiens
aaatttgactaatttta

SEQ ID NO: 3472532 - DNA, 18 bp, Homo sapiens
aaatttgactaattttac

SEQ ID NO: 3472533 - DNA, 20 bp, Homo sapiens
aaatttgactaattttacat

SEQ ID NO: 3472534 - DNA, 15 bp, Homo sapiens
aaatttgataatgac

SEQ ID NO: 3472535 - DNA, 14 bp, Homo sapiens
aaatttgattgatt

SEQ ID NO: 3472536 - DNA, 12 bp, Homo sapiens
aaattttatctg

SEQ ID NO: 3472537 - DNA, 18 bp, Homo sapiens
aaattttgtaatgaattc

SEQ ID NO: 3472538 - DNA, 12 bp, Homo sapiens
aaatttttgtaa

SEQ ID NO: 3472539 - DNA, 15 bp, Homo sapiens
aaatttttttagaaa

SEQ ID NO: 3472540 - DNA, 17 bp, Homo sapiens
aaattttttttcatgtt

SEQ ID NO: 3472541 - DNA, 22 bp, Homo sapiens
aaattttttttcatgttttaac

SEQ ID NO: 3472542 - DNA, 23 bp, Homo sapiens
aaattttttttcatgttttaaca

SEQ ID NO: 3472543 - DNA, 12 bp, Homo sapiens
aacaaaaagaac

SEQ ID NO: 3472544 - DNA, 17 bp, Homo sapiens
aacaaaaatgctgccag

SEQ ID NO: 3472545 - DNA, 17 bp, Homo sapiens
aacaaaccacagcagga

SEQ ID NO: 3472546 - DNA, 11 bp, Homo sapiens
aacaaaccatc

SEQ ID NO: 3472547 - DNA, 14 bp, Homo sapiens
aacaaagcagccac

SEQ ID NO: 3472548 - DNA, 11 bp, Homo sapiens
aacaaagccag

SEQ ID NO: 3472549 - DNA, 22 bp, Homo sapiens
aacaaatacattcaaattcttt

SEQ ID NO: 3472550 - DNA, 15 bp, Homo sapiens
aacaaattatttttg

SEQ ID NO: 3472551 - DNA, 16 bp, Homo sapiens
aacaacatttaaggga

SEQ ID NO: 3472552 - DNA, 21 bp, Homo sapiens
aacaacattttgagaacaaag

SEQ ID NO: 3472553 - DNA, 21 bp, Homo sapiens
aacaactcctagggccactga

SEQ ID NO: 3472554 - DNA, 19 bp, Homo sapiens
aacaaggttatatgaatat

SEQ ID NO: 3472555 - DNA, 16 bp, Homo sapiens
aacaataaaatttttt

SEQ ID NO: 3472556 - DNA, 18 bp, Homo sapiens
aacaatagtaattctcag

SEQ ID NO: 3472557 - DNA, 14 bp, Homo sapiens
aacaattgtgaagt

SEQ ID NO: 3472558 - DNA, 16 bp, Homo sapiens
aacacaaactgtaaat

SEQ ID NO: 3472559 - DNA, 17 bp, Homo sapiens
aacacacagagctcacc

SEQ ID NO: 3472560 - DNA, 19 bp, Homo sapiens
aacacactgaggcagggaa

SEQ ID NO: 3472561 - DNA, 21 bp, Homo sapiens
aacacactgaggcagggaagt

SEQ ID NO: 3472562 - DNA, 19 bp, Homo sapiens
aacacagaaacctttttaa

SEQ ID NO: 3472563 - DNA, 21 bp, Homo sapiens
aacacagttgaccctattttt

SEQ ID NO: 3472564 - DNA, 20 bp, Homo sapiens
aacacattttggttcttctc

SEQ ID NO: 3472565 - DNA, 14 bp, Homo sapiens
aacaccaagcacag

SEQ ID NO: 3472566 - DNA, 21 bp, Homo sapiens
aacaccaagcacagcagcctg

SEQ ID NO: 3472567 - DNA, 21 bp, Homo sapiens
aacaccagtcccgaaatttgg

SEQ ID NO: 3472568 - DNA, 15 bp, Homo sapiens
aacacgcacctgcct

SEQ ID NO: 3472569 - DNA, 19 bp, Homo sapiens
aacacgcacctgcctcagg

SEQ ID NO: 3472570 - DNA, 14 bp, Homo sapiens
aacacgcaggagca

SEQ ID NO: 3472571 - DNA, 19 bp, Homo sapiens
aaacacactgaggcaggga

SEQ ID NO: 3472572 - DNA, 15 bp, Homo sapiens
aaacacttgcaacct

SEQ ID NO: 3472573 - DNA, 13 bp, Homo sapiens
aaacactttcaaa

SEQ ID NO: 3472574 - DNA, 14 bp, Homo sapiens
aaacagacaatatg

SEQ ID NO: 3472575 - DNA, 17 bp, Homo sapiens
aaacagagcccagggag

SEQ ID NO: 3472576 - DNA, 15 bp, Homo sapiens
aaacagatatcttca

SEQ ID NO: 3472577 - DNA, 18 bp, Homo sapiens
aaacagatatcttcagtt

SEQ ID NO: 3472578 - DNA, 20 bp, Homo sapiens
aaacagatatcttcagttta

SEQ ID NO: 3472579 - DNA, 23 bp, Homo sapiens
aaacagatatcttcagtttaatg

SEQ ID NO: 3472580 - DNA, 14 bp, Homo sapiens
aaacagcattagat

SEQ ID NO: 3472581 - DNA, 17 bp, Homo sapiens
aaacagctaatgggaca

SEQ ID NO: 3472582 - DNA, 14 bp, Homo sapiens
aaacagctgcctta

SEQ ID NO: 3472583 - DNA, 15 bp, Homo sapiens
aaacagctgccttag

SEQ ID NO: 3472584 - DNA, 21 bp, Homo sapiens
aaacagctgccttagcttcag

SEQ ID NO: 3472585 - DNA, 22 bp, Homo sapiens
aaacagctgccttagcttcagg

SEQ ID NO: 3472586 - DNA, 21 bp, Homo sapiens
aaacaggcagttggccagaga

SEQ ID NO: 3472587 - DNA, 18 bp, Homo sapiens
aaacaggttgggatggga

SEQ ID NO: 3472588 - DNA, 11 bp, Homo sapiens
aaacagtatct

SEQ ID NO: 3472589 - DNA, 17 bp, Homo sapiens
aaacataccaacatgtt

SEQ ID NO: 3472590 - DNA, 22 bp, Homo sapiens
aaacatcacacacacagacaga

SEQ ID NO: 3472591 - DNA, 16 bp, Homo sapiens
aaacatcagttactct

SEQ ID NO: 3472592 - DNA, 19 bp, Homo sapiens
aaacatcagttactctgaa

SEQ ID NO: 3472593 - DNA, 22 bp, Homo sapiens
aaacatcagttactctgaaggg

SEQ ID NO: 3472594 - DNA, 17 bp, Homo sapiens
aaacatccaatattttc

SEQ ID NO: 3472595 - DNA, 20 bp, Homo sapiens
aaacatctattctctccaaa

SEQ ID NO: 3472596 - DNA, 13 bp, Homo sapiens
aaacatgtatgtg

SEQ ID NO: 3472597 - DNA, 12 bp, Homo sapiens
aaacattaagaa

SEQ ID NO: 3472598 - DNA, 18 bp, Homo sapiens
aaacattaagaaaatcat

SEQ ID NO: 3472599 - DNA, 17 bp, Homo sapiens
aaacattgcctttgaat

SEQ ID NO: 3472600 - DNA, 18 bp, Homo sapiens
aaacattgcctttgaatg

SEQ ID NO: 3472601 - DNA, 14 bp, Homo sapiens
aaacattgttttgt

SEQ ID NO: 3472602 - DNA, 17 bp, Homo sapiens
aaacattgttttgtgta

SEQ ID NO: 3472603 - DNA, 19 bp, Homo sapiens
aaacatttcaagtttactc

SEQ ID NO: 3472604 - DNA, 21 bp, Homo sapiens
aaacatttcaagtttactcct

SEQ ID NO: 3472605 - DNA, 14 bp, Homo sapiens
aaacattttaaaaa

SEQ ID NO: 3472606 - DNA, 15 bp, Homo sapiens
aaaccaaaaactgaa

SEQ ID NO: 3472607 - DNA, 12 bp, Homo sapiens
aaaccaagaaga

SEQ ID NO: 3472608 - DNA, 13 bp, Homo sapiens
aaaccacagcagg

SEQ ID NO: 3472609 - DNA, 13 bp, Homo sapiens
aaaccagctgcta

SEQ ID NO: 3472610 - DNA, 12 bp, Homo sapiens
aaaccagggagc

SEQ ID NO: 3472611 - DNA, 21 bp, Homo sapiens
aaaccatgcctggtattttca

SEQ ID NO: 3472612 - DNA, 16 bp, Homo sapiens
aaacccgacagaggga

SEQ ID NO: 3472613 - DNA, 19 bp, Homo sapiens
aaacccgacagagggaaga

SEQ ID NO: 3472614 - DNA, 18 bp, Homo sapiens
aaaccgctttggcctgag

SEQ ID NO: 3472615 - DNA, 19 bp, Homo sapiens
aaacctaaaaaagatatat

SEQ ID NO: 3472616 - DNA, 18 bp, Homo sapiens
aaacctaattaaggaagt

SEQ ID NO: 3472617 - DNA, 18 bp, Homo sapiens
aaacctacacactgtcat

SEQ ID NO: 3472618 - DNA, 22 bp, Homo sapiens
aaacctcatgacagccagagcc

SEQ ID NO: 3472619 - DNA, 12 bp, Homo sapiens
aaacctgcctgg

SEQ ID NO: 3472620 - DNA, 22 bp, Homo sapiens
aaaccttatctccacaacctct

SEQ ID NO: 3472621 - DNA, 13 bp, Homo sapiens
aaaccttttgaaa

SEQ ID NO: 3472622 - DNA, 20 bp, Homo sapiens
aaaccttttggaaaatctgc

SEQ ID NO: 3472623 - DNA, 16 bp, Homo sapiens
aaacgctacctctctg

SEQ ID NO: 3472624 - DNA, 12 bp, Homo sapiens
aaacgctgcctg

SEQ ID NO: 3472625 - DNA, 21 bp, Homo sapiens
aaacgggttaaaaattgtttt

SEQ ID NO: 3472626 - DNA, 20 bp, Homo sapiens
aaactaatggtccacaccca

SEQ ID NO: 3472627 - DNA, 21 bp, Homo sapiens
aaactacaaccaatggaatgt

SEQ ID NO: 3472628 - DNA, 20 bp, Homo sapiens
aaactagcatatctgccttt

SEQ ID NO: 3472629 - DNA, 22 bp, Homo sapiens
aaactagcatatctgcctttat

SEQ ID NO: 3472630 - DNA, 17 bp, Homo sapiens
aaactatattttgtcat

SEQ ID NO: 3472631 - DNA, 14 bp, Homo sapiens
aaactattaaggat

SEQ ID NO: 3472632 - DNA, 19 bp, Homo sapiens
aaactattcatgctaccca

SEQ ID NO: 3472633 - DNA, 15 bp, Homo sapiens
aaactatttgcgact

SEQ ID NO: 3472634 - DNA, 22 bp, Homo sapiens
aaactcatttcctatgtaactg

SEQ ID NO: 3472635 - DNA, 22 bp, Homo sapiens
aaactccgagtgaactggtctt

SEQ ID NO: 3472636 - DNA, 17 bp, Homo sapiens
aaactctctttgggaat

SEQ ID NO: 3472637 - DNA, 22 bp, Homo sapiens
aaactctctttgggaatgtttg

SEQ ID NO: 3472638 - DNA, 23 bp, Homo sapiens
aaactctgcatccagagattcat

SEQ ID NO: 3472639 - DNA, 11 bp, Homo sapiens
aaactcttcag

SEQ ID NO: 3472640 - DNA, 21 bp, Homo sapiens
aaactcttcagttaattctta

SEQ ID NO: 3472641 - DNA, 17 bp, Homo sapiens
aaactcttgacctcagg

SEQ ID NO: 3472642 - DNA, 22 bp, Homo sapiens
aaactgaagcagcctctcccca

SEQ ID NO: 3472643 - DNA, 12 bp, Homo sapiens
aaactggccagg

SEQ ID NO: 3472644 - DNA, 18 bp, Homo sapiens
aaactggggcctccagaa

SEQ ID NO: 3472645 - DNA, 11 bp, Homo sapiens
aaactgtctct

SEQ ID NO: 3472646 - DNA, 18 bp, Homo sapiens
aaactgtctttaaaagag

SEQ ID NO: 3472647 - DNA, 15 bp, Homo sapiens
aaacttaagatattt

SEQ ID NO: 3472648 - DNA, 20 bp, Homo sapiens
aaactttcctcttcctgcct

SEQ ID NO: 3472649 - DNA, 16 bp, Homo sapiens
aaactttcctttaact

SEQ ID NO: 3472650 - DNA, 17 bp, Homo sapiens
aaactttcctttaactc

SEQ ID NO: 3472651 - DNA, 21 bp, Homo sapiens
aaactttgaggataacttttt

SEQ ID NO: 3472652 - DNA, 13 bp, Homo sapiens
aaagaaaattcct

SEQ ID NO: 3472653 - DNA, 20 bp, Homo sapiens
aaagaaacccgacagaggga

SEQ ID NO: 3472654 - DNA, 14 bp, Homo sapiens
aaagaaagcaactt

SEQ ID NO: 3472655 - DNA, 23 bp, Homo sapiens
aaagaaagttgcacggctgctga

SEQ ID NO: 3472656 - DNA, 19 bp, Homo sapiens
aaagaaatgtctattaagg

SEQ ID NO: 3472657 - DNA, 16 bp, Homo sapiens
aaagaacaaaaaaatc

SEQ ID NO: 3472658 - DNA, 19 bp, Homo sapiens
aaagaacatgcagtttgaa

SEQ ID NO: 3472659 - DNA, 19 bp, Homo sapiens
aaagaagacaacattaaaa

SEQ ID NO: 3472660 - DNA, 15 bp, Homo sapiens
aaagaatatgacttt

SEQ ID NO: 3472661 - DNA, 19 bp, Homo sapiens
aaagaatgttactgcctta

SEQ ID NO: 3472662 - DNA, 16 bp, Homo sapiens
aaagacaaattctgtt

SEQ ID NO: 3472663 - DNA, 17 bp, Homo sapiens
aaagacaagacttcagt

SEQ ID NO: 3472664 - DNA, 17 bp, Homo sapiens
aaagacaatcactgcca

SEQ ID NO: 3472665 - DNA, 18 bp, Homo sapiens
aaagacaatcactgccaa

SEQ ID NO: 3472666 - DNA, 16 bp, Homo sapiens
aaagacccgggagctg

SEQ ID NO: 3472667 - DNA, 14 bp, Homo sapiens
aaagactgtgaaca

SEQ ID NO: 3472668 - DNA, 14 bp, Homo sapiens
aaagacttccctaa

SEQ ID NO: 3472669 - DNA, 18 bp, Homo sapiens
aaagagagaaaaacaaat

SEQ ID NO: 3472670 - DNA, 12 bp, Homo sapiens
aaagagcactta

SEQ ID NO: 3472671 - DNA, 21 bp, Homo sapiens
aaagagcacttaagagaatat

SEQ ID NO: 3472672 - DNA, 22 bp, Homo sapiens
aaagagcacttaagagaatatt

SEQ ID NO: 3472673 - DNA, 17 bp, Homo sapiens
aaagagctcagacattt

SEQ ID NO: 3472674 - DNA, 19 bp, Homo sapiens
aaagaggcgttgctttcac

SEQ ID NO: 3472675 - DNA, 19 bp, Homo sapiens
aaagaggctgaggctggca

SEQ ID NO: 3472676 - DNA, 19 bp, Homo sapiens
aaagatagagtcattgctg

SEQ ID NO: 3472677 - DNA, 15 bp, Homo sapiens
aaagatataagtgct

SEQ ID NO: 3472678 - DNA, 16 bp, Homo sapiens
aaagatataagtgctg

SEQ ID NO: 3472679 - DNA, 21 bp, Homo sapiens
aaagatataagtgctgtataa

SEQ ID NO: 3472680 - DNA, 12 bp, Homo sapiens
aaagatatatta

SEQ ID NO: 3472681 - DNA, 18 bp, Homo sapiens
aaagatctgtcctcagcc

SEQ ID NO: 3472682 - DNA, 22 bp, Homo sapiens
aaggctgtccttacccatctgc

SEQ ID NO: 3472683 - DNA, 13 bp, Homo sapiens
aaggctgtttgct

SEQ ID NO: 3472684 - DNA, 13 bp, Homo sapiens
aaggcttcagtct

SEQ ID NO: 3472685 - DNA, 20 bp, Homo sapiens
aaggcttgttgtgcttttag

SEQ ID NO: 3472686 - DNA, 16 bp, Homo sapiens
aagggaaaagtctctt

SEQ ID NO: 3472687 - DNA, 15 bp, Homo sapiens
aagggcagagtcaca

SEQ ID NO: 3472688 - DNA, 21 bp, Homo sapiens
aagggcatgggtcgggagagg

SEQ ID NO: 3472689 - DNA, 18 bp, Homo sapiens
aagggccagacagacctt

SEQ ID NO: 3472690 - DNA, 15 bp, Homo sapiens
aagggccagagccag

SEQ ID NO: 3472691 - DNA, 16 bp, Homo sapiens
aagggccagagccagg

SEQ ID NO: 3472692 - DNA, 17 bp, Homo sapiens
aagggccagagccaggg

SEQ ID NO: 3472693 - DNA, 11 bp, Homo sapiens
aagggctgccg

SEQ ID NO: 3472694 - DNA, 16 bp, Homo sapiens
aaggggacccccgccc

SEQ ID NO: 3472695 - DNA, 20 bp, Homo sapiens
aaggggacccccgccccctg

SEQ ID NO: 3472696 - DNA, 16 bp, Homo sapiens
aaggggagaagggaat

SEQ ID NO: 3472697 - DNA, 13 bp, Homo sapiens
aaggggagcccac

SEQ ID NO: 3472698 - DNA, 15 bp, Homo sapiens
aaggggcccgtggga

SEQ ID NO: 3472699 - DNA, 23 bp, Homo sapiens
aaggggtttctatccttccagaa

SEQ ID NO: 3472700 - DNA, 15 bp, Homo sapiens
aagggttaaggcctg

SEQ ID NO: 3472701 - DNA, 16 bp, Homo sapiens
aagggttccctcaaga

SEQ ID NO: 3472702 - DNA, 12 bp, Homo sapiens
aaggtaaaattg

SEQ ID NO: 3472703 - DNA, 12 bp, Homo sapiens
aaggtctttcag

SEQ ID NO: 3472704 - DNA, 18 bp, Homo sapiens
aaggtctttcagtacttt

SEQ ID NO: 3472705 - DNA, 11 bp, Homo sapiens
aaggtgaagga

SEQ ID NO: 3472706 - DNA, 18 bp, Homo sapiens
aaggtgaaggaatatatg

SEQ ID NO: 3472707 - DNA, 21 bp, Homo sapiens
aaggtgaggcctgtctgtgac

SEQ ID NO: 3472708 - DNA, 22 bp, Homo sapiens
aaggtgaggcctgtctgtgacc

SEQ ID NO: 3472709 - DNA, 14 bp, Homo sapiens
aaggtgccatggaa

SEQ ID NO: 3472710 - DNA, 15 bp, Homo sapiens
aaggtgcctgccata

SEQ ID NO: 3472711 - DNA, 18 bp, Homo sapiens
aaggtgctgacggccagg

SEQ ID NO: 3472712 - DNA, 15 bp, Homo sapiens
aaggtggtgtttctg

SEQ ID NO: 3472713 - DNA, 19 bp, Homo sapiens
aagccaagggaacctgtgt

SEQ ID NO: 3472714 - DNA, 20 bp, Homo sapiens
aagccaagggaacctgtgtc

SEQ ID NO: 3472715 - DNA, 17 bp, Homo sapiens
aagccaataacacacag

SEQ ID NO: 3472716 - DNA, 17 bp, Homo sapiens
aagccacaggcctgaga

SEQ ID NO: 3472717 - DNA, 20 bp, Homo sapiens
aagccagaagctgagcacca

SEQ ID NO: 3472718 - DNA, 15 bp, Homo sapiens
aagccagaggctggg

SEQ ID NO: 3472719 - DNA, 16 bp, Homo sapiens
aagccagctgccctat

SEQ ID NO: 3472720 - DNA, 22 bp, Homo sapiens
aagccagctgccctatgggcct

SEQ ID NO: 3472721 - DNA, 15 bp, Homo sapiens
aagccattccaaagt

SEQ ID NO: 3472722 - DNA, 19 bp, Homo sapiens
aagcccagcccctactgct

SEQ ID NO: 3472723 - DNA, 14 bp, Homo sapiens
aagccccagcaagc

SEQ ID NO: 3472724 - DNA, 21 bp, Homo sapiens
aagcccccagctaagaacctg

SEQ ID NO: 3472725 - DNA, 23 bp, Homo sapiens
aagcccccccttatagtttgggc

SEQ ID NO: 3472726 - DNA, 16 bp, Homo sapiens
aagcccccccttccac

SEQ ID NO: 3472727 - DNA, 14 bp, Homo sapiens
aagcccctctttct

SEQ ID NO: 3472728 - DNA, 19 bp, Homo sapiens
aagccctgagctttctgct

SEQ ID NO: 3472729 - DNA, 14 bp, Homo sapiens
aagccgtgccctgc

SEQ ID NO: 3472730 - DNA, 16 bp, Homo sapiens
aagcctacctaagcat

SEQ ID NO: 3472731 - DNA, 15 bp, Homo sapiens
aagcctcctccagcc

SEQ ID NO: 3472732 - DNA, 15 bp, Homo sapiens
aagcctgaagagctt

SEQ ID NO: 3472733 - DNA, 23 bp, Homo sapiens
aagcctgaatttctcagtgttgg

SEQ ID NO: 3472734 - DNA, 15 bp, Homo sapiens
aagcctgatgctgac

SEQ ID NO: 3472735 - DNA, 16 bp, Homo sapiens
aagaagggctgcatga

SEQ ID NO: 3472736 - DNA, 18 bp, Homo sapiens
aagaataatttatagtaa

SEQ ID NO: 3472737 - DNA, 15 bp, Homo sapiens
aagaatacagctttc

SEQ ID NO: 3472738 - DNA, 16 bp, Homo sapiens
aagaatacttgaactt

SEQ ID NO: 3472739 - DNA, 17 bp, Homo sapiens
aagaatacttgaacttg

SEQ ID NO: 3472740 - DNA, 15 bp, Homo sapiens
aagaatagcatctgt

SEQ ID NO: 3472741 - DNA, 16 bp, Homo sapiens
aagaatagcatctgta

SEQ ID NO: 3472742 - DNA, 21 bp, Homo sapiens
aagaatagcatctgtacaaag

SEQ ID NO: 3472743 - DNA, 23 bp, Homo sapiens
aagaatagcatctgtacaaaggg

SEQ ID NO: 3472744 - DNA, 19 bp, Homo sapiens
aagaataggcattaacaca

SEQ ID NO: 3472745 - DNA, 23 bp, Homo sapiens
aagaatccctagactttaggctt

SEQ ID NO: 3472746 - DNA, 18 bp, Homo sapiens
aagaatgttactgcctta

SEQ ID NO: 3472747 - DNA, 19 bp, Homo sapiens
aagaattcaaactggggcc

SEQ ID NO: 3472748 - DNA, 16 bp, Homo sapiens
aacacgcgtatttaca

SEQ ID NO: 3472749 - DNA, 21 bp, Homo sapiens
aacacggccacatcaaagagg

SEQ ID NO: 3472750 - DNA, 18 bp, Homo sapiens
aacactaactatgcatgg

SEQ ID NO: 3472751 - DNA, 18 bp, Homo sapiens
aacactactcttacatgt

SEQ ID NO: 3472752 - DNA, 18 bp, Homo sapiens
aacactagacaagccaga

SEQ ID NO: 3472753 - DNA, 16 bp, Homo sapiens
aacactcttttgcttt

SEQ ID NO: 3472754 - DNA, 10 bp, Homo sapiens
aacactgagc

SEQ ID NO: 3472755 - DNA, 13 bp, Homo sapiens
aacactgatgata

SEQ ID NO: 3472756 - DNA, 16 bp, Homo sapiens
aacactgcaagaagtc

SEQ ID NO: 3472757 - DNA, 15 bp, Homo sapiens
aacactggcagactg

SEQ ID NO: 3472758 - DNA, 12 bp, Homo sapiens
aacactgtgaaa

SEQ ID NO: 3472759 - DNA, 22 bp, Homo sapiens
aacagaagctcttactctttcc

SEQ ID NO: 3472760 - DNA, 15 bp, Homo sapiens
aacagacaggtggaa

SEQ ID NO: 3472761 - DNA, 21 bp, Homo sapiens
aacagatatcttcagtttaat

SEQ ID NO: 3472762 - DNA, 24 bp, Homo sapiens
aacagatgtttcttttgtatgtaa

SEQ ID NO: 3472763 - DNA, 14 bp, Homo sapiens
aacagcatgacaaa

SEQ ID NO: 3472764 - DNA, 17 bp, Homo sapiens
aacagcatgacaaaaat

SEQ ID NO: 3472765 - DNA, 19 bp, Homo sapiens
aacagcatgacaaaaatta

SEQ ID NO: 3472766 - DNA, 15 bp, Homo sapiens
aacagcattagatag

SEQ ID NO: 3472767 - DNA, 17 bp, Homo sapiens
aacagcctattcctgaa

SEQ ID NO: 3472768 - DNA, 16 bp, Homo sapiens
aacagcctttgaatgt

SEQ ID NO: 3472769 - DNA, 16 bp, Homo sapiens
aacagctaatgggaca

SEQ ID NO: 3472770 - DNA, 11 bp, Homo sapiens
aacagctgcct

SEQ ID NO: 3472771 - DNA, 14 bp, Homo sapiens
aacagctgccttag

SEQ ID NO: 3472772 - DNA, 18 bp, Homo sapiens
aacagctgccttagcttc

SEQ ID NO: 3472773 - DNA, 19 bp, Homo sapiens
aacagctgccttagcttca

SEQ ID NO: 3472774 - DNA, 14 bp, Homo sapiens
aacagcttgctgtc

SEQ ID NO: 3472775 - DNA, 14 bp, Homo sapiens
aacaggaatctcag

SEQ ID NO: 3472776 - DNA, 21 bp, Homo sapiens
aacaggaatctcagagacagg

SEQ ID NO: 3472777 - DNA, 21 bp, Homo sapiens
aacaggagctgggatcctaag

SEQ ID NO: 3472778 - DNA, 11 bp, Homo sapiens
aacagggaggg

SEQ ID NO: 3472779 - DNA, 18 bp, Homo sapiens
aacaggtaatataaaaag

SEQ ID NO: 3472780 - DNA, 12 bp, Homo sapiens
aacagtatctct

SEQ ID NO: 3472781 - DNA, 16 bp, Homo sapiens
aacagtcacgcctgaa

SEQ ID NO: 3472782 - DNA, 11 bp, Homo sapiens
aacagttcaaa

SEQ ID NO: 3472783 - DNA, 13 bp, Homo sapiens
aacagttcaaaga

SEQ ID NO: 3472784 - DNA, 18 bp, Homo sapiens
aacagttttcctatgctt

SEQ ID NO: 3472785 - DNA, 13 bp, Homo sapiens
aacatagaaaaat

SEQ ID NO: 3472786 - DNA, 12 bp, Homo sapiens
aacatctagaaa

SEQ ID NO: 3472787 - DNA, 14 bp, Homo sapiens
aacatctattctct

SEQ ID NO: 3472788 - DNA, 21 bp, Homo sapiens
aacatcttgaatactctgccc

SEQ ID NO: 3472789 - DNA, 11 bp, Homo sapiens
aacatcttttc

SEQ ID NO: 3472790 - DNA, 15 bp, Homo sapiens
aacatcttttcttgc

SEQ ID NO: 3472791 - DNA, 21 bp, Homo sapiens
aacatgaggggacattttggt

SEQ ID NO: 3472792 - DNA, 13 bp, Homo sapiens
aacatgatgtact

SEQ ID NO: 3472793 - DNA, 22 bp, Homo sapiens
aacatgcaagatacaggaaaaa

SEQ ID NO: 3472794 - DNA, 11 bp, Homo sapiens
aacatgcagtt

SEQ ID NO: 3472795 - DNA, 18 bp, Homo sapiens
aacatgcagtttgaaatt

SEQ ID NO: 3472796 - DNA, 22 bp, Homo sapiens
aacatgcctgccccaaacaaat

SEQ ID NO: 3472797 - DNA, 16 bp, Homo sapiens
aacatgcttgatgttt

SEQ ID NO: 3472798 - DNA, 22 bp, Homo sapiens
aacatggtaaacgctgtcccta

SEQ ID NO: 3472799 - DNA, 18 bp, Homo sapiens
aacatggtgtctggattc

SEQ ID NO: 3472800 - DNA, 15 bp, Homo sapiens
aacatgtaggaagta

SEQ ID NO: 3472801 - DNA, 16 bp, Homo sapiens
aacatgtatgtgcatt

SEQ ID NO: 3472802 - DNA, 20 bp, Homo sapiens
aacatgtggctcctcccagc

SEQ ID NO: 3472803 - DNA, 22 bp, Homo sapiens
aacatgttgtacatttcaccat

SEQ ID NO: 3472804 - DNA, 14 bp, Homo sapiens
aacattaagaaaat

SEQ ID NO: 3472805 - DNA, 16 bp, Homo sapiens
aacattaagaaaatca

SEQ ID NO: 3472806 - DNA, 18 bp, Homo sapiens
aacattaagaaaatcata

SEQ ID NO: 3472807 - DNA, 20 bp, Homo sapiens
aacattacagggaatgcctg

SEQ ID NO: 3472808 - DNA, 22 bp, Homo sapiens
aacattgcctttgaatgttaat

SEQ ID NO: 3472809 - DNA, 12 bp, Homo sapiens
aacattgtatta

SEQ ID NO: 3472810 - DNA, 15 bp, Homo sapiens
aacatttaatttaga

SEQ ID NO: 3472811 - DNA, 14 bp, Homo sapiens
aacatttcaagttt

SEQ ID NO: 3472812 - DNA, 15 bp, Homo sapiens
aacatttcaagttta

SEQ ID NO: 3472813 - DNA, 16 bp, Homo sapiens
aacatttcaagtttac

SEQ ID NO: 3472814 - DNA, 17 bp, Homo sapiens
aacatttcaagtttact

SEQ ID NO: 3472815 - DNA, 14 bp, Homo sapiens
aacattttaattca

SEQ ID NO: 3472816 - DNA, 17 bp, Homo sapiens
aacattttacccacaca

SEQ ID NO: 3472817 - DNA, 16 bp, Homo sapiens
aacattttgagaacaa

SEQ ID NO: 3472818 - DNA, 14 bp, Homo sapiens
aaccaaaatgatac

SEQ ID NO: 3472819 - DNA, 20 bp, Homo sapiens
aaccaaaggtgaaggaatat

SEQ ID NO: 3472820 - DNA, 23 bp, Homo sapiens
aaccaaaggtgaaggaatatatg

SEQ ID NO: 3472821 - DNA, 13 bp, Homo sapiens
aaccacagcagga

SEQ ID NO: 3472822 - DNA, 16 bp, Homo sapiens
aaccacagctgctgga

SEQ ID NO: 3472823 - DNA, 18 bp, Homo sapiens
aaccacatcttgctctgc

SEQ ID NO: 3472824 - DNA, 22 bp, Homo sapiens
aaccacatcttgctctgctgac

SEQ ID NO: 3472825 - DNA, 17 bp, Homo sapiens
aaccacctaggcaatga

SEQ ID NO: 3472826 - DNA, 20 bp, Homo sapiens
aaccactgcaagtccttttg

SEQ ID NO: 3472827 - DNA, 14 bp, Homo sapiens
aaccactttttgca

SEQ ID NO: 3472828 - DNA, 23 bp, Homo sapiens
aaccagaaaggtgattccaggag

SEQ ID NO: 3472829 - DNA, 16 bp, Homo sapiens
aaccagaacagtatga

SEQ ID NO: 3472830 - DNA, 19 bp, Homo sapiens
aaccagggaagctgtccct

SEQ ID NO: 3472831 - DNA, 21 bp, Homo sapiens
aaccagtatttttgctgcttc

SEQ ID NO: 3472832 - DNA, 20 bp, Homo sapiens
aaccatccagtgacaaacca

SEQ ID NO: 3472833 - DNA, 17 bp, Homo sapiens
aaccatgtcagcaaaaa

SEQ ID NO: 3472834 - DNA, 17 bp, Homo sapiens
aaccattccatttccaa

SEQ ID NO: 3472835 - DNA, 23 bp, Homo sapiens
aaccattccatttccaagcactt

SEQ ID NO: 3472836 - DNA, 14 bp, Homo sapiens
aacccaaaacctca

SEQ ID NO: 3472837 - DNA, 14 bp, Homo sapiens
aacccaaactctcc

SEQ ID NO: 3472838 - DNA, 14 bp, Homo sapiens
aacccaatccaaat

SEQ ID NO: 3472839 - DNA, 22 bp, Homo sapiens
aacccagacctgttagcagaca

SEQ ID NO: 3472840 - DNA, 18 bp, Homo sapiens
aacccagactcagacatt

SEQ ID NO: 3472841 - DNA, 16 bp, Homo sapiens
aacccagtctcctctc

SEQ ID NO: 3472842 - DNA, 20 bp, Homo sapiens
aacccatcaacaaaaattgt

SEQ ID NO: 3472843 - DNA, 17 bp, Homo sapiens
aacccatttttgagcca

SEQ ID NO: 3472844 - DNA, 20 bp, Homo sapiens
aaccccagggcccccacagg

SEQ ID NO: 3472845 - DNA, 14 bp, Homo sapiens
aacccccagcctgc

SEQ ID NO: 3472846 - DNA, 17 bp, Homo sapiens
aacccgacagagggaag

SEQ ID NO: 3472847 - DNA, 20 bp, Homo sapiens
aaccctggggaaggagccag

SEQ ID NO: 3472848 - DNA, 16 bp, Homo sapiens
aacccttcatcttcct

SEQ ID NO: 3472849 - DNA, 22 bp, Homo sapiens
aacccttcatcttcctgtgtcc

SEQ ID NO: 3472850 - DNA, 15 bp, Homo sapiens
aaccgcaggaagctg

SEQ ID NO: 3472851 - DNA, 16 bp, Homo sapiens
aaccgctttggcctga

SEQ ID NO: 3472852 - DNA, 18 bp, Homo sapiens
aaccgctttggcctgagt

SEQ ID NO: 3472853 - DNA, 18 bp, Homo sapiens
aaccgttttgaagctact

SEQ ID NO: 3472854 - DNA, 16 bp, Homo sapiens
aacctaaaaaagatat

SEQ ID NO: 3472855 - DNA, 19 bp, Homo sapiens
aacctaggagtgccccatt

SEQ ID NO: 3472856 - DNA, 13 bp, Homo sapiens
aacctaggcagtg

SEQ ID NO: 3472857 - DNA, 22 bp, Homo sapiens
aacctatttcttaaacacttgc

SEQ ID NO: 3472858 - DNA, 22 bp, Homo sapiens
aacctcacgcacctcccatcct

SEQ ID NO: 3472859 - DNA, 16 bp, Homo sapiens
aacctcagcctggcca

SEQ ID NO: 3472860 - DNA, 18 bp, Homo sapiens
aacctcatgacagccaga

SEQ ID NO: 3472861 - DNA, 20 bp, Homo sapiens
aacctcatgacagccagagc

SEQ ID NO: 3472862 - DNA, 14 bp, Homo sapiens
aacctcattcccca

SEQ ID NO: 3472863 - DNA, 17 bp, Homo sapiens
aacctccccagcctgcg

SEQ ID NO: 3472864 - DNA, 14 bp, Homo sapiens
aacctcctctgtga

SEQ ID NO: 3472865 - DNA, 18 bp, Homo sapiens
aacctctcacttcaccct

SEQ ID NO: 3472866 - DNA, 16 bp, Homo sapiens
aacctctgcttcccag

SEQ ID NO: 3472867 - DNA, 18 bp, Homo sapiens
aacctctgcttcccaggt

SEQ ID NO: 3472868 - DNA, 12 bp, Homo sapiens
aacctctgttca

SEQ ID NO: 3472869 - DNA, 13 bp, Homo sapiens
aacctctgttcag

SEQ ID NO: 3472870 - DNA, 15 bp, Homo sapiens
aacctctgttcagtg

SEQ ID NO: 3472871 - DNA, 16 bp, Homo sapiens
aacctctgttcagtgt

SEQ ID NO: 3472872 - DNA, 17 bp, Homo sapiens
aacctcttctggctcaa

SEQ ID NO: 3472873 - DNA, 19 bp, Homo sapiens
aacctgacaaaaaaaaagt

SEQ ID NO: 3472874 - DNA, 17 bp, Homo sapiens
aacctgggttgcagaca

SEQ ID NO: 3472875 - DNA, 19 bp, Homo sapiens
aacctgggttgcagacagg

SEQ ID NO: 3472876 - DNA, 20 bp, Homo sapiens
aacctgggttgcagacagga

SEQ ID NO: 3472877 - DNA, 22 bp, Homo sapiens
aacctgtataagtggaggcact

SEQ ID NO: 3472878 - DNA, 21 bp, Homo sapiens
aacctgttgatagcaagtgaa

SEQ ID NO: 3472879 - DNA, 16 bp, Homo sapiens
aaccttattgtacctc

SEQ ID NO: 3472880 - DNA, 17 bp, Homo sapiens
aaccttattgtacctct

SEQ ID NO: 3472881 - DNA, 19 bp, Homo sapiens
aaccttattgtacctctct

SEQ ID NO: 3472882 - DNA, 13 bp, Homo sapiens
aaccttctctatg

SEQ ID NO: 3472883 - DNA, 17 bp, Homo sapiens
aaccttggcctgggccg

SEQ ID NO: 3472884 - DNA, 18 bp, Homo sapiens
aacgaaccttggcctggg

SEQ ID NO: 3472885 - DNA, 17 bp, Homo sapiens
aacgctgagccacctgc

SEQ ID NO: 3472886 - DNA, 16 bp, Homo sapiens
agctggtcccactcag

SEQ ID NO: 3472887 - DNA, 17 bp, Homo sapiens
agctggtcccactcagt

SEQ ID NO: 3472888 - DNA, 19 bp, Homo sapiens
agctggtcccactcagtcc

SEQ ID NO: 3472889 - DNA, 18 bp, Homo sapiens
agctggtgagtgatgcgg

SEQ ID NO: 3472890 - DNA, 15 bp, Homo sapiens
agctggtggcagagt

SEQ ID NO: 3472891 - DNA, 22 bp, Homo sapiens
agctggtttttagcggagacgg

SEQ ID NO: 3472892 - DNA, 10 bp, Homo sapiens
agctgtattc

SEQ ID NO: 3472893 - DNA, 15 bp, Homo sapiens
agctgtattttgaaa

SEQ ID NO: 3472894 - DNA, 17 bp, Homo sapiens
agctgtgctctggacag

SEQ ID NO: 3472895 - DNA, 23 bp, Homo sapiens
agctgtgtgacatttggagaggg

SEQ ID NO: 3472896 - DNA, 13 bp, Homo sapiens
agctgttcagctg

SEQ ID NO: 3472897 - DNA, 23 bp, Homo sapiens
agctgttctcattcctgttcttt

SEQ ID NO: 3472898 - DNA, 22 bp, Homo sapiens
agctgtttactagggatccctc

SEQ ID NO: 3472899 - DNA, 15 bp, Homo sapiens
agctgttttccctga

SEQ ID NO: 3472900 - DNA, 10 bp, Homo sapiens
agcttagaac

SEQ ID NO: 3472901 - DNA, 15 bp, Homo sapiens
agcttagactaaggc

SEQ ID NO: 3472902 - DNA, 14 bp, Homo sapiens
agcttatctcaggg

SEQ ID NO: 3472903 - DNA, 19 bp, Homo sapiens
agcttcaaccctcagcctt

SEQ ID NO: 3472904 - DNA, 21 bp, Homo sapiens
agcttcaaccctcagccttga

SEQ ID NO: 3472905 - DNA, 21 bp, Homo sapiens
agcttcaccccaatcccagct

SEQ ID NO: 3472906 - DNA, 13 bp, Homo sapiens
agcttcaggaacc

SEQ ID NO: 3472907 - DNA, 23 bp, Homo sapiens
agcttcaggaacctcgagtactg

SEQ ID NO: 3472908 - DNA, 19 bp, Homo sapiens
agcttcatggcagaaggca

SEQ ID NO: 3472909 - DNA, 16 bp, Homo sapiens
agcttcattctccttg

SEQ ID NO: 3472910 - DNA, 21 bp, Homo sapiens
agcttcattctccttgttgtt

SEQ ID NO: 3472911 - DNA, 18 bp, Homo sapiens
agcttcatttcctgtgtc

SEQ ID NO: 3472912 - DNA, 17 bp, Homo sapiens
agcttccatagctgctg

SEQ ID NO: 3472913 - DNA, 19 bp, Homo sapiens
agcttccatagctgctgcc

SEQ ID NO: 3472914 - DNA, 21 bp, Homo sapiens
agcttccatagctgctgccct

SEQ ID NO: 3472915 - DNA, 21 bp, Homo sapiens
agcttcctgtccccatctgtc

SEQ ID NO: 3472916 - DNA, 16 bp, Homo sapiens
agcttctagaggctca

SEQ ID NO: 3472917 - DNA, 14 bp, Homo sapiens
agcttctgtctcca

SEQ ID NO: 3472918 - DNA, 17 bp, Homo sapiens
agcttctgtctccagct

SEQ ID NO: 3472919 - DNA, 12 bp, Homo sapiens
agcttcttccag

SEQ ID NO: 3472920 - DNA, 13 bp, Homo sapiens
agcttcttgtttc

SEQ ID NO: 3472921 - DNA, 14 bp, Homo sapiens
agcttcttgtttcc

SEQ ID NO: 3472922 - DNA, 17 bp, Homo sapiens
agcttcttgtttccttg

SEQ ID NO: 3472923 - DNA, 18 bp, Homo sapiens
agcttcttgtttccttgt

SEQ ID NO: 3472924 - DNA, 19 bp, Homo sapiens
agcttcttgtttccttgtt

SEQ ID NO: 3472925 - DNA, 16 bp, Homo sapiens
agcttgacctgaggct

SEQ ID NO: 3472926 - DNA, 14 bp, Homo sapiens
agcttgagggttgg

SEQ ID NO: 3472927 - DNA, 22 bp, Homo sapiens
agcttgagggttgggctggtgt

SEQ ID NO: 3472928 - DNA, 15 bp, Homo sapiens
agcttgcaagaagca

SEQ ID NO: 3472929 - DNA, 15 bp, Homo sapiens
agcttgccagatgct

SEQ ID NO: 3472930 - DNA, 17 bp, Homo sapiens
agcttgctcacatcttg

SEQ ID NO: 3472931 - DNA, 16 bp, Homo sapiens
aggataaattgccata

SEQ ID NO: 3472932 - DNA, 14 bp, Homo sapiens
aggatagatgctgg

SEQ ID NO: 3472933 - DNA, 15 bp, Homo sapiens
aggatagatgctggc

SEQ ID NO: 3472934 - DNA, 21 bp, Homo sapiens
aggatagatgctggcccaggg

SEQ ID NO: 3472935 - DNA, 16 bp, Homo sapiens
aggatattaaaatgct

SEQ ID NO: 3472936 - DNA, 17 bp, Homo sapiens
aggatattaaaatgcta

SEQ ID NO: 3472937 - DNA, 15 bp, Homo sapiens
aggatccagcctcac

SEQ ID NO: 3472938 - DNA, 17 bp, Homo sapiens
aggatccctctctggat

SEQ ID NO: 3472939 - DNA, 16 bp, Homo sapiens
aggatctaaggctgtt

SEQ ID NO: 3472940 - DNA, 12 bp, Homo sapiens
aggatctcttga

SEQ ID NO: 3472941 - DNA, 19 bp, Homo sapiens
aggatctcttgagcctggg

SEQ ID NO: 3472942 - DNA, 18 bp, Homo sapiens
aggatctttgtggccaag

SEQ ID NO: 3472943 - DNA, 13 bp, Homo sapiens
aggatcttttgaa

SEQ ID NO: 3472944 - DNA, 20 bp, Homo sapiens
aggatgagctctacccaggg

SEQ ID NO: 3472945 - DNA, 18 bp, Homo sapiens
aggatgataagttccttt

SEQ ID NO: 3472946 - DNA, 14 bp, Homo sapiens
aggatggaacacgg

SEQ ID NO: 3472947 - DNA, 19 bp, Homo sapiens
aggatggaacacggccaca

SEQ ID NO: 3472948 - DNA, 13 bp, Homo sapiens
aggatggcctggc

SEQ ID NO: 3472949 - DNA, 23 bp, Homo sapiens
aggatggcctggccagggcctgg

SEQ ID NO: 3472950 - DNA, 22 bp, Homo sapiens
aggatggctggctctgcacctg

SEQ ID NO: 3472951 - DNA, 16 bp, Homo sapiens
aggatgggtcagagct

SEQ ID NO: 3472952 - DNA, 14 bp, Homo sapiens
aggatgtagctttt

SEQ ID NO: 3472953 - DNA, 16 bp, Homo sapiens
aggatgtagcttttca

SEQ ID NO: 3472954 - DNA, 20 bp, Homo sapiens
aggatgtgattgtggaatgg

SEQ ID NO: 3472955 - DNA, 21 bp, Homo sapiens
aggatgtgggggaagacctgg

SEQ ID NO: 3472956 - DNA, 13 bp, Homo sapiens
aggatgtgtttgc

SEQ ID NO: 3472957 - DNA, 17 bp, Homo sapiens
aggatgtgtttgctttc

SEQ ID NO: 3472958 - DNA, 15 bp, Homo sapiens
aggatgttctgggac

SEQ ID NO: 3472959 - DNA, 20 bp, Homo sapiens
aggatgttctgggacacagt

SEQ ID NO: 3472960 - DNA, 23 bp, Homo sapiens
aggatgtttttctttatttttgt

SEQ ID NO: 3472961 - DNA, 16 bp, Homo sapiens
aggattacatgcatgt

SEQ ID NO: 3472962 - DNA, 17 bp, Homo sapiens
aggattgctactgtcct

SEQ ID NO: 3472963 - DNA, 22 bp, Homo sapiens
aggattgctactgtcctaccca

SEQ ID NO: 3472964 - DNA, 17 bp, Homo sapiens
aggattgctgccagaga

SEQ ID NO: 3472965 - DNA, 18 bp, Homo sapiens
aggattgctgccagagaa

SEQ ID NO: 3472966 - DNA, 24 bp, Homo sapiens
aggattgctgccagagaagtctgg

SEQ ID NO: 3472967 - DNA, 23 bp, Homo sapiens
aggatttgcacagaagcacatgc

SEQ ID NO: 3472968 - DNA, 13 bp, Homo sapiens
aggattttatacc

SEQ ID NO: 3472969 - DNA, 21 bp, Homo sapiens
aggattttttttaatgtttaa

SEQ ID NO: 3472970 - DNA, 17 bp, Homo sapiens
aggcaaaattgcaaatc

SEQ ID NO: 3472971 - DNA, 20 bp, Homo sapiens
aggcaaagggtccagaagga

SEQ ID NO: 3472972 - DNA, 15 bp, Homo sapiens
aggcaaatgcccaag

SEQ ID NO: 3472973 - DNA, 15 bp, Homo sapiens
aggcaaatgggatgg

SEQ ID NO: 3472974 - DNA, 16 bp, Homo sapiens
aggcaacatccaaaat

SEQ ID NO: 3472975 - DNA, 19 bp, Homo sapiens
aggcaactgcattggcttt

SEQ ID NO: 3472976 - DNA, 18 bp, Homo sapiens
aggcaagcacctcctgcc

SEQ ID NO: 3472977 - DNA, 17 bp, Homo sapiens
aggcaagccagcatgtg

SEQ ID NO: 3472978 - DNA, 15 bp, Homo sapiens
aggcaatcctacctt

SEQ ID NO: 3472979 - DNA, 16 bp, Homo sapiens
aggcaatgctggctgt

SEQ ID NO: 3472980 - DNA, 19 bp, Homo sapiens
aggcaattctcctgccttt

SEQ ID NO: 3472981 - DNA, 18 bp, Homo sapiens
aggcacaggacacctggc

SEQ ID NO: 3472982 - DNA, 22 bp, Homo sapiens
aggcacccaccatcatgtctgg

SEQ ID NO: 3472983 - DNA, 12 bp, Homo sapiens
aggcacctcaag

SEQ ID NO: 3472984 - DNA, 15 bp, Homo sapiens
aggcactgaagcccg

SEQ ID NO: 3472985 - DNA, 23 bp, Homo sapiens
aggcactgagataccagcgagga

SEQ ID NO: 3472986 - DNA, 22 bp, Homo sapiens
aggcactttagggctgtaaaat

SEQ ID NO: 3472987 - DNA, 14 bp, Homo sapiens
aggcagaaggcagt

SEQ ID NO: 3472988 - DNA, 11 bp, Homo sapiens
aggcagatcca

SEQ ID NO: 3472989 - DNA, 15 bp, Homo sapiens
aggcagatccaggac

SEQ ID NO: 3472990 - DNA, 16 bp, Homo sapiens
aggcagatccaggact

SEQ ID NO: 3472991 - DNA, 17 bp, Homo sapiens
aggcagatccaggacta

SEQ ID NO: 3472992 - DNA, 17 bp, Homo sapiens
aggcagccccattctgc

SEQ ID NO: 3472993 - DNA, 16 bp, Homo sapiens
aggcagcgaccccagg

SEQ ID NO: 3472994 - DNA, 18 bp, Homo sapiens
aggcaggctaaggcgtgg

SEQ ID NO: 3472995 - DNA, 22 bp, Homo sapiens
aggcaggctaaggcgtggagct

SEQ ID NO: 3472996 - DNA, 21 bp, Homo sapiens
aggcagggaagtgtaagaaac

SEQ ID NO: 3472997 - DNA, 22 bp, Homo sapiens
aggcaggtcttgaactcctggc

SEQ ID NO: 3472998 - DNA, 19 bp, Homo sapiens
aggcagtttcagagatgga

SEQ ID NO: 3472999 - DNA, 21 bp, Homo sapiens
aggcatacgagagcagaggtc

SEQ ID NO: 3473000 - DNA, 20 bp, Homo sapiens
aggcatccagcagtctctgc

SEQ ID NO: 3473001 - DNA, 23 bp, Homo sapiens
aggcatccagcagtctctgcctt

SEQ ID NO: 3473002 - DNA, 18 bp, Homo sapiens
aggcatccttcctcacac

SEQ ID NO: 3473003 - DNA, 20 bp, Homo sapiens
aggcatgggtgcaaggaaaa

SEQ ID NO: 3473004 - DNA, 21 bp, Homo sapiens
aggcatgggtgcaaggaaaat

SEQ ID NO: 3473005 - DNA, 15 bp, Homo sapiens
aggcatggtggccca

SEQ ID NO: 3473006 - DNA, 19 bp, Homo sapiens
aggcatgttctctgaggac

SEQ ID NO: 3473007 - DNA, 22 bp, Homo sapiens
aggcatgttctctgaggacact

SEQ ID NO: 3473008 - DNA, 13 bp, Homo sapiens
aggcattaacaca

SEQ ID NO: 3473009 - DNA, 19 bp, Homo sapiens
aggcattaacacaaaggag

SEQ ID NO: 3473010 - DNA, 14 bp, Homo sapiens
aggcattgccaagg

SEQ ID NO: 3473011 - DNA, 16 bp, Homo sapiens
aggcattgccaagggc

SEQ ID NO: 3473012 - DNA, 21 bp, Homo sapiens
aggcattgccaagggctttgt

SEQ ID NO: 3473013 - DNA, 14 bp, Homo sapiens
aggcatttcctgct

SEQ ID NO: 3473014 - DNA, 14 bp, Homo sapiens
aggccaaacctctg

SEQ ID NO: 3473015 - DNA, 17 bp, Homo sapiens
aggccaaacctctgttc

SEQ ID NO: 3473016 - DNA, 18 bp, Homo sapiens
aggccaaacctctgttca

SEQ ID NO: 3473017 - DNA, 17 bp, Homo sapiens
aggccaaaggctggtgg

SEQ ID NO: 3473018 - DNA, 23 bp, Homo sapiens
aggccaacactgtgggtgtgtga

SEQ ID NO: 3473019 - DNA, 21 bp, Homo sapiens
aggccaagcagtgcctgccta

SEQ ID NO: 3473020 - DNA, 15 bp, Homo sapiens
aggccacctccccag

SEQ ID NO: 3473021 - DNA, 14 bp, Homo sapiens
aggccagagccaag

SEQ ID NO: 3473022 - DNA, 16 bp, Homo sapiens
aggccagcacccaaag

SEQ ID NO: 3473023 - DNA, 22 bp, Homo sapiens
aggccagccagtgacctgagga

SEQ ID NO: 3473024 - DNA, 21 bp, Homo sapiens
aggccagctatctgcctgaca

SEQ ID NO: 3473025 - DNA, 22 bp, Homo sapiens
aggccagctatctgcctgacag

SEQ ID NO: 3473026 - DNA, 24 bp, Homo sapiens
aggccagctatctgcctgacaggc

SEQ ID NO: 3473027 - DNA, 16 bp, Homo sapiens
aggccagctggcagca

SEQ ID NO: 3473028 - DNA, 18 bp, Homo sapiens
aggccagctggcagcaga

SEQ ID NO: 3473029 - DNA, 19 bp, Homo sapiens
aggccagctggcagcagag

SEQ ID NO: 3473030 - DNA, 15 bp, Homo sapiens
agccaagctccttgg

SEQ ID NO: 3473031 - DNA, 17 bp, Homo sapiens
agccaagctccttggga

SEQ ID NO: 3473032 - DNA, 19 bp, Homo sapiens
agccaagcttcaaccctca

SEQ ID NO: 3473033 - DNA, 17 bp, Homo sapiens
agccaaggatagaagct

SEQ ID NO: 3473034 - DNA, 21 bp, Homo sapiens
agccaagggaacctgtgtccg

SEQ ID NO: 3473035 - DNA, 17 bp, Homo sapiens
agccaagtagcctctcc

SEQ ID NO: 3473036 - DNA, 15 bp, Homo sapiens
agccaattatgttaa

SEQ ID NO: 3473037 - DNA, 17 bp, Homo sapiens
agccaattcagacaggc

SEQ ID NO: 3473038 - DNA, 22 bp, Homo sapiens
agccacaggcctgagatttcat

SEQ ID NO: 3473039 - DNA, 20 bp, Homo sapiens
agccacagggtctgcctcca

SEQ ID NO: 3473040 - DNA, 21 bp, Homo sapiens
agccacagggtctgcctccag

SEQ ID NO: 3473041 - DNA, 23 bp, Homo sapiens
agccacatttggaatactttttg

SEQ ID NO: 3473042 - DNA, 17 bp, Homo sapiens
agccaccacacctggct

SEQ ID NO: 3473043 - DNA, 13 bp, Homo sapiens
agccacccctgag

SEQ ID NO: 3473044 - DNA, 15 bp, Homo sapiens
agccacggccaggcc

SEQ ID NO: 3473045 - DNA, 18 bp, Homo sapiens
agccacggccaggccaga

SEQ ID NO: 3473046 - DNA, 14 bp, Homo sapiens
agccactcccctcc

SEQ ID NO: 3473047 - DNA, 13 bp, Homo sapiens
agccactcctctg

SEQ ID NO: 3473048 - DNA, 22 bp, Homo sapiens
agccactcctctgactcagggc

SEQ ID NO: 3473049 - DNA, 17 bp, Homo sapiens
agccacttaaaatgttc

SEQ ID NO: 3473050 - DNA, 15 bp, Homo sapiens
agccagaagctgagc

SEQ ID NO: 3473051 - DNA, 20 bp, Homo sapiens
agccagaagctgagcaccag

SEQ ID NO: 3473052 - DNA, 19 bp, Homo sapiens
agccagaatctcattactg

SEQ ID NO: 3473053 - DNA, 18 bp, Homo sapiens
agccagcacacagggcag

SEQ ID NO: 3473054 - DNA, 13 bp, Homo sapiens
agccagcacctgg

SEQ ID NO: 3473055 - DNA, 18 bp, Homo sapiens
agccagcagcagcccaag

SEQ ID NO: 3473056 - DNA, 20 bp, Homo sapiens
agccagcccaagtagagggg

SEQ ID NO: 3473057 - DNA, 22 bp, Homo sapiens
agccagcgggaatggcagctgc

SEQ ID NO: 3473058 - DNA, 19 bp, Homo sapiens
agccagcgtcctcctctgt

SEQ ID NO: 3473059 - DNA, 15 bp, Homo sapiens
agccagctcacagtg

SEQ ID NO: 3473060 - DNA, 21 bp, Homo sapiens
agccagctcacagtgctgtgt

SEQ ID NO: 3473061 - DNA, 15 bp, Homo sapiens
agccagctccctcta

SEQ ID NO: 3473062 - DNA, 14 bp, Homo sapiens
agccagctgcccta

SEQ ID NO: 3473063 - DNA, 13 bp, Homo sapiens
agccagctgccta

SEQ ID NO: 3473064 - DNA, 15 bp, Homo sapiens
agccagctgcctagg

SEQ ID NO: 3473065 - DNA, 22 bp, Homo sapiens
agccagctgcctaggtccccca

SEQ ID NO: 3473066 - DNA, 16 bp, Homo sapiens
agccagctgctcccca

SEQ ID NO: 3473067 - DNA, 19 bp, Homo sapiens
agccaggaatttcccagga

SEQ ID NO: 3473068 - DNA, 13 bp, Homo sapiens
agccaggagcgca

SEQ ID NO: 3473069 - DNA, 12 bp, Homo sapiens
agccagggctgc

SEQ ID NO: 3473070 - DNA, 17 bp, Homo sapiens
agccagtgacctgagga

SEQ ID NO: 3473071 - DNA, 21 bp, Homo sapiens
agccagtttgccggatacaaa

SEQ ID NO: 3473072 - DNA, 15 bp, Homo sapiens
agccatcaaaatgct

SEQ ID NO: 3473073 - DNA, 13 bp, Homo sapiens
agccatcatggat

SEQ ID NO: 3473074 - DNA, 21 bp, Homo sapiens
agccatgagatgatacatcca

SEQ ID NO: 3473075 - DNA, 23 bp, Homo sapiens
agccatgcgccccctccgccctg

SEQ ID NO: 3473076 - DNA, 15 bp, Homo sapiens
agccatgtctgcatt

SEQ ID NO: 3473077 - DNA, 22 bp, Homo sapiens
agccatgtgaaactcatctcat

SEQ ID NO: 3473078 - DNA, 20 bp, Homo sapiens
agccattgcacccagcccag

SEQ ID NO: 3473079 - DNA, 18 bp, Homo sapiens
agccatttttcaaagcaa

SEQ ID NO: 3473080 - DNA, 19 bp, Homo sapiens
agccatttttcaaagcaat

SEQ ID NO: 3473081 - DNA, 15 bp, Homo sapiens
agcccaagcttccct

SEQ ID NO: 3473082 - DNA, 15 bp, Homo sapiens
agcccacccctcaac

SEQ ID NO: 3473083 - DNA, 13 bp, Homo sapiens
agcccaccttggc

SEQ ID NO: 3473084 - DNA, 16 bp, Homo sapiens
agcccaccttggctca

SEQ ID NO: 3473085 - DNA, 15 bp, Homo sapiens
agcccactctgctcg

SEQ ID NO: 3473086 - DNA, 23 bp, Homo sapiens
agcccactgtcctgggcctgcag

SEQ ID NO: 3473087 - DNA, 13 bp, Homo sapiens
agcccacttctgc

SEQ ID NO: 3473088 - DNA, 14 bp, Homo sapiens
agcccacttctgcc

SEQ ID NO: 3473089 - DNA, 11 bp, Homo sapiens
agcccagagac

SEQ ID NO: 3473090 - DNA, 12 bp, Homo sapiens
agcccagagaca

SEQ ID NO: 3473091 - DNA, 16 bp, Homo sapiens
agcccagaggagggca

SEQ ID NO: 3473092 - DNA, 21 bp, Homo sapiens
agcccagcactgcttgaggaa

SEQ ID NO: 3473093 - DNA, 17 bp, Homo sapiens
agcccagcccctactgc

SEQ ID NO: 3473094 - DNA, 13 bp, Homo sapiens
agcccagccctcc

SEQ ID NO: 3473095 - DNA, 12 bp, Homo sapiens
agcccagctcca

SEQ ID NO: 3473096 - DNA, 17 bp, Homo sapiens
agcccagctgggtcagg

SEQ ID NO: 3473097 - DNA, 23 bp, Homo sapiens
agacagagaatatgtctgctcct

SEQ ID NO: 3473098 - DNA, 16 bp, Homo sapiens
agacagagacctcctg

SEQ ID NO: 3473099 - DNA, 19 bp, Homo sapiens
agacagagacctcctgcct

SEQ ID NO: 3473100 - DNA, 15 bp, Homo sapiens
agacagagaggactg

SEQ ID NO: 3473101 - DNA, 21 bp, Homo sapiens
agacagagtctcactgttgcc

SEQ ID NO: 3473102 - DNA, 19 bp, Homo sapiens
agacagccaaaggctggcg

SEQ ID NO: 3473103 - DNA, 23 bp, Homo sapiens
agacagcttctcatcctgcaggc

SEQ ID NO: 3473104 - DNA, 23 bp, Homo sapiens
agacaggcaagcacctcctgcct

SEQ ID NO: 3473105 - DNA, 23 bp, Homo sapiens
agacagggtttcaccatgttgcc

SEQ ID NO: 3473106 - DNA, 21 bp, Homo sapiens
agacagggtttggctgtgtct

SEQ ID NO: 3473107 - DNA, 22 bp, Homo sapiens
agacagggtttggctgtgtcta

SEQ ID NO: 3473108 - DNA, 21 bp, Homo sapiens
agacagggttttgccatgttg

SEQ ID NO: 3473109 - DNA, 16 bp, Homo sapiens
agacaggtggcctagc

SEQ ID NO: 3473110 - DNA, 17 bp, Homo sapiens
agacagtcaccccagga

SEQ ID NO: 3473111 - DNA, 14 bp, Homo sapiens
agacatacttgaag

SEQ ID NO: 3473112 - DNA, 17 bp, Homo sapiens
agacatacttgaagggc

SEQ ID NO: 3473113 - DNA, 12 bp, Homo sapiens
agacatcttcag

SEQ ID NO: 3473114 - DNA, 20 bp, Homo sapiens
agacatgagtgcgtgctcag

SEQ ID NO: 3473115 - DNA, 15 bp, Homo sapiens
agacatgatttcctt

SEQ ID NO: 3473116 - DNA, 23 bp, Homo sapiens
agacatgccacaaggacttcctg

SEQ ID NO: 3473117 - DNA, 21 bp, Homo sapiens
agacattctcgcttccctgaa

SEQ ID NO: 3473118 - DNA, 19 bp, Homo sapiens
agacattctgccaggcccc

SEQ ID NO: 3473119 - DNA, 13 bp, Homo sapiens
agaccaaaatgaa

SEQ ID NO: 3473120 - DNA, 19 bp, Homo sapiens
agaccagcctggccaacat

SEQ ID NO: 3473121 - DNA, 12 bp, Homo sapiens
agaccagctctt

SEQ ID NO: 3473122 - DNA, 15 bp, Homo sapiens
agaccagggagcctt

SEQ ID NO: 3473123 - DNA, 22 bp, Homo sapiens
agaccagttagattattgaaat

SEQ ID NO: 3473124 - DNA, 13 bp, Homo sapiens
agacccagatctc

SEQ ID NO: 3473125 - DNA, 14 bp, Homo sapiens
agacccggctgcgt

SEQ ID NO: 3473126 - DNA, 13 bp, Homo sapiens
agacctcagggca

SEQ ID NO: 3473127 - DNA, 11 bp, Homo sapiens
agacctctgag

SEQ ID NO: 3473128 - DNA, 17 bp, Homo sapiens
agacctctgagaccaaa

SEQ ID NO: 3473129 - DNA, 11 bp, Homo sapiens
agacctctgga

SEQ ID NO: 3473130 - DNA, 17 bp, Homo sapiens
agacctgagggaccctt

SEQ ID NO: 3473131 - DNA, 14 bp, Homo sapiens
agacctgatcctgg

SEQ ID NO: 3473132 - DNA, 18 bp, Homo sapiens
agacctgatcctggaggc

SEQ ID NO: 3473133 - DNA, 14 bp, Homo sapiens
agacctggcagctc

SEQ ID NO: 3473134 - DNA, 19 bp, Homo sapiens
agacctgttagcagacagg

SEQ ID NO: 3473135 - DNA, 19 bp, Homo sapiens
agacctgttggtataggaa

SEQ ID NO: 3473136 - DNA, 20 bp, Homo sapiens
agaccttcacagatgcctac

SEQ ID NO: 3473137 - DNA, 21 bp, Homo sapiens
agaccttgttacttctgaggt

SEQ ID NO: 3473138 - DNA, 21 bp, Homo sapiens
agacgacaaggaaaggcaaat

SEQ ID NO: 3473139 - DNA, 13 bp, Homo sapiens
agacgcctgagga

SEQ ID NO: 3473140 - DNA, 21 bp, Homo sapiens
agacggaggcctactcttcca

SEQ ID NO: 3473141 - DNA, 16 bp, Homo sapiens
agacggaggggagtag

SEQ ID NO: 3473142 - DNA, 16 bp, Homo sapiens
agacggtgttttgcca

SEQ ID NO: 3473143 - DNA, 19 bp, Homo sapiens
agactcaggccaagaaacg

SEQ ID NO: 3473144 - DNA, 23 bp, Homo sapiens
agactcccattcctgaagaacca

SEQ ID NO: 3473145 - DNA, 16 bp, Homo sapiens
agactccgcctgaggc

SEQ ID NO: 3473146 - DNA, 11 bp, Homo sapiens
agactcctagg

SEQ ID NO: 3473147 - DNA, 22 bp, Homo sapiens
agactcctaggcaggacatgct

SEQ ID NO: 3473148 - DNA, 14 bp, Homo sapiens
agactcgagaactt

SEQ ID NO: 3473149 - DNA, 15 bp, Homo sapiens
agactctccttcagg

SEQ ID NO: 3473150 - DNA, 19 bp, Homo sapiens
agactctcgcatcttccca

SEQ ID NO: 3473151 - DNA, 15 bp, Homo sapiens
agactgaggggtcga

SEQ ID NO: 3473152 - DNA, 16 bp, Homo sapiens
agactgatcaggacct

SEQ ID NO: 3473153 - DNA, 18 bp, Homo sapiens
agactggaacactagaca

SEQ ID NO: 3473154 - DNA, 16 bp, Homo sapiens
agactggaagcacagc

SEQ ID NO: 3473155 - DNA, 19 bp, Homo sapiens
agactggaagctaatttgc

SEQ ID NO: 3473156 - DNA, 18 bp, Homo sapiens
agactgggctctggctct

SEQ ID NO: 3473157 - DNA, 12 bp, Homo sapiens
agactgggctga

SEQ ID NO: 3473158 - DNA, 14 bp, Homo sapiens
agactgggctgagg

SEQ ID NO: 3473159 - DNA, 15 bp, Homo sapiens
agactgggctgaggg

SEQ ID NO: 3473160 - DNA, 20 bp, Homo sapiens
agactgggctgagggagcct

SEQ ID NO: 3473161 - DNA, 22 bp, Homo sapiens
agactgtgtaaaatgtaatgca

SEQ ID NO: 3473162 - DNA, 11 bp, Homo sapiens
agactgttggg

SEQ ID NO: 3473163 - DNA, 17 bp, Homo sapiens
agacttaatagaaacat

SEQ ID NO: 3473164 - DNA, 14 bp, Homo sapiens
agacttcccagcta

SEQ ID NO: 3473165 - DNA, 16 bp, Homo sapiens
agacttccctaacact

SEQ ID NO: 3473166 - DNA, 19 bp, Homo sapiens
agacttccctgaatgtatt

SEQ ID NO: 3473167 - DNA, 15 bp, Homo sapiens
agacttgccatgtga

SEQ ID NO: 3473168 - DNA, 11 bp, Homo sapiens
agacttgcctt

SEQ ID NO: 3473169 - DNA, 13 bp, Homo sapiens
agacttgccttcc

SEQ ID NO: 3473170 - DNA, 19 bp, Homo sapiens
agactttgtttttaaaatg

SEQ ID NO: 3473171 - DNA, 16 bp, Homo sapiens
agagaaaaaaaaaata

SEQ ID NO: 3473172 - DNA, 22 bp, Homo sapiens
agagaaaaaatattttcctgcc

SEQ ID NO: 3473173 - DNA, 15 bp, Homo sapiens
agagaaaaacaaatt

SEQ ID NO: 3473174 - DNA, 17 bp, Homo sapiens
agagaaaaaggctgaaa

SEQ ID NO: 3473175 - DNA, 19 bp, Homo sapiens
agagaaaaaggctgaaaag

SEQ ID NO: 3473176 - DNA, 16 bp, Homo sapiens
agagaaaatatatgta

SEQ ID NO: 3473177 - DNA, 18 bp, Homo sapiens
agagaaagtacttctcca

SEQ ID NO: 3473178 - DNA, 20 bp, Homo sapiens
agagaaatcaatagtgcaac

SEQ ID NO: 3473179 - DNA, 13 bp, Homo sapiens
agagaacaggact

SEQ ID NO: 3473180 - DNA, 14 bp, Homo sapiens
agagaacaggacta

SEQ ID NO: 3473181 - DNA, 13 bp, Homo sapiens
agagaacatttta

SEQ ID NO: 3473182 - DNA, 18 bp, Homo sapiens
agagaacattttactgtt

SEQ ID NO: 3473183 - DNA, 18 bp, Homo sapiens
agagaactttattttgga

SEQ ID NO: 3473184 - DNA, 21 bp, Homo sapiens
agagaactttattttggattg

SEQ ID NO: 3473185 - DNA, 18 bp, Homo sapiens
agagaaggggtgtgcatg

SEQ ID NO: 3473186 - DNA, 17 bp, Homo sapiens
agagaagtctggtcaga

SEQ ID NO: 3473187 - DNA, 17 bp, Homo sapiens
agagaatgagagcgaca

SEQ ID NO: 3473188 - DNA, 23 bp, Homo sapiens
agagaatgagagcgacacagacg

SEQ ID NO: 3473189 - DNA, 23 bp, Homo sapiens
agagaatgataggcttttgttct

SEQ ID NO: 3473190 - DNA, 16 bp, Homo sapiens
agagaatgttccagac

SEQ ID NO: 3473191 - DNA, 12 bp, Homo sapiens
agagacagtcac

SEQ ID NO: 3473192 - DNA, 19 bp, Homo sapiens
agcaacagcctttgaatgt

SEQ ID NO: 3473193 - DNA, 19 bp, Homo sapiens
agcaacaggaatctcagag

SEQ ID NO: 3473194 - DNA, 21 bp, Homo sapiens
agcaacatctagcaaatgtta

SEQ ID NO: 3473195 - DNA, 22 bp, Homo sapiens
agcaacattttacccacacaca

SEQ ID NO: 3473196 - DNA, 21 bp, Homo sapiens
agcaacattttcttgaatttt

SEQ ID NO: 3473197 - DNA, 14 bp, Homo sapiens
agcaaccccaggct

SEQ ID NO: 3473198 - DNA, 15 bp, Homo sapiens
agcaaccccaggctg

SEQ ID NO: 3473199 - DNA, 16 bp, Homo sapiens
agcaactcttgattat

SEQ ID NO: 3473200 - DNA, 17 bp, Homo sapiens
agcaagaactgcacggt

SEQ ID NO: 3473201 - DNA, 11 bp, Homo sapiens
agcaagctccc

SEQ ID NO: 3473202 - DNA, 18 bp, Homo sapiens
agcaagggggtgatgtag

SEQ ID NO: 3473203 - DNA, 13 bp, Homo sapiens
agcaagtgagagc

SEQ ID NO: 3473204 - DNA, 14 bp, Homo sapiens
agcaagtgagagct

SEQ ID NO: 3473205 - DNA, 17 bp, Homo sapiens
agcaagtgagagctggg

SEQ ID NO: 3473206 - DNA, 13 bp, Homo sapiens
agcaagtggtcct

SEQ ID NO: 3473207 - DNA, 15 bp, Homo sapiens
agcaagttttcttcc

SEQ ID NO: 3473208 - DNA, 12 bp, Homo sapiens
agcaatatgcat

SEQ ID NO: 3473209 - DNA, 19 bp, Homo sapiens
agcaatcctaggtagggtt

SEQ ID NO: 3473210 - DNA, 23 bp, Homo sapiens
agcaatcctctcacctcagcctc

SEQ ID NO: 3473211 - DNA, 16 bp, Homo sapiens
agcaatggatatttgt

SEQ ID NO: 3473212 - DNA, 20 bp, Homo sapiens
agcaatttatacaatatcat

SEQ ID NO: 3473213 - DNA, 22 bp, Homo sapiens
agcaatttccccctaaaccaac

SEQ ID NO: 3473214 - DNA, 14 bp, Homo sapiens
agcacactcatccc

SEQ ID NO: 3473215 - DNA, 23 bp, Homo sapiens
agcacagcagcctggggctggcc

SEQ ID NO: 3473216 - DNA, 23 bp, Homo sapiens
agcacagccaacacgcacctgcc

SEQ ID NO: 3473217 - DNA, 21 bp, Homo sapiens
agcacaggtgggcttcccagt

SEQ ID NO: 3473218 - DNA, 16 bp, Homo sapiens
agcacatctgcatttt

SEQ ID NO: 3473219 - DNA, 23 bp, Homo sapiens
agcacatctgcattttcacccca

SEQ ID NO: 3473220 - DNA, 22 bp, Homo sapiens
agcaccaaaagcttaccaaggg

SEQ ID NO: 3473221 - DNA, 17 bp, Homo sapiens
agcaccaagctcaaagc

SEQ ID NO: 3473222 - DNA, 20 bp, Homo sapiens
agcaccattttaagtccctg

SEQ ID NO: 3473223 - DNA, 19 bp, Homo sapiens
agcacccagatcagactct

SEQ ID NO: 3473224 - DNA, 18 bp, Homo sapiens
agcacccctactcacata

SEQ ID NO: 3473225 - DNA, 21 bp, Homo sapiens
agcaccgtgtcaagctgctct

SEQ ID NO: 3473226 - DNA, 22 bp, Homo sapiens
agcaccgtgtcaagctgctctg

SEQ ID NO: 3473227 - DNA, 17 bp, Homo sapiens
agcaccgttctgtgcac

SEQ ID NO: 3473228 - DNA, 19 bp, Homo sapiens
agcacggtgactctgtcca

SEQ ID NO: 3473229 - DNA, 17 bp, Homo sapiens
agcactcaggctctcca

SEQ ID NO: 3473230 - DNA, 14 bp, Homo sapiens
agcactgaggaaga

SEQ ID NO: 3473231 - DNA, 21 bp, Homo sapiens
agcactgaggaagaacggggc

SEQ ID NO: 3473232 - DNA, 14 bp, Homo sapiens
agcactgccaccag

SEQ ID NO: 3473233 - DNA, 17 bp, Homo sapiens
agcactgcttgaggaaa

SEQ ID NO: 3473234 - DNA, 21 bp, Homo sapiens
agcactgggctcccgggcccc

SEQ ID NO: 3473235 - DNA, 18 bp, Homo sapiens
agcacttaagagaatatt

SEQ ID NO: 3473236 - DNA, 23 bp, Homo sapiens
agcacttcatctggctgcctttg

SEQ ID NO: 3473237 - DNA, 19 bp, Homo sapiens
agcactttgcaaggaatgt

SEQ ID NO: 3473238 - DNA, 22 bp, Homo sapiens
agcactttgggaggccaaggtg

SEQ ID NO: 3473239 - DNA, 15 bp, Homo sapiens
agcagaaccagcctc

SEQ ID NO: 3473240 - DNA, 16 bp, Homo sapiens
agcagaaccttaaaca

SEQ ID NO: 3473241 - DNA, 22 bp, Homo sapiens
agcagaagggggtggtgtctcc

SEQ ID NO: 3473242 - DNA, 23 bp, Homo sapiens
agcagaagggggtggtgtctcca

SEQ ID NO: 3473243 - DNA, 17 bp, Homo sapiens
agcagactgatcaggac

SEQ ID NO: 3473244 - DNA, 19 bp, Homo sapiens
agcagactttctctgtgta

SEQ ID NO: 3473245 - DNA, 23 bp, Homo sapiens
agcagagaatgaaagggcccaga

SEQ ID NO: 3473246 - DNA, 21 bp, Homo sapiens
agcagagcccggagctccggc

SEQ ID NO: 3473247 - DNA, 12 bp, Homo sapiens
agcagaggaggg

SEQ ID NO: 3473248 - DNA, 15 bp, Homo sapiens
agcagaggaggggcc

SEQ ID NO: 3473249 - DNA, 13 bp, Homo sapiens
agaacctggaact

SEQ ID NO: 3473250 - DNA, 19 bp, Homo sapiens
agaacggggctcttctcat

SEQ ID NO: 3473251 - DNA, 21 bp, Homo sapiens
agaacggggctcttctcattt

SEQ ID NO: 3473252 - DNA, 18 bp, Homo sapiens
agaactaaactcatttat

SEQ ID NO: 3473253 - DNA, 18 bp, Homo sapiens
agaactacaaacaaaatt

SEQ ID NO: 3473254 - DNA, 19 bp, Homo sapiens
agaactcaaatggggccag

SEQ ID NO: 3473255 - DNA, 20 bp, Homo sapiens
agaactcaaatggggccaga

SEQ ID NO: 3473256 - DNA, 15 bp, Homo sapiens
agaactcatcactgt

SEQ ID NO: 3473257 - DNA, 11 bp, Homo sapiens
agaactcctag

SEQ ID NO: 3473258 - DNA, 14 bp, Homo sapiens
agaactctttcaaa

SEQ ID NO: 3473259 - DNA, 16 bp, Homo sapiens
agaactgcaggccctg

SEQ ID NO: 3473260 - DNA, 20 bp, Homo sapiens
agaactgcaggccctggcct

SEQ ID NO: 3473261 - DNA, 13 bp, Homo sapiens
agaactgtgccac

SEQ ID NO: 3473262 - DNA, 19 bp, Homo sapiens
agaactgtgtttcaagttc

SEQ ID NO: 3473263 - DNA, 20 bp, Homo sapiens
agaactgtgtttcaagttca

SEQ ID NO: 3473264 - DNA, 21 bp, Homo sapiens
agaactgtgtttcaagttcaa

SEQ ID NO: 3473265 - DNA, 15 bp, Homo sapiens
agaacttgcagtgtc

SEQ ID NO: 3473266 - DNA, 14 bp, Homo sapiens
agaactttcatttt

SEQ ID NO: 3473267 - DNA, 20 bp, Homo sapiens
agaactttgcatagcagctg

SEQ ID NO: 3473268 - DNA, 20 bp, Homo sapiens
agaagaaaatggaaccaggc

SEQ ID NO: 3473269 - DNA, 21 bp, Homo sapiens
agaagaactgtgtttcaagtt

SEQ ID NO: 3473270 - DNA, 13 bp, Homo sapiens
agaagacaaaaag

SEQ ID NO: 3473271 - DNA, 15 bp, Homo sapiens
agaagacaaaaagac

SEQ ID NO: 3473272 - DNA, 15 bp, Homo sapiens
agaagacaattgaca

SEQ ID NO: 3473273 - DNA, 21 bp, Homo sapiens
agaagagattgtggtttcatt

SEQ ID NO: 3473274 - DNA, 17 bp, Homo sapiens
agaagatcctaaaacaa

SEQ ID NO: 3473275 - DNA, 12 bp, Homo sapiens
agaagcccccag

SEQ ID NO: 3473276 - DNA, 23 bp, Homo sapiens
agaagcccccagctaagaacctg

SEQ ID NO: 3473277 - DNA, 19 bp, Homo sapiens
agaagcgatttaagttaca

SEQ ID NO: 3473278 - DNA, 15 bp, Homo sapiens
agaagcggctggcag

SEQ ID NO: 3473279 - DNA, 21 bp, Homo sapiens
agaagctataaattcctcttt

SEQ ID NO: 3473280 - DNA, 20 bp, Homo sapiens
agaagctcctctccccagcc

SEQ ID NO: 3473281 - DNA, 23 bp, Homo sapiens
agaagctcctctccccagcccag

SEQ ID NO: 3473282 - DNA, 16 bp, Homo sapiens
agaagggaatcctcct

SEQ ID NO: 3473283 - DNA, 19 bp, Homo sapiens
agaagggagctagccagag

SEQ ID NO: 3473284 - DNA, 22 bp, Homo sapiens
agaagggctgaaccctcagcct

SEQ ID NO: 3473285 - DNA, 13 bp, Homo sapiens
agaagggggtggt

SEQ ID NO: 3473286 - DNA, 19 bp, Homo sapiens
agaagggtgtggcatttgg

SEQ ID NO: 3473287 - DNA, 13 bp, Homo sapiens
agaaggtgcctgc

SEQ ID NO: 3473288 - DNA, 20 bp, Homo sapiens
agaaggtgcctgccatagcc

SEQ ID NO: 3473289 - DNA, 17 bp, Homo sapiens
agaaggtgttggacagg

SEQ ID NO: 3473290 - DNA, 18 bp, Homo sapiens
agaaggttaagtcaggga

SEQ ID NO: 3473291 - DNA, 14 bp, Homo sapiens
agaagtcacacagt

SEQ ID NO: 3473292 - DNA, 20 bp, Homo sapiens
agaagtcatggcccaaatcc

SEQ ID NO: 3473293 - DNA, 17 bp, Homo sapiens
agaagtccttatgttaa

SEQ ID NO: 3473294 - DNA, 14 bp, Homo sapiens
agaagtctggtcag

SEQ ID NO: 3473295 - DNA, 19 bp, Homo sapiens
agaagtctggtcagagcca

SEQ ID NO: 3473296 - DNA, 20 bp, Homo sapiens
agaagtctggtcagagccac

SEQ ID NO: 3473297 - DNA, 23 bp, Homo sapiens
agaagtctggtcagagccacagg

SEQ ID NO: 3473298 - DNA, 21 bp, Homo sapiens
agaagtgaatgctgggactca

SEQ ID NO: 3473299 - DNA, 15 bp, Homo sapiens
agaagtgctcccctc

SEQ ID NO: 3473300 - DNA, 15 bp, Homo sapiens
agaagttaagcaaca

SEQ ID NO: 3473301 - DNA, 19 bp, Homo sapiens
agaagttcagaaatttaaa

SEQ ID NO: 3473302 - DNA, 22 bp, Homo sapiens
agaagtttgagatcagcctggg

SEQ ID NO: 3473303 - DNA, 21 bp, Homo sapiens
agaagtttgcactatctttca

SEQ ID NO: 3473304 - DNA, 14 bp, Homo sapiens
agaataaaatgttg

SEQ ID NO: 3473305 - DNA, 20 bp, Homo sapiens
agaataaaggtatgaaaggg

SEQ ID NO: 3473306 - DNA, 15 bp, Homo sapiens
agaataagtgtcttt

SEQ ID NO: 3473307 - DNA, 16 bp, Homo sapiens
agaataatttatagta

SEQ ID NO: 3473308 - DNA, 22 bp, Homo sapiens
agaataatttatagtaatgagt

SEQ ID NO: 3473309 - DNA, 22 bp, Homo sapiens
agaatacaagatattatgtata

SEQ ID NO: 3473310 - DNA, 23 bp, Homo sapiens
agaatacaagatattatgtataa

SEQ ID NO: 3473311 - DNA, 14 bp, Homo sapiens
agaatacagctttc

SEQ ID NO: 3473312 - DNA, 15 bp, Homo sapiens
agaatacagctttct

SEQ ID NO: 3473313 - DNA, 19 bp, Homo sapiens
agaatactgttaaaggaaa

SEQ ID NO: 3473314 - DNA, 12 bp, Homo sapiens
agaatacttgaa

SEQ ID NO: 3473315 - DNA, 14 bp, Homo sapiens
agaatacttgaact

SEQ ID NO: 3473316 - DNA, 22 bp, Homo sapiens
agaatagcatctgtacaaaggg

SEQ ID NO: 3473317 - DNA, 21 bp, Homo sapiens
agaatagccacatttggaata

SEQ ID NO: 3473318 - DNA, 18 bp, Homo sapiens
agaataggcattaacaca

SEQ ID NO: 3473319 - DNA, 21 bp, Homo sapiens
agaatagtcatacctggaatg

SEQ ID NO: 3473320 - DNA, 16 bp, Homo sapiens
agaatataaaaaactt

SEQ ID NO: 3473321 - DNA, 19 bp, Homo sapiens
agaatatagcatctttcat

SEQ ID NO: 3473322 - DNA, 22 bp, Homo sapiens
agaatatagcatctttcatatg

SEQ ID NO: 3473323 - DNA, 15 bp, Homo sapiens
agaatatcatctttt

SEQ ID NO: 3473324 - DNA, 16 bp, Homo sapiens
agaatatttattacct

SEQ ID NO: 3473325 - DNA, 13 bp, Homo sapiens
agaatatttctat

SEQ ID NO: 3473326 - DNA, 16 bp, Homo sapiens
agaatatttctattga

SEQ ID NO: 3473327 - DNA, 14 bp, Homo sapiens
agaatccaaacttg

SEQ ID NO: 3473328 - DNA, 12 bp, Homo sapiens
agaatccaaaga

SEQ ID NO: 3473329 - DNA, 13 bp, Homo sapiens
agaatccaaagat

SEQ ID NO: 3473330 - DNA, 15 bp, Homo sapiens
agaatcccaaatttg

SEQ ID NO: 3473331 - DNA, 17 bp, Homo sapiens
agaatcccaaatttgat

SEQ ID NO: 3473332 - DNA, 17 bp, Homo sapiens
agaatccttttgtagaa

SEQ ID NO: 3473333 - DNA, 17 bp, Homo sapiens
agaatctacccaaagga

SEQ ID NO: 3473334 - DNA, 19 bp, Homo sapiens
agaatctacccaaaggata

SEQ ID NO: 3473335 - DNA, 15 bp, Homo sapiens
agaatctcattactg

SEQ ID NO: 3473336 - DNA, 13 bp, Homo sapiens
agaatctctttcg

SEQ ID NO: 3473337 - DNA, 19 bp, Homo sapiens
agaatcttggtttgccttc

SEQ ID NO: 3473338 - DNA, 16 bp, Homo sapiens
agaatgaaagggccca

SEQ ID NO: 3473339 - DNA, 13 bp, Homo sapiens
agaatgatgctca

SEQ ID NO: 3473340 - DNA, 17 bp, Homo sapiens
agaatgcatctcatcaa

SEQ ID NO: 3473341 - DNA, 16 bp, Homo sapiens
agaatgtaagaactac

SEQ ID NO: 3473342 - DNA, 16 bp, Homo sapiens
agaatgtgccatgtat

SEQ ID NO: 3473343 - DNA, 18 bp, Homo sapiens
agaatgtgccatgtataa

SEQ ID NO: 3473344 - DNA, 14 bp, Homo sapiens
agaatgttccagac

SEQ ID NO: 3473345 - DNA, 14 bp, Homo sapiens
agaattaatttatt

SEQ ID NO: 3473346 - DNA, 14 bp, Homo sapiens
agaattactgtaac

SEQ ID NO: 3473347 - DNA, 13 bp, Homo sapiens
agaattagacatc

SEQ ID NO: 3473348 - DNA, 20 bp, Homo sapiens
agaattataattagttcctc

SEQ ID NO: 3473349 - DNA, 21 bp, Homo sapiens
agaattcattccccagctcca

SEQ ID NO: 3473350 - DNA, 20 bp, Homo sapiens
agaattccttcgaaaggcct

SEQ ID NO: 3473351 - DNA, 17 bp, Homo sapiens
agaattcttacatgttt

SEQ ID NO: 3473352 - DNA, 13 bp, Homo sapiens
actccaggcccaa

SEQ ID NO: 3473353 - DNA, 16 bp, Homo sapiens
actccagtactatttt

SEQ ID NO: 3473354 - DNA, 16 bp, Homo sapiens
actccagtatgacaga

SEQ ID NO: 3473355 - DNA, 17 bp, Homo sapiens
actccagtcctgccacc

SEQ ID NO: 3473356 - DNA, 18 bp, Homo sapiens
actccagttaaaaaaaat

SEQ ID NO: 3473357 - DNA, 20 bp, Homo sapiens
actccagttaaaaaaaattt

SEQ ID NO: 3473358 - DNA, 14 bp, Homo sapiens
actccatcagctta

SEQ ID NO: 3473359 - DNA, 11 bp, Homo sapiens
actccatctct

SEQ ID NO: 3473360 - DNA, 12 bp, Homo sapiens
actccattgtcg

SEQ ID NO: 3473361 - DNA, 13 bp, Homo sapiens
actcccttcccat

SEQ ID NO: 3473362 - DNA, 22 bp, Homo sapiens
actccgagaggtgggccagtct

SEQ ID NO: 3473363 - DNA, 15 bp, Homo sapiens
actccggccctccta

SEQ ID NO: 3473364 - DNA, 13 bp, Homo sapiens
actccggctgtgc

SEQ ID NO: 3473365 - DNA, 14 bp, Homo sapiens
actccggctgtgct

SEQ ID NO: 3473366 - DNA, 18 bp, Homo sapiens
actccgttggccactccg

SEQ ID NO: 3473367 - DNA, 21 bp, Homo sapiens
actcctaggcaggacatgctg

SEQ ID NO: 3473368 - DNA, 13 bp, Homo sapiens
actcctcacactt

SEQ ID NO: 3473369 - DNA, 14 bp, Homo sapiens
actcctctgactca

SEQ ID NO: 3473370 - DNA, 13 bp, Homo sapiens
actccttcctggc

SEQ ID NO: 3473371 - DNA, 17 bp, Homo sapiens
actccttcctggcctga

SEQ ID NO: 3473372 - DNA, 23 bp, Homo sapiens
actccttcctggcctgagagtca

SEQ ID NO: 3473373 - DNA, 21 bp, Homo sapiens
actccttctctcactgtgtta

SEQ ID NO: 3473374 - DNA, 12 bp, Homo sapiens
actcggtttctc

SEQ ID NO: 3473375 - DNA, 14 bp, Homo sapiens
actcggtttctcca

SEQ ID NO: 3473376 - DNA, 16 bp, Homo sapiens
actcggtttctccaaa

SEQ ID NO: 3473377 - DNA, 18 bp, Homo sapiens
actctacatgtaactatt

SEQ ID NO: 3473378 - DNA, 13 bp, Homo sapiens
actctaccctctt

SEQ ID NO: 3473379 - DNA, 21 bp, Homo sapiens
actctaccctcttagaaaaac

SEQ ID NO: 3473380 - DNA, 19 bp, Homo sapiens
actctacttaatccaatgg

SEQ ID NO: 3473381 - DNA, 21 bp, Homo sapiens
actctacttaatccaatgggt

SEQ ID NO: 3473382 - DNA, 20 bp, Homo sapiens
actctagatacctaaaacat

SEQ ID NO: 3473383 - DNA, 22 bp, Homo sapiens
actctagatgaagttttacatt

SEQ ID NO: 3473384 - DNA, 20 bp, Homo sapiens
actctagctgggggtgggcc

SEQ ID NO: 3473385 - DNA, 18 bp, Homo sapiens
actctataagattccaaa

SEQ ID NO: 3473386 - DNA, 19 bp, Homo sapiens
actctccccacgagggctg

SEQ ID NO: 3473387 - DNA, 22 bp, Homo sapiens
actctccccacgagggctggct

SEQ ID NO: 3473388 - DNA, 10 bp, Homo sapiens
actctccccc

SEQ ID NO: 3473389 - DNA, 15 bp, Homo sapiens
actctcctatgcctt

SEQ ID NO: 3473390 - DNA, 21 bp, Homo sapiens
actctctattgaccaccagtt

SEQ ID NO: 3473391 - DNA, 18 bp, Homo sapiens
actctctgaacccctccc

SEQ ID NO: 3473392 - DNA, 20 bp, Homo sapiens
actctgaagggcatcatgca

SEQ ID NO: 3473393 - DNA, 21 bp, Homo sapiens
actctgaagggcatcatgcat

SEQ ID NO: 3473394 - DNA, 20 bp, Homo sapiens
actctgagtgttttatgaga

SEQ ID NO: 3473395 - DNA, 21 bp, Homo sapiens
actctgagtgttttatgagaa

SEQ ID NO: 3473396 - DNA, 22 bp, Homo sapiens
actctgatagaattatttcaca

SEQ ID NO: 3473397 - DNA, 17 bp, Homo sapiens
actctgatccctctggg

SEQ ID NO: 3473398 - DNA, 18 bp, Homo sapiens
actctgatccctctgggg

SEQ ID NO: 3473399 - DNA, 12 bp, Homo sapiens
actctgcttctc

SEQ ID NO: 3473400 - DNA, 16 bp, Homo sapiens
actctgcttctctgac

SEQ ID NO: 3473401 - DNA, 22 bp, Homo sapiens
actctgcttctctgacttctgc

SEQ ID NO: 3473402 - DNA, 23 bp, Homo sapiens
actctggcaaagcttttagaaat

SEQ ID NO: 3473403 - DNA, 15 bp, Homo sapiens
actctggcttggcct

SEQ ID NO: 3473404 - DNA, 20 bp, Homo sapiens
actctgttgcaagtgcaata

SEQ ID NO: 3473405 - DNA, 17 bp, Homo sapiens
actcttaggaagagaaa

SEQ ID NO: 3473406 - DNA, 15 bp, Homo sapiens
actcttcaaatgcct

SEQ ID NO: 3473407 - DNA, 16 bp, Homo sapiens
actcttcactcttcaa

SEQ ID NO: 3473408 - DNA, 22 bp, Homo sapiens
actcttcctatttttgtagtga

SEQ ID NO: 3473409 - DNA, 16 bp, Homo sapiens
actcttgattatccat

SEQ ID NO: 3473410 - DNA, 11 bp, Homo sapiens
actctttcaaa

SEQ ID NO: 3473411 - DNA, 17 bp, Homo sapiens
actctttctgagtgcct

SEQ ID NO: 3473412 - DNA, 21 bp, Homo sapiens
actctttctgtatatactttt

SEQ ID NO: 3473413 - DNA, 21 bp, Homo sapiens
actctttctttccgttttttt

SEQ ID NO: 3473414 - DNA, 13 bp, Homo sapiens
actctttgagaaa

SEQ ID NO: 3473415 - DNA, 17 bp, Homo sapiens
actgaaaacctctcctc

SEQ ID NO: 3473416 - DNA, 20 bp, Homo sapiens
actgaaaaggaggggtctgg

SEQ ID NO: 3473417 - DNA, 14 bp, Homo sapiens
actgaaatctgtca

SEQ ID NO: 3473418 - DNA, 17 bp, Homo sapiens
actgaaatctgtcaaga

SEQ ID NO: 3473419 - DNA, 20 bp, Homo sapiens
actgaacattagttgcacta

SEQ ID NO: 3473420 - DNA, 18 bp, Homo sapiens
actgaactcactttcctc

SEQ ID NO: 3473421 - DNA, 13 bp, Homo sapiens
actgaactttctt

SEQ ID NO: 3473422 - DNA, 13 bp, Homo sapiens
actgaagcagcct

SEQ ID NO: 3473423 - DNA, 14 bp, Homo sapiens
actgaagcagcctc

SEQ ID NO: 3473424 - DNA, 19 bp, Homo sapiens
actgaaggctaaaaagcaa

SEQ ID NO: 3473425 - DNA, 17 bp, Homo sapiens
actgaaggtaaaattga

SEQ ID NO: 3473426 - DNA, 20 bp, Homo sapiens
actgaatgggatcatgaaag

SEQ ID NO: 3473427 - DNA, 18 bp, Homo sapiens
actgacagcctcccaccc

SEQ ID NO: 3473428 - DNA, 23 bp, Homo sapiens
actgacatcaattttaccctgag

SEQ ID NO: 3473429 - DNA, 17 bp, Homo sapiens
actgacattgttggcca

SEQ ID NO: 3473430 - DNA, 18 bp, Homo sapiens
actgacattgttggccaa

SEQ ID NO: 3473431 - DNA, 17 bp, Homo sapiens
actgacctggtccacag

SEQ ID NO: 3473432 - DNA, 18 bp, Homo sapiens
actgagataccagcgagg

SEQ ID NO: 3473433 - DNA, 14 bp, Homo sapiens
actgagcaccctct

SEQ ID NO: 3473434 - DNA, 17 bp, Homo sapiens
actgagcctagctacct

SEQ ID NO: 3473435 - DNA, 18 bp, Homo sapiens
actgagcttctctgtgaa

SEQ ID NO: 3473436 - DNA, 13 bp, Homo sapiens
actgaggcctgag

SEQ ID NO: 3473437 - DNA, 17 bp, Homo sapiens
actgagggctgatcttt

SEQ ID NO: 3473438 - DNA, 20 bp, Homo sapiens
actgatgctgcccctcatct

SEQ ID NO: 3473439 - DNA, 14 bp, Homo sapiens
actgattaaatatt

SEQ ID NO: 3473440 - DNA, 20 bp, Homo sapiens
actgattaaatatttgaaga

SEQ ID NO: 3473441 - DNA, 14 bp, Homo sapiens
actgcaacctccgc

SEQ ID NO: 3473442 - DNA, 22 bp, Homo sapiens
actgcaagagccaagttccaaa

SEQ ID NO: 3473443 - DNA, 21 bp, Homo sapiens
actgcactatagcctaggtga

SEQ ID NO: 3473444 - DNA, 19 bp, Homo sapiens
actgcactccagcctgggt

SEQ ID NO: 3473445 - DNA, 20 bp, Homo sapiens
actgcactccagcctgggtg

SEQ ID NO: 3473446 - DNA, 14 bp, Homo sapiens
actgcaggccctgg

SEQ ID NO: 3473447 - DNA, 16 bp, Homo sapiens
actgcaggccctggcc

SEQ ID NO: 3473448 - DNA, 17 bp, Homo sapiens
actgcaggccctggcct

SEQ ID NO: 3473449 - DNA, 18 bp, Homo sapiens
actgcaggccctggcctc

SEQ ID NO: 3473450 - DNA, 10 bp, Homo sapiens
actgcaggga

SEQ ID NO: 3473451 - DNA, 14 bp, Homo sapiens
actgcagggttcaa

SEQ ID NO: 3473452 - DNA, 14 bp, Homo sapiens
actgcatacaatct

SEQ ID NO: 3473453 - DNA, 20 bp, Homo sapiens
actgcataccaacctgggca

SEQ ID NO: 3473454 - DNA, 15 bp, Homo sapiens
actgcatctcaaaaa

SEQ ID NO: 3473455 - DNA, 17 bp, Homo sapiens
actgcatctcaaaaaaa

SEQ ID NO: 3473456 - DNA, 13 bp, Homo sapiens
actgcatgctgct

SEQ ID NO: 3473457 - DNA, 20 bp, Homo sapiens
actgcattaccgcgttgtaa

SEQ ID NO: 3473458 - DNA, 21 bp, Homo sapiens
actgccaaagggaaatatcat

SEQ ID NO: 3473459 - DNA, 15 bp, Homo sapiens
actgccacaccctcc

SEQ ID NO: 3473460 - DNA, 16 bp, Homo sapiens
actgccatgcagggcc

SEQ ID NO: 3473461 - DNA, 21 bp, Homo sapiens
actgccatgtactagttttag

SEQ ID NO: 3473462 - DNA, 17 bp, Homo sapiens
actgcccaggcactgca

SEQ ID NO: 3473463 - DNA, 15 bp, Homo sapiens
actgccgccttctcg

SEQ ID NO: 3473464 - DNA, 20 bp, Homo sapiens
actgccgtcagtgctgtgct

SEQ ID NO: 3473465 - DNA, 17 bp, Homo sapiens
actgcctgatggacctg

SEQ ID NO: 3473466 - DNA, 20 bp, Homo sapiens
actgcctgatggacctgtca

SEQ ID NO: 3473467 - DNA, 19 bp, Homo sapiens
actgccttgcctcctcagt

SEQ ID NO: 3473468 - DNA, 19 bp, Homo sapiens
actgcgactttctgcctgg

SEQ ID NO: 3473469 - DNA, 22 bp, Homo sapiens
actgcgactttctgcctggagt

SEQ ID NO: 3473470 - DNA, 23 bp, Homo sapiens
actgcgactttctgcctggagtg

SEQ ID NO: 3473471 - DNA, 14 bp, Homo sapiens
actgctcagctctg

SEQ ID NO: 3473472 - DNA, 16 bp, Homo sapiens
actgctcagctctggt

SEQ ID NO: 3473473 - DNA, 19 bp, Homo sapiens
actgctcatcattccttga

SEQ ID NO: 3473474 - DNA, 15 bp, Homo sapiens
actgctctcagcctc

SEQ ID NO: 3473475 - DNA, 20 bp, Homo sapiens
actgctgagatacatacaga

SEQ ID NO: 3473476 - DNA, 15 bp, Homo sapiens
actgctttgcaaaga

SEQ ID NO: 3473477 - DNA, 17 bp, Homo sapiens
actgcttttggcctgga

SEQ ID NO: 3473478 - DNA, 16 bp, Homo sapiens
actggaacactagaca

SEQ ID NO: 3473479 - DNA, 22 bp, Homo sapiens
actggaacactagacaagccag

SEQ ID NO: 3473480 - DNA, 16 bp, Homo sapiens
actggaagctaatttg

SEQ ID NO: 3473481 - DNA, 15 bp, Homo sapiens
actggaccctgttgc

SEQ ID NO: 3473482 - DNA, 18 bp, Homo sapiens
actggaccctgttgctaa

SEQ ID NO: 3473483 - DNA, 20 bp, Homo sapiens
actggaccctgttgctaagc

SEQ ID NO: 3473484 - DNA, 16 bp, Homo sapiens
actggactccggccct

SEQ ID NO: 3473485 - DNA, 22 bp, Homo sapiens
actggcaaaaggatctttgtgg

SEQ ID NO: 3473486 - DNA, 14 bp, Homo sapiens
actggcagactgtg

SEQ ID NO: 3473487 - DNA, 21 bp, Homo sapiens
actggcaggcaggctcccagg

SEQ ID NO: 3473488 - DNA, 16 bp, Homo sapiens
actggcagttttccat

SEQ ID NO: 3473489 - DNA, 16 bp, Homo sapiens
acctggtgctgcctct

SEQ ID NO: 3473490 - DNA, 20 bp, Homo sapiens
acctgtaatcccagctactt

SEQ ID NO: 3473491 - DNA, 17 bp, Homo sapiens
acctgtaggatattgga

SEQ ID NO: 3473492 - DNA, 19 bp, Homo sapiens
acctgtcaaacaaagccag

SEQ ID NO: 3473493 - DNA, 20 bp, Homo sapiens
acctgtcaaacaaagccaga

SEQ ID NO: 3473494 - DNA, 23 bp, Homo sapiens
acctgtcacgattgtcatcagga

SEQ ID NO: 3473495 - DNA, 17 bp, Homo sapiens
acctgtcattttgcact

SEQ ID NO: 3473496 - DNA, 18 bp, Homo sapiens
acctgtgagcccagctgg

SEQ ID NO: 3473497 - DNA, 19 bp, Homo sapiens
acctgtgcttcgggccctt

SEQ ID NO: 3473498 - DNA, 11 bp, Homo sapiens
acctgtgtgct

SEQ ID NO: 3473499 - DNA, 22 bp, Homo sapiens
acctgttgagcatcacagaatg

SEQ ID NO: 3473500 - DNA, 18 bp, Homo sapiens
acctgtttttaagctgtt

SEQ ID NO: 3473501 - DNA, 17 bp, Homo sapiens
acctgtttttttttcat

SEQ ID NO: 3473502 - DNA, 21 bp, Homo sapiens
accttagatttagtagtgtaa

SEQ ID NO: 3473503 - DNA, 15 bp, Homo sapiens
acccggggcccaggg

SEQ ID NO: 3473504 - DNA, 17 bp, Homo sapiens
acccggtgctccctctg

SEQ ID NO: 3473505 - DNA, 19 bp, Homo sapiens
acccggtgctccctctgtc

SEQ ID NO: 3473506 - DNA, 14 bp, Homo sapiens
accctatatgctta

SEQ ID NO: 3473507 - DNA, 13 bp, Homo sapiens
accctattgctgc

SEQ ID NO: 3473508 - DNA, 18 bp, Homo sapiens
accctattttttgacact

SEQ ID NO: 3473509 - DNA, 21 bp, Homo sapiens
accctcaacctcttctggctc

SEQ ID NO: 3473510 - DNA, 14 bp, Homo sapiens
accctcagccttga

SEQ ID NO: 3473511 - DNA, 14 bp, Homo sapiens
accctcaggcaggt

SEQ ID NO: 3473512 - DNA, 16 bp, Homo sapiens
accctcaggcaggtgg

SEQ ID NO: 3473513 - DNA, 16 bp, Homo sapiens
accctcataccatctg

SEQ ID NO: 3473514 - DNA, 18 bp, Homo sapiens
accctcgccggaccctct

SEQ ID NO: 3473515 - DNA, 12 bp, Homo sapiens
accctctgtacc

SEQ ID NO: 3473516 - DNA, 13 bp, Homo sapiens
accctcttcatgg

SEQ ID NO: 3473517 - DNA, 20 bp, Homo sapiens
accctctttgctgcagagaa

SEQ ID NO: 3473518 - DNA, 17 bp, Homo sapiens
accctgaagatttcaga

SEQ ID NO: 3473519 - DNA, 22 bp, Homo sapiens
accctgagctgaccagccgtga

SEQ ID NO: 3473520 - DNA, 23 bp, Homo sapiens
accctgagctgaggcagcagtgt

SEQ ID NO: 3473521 - DNA, 17 bp, Homo sapiens
accctgaggtcactgct

SEQ ID NO: 3473522 - DNA, 22 bp, Homo sapiens
accctgatttaggagaagccag

SEQ ID NO: 3473523 - DNA, 23 bp, Homo sapiens
accctgatttaggagaagccagg

SEQ ID NO: 3473524 - DNA, 23 bp, Homo sapiens
accctgcagagcacacaggtaca

SEQ ID NO: 3473525 - DNA, 12 bp, Homo sapiens
accctgcaggac

SEQ ID NO: 3473526 - DNA, 14 bp, Homo sapiens
accctgcaggactt

SEQ ID NO: 3473527 - DNA, 14 bp, Homo sapiens
accctgccatggaa

SEQ ID NO: 3473528 - DNA, 22 bp, Homo sapiens
accctgccatggaactgtttcc

SEQ ID NO: 3473529 - DNA, 23 bp, Homo sapiens
accctgccatggaactgtttcct

SEQ ID NO: 3473530 - DNA, 13 bp, Homo sapiens
accctggagccca

SEQ ID NO: 3473531 - DNA, 15 bp, Homo sapiens
accctgggcctggca

SEQ ID NO: 3473532 - DNA, 22 bp, Homo sapiens
accctgggcctggcagctcagc

SEQ ID NO: 3473533 - DNA, 18 bp, Homo sapiens
accctggggcctgactgc

SEQ ID NO: 3473534 - DNA, 22 bp, Homo sapiens
accctggggctggcttttctgt

SEQ ID NO: 3473535 - DNA, 15 bp, Homo sapiens
accctggtgggccaa

SEQ ID NO: 3473536 - DNA, 20 bp, Homo sapiens
accctgtatatagcccagcc

SEQ ID NO: 3473537 - DNA, 14 bp, Homo sapiens
accctgtcttcctc

SEQ ID NO: 3473538 - DNA, 18 bp, Homo sapiens
accctgtcttcctctgca

SEQ ID NO: 3473539 - DNA, 22 bp, Homo sapiens
accctgtgccctccttcccaat

SEQ ID NO: 3473540 - DNA, 15 bp, Homo sapiens
accctgttcctggag

SEQ ID NO: 3473541 - DNA, 14 bp, Homo sapiens
accctgttgctaag

SEQ ID NO: 3473542 - DNA, 16 bp, Homo sapiens
acccttagaatccacg

SEQ ID NO: 3473543 - DNA, 19 bp, Homo sapiens
acccttcatcttcctgtgt

SEQ ID NO: 3473544 - DNA, 20 bp, Homo sapiens
acccttcatcttcctgtgtc

SEQ ID NO: 3473545 - DNA, 18 bp, Homo sapiens
acccttctggaaactgtg

SEQ ID NO: 3473546 - DNA, 12 bp, Homo sapiens
accgaaacagcg

SEQ ID NO: 3473547 - DNA, 17 bp, Homo sapiens
accgaaacagcgctggg

SEQ ID NO: 3473548 - DNA, 13 bp, Homo sapiens
accgagagccaaa

SEQ ID NO: 3473549 - DNA, 13 bp, Homo sapiens
accgcaggaagct

SEQ ID NO: 3473550 - DNA, 16 bp, Homo sapiens
accgcaggaagctgct

SEQ ID NO: 3473551 - DNA, 17 bp, Homo sapiens
accgccaaggctggggg

SEQ ID NO: 3473552 - DNA, 20 bp, Homo sapiens
accgccccaaagtaaaagaa

SEQ ID NO: 3473553 - DNA, 16 bp, Homo sapiens
accgcgactaatttca

SEQ ID NO: 3473554 - DNA, 13 bp, Homo sapiens
accgcgttgtaaa

SEQ ID NO: 3473555 - DNA, 18 bp, Homo sapiens
accgcgttgtaaaatata

SEQ ID NO: 3473556 - DNA, 19 bp, Homo sapiens
accgcgttgtaaaatatag

SEQ ID NO: 3473557 - DNA, 17 bp, Homo sapiens
accgctttggcctgagt

SEQ ID NO: 3473558 - DNA, 15 bp, Homo sapiens
accggaaggttttta

SEQ ID NO: 3473559 - DNA, 16 bp, Homo sapiens
accggatcctgggtgg

SEQ ID NO: 3473560 - DNA, 16 bp, Homo sapiens
accgggcactcagaag

SEQ ID NO: 3473561 - DNA, 15 bp, Homo sapiens
accgggccacagaga

SEQ ID NO: 3473562 - DNA, 16 bp, Homo sapiens
accgtcccctgcccac

SEQ ID NO: 3473563 - DNA, 20 bp, Homo sapiens
accgtggtatgtctgccatg

SEQ ID NO: 3473564 - DNA, 13 bp, Homo sapiens
accgtgtcaagct

SEQ ID NO: 3473565 - DNA, 14 bp, Homo sapiens
accgttctgtgcac

SEQ ID NO: 3473566 - DNA, 13 bp, Homo sapiens
acctaaaaaagat

SEQ ID NO: 3473567 - DNA, 16 bp, Homo sapiens
acctaattaaggaagt

SEQ ID NO: 3473568 - DNA, 19 bp, Homo sapiens
acctacatccccaggtctc

SEQ ID NO: 3473569 - DNA, 19 bp, Homo sapiens
acctacatgttattctagt

SEQ ID NO: 3473570 - DNA, 15 bp, Homo sapiens
acctaccacatgcca

SEQ ID NO: 3473571 - DNA, 22 bp, Homo sapiens
acctagaaattgacacaagtgg

SEQ ID NO: 3473572 - DNA, 14 bp, Homo sapiens
acctagcagcaccg

SEQ ID NO: 3473573 - DNA, 17 bp, Homo sapiens
acctaggcaatgaagaa

SEQ ID NO: 3473574 - DNA, 18 bp, Homo sapiens
acctaggcaatgaagaat

SEQ ID NO: 3473575 - DNA, 17 bp, Homo sapiens
acctaggcagtgggagg

SEQ ID NO: 3473576 - DNA, 12 bp, Homo sapiens
acctaggctcct

SEQ ID NO: 3473577 - DNA, 15 bp, Homo sapiens
acctaggctcctctt

SEQ ID NO: 3473578 - DNA, 15 bp, Homo sapiens
acctaggggcgccgc

SEQ ID NO: 3473579 - DNA, 14 bp, Homo sapiens
acctatgaagcaat

SEQ ID NO: 3473580 - DNA, 16 bp, Homo sapiens
acctcaaccaatgcca

SEQ ID NO: 3473581 - DNA, 21 bp, Homo sapiens
acctcaaccatcctggctgcg

SEQ ID NO: 3473582 - DNA, 21 bp, Homo sapiens
acctcaacccccatttctatt

SEQ ID NO: 3473583 - DNA, 20 bp, Homo sapiens
acctcaagtgatcctcccac

SEQ ID NO: 3473584 - DNA, 18 bp, Homo sapiens
acctcacgcacctcccat

SEQ ID NO: 3473585 - DNA, 12 bp, Homo sapiens
acctcagcattt

SEQ ID NO: 3473586 - DNA, 11 bp, Homo sapiens
acctcagcctg

SEQ ID NO: 3473587 - DNA, 13 bp, Homo sapiens
acctcagcctggc

SEQ ID NO: 3473588 - DNA, 16 bp, Homo sapiens
acctcatgacagccag

SEQ ID NO: 3473589 - DNA, 18 bp, Homo sapiens
acctcatgacagccagag

SEQ ID NO: 3473590 - DNA, 21 bp, Homo sapiens
acctcatgacagccagagcct

SEQ ID NO: 3473591 - DNA, 14 bp, Homo sapiens
acctccacagcttc

SEQ ID NO: 3473592 - DNA, 15 bp, Homo sapiens
acctccacagcttcc

SEQ ID NO: 3473593 - DNA, 14 bp, Homo sapiens
acctccacatcctc

SEQ ID NO: 3473594 - DNA, 16 bp, Homo sapiens
acctccacatcctcca

SEQ ID NO: 3473595 - DNA, 20 bp, Homo sapiens
acctcccacaaaggagagct

SEQ ID NO: 3473596 - DNA, 14 bp, Homo sapiens
acctccccagcctg

SEQ ID NO: 3473597 - DNA, 22 bp, Homo sapiens
acctccccagcctgcgcctgct

SEQ ID NO: 3473598 - DNA, 14 bp, Homo sapiens
acctccctgcctcc

SEQ ID NO: 3473599 - DNA, 12 bp, Homo sapiens
acctcctctcag

SEQ ID NO: 3473600 - DNA, 12 bp, Homo sapiens
acctcctctgtg

SEQ ID NO: 3473601 - DNA, 13 bp, Homo sapiens
acctcctgagaaa

SEQ ID NO: 3473602 - DNA, 13 bp, Homo sapiens
acctcctgcctcg

SEQ ID NO: 3473603 - DNA, 23 bp, Homo sapiens
acctcctgcctcgaactggctgc

SEQ ID NO: 3473604 - DNA, 17 bp, Homo sapiens
acctcctgtctctggcc

SEQ ID NO: 3473605 - DNA, 16 bp, Homo sapiens
acctcgagtactgtgg

SEQ ID NO: 3473606 - DNA, 18 bp, Homo sapiens
acctcgagtactgtgggc

SEQ ID NO: 3473607 - DNA, 22 bp, Homo sapiens
acctcgagtactgtgggcaatt

SEQ ID NO: 3473608 - DNA, 20 bp, Homo sapiens
acctctccagcctcagctct

SEQ ID NO: 3473609 - DNA, 12 bp, Homo sapiens
acctctcccacg

SEQ ID NO: 3473610 - DNA, 22 bp, Homo sapiens
acctctccctgaccctgtatat

SEQ ID NO: 3473611 - DNA, 14 bp, Homo sapiens
acctctcctcatgt

SEQ ID NO: 3473612 - DNA, 19 bp, Homo sapiens
acctctctgtcccttgctg

SEQ ID NO: 3473613 - DNA, 19 bp, Homo sapiens
acctctcttgaaccccaaa

SEQ ID NO: 3473614 - DNA, 14 bp, Homo sapiens
acctctgcttccca

SEQ ID NO: 3473615 - DNA, 17 bp, Homo sapiens
acctctgttcagtgtaa

SEQ ID NO: 3473616 - DNA, 17 bp, Homo sapiens
acctcttcagaggccct

SEQ ID NO: 3473617 - DNA, 22 bp, Homo sapiens
acctcttctggagatggaagct

SEQ ID NO: 3473618 - DNA, 11 bp, Homo sapiens
acctgaaaaca

SEQ ID NO: 3473619 - DNA, 18 bp, Homo sapiens
acctgaaaacactgtgca

SEQ ID NO: 3473620 - DNA, 20 bp, Homo sapiens
acctgaaaacactgtgcaca

SEQ ID NO: 3473621 - DNA, 14 bp, Homo sapiens
acctgaacctagga

SEQ ID NO: 3473622 - DNA, 18 bp, Homo sapiens
acctgagcaggacctctg

SEQ ID NO: 3473623 - DNA, 17 bp, Homo sapiens
acctgattaactgaggc

SEQ ID NO: 3473624 - DNA, 19 bp, Homo sapiens
acctgattcaactaaaaaa

SEQ ID NO: 3473625 - DNA, 17 bp, Homo sapiens
acctgcatctggggccc

SEQ ID NO: 3473626 - DNA, 23 bp, Homo sapiens
acctgcccttttttctgcctcct

SEQ ID NO: 3473627 - DNA, 13 bp, Homo sapiens
acctgcctcagga

SEQ ID NO: 3473628 - DNA, 21 bp, Homo sapiens
acctgcctcggcctcccaaag

SEQ ID NO: 3473629 - DNA, 23 bp, Homo sapiens
acctgcctcggcctcccaaagtg

SEQ ID NO: 3473630 - DNA, 13 bp, Homo sapiens
acctgcctgggtt

SEQ ID NO: 3473631 - DNA, 14 bp, Homo sapiens
acctgctgcttctc

SEQ ID NO: 3473632 - DNA, 15 bp, Homo sapiens
acctgctgcttctcc

SEQ ID NO: 3473633 - DNA, 18 bp, Homo sapiens
acctggaacttggggagt

SEQ ID NO: 3473634 - DNA, 20 bp, Homo sapiens
acctggccgcctccaggagc

SEQ ID NO: 3473635 - DNA, 18 bp, Homo sapiens
acctgggctgtgatgtga

SEQ ID NO: 3473636 - DNA, 14 bp, Homo sapiens
acctggggctgctg

SEQ ID NO: 3473637 - DNA, 15 bp, Homo sapiens
acctggggctgctgg

SEQ ID NO: 3473638 - DNA, 20 bp, Homo sapiens
acctggggctgctggcctga

SEQ ID NO: 3473639 - DNA, 21 bp, Homo sapiens
acctggggtgtgggaggcccg

SEQ ID NO: 3473640 - DNA, 21 bp, Homo sapiens
acctgggtaactagggaagat

SEQ ID NO: 3473641 - DNA, 22 bp, Homo sapiens
accagccgtgagcatgtttgga

SEQ ID NO: 3473642 - DNA, 22 bp, Homo sapiens
accagcctcaaaaacgccctca

SEQ ID NO: 3473643 - DNA, 13 bp, Homo sapiens
accagcctggcca

SEQ ID NO: 3473644 - DNA, 14 bp, Homo sapiens
accagcctggccaa

SEQ ID NO: 3473645 - DNA, 15 bp, Homo sapiens
accagcctggccaac

SEQ ID NO: 3473646 - DNA, 20 bp, Homo sapiens
accagcctggccaacatggt

SEQ ID NO: 3473647 - DNA, 20 bp, Homo sapiens
accagcctggtcaacatggt

SEQ ID NO: 3473648 - DNA, 22 bp, Homo sapiens
accagctaagaaaagattttaa

SEQ ID NO: 3473649 - DNA, 13 bp, Homo sapiens
accagctcaggac

SEQ ID NO: 3473650 - DNA, 14 bp, Homo sapiens
accagctcaggaca

SEQ ID NO: 3473651 - DNA, 15 bp, Homo sapiens
accagctcaggacag

SEQ ID NO: 3473652 - DNA, 16 bp, Homo sapiens
accagctcaggacaga

SEQ ID NO: 3473653 - DNA, 13 bp, Homo sapiens
accagctgcaaag

SEQ ID NO: 3473654 - DNA, 15 bp, Homo sapiens
accagctgcaaagtg

SEQ ID NO: 3473655 - DNA, 18 bp, Homo sapiens
accagctgcaaagtgttt

SEQ ID NO: 3473656 - DNA, 22 bp, Homo sapiens
accagctgcaaagtgttttgta

SEQ ID NO: 3473657 - DNA, 11 bp, Homo sapiens
accagctgcta

SEQ ID NO: 3473658 - DNA, 17 bp, Homo sapiens
accaggaacctcttcag

SEQ ID NO: 3473659 - DNA, 23 bp, Homo sapiens
accaggagaagggctggggccgg

SEQ ID NO: 3473660 - DNA, 16 bp, Homo sapiens
accaggatagagactg

SEQ ID NO: 3473661 - DNA, 19 bp, Homo sapiens
accaggatagagactggaa

SEQ ID NO: 3473662 - DNA, 15 bp, Homo sapiens
accaggccctggcta

SEQ ID NO: 3473663 - DNA, 16 bp, Homo sapiens
accaggggtttctcgc

SEQ ID NO: 3473664 - DNA, 17 bp, Homo sapiens
accaggggtttctcgca

SEQ ID NO: 3473665 - DNA, 20 bp, Homo sapiens
accagggttgaccccagagg

SEQ ID NO: 3473666 - DNA, 17 bp, Homo sapiens
accaggtgcctttcaaa

SEQ ID NO: 3473667 - DNA, 23 bp, Homo sapiens
accaggtgcctttcaaatttaga

SEQ ID NO: 3473668 - DNA, 14 bp, Homo sapiens
accaggtgggagcg

SEQ ID NO: 3473669 - DNA, 22 bp, Homo sapiens
accagtgttagggaagggcctg

SEQ ID NO: 3473670 - DNA, 18 bp, Homo sapiens
accagttaacgtattagt

SEQ ID NO: 3473671 - DNA, 16 bp, Homo sapiens
accagttttatccata

SEQ ID NO: 3473672 - DNA, 21 bp, Homo sapiens
acagcttgacctgaggctgtg

SEQ ID NO: 3473673 - DNA, 22 bp, Homo sapiens
acagctttctgaccttcagctc

SEQ ID NO: 3473674 - DNA, 14 bp, Homo sapiens
acagcttttccaaa

SEQ ID NO: 3473675 - DNA, 18 bp, Homo sapiens
acaggaaaagctgctgac

SEQ ID NO: 3473676 - DNA, 15 bp, Homo sapiens
acaggaagtgaagaa

SEQ ID NO: 3473677 - DNA, 17 bp, Homo sapiens
acaggaatctcagagac

SEQ ID NO: 3473678 - DNA, 15 bp, Homo sapiens
acaggacacagtcag

SEQ ID NO: 3473679 - DNA, 16 bp, Homo sapiens
acaggacacagtcaga

SEQ ID NO: 3473680 - DNA, 15 bp, Homo sapiens
acaggacacctggcc

SEQ ID NO: 3473681 - DNA, 22 bp, Homo sapiens
acaggacatgcggtagccagca

SEQ ID NO: 3473682 - DNA, 14 bp, Homo sapiens
acaggagacctggc

SEQ ID NO: 3473683 - DNA, 13 bp, Homo sapiens
acaggagctggga

SEQ ID NO: 3473684 - DNA, 17 bp, Homo sapiens
acaggagtgtcctcttc

SEQ ID NO: 3473685 - DNA, 20 bp, Homo sapiens
acaggatgtgtttgctttct

SEQ ID NO: 3473686 - DNA, 21 bp, Homo sapiens
acaggatgtgtttgctttctg

SEQ ID NO: 3473687 - DNA, 12 bp, Homo sapiens
acaggcaagcac

SEQ ID NO: 3473688 - DNA, 16 bp, Homo sapiens
acaggcaatgctggct

SEQ ID NO: 3473689 - DNA, 17 bp, Homo sapiens
acaggcaatgctggctg

SEQ ID NO: 3473690 - DNA, 23 bp, Homo sapiens
acaggcaatgctggctgttggct

SEQ ID NO: 3473691 - DNA, 14 bp, Homo sapiens
acaggcacccacca

SEQ ID NO: 3473692 - DNA, 17 bp, Homo sapiens
acaggcagcacagagac

SEQ ID NO: 3473693 - DNA, 22 bp, Homo sapiens
acaggcagtttcagagatggac

SEQ ID NO: 3473694 - DNA, 19 bp, Homo sapiens
acaggccattgtgaaccaa

SEQ ID NO: 3473695 - DNA, 20 bp, Homo sapiens
acaggccccccgcagcaccc

SEQ ID NO: 3473696 - DNA, 21 bp, Homo sapiens
acaggccccccgcagcaccct

SEQ ID NO: 3473697 - DNA, 17 bp, Homo sapiens
acaggcccggctccagg

SEQ ID NO: 3473698 - DNA, 22 bp, Homo sapiens
acaggccctccctgttccccag

SEQ ID NO: 3473699 - DNA, 21 bp, Homo sapiens
acaggcctgagatttcatctg

SEQ ID NO: 3473700 - DNA, 14 bp, Homo sapiens
acaggctgggcttc

SEQ ID NO: 3473701 - DNA, 17 bp, Homo sapiens
acaggctgtgactcttc

SEQ ID NO: 3473702 - DNA, 22 bp, Homo sapiens
acaggctgtgactcttctctca

SEQ ID NO: 3473703 - DNA, 13 bp, Homo sapiens
acagggacttgaa

SEQ ID NO: 3473704 - DNA, 22 bp, Homo sapiens
acagggcacaccgggcactcag

SEQ ID NO: 3473705 - DNA, 14 bp, Homo sapiens
acagggtctgcctc

SEQ ID NO: 3473706 - DNA, 23 bp, Homo sapiens
acaggtcaagaaatagcgcagtg

SEQ ID NO: 3473707 - DNA, 23 bp, Homo sapiens
acaggtcaatacagtacaggcag

SEQ ID NO: 3473708 - DNA, 21 bp, Homo sapiens
acaggtctttcctaaggctgc

SEQ ID NO: 3473709 - DNA, 19 bp, Homo sapiens
acaggtggcctagcaggca

SEQ ID NO: 3473710 - DNA, 13 bp, Homo sapiens
acaggtgtgcacc

SEQ ID NO: 3473711 - DNA, 23 bp, Homo sapiens
acagtaaatatcccaaactgtga

SEQ ID NO: 3473712 - DNA, 17 bp, Homo sapiens
acagtaacgcaggggaa

SEQ ID NO: 3473713 - DNA, 14 bp, Homo sapiens
acagtaggagccca

SEQ ID NO: 3473714 - DNA, 23 bp, Homo sapiens
acagtatcactgtctttcctaga

SEQ ID NO: 3473715 - DNA, 10 bp, Homo sapiens
acagtatctc

SEQ ID NO: 3473716 - DNA, 15 bp, Homo sapiens
acagtattacttctg

SEQ ID NO: 3473717 - DNA, 17 bp, Homo sapiens
acagtcacgcctgaaac

SEQ ID NO: 3473718 - DNA, 19 bp, Homo sapiens
acagtcacgcctgaaactt

SEQ ID NO: 3473719 - DNA, 16 bp, Homo sapiens
acagtcagctcttcat

SEQ ID NO: 3473720 - DNA, 15 bp, Homo sapiens
acagtcctgaagcag

SEQ ID NO: 3473721 - DNA, 21 bp, Homo sapiens
acagtcttccacaaagaaaat

SEQ ID NO: 3473722 - DNA, 13 bp, Homo sapiens
acagtgaagacag

SEQ ID NO: 3473723 - DNA, 23 bp, Homo sapiens
acagtgagtcgaggacagggagg

SEQ ID NO: 3473724 - DNA, 17 bp, Homo sapiens
acagtgggaactggagg

SEQ ID NO: 3473725 - DNA, 13 bp, Homo sapiens
acagtgtgggaca

SEQ ID NO: 3473726 - DNA, 22 bp, Homo sapiens
acagtgtgggacaggctcttct

SEQ ID NO: 3473727 - DNA, 19 bp, Homo sapiens
acagttacataattcactc

SEQ ID NO: 3473728 - DNA, 20 bp, Homo sapiens
acagttcaattctcatttgt

SEQ ID NO: 3473729 - DNA, 19 bp, Homo sapiens
acagttcggtgagctacaa

SEQ ID NO: 3473730 - DNA, 21 bp, Homo sapiens
acagttctttgggccagacat

SEQ ID NO: 3473731 - DNA, 13 bp, Homo sapiens
acagttgacccta

SEQ ID NO: 3473732 - DNA, 14 bp, Homo sapiens
acagtttgtcacat

SEQ ID NO: 3473733 - DNA, 22 bp, Homo sapiens
acagttttccttctcatctgtg

SEQ ID NO: 3473734 - DNA, 23 bp, Homo sapiens
acataatgggccactgaaatctg

SEQ ID NO: 3473735 - DNA, 18 bp, Homo sapiens
acataattcactctgagt

SEQ ID NO: 3473736 - DNA, 16 bp, Homo sapiens
acatacaattattttt

SEQ ID NO: 3473737 - DNA, 14 bp, Homo sapiens
acatacaccagcat

SEQ ID NO: 3473738 - DNA, 19 bp, Homo sapiens
acatacagaattactgtaa

SEQ ID NO: 3473739 - DNA, 15 bp, Homo sapiens
acataccagcttaga

SEQ ID NO: 3473740 - DNA, 12 bp, Homo sapiens
acatactgctgt

SEQ ID NO: 3473741 - DNA, 19 bp, Homo sapiens
acatacttgaagggccaga

SEQ ID NO: 3473742 - DNA, 22 bp, Homo sapiens
acatacttgaagggccagagcc

SEQ ID NO: 3473743 - DNA, 21 bp, Homo sapiens
acatagcatgacatttctttg

SEQ ID NO: 3473744 - DNA, 13 bp, Homo sapiens
acatagtgaaata

SEQ ID NO: 3473745 - DNA, 22 bp, Homo sapiens
acatataaaataatgcaaagaa

SEQ ID NO: 3473746 - DNA, 17 bp, Homo sapiens
acatataagttgagaag

SEQ ID NO: 3473747 - DNA, 23 bp, Homo sapiens
acatatatatatatttttttttg

SEQ ID NO: 3473748 - DNA, 18 bp, Homo sapiens
acatatctttattaatca

SEQ ID NO: 3473749 - DNA, 14 bp, Homo sapiens
acatatgtaaaata

SEQ ID NO: 3473750 - DNA, 13 bp, Homo sapiens
acatatttaactg

SEQ ID NO: 3473751 - DNA, 15 bp, Homo sapiens
acatatttaactggt

SEQ ID NO: 3473752 - DNA, 20 bp, Homo sapiens
acatatttaactggtgcact

SEQ ID NO: 3473753 - DNA, 12 bp, Homo sapiens
acatatttaatg

SEQ ID NO: 3473754 - DNA, 14 bp, Homo sapiens
acatatttaatgtt

SEQ ID NO: 3473755 - DNA, 15 bp, Homo sapiens
acatatttaatgttt

SEQ ID NO: 3473756 - DNA, 16 bp, Homo sapiens
acatatttaatgtttt

SEQ ID NO: 3473757 - DNA, 15 bp, Homo sapiens
acatcactggggtca

SEQ ID NO: 3473758 - DNA, 17 bp, Homo sapiens
acatcactgttcatgct

SEQ ID NO: 3473759 - DNA, 23 bp, Homo sapiens
acatcaggagactgggctctggc

SEQ ID NO: 3473760 - DNA, 18 bp, Homo sapiens
aattatagacctctagta

SEQ ID NO: 3473761 - DNA, 20 bp, Homo sapiens
aattatatttgtgctatagt

SEQ ID NO: 3473762 - DNA, 14 bp, Homo sapiens
aattatctatacat

SEQ ID NO: 3473763 - DNA, 22 bp, Homo sapiens
aattatctatacatatctttat

SEQ ID NO: 3473764 - DNA, 14 bp, Homo sapiens
aattatgttaaact

SEQ ID NO: 3473765 - DNA, 24 bp, Homo sapiens
aattatttttttttttgttcttga

SEQ ID NO: 3473766 - DNA, 20 bp, Homo sapiens
aattcaaactggggcctcca

SEQ ID NO: 3473767 - DNA, 19 bp, Homo sapiens
aattcaattgtaaattgaa

SEQ ID NO: 3473768 - DNA, 18 bp, Homo sapiens
aattcagccatgtacaga

SEQ ID NO: 3473769 - DNA, 14 bp, Homo sapiens
aattccaaagcaaa

SEQ ID NO: 3473770 - DNA, 18 bp, Homo sapiens
aattccaagtgattgaaa

SEQ ID NO: 3473771 - DNA, 19 bp, Homo sapiens
aattccatatatccttttc

SEQ ID NO: 3473772 - DNA, 22 bp, Homo sapiens
aattccatatatccttttcttc

SEQ ID NO: 3473773 - DNA, 13 bp, Homo sapiens
aattccgtcacca

SEQ ID NO: 3473774 - DNA, 14 bp, Homo sapiens
aattcctagaatta

SEQ ID NO: 3473775 - DNA, 17 bp, Homo sapiens
aattcctagaattaaac

SEQ ID NO: 3473776 - DNA, 22 bp, Homo sapiens
aattccttcgaaaggccttcag

SEQ ID NO: 3473777 - DNA, 18 bp, Homo sapiens
aattcgctgcaacctgtt

SEQ ID NO: 3473778 - DNA, 13 bp, Homo sapiens
aattctaaatgta

SEQ ID NO: 3473779 - DNA, 16 bp, Homo sapiens
aattctataaggccat

SEQ ID NO: 3473780 - DNA, 22 bp, Homo sapiens
aattctataaggccataaaaca

SEQ ID NO: 3473781 - DNA, 22 bp, Homo sapiens
aattctatcttttgtttccttt

SEQ ID NO: 3473782 - DNA, 12 bp, Homo sapiens
aattctcctgga

SEQ ID NO: 3473783 - DNA, 14 bp, Homo sapiens
aattctgaatttgc

SEQ ID NO: 3473784 - DNA, 15 bp, Homo sapiens
aattcttacatgttt

SEQ ID NO: 3473785 - DNA, 17 bp, Homo sapiens
aattcttttgaattgtt

SEQ ID NO: 3473786 - DNA, 13 bp, Homo sapiens
aattgatttgcat

SEQ ID NO: 3473787 - DNA, 14 bp, Homo sapiens
aattgatttgcatt

SEQ ID NO: 3473788 - DNA, 20 bp, Homo sapiens
aattgcaaaaacatagaaat

SEQ ID NO: 3473789 - DNA, 14 bp, Homo sapiens
aattgcaaatcttg

SEQ ID NO: 3473790 - DNA, 18 bp, Homo sapiens
aattgcacagaagtcctg

SEQ ID NO: 3473791 - DNA, 13 bp, Homo sapiens
aattgccataata

SEQ ID NO: 3473792 - DNA, 22 bp, Homo sapiens
aattgccataatatgatgcaaa

SEQ ID NO: 3473793 - DNA, 13 bp, Homo sapiens
aattgccatattg

SEQ ID NO: 3473794 - DNA, 14 bp, Homo sapiens
aattgcgttggtct

SEQ ID NO: 3473795 - DNA, 16 bp, Homo sapiens
aattgcgttggtctct

SEQ ID NO: 3473796 - DNA, 20 bp, Homo sapiens
aattgcgttggtctctgcat

SEQ ID NO: 3473797 - DNA, 11 bp, Homo sapiens
aattgctttga

SEQ ID NO: 3473798 - DNA, 15 bp, Homo sapiens
aattggttctttatt

SEQ ID NO: 3473799 - DNA, 17 bp, Homo sapiens
aattgtaaattgaatca

SEQ ID NO: 3473800 - DNA, 24 bp, Homo sapiens
aattgtaaattgaatcagtataaa

SEQ ID NO: 3473801 - DNA, 11 bp, Homo sapiens
aattgtaatag

SEQ ID NO: 3473802 - DNA, 17 bp, Homo sapiens
aattgtatattcacttt

SEQ ID NO: 3473803 - DNA, 11 bp, Homo sapiens
aattgtccctt

SEQ ID NO: 3473804 - DNA, 16 bp, Homo sapiens
aattgtcccttaaaca

SEQ ID NO: 3473805 - DNA, 22 bp, Homo sapiens
aattgtgaagctaatgaccaac

SEQ ID NO: 3473806 - DNA, 23 bp, Homo sapiens
aattgtgtgtgatgtgaagccaa

SEQ ID NO: 3473807 - DNA, 21 bp, Homo sapiens
aattgtgtgtgctctgcttca

SEQ ID NO: 3473808 - DNA, 21 bp, Homo sapiens
aattgttgaacaggtgttttt

SEQ ID NO: 3473809 - DNA, 13 bp, Homo sapiens
aatttaaaagcag

SEQ ID NO: 3473810 - DNA, 19 bp, Homo sapiens
aatttaattcatgtttctt

SEQ ID NO: 3473811 - DNA, 16 bp, Homo sapiens
aatttacaaagtgtgt

SEQ ID NO: 3473812 - DNA, 19 bp, Homo sapiens
aatttacaaagtgtgtatt

SEQ ID NO: 3473813 - DNA, 17 bp, Homo sapiens
aatttagaaaaagaaca

SEQ ID NO: 3473814 - DNA, 22 bp, Homo sapiens
aatttagaaaaagaacatgcag

SEQ ID NO: 3473815 - DNA, 18 bp, Homo sapiens
aatttagaaactaattga

SEQ ID NO: 3473816 - DNA, 19 bp, Homo sapiens
aatttagaaactaattgac

SEQ ID NO: 3473817 - DNA, 17 bp, Homo sapiens
aatttagatattttcca

SEQ ID NO: 3473818 - DNA, 20 bp, Homo sapiens
aatttaggtttttattagta

SEQ ID NO: 3473819 - DNA, 16 bp, Homo sapiens
aatttagtaaatgtta

SEQ ID NO: 3473820 - DNA, 17 bp, Homo sapiens
aatttatacaatatcat

SEQ ID NO: 3473821 - DNA, 12 bp, Homo sapiens
aatttattaaat

SEQ ID NO: 3473822 - DNA, 22 bp, Homo sapiens
aatttatttcctagttctgtag

SEQ ID NO: 3473823 - DNA, 19 bp, Homo sapiens
acacacaaaaaatgcacaa

SEQ ID NO: 3473824 - DNA, 10 bp, Homo sapiens
acacacacaa

SEQ ID NO: 3473825 - DNA, 10 bp, Homo sapiens
acacacacac

SEQ ID NO: 3473826 - DNA, 15 bp, Homo sapiens
acacacacacaaacc

SEQ ID NO: 3473827 - DNA, 12 bp, Homo sapiens
acacacacacac

SEQ ID NO: 3473828 - DNA, 14 bp, Homo sapiens
acacacacagccag

SEQ ID NO: 3473829 - DNA, 14 bp, Homo sapiens
acacacagctctgt

SEQ ID NO: 3473830 - DNA, 19 bp, Homo sapiens
acacacagctctgtcctgg

SEQ ID NO: 3473831 - DNA, 20 bp, Homo sapiens
acacacctgtagcacttact

SEQ ID NO: 3473832 - DNA, 21 bp, Homo sapiens
acacacgcgtgcacacaccag

SEQ ID NO: 3473833 - DNA, 22 bp, Homo sapiens
acacacggctcccccaggcctg

SEQ ID NO: 3473834 - DNA, 13 bp, Homo sapiens
acacactgatgct

SEQ ID NO: 3473835 - DNA, 17 bp, Homo sapiens
acacactgatgcttaga

SEQ ID NO: 3473836 - DNA, 19 bp, Homo sapiens
acacactgtcatgcttcat

SEQ ID NO: 3473837 - DNA, 14 bp, Homo sapiens
acacactttttaag

SEQ ID NO: 3473838 - DNA, 19 bp, Homo sapiens
acacagaaacctttttaaa

SEQ ID NO: 3473839 - DNA, 14 bp, Homo sapiens
acacagaaatgctg

SEQ ID NO: 3473840 - DNA, 23 bp, Homo sapiens
acacagacattctgccaggcccc

SEQ ID NO: 3473841 - DNA, 16 bp, Homo sapiens
acacagatgaaacaca

SEQ ID NO: 3473842 - DNA, 19 bp, Homo sapiens
acacagccgattcacctga

SEQ ID NO: 3473843 - DNA, 17 bp, Homo sapiens
acacagctactctcccc

SEQ ID NO: 3473844 - DNA, 20 bp, Homo sapiens
acacagctctgtcctgggag

SEQ ID NO: 3473845 - DNA, 14 bp, Homo sapiens
acacagctcttctc

SEQ ID NO: 3473846 - DNA, 16 bp, Homo sapiens
acacagctcttctcca

SEQ ID NO: 3473847 - DNA, 18 bp, Homo sapiens
acacagctcttctccagg

SEQ ID NO: 3473848 - DNA, 22 bp, Homo sapiens
acacaggcccggctccaggctc

SEQ ID NO: 3473849 - DNA, 23 bp, Homo sapiens
acacaggcccggctccaggctcc

SEQ ID NO: 3473850 - DNA, 12 bp, Homo sapiens
acacaggctggc

SEQ ID NO: 3473851 - DNA, 20 bp, Homo sapiens
acacaggtacagcaacagga

SEQ ID NO: 3473852 - DNA, 15 bp, Homo sapiens
acacaggtctttcct

SEQ ID NO: 3473853 - DNA, 11 bp, Homo sapiens
acacagtgagt

SEQ ID NO: 3473854 - DNA, 21 bp, Homo sapiens
acacagttgaccctatttttt

SEQ ID NO: 3473855 - DNA, 23 bp, Homo sapiens
acacagttgaccctattttttga

SEQ ID NO: 3473856 - DNA, 17 bp, Homo sapiens
acacatctgtggagatg

SEQ ID NO: 3473857 - DNA, 21 bp, Homo sapiens
acacattttggttcttctcaa

SEQ ID NO: 3473858 - DNA, 21 bp, Homo sapiens
acaccaagcacagcagcctgg

SEQ ID NO: 3473859 - DNA, 14 bp, Homo sapiens
acaccagacagaca

SEQ ID NO: 3473860 - DNA, 22 bp, Homo sapiens
acaccaggatagagactggaac

SEQ ID NO: 3473861 - DNA, 21 bp, Homo sapiens
acaccaggcttgcctgcaggc

SEQ ID NO: 3473862 - DNA, 13 bp, Homo sapiens
acaccattttttt

SEQ ID NO: 3473863 - DNA, 22 bp, Homo sapiens
acaccattttttttttcttttt

SEQ ID NO: 3473864 - DNA, 15 bp, Homo sapiens
acacccaagagggct

SEQ ID NO: 3473865 - DNA, 12 bp, Homo sapiens
acacccagccca

SEQ ID NO: 3473866 - DNA, 21 bp, Homo sapiens
acacccagcccacttctgcca

SEQ ID NO: 3473867 - DNA, 12 bp, Homo sapiens
acacccagcccc

SEQ ID NO: 3473868 - DNA, 22 bp, Homo sapiens
acacccctcaaaaaaagccttt

SEQ ID NO: 3473869 - DNA, 21 bp, Homo sapiens
acacccctcagttgtgcagct

SEQ ID NO: 3473870 - DNA, 13 bp, Homo sapiens
acaccctccccat

SEQ ID NO: 3473871 - DNA, 16 bp, Homo sapiens
acaccgggcactcaga

SEQ ID NO: 3473872 - DNA, 23 bp, Homo sapiens
acacctagccagctgtcaagggc

SEQ ID NO: 3473873 - DNA, 18 bp, Homo sapiens
acacctctgcacaagctg

SEQ ID NO: 3473874 - DNA, 19 bp, Homo sapiens
acacctctgcacaagctgc

SEQ ID NO: 3473875 - DNA, 22 bp, Homo sapiens
acacctggccgcctccaggagc

SEQ ID NO: 3473876 - DNA, 16 bp, Homo sapiens
acaccttgacagggca

SEQ ID NO: 3473877 - DNA, 20 bp, Homo sapiens
acaccttggacatcctcctc

SEQ ID NO: 3473878 - DNA, 23 bp, Homo sapiens
acaccttttattgacacagaaaa

SEQ ID NO: 3473879 - DNA, 16 bp, Homo sapiens
acacgcacctgcctca

SEQ ID NO: 3473880 - DNA, 13 bp, Homo sapiens
acacgcaggagca

SEQ ID NO: 3473881 - DNA, 14 bp, Homo sapiens
acacgcaggagcac

SEQ ID NO: 3473882 - DNA, 22 bp, Homo sapiens
acacgcctgcaaacgctgcctg

SEQ ID NO: 3473883 - DNA, 17 bp, Homo sapiens
acacgcgtgcacacacc

SEQ ID NO: 3473884 - DNA, 16 bp, Homo sapiens
acacggatctgagaat

SEQ ID NO: 3473885 - DNA, 19 bp, Homo sapiens
acacggatctgagaatctt

SEQ ID NO: 3473886 - DNA, 21 bp, Homo sapiens
acacggatctgagaatcttta

SEQ ID NO: 3473887 - DNA, 14 bp, Homo sapiens
acacggccacatca

SEQ ID NO: 3473888 - DNA, 17 bp, Homo sapiens
acacggctcccccaggc

SEQ ID NO: 3473889 - DNA, 17 bp, Homo sapiens
acactaaccacgctgga

SEQ ID NO: 3473890 - DNA, 16 bp, Homo sapiens
acactaccttatcagg

SEQ ID NO: 3473891 - DNA, 18 bp, Homo sapiens
acactactcttacatgta

SEQ ID NO: 3473892 - DNA, 16 bp, Homo sapiens
acactagacaagccag

SEQ ID NO: 3473893 - DNA, 21 bp, Homo sapiens
acactcaaaagctgggcaggt

SEQ ID NO: 3473894 - DNA, 16 bp, Homo sapiens
acactcaagaagcagg

SEQ ID NO: 3473895 - DNA, 20 bp, Homo sapiens
acactcacatttattctgct

SEQ ID NO: 3473896 - DNA, 22 bp, Homo sapiens
acactgagaatgtaagaactac

SEQ ID NO: 3473897 - DNA, 18 bp, Homo sapiens
acactgatgataggttaa

SEQ ID NO: 3473898 - DNA, 16 bp, Homo sapiens
acactggactccggcc

SEQ ID NO: 3473899 - DNA, 14 bp, Homo sapiens
acactgggaggcca

SEQ ID NO: 3473900 - DNA, 13 bp, Homo sapiens
acactggggtctg

SEQ ID NO: 3473901 - DNA, 14 bp, Homo sapiens
acactggggtctgt

SEQ ID NO: 3473902 - DNA, 17 bp, Homo sapiens
acactggggtctgtttc

SEQ ID NO: 3473903 - DNA, 13 bp, Homo sapiens
acactgggtggtg

SEQ ID NO: 3473904 - DNA, 18 bp, Homo sapiens
acactgggtggtggcctg

SEQ ID NO: 3473905 - DNA, 18 bp, Homo sapiens
acactggtattcctgcct

SEQ ID NO: 3473906 - DNA, 21 bp, Homo sapiens
acactggtattcctgcctcca

SEQ ID NO: 3473907 - DNA, 17 bp, Homo sapiens
acactgtgggtgtgtga

SEQ ID NO: 3473908 - DNA, 19 bp, Homo sapiens
acactgtgggtgtgtgact

SEQ ID NO: 3473909 - DNA, 18 bp, Homo sapiens
acacttaccccatggctg

SEQ ID NO: 3473910 - DNA, 17 bp, Homo sapiens
acacttactgtaagaca

SEQ ID NO: 3473911 - DNA, 19 bp, Homo sapiens
acacttagggtttggagct

SEQ ID NO: 3473912 - DNA, 16 bp, Homo sapiens
acacttcatggaccaa

SEQ ID NO: 3473913 - DNA, 18 bp, Homo sapiens
acacttcatggaccaaga

SEQ ID NO: 3473914 - DNA, 19 bp, Homo sapiens
acacttcatggaccaagaa

SEQ ID NO: 3473915 - DNA, 21 bp, Homo sapiens
acacttcatggaccaagaatg

SEQ ID NO: 3473916 - DNA, 19 bp, Homo sapiens
acacttgtccccaaatccg

SEQ ID NO: 3473917 - DNA, 20 bp, Homo sapiens
acactttatggtaagtagca

SEQ ID NO: 3473918 - DNA, 20 bp, Homo sapiens
acagaaacctttttaaaaat

SEQ ID NO: 3473919 - DNA, 20 bp, Homo sapiens
acagaaagcagttctgatgc

SEQ ID NO: 3473920 - DNA, 16 bp, Homo sapiens
acagaaatgctgctgg

SEQ ID NO: 3473921 - DNA, 19 bp, Homo sapiens
acagaaccttgttatttct

SEQ ID NO: 3473922 - DNA, 22 bp, Homo sapiens
acagaaccttgttatttctcag

SEQ ID NO: 3473923 - DNA, 23 bp, Homo sapiens
acagaaccttgttatttctcaga

SEQ ID NO: 3473924 - DNA, 18 bp, Homo sapiens
acagaactctttcaaaac

SEQ ID NO: 3473925 - DNA, 14 bp, Homo sapiens
acagaagcacatgc

SEQ ID NO: 3473926 - DNA, 14 bp, Homo sapiens
acagaagtcctgta

SEQ ID NO: 3473927 - DNA, 15 bp, Homo sapiens
acagaagtcctgtat

SEQ ID NO: 3473928 - DNA, 17 bp, Homo sapiens
acagaagtttgcactat

SEQ ID NO: 3473929 - DNA, 22 bp, Homo sapiens
acagaatactgttaaaggaaaa

SEQ ID NO: 3473930 - DNA, 12 bp, Homo sapiens
acagaatatttc

SEQ ID NO: 3473931 - DNA, 21 bp, Homo sapiens
acagaatatttctattgaatt

SEQ ID NO: 3473932 - DNA, 18 bp, Homo sapiens
acagaatgtgataaggaa

SEQ ID NO: 3473933 - DNA, 18 bp, Homo sapiens
acagaattttatggtgca

SEQ ID NO: 3473934 - DNA, 14 bp, Homo sapiens
acagacacacacac

SEQ ID NO: 3473935 - DNA, 18 bp, Homo sapiens
acagacacaggcccggct

SEQ ID NO: 3473936 - DNA, 17 bp, Homo sapiens
acagacagaaagagaca

SEQ ID NO: 3473937 - DNA, 16 bp, Homo sapiens
acagacctaatgctcc

SEQ ID NO: 3473938 - DNA, 20 bp, Homo sapiens
acagacgttaggcatttcct

SEQ ID NO: 3473939 - DNA, 22 bp, Homo sapiens
acagacgttaggcatttcctgc

SEQ ID NO: 3473940 - DNA, 16 bp, Homo sapiens
acagagaaacagacag

SEQ ID NO: 3473941 - DNA, 19 bp, Homo sapiens
acagagaaagaggaagctt

SEQ ID NO: 3473942 - DNA, 11 bp, Homo sapiens
acagagaaagt

SEQ ID NO: 3473943 - DNA, 18 bp, Homo sapiens
acagagaaagtacttctc

SEQ ID NO: 3473944 - DNA, 22 bp, Homo sapiens
acagagacccagatctcatgga

SEQ ID NO: 3473945 - DNA, 19 bp, Homo sapiens
acagagcccagggagactc

SEQ ID NO: 3473946 - DNA, 14 bp, Homo sapiens
acagagcttccctg

SEQ ID NO: 3473947 - DNA, 22 bp, Homo sapiens
acagaggaggatgtaaggcctt

SEQ ID NO: 3473948 - DNA, 15 bp, Homo sapiens
acagaggcagcccca

SEQ ID NO: 3473949 - DNA, 21 bp, Homo sapiens
acagaggccatgggcctcctg

SEQ ID NO: 3473950 - DNA, 23 bp, Homo sapiens
acagaggccatgggcctcctgtg

SEQ ID NO: 3473951 - DNA, 18 bp, Homo sapiens
acagaggccccagcctcc

SEQ ID NO: 3473952 - DNA, 15 bp, Homo sapiens
acagagggaagaaaa

SEQ ID NO: 3473953 - DNA, 16 bp, Homo sapiens
acagagggaagaaaag

SEQ ID NO: 3473954 - DNA, 18 bp, Homo sapiens
acagagggtgataaatct

SEQ ID NO: 3473955 - DNA, 12 bp, Homo sapiens
acagagtctcac

SEQ ID NO: 3473956 - DNA, 19 bp, Homo sapiens
acagagtctcactgttgcc

SEQ ID NO: 3473957 - DNA, 19 bp, Homo sapiens
acagatatcttcagtttaa

SEQ ID NO: 3473958 - DNA, 14 bp, Homo sapiens
acagatctggaacc

SEQ ID NO: 3473959 - DNA, 20 bp, Homo sapiens
aatttcaggttttgtaaaga

SEQ ID NO: 3473960 - DNA, 21 bp, Homo sapiens
aatttcccaggaccctgaagg

SEQ ID NO: 3473961 - DNA, 19 bp, Homo sapiens
aatttccccctaaaccaac

SEQ ID NO: 3473962 - DNA, 16 bp, Homo sapiens
aatttctactttgaag

SEQ ID NO: 3473963 - DNA, 20 bp, Homo sapiens
aatttctgtgccctcctgac

SEQ ID NO: 3473964 - DNA, 16 bp, Homo sapiens
aatttgactaatttta

SEQ ID NO: 3473965 - DNA, 14 bp, Homo sapiens
aatttgataatgac

SEQ ID NO: 3473966 - DNA, 15 bp, Homo sapiens
aatttgataatgaca

SEQ ID NO: 3473967 - DNA, 16 bp, Homo sapiens
aatttgataatgacac

SEQ ID NO: 3473968 - DNA, 12 bp, Homo sapiens
aatttgattgat

SEQ ID NO: 3473969 - DNA, 17 bp, Homo sapiens
aatttgattgatttgaa

SEQ ID NO: 3473970 - DNA, 22 bp, Homo sapiens
aatttgcacatcttggctatgt

SEQ ID NO: 3473971 - DNA, 14 bp, Homo sapiens
aatttgctgccaaa

SEQ ID NO: 3473972 - DNA, 20 bp, Homo sapiens
aatttgctgccaaatgcgta

SEQ ID NO: 3473973 - DNA, 17 bp, Homo sapiens
aatttggttctaggccg

SEQ ID NO: 3473974 - DNA, 20 bp, Homo sapiens
aatttgtaaaatgttctctt

SEQ ID NO: 3473975 - DNA, 20 bp, Homo sapiens
aatttgtacatatgtaaaat

SEQ ID NO: 3473976 - DNA, 13 bp, Homo sapiens
aatttgtattgaa

SEQ ID NO: 3473977 - DNA, 19 bp, Homo sapiens
aatttgtgttgaaggaact

SEQ ID NO: 3473978 - DNA, 16 bp, Homo sapiens
aattttaatgaagaaa

SEQ ID NO: 3473979 - DNA, 14 bp, Homo sapiens
aattttaatttagt

SEQ ID NO: 3473980 - DNA, 14 bp, Homo sapiens
aattttacttttta

SEQ ID NO: 3473981 - DNA, 18 bp, Homo sapiens
aattttagtaatttccta

SEQ ID NO: 3473982 - DNA, 17 bp, Homo sapiens
aattttcaaggccttca

SEQ ID NO: 3473983 - DNA, 12 bp, Homo sapiens
aattttcagcat

SEQ ID NO: 3473984 - DNA, 18 bp, Homo sapiens
aattttggggattttcaa

SEQ ID NO: 3473985 - DNA, 14 bp, Homo sapiens
aattttgttctctg

SEQ ID NO: 3473986 - DNA, 16 bp, Homo sapiens
aattttgttctctggg

SEQ ID NO: 3473987 - DNA, 20 bp, Homo sapiens
aatttttaaatgtaaaacat

SEQ ID NO: 3473988 - DNA, 13 bp, Homo sapiens
aatttttaagcaa

SEQ ID NO: 3473989 - DNA, 14 bp, Homo sapiens
aatttttgcaataa

SEQ ID NO: 3473990 - DNA, 16 bp, Homo sapiens
aattttttggtacaaa

SEQ ID NO: 3473991 - DNA, 20 bp, Homo sapiens
aattttttggtacaaaaata

SEQ ID NO: 3473992 - DNA, 21 bp, Homo sapiens
aattttttggtacaaaaataa

SEQ ID NO: 3473993 - DNA, 19 bp, Homo sapiens
aatttttttaaccaaaggt

SEQ ID NO: 3473994 - DNA, 19 bp, Homo sapiens
aatttttttcaatatttat

SEQ ID NO: 3473995 - DNA, 17 bp, Homo sapiens
aatttttttctgcacag

SEQ ID NO: 3473996 - DNA, 18 bp, Homo sapiens
aatttttttctgcacagc

SEQ ID NO: 3473997 - DNA, 14 bp, Homo sapiens
aattttttttcatg

SEQ ID NO: 3473998 - DNA, 13 bp, Homo sapiens
acaaaaaaatctg

SEQ ID NO: 3473999 - DNA, 18 bp, Homo sapiens
acaaaaaaatctgcagaa

SEQ ID NO: 3474000 - DNA, 16 bp, Homo sapiens
acaaaaagcataaaaa

SEQ ID NO: 3474001 - DNA, 15 bp, Homo sapiens
acaaaaagtgcttca

SEQ ID NO: 3474002 - DNA, 12 bp, Homo sapiens
acaaaaccagct

SEQ ID NO: 3474003 - DNA, 17 bp, Homo sapiens
acaaaactacatgagaa

SEQ ID NO: 3474004 - DNA, 14 bp, Homo sapiens
acaaaacttttcta

SEQ ID NO: 3474005 - DNA, 23 bp, Homo sapiens
acaaaatgtagaatattcagaca

SEQ ID NO: 3474006 - DNA, 14 bp, Homo sapiens
acaaaatttctatt

SEQ ID NO: 3474007 - DNA, 19 bp, Homo sapiens
acaaacaaaatttctatta

SEQ ID NO: 3474008 - DNA, 16 bp, Homo sapiens
acaaacaaacaaacaa

SEQ ID NO: 3474009 - DNA, 17 bp, Homo sapiens
acaaacacacacaaaag

SEQ ID NO: 3474010 - DNA, 18 bp, Homo sapiens
acaaacctgcctgggttt

SEQ ID NO: 3474011 - DNA, 23 bp, Homo sapiens
acaaactacttgattttattgta

SEQ ID NO: 3474012 - DNA, 15 bp, Homo sapiens
acaaactctctgaac

SEQ ID NO: 3474013 - DNA, 17 bp, Homo sapiens
acaaactggtattctgt

SEQ ID NO: 3474014 - DNA, 19 bp, Homo sapiens
acaaactgtaatacaatga

SEQ ID NO: 3474015 - DNA, 12 bp, Homo sapiens
acaaagaaaatt

SEQ ID NO: 3474016 - DNA, 12 bp, Homo sapiens
acaaagaacctt

SEQ ID NO: 3474017 - DNA, 18 bp, Homo sapiens
acaaagacaaattctgtt

SEQ ID NO: 3474018 - DNA, 19 bp, Homo sapiens
acaaagacaaattctgttt

SEQ ID NO: 3474019 - DNA, 22 bp, Homo sapiens
acaaagatgggtgaaggctggc

SEQ ID NO: 3474020 - DNA, 12 bp, Homo sapiens
acaaagcagcca

SEQ ID NO: 3474021 - DNA, 13 bp, Homo sapiens
acaaagcagccac

SEQ ID NO: 3474022 - DNA, 13 bp, Homo sapiens
acaaagcccaagg

SEQ ID NO: 3474023 - DNA, 20 bp, Homo sapiens
acaaagcccaagggatctgg

SEQ ID NO: 3474024 - DNA, 20 bp, Homo sapiens
acaaaggattaattgctgca

SEQ ID NO: 3474025 - DNA, 11 bp, Homo sapiens
acaaaggcaag

SEQ ID NO: 3474026 - DNA, 20 bp, Homo sapiens
acaaagggcacagcatctgt

SEQ ID NO: 3474027 - DNA, 15 bp, Homo sapiens
acaaaggggaaagaa

SEQ ID NO: 3474028 - DNA, 17 bp, Homo sapiens
acaaaggggaaagaaca

SEQ ID NO: 3474029 - DNA, 18 bp, Homo sapiens
acaaagtgagacagtcca

SEQ ID NO: 3474030 - DNA, 15 bp, Homo sapiens
acaaagtgtgtatta

SEQ ID NO: 3474031 - DNA, 17 bp, Homo sapiens
acaaagtgtgtattaaa

SEQ ID NO: 3474032 - DNA, 18 bp, Homo sapiens
acaaagtgtgtattaaaa

SEQ ID NO: 3474033 - DNA, 21 bp, Homo sapiens
acaaagttactaggtaacttc

SEQ ID NO: 3474034 - DNA, 23 bp, Homo sapiens
acaaagttactaggtaacttcat

SEQ ID NO: 3474035 - DNA, 12 bp, Homo sapiens
acaaatatgcaa

SEQ ID NO: 3474036 - DNA, 21 bp, Homo sapiens
acaaatattggtgttgtcagt

SEQ ID NO: 3474037 - DNA, 14 bp, Homo sapiens
acaaattgcacaga

SEQ ID NO: 3474038 - DNA, 20 bp, Homo sapiens
acaaattgcacagaagtcct

SEQ ID NO: 3474039 - DNA, 12 bp, Homo sapiens
acaacactcaca

SEQ ID NO: 3474040 - DNA, 16 bp, Homo sapiens
acaacattaaaacaat

SEQ ID NO: 3474041 - DNA, 17 bp, Homo sapiens
acaaccactcattcaaa

SEQ ID NO: 3474042 - DNA, 13 bp, Homo sapiens
acaacctgaacct

SEQ ID NO: 3474043 - DNA, 15 bp, Homo sapiens
acaacgtgcattgtg

SEQ ID NO: 3474044 - DNA, 18 bp, Homo sapiens
acaacgtgcattgtgctt

SEQ ID NO: 3474045 - DNA, 23 bp, Homo sapiens
acaactagatcaaggagcccaga

SEQ ID NO: 3474046 - DNA, 17 bp, Homo sapiens
acaactatggatcagaa

SEQ ID NO: 3474047 - DNA, 19 bp, Homo sapiens
acaactatttcggcctttt

SEQ ID NO: 3474048 - DNA, 16 bp, Homo sapiens
acaactattttcagat

SEQ ID NO: 3474049 - DNA, 22 bp, Homo sapiens
acaactgcctcgaaacacagaa

SEQ ID NO: 3474050 - DNA, 16 bp, Homo sapiens
acaactggcaggcagg

SEQ ID NO: 3474051 - DNA, 15 bp, Homo sapiens
acaagacccccagca

SEQ ID NO: 3474052 - DNA, 17 bp, Homo sapiens
acaagacttcagtatgt

SEQ ID NO: 3474053 - DNA, 16 bp, Homo sapiens
acaagagaatgctgtc

SEQ ID NO: 3474054 - DNA, 21 bp, Homo sapiens
acaagagcactacattcattt

SEQ ID NO: 3474055 - DNA, 22 bp, Homo sapiens
acaagagggaatagtatagaca

SEQ ID NO: 3474056 - DNA, 19 bp, Homo sapiens
acaagatattatgtataaa

SEQ ID NO: 3474057 - DNA, 23 bp, Homo sapiens
acaagatattatgtataaaatgt

SEQ ID NO: 3474058 - DNA, 16 bp, Homo sapiens
acaagcaaacccagac

SEQ ID NO: 3474059 - DNA, 19 bp, Homo sapiens
acaagcaagggtctccttc

SEQ ID NO: 3474060 - DNA, 12 bp, Homo sapiens
acaagccagcca

SEQ ID NO: 3474061 - DNA, 13 bp, Homo sapiens
acaagctgcaccc

SEQ ID NO: 3474062 - DNA, 23 bp, Homo sapiens
acaagctgcaccctcaggcaggt

SEQ ID NO: 3474063 - DNA, 17 bp, Homo sapiens
acaaggaaggtggtggg

SEQ ID NO: 3474064 - DNA, 19 bp, Homo sapiens
acaaggttatatgaatata

SEQ ID NO: 3474065 - DNA, 20 bp, Homo sapiens
acaagtcctggatgttgtgt

SEQ ID NO: 3474066 - DNA, 18 bp, Homo sapiens
acaagtgaaaaacatcca

SEQ ID NO: 3474067 - DNA, 18 bp, Homo sapiens
acaagtgccgcaaattgt

SEQ ID NO: 3474068 - DNA, 23 bp, Homo sapiens
acaagtgccgcaaattgtacctt

SEQ ID NO: 3474069 - DNA, 19 bp, Homo sapiens
acaagtggactcagggcag

SEQ ID NO: 3474070 - DNA, 15 bp, Homo sapiens
acaagttgtgtttga

SEQ ID NO: 3474071 - DNA, 12 bp, Homo sapiens
acaataaaatat

SEQ ID NO: 3474072 - DNA, 20 bp, Homo sapiens
acaataaaattttttttcat

SEQ ID NO: 3474073 - DNA, 17 bp, Homo sapiens
acaataatgtaatttag

SEQ ID NO: 3474074 - DNA, 21 bp, Homo sapiens
acaatagcattgattcacctt

SEQ ID NO: 3474075 - DNA, 18 bp, Homo sapiens
acaatagtaacctgggta

SEQ ID NO: 3474076 - DNA, 14 bp, Homo sapiens
acaatatgtgccaa

SEQ ID NO: 3474077 - DNA, 22 bp, Homo sapiens
acaatatgtgccaatcaatagc

SEQ ID NO: 3474078 - DNA, 15 bp, Homo sapiens
acaatattgactttg

SEQ ID NO: 3474079 - DNA, 13 bp, Homo sapiens
acaatcactgcca

SEQ ID NO: 3474080 - DNA, 14 bp, Homo sapiens
acaatcactgccaa

SEQ ID NO: 3474081 - DNA, 19 bp, Homo sapiens
acaatcagccacattctag

SEQ ID NO: 3474082 - DNA, 22 bp, Homo sapiens
acaatcagctccttcctggaga

SEQ ID NO: 3474083 - DNA, 19 bp, Homo sapiens
acaatcatgaaatatgcat

SEQ ID NO: 3474084 - DNA, 15 bp, Homo sapiens
acaatcatgttctgg

SEQ ID NO: 3474085 - DNA, 20 bp, Homo sapiens
acaatggcccgacatttctt

SEQ ID NO: 3474086 - DNA, 17 bp, Homo sapiens
acaatggggatgttgtg

SEQ ID NO: 3474087 - DNA, 22 bp, Homo sapiens
acaatgtgaactttattaaata

SEQ ID NO: 3474088 - DNA, 21 bp, Homo sapiens
acaatgttcatcccatgatgt

SEQ ID NO: 3474089 - DNA, 18 bp, Homo sapiens
acaattatttttacagtt

SEQ ID NO: 3474090 - DNA, 21 bp, Homo sapiens
acaattatttttacagttctc

SEQ ID NO: 3474091 - DNA, 14 bp, Homo sapiens
acaattccatttcc

SEQ ID NO: 3474092 - DNA, 23 bp, Homo sapiens
acaattcctctactaacaatcag

SEQ ID NO: 3474093 - DNA, 20 bp, Homo sapiens
acaatttacaaagtgtgtat

SEQ ID NO: 3474094 - DNA, 19 bp, Homo sapiens
acacaaagaccaaaatgaa

SEQ ID NO: 3474095 - DNA, 19 bp, Homo sapiens
acacaaggatagatgctgg

SEQ ID NO: 3474096 - DNA, 14 bp, Homo sapiens
aaagacactgcaga

SEQ ID NO: 3474097 - DNA, 22 bp, Homo sapiens
aaagacagggctgataagctaa

SEQ ID NO: 3474098 - DNA, 23 bp, Homo sapiens
aaagacatctttctcttttctaa

SEQ ID NO: 3474099 - DNA, 22 bp, Homo sapiens
aaagactgtgaacagcttgctg

SEQ ID NO: 3474100 - DNA, 16 bp, Homo sapiens
aaagagggtgagggcc

SEQ ID NO: 3474101 - DNA, 21 bp, Homo sapiens
aaagagggtgagggccttctt

SEQ ID NO: 3474102 - DNA, 13 bp, Homo sapiens
aaagagtagaatt

SEQ ID NO: 3474103 - DNA, 18 bp, Homo sapiens
aaagagtagaattgcatt

SEQ ID NO: 3474104 - DNA, 18 bp, Homo sapiens
aaagatataagtgctgta

SEQ ID NO: 3474105 - DNA, 20 bp, Homo sapiens
aaagatataagtgctgtata

SEQ ID NO: 3474106 - DNA, 21 bp, Homo sapiens
aaagatatattaaaaatataa

SEQ ID NO: 3474107 - DNA, 23 bp, Homo sapiens
aaagatatattaaaaatataaaa

SEQ ID NO: 3474108 - DNA, 21 bp, Homo sapiens
aaagatctgtcctcagccttg

SEQ ID NO: 3474109 - DNA, 12 bp, Homo sapiens
aaagatgctttt

SEQ ID NO: 3474110 - DNA, 18 bp, Homo sapiens
aaagatggggtctgtaaa

SEQ ID NO: 3474111 - DNA, 18 bp, Homo sapiens
aaagattttaatcaagtt

SEQ ID NO: 3474112 - DNA, 14 bp, Homo sapiens
aaagcaatatgcat

SEQ ID NO: 3474113 - DNA, 15 bp, Homo sapiens
aaagcagctctcccc

SEQ ID NO: 3474114 - DNA, 20 bp, Homo sapiens
aaagcagttctgatgcttac

SEQ ID NO: 3474115 - DNA, 16 bp, Homo sapiens
aaagcataaaaacatt

SEQ ID NO: 3474116 - DNA, 15 bp, Homo sapiens
aaagccaaacatata

SEQ ID NO: 3474117 - DNA, 15 bp, Homo sapiens
aaagccaaggcagcg

SEQ ID NO: 3474118 - DNA, 19 bp, Homo sapiens
aaagccaataacacacagc

SEQ ID NO: 3474119 - DNA, 16 bp, Homo sapiens
aaagcctcctccagcc

SEQ ID NO: 3474120 - DNA, 19 bp, Homo sapiens
aaagcggacatcagctggt

SEQ ID NO: 3474121 - DNA, 15 bp, Homo sapiens
aaagcggctgcctcc

SEQ ID NO: 3474122 - DNA, 16 bp, Homo sapiens
aaagctaggcctggcc

SEQ ID NO: 3474123 - DNA, 18 bp, Homo sapiens
aaagctaggcctggccag

SEQ ID NO: 3474124 - DNA, 20 bp, Homo sapiens
aaagctcaagatgacagctc

SEQ ID NO: 3474125 - DNA, 21 bp, Homo sapiens
aaagctcaagatgacagctct

SEQ ID NO: 3474126 - DNA, 15 bp, Homo sapiens
aaagctgacattgcc

SEQ ID NO: 3474127 - DNA, 18 bp, Homo sapiens
aaagctgacattgccaaa

SEQ ID NO: 3474128 - DNA, 19 bp, Homo sapiens
aaagctgacattgccaaaa

SEQ ID NO: 3474129 - DNA, 23 bp, Homo sapiens
aaagctgtggccagcttgttatt

SEQ ID NO: 3474130 - DNA, 17 bp, Homo sapiens
aaagcttccatgattct

SEQ ID NO: 3474131 - DNA, 18 bp, Homo sapiens
aaagcttccatgattcta

SEQ ID NO: 3474132 - DNA, 20 bp, Homo sapiens
aaagcttccatgattctatt

SEQ ID NO: 3474133 - DNA, 17 bp, Homo sapiens
aaaggaaaagattcctg

SEQ ID NO: 3474134 - DNA, 23 bp, Homo sapiens
aaaggaaatctcaccccatccca

SEQ ID NO: 3474135 - DNA, 13 bp, Homo sapiens
aaaggaagaaaaa

SEQ ID NO: 3474136 - DNA, 14 bp, Homo sapiens
aaaggaagccaaag

SEQ ID NO: 3474137 - DNA, 13 bp, Homo sapiens
aaaggaatttaaa

SEQ ID NO: 3474138 - DNA, 13 bp, Homo sapiens
aaaggagagcatc

SEQ ID NO: 3474139 - DNA, 23 bp, Homo sapiens
aaaggagcatttttttattcagc

SEQ ID NO: 3474140 - DNA, 19 bp, Homo sapiens
aaaggatctttgtggccaa

SEQ ID NO: 3474141 - DNA, 15 bp, Homo sapiens
aaaggccaaacctct

SEQ ID NO: 3474142 - DNA, 12 bp, Homo sapiens
aaaggccagctg

SEQ ID NO: 3474143 - DNA, 14 bp, Homo sapiens
aaaggccagctggc

SEQ ID NO: 3474144 - DNA, 18 bp, Homo sapiens
aaaggccagctggcagca

SEQ ID NO: 3474145 - DNA, 14 bp, Homo sapiens
aaaggccatggaga

SEQ ID NO: 3474146 - DNA, 19 bp, Homo sapiens
aaaggccatggagagctgg

SEQ ID NO: 3474147 - DNA, 17 bp, Homo sapiens
aaaggccttcagacaca

SEQ ID NO: 3474148 - DNA, 17 bp, Homo sapiens
aaaggctcgattttgta

SEQ ID NO: 3474149 - DNA, 22 bp, Homo sapiens
aaagggacttggaagctccgct

SEQ ID NO: 3474150 - DNA, 18 bp, Homo sapiens
aaagggcacagcatctgt

SEQ ID NO: 3474151 - DNA, 17 bp, Homo sapiens
aaaggggacaaggaagg

SEQ ID NO: 3474152 - DNA, 24 bp, Homo sapiens
aaaggggtcggctgaccatgctca

SEQ ID NO: 3474153 - DNA, 15 bp, Homo sapiens
aaaggtgaaggaata

SEQ ID NO: 3474154 - DNA, 16 bp, Homo sapiens
aaaggtgaaggaatat

SEQ ID NO: 3474155 - DNA, 24 bp, Homo sapiens
aaaggtgaaggaatatatggcaga

SEQ ID NO: 3474156 - DNA, 18 bp, Homo sapiens
aaaggtgttgtcccttct

SEQ ID NO: 3474157 - DNA, 19 bp, Homo sapiens
aaaggttgctgtttcacaa

SEQ ID NO: 3474158 - DNA, 16 bp, Homo sapiens
aaaggtttacagaatt

SEQ ID NO: 3474159 - DNA, 11 bp, Homo sapiens
aaagtactgta

SEQ ID NO: 3474160 - DNA, 12 bp, Homo sapiens
aaagtactgtaa

SEQ ID NO: 3474161 - DNA, 20 bp, Homo sapiens
aaagtagaagagggttttag

SEQ ID NO: 3474162 - DNA, 14 bp, Homo sapiens
aaagtagattaaga

SEQ ID NO: 3474163 - DNA, 14 bp, Homo sapiens
aaagtattatcatt

SEQ ID NO: 3474164 - DNA, 15 bp, Homo sapiens
aaagtattattttcc

SEQ ID NO: 3474165 - DNA, 21 bp, Homo sapiens
aaagtattcgttacatcttgt

SEQ ID NO: 3474166 - DNA, 15 bp, Homo sapiens
aaagtattgtaaatt

SEQ ID NO: 3474167 - DNA, 23 bp, Homo sapiens
aaagtattgtaaattatatttgt

SEQ ID NO: 3474168 - DNA, 21 bp, Homo sapiens
aaagtatttaattagtgctaa

SEQ ID NO: 3474169 - DNA, 18 bp, Homo sapiens
aaagtcaccattctgcat

SEQ ID NO: 3474170 - DNA, 20 bp, Homo sapiens
aaagtcaccattctgcattt

SEQ ID NO: 3474171 - DNA, 15 bp, Homo sapiens
aaagtcattggcttt

SEQ ID NO: 3474172 - DNA, 17 bp, Homo sapiens
aaagtcattggctttat

SEQ ID NO: 3474173 - DNA, 12 bp, Homo sapiens
aaagtctcttgt

SEQ ID NO: 3474174 - DNA, 15 bp, Homo sapiens
aaagtgacagagacc

SEQ ID NO: 3474175 - DNA, 18 bp, Homo sapiens
aaagtgacagagacccag

SEQ ID NO: 3474176 - DNA, 15 bp, Homo sapiens
aaagtgataatttct

SEQ ID NO: 3474177 - DNA, 22 bp, Homo sapiens
aaagtgcttcattctttgcagg

SEQ ID NO: 3474178 - DNA, 14 bp, Homo sapiens
aaagtggcctcttt

SEQ ID NO: 3474179 - DNA, 13 bp, Homo sapiens
aaagtgtgcttta

SEQ ID NO: 3474180 - DNA, 22 bp, Homo sapiens
aaagtgtgctttatgctgaaac

SEQ ID NO: 3474181 - DNA, 14 bp, Homo sapiens
aaagtgtgtattaa

SEQ ID NO: 3474182 - DNA, 11 bp, Homo sapiens
aaagttaaaag

SEQ ID NO: 3474183 - DNA, 15 bp, Homo sapiens
aaagttaatgcttaa

SEQ ID NO: 3474184 - DNA, 12 bp, Homo sapiens
aaagttactagg

SEQ ID NO: 3474185 - DNA, 24 bp, Homo sapiens
aaagttatatttcagatgtaatgt

SEQ ID NO: 3474186 - DNA, 22 bp, Homo sapiens
aaagttctgctttctccccaat

SEQ ID NO: 3474187 - DNA, 12 bp, Homo sapiens
aaagttgaaatt

SEQ ID NO: 3474188 - DNA, 18 bp, Homo sapiens
aaagttgcacggctgctg

SEQ ID NO: 3474189 - DNA, 12 bp, Homo sapiens
aaagttgccatt

SEQ ID NO: 3474190 - DNA, 20 bp, Homo sapiens
aaagttgccattattctatg

SEQ ID NO: 3474191 - DNA, 16 bp, Homo sapiens
aaagttggttggataa

SEQ ID NO: 3474192 - DNA, 13 bp, Homo sapiens
aaagttgtacatg

SEQ ID NO: 3474193 - DNA, 20 bp, Homo sapiens
aaagtttaaaacagaagcct

SEQ ID NO: 3474194 - DNA, 15 bp, Homo sapiens
aaagtttgcttagaa

SEQ ID NO: 3474195 - DNA, 16 bp, Homo sapiens
aaagttttacaaaggg

SEQ ID NO: 3474196 - DNA, 15 bp, Homo sapiens
aaataaaacaaaggg

SEQ ID NO: 3474197 - DNA, 16 bp, Homo sapiens
aaataaaacagtatct

SEQ ID NO: 3474198 - DNA, 16 bp, Homo sapiens
aaataaactgtaaact

SEQ ID NO: 3474199 - DNA, 15 bp, Homo sapiens
aaataaattgtatat

SEQ ID NO: 3474200 - DNA, 22 bp, Homo sapiens
aaataaattgtatattcacttt

SEQ ID NO: 3474201 - DNA, 19 bp, Homo sapiens
aaataaatttggttctaat

SEQ ID NO: 3474202 - DNA, 14 bp, Homo sapiens
aaataagaatagaa

SEQ ID NO: 3474203 - DNA, 17 bp, Homo sapiens
aaataatactgctgaga

SEQ ID NO: 3474204 - DNA, 14 bp, Homo sapiens
aaataatatgcatt

SEQ ID NO: 3474205 - DNA, 13 bp, Homo sapiens
aaataatttccta

SEQ ID NO: 3474206 - DNA, 11 bp, Homo sapiens
aaatacaaaaa

SEQ ID NO: 3474207 - DNA, 15 bp, Homo sapiens
aaatacagattttga

SEQ ID NO: 3474208 - DNA, 17 bp, Homo sapiens
aaatacagattttgata

SEQ ID NO: 3474209 - DNA, 20 bp, Homo sapiens
aaatacagtttgtcacatga

SEQ ID NO: 3474210 - DNA, 14 bp, Homo sapiens
aaatacatgcatct

SEQ ID NO: 3474211 - DNA, 19 bp, Homo sapiens
aaatacattcaaattcttt

SEQ ID NO: 3474212 - DNA, 17 bp, Homo sapiens
aaatactgcaagaaaat

SEQ ID NO: 3474213 - DNA, 14 bp, Homo sapiens
aaatagaaaagtta

SEQ ID NO: 3474214 - DNA, 15 bp, Homo sapiens
aaatagaatatagca

SEQ ID NO: 3474215 - DNA, 20 bp, Homo sapiens
aaatagaatatagcatcttt

SEQ ID NO: 3474216 - DNA, 23 bp, Homo sapiens
aaatagacaagagaatgctgtca

SEQ ID NO: 3474217 - DNA, 14 bp, Homo sapiens
aaataggattttta

SEQ ID NO: 3474218 - DNA, 15 bp, Homo sapiens
aaatagtatttgcat

SEQ ID NO: 3474219 - DNA, 17 bp, Homo sapiens
aaatagttaagacatga

SEQ ID NO: 3474220 - DNA, 14 bp, Homo sapiens
aaatatataaatat

SEQ ID NO: 3474221 - DNA, 23 bp, Homo sapiens
aaatatatattattctcatttag

SEQ ID NO: 3474222 - DNA, 18 bp, Homo sapiens
aaatatatgctaagtctt

SEQ ID NO: 3474223 - DNA, 11 bp, Homo sapiens
aaatatatgta

SEQ ID NO: 3474224 - DNA, 19 bp, Homo sapiens
aaatatcccgggggtgggg

SEQ ID NO: 3474225 - DNA, 14 bp, Homo sapiens
aaatatcttggcct

SEQ ID NO: 3474226 - DNA, 13 bp, Homo sapiens
aaatatgctcttt

SEQ ID NO: 3474227 - DNA, 13 bp, Homo sapiens
aaatatggaactt

SEQ ID NO: 3474228 - DNA, 17 bp, Homo sapiens
aaatattcagaatcttt

SEQ ID NO: 3474229 - DNA, 14 bp, Homo sapiens
aacacacacaaaag

SEQ ID NO: 3474230 - DNA, 18 bp, Homo sapiens
aacacactgaggcaggga

SEQ ID NO: 3474231 - DNA, 19 bp, Homo sapiens
aacacagacattctgccag

SEQ ID NO: 3474232 - DNA, 22 bp, Homo sapiens
aacaccattttttttttctttt

SEQ ID NO: 3474233 - DNA, 21 bp, Homo sapiens
aacacccctcagttgtgcagc

SEQ ID NO: 3474234 - DNA, 14 bp, Homo sapiens
aacaccttaatatg

SEQ ID NO: 3474235 - DNA, 15 bp, Homo sapiens
aacacgcctgcaaac

SEQ ID NO: 3474236 - DNA, 22 bp, Homo sapiens
aacactactcttacatgtataa

SEQ ID NO: 3474237 - DNA, 19 bp, Homo sapiens
aacactagacaagccagaa

SEQ ID NO: 3474238 - DNA, 17 bp, Homo sapiens
aacactcaagaagcagg

SEQ ID NO: 3474239 - DNA, 15 bp, Homo sapiens
aacactgagctgtca

SEQ ID NO: 3474240 - DNA, 14 bp, Homo sapiens
aacactgcaggcat

SEQ ID NO: 3474241 - DNA, 23 bp, Homo sapiens
aacactggtggaggatggaaagg

SEQ ID NO: 3474242 - DNA, 22 bp, Homo sapiens
aacactgtgcacatctgtgtct

SEQ ID NO: 3474243 - DNA, 23 bp, Homo sapiens
aacagaaaaatatgtaccaagaa

SEQ ID NO: 3474244 - DNA, 23 bp, Homo sapiens
aacagaatactgttaaaggaaaa

SEQ ID NO: 3474245 - DNA, 16 bp, Homo sapiens
aacagagagaatgaga

SEQ ID NO: 3474246 - DNA, 15 bp, Homo sapiens
aacagattcacactg

SEQ ID NO: 3474247 - DNA, 16 bp, Homo sapiens
aacagattcacactgt

SEQ ID NO: 3474248 - DNA, 18 bp, Homo sapiens
aacagattcacactgtct

SEQ ID NO: 3474249 - DNA, 18 bp, Homo sapiens
aacagccactcccctcca

SEQ ID NO: 3474250 - DNA, 18 bp, Homo sapiens
aacagcctttgaatgtaa

SEQ ID NO: 3474251 - DNA, 22 bp, Homo sapiens
aacagcctttgaatgtaaccaa

SEQ ID NO: 3474252 - DNA, 10 bp, Homo sapiens
aacagctcag

SEQ ID NO: 3474253 - DNA, 14 bp, Homo sapiens
aacagctcaggatc

SEQ ID NO: 3474254 - DNA, 23 bp, Homo sapiens
aacagctctcttcaatgacatag

SEQ ID NO: 3474255 - DNA, 15 bp, Homo sapiens
aacagctgccttagc

SEQ ID NO: 3474256 - DNA, 20 bp, Homo sapiens
aacagctgccttagcttcag

SEQ ID NO: 3474257 - DNA, 15 bp, Homo sapiens
aacagcttgctgtca

SEQ ID NO: 3474258 - DNA, 22 bp, Homo sapiens
aacaggaaaggctcgaaataca

SEQ ID NO: 3474259 - DNA, 12 bp, Homo sapiens
aacaggaccggg

SEQ ID NO: 3474260 - DNA, 17 bp, Homo sapiens
aacaggaccgggtggaa

SEQ ID NO: 3474261 - DNA, 19 bp, Homo sapiens
aacaggagctgggatccta

SEQ ID NO: 3474262 - DNA, 23 bp, Homo sapiens
aacaggccattgtgaaccaatgc

SEQ ID NO: 3474263 - DNA, 22 bp, Homo sapiens
aacaggctgggcttcagtggca

SEQ ID NO: 3474264 - DNA, 14 bp, Homo sapiens
aacagggagactgc

SEQ ID NO: 3474265 - DNA, 13 bp, Homo sapiens
aacaggttgggat

SEQ ID NO: 3474266 - DNA, 17 bp, Homo sapiens
aacaggttgggatggga

SEQ ID NO: 3474267 - DNA, 11 bp, Homo sapiens
aacagtatctc

SEQ ID NO: 3474268 - DNA, 21 bp, Homo sapiens
aacagtcacgcctgaaacttt

SEQ ID NO: 3474269 - DNA, 15 bp, Homo sapiens
aacagttcaaagaag

SEQ ID NO: 3474270 - DNA, 12 bp, Homo sapiens
aacagttttcct

SEQ ID NO: 3474271 - DNA, 21 bp, Homo sapiens
aacagttttcctatgctttga

SEQ ID NO: 3474272 - DNA, 19 bp, Homo sapiens
aacataaaggtaaaacaaa

SEQ ID NO: 3474273 - DNA, 16 bp, Homo sapiens
aacatcacacctgccc

SEQ ID NO: 3474274 - DNA, 16 bp, Homo sapiens
aacatcatcaaggcac

SEQ ID NO: 3474275 - DNA, 21 bp, Homo sapiens
aacatcatcaaggcactgcct

SEQ ID NO: 3474276 - DNA, 22 bp, Homo sapiens
aacatcatgaatttattgcaca

SEQ ID NO: 3474277 - DNA, 16 bp, Homo sapiens
aacatctagaaattgc

SEQ ID NO: 3474278 - DNA, 20 bp, Homo sapiens
aacatgaaagtctagaaata

SEQ ID NO: 3474279 - DNA, 13 bp, Homo sapiens
aacatgatgggcc

SEQ ID NO: 3474280 - DNA, 19 bp, Homo sapiens
aacatgcagtttgaaattc

SEQ ID NO: 3474281 - DNA, 21 bp, Homo sapiens
aacatgcagtttgaaattctg

SEQ ID NO: 3474282 - DNA, 21 bp, Homo sapiens
aacatgcctgccccaaacaaa

SEQ ID NO: 3474283 - DNA, 22 bp, Homo sapiens
aacatggtggaaaacgaagctc

SEQ ID NO: 3474284 - DNA, 20 bp, Homo sapiens
aacatgtaaccggcatgttt

SEQ ID NO: 3474285 - DNA, 13 bp, Homo sapiens
aacattaagaaaa

SEQ ID NO: 3474286 - DNA, 19 bp, Homo sapiens
aacattaagaaaatcatat

SEQ ID NO: 3474287 - DNA, 22 bp, Homo sapiens
aacattagttgcactaactgct

SEQ ID NO: 3474288 - DNA, 16 bp, Homo sapiens
aacattcagaggaaga

SEQ ID NO: 3474289 - DNA, 12 bp, Homo sapiens
aacattcccact

SEQ ID NO: 3474290 - DNA, 21 bp, Homo sapiens
aacattctattgactttctta

SEQ ID NO: 3474291 - DNA, 22 bp, Homo sapiens
aacattgtgatgtatattcctt

SEQ ID NO: 3474292 - DNA, 22 bp, Homo sapiens
aacatttaagggaatgtgagca

SEQ ID NO: 3474293 - DNA, 21 bp, Homo sapiens
aacatttgtgtaatatgaaat

SEQ ID NO: 3474294 - DNA, 22 bp, Homo sapiens
aacattttaaaaacatagaaaa

SEQ ID NO: 3474295 - DNA, 15 bp, Homo sapiens
aacattttacccaca

SEQ ID NO: 3474296 - DNA, 16 bp, Homo sapiens
aacattttactgttgt

SEQ ID NO: 3474297 - DNA, 17 bp, Homo sapiens
aacattttcttgaattt

SEQ ID NO: 3474298 - DNA, 18 bp, Homo sapiens
aacattttcttgaatttt

SEQ ID NO: 3474299 - DNA, 10 bp, Homo sapiens
aaccaaaggt

SEQ ID NO: 3474300 - DNA, 15 bp, Homo sapiens
aaccaagtcaagtga

SEQ ID NO: 3474301 - DNA, 20 bp, Homo sapiens
aaccaagtcatgtgcatttc

SEQ ID NO: 3474302 - DNA, 13 bp, Homo sapiens
aaccacaccacat

SEQ ID NO: 3474303 - DNA, 23 bp, Homo sapiens
aaccacaccacatctaagcctga

SEQ ID NO: 3474304 - DNA, 15 bp, Homo sapiens
aaccacagctgctgg

SEQ ID NO: 3474305 - DNA, 18 bp, Homo sapiens
aaccacagctgctggaga

SEQ ID NO: 3474306 - DNA, 13 bp, Homo sapiens
aaccacatcttgc

SEQ ID NO: 3474307 - DNA, 21 bp, Homo sapiens
aaccacctaggcaatgaagaa

SEQ ID NO: 3474308 - DNA, 22 bp, Homo sapiens
aaccacctaggcaatgaagaat

SEQ ID NO: 3474309 - DNA, 13 bp, Homo sapiens
aaccacgctggac

SEQ ID NO: 3474310 - DNA, 23 bp, Homo sapiens
aaccactgcaagtccttttgtaa

SEQ ID NO: 3474311 - DNA, 21 bp, Homo sapiens
aaccagcatcccttgaccagg

SEQ ID NO: 3474312 - DNA, 14 bp, Homo sapiens
aaccagctaagaaa

SEQ ID NO: 3474313 - DNA, 16 bp, Homo sapiens
aaccagctaagaaaag

SEQ ID NO: 3474314 - DNA, 21 bp, Homo sapiens
aaccagctaagaaaagatttt

SEQ ID NO: 3474315 - DNA, 18 bp, Homo sapiens
aaccagggaagctgtccc

SEQ ID NO: 3474316 - DNA, 21 bp, Homo sapiens
aaccagggagcccctttgatg

SEQ ID NO: 3474317 - DNA, 16 bp, Homo sapiens
aaccagtatttttgct

SEQ ID NO: 3474318 - DNA, 18 bp, Homo sapiens
aaccagtccccccaccct

SEQ ID NO: 3474319 - DNA, 22 bp, Homo sapiens
aaccatgaatgaacccctggct

SEQ ID NO: 3474320 - DNA, 20 bp, Homo sapiens
aaccatgcctggtattttca

SEQ ID NO: 3474321 - DNA, 22 bp, Homo sapiens
aacccaaaaaagaacaagctca

SEQ ID NO: 3474322 - DNA, 15 bp, Homo sapiens
aacccaagcttagaa

SEQ ID NO: 3474323 - DNA, 12 bp, Homo sapiens
aacccagactca

SEQ ID NO: 3474324 - DNA, 14 bp, Homo sapiens
aacccagactcaga

SEQ ID NO: 3474325 - DNA, 15 bp, Homo sapiens
aacccagactcagac

SEQ ID NO: 3474326 - DNA, 21 bp, Homo sapiens
aacccagactgtctccacggc

SEQ ID NO: 3474327 - DNA, 21 bp, Homo sapiens
aacccagtcttgtggatggaa

SEQ ID NO: 3474328 - DNA, 14 bp, Homo sapiens
aacccatggctcta

SEQ ID NO: 3474329 - DNA, 17 bp, Homo sapiens
aaccccagggcccccac

SEQ ID NO: 3474330 - DNA, 15 bp, Homo sapiens
aacccccagcctgct

SEQ ID NO: 3474331 - DNA, 18 bp, Homo sapiens
aaccccccagcactgagg

SEQ ID NO: 3474332 - DNA, 19 bp, Homo sapiens
aaccccccagcactgagga

SEQ ID NO: 3474333 - DNA, 17 bp, Homo sapiens
aacccctggctccttca

SEQ ID NO: 3474334 - DNA, 18 bp, Homo sapiens
aacccctggctccttcac

SEQ ID NO: 3474335 - DNA, 21 bp, Homo sapiens
aaccctgggagtagctagttt

SEQ ID NO: 3474336 - DNA, 20 bp, Homo sapiens
aacccttctcctcttgtaaa

SEQ ID NO: 3474337 - DNA, 21 bp, Homo sapiens
aacccttctcctcttgtaaat

SEQ ID NO: 3474338 - DNA, 14 bp, Homo sapiens
aaccgcaggaagct

SEQ ID NO: 3474339 - DNA, 13 bp, Homo sapiens
aacctaaaaaaga

SEQ ID NO: 3474340 - DNA, 22 bp, Homo sapiens
aacctaaatttggttctaggcc

SEQ ID NO: 3474341 - DNA, 18 bp, Homo sapiens
aacctacacactgtcatg

SEQ ID NO: 3474342 - DNA, 18 bp, Homo sapiens
aacctacctcccacactc

SEQ ID NO: 3474343 - DNA, 21 bp, Homo sapiens
aacctatgaagcaatggatat

SEQ ID NO: 3474344 - DNA, 19 bp, Homo sapiens
aacctcacgcacctcccat

SEQ ID NO: 3474345 - DNA, 11 bp, Homo sapiens
aacctcagcct

SEQ ID NO: 3474346 - DNA, 12 bp, Homo sapiens
aacctcagcctg

SEQ ID NO: 3474347 - DNA, 13 bp, Homo sapiens
aacctcagcctgg

SEQ ID NO: 3474348 - DNA, 14 bp, Homo sapiens
aacctccccagcct

SEQ ID NO: 3474349 - DNA, 14 bp, Homo sapiens
aacctcgagtactg

SEQ ID NO: 3474350 - DNA, 16 bp, Homo sapiens
aacctcgagtactgtg

SEQ ID NO: 3474351 - DNA, 19 bp, Homo sapiens
aacctcgagtactgtgggc

SEQ ID NO: 3474352 - DNA, 17 bp, Homo sapiens
aacctcgccctctcctt

SEQ ID NO: 3474353 - DNA, 19 bp, Homo sapiens
aacctcgctggactctcag

SEQ ID NO: 3474354 - DNA, 19 bp, Homo sapiens
aacctctgtctcccgggtt

SEQ ID NO: 3474355 - DNA, 18 bp, Homo sapiens
aacctcttcagaggccct

SEQ ID NO: 3474356 - DNA, 12 bp, Homo sapiens
aacctcttttta

SEQ ID NO: 3474357 - DNA, 15 bp, Homo sapiens
aacctgaacctagga

SEQ ID NO: 3474358 - DNA, 21 bp, Homo sapiens
aacctgcaaaaaatacttttt

SEQ ID NO: 3474359 - DNA, 19 bp, Homo sapiens
aacctggaggtcaatgtta

SEQ ID NO: 3474360 - DNA, 20 bp, Homo sapiens
aacctgggattcaggaatgt

SEQ ID NO: 3474361 - DNA, 13 bp, Homo sapiens
aagttgccattat

SEQ ID NO: 3474362 - DNA, 21 bp, Homo sapiens
aagttgccattattctatgta

SEQ ID NO: 3474363 - DNA, 19 bp, Homo sapiens
aagttggaccagaggaagc

SEQ ID NO: 3474364 - DNA, 15 bp, Homo sapiens
aagttgtacatgaaa

SEQ ID NO: 3474365 - DNA, 16 bp, Homo sapiens
aagttgtacatgaaat

SEQ ID NO: 3474366 - DNA, 16 bp, Homo sapiens
aagtttcagttgattt

SEQ ID NO: 3474367 - DNA, 19 bp, Homo sapiens
aagtttccttccagcccag

SEQ ID NO: 3474368 - DNA, 17 bp, Homo sapiens
aagtttccttggctggt

SEQ ID NO: 3474369 - DNA, 20 bp, Homo sapiens
aagtttgagatcagcctggg

SEQ ID NO: 3474370 - DNA, 16 bp, Homo sapiens
aagttttcaaatttgt

SEQ ID NO: 3474371 - DNA, 22 bp, Homo sapiens
aagttttttcctccctgcttaa

SEQ ID NO: 3474372 - DNA, 16 bp, Homo sapiens
aataaaaaacaaatat

SEQ ID NO: 3474373 - DNA, 23 bp, Homo sapiens
aataaaaacattgcctttgaatg

SEQ ID NO: 3474374 - DNA, 22 bp, Homo sapiens
aataaaaaccaagaagatgtct

SEQ ID NO: 3474375 - DNA, 18 bp, Homo sapiens
aataaaacagtatctctt

SEQ ID NO: 3474376 - DNA, 21 bp, Homo sapiens
aataaaaggaagccaaagagt

SEQ ID NO: 3474377 - DNA, 15 bp, Homo sapiens
aataaaaggactctg

SEQ ID NO: 3474378 - DNA, 18 bp, Homo sapiens
aataaaaggactctggaa

SEQ ID NO: 3474379 - DNA, 20 bp, Homo sapiens
aataaaagttttacaaaggg

SEQ ID NO: 3474380 - DNA, 19 bp, Homo sapiens
aataaaattttttttcatg

SEQ ID NO: 3474381 - DNA, 22 bp, Homo sapiens
aataaaattttttttcatgttt

SEQ ID NO: 3474382 - DNA, 17 bp, Homo sapiens
aataaacgatgttgtga

SEQ ID NO: 3474383 - DNA, 19 bp, Homo sapiens
aataaaggtatgaaagggt

SEQ ID NO: 3474384 - DNA, 16 bp, Homo sapiens
aataaagtatttaatt

SEQ ID NO: 3474385 - DNA, 16 bp, Homo sapiens
aataaatatatataaa

SEQ ID NO: 3474386 - DNA, 19 bp, Homo sapiens
aataaatatatataaacct

SEQ ID NO: 3474387 - DNA, 16 bp, Homo sapiens
aataaatctgacccag

SEQ ID NO: 3474388 - DNA, 21 bp, Homo sapiens
aataaatgtatcttattcaca

SEQ ID NO: 3474389 - DNA, 15 bp, Homo sapiens
aataaattctgattc

SEQ ID NO: 3474390 - DNA, 20 bp, Homo sapiens
aataaattgctaatgttgct

SEQ ID NO: 3474391 - DNA, 21 bp, Homo sapiens
aataacaatgaaagttgataa

SEQ ID NO: 3474392 - DNA, 12 bp, Homo sapiens
aataacacacat

SEQ ID NO: 3474393 - DNA, 20 bp, Homo sapiens
aataacataatttgtacata

SEQ ID NO: 3474394 - DNA, 19 bp, Homo sapiens
aataactctgtggcattat

SEQ ID NO: 3474395 - DNA, 22 bp, Homo sapiens
aataagaaacaactctttgaga

SEQ ID NO: 3474396 - DNA, 16 bp, Homo sapiens
aataagtgtctttctg

SEQ ID NO: 3474397 - DNA, 19 bp, Homo sapiens
aataataagtgatgtgctg

SEQ ID NO: 3474398 - DNA, 20 bp, Homo sapiens
aataataagtgatgtgctga

SEQ ID NO: 3474399 - DNA, 16 bp, Homo sapiens
aataatactgctgaga

SEQ ID NO: 3474400 - DNA, 11 bp, Homo sapiens
aataatatgca

SEQ ID NO: 3474401 - DNA, 12 bp, Homo sapiens
aataatatgcat

SEQ ID NO: 3474402 - DNA, 21 bp, Homo sapiens
aataatcctaaacatatgaat

SEQ ID NO: 3474403 - DNA, 23 bp, Homo sapiens
aataatcttattagggagaaaat

SEQ ID NO: 3474404 - DNA, 10 bp, Homo sapiens
aataatgcag

SEQ ID NO: 3474405 - DNA, 17 bp, Homo sapiens
aataatgcagtatggta

SEQ ID NO: 3474406 - DNA, 19 bp, Homo sapiens
aataatgcagtatggtaca

SEQ ID NO: 3474407 - DNA, 16 bp, Homo sapiens
aataatgtaattgtaa

SEQ ID NO: 3474408 - DNA, 23 bp, Homo sapiens
aataattccacagtcctgaagca

SEQ ID NO: 3474409 - DNA, 16 bp, Homo sapiens
aataattgcagaacta

SEQ ID NO: 3474410 - DNA, 15 bp, Homo sapiens
aataatttatagtaa

SEQ ID NO: 3474411 - DNA, 13 bp, Homo sapiens
aatacaaaacttc

SEQ ID NO: 3474412 - DNA, 18 bp, Homo sapiens
aatacaaaggttccattc

SEQ ID NO: 3474413 - DNA, 14 bp, Homo sapiens
aatacaacaaagga

SEQ ID NO: 3474414 - DNA, 22 bp, Homo sapiens
aatacaagatattatgtataaa

SEQ ID NO: 3474415 - DNA, 13 bp, Homo sapiens
aatacagaggcaa

SEQ ID NO: 3474416 - DNA, 20 bp, Homo sapiens
aatacagattttgatagcaa

SEQ ID NO: 3474417 - DNA, 15 bp, Homo sapiens
aatacagtacaggca

SEQ ID NO: 3474418 - DNA, 18 bp, Homo sapiens
aatacagtacaggcagca

SEQ ID NO: 3474419 - DNA, 16 bp, Homo sapiens
aatacagtcttccaca

SEQ ID NO: 3474420 - DNA, 18 bp, Homo sapiens
aatacagtcttccacaaa

SEQ ID NO: 3474421 - DNA, 21 bp, Homo sapiens
aatacagtcttccacaaagaa

SEQ ID NO: 3474422 - DNA, 17 bp, Homo sapiens
aatacatgacatttatt

SEQ ID NO: 3474423 - DNA, 23 bp, Homo sapiens
aatacatgacatttatttttcat

SEQ ID NO: 3474424 - DNA, 18 bp, Homo sapiens
aatacattcaaattcttt

SEQ ID NO: 3474425 - DNA, 14 bp, Homo sapiens
aatactaccttgaa

SEQ ID NO: 3474426 - DNA, 16 bp, Homo sapiens
aatactaccttgaaaa

SEQ ID NO: 3474427 - DNA, 22 bp, Homo sapiens
aatactctaccctcttagaaaa

SEQ ID NO: 3474428 - DNA, 23 bp, Homo sapiens
aatactcttaggaagagaaacca

SEQ ID NO: 3474429 - DNA, 15 bp, Homo sapiens
aatactgctgagata

SEQ ID NO: 3474430 - DNA, 21 bp, Homo sapiens
aatactgctgagatacataca

SEQ ID NO: 3474431 - DNA, 15 bp, Homo sapiens
aatacttgaacttgt

SEQ ID NO: 3474432 - DNA, 13 bp, Homo sapiens
aatacttttcctt

SEQ ID NO: 3474433 - DNA, 14 bp, Homo sapiens
aatacttttcctta

SEQ ID NO: 3474434 - DNA, 20 bp, Homo sapiens
aatagaaggatgtacatttc

SEQ ID NO: 3474435 - DNA, 22 bp, Homo sapiens
aatagaaggatgtacatttcca

SEQ ID NO: 3474436 - DNA, 22 bp, Homo sapiens
aatagaatatagcatctttcat

SEQ ID NO: 3474437 - DNA, 14 bp, Homo sapiens
aatagattaggttt

SEQ ID NO: 3474438 - DNA, 20 bp, Homo sapiens
aatagcctgcctcttctcta

SEQ ID NO: 3474439 - DNA, 14 bp, Homo sapiens
aatagctgggacta

SEQ ID NO: 3474440 - DNA, 21 bp, Homo sapiens
aatagcttatgtacaaaactt

SEQ ID NO: 3474441 - DNA, 22 bp, Homo sapiens
aataggcattaacacaaaggag

SEQ ID NO: 3474442 - DNA, 16 bp, Homo sapiens
aataggttcttcttgt

SEQ ID NO: 3474443 - DNA, 13 bp, Homo sapiens
aatagtatagaca

SEQ ID NO: 3474444 - DNA, 14 bp, Homo sapiens
aatagtcatacctg

SEQ ID NO: 3474445 - DNA, 14 bp, Homo sapiens
aatagtctagatgg

SEQ ID NO: 3474446 - DNA, 12 bp, Homo sapiens
aatagttcaagg

SEQ ID NO: 3474447 - DNA, 21 bp, Homo sapiens
aatagttcaggtaacaggcag

SEQ ID NO: 3474448 - DNA, 22 bp, Homo sapiens
aatagtttgaacagatatgttt

SEQ ID NO: 3474449 - DNA, 12 bp, Homo sapiens
aatataaatgtt

SEQ ID NO: 3474450 - DNA, 13 bp, Homo sapiens
aatataagaataa

SEQ ID NO: 3474451 - DNA, 16 bp, Homo sapiens
aatataagaataaaat

SEQ ID NO: 3474452 - DNA, 17 bp, Homo sapiens
aatataagtaaagtgat

SEQ ID NO: 3474453 - DNA, 21 bp, Homo sapiens
aatataagtggtgcttagaaa

SEQ ID NO: 3474454 - DNA, 22 bp, Homo sapiens
aatatacttgtggactaaaaga

SEQ ID NO: 3474455 - DNA, 23 bp, Homo sapiens
aatatacttgtggactaaaagat

SEQ ID NO: 3474456 - DNA, 15 bp, Homo sapiens
aatatagcatctttc

SEQ ID NO: 3474457 - DNA, 19 bp, Homo sapiens
aatatagctgtacaaatat

SEQ ID NO: 3474458 - DNA, 13 bp, Homo sapiens
aatatataaatat

SEQ ID NO: 3474459 - DNA, 17 bp, Homo sapiens
aatatataaatatatat

SEQ ID NO: 3474460 - DNA, 14 bp, Homo sapiens
aatatatataaacc

SEQ ID NO: 3474461 - DNA, 16 bp, Homo sapiens
aatatatattattctc

SEQ ID NO: 3474462 - DNA, 21 bp, Homo sapiens
aatatatattattctcattta

SEQ ID NO: 3474463 - DNA, 23 bp, Homo sapiens
aatatatattattctcatttagt

SEQ ID NO: 3474464 - DNA, 14 bp, Homo sapiens
aatatatggcagag

SEQ ID NO: 3474465 - DNA, 13 bp, Homo sapiens
aatatatgtattt

SEQ ID NO: 3474466 - DNA, 21 bp, Homo sapiens
aatatatttgtgtatttaaca

SEQ ID NO: 3474467 - DNA, 14 bp, Homo sapiens
aatatcaaatgcag

SEQ ID NO: 3474468 - DNA, 15 bp, Homo sapiens
aatatcaatataatg

SEQ ID NO: 3474469 - DNA, 13 bp, Homo sapiens
aatatcctgcttg

SEQ ID NO: 3474470 - DNA, 15 bp, Homo sapiens
aatatcttggcctaa

SEQ ID NO: 3474471 - DNA, 13 bp, Homo sapiens
aatatgaaaactt

SEQ ID NO: 3474472 - DNA, 14 bp, Homo sapiens
aatatgaaaactta

SEQ ID NO: 3474473 - DNA, 23 bp, Homo sapiens
aatatgaatgagaatgtgccatg

SEQ ID NO: 3474474 - DNA, 18 bp, Homo sapiens
aatatgcacacagtgctt

SEQ ID NO: 3474475 - DNA, 14 bp, Homo sapiens
aatatgctggctgg

SEQ ID NO: 3474476 - DNA, 17 bp, Homo sapiens
aatatggacacttaata

SEQ ID NO: 3474477 - DNA, 12 bp, Homo sapiens
aatatgtaccaa

SEQ ID NO: 3474478 - DNA, 21 bp, Homo sapiens
aatatgtgagtgccttttgca

SEQ ID NO: 3474479 - DNA, 13 bp, Homo sapiens
aatattaaatctg

SEQ ID NO: 3474480 - DNA, 19 bp, Homo sapiens
aatattagctttactgttt

SEQ ID NO: 3474481 - DNA, 16 bp, Homo sapiens
aatattatgagatgct

SEQ ID NO: 3474482 - DNA, 15 bp, Homo sapiens
aatattcagaatctt

SEQ ID NO: 3474483 - DNA, 23 bp, Homo sapiens
aatattcagacaaaatggataca

SEQ ID NO: 3474484 - DNA, 15 bp, Homo sapiens
aatattccctagaaa

SEQ ID NO: 3474485 - DNA, 15 bp, Homo sapiens
aatattgactttgtc

SEQ ID NO: 3474486 - DNA, 22 bp, Homo sapiens
aatattggtgtactgtaatgtg

SEQ ID NO: 3474487 - DNA, 23 bp, Homo sapiens
aatattgtgaagaaaaataaagt

SEQ ID NO: 3474488 - DNA, 17 bp, Homo sapiens
aatatttataaaacttc

SEQ ID NO: 3474489 - DNA, 15 bp, Homo sapiens
aatatttattacctc

SEQ ID NO: 3474490 - DNA, 16 bp, Homo sapiens
aatatttattacctct

SEQ ID NO: 3474491 - DNA, 18 bp, Homo sapiens
aatatttattacctctga

SEQ ID NO: 3474492 - DNA, 12 bp, Homo sapiens
aatatttctagt

SEQ ID NO: 3474493 - DNA, 21 bp, Homo sapiens
aattttgttctctgggagaaa

SEQ ID NO: 3474494 - DNA, 23 bp, Homo sapiens
aattttgttctctgggagaaaat

SEQ ID NO: 3474495 - DNA, 19 bp, Homo sapiens
aatttttaaaataaactgt

SEQ ID NO: 3474496 - DNA, 13 bp, Homo sapiens
aatttttcctatg

SEQ ID NO: 3474497 - DNA, 20 bp, Homo sapiens
aatttttctctaactcagaa

SEQ ID NO: 3474498 - DNA, 22 bp, Homo sapiens
aatttttctctaactcagaaac

SEQ ID NO: 3474499 - DNA, 11 bp, Homo sapiens
aatttttgcaa

SEQ ID NO: 3474500 - DNA, 12 bp, Homo sapiens
aatttttgcaat

SEQ ID NO: 3474501 - DNA, 14 bp, Homo sapiens
aatttttgtaattt

SEQ ID NO: 3474502 - DNA, 17 bp, Homo sapiens
aatttttgtattatttt

SEQ ID NO: 3474503 - DNA, 15 bp, Homo sapiens
aattttttggtacaa

SEQ ID NO: 3474504 - DNA, 15 bp, Homo sapiens
aatttttttagaaag

SEQ ID NO: 3474505 - DNA, 18 bp, Homo sapiens
aatttttttagaaagcat

SEQ ID NO: 3474506 - DNA, 15 bp, Homo sapiens
aatttttttctgcac

SEQ ID NO: 3474507 - DNA, 19 bp, Homo sapiens
aatttttttctgcacagct

SEQ ID NO: 3474508 - DNA, 15 bp, Homo sapiens
aattttttttcatgt

SEQ ID NO: 3474509 - DNA, 23 bp, Homo sapiens
aattttttttcatgttttaacaa

SEQ ID NO: 3474510 - DNA, 16 bp, Homo sapiens
acaaaaaaatctgcag

SEQ ID NO: 3474511 - DNA, 19 bp, Homo sapiens
acaaaaaaatctgcagaag

SEQ ID NO: 3474512 - DNA, 12 bp, Homo sapiens
acaaaaacaaaa

SEQ ID NO: 3474513 - DNA, 16 bp, Homo sapiens
acaaaaacaaaaccag

SEQ ID NO: 3474514 - DNA, 15 bp, Homo sapiens
acaaaaagacaaaca

SEQ ID NO: 3474515 - DNA, 10 bp, Homo sapiens
acaaaaataa

SEQ ID NO: 3474516 - DNA, 20 bp, Homo sapiens
acaaaaataaatttatatga

SEQ ID NO: 3474517 - DNA, 16 bp, Homo sapiens
acaaaaatactcagat

SEQ ID NO: 3474518 - DNA, 14 bp, Homo sapiens
acaaaaattaaaat

SEQ ID NO: 3474519 - DNA, 14 bp, Homo sapiens
acaaaacaaaacaa

SEQ ID NO: 3474520 - DNA, 15 bp, Homo sapiens
acaaaactacatgag

SEQ ID NO: 3474521 - DNA, 16 bp, Homo sapiens
acaaaactgcatttca

SEQ ID NO: 3474522 - DNA, 11 bp, Homo sapiens
acaaaacttcc

SEQ ID NO: 3474523 - DNA, 14 bp, Homo sapiens
acaaaactttttaa

SEQ ID NO: 3474524 - DNA, 15 bp, Homo sapiens
acaaaataaagctgt

SEQ ID NO: 3474525 - DNA, 22 bp, Homo sapiens
acaaaataaccaatcctggaca

SEQ ID NO: 3474526 - DNA, 14 bp, Homo sapiens
acaaaatctgttta

SEQ ID NO: 3474527 - DNA, 16 bp, Homo sapiens
acaaaatggcttcagt

SEQ ID NO: 3474528 - DNA, 17 bp, Homo sapiens
acaaaatgtagaatatt

SEQ ID NO: 3474529 - DNA, 22 bp, Homo sapiens
acaaaatgtagaatattcagac

SEQ ID NO: 3474530 - DNA, 19 bp, Homo sapiens
acaaaattaaaaaaaattg

SEQ ID NO: 3474531 - DNA, 14 bp, Homo sapiens
acaaacctgcctgg

SEQ ID NO: 3474532 - DNA, 20 bp, Homo sapiens
acaaactcaccatctgtgca

SEQ ID NO: 3474533 - DNA, 17 bp, Homo sapiens
acaaactgtaatacaat

SEQ ID NO: 3474534 - DNA, 15 bp, Homo sapiens
acaaagacattgatt

SEQ ID NO: 3474535 - DNA, 16 bp, Homo sapiens
acaaagaccaaaatga

SEQ ID NO: 3474536 - DNA, 20 bp, Homo sapiens
acaaagaccaaaatgaaagt

SEQ ID NO: 3474537 - DNA, 14 bp, Homo sapiens
acaaagcagccacg

SEQ ID NO: 3474538 - DNA, 16 bp, Homo sapiens
acaaagccagaagctg

SEQ ID NO: 3474539 - DNA, 20 bp, Homo sapiens
acaaagccagaagctgagca

SEQ ID NO: 3474540 - DNA, 11 bp, Homo sapiens
acaaagcccaa

SEQ ID NO: 3474541 - DNA, 18 bp, Homo sapiens
acaaagctcaagatgaca

SEQ ID NO: 3474542 - DNA, 14 bp, Homo sapiens
acaaaggttccatt

SEQ ID NO: 3474543 - DNA, 16 bp, Homo sapiens
acaaataataagcaaa

SEQ ID NO: 3474544 - DNA, 19 bp, Homo sapiens
acaaatacattcaaattct

SEQ ID NO: 3474545 - DNA, 22 bp, Homo sapiens
acaaatacattcaaattctttt

SEQ ID NO: 3474546 - DNA, 15 bp, Homo sapiens
acaaatactcttagg

SEQ ID NO: 3474547 - DNA, 14 bp, Homo sapiens
acaaatataagaat

SEQ ID NO: 3474548 - DNA, 15 bp, Homo sapiens
acaaatataagaata

SEQ ID NO: 3474549 - DNA, 16 bp, Homo sapiens
acaaatataagaataa

SEQ ID NO: 3474550 - DNA, 17 bp, Homo sapiens
acaaatataagaataaa

SEQ ID NO: 3474551 - DNA, 19 bp, Homo sapiens
acaaatataagaataaaat

SEQ ID NO: 3474552 - DNA, 15 bp, Homo sapiens
acaaatggacatagg

SEQ ID NO: 3474553 - DNA, 15 bp, Homo sapiens
acaaattctgtttct

SEQ ID NO: 3474554 - DNA, 17 bp, Homo sapiens
acaacaggttttcacca

SEQ ID NO: 3474555 - DNA, 18 bp, Homo sapiens
acaacaggttttcaccat

SEQ ID NO: 3474556 - DNA, 19 bp, Homo sapiens
acaacaggttttcaccata

SEQ ID NO: 3474557 - DNA, 23 bp, Homo sapiens
acaacagttacataattcactct

SEQ ID NO: 3474558 - DNA, 16 bp, Homo sapiens
acaaccaatggaatgt

SEQ ID NO: 3474559 - DNA, 18 bp, Homo sapiens
acaacctgaacctaggag

SEQ ID NO: 3474560 - DNA, 15 bp, Homo sapiens
acaacgaggaagccc

SEQ ID NO: 3474561 - DNA, 14 bp, Homo sapiens
acaacgtctttttg

SEQ ID NO: 3474562 - DNA, 20 bp, Homo sapiens
acaacgtctttttgtttgtt

SEQ ID NO: 3474563 - DNA, 17 bp, Homo sapiens
acaactatttcggcctt

SEQ ID NO: 3474564 - DNA, 15 bp, Homo sapiens
acaactattttcaga

SEQ ID NO: 3474565 - DNA, 21 bp, Homo sapiens
acaactctactgttgcaaagc

SEQ ID NO: 3474566 - DNA, 21 bp, Homo sapiens
acaactgcctcgaaacacaga

SEQ ID NO: 3474567 - DNA, 14 bp, Homo sapiens
acaagacttcagta

SEQ ID NO: 3474568 - DNA, 15 bp, Homo sapiens
acaagagcactacat

SEQ ID NO: 3474569 - DNA, 15 bp, Homo sapiens
acaagcaaacccaga

SEQ ID NO: 3474570 - DNA, 22 bp, Homo sapiens
acaagcaattagacaagaactt

SEQ ID NO: 3474571 - DNA, 19 bp, Homo sapiens
acaagcacaaagctcaaga

SEQ ID NO: 3474572 - DNA, 18 bp, Homo sapiens
acaagcactaaacaaaga

SEQ ID NO: 3474573 - DNA, 12 bp, Homo sapiens
acaagccacccc

SEQ ID NO: 3474574 - DNA, 14 bp, Homo sapiens
acaagccagaactt

SEQ ID NO: 3474575 - DNA, 22 bp, Homo sapiens
acaagccagaacttgaccctga

SEQ ID NO: 3474576 - DNA, 17 bp, Homo sapiens
acaagcccccccttcca

SEQ ID NO: 3474577 - DNA, 18 bp, Homo sapiens
acaagcccccccttccac

SEQ ID NO: 3474578 - DNA, 20 bp, Homo sapiens
acaagcctggtaggaaaggg

SEQ ID NO: 3474579 - DNA, 17 bp, Homo sapiens
acaagcgtgagccactg

SEQ ID NO: 3474580 - DNA, 18 bp, Homo sapiens
acaagcgtgagccactgc

SEQ ID NO: 3474581 - DNA, 20 bp, Homo sapiens
acaagcgtgagccactgcac

SEQ ID NO: 3474582 - DNA, 21 bp, Homo sapiens
acaagcgtgagccactgcacc

SEQ ID NO: 3474583 - DNA, 23 bp, Homo sapiens
acaagctattccctcaaatctga

SEQ ID NO: 3474584 - DNA, 22 bp, Homo sapiens
acaagctgcaccctcaggcagg

SEQ ID NO: 3474585 - DNA, 17 bp, Homo sapiens
acaaggaaggaaaagaa

SEQ ID NO: 3474586 - DNA, 18 bp, Homo sapiens
acaaggaaggaaaagaaa

SEQ ID NO: 3474587 - DNA, 21 bp, Homo sapiens
acaaggaagtcaaagcaagga

SEQ ID NO: 3474588 - DNA, 16 bp, Homo sapiens
acaaggatagatgctg

SEQ ID NO: 3474589 - DNA, 17 bp, Homo sapiens
acaaggatagatgctgg

SEQ ID NO: 3474590 - DNA, 19 bp, Homo sapiens
acaaggccagcacccaaag

SEQ ID NO: 3474591 - DNA, 21 bp, Homo sapiens
acaaggccagcacccaaaggg

SEQ ID NO: 3474592 - DNA, 20 bp, Homo sapiens
acaaggtcaggagttcgaga

SEQ ID NO: 3474593 - DNA, 23 bp, Homo sapiens
acaaggtcctctgtcagtcacag

SEQ ID NO: 3474594 - DNA, 16 bp, Homo sapiens
acaaggtctttaaagt

SEQ ID NO: 3474595 - DNA, 17 bp, Homo sapiens
acaagtgccgcaaattg

SEQ ID NO: 3474596 - DNA, 15 bp, Homo sapiens
acaagtggactcagg

SEQ ID NO: 3474597 - DNA, 13 bp, Homo sapiens
acaagtggtggta

SEQ ID NO: 3474598 - DNA, 13 bp, Homo sapiens
acaagtgtctttt

SEQ ID NO: 3474599 - DNA, 22 bp, Homo sapiens
acaataaaattttttttcatgt

SEQ ID NO: 3474600 - DNA, 14 bp, Homo sapiens
acaataaatgtgca

SEQ ID NO: 3474601 - DNA, 16 bp, Homo sapiens
acaataaattgctaat

SEQ ID NO: 3474602 - DNA, 23 bp, Homo sapiens
acaataaattgctaatgttgctg

SEQ ID NO: 3474603 - DNA, 12 bp, Homo sapiens
acaataatttca

SEQ ID NO: 3474604 - DNA, 22 bp, Homo sapiens
acaatagccgatatcagaattt

SEQ ID NO: 3474605 - DNA, 20 bp, Homo sapiens
acaatatgtgccaatcaata

SEQ ID NO: 3474606 - DNA, 18 bp, Homo sapiens
acaatcatgaaatatgca

SEQ ID NO: 3474607 - DNA, 22 bp, Homo sapiens
acaatcctagtgctttcctttt

SEQ ID NO: 3474608 - DNA, 20 bp, Homo sapiens
acaatgatcctgtattcaga

SEQ ID NO: 3474609 - DNA, 22 bp, Homo sapiens
acaatgatcctgtattcagaca

SEQ ID NO: 3474610 - DNA, 22 bp, Homo sapiens
acaatgcagttctgagcaccgt

SEQ ID NO: 3474611 - DNA, 19 bp, Homo sapiens
acaatgcataatgtcttta

SEQ ID NO: 3474612 - DNA, 22 bp, Homo sapiens
acaatggtgttatttgaaactt

SEQ ID NO: 3474613 - DNA, 18 bp, Homo sapiens
acaatggtttttaaattt

SEQ ID NO: 3474614 - DNA, 19 bp, Homo sapiens
acaatgtgaaaagaaaaat

SEQ ID NO: 3474615 - DNA, 19 bp, Homo sapiens
acaatgtgaactttattaa

SEQ ID NO: 3474616 - DNA, 15 bp, Homo sapiens
acaatgttcatccca

SEQ ID NO: 3474617 - DNA, 15 bp, Homo sapiens
acaattctacattgt

SEQ ID NO: 3474618 - DNA, 17 bp, Homo sapiens
acaatttacaaagtgtg

SEQ ID NO: 3474619 - DNA, 23 bp, Homo sapiens
acaatttacaaagtgtgtattaa

SEQ ID NO: 3474620 - DNA, 14 bp, Homo sapiens
acacaaacacacac

SEQ ID NO: 3474621 - DNA, 15 bp, Homo sapiens
acacaaacctgcctg

SEQ ID NO: 3474622 - DNA, 14 bp, Homo sapiens
acacaaactgtaaa

SEQ ID NO: 3474623 - DNA, 15 bp, Homo sapiens
acacaaactgtaaat

SEQ ID NO: 3474624 - DNA, 12 bp, Homo sapiens
acacaaagacca

SEQ ID NO: 3474625 - DNA, 12 bp, Homo sapiens
acacaaatgata

SEQ ID NO: 3474626 - DNA, 17 bp, Homo sapiens
acctgtcaccctgcagg

SEQ ID NO: 3474627 - DNA, 23 bp, Homo sapiens
acctgtgcttcgggcccttccca

SEQ ID NO: 3474628 - DNA, 13 bp, Homo sapiens
acctgtgtgcttg

SEQ ID NO: 3474629 - DNA, 21 bp, Homo sapiens
acctgttgagcatcacagaat

SEQ ID NO: 3474630 - DNA, 18 bp, Homo sapiens
acctgtttttttttcatt

SEQ ID NO: 3474631 - DNA, 22 bp, Homo sapiens
accttagatgttctaagtcttt

SEQ ID NO: 3474632 - DNA, 22 bp, Homo sapiens
accttaggcccggagctgcccc

SEQ ID NO: 3474633 - DNA, 14 bp, Homo sapiens
accttaggccttcc

SEQ ID NO: 3474634 - DNA, 17 bp, Homo sapiens
accttaggccttcctct

SEQ ID NO: 3474635 - DNA, 20 bp, Homo sapiens
accttaggccttcctctctc

SEQ ID NO: 3474636 - DNA, 17 bp, Homo sapiens
accttattgtacctctc

SEQ ID NO: 3474637 - DNA, 18 bp, Homo sapiens
accttattgtacctctct

SEQ ID NO: 3474638 - DNA, 22 bp, Homo sapiens
accttattgtacctctcttata

SEQ ID NO: 3474639 - DNA, 13 bp, Homo sapiens
accttcacagatg

SEQ ID NO: 3474640 - DNA, 19 bp, Homo sapiens
accttcacagatgcctact

SEQ ID NO: 3474641 - DNA, 17 bp, Homo sapiens
accttcagagccagccg

SEQ ID NO: 3474642 - DNA, 16 bp, Homo sapiens
accttcagctcacgct

SEQ ID NO: 3474643 - DNA, 17 bp, Homo sapiens
accttcagctcacgctt

SEQ ID NO: 3474644 - DNA, 14 bp, Homo sapiens
accttcatttcatg

SEQ ID NO: 3474645 - DNA, 11 bp, Homo sapiens
accttccaaac

SEQ ID NO: 3474646 - DNA, 21 bp, Homo sapiens
accttcccaaacgcctcccct

SEQ ID NO: 3474647 - DNA, 16 bp, Homo sapiens
accttcgggctgtgcc

SEQ ID NO: 3474648 - DNA, 18 bp, Homo sapiens
accttcgggctgtgcccg

SEQ ID NO: 3474649 - DNA, 20 bp, Homo sapiens
accttctctacccatctccc

SEQ ID NO: 3474650 - DNA, 20 bp, Homo sapiens
accttgaaaataagaataga

SEQ ID NO: 3474651 - DNA, 14 bp, Homo sapiens
accttgacagggca

SEQ ID NO: 3474652 - DNA, 12 bp, Homo sapiens
accttgcttctt

SEQ ID NO: 3474653 - DNA, 22 bp, Homo sapiens
accttgcttcttactgataatt

SEQ ID NO: 3474654 - DNA, 14 bp, Homo sapiens
accttggcaccaga

SEQ ID NO: 3474655 - DNA, 17 bp, Homo sapiens
accttggcaccagacac

SEQ ID NO: 3474656 - DNA, 16 bp, Homo sapiens
accttggcctgggccg

SEQ ID NO: 3474657 - DNA, 13 bp, Homo sapiens
accttggccttct

SEQ ID NO: 3474658 - DNA, 14 bp, Homo sapiens
accttggccttctc

SEQ ID NO: 3474659 - DNA, 15 bp, Homo sapiens
accttggccttctcc

SEQ ID NO: 3474660 - DNA, 16 bp, Homo sapiens
accttggccttctccc

SEQ ID NO: 3474661 - DNA, 17 bp, Homo sapiens
accttggccttctcccc

SEQ ID NO: 3474662 - DNA, 19 bp, Homo sapiens
accttggccttctcccctc

SEQ ID NO: 3474663 - DNA, 20 bp, Homo sapiens
accttggccttctcccctct

SEQ ID NO: 3474664 - DNA, 12 bp, Homo sapiens
accttggctcaa

SEQ ID NO: 3474665 - DNA, 14 bp, Homo sapiens
accttggctcaagt

SEQ ID NO: 3474666 - DNA, 17 bp, Homo sapiens
accttggctgcagggag

SEQ ID NO: 3474667 - DNA, 16 bp, Homo sapiens
accttggcttgttatt

SEQ ID NO: 3474668 - DNA, 24 bp, Homo sapiens
accttggggccttgatgactgcct

SEQ ID NO: 3474669 - DNA, 17 bp, Homo sapiens
accttgttacttctgag

SEQ ID NO: 3474670 - DNA, 13 bp, Homo sapiens
acctttactttag

SEQ ID NO: 3474671 - DNA, 14 bp, Homo sapiens
acctttattctttt

SEQ ID NO: 3474672 - DNA, 19 bp, Homo sapiens
acctttcataatctttgct

SEQ ID NO: 3474673 - DNA, 21 bp, Homo sapiens
acctttcataatctttgcttt

SEQ ID NO: 3474674 - DNA, 22 bp, Homo sapiens
acctttcccactttcttctacc

SEQ ID NO: 3474675 - DNA, 17 bp, Homo sapiens
acctttcctacattttc

SEQ ID NO: 3474676 - DNA, 20 bp, Homo sapiens
acctttctcctttgtacttt

SEQ ID NO: 3474677 - DNA, 17 bp, Homo sapiens
acctttggaaacaacat

SEQ ID NO: 3474678 - DNA, 18 bp, Homo sapiens
acctttgtacagcccaga

SEQ ID NO: 3474679 - DNA, 18 bp, Homo sapiens
accttttttcaacagtga

SEQ ID NO: 3474680 - DNA, 20 bp, Homo sapiens
acgaaaggatgagcagagcc

SEQ ID NO: 3474681 - DNA, 18 bp, Homo sapiens
acgaaccttggcctgggc

SEQ ID NO: 3474682 - DNA, 12 bp, Homo sapiens
acgactgtctcc

SEQ ID NO: 3474683 - DNA, 12 bp, Homo sapiens
acgagggctggc

SEQ ID NO: 3474684 - DNA, 16 bp, Homo sapiens
acgagggctggctggc

SEQ ID NO: 3474685 - DNA, 18 bp, Homo sapiens
acgatttagaaagaagcc

SEQ ID NO: 3474686 - DNA, 13 bp, Homo sapiens
acgcacctcccat

SEQ ID NO: 3474687 - DNA, 21 bp, Homo sapiens
acgcagcaggaggccaggccg

SEQ ID NO: 3474688 - DNA, 21 bp, Homo sapiens
acgcaggcccctctcctccgt

SEQ ID NO: 3474689 - DNA, 23 bp, Homo sapiens
acgcccccccccacccctggggg

SEQ ID NO: 3474690 - DNA, 13 bp, Homo sapiens
acgccctcaagaa

SEQ ID NO: 3474691 - DNA, 15 bp, Homo sapiens
acgccctcaagaaca

SEQ ID NO: 3474692 - DNA, 17 bp, Homo sapiens
acgccctttcctcctca

SEQ ID NO: 3474693 - DNA, 20 bp, Homo sapiens
acgccgccctaaaagcacac

SEQ ID NO: 3474694 - DNA, 15 bp, Homo sapiens
acgcctcccactggg

SEQ ID NO: 3474695 - DNA, 21 bp, Homo sapiens
acgcctgaaactttgaggata

SEQ ID NO: 3474696 - DNA, 21 bp, Homo sapiens
acgcctgaggaacccttacag

SEQ ID NO: 3474697 - DNA, 17 bp, Homo sapiens
acgcctgcaaacgctgc

SEQ ID NO: 3474698 - DNA, 23 bp, Homo sapiens
acgcctgcaaacgctgcctgccc

SEQ ID NO: 3474699 - DNA, 17 bp, Homo sapiens
acgctccagctgccccg

SEQ ID NO: 3474700 - DNA, 13 bp, Homo sapiens
acgctcctttgtg

SEQ ID NO: 3474701 - DNA, 21 bp, Homo sapiens
acgctcctttgtgtgtgtgtc

SEQ ID NO: 3474702 - DNA, 22 bp, Homo sapiens
acgctcctttgtgtgtgtgtca

SEQ ID NO: 3474703 - DNA, 20 bp, Homo sapiens
acgctgcctctcattggcac

SEQ ID NO: 3474704 - DNA, 12 bp, Homo sapiens
acgctgcctgcc

SEQ ID NO: 3474705 - DNA, 13 bp, Homo sapiens
acgctgcctgccc

SEQ ID NO: 3474706 - DNA, 16 bp, Homo sapiens
acgctggagtgcagtg

SEQ ID NO: 3474707 - DNA, 18 bp, Homo sapiens
acgctggcaacacagagg

SEQ ID NO: 3474708 - DNA, 19 bp, Homo sapiens
acgctgggtattaccatgt

SEQ ID NO: 3474709 - DNA, 22 bp, Homo sapiens
acgcttgctctgtttgtggggt

SEQ ID NO: 3474710 - DNA, 17 bp, Homo sapiens
acgctttctagctgttg

SEQ ID NO: 3474711 - DNA, 12 bp, Homo sapiens
acgctttgattc

SEQ ID NO: 3474712 - DNA, 20 bp, Homo sapiens
acggaagttttcaatgatgg

SEQ ID NO: 3474713 - DNA, 17 bp, Homo sapiens
acggacactcaaaagct

SEQ ID NO: 3474714 - DNA, 18 bp, Homo sapiens
acggagccactcctctga

SEQ ID NO: 3474715 - DNA, 16 bp, Homo sapiens
acggatcagaaataca

SEQ ID NO: 3474716 - DNA, 17 bp, Homo sapiens
acggatcagaaatacag

SEQ ID NO: 3474717 - DNA, 15 bp, Homo sapiens
acggatctgagaatc

SEQ ID NO: 3474718 - DNA, 18 bp, Homo sapiens
acggcacggtcttccctc

SEQ ID NO: 3474719 - DNA, 19 bp, Homo sapiens
acggcacggtcttccctct

SEQ ID NO: 3474720 - DNA, 22 bp, Homo sapiens
acggcacggtcttccctcttcc

SEQ ID NO: 3474721 - DNA, 13 bp, Homo sapiens
acggccaggccag

SEQ ID NO: 3474722 - DNA, 23 bp, Homo sapiens
acggccagggagaagctcctctc

SEQ ID NO: 3474723 - DNA, 19 bp, Homo sapiens
acggcgttgtacctgtagg

SEQ ID NO: 3474724 - DNA, 16 bp, Homo sapiens
acggctcactgcagcc

SEQ ID NO: 3474725 - DNA, 19 bp, Homo sapiens
acggctcccccaggcctga

SEQ ID NO: 3474726 - DNA, 18 bp, Homo sapiens
acggcttttacttaaacc

SEQ ID NO: 3474727 - DNA, 20 bp, Homo sapiens
acggtgtcttgttctgtcac

SEQ ID NO: 3474728 - DNA, 17 bp, Homo sapiens
acggtgttttgccatgt

SEQ ID NO: 3474729 - DNA, 17 bp, Homo sapiens
acggtttgaagcctgga

SEQ ID NO: 3474730 - DNA, 15 bp, Homo sapiens
acggttttactgcag

SEQ ID NO: 3474731 - DNA, 17 bp, Homo sapiens
acggttttactgcagct

SEQ ID NO: 3474732 - DNA, 16 bp, Homo sapiens
acgtagcaggccatgg

SEQ ID NO: 3474733 - DNA, 16 bp, Homo sapiens
acgtagctgcaaagga

SEQ ID NO: 3474734 - DNA, 21 bp, Homo sapiens
acgtccaggttcaacccacag

SEQ ID NO: 3474735 - DNA, 13 bp, Homo sapiens
acgtctgacaggc

SEQ ID NO: 3474736 - DNA, 12 bp, Homo sapiens
acgtcttctaaa

SEQ ID NO: 3474737 - DNA, 18 bp, Homo sapiens
acgtctttttgtttgttt

SEQ ID NO: 3474738 - DNA, 15 bp, Homo sapiens
acgtgaccctctgct

SEQ ID NO: 3474739 - DNA, 21 bp, Homo sapiens
acgtgaccggacttttctgca

SEQ ID NO: 3474740 - DNA, 23 bp, Homo sapiens
acgtgagagtgtcttcacggcag

SEQ ID NO: 3474741 - DNA, 22 bp, Homo sapiens
acgtgattcaattcaacactcc

SEQ ID NO: 3474742 - DNA, 14 bp, Homo sapiens
acgtgcattgtgct

SEQ ID NO: 3474743 - DNA, 16 bp, Homo sapiens
acgtgcattgtgcttc

SEQ ID NO: 3474744 - DNA, 23 bp, Homo sapiens
acgtgcgctgggcacttccctgc

SEQ ID NO: 3474745 - DNA, 17 bp, Homo sapiens
acgtggacgtttttaat

SEQ ID NO: 3474746 - DNA, 14 bp, Homo sapiens
acgtggctcagcca

SEQ ID NO: 3474747 - DNA, 17 bp, Homo sapiens
acgtggctcagccagca

SEQ ID NO: 3474748 - DNA, 16 bp, Homo sapiens
acgtgggcaaacaggc

SEQ ID NO: 3474749 - DNA, 11 bp, Homo sapiens
acgtgtttaaa

SEQ ID NO: 3474750 - DNA, 16 bp, Homo sapiens
acgttaggcatttcct

SEQ ID NO: 3474751 - DNA, 16 bp, Homo sapiens
acgttagtcgtgagct

SEQ ID NO: 3474752 - DNA, 21 bp, Homo sapiens
acgttagtcgtgagctcttgt

SEQ ID NO: 3474753 - DNA, 22 bp, Homo sapiens
acgttagtcgtgagctcttgtg

SEQ ID NO: 3474754 - DNA, 18 bp, Homo sapiens
acgttggagaagcccgtg

SEQ ID NO: 3474755 - DNA, 18 bp, Homo sapiens
acgtttccccgaagagtc

SEQ ID NO: 3474756 - DNA, 23 bp, Homo sapiens
acgtttggaagatcctgtgagga

SEQ ID NO: 3474757 - DNA, 17 bp, Homo sapiens
acgttttttcctcagtg

SEQ ID NO: 3474758 - DNA, 14 bp, Homo sapiens
actttaggctttca

SEQ ID NO: 3474759 - DNA, 16 bp, Homo sapiens
actttagtctgcaaaa

SEQ ID NO: 3474760 - DNA, 17 bp, Homo sapiens
actttattgacaagtga

SEQ ID NO: 3474761 - DNA, 22 bp, Homo sapiens
actttattttctataatttaaa

SEQ ID NO: 3474762 - DNA, 22 bp, Homo sapiens
actttattttggattgtggatg

SEQ ID NO: 3474763 - DNA, 21 bp, Homo sapiens
actttcaggtactaaatacct

SEQ ID NO: 3474764 - DNA, 15 bp, Homo sapiens
actttcctttaactc

SEQ ID NO: 3474765 - DNA, 19 bp, Homo sapiens
actttctacaatgtgaact

SEQ ID NO: 3474766 - DNA, 21 bp, Homo sapiens
actttctacaatgtgaacttt

SEQ ID NO: 3474767 - DNA, 16 bp, Homo sapiens
actttcttctaccaga

SEQ ID NO: 3474768 - DNA, 16 bp, Homo sapiens
actttgaggataactt

SEQ ID NO: 3474769 - DNA, 15 bp, Homo sapiens
actttgctcctcaca

SEQ ID NO: 3474770 - DNA, 15 bp, Homo sapiens
actttggaaaatgca

SEQ ID NO: 3474771 - DNA, 18 bp, Homo sapiens
actttggaaaatgcattg

SEQ ID NO: 3474772 - DNA, 12 bp, Homo sapiens
actttgggaggc

SEQ ID NO: 3474773 - DNA, 16 bp, Homo sapiens
actttggttcctgtga

SEQ ID NO: 3474774 - DNA, 20 bp, Homo sapiens
actttgtcgcccaggctgga

SEQ ID NO: 3474775 - DNA, 20 bp, Homo sapiens
actttgtttcgtggggaggt

SEQ ID NO: 3474776 - DNA, 18 bp, Homo sapiens
acttttaaaagtaggaaa

SEQ ID NO: 3474777 - DNA, 14 bp, Homo sapiens
acttttaaggcagt

SEQ ID NO: 3474778 - DNA, 23 bp, Homo sapiens
acttttatactctttctgtatat

SEQ ID NO: 3474779 - DNA, 10 bp, Homo sapiens
acttttcatt

SEQ ID NO: 3474780 - DNA, 22 bp, Homo sapiens
acttttgaagaggcctaagtca

SEQ ID NO: 3474781 - DNA, 11 bp, Homo sapiens
actttttacaa

SEQ ID NO: 3474782 - DNA, 12 bp, Homo sapiens
actttttataaa

SEQ ID NO: 3474783 - DNA, 14 bp, Homo sapiens
actttttattgcct

SEQ ID NO: 3474784 - DNA, 15 bp, Homo sapiens
actttttattgcctt

SEQ ID NO: 3474785 - DNA, 16 bp, Homo sapiens
actttttattgccttc

SEQ ID NO: 3474786 - DNA, 20 bp, Homo sapiens
actttttgaacttttcattc

SEQ ID NO: 3474787 - DNA, 13 bp, Homo sapiens
actttttgtgaag

SEQ ID NO: 3474788 - DNA, 15 bp, Homo sapiens
actttttgtgaagac

SEQ ID NO: 3474789 - DNA, 11 bp, Homo sapiens
acttttttccc

SEQ ID NO: 3474790 - DNA, 17 bp, Homo sapiens
acttttttttgtatgtt

SEQ ID NO: 3474791 - DNA, 13 bp, Homo sapiens
agaaaaaaattca

SEQ ID NO: 3474792 - DNA, 19 bp, Homo sapiens
agaaaaaagtcaccattct

SEQ ID NO: 3474793 - DNA, 13 bp, Homo sapiens
agaaaaagaaaaa

SEQ ID NO: 3474794 - DNA, 12 bp, Homo sapiens
agaaaaagaaca

SEQ ID NO: 3474795 - DNA, 15 bp, Homo sapiens
agaaaaagggctgcc

SEQ ID NO: 3474796 - DNA, 20 bp, Homo sapiens
agaaaaattcagcaaaccat

SEQ ID NO: 3474797 - DNA, 14 bp, Homo sapiens
agaaaacctccagt

SEQ ID NO: 3474798 - DNA, 12 bp, Homo sapiens
agaaaagatttt

SEQ ID NO: 3474799 - DNA, 21 bp, Homo sapiens
agaaaagtgcatatttatcca

SEQ ID NO: 3474800 - DNA, 12 bp, Homo sapiens
agaaaagttatt

SEQ ID NO: 3474801 - DNA, 14 bp, Homo sapiens
agaaaataacaata

SEQ ID NO: 3474802 - DNA, 15 bp, Homo sapiens
agaaaatatatgtat

SEQ ID NO: 3474803 - DNA, 19 bp, Homo sapiens
agaaaatggaaccaggctt

SEQ ID NO: 3474804 - DNA, 19 bp, Homo sapiens
agaaaatgttatttaacag

SEQ ID NO: 3474805 - DNA, 16 bp, Homo sapiens
agaaaatgttgagaat

SEQ ID NO: 3474806 - DNA, 13 bp, Homo sapiens
agaaaattcaatt

SEQ ID NO: 3474807 - DNA, 15 bp, Homo sapiens
agaaaattcaattgt

SEQ ID NO: 3474808 - DNA, 14 bp, Homo sapiens
agaaaattcctata

SEQ ID NO: 3474809 - DNA, 16 bp, Homo sapiens
agaaaattcctataag

SEQ ID NO: 3474810 - DNA, 19 bp, Homo sapiens
agaaaattcctataaggaa

SEQ ID NO: 3474811 - DNA, 20 bp, Homo sapiens
agaaacaactctttgagaaa

SEQ ID NO: 3474812 - DNA, 20 bp, Homo sapiens
agaaacacactgaggcaggg

SEQ ID NO: 3474813 - DNA, 23 bp, Homo sapiens
agaaacagacagaaagagacaca

SEQ ID NO: 3474814 - DNA, 16 bp, Homo sapiens
agaaacccaccagcct

SEQ ID NO: 3474815 - DNA, 22 bp, Homo sapiens
agaaacccaccagcctaagaag

SEQ ID NO: 3474816 - DNA, 18 bp, Homo sapiens
agaaacctgttgaagatt

SEQ ID NO: 3474817 - DNA, 19 bp, Homo sapiens
agaaacgcaacaagaaact

SEQ ID NO: 3474818 - DNA, 18 bp, Homo sapiens
agaaacgtcttctaaact

SEQ ID NO: 3474819 - DNA, 19 bp, Homo sapiens
agaaactcaatgcacaaca

SEQ ID NO: 3474820 - DNA, 15 bp, Homo sapiens
agaaactgcagggaa

SEQ ID NO: 3474821 - DNA, 22 bp, Homo sapiens
agaaactgttcccacctgctgg

SEQ ID NO: 3474822 - DNA, 15 bp, Homo sapiens
agaaagaagagaagg

SEQ ID NO: 3474823 - DNA, 12 bp, Homo sapiens
agaaagaagccc

SEQ ID NO: 3474824 - DNA, 21 bp, Homo sapiens
agaaagaatgttactgcctta

SEQ ID NO: 3474825 - DNA, 18 bp, Homo sapiens
agaaagacatctttctct

SEQ ID NO: 3474826 - DNA, 22 bp, Homo sapiens
agaaagagcacttaagagaata

SEQ ID NO: 3474827 - DNA, 14 bp, Homo sapiens
agaaagcagttctg

SEQ ID NO: 3474828 - DNA, 13 bp, Homo sapiens
agaaagccttctt

SEQ ID NO: 3474829 - DNA, 14 bp, Homo sapiens
agaaagctgacatt

SEQ ID NO: 3474830 - DNA, 23 bp, Homo sapiens
agaaaggaggggatagagagaga

SEQ ID NO: 3474831 - DNA, 15 bp, Homo sapiens
agaaaggcctttaaa

SEQ ID NO: 3474832 - DNA, 15 bp, Homo sapiens
agaaaggggagccca

SEQ ID NO: 3474833 - DNA, 19 bp, Homo sapiens
agaaaggtgattccaggag

SEQ ID NO: 3474834 - DNA, 20 bp, Homo sapiens
agaaaggtgattccaggagg

SEQ ID NO: 3474835 - DNA, 22 bp, Homo sapiens
agaaagtacttctccaccctgc

SEQ ID NO: 3474836 - DNA, 15 bp, Homo sapiens
agaaagtgtgcttta

SEQ ID NO: 3474837 - DNA, 22 bp, Homo sapiens
agaaagtgtgctttatgctgaa

SEQ ID NO: 3474838 - DNA, 21 bp, Homo sapiens
agaaagttgcacggctgctga

SEQ ID NO: 3474839 - DNA, 18 bp, Homo sapiens
agaaataaaaggaagcca

SEQ ID NO: 3474840 - DNA, 18 bp, Homo sapiens
agaaataaagtttgctta

SEQ ID NO: 3474841 - DNA, 15 bp, Homo sapiens
agaaataatatgcat

SEQ ID NO: 3474842 - DNA, 16 bp, Homo sapiens
agaaataatatgcatt

SEQ ID NO: 3474843 - DNA, 19 bp, Homo sapiens
agaaatacagtcttccaca

SEQ ID NO: 3474844 - DNA, 14 bp, Homo sapiens
agaaataggttaaa

SEQ ID NO: 3474845 - DNA, 22 bp, Homo sapiens
agaaatcaatagtgcaactgtt

SEQ ID NO: 3474846 - DNA, 20 bp, Homo sapiens
agaaatctgggatgtactgt

SEQ ID NO: 3474847 - DNA, 11 bp, Homo sapiens
agaaatgccaa

SEQ ID NO: 3474848 - DNA, 21 bp, Homo sapiens
agaaatgccaagcacttcttt

SEQ ID NO: 3474849 - DNA, 22 bp, Homo sapiens
agaaatgccaagcacttctttt

SEQ ID NO: 3474850 - DNA, 19 bp, Homo sapiens
agaaatggttgtattagat

SEQ ID NO: 3474851 - DNA, 23 bp, Homo sapiens
agaaatttatttcctagttctgt

SEQ ID NO: 3474852 - DNA, 19 bp, Homo sapiens
agaacaaaaaaatctgcag

SEQ ID NO: 3474853 - DNA, 19 bp, Homo sapiens
agaacaatattgactttgt

SEQ ID NO: 3474854 - DNA, 20 bp, Homo sapiens
agaacaatattgactttgtc

SEQ ID NO: 3474855 - DNA, 18 bp, Homo sapiens
agaacacggctcacgctt

SEQ ID NO: 3474856 - DNA, 23 bp, Homo sapiens
agaacaggtgttggtgacaattg

SEQ ID NO: 3474857 - DNA, 19 bp, Homo sapiens
agaacatccctgccagctc

SEQ ID NO: 3474858 - DNA, 13 bp, Homo sapiens
agaacatgcagtt

SEQ ID NO: 3474859 - DNA, 14 bp, Homo sapiens
agaacatgcagttt

SEQ ID NO: 3474860 - DNA, 22 bp, Homo sapiens
agaacatgcagtttgaaattct

SEQ ID NO: 3474861 - DNA, 20 bp, Homo sapiens
agaacattttactgttgtac

SEQ ID NO: 3474862 - DNA, 13 bp, Homo sapiens
agaaccaaatctg

SEQ ID NO: 3474863 - DNA, 16 bp, Homo sapiens
agaaccaaatctggaa

SEQ ID NO: 3474864 - DNA, 12 bp, Homo sapiens
agaaccagcctc

SEQ ID NO: 3474865 - DNA, 13 bp, Homo sapiens
agaaccagcctca

SEQ ID NO: 3474866 - DNA, 20 bp, Homo sapiens
agaacccttggcttgcccac

SEQ ID NO: 3474867 - DNA, 20 bp, Homo sapiens
agaacctggaacttggggag

SEQ ID NO: 3474868 - DNA, 12 bp, Homo sapiens
agaaccttctct

SEQ ID NO: 3474869 - DNA, 17 bp, Homo sapiens
agaacggggctcttctc

SEQ ID NO: 3474870 - DNA, 17 bp, Homo sapiens
agaacgtaaagaacttt

SEQ ID NO: 3474871 - DNA, 22 bp, Homo sapiens
agaactacaaacaaaatttcta

SEQ ID NO: 3474872 - DNA, 23 bp, Homo sapiens
agaactacaaacaaaatttctat

SEQ ID NO: 3474873 - DNA, 12 bp, Homo sapiens
agaactgcaggc

SEQ ID NO: 3474874 - DNA, 18 bp, Homo sapiens
agaacttggatgtacctg

SEQ ID NO: 3474875 - DNA, 23 bp, Homo sapiens
agaactttattttggattgtgga

SEQ ID NO: 3474876 - DNA, 16 bp, Homo sapiens
agaactttcatttttt

SEQ ID NO: 3474877 - DNA, 18 bp, Homo sapiens
agaactttcatttttttc

SEQ ID NO: 3474878 - DNA, 15 bp, Homo sapiens
agaactttgagctac

SEQ ID NO: 3474879 - DNA, 20 bp, Homo sapiens
agaactttgagctactgccg

SEQ ID NO: 3474880 - DNA, 20 bp, Homo sapiens
agaactttttcttttccctc

SEQ ID NO: 3474881 - DNA, 19 bp, Homo sapiens
agaagaaaatggaaccagg

SEQ ID NO: 3474882 - DNA, 20 bp, Homo sapiens
agaagaactgtgtttcaagt

SEQ ID NO: 3474883 - DNA, 21 bp, Homo sapiens
agaagagccaagagtccagga

SEQ ID NO: 3474884 - DNA, 17 bp, Homo sapiens
agaagagggtgtgtttg

SEQ ID NO: 3474885 - DNA, 18 bp, Homo sapiens
agaagatcctaaaacaaa

SEQ ID NO: 3474886 - DNA, 14 bp, Homo sapiens
agaagcaggaaggg

SEQ ID NO: 3474887 - DNA, 16 bp, Homo sapiens
agaagccacaggcctg

SEQ ID NO: 3474888 - DNA, 18 bp, Homo sapiens
agaagccacaggcctgag

SEQ ID NO: 3474889 - DNA, 12 bp, Homo sapiens
agaagccaggaa

SEQ ID NO: 3474890 - DNA, 18 bp, Homo sapiens
agaagcccaatattataa

SEQ ID NO: 3474891 - DNA, 15 bp, Homo sapiens
agatgttagactcat

SEQ ID NO: 3474892 - DNA, 12 bp, Homo sapiens
agatgttctcta

SEQ ID NO: 3474893 - DNA, 21 bp, Homo sapiens
agatgttctctatcatttaat

SEQ ID NO: 3474894 - DNA, 14 bp, Homo sapiens
agatgtttccagac

SEQ ID NO: 3474895 - DNA, 18 bp, Homo sapiens
agatgtttcttttgtatg

SEQ ID NO: 3474896 - DNA, 21 bp, Homo sapiens
agatgtttcttttgtatgtaa

SEQ ID NO: 3474897 - DNA, 21 bp, Homo sapiens
agattaaaaattataggaata

SEQ ID NO: 3474898 - DNA, 21 bp, Homo sapiens
agattaagacagagaaacaga

SEQ ID NO: 3474899 - DNA, 22 bp, Homo sapiens
agattaagatgccttgaattgt

SEQ ID NO: 3474900 - DNA, 15 bp, Homo sapiens
agattatctatttgt

SEQ ID NO: 3474901 - DNA, 18 bp, Homo sapiens
agattattccttcttcta

SEQ ID NO: 3474902 - DNA, 17 bp, Homo sapiens
agattcacactgtctgg

SEQ ID NO: 3474903 - DNA, 15 bp, Homo sapiens
agattcccctgtgtc

SEQ ID NO: 3474904 - DNA, 16 bp, Homo sapiens
agattcgctttccatg

SEQ ID NO: 3474905 - DNA, 19 bp, Homo sapiens
agattgcaacaggctgggc

SEQ ID NO: 3474906 - DNA, 20 bp, Homo sapiens
agattgcaacaggctgggct

SEQ ID NO: 3474907 - DNA, 16 bp, Homo sapiens
agattgcatgtgactc

SEQ ID NO: 3474908 - DNA, 18 bp, Homo sapiens
agattgcatgtgactctg

SEQ ID NO: 3474909 - DNA, 22 bp, Homo sapiens
agattgcatgtgactctgaagc

SEQ ID NO: 3474910 - DNA, 23 bp, Homo sapiens
agattgcatgtgactctgaagct

SEQ ID NO: 3474911 - DNA, 22 bp, Homo sapiens
agattggctcacactgagaatg

SEQ ID NO: 3474912 - DNA, 23 bp, Homo sapiens
agattgtaaaccgctttggcctg

SEQ ID NO: 3474913 - DNA, 17 bp, Homo sapiens
agattgtcttaatttct

SEQ ID NO: 3474914 - DNA, 22 bp, Homo sapiens
agattgtggaatgttggataag

SEQ ID NO: 3474915 - DNA, 15 bp, Homo sapiens
agattgttaaaataa

SEQ ID NO: 3474916 - DNA, 14 bp, Homo sapiens
agattgttggtgaa

SEQ ID NO: 3474917 - DNA, 17 bp, Homo sapiens
agattgttggtgaattt

SEQ ID NO: 3474918 - DNA, 20 bp, Homo sapiens
agattgttggtgaattttca

SEQ ID NO: 3474919 - DNA, 13 bp, Homo sapiens
agatttcatctgc

SEQ ID NO: 3474920 - DNA, 19 bp, Homo sapiens
agatttcatctgctctcct

SEQ ID NO: 3474921 - DNA, 20 bp, Homo sapiens
agatttcatctgctctcctt

SEQ ID NO: 3474922 - DNA, 21 bp, Homo sapiens
agatttcatctgctctccttc

SEQ ID NO: 3474923 - DNA, 15 bp, Homo sapiens
agatttctaaataaa

SEQ ID NO: 3474924 - DNA, 13 bp, Homo sapiens
agatttgggctgg

SEQ ID NO: 3474925 - DNA, 14 bp, Homo sapiens
agatttgggctgga

SEQ ID NO: 3474926 - DNA, 17 bp, Homo sapiens
agatttgggctggaaca

SEQ ID NO: 3474927 - DNA, 17 bp, Homo sapiens
agatttgtttttctctt

SEQ ID NO: 3474928 - DNA, 14 bp, Homo sapiens
agattttaattttg

SEQ ID NO: 3474929 - DNA, 12 bp, Homo sapiens
agattttcattg

SEQ ID NO: 3474930 - DNA, 19 bp, Homo sapiens
agattttgatagcaaagcg

SEQ ID NO: 3474931 - DNA, 22 bp, Homo sapiens
agattttttcagacttgtcaag

SEQ ID NO: 3474932 - DNA, 14 bp, Homo sapiens
agcaaaaacatgta

SEQ ID NO: 3474933 - DNA, 12 bp, Homo sapiens
agcaaaagaaaa

SEQ ID NO: 3474934 - DNA, 13 bp, Homo sapiens
agcaaaagaaaaa

SEQ ID NO: 3474935 - DNA, 18 bp, Homo sapiens
agcaaactatttgcgact

SEQ ID NO: 3474936 - DNA, 22 bp, Homo sapiens
agcaacagcctttgaatgtaac

SEQ ID NO: 3474937 - DNA, 23 bp, Homo sapiens
agcaacagcctttgaatgtaacc

SEQ ID NO: 3474938 - DNA, 24 bp, Homo sapiens
agcaacagcctttgaatgtaacca

SEQ ID NO: 3474939 - DNA, 22 bp, Homo sapiens
agcaacaggaatctcagagaca

SEQ ID NO: 3474940 - DNA, 20 bp, Homo sapiens
agcaacattttacccacaca

SEQ ID NO: 3474941 - DNA, 19 bp, Homo sapiens
agcaacattttcttgaatt

SEQ ID NO: 3474942 - DNA, 20 bp, Homo sapiens
agcaacattttcttgaattt

SEQ ID NO: 3474943 - DNA, 23 bp, Homo sapiens
agcaacattttcttgaatttttt

SEQ ID NO: 3474944 - DNA, 20 bp, Homo sapiens
agcaactcttgattatccat

SEQ ID NO: 3474945 - DNA, 18 bp, Homo sapiens
agcaagaagggagttcca

SEQ ID NO: 3474946 - DNA, 12 bp, Homo sapiens
agcaagactctg

SEQ ID NO: 3474947 - DNA, 21 bp, Homo sapiens
agcaaggcggtggacttgaac

SEQ ID NO: 3474948 - DNA, 20 bp, Homo sapiens
agcaagggttccctcaagag

SEQ ID NO: 3474949 - DNA, 17 bp, Homo sapiens
agcaagtatgctgtgga

SEQ ID NO: 3474950 - DNA, 20 bp, Homo sapiens
agcaagtgagaccctgtctc

SEQ ID NO: 3474951 - DNA, 15 bp, Homo sapiens
agcaagtgagagctg

SEQ ID NO: 3474952 - DNA, 16 bp, Homo sapiens
agcaagtgagagctgg

SEQ ID NO: 3474953 - DNA, 18 bp, Homo sapiens
agcaagtgagagctgggt

SEQ ID NO: 3474954 - DNA, 16 bp, Homo sapiens
agcacaaagctcaaga

SEQ ID NO: 3474955 - DNA, 19 bp, Homo sapiens
agcacaactttaagaggac

SEQ ID NO: 3474956 - DNA, 22 bp, Homo sapiens
agcacaaggccttgcctggcct

SEQ ID NO: 3474957 - DNA, 20 bp, Homo sapiens
agcacactcatcccctcact

SEQ ID NO: 3474958 - DNA, 16 bp, Homo sapiens
agcacagcttcatttc

SEQ ID NO: 3474959 - DNA, 14 bp, Homo sapiens
agcacagcttgacc

SEQ ID NO: 3474960 - DNA, 18 bp, Homo sapiens
agcaccaagctcaaagcg

SEQ ID NO: 3474961 - DNA, 20 bp, Homo sapiens
agcacccagatcagactctc

SEQ ID NO: 3474962 - DNA, 24 bp, Homo sapiens
agcaccctataaatcaacacctta

SEQ ID NO: 3474963 - DNA, 13 bp, Homo sapiens
agcaccctctgga

SEQ ID NO: 3474964 - DNA, 15 bp, Homo sapiens
agcaccgttctgtgc

SEQ ID NO: 3474965 - DNA, 16 bp, Homo sapiens
agcacctccagcctga

SEQ ID NO: 3474966 - DNA, 19 bp, Homo sapiens
agcactactaaaagtttag

SEQ ID NO: 3474967 - DNA, 23 bp, Homo sapiens
agcactactaaaagtttagaact

SEQ ID NO: 3474968 - DNA, 12 bp, Homo sapiens
agcactatgaca

SEQ ID NO: 3474969 - DNA, 19 bp, Homo sapiens
agcactcaggctctccatt

SEQ ID NO: 3474970 - DNA, 11 bp, Homo sapiens
agcactgagca

SEQ ID NO: 3474971 - DNA, 10 bp, Homo sapiens
agcactgagg

SEQ ID NO: 3474972 - DNA, 12 bp, Homo sapiens
agcactgggctc

SEQ ID NO: 3474973 - DNA, 16 bp, Homo sapiens
agcactgggctcccgg

SEQ ID NO: 3474974 - DNA, 18 bp, Homo sapiens
agcactgggctcccgggc

SEQ ID NO: 3474975 - DNA, 22 bp, Homo sapiens
agcactgttctgggactccagg

SEQ ID NO: 3474976 - DNA, 12 bp, Homo sapiens
agcacttaagag

SEQ ID NO: 3474977 - DNA, 15 bp, Homo sapiens
agcacttaagagaat

SEQ ID NO: 3474978 - DNA, 17 bp, Homo sapiens
agcacttaagagaatat

SEQ ID NO: 3474979 - DNA, 15 bp, Homo sapiens
agcacttatttaatg

SEQ ID NO: 3474980 - DNA, 21 bp, Homo sapiens
agcacttgtgggtttttgttt

SEQ ID NO: 3474981 - DNA, 12 bp, Homo sapiens
agcagaaggggg

SEQ ID NO: 3474982 - DNA, 18 bp, Homo sapiens
agcagactggtttgcagt

SEQ ID NO: 3474983 - DNA, 18 bp, Homo sapiens
agcagactttctctgtgt

SEQ ID NO: 3474984 - DNA, 21 bp, Homo sapiens
agcagagcattttttatgata

SEQ ID NO: 3474985 - DNA, 18 bp, Homo sapiens
agcagagcccggagctcc

SEQ ID NO: 3474986 - DNA, 19 bp, Homo sapiens
agcagatgcaaagaggcaa

SEQ ID NO: 3474987 - DNA, 19 bp, Homo sapiens
agcagatggtttccacatt

SEQ ID NO: 3474988 - DNA, 13 bp, Homo sapiens
agcagattttaat

SEQ ID NO: 3474989 - DNA, 15 bp, Homo sapiens
agcagcaaattttca

SEQ ID NO: 3474990 - DNA, 18 bp, Homo sapiens
agcagcaccgttctgtgc

SEQ ID NO: 3474991 - DNA, 16 bp, Homo sapiens
agcagcagggagggct

SEQ ID NO: 3474992 - DNA, 19 bp, Homo sapiens
agcagcccaagcttccctc

SEQ ID NO: 3474993 - DNA, 20 bp, Homo sapiens
agcagcctctccccaggtcc

SEQ ID NO: 3474994 - DNA, 16 bp, Homo sapiens
agcagcctttaatgca

SEQ ID NO: 3474995 - DNA, 15 bp, Homo sapiens
agcagcgcctttccc

SEQ ID NO: 3474996 - DNA, 17 bp, Homo sapiens
agcagctaaattttctg

SEQ ID NO: 3474997 - DNA, 18 bp, Homo sapiens
agcagctaaattttctga

SEQ ID NO: 3474998 - DNA, 15 bp, Homo sapiens
agcagctcaaaggca

SEQ ID NO: 3474999 - DNA, 16 bp, Homo sapiens
agcagctcaaaggcac

SEQ ID NO: 3475000 - DNA, 14 bp, Homo sapiens
agcagctctcccct

SEQ ID NO: 3475001 - DNA, 23 bp, Homo sapiens
agcagctgaaatatgctggctgg

SEQ ID NO: 3475002 - DNA, 14 bp, Homo sapiens
agcaggaagctcag

SEQ ID NO: 3475003 - DNA, 15 bp, Homo sapiens
agcaggaagctcaga

SEQ ID NO: 3475004 - DNA, 14 bp, Homo sapiens
agcaggactccagg

SEQ ID NO: 3475005 - DNA, 22 bp, Homo sapiens
agcaggactccaggcccaaggc

SEQ ID NO: 3475006 - DNA, 21 bp, Homo sapiens
agcaggatcgaagggttttta

SEQ ID NO: 3475007 - DNA, 13 bp, Homo sapiens
agcaggcacagga

SEQ ID NO: 3475008 - DNA, 13 bp, Homo sapiens
agcagggaaacag

SEQ ID NO: 3475009 - DNA, 22 bp, Homo sapiens
agcagggctcagcggggacagc

SEQ ID NO: 3475010 - DNA, 21 bp, Homo sapiens
agcagggggggaaatgcattt

SEQ ID NO: 3475011 - DNA, 18 bp, Homo sapiens
agcagggtcgggaaaggc

SEQ ID NO: 3475012 - DNA, 16 bp, Homo sapiens
agcagggtctgggcag

SEQ ID NO: 3475013 - DNA, 17 bp, Homo sapiens
agcaggtagcctgctgg

SEQ ID NO: 3475014 - DNA, 16 bp, Homo sapiens
agcaggttcccaagct

SEQ ID NO: 3475015 - DNA, 17 bp, Homo sapiens
agcagtaactgacaact

SEQ ID NO: 3475016 - DNA, 21 bp, Homo sapiens
agcagtagaaataatatgcat

SEQ ID NO: 3475017 - DNA, 22 bp, Homo sapiens
agcagtagaaataatatgcatt

SEQ ID NO: 3475018 - DNA, 14 bp, Homo sapiens
agcagtcgtgcctg

SEQ ID NO: 3475019 - DNA, 21 bp, Homo sapiens
agcagtcgtgcctgtgtccat

SEQ ID NO: 3475020 - DNA, 19 bp, Homo sapiens
agcagtctatcattgcagg

SEQ ID NO: 3475021 - DNA, 20 bp, Homo sapiens
agcagtctctgccttgcctt

SEQ ID NO: 3475022 - DNA, 21 bp, Homo sapiens
agcagtgaatgattcagtgtt

SEQ ID NO: 3475023 - DNA, 21 bp, Homo sapiens
agggacagaggccccagcctc

SEQ ID NO: 3475024 - DNA, 14 bp, Homo sapiens
agggacaggagaag

SEQ ID NO: 3475025 - DNA, 17 bp, Homo sapiens
agggacgctttgtctgt

SEQ ID NO: 3475026 - DNA, 17 bp, Homo sapiens
agggactgtgagactga

SEQ ID NO: 3475027 - DNA, 14 bp, Homo sapiens
agggacttgaagtt

SEQ ID NO: 3475028 - DNA, 15 bp, Homo sapiens
agggacttgaagttg

SEQ ID NO: 3475029 - DNA, 15 bp, Homo sapiens
agggacttggaagct

SEQ ID NO: 3475030 - DNA, 18 bp, Homo sapiens
agggacttggaagctccg

SEQ ID NO: 3475031 - DNA, 17 bp, Homo sapiens
agggagcggaaagcagc

SEQ ID NO: 3475032 - DNA, 18 bp, Homo sapiens
agggagcggaaagcagct

SEQ ID NO: 3475033 - DNA, 21 bp, Homo sapiens
agggagcggccggccagcccc

SEQ ID NO: 3475034 - DNA, 16 bp, Homo sapiens
agggagctagccagag

SEQ ID NO: 3475035 - DNA, 15 bp, Homo sapiens
agggaggagtggagg

SEQ ID NO: 3475036 - DNA, 16 bp, Homo sapiens
agggaggagtggaggt

SEQ ID NO: 3475037 - DNA, 15 bp, Homo sapiens
agggaggcaagccct

SEQ ID NO: 3475038 - DNA, 15 bp, Homo sapiens
agggaggggcctagg

SEQ ID NO: 3475039 - DNA, 13 bp, Homo sapiens
agggaggggctgt

SEQ ID NO: 3475040 - DNA, 20 bp, Homo sapiens
agggaggtcaagttgtttgt

SEQ ID NO: 3475041 - DNA, 17 bp, Homo sapiens
agggaggtgaccccagg

SEQ ID NO: 3475042 - DNA, 23 bp, Homo sapiens
agggagtccgaaagggacttgga

SEQ ID NO: 3475043 - DNA, 18 bp, Homo sapiens
agggagtgacagaggcag

SEQ ID NO: 3475044 - DNA, 21 bp, Homo sapiens
agggagttatctaaaagaaat

SEQ ID NO: 3475045 - DNA, 19 bp, Homo sapiens
agggatccctcatctgtcc

SEQ ID NO: 3475046 - DNA, 22 bp, Homo sapiens
agggatctggtcctacccatcc

SEQ ID NO: 3475047 - DNA, 21 bp, Homo sapiens
agggatgccctggaggtggct

SEQ ID NO: 3475048 - DNA, 17 bp, Homo sapiens
agggattctcacaatag

SEQ ID NO: 3475049 - DNA, 15 bp, Homo sapiens
agggatttgcctcac

SEQ ID NO: 3475050 - DNA, 17 bp, Homo sapiens
agggatttgcctcacct

SEQ ID NO: 3475051 - DNA, 19 bp, Homo sapiens
agggcaaacccaaaacctc

SEQ ID NO: 3475052 - DNA, 17 bp, Homo sapiens
agggcaagctccgcagg

SEQ ID NO: 3475053 - DNA, 12 bp, Homo sapiens
agggcaagtctt

SEQ ID NO: 3475054 - DNA, 17 bp, Homo sapiens
agggcacaccgggcact

SEQ ID NO: 3475055 - DNA, 19 bp, Homo sapiens
agggcacagcatctgtagt

SEQ ID NO: 3475056 - DNA, 19 bp, Homo sapiens
agggcagagtgagacccag

SEQ ID NO: 3475057 - DNA, 12 bp, Homo sapiens
agggcagggccc

SEQ ID NO: 3475058 - DNA, 12 bp, Homo sapiens
agggcaggtggg

SEQ ID NO: 3475059 - DNA, 19 bp, Homo sapiens
agggcaggtggggtgagaa

SEQ ID NO: 3475060 - DNA, 18 bp, Homo sapiens
agggcatcttgctggcta

SEQ ID NO: 3475061 - DNA, 16 bp, Homo sapiens
agggcatgggtcggga

SEQ ID NO: 3475062 - DNA, 20 bp, Homo sapiens
agggcatgggtcgggagagg

SEQ ID NO: 3475063 - DNA, 21 bp, Homo sapiens
agggccaacccttctcctctt

SEQ ID NO: 3475064 - DNA, 15 bp, Homo sapiens
agggccacgctccag

SEQ ID NO: 3475065 - DNA, 20 bp, Homo sapiens
agggccacgctccagctgcc

SEQ ID NO: 3475066 - DNA, 22 bp, Homo sapiens
agggccagacagaccttcacag

SEQ ID NO: 3475067 - DNA, 12 bp, Homo sapiens
agggccagagcc

SEQ ID NO: 3475068 - DNA, 15 bp, Homo sapiens
agggccagagccagg

SEQ ID NO: 3475069 - DNA, 19 bp, Homo sapiens
agggccatgctgaggcctg

SEQ ID NO: 3475070 - DNA, 20 bp, Homo sapiens
agggccatgctgaggcctgg

SEQ ID NO: 3475071 - DNA, 21 bp, Homo sapiens
agggccatgctgaggcctggg

SEQ ID NO: 3475072 - DNA, 22 bp, Homo sapiens
agggccatgctgaggcctgggc

SEQ ID NO: 3475073 - DNA, 13 bp, Homo sapiens
agggcccagagag

SEQ ID NO: 3475074 - DNA, 14 bp, Homo sapiens
agggcccagagagg

SEQ ID NO: 3475075 - DNA, 23 bp, Homo sapiens
agggcccagagagggtggtgacc

SEQ ID NO: 3475076 - DNA, 18 bp, Homo sapiens
agggcccccacagttgct

SEQ ID NO: 3475077 - DNA, 23 bp, Homo sapiens
agggccgccagggagacctggac

SEQ ID NO: 3475078 - DNA, 15 bp, Homo sapiens
agggcctgagcctgg

SEQ ID NO: 3475079 - DNA, 18 bp, Homo sapiens
agggcctgctggaggcct

SEQ ID NO: 3475080 - DNA, 14 bp, Homo sapiens
agggcgcaaagggc

SEQ ID NO: 3475081 - DNA, 17 bp, Homo sapiens
agggcgcaaagggcatg

SEQ ID NO: 3475082 - DNA, 18 bp, Homo sapiens
agggcgcaaagggcatgg

SEQ ID NO: 3475083 - DNA, 15 bp, Homo sapiens
agggcggcaggggcc

SEQ ID NO: 3475084 - DNA, 23 bp, Homo sapiens
agggcggcaggggcctggagatc

SEQ ID NO: 3475085 - DNA, 18 bp, Homo sapiens
agggcgggcagagggctg

SEQ ID NO: 3475086 - DNA, 18 bp, Homo sapiens
agggctaccctgagctga

SEQ ID NO: 3475087 - DNA, 23 bp, Homo sapiens
agggctaccctgagctgaggcag

SEQ ID NO: 3475088 - DNA, 12 bp, Homo sapiens
agggctcctggg

SEQ ID NO: 3475089 - DNA, 16 bp, Homo sapiens
agggctgcatgatgtt

SEQ ID NO: 3475090 - DNA, 21 bp, Homo sapiens
agggctgcggcgtacaggctg

SEQ ID NO: 3475091 - DNA, 14 bp, Homo sapiens
agggctggactgag

SEQ ID NO: 3475092 - DNA, 17 bp, Homo sapiens
agggctggactgaggcc

SEQ ID NO: 3475093 - DNA, 20 bp, Homo sapiens
agggctggactgaggcctga

SEQ ID NO: 3475094 - DNA, 17 bp, Homo sapiens
agggctggaggcccagg

SEQ ID NO: 3475095 - DNA, 12 bp, Homo sapiens
agggctggctgg

SEQ ID NO: 3475096 - DNA, 12 bp, Homo sapiens
agggcttgtttt

SEQ ID NO: 3475097 - DNA, 16 bp, Homo sapiens
aggggaaaaaaatgtt

SEQ ID NO: 3475098 - DNA, 22 bp, Homo sapiens
aggggaaaatcagcctgctcca

SEQ ID NO: 3475099 - DNA, 14 bp, Homo sapiens
aggggaacagactg

SEQ ID NO: 3475100 - DNA, 13 bp, Homo sapiens
aggggaatgtttg

SEQ ID NO: 3475101 - DNA, 20 bp, Homo sapiens
aggggaatgtttgcctctgc

SEQ ID NO: 3475102 - DNA, 21 bp, Homo sapiens
aggggaatgtttgcctctgcc

SEQ ID NO: 3475103 - DNA, 17 bp, Homo sapiens
aggggacgcaggcccct

SEQ ID NO: 3475104 - DNA, 22 bp, Homo sapiens
aggggacgcaggcccctctcct

SEQ ID NO: 3475105 - DNA, 12 bp, Homo sapiens
aggggagcccac

SEQ ID NO: 3475106 - DNA, 16 bp, Homo sapiens
aggggatagagagaga

SEQ ID NO: 3475107 - DNA, 18 bp, Homo sapiens
aggggattaatatgaaaa

SEQ ID NO: 3475108 - DNA, 15 bp, Homo sapiens
aggggcacagggtct

SEQ ID NO: 3475109 - DNA, 15 bp, Homo sapiens
aggggccagaggctc

SEQ ID NO: 3475110 - DNA, 16 bp, Homo sapiens
aggggcccccctgccc

SEQ ID NO: 3475111 - DNA, 20 bp, Homo sapiens
aggggcccccctgccctgtg

SEQ ID NO: 3475112 - DNA, 13 bp, Homo sapiens
aggggcccggcca

SEQ ID NO: 3475113 - DNA, 15 bp, Homo sapiens
aggggcccggccagc

SEQ ID NO: 3475114 - DNA, 14 bp, Homo sapiens
aggggcctggagat

SEQ ID NO: 3475115 - DNA, 23 bp, Homo sapiens
aggggcgccgcaaaccacactgg

SEQ ID NO: 3475116 - DNA, 19 bp, Homo sapiens
aggggcgtctgttccccct

SEQ ID NO: 3475117 - DNA, 20 bp, Homo sapiens
aggggctgcttcctcctgga

SEQ ID NO: 3475118 - DNA, 22 bp, Homo sapiens
agggggagccccttctgctcag

SEQ ID NO: 3475119 - DNA, 17 bp, Homo sapiens
aggggggaagatcaggt

SEQ ID NO: 3475120 - DNA, 20 bp, Homo sapiens
aggggtctgggagtcaggcc

SEQ ID NO: 3475121 - DNA, 22 bp, Homo sapiens
aggggtctgggagtcaggcccg

SEQ ID NO: 3475122 - DNA, 22 bp, Homo sapiens
aggggtgtcttgggcagagctg

SEQ ID NO: 3475123 - DNA, 18 bp, Homo sapiens
agggtatcaggtgctgcc

SEQ ID NO: 3475124 - DNA, 13 bp, Homo sapiens
agggtattccaga

SEQ ID NO: 3475125 - DNA, 19 bp, Homo sapiens
agggtcagacgcctgagga

SEQ ID NO: 3475126 - DNA, 18 bp, Homo sapiens
agggtccagaaggagaca

SEQ ID NO: 3475127 - DNA, 21 bp, Homo sapiens
agggtccagaaggagacaggc

SEQ ID NO: 3475128 - DNA, 13 bp, Homo sapiens
agggtccagaccc

SEQ ID NO: 3475129 - DNA, 14 bp, Homo sapiens
agggtccctctgtg

SEQ ID NO: 3475130 - DNA, 15 bp, Homo sapiens
agggtccctctgtgt

SEQ ID NO: 3475131 - DNA, 20 bp, Homo sapiens
agggtccctctgtgtatttg

SEQ ID NO: 3475132 - DNA, 20 bp, Homo sapiens
agggtctcactatgttgccc

SEQ ID NO: 3475133 - DNA, 15 bp, Homo sapiens
agggtctcactctgt

SEQ ID NO: 3475134 - DNA, 22 bp, Homo sapiens
agggtctcactctgtcgcccag

SEQ ID NO: 3475135 - DNA, 15 bp, Homo sapiens
agggtctctgctgcc

SEQ ID NO: 3475136 - DNA, 16 bp, Homo sapiens
agggtctctgctgccg

SEQ ID NO: 3475137 - DNA, 15 bp, Homo sapiens
agggtcttgtgttgc

SEQ ID NO: 3475138 - DNA, 13 bp, Homo sapiens
agggtgagggcct

SEQ ID NO: 3475139 - DNA, 14 bp, Homo sapiens
agggtgagggcctt

SEQ ID NO: 3475140 - DNA, 17 bp, Homo sapiens
agggtgcgtctgggagg

SEQ ID NO: 3475141 - DNA, 21 bp, Homo sapiens
agggtggtgacctctgcctga

SEQ ID NO: 3475142 - DNA, 15 bp, Homo sapiens
agggtggtggagcca

SEQ ID NO: 3475143 - DNA, 22 bp, Homo sapiens
agggtgtccggtccctgtccca

SEQ ID NO: 3475144 - DNA, 12 bp, Homo sapiens
agggtgtgtgct

SEQ ID NO: 3475145 - DNA, 20 bp, Homo sapiens
agggtgtgtttgaaatcatc

SEQ ID NO: 3475146 - DNA, 18 bp, Homo sapiens
agggttattgcatttgga

SEQ ID NO: 3475147 - DNA, 17 bp, Homo sapiens
agggttcccgcggggct

SEQ ID NO: 3475148 - DNA, 19 bp, Homo sapiens
agggttcccgcggggctgt

SEQ ID NO: 3475149 - DNA, 14 bp, Homo sapiens
agggttctgcctct

SEQ ID NO: 3475150 - DNA, 18 bp, Homo sapiens
agggttgaccccagagga

SEQ ID NO: 3475151 - DNA, 18 bp, Homo sapiens
agggttggcccctgcccg

SEQ ID NO: 3475152 - DNA, 23 bp, Homo sapiens
agggttggcccctgcccggctgc

SEQ ID NO: 3475153 - DNA, 21 bp, Homo sapiens
agggtttaatccccagtaaaa

SEQ ID NO: 3475154 - DNA, 21 bp, Homo sapiens
agggtttggctgtgtctaaac

SEQ ID NO: 3475155 - DNA, 22 bp, Homo sapiens
agttcagaaatttaaaagcaga

SEQ ID NO: 3475156 - DNA, 11 bp, Homo sapiens
agttcagatct

SEQ ID NO: 3475157 - DNA, 14 bp, Homo sapiens
agttcataccctgt

SEQ ID NO: 3475158 - DNA, 20 bp, Homo sapiens
agttcatctatggcagtcca

SEQ ID NO: 3475159 - DNA, 21 bp, Homo sapiens
agttcatggcttttctctttg

SEQ ID NO: 3475160 - DNA, 16 bp, Homo sapiens
agttccccatgcagac

SEQ ID NO: 3475161 - DNA, 17 bp, Homo sapiens
agttcctatgacacagt

SEQ ID NO: 3475162 - DNA, 20 bp, Homo sapiens
agttccttgatctgtatata

SEQ ID NO: 3475163 - DNA, 19 bp, Homo sapiens
agttcgagaccagcctggc

SEQ ID NO: 3475164 - DNA, 16 bp, Homo sapiens
agttcgcctggagccc

SEQ ID NO: 3475165 - DNA, 14 bp, Homo sapiens
agttctgacttgac

SEQ ID NO: 3475166 - DNA, 19 bp, Homo sapiens
agttctgccttatctaaat

SEQ ID NO: 3475167 - DNA, 10 bp, Homo sapiens
agttctggaa

SEQ ID NO: 3475168 - DNA, 23 bp, Homo sapiens
agttctggagcttaattttctgt

SEQ ID NO: 3475169 - DNA, 22 bp, Homo sapiens
agttctggatggtgtgccttcc

SEQ ID NO: 3475170 - DNA, 15 bp, Homo sapiens
agttctgtagaaatg

SEQ ID NO: 3475171 - DNA, 18 bp, Homo sapiens
agttctttgggccagaca

SEQ ID NO: 3475172 - DNA, 23 bp, Homo sapiens
agttgaattgaggggattaatat

SEQ ID NO: 3475173 - DNA, 16 bp, Homo sapiens
agttgacaattctgca

SEQ ID NO: 3475174 - DNA, 15 bp, Homo sapiens
agttgaccctatttt

SEQ ID NO: 3475175 - DNA, 14 bp, Homo sapiens
agttgagaaggtgc

SEQ ID NO: 3475176 - DNA, 20 bp, Homo sapiens
agttgagaaggtgcctgcca

SEQ ID NO: 3475177 - DNA, 22 bp, Homo sapiens
agttgatatgttttatttcatt

SEQ ID NO: 3475178 - DNA, 18 bp, Homo sapiens
agttgatctggaacccag

SEQ ID NO: 3475179 - DNA, 17 bp, Homo sapiens
agttgattcagctctgc

SEQ ID NO: 3475180 - DNA, 17 bp, Homo sapiens
agttgcacggctgctga

SEQ ID NO: 3475181 - DNA, 10 bp, Homo sapiens
agttgcagcc

SEQ ID NO: 3475182 - DNA, 20 bp, Homo sapiens
agttgcatggcatcacctcc

SEQ ID NO: 3475183 - DNA, 13 bp, Homo sapiens
agttgccaatatg

SEQ ID NO: 3475184 - DNA, 15 bp, Homo sapiens
agttgccaatatgcc

SEQ ID NO: 3475185 - DNA, 15 bp, Homo sapiens
agttgccattattct

SEQ ID NO: 3475186 - DNA, 14 bp, Homo sapiens
agttgctctatgct

SEQ ID NO: 3475187 - DNA, 16 bp, Homo sapiens
agttgctctatgcttt

SEQ ID NO: 3475188 - DNA, 17 bp, Homo sapiens
agttgctctatgctttc

SEQ ID NO: 3475189 - DNA, 21 bp, Homo sapiens
agttgctctatgctttccaaa

SEQ ID NO: 3475190 - DNA, 19 bp, Homo sapiens
agttggagttttttgtacc

SEQ ID NO: 3475191 - DNA, 20 bp, Homo sapiens
agttggagttttttgtacca

SEQ ID NO: 3475192 - DNA, 19 bp, Homo sapiens
agttgggcttcctcatagt

SEQ ID NO: 3475193 - DNA, 15 bp, Homo sapiens
agttgggtgagaaca

SEQ ID NO: 3475194 - DNA, 15 bp, Homo sapiens
agttggttgaatttt

SEQ ID NO: 3475195 - DNA, 17 bp, Homo sapiens
agttgtaaatatataaa

SEQ ID NO: 3475196 - DNA, 20 bp, Homo sapiens
agttgtaaatatataaatat

SEQ ID NO: 3475197 - DNA, 15 bp, Homo sapiens
agttgtcactgcttt

SEQ ID NO: 3475198 - DNA, 21 bp, Homo sapiens
agttgtcactgcttttggcct

SEQ ID NO: 3475199 - DNA, 13 bp, Homo sapiens
agttgtctaaaca

SEQ ID NO: 3475200 - DNA, 21 bp, Homo sapiens
agttgtgcagcttttggtcat

SEQ ID NO: 3475201 - DNA, 17 bp, Homo sapiens
agtttaaaaatcaactt

SEQ ID NO: 3475202 - DNA, 18 bp, Homo sapiens
agtttaaaaatcaacttt

SEQ ID NO: 3475203 - DNA, 19 bp, Homo sapiens
agtttaaaaatcaactttt

SEQ ID NO: 3475204 - DNA, 12 bp, Homo sapiens
agtttaaagcaa

SEQ ID NO: 3475205 - DNA, 14 bp, Homo sapiens
agtttaaattgtaa

SEQ ID NO: 3475206 - DNA, 16 bp, Homo sapiens
agtttaggcctatcaa

SEQ ID NO: 3475207 - DNA, 21 bp, Homo sapiens
agtttatttccactattttca

SEQ ID NO: 3475208 - DNA, 22 bp, Homo sapiens
agtttatttccactattttcaa

SEQ ID NO: 3475209 - DNA, 23 bp, Homo sapiens
agtttatttccactattttcaaa

SEQ ID NO: 3475210 - DNA, 15 bp, Homo sapiens
agtttattttaagac

SEQ ID NO: 3475211 - DNA, 20 bp, Homo sapiens
agtttatttttaaagataga

SEQ ID NO: 3475212 - DNA, 12 bp, Homo sapiens
agtttcctgaaa

SEQ ID NO: 3475213 - DNA, 14 bp, Homo sapiens
agtttctcttttca

SEQ ID NO: 3475214 - DNA, 17 bp, Homo sapiens
agtttctgtcctgctgg

SEQ ID NO: 3475215 - DNA, 13 bp, Homo sapiens
agtttgaaattct

SEQ ID NO: 3475216 - DNA, 14 bp, Homo sapiens
agtttgaaattctg

SEQ ID NO: 3475217 - DNA, 15 bp, Homo sapiens
agtttgaaattctga

SEQ ID NO: 3475218 - DNA, 14 bp, Homo sapiens
agtttgaatgttaa

SEQ ID NO: 3475219 - DNA, 15 bp, Homo sapiens
agtttgaatgttaaa

SEQ ID NO: 3475220 - DNA, 17 bp, Homo sapiens
agtttgagaccagcctg

SEQ ID NO: 3475221 - DNA, 19 bp, Homo sapiens
agtttgagaccagcctggc

SEQ ID NO: 3475222 - DNA, 11 bp, Homo sapiens
agtttgcttag

SEQ ID NO: 3475223 - DNA, 19 bp, Homo sapiens
agtttgggatccctgtctt

SEQ ID NO: 3475224 - DNA, 20 bp, Homo sapiens
agtttgggatccctgtcttt

SEQ ID NO: 3475225 - DNA, 12 bp, Homo sapiens
agtttgggcttc

SEQ ID NO: 3475226 - DNA, 17 bp, Homo sapiens
agtttgggcttcagcct

SEQ ID NO: 3475227 - DNA, 13 bp, Homo sapiens
agtttgtatatac

SEQ ID NO: 3475228 - DNA, 18 bp, Homo sapiens
agtttgtcacatgaaaca

SEQ ID NO: 3475229 - DNA, 17 bp, Homo sapiens
agtttgtcgctcatgtg

SEQ ID NO: 3475230 - DNA, 19 bp, Homo sapiens
agtttgtcgctcatgtgtg

SEQ ID NO: 3475231 - DNA, 21 bp, Homo sapiens
agtttgtgtgttgtctcttga

SEQ ID NO: 3475232 - DNA, 15 bp, Homo sapiens
agtttgttgatcttt

SEQ ID NO: 3475233 - DNA, 14 bp, Homo sapiens
agttttagttttct

SEQ ID NO: 3475234 - DNA, 15 bp, Homo sapiens
agttttagttttctc

SEQ ID NO: 3475235 - DNA, 20 bp, Homo sapiens
agttttatccataatgatgg

SEQ ID NO: 3475236 - DNA, 21 bp, Homo sapiens
agttttcaagtcaaattaata

SEQ ID NO: 3475237 - DNA, 20 bp, Homo sapiens
agttttccatggcaggaagg

SEQ ID NO: 3475238 - DNA, 18 bp, Homo sapiens
agttttcccttgaggaaa

SEQ ID NO: 3475239 - DNA, 12 bp, Homo sapiens
agttttctctta

SEQ ID NO: 3475240 - DNA, 13 bp, Homo sapiens
agttttcttgttg

SEQ ID NO: 3475241 - DNA, 18 bp, Homo sapiens
agttttcttgttgctttg

SEQ ID NO: 3475242 - DNA, 19 bp, Homo sapiens
agttttcttgttgctttgt

SEQ ID NO: 3475243 - DNA, 12 bp, Homo sapiens
agttttgagaac

SEQ ID NO: 3475244 - DNA, 18 bp, Homo sapiens
agttttgagaacgtaaag

SEQ ID NO: 3475245 - DNA, 18 bp, Homo sapiens
agttttggatgcagtgct

SEQ ID NO: 3475246 - DNA, 23 bp, Homo sapiens
agtttttctgttttgtttggcaa

SEQ ID NO: 3475247 - DNA, 14 bp, Homo sapiens
ataaaaaatatgta

SEQ ID NO: 3475248 - DNA, 13 bp, Homo sapiens
ataaaaaatgaaa

SEQ ID NO: 3475249 - DNA, 17 bp, Homo sapiens
ataaaaagcttccatga

SEQ ID NO: 3475250 - DNA, 13 bp, Homo sapiens
ataaaaataaatt

SEQ ID NO: 3475251 - DNA, 18 bp, Homo sapiens
ataaaacaggtcaataca

SEQ ID NO: 3475252 - DNA, 15 bp, Homo sapiens
ataaaacagtatctc

SEQ ID NO: 3475253 - DNA, 14 bp, Homo sapiens
ataaaacattaaga

SEQ ID NO: 3475254 - DNA, 18 bp, Homo sapiens
ataaaacattaagaaaat

SEQ ID NO: 3475255 - DNA, 15 bp, Homo sapiens
ataaaagacagtgaa

SEQ ID NO: 3475256 - DNA, 19 bp, Homo sapiens
ataaaaggaagccaaagag

SEQ ID NO: 3475257 - DNA, 16 bp, Homo sapiens
ataaaaggactctgga

SEQ ID NO: 3475258 - DNA, 21 bp, Homo sapiens
ataaaataaatatatataaac

SEQ ID NO: 3475259 - DNA, 18 bp, Homo sapiens
ataaaatattattgaact

SEQ ID NO: 3475260 - DNA, 11 bp, Homo sapiens
ataaaatcagc

SEQ ID NO: 3475261 - DNA, 15 bp, Homo sapiens
ataaaatcagccaat

SEQ ID NO: 3475262 - DNA, 16 bp, Homo sapiens
ataaaatggctgtaat

SEQ ID NO: 3475263 - DNA, 15 bp, Homo sapiens
ataaaatgtcttcaa

SEQ ID NO: 3475264 - DNA, 17 bp, Homo sapiens
ataaaattttttttcat

SEQ ID NO: 3475265 - DNA, 19 bp, Homo sapiens
ataaaattttttttcatgt

SEQ ID NO: 3475266 - DNA, 23 bp, Homo sapiens
ataaaattttttttcatgtttta

SEQ ID NO: 3475267 - DNA, 14 bp, Homo sapiens
ataaacactacaga

SEQ ID NO: 3475268 - DNA, 14 bp, Homo sapiens
ataaacagacaata

SEQ ID NO: 3475269 - DNA, 20 bp, Homo sapiens
ataaacctaaaaaagatata

SEQ ID NO: 3475270 - DNA, 22 bp, Homo sapiens
ataaactaatggtccacaccca

SEQ ID NO: 3475271 - DNA, 12 bp, Homo sapiens
ataaactgtaaa

SEQ ID NO: 3475272 - DNA, 16 bp, Homo sapiens
ataaactttaatataa

SEQ ID NO: 3475273 - DNA, 16 bp, Homo sapiens
ataaagaatacttgaa

SEQ ID NO: 3475274 - DNA, 19 bp, Homo sapiens
ataaagaatacttgaactt

SEQ ID NO: 3475275 - DNA, 20 bp, Homo sapiens
ataaagagagaacaggacta

SEQ ID NO: 3475276 - DNA, 13 bp, Homo sapiens
ataaagatgattg

SEQ ID NO: 3475277 - DNA, 14 bp, Homo sapiens
ataaagcacagctg

SEQ ID NO: 3475278 - DNA, 20 bp, Homo sapiens
ataaagcctgttttgtcttt

SEQ ID NO: 3475279 - DNA, 22 bp, Homo sapiens
ataaaggatgtgattgtggaat

SEQ ID NO: 3475280 - DNA, 15 bp, Homo sapiens
ataaaggtaaaacaa

SEQ ID NO: 3475281 - DNA, 16 bp, Homo sapiens
ataaagtagtcctgtg

SEQ ID NO: 3475282 - DNA, 17 bp, Homo sapiens
ataaagtatttaattag

SEQ ID NO: 3475283 - DNA, 19 bp, Homo sapiens
ataaagtatttaattagtg

SEQ ID NO: 3475284 - DNA, 21 bp, Homo sapiens
ataaagtatttaattagtgct

SEQ ID NO: 3475285 - DNA, 21 bp, Homo sapiens
ataaatatatataaacctaaa

SEQ ID NO: 3475286 - DNA, 18 bp, Homo sapiens
ataaatctgacccagtgc

SEQ ID NO: 3475287 - DNA, 16 bp, Homo sapiens
ataaatgttaagaaaa

SEQ ID NO: 3475288 - DNA, 22 bp, Homo sapiens
atccataaagacaatcactgcc

SEQ ID NO: 3475289 - DNA, 12 bp, Homo sapiens
atccataatgat

SEQ ID NO: 3475290 - DNA, 19 bp, Homo sapiens
atccataatgatggattta

SEQ ID NO: 3475291 - DNA, 20 bp, Homo sapiens
atccatattgagtcaaatgg

SEQ ID NO: 3475292 - DNA, 13 bp, Homo sapiens
atccatattgcac

SEQ ID NO: 3475293 - DNA, 15 bp, Homo sapiens
atccatattgcacaa

SEQ ID NO: 3475294 - DNA, 14 bp, Homo sapiens
atccatcatcatgt

SEQ ID NO: 3475295 - DNA, 15 bp, Homo sapiens
atccattcccaagat

SEQ ID NO: 3475296 - DNA, 23 bp, Homo sapiens
atccattcccaagatgcctgatc

SEQ ID NO: 3475297 - DNA, 13 bp, Homo sapiens
atccattctttct

SEQ ID NO: 3475298 - DNA, 15 bp, Homo sapiens
atccattgtctcttc

SEQ ID NO: 3475299 - DNA, 23 bp, Homo sapiens
atccatttgcgttccatgatgct

SEQ ID NO: 3475300 - DNA, 20 bp, Homo sapiens
atcccaagtagaatctcagt

SEQ ID NO: 3475301 - DNA, 22 bp, Homo sapiens
atcccagcactttgggaggctg

SEQ ID NO: 3475302 - DNA, 13 bp, Homo sapiens
atcccatgagcct

SEQ ID NO: 3475303 - DNA, 16 bp, Homo sapiens
atcccattctttataa

SEQ ID NO: 3475304 - DNA, 15 bp, Homo sapiens
atcccatttaaaaaa

SEQ ID NO: 3475305 - DNA, 17 bp, Homo sapiens
atccccaggtctctcca

SEQ ID NO: 3475306 - DNA, 22 bp, Homo sapiens
atccccaggtctctccactgct

SEQ ID NO: 3475307 - DNA, 21 bp, Homo sapiens
atccccagtaaaattgccata

SEQ ID NO: 3475308 - DNA, 20 bp, Homo sapiens
atcccccactgccacaccct

SEQ ID NO: 3475309 - DNA, 17 bp, Homo sapiens
atccccccatcttgctt

SEQ ID NO: 3475310 - DNA, 19 bp, Homo sapiens
atcccccccacctctccct

SEQ ID NO: 3475311 - DNA, 22 bp, Homo sapiens
atccccgcagtgtgcactaagg

SEQ ID NO: 3475312 - DNA, 15 bp, Homo sapiens
atcccctgtagagtg

SEQ ID NO: 3475313 - DNA, 16 bp, Homo sapiens
atccccttgaactctt

SEQ ID NO: 3475314 - DNA, 14 bp, Homo sapiens
atcccgagcacctc

SEQ ID NO: 3475315 - DNA, 19 bp, Homo sapiens
atccctaccgacccagggt

SEQ ID NO: 3475316 - DNA, 17 bp, Homo sapiens
atccctcatctgtccct

SEQ ID NO: 3475317 - DNA, 19 bp, Homo sapiens
atccctctgggggctctgg

SEQ ID NO: 3475318 - DNA, 14 bp, Homo sapiens
atccctgccagctc

SEQ ID NO: 3475319 - DNA, 12 bp, Homo sapiens
atccctgcccat

SEQ ID NO: 3475320 - DNA, 18 bp, Homo sapiens
atcccttgaccaggcctg

SEQ ID NO: 3475321 - DNA, 22 bp, Homo sapiens
atccctttattaccccctcctt

SEQ ID NO: 3475322 - DNA, 20 bp, Homo sapiens
atccgaacctcctctgtgaa

SEQ ID NO: 3475323 - DNA, 21 bp, Homo sapiens
atccgtctttggcctcctcca

SEQ ID NO: 3475324 - DNA, 14 bp, Homo sapiens
atccgtttgaccaa

SEQ ID NO: 3475325 - DNA, 15 bp, Homo sapiens
atccgtttgaccaat

SEQ ID NO: 3475326 - DNA, 14 bp, Homo sapiens
atccgttttttaag

SEQ ID NO: 3475327 - DNA, 19 bp, Homo sapiens
atcctaatcatccaatgct

SEQ ID NO: 3475328 - DNA, 19 bp, Homo sapiens
atcctagcacatgcttcaa

SEQ ID NO: 3475329 - DNA, 21 bp, Homo sapiens
atcctaggcatttgctgaata

SEQ ID NO: 3475330 - DNA, 13 bp, Homo sapiens
atcctagtgcttt

SEQ ID NO: 3475331 - DNA, 12 bp, Homo sapiens
atcctatgtttt

SEQ ID NO: 3475332 - DNA, 21 bp, Homo sapiens
atcctcaaacactgcaggcat

SEQ ID NO: 3475333 - DNA, 13 bp, Homo sapiens
atcctcatctctc

SEQ ID NO: 3475334 - DNA, 19 bp, Homo sapiens
atcctccagtaccttgctt

SEQ ID NO: 3475335 - DNA, 15 bp, Homo sapiens
atcctcctccagggt

SEQ ID NO: 3475336 - DNA, 16 bp, Homo sapiens
atcctctcacctcagc

SEQ ID NO: 3475337 - DNA, 21 bp, Homo sapiens
atcctctgactccactcaaag

SEQ ID NO: 3475338 - DNA, 21 bp, Homo sapiens
atcctcttctcaaagctggga

SEQ ID NO: 3475339 - DNA, 13 bp, Homo sapiens
atcctctttagag

SEQ ID NO: 3475340 - DNA, 22 bp, Homo sapiens
atcctctttagagttagactgt

SEQ ID NO: 3475341 - DNA, 18 bp, Homo sapiens
atcctgaaatagaggcta

SEQ ID NO: 3475342 - DNA, 23 bp, Homo sapiens
atcctgcggcaggactgcagagc

SEQ ID NO: 3475343 - DNA, 24 bp, Homo sapiens
atcctgcggcaggactgcagagca

SEQ ID NO: 3475344 - DNA, 12 bp, Homo sapiens
atcctgcttgat

SEQ ID NO: 3475345 - DNA, 22 bp, Homo sapiens
atcctggacatgaagattcttt

SEQ ID NO: 3475346 - DNA, 15 bp, Homo sapiens
atcctggaggcccag

SEQ ID NO: 3475347 - DNA, 17 bp, Homo sapiens
atcctggaggcccagtt

SEQ ID NO: 3475348 - DNA, 20 bp, Homo sapiens
atcctggaggcccagttcac

SEQ ID NO: 3475349 - DNA, 19 bp, Homo sapiens
atcctggaggtcttttcta

SEQ ID NO: 3475350 - DNA, 17 bp, Homo sapiens
atcctggcacccggccc

SEQ ID NO: 3475351 - DNA, 19 bp, Homo sapiens
atcctggcacccggcccct

SEQ ID NO: 3475352 - DNA, 24 bp, Homo sapiens
atcctggctctttggagatcaagg

SEQ ID NO: 3475353 - DNA, 21 bp, Homo sapiens
atcctgtattcagacagatga

SEQ ID NO: 3475354 - DNA, 17 bp, Homo sapiens
atcctgtcttatttgtt

SEQ ID NO: 3475355 - DNA, 16 bp, Homo sapiens
atcctgtgaagtaagg

SEQ ID NO: 3475356 - DNA, 11 bp, Homo sapiens
atcctgtgagg

SEQ ID NO: 3475357 - DNA, 16 bp, Homo sapiens
atccttaaatatgtga

SEQ ID NO: 3475358 - DNA, 18 bp, Homo sapiens
atccttagatctggcatg

SEQ ID NO: 3475359 - DNA, 17 bp, Homo sapiens
atccttcatcttttaaa

SEQ ID NO: 3475360 - DNA, 22 bp, Homo sapiens
atccttcccaagtaagaggctg

SEQ ID NO: 3475361 - DNA, 22 bp, Homo sapiens
atccttccctgtctgccagggc

SEQ ID NO: 3475362 - DNA, 21 bp, Homo sapiens
atccttccctttggagatgct

SEQ ID NO: 3475363 - DNA, 15 bp, Homo sapiens
atccttcctctcctt

SEQ ID NO: 3475364 - DNA, 22 bp, Homo sapiens
atccttgggggctcccagggca

SEQ ID NO: 3475365 - DNA, 15 bp, Homo sapiens
atccttttcttctat

SEQ ID NO: 3475366 - DNA, 18 bp, Homo sapiens
atccttttcttctatgta

SEQ ID NO: 3475367 - DNA, 19 bp, Homo sapiens
atcgaagggtttttagaga

SEQ ID NO: 3475368 - DNA, 23 bp, Homo sapiens
atcgatgggggagtctgaagcag

SEQ ID NO: 3475369 - DNA, 19 bp, Homo sapiens
atcgccagaggtgcttcac

SEQ ID NO: 3475370 - DNA, 22 bp, Homo sapiens
atcgcggcggagctggccccgc

SEQ ID NO: 3475371 - DNA, 23 bp, Homo sapiens
atcgtccagggagcattttcctc

SEQ ID NO: 3475372 - DNA, 14 bp, Homo sapiens
atcgtctaaacttt

SEQ ID NO: 3475373 - DNA, 14 bp, Homo sapiens
atcgtgacaacact

SEQ ID NO: 3475374 - DNA, 17 bp, Homo sapiens
atctaaagttatatttc

SEQ ID NO: 3475375 - DNA, 13 bp, Homo sapiens
atctaagcctgaa

SEQ ID NO: 3475376 - DNA, 23 bp, Homo sapiens
atctaatatggccacagtagtct

SEQ ID NO: 3475377 - DNA, 18 bp, Homo sapiens
atctaatatgtaacaagc

SEQ ID NO: 3475378 - DNA, 23 bp, Homo sapiens
atctaatatgtaacaagccaccc

SEQ ID NO: 3475379 - DNA, 16 bp, Homo sapiens
atctaatatttctagt

SEQ ID NO: 3475380 - DNA, 15 bp, Homo sapiens
atctacccaaaggat

SEQ ID NO: 3475381 - DNA, 20 bp, Homo sapiens
atctactaaaaatacaaaaa

SEQ ID NO: 3475382 - DNA, 15 bp, Homo sapiens
atctactaattccac

SEQ ID NO: 3475383 - DNA, 17 bp, Homo sapiens
atctactttttgaactt

SEQ ID NO: 3475384 - DNA, 16 bp, Homo sapiens
atctagatatcgactt

SEQ ID NO: 3475385 - DNA, 14 bp, Homo sapiens
atctagcaaatgtt

SEQ ID NO: 3475386 - DNA, 17 bp, Homo sapiens
atctagcgcaattgaag

SEQ ID NO: 3475387 - DNA, 18 bp, Homo sapiens
atctaggcaacatagtat

SEQ ID NO: 3475388 - DNA, 16 bp, Homo sapiens
atctatacatatcttt

SEQ ID NO: 3475389 - DNA, 21 bp, Homo sapiens
atctatggcagtccagccagc

SEQ ID NO: 3475390 - DNA, 22 bp, Homo sapiens
atctatggcagtccagccagct

SEQ ID NO: 3475391 - DNA, 15 bp, Homo sapiens
atctattaaaaccac

SEQ ID NO: 3475392 - DNA, 13 bp, Homo sapiens
atctatttggaac

SEQ ID NO: 3475393 - DNA, 14 bp, Homo sapiens
atctattttggatt

SEQ ID NO: 3475394 - DNA, 13 bp, Homo sapiens
atctcaatcctgc

SEQ ID NO: 3475395 - DNA, 18 bp, Homo sapiens
atctcaatgaagccagct

SEQ ID NO: 3475396 - DNA, 13 bp, Homo sapiens
atctcaccccatc

SEQ ID NO: 3475397 - DNA, 23 bp, Homo sapiens
atctcaccccatcccacaccctg

SEQ ID NO: 3475398 - DNA, 12 bp, Homo sapiens
atctcagagaca

SEQ ID NO: 3475399 - DNA, 19 bp, Homo sapiens
atctcaggacacttccgta

SEQ ID NO: 3475400 - DNA, 17 bp, Homo sapiens
atctcaggccagagcca

SEQ ID NO: 3475401 - DNA, 16 bp, Homo sapiens
atctcagggcctggtc

SEQ ID NO: 3475402 - DNA, 17 bp, Homo sapiens
atctcagggtccagacc

SEQ ID NO: 3475403 - DNA, 23 bp, Homo sapiens
atctcatgcccctggctgggacg

SEQ ID NO: 3475404 - DNA, 21 bp, Homo sapiens
atctcattactgcttcatttt

SEQ ID NO: 3475405 - DNA, 23 bp, Homo sapiens
atctcattactgcttcatttttg

SEQ ID NO: 3475406 - DNA, 18 bp, Homo sapiens
atctccacaacctcttcc

SEQ ID NO: 3475407 - DNA, 20 bp, Homo sapiens
atctccaggcaaaaggagtg

SEQ ID NO: 3475408 - DNA, 19 bp, Homo sapiens
atctcccacctagcagcac

SEQ ID NO: 3475409 - DNA, 20 bp, Homo sapiens
atctcccacctagcagcacc

SEQ ID NO: 3475410 - DNA, 19 bp, Homo sapiens
atctcccagataatgtgaa

SEQ ID NO: 3475411 - DNA, 20 bp, Homo sapiens
atctcccccatcccccactg

SEQ ID NO: 3475412 - DNA, 23 bp, Homo sapiens
atctcccccatcccccactgcca

SEQ ID NO: 3475413 - DNA, 20 bp, Homo sapiens
atctcccctcagctcggctc

SEQ ID NO: 3475414 - DNA, 16 bp, Homo sapiens
atctcctgccttcctc

SEQ ID NO: 3475415 - DNA, 17 bp, Homo sapiens
atctcctgccttcctcc

SEQ ID NO: 3475416 - DNA, 17 bp, Homo sapiens
atctcgctccctcccag

SEQ ID NO: 3475417 - DNA, 22 bp, Homo sapiens
atctctccagctaattcaggtc

SEQ ID NO: 3475418 - DNA, 11 bp, Homo sapiens
atctctccctc

SEQ ID NO: 3475419 - DNA, 21 bp, Homo sapiens
atgtagtcagaattagctgct

SEQ ID NO: 3475420 - DNA, 14 bp, Homo sapiens
atgtagtgcctctt

SEQ ID NO: 3475421 - DNA, 17 bp, Homo sapiens
atgtagtggttttagga

SEQ ID NO: 3475422 - DNA, 13 bp, Homo sapiens
atgtataaaatgt

SEQ ID NO: 3475423 - DNA, 15 bp, Homo sapiens
atgtataaaatgtaa

SEQ ID NO: 3475424 - DNA, 16 bp, Homo sapiens
atgtataaaatgtaac

SEQ ID NO: 3475425 - DNA, 18 bp, Homo sapiens
atgtataaaatgtaacac

SEQ ID NO: 3475426 - DNA, 19 bp, Homo sapiens
atgtatcgggaagatttct

SEQ ID NO: 3475427 - DNA, 21 bp, Homo sapiens
atgtatttaccaaaaattttg

SEQ ID NO: 3475428 - DNA, 19 bp, Homo sapiens
atgtatttcctggatgttt

SEQ ID NO: 3475429 - DNA, 14 bp, Homo sapiens
atgtcacaggcagg

SEQ ID NO: 3475430 - DNA, 15 bp, Homo sapiens
atgtcacaggcaggt

SEQ ID NO: 3475431 - DNA, 20 bp, Homo sapiens
atgtcaccggatcctgggtg

SEQ ID NO: 3475432 - DNA, 22 bp, Homo sapiens
atgtcagcaaaaagcaaaatca

SEQ ID NO: 3475433 - DNA, 23 bp, Homo sapiens
atgtcagcaaaaagcaaaatcat

SEQ ID NO: 3475434 - DNA, 16 bp, Homo sapiens
atgtcagtattttaat

SEQ ID NO: 3475435 - DNA, 16 bp, Homo sapiens
atgtccacgtgtgtgt

SEQ ID NO: 3475436 - DNA, 14 bp, Homo sapiens
atgtcccctcccag

SEQ ID NO: 3475437 - DNA, 19 bp, Homo sapiens
atgtcgtagaattccttcg

SEQ ID NO: 3475438 - DNA, 23 bp, Homo sapiens
atgtcgtcaaagctgaaatggac

SEQ ID NO: 3475439 - DNA, 16 bp, Homo sapiens
atgtctagagcctctt

SEQ ID NO: 3475440 - DNA, 18 bp, Homo sapiens
atgtctattccattccct

SEQ ID NO: 3475441 - DNA, 21 bp, Homo sapiens
atgtctctgtgagactcgaga

SEQ ID NO: 3475442 - DNA, 17 bp, Homo sapiens
atgtctgaactttggga

SEQ ID NO: 3475443 - DNA, 15 bp, Homo sapiens
atgtctgagtgaacc

SEQ ID NO: 3475444 - DNA, 13 bp, Homo sapiens
atgtctgtcattg

SEQ ID NO: 3475445 - DNA, 19 bp, Homo sapiens
atgtcttaatgaagtttga

SEQ ID NO: 3475446 - DNA, 20 bp, Homo sapiens
atgtcttaatgaagtttgaa

SEQ ID NO: 3475447 - DNA, 16 bp, Homo sapiens
atgtcttcaaggcttc

SEQ ID NO: 3475448 - DNA, 20 bp, Homo sapiens
atgtcttcaaggcttcagtc

SEQ ID NO: 3475449 - DNA, 13 bp, Homo sapiens
atgtcttttaaaa

SEQ ID NO: 3475450 - DNA, 19 bp, Homo sapiens
atgtcttttgatgaataga

SEQ ID NO: 3475451 - DNA, 18 bp, Homo sapiens
atgtgaaaggaacatttt

SEQ ID NO: 3475452 - DNA, 12 bp, Homo sapiens
atgtgaaccatt

SEQ ID NO: 3475453 - DNA, 22 bp, Homo sapiens
atgtgaaccattaaccagatct

SEQ ID NO: 3475454 - DNA, 12 bp, Homo sapiens
atgtgactctga

SEQ ID NO: 3475455 - DNA, 13 bp, Homo sapiens
atgtgactctgaa

SEQ ID NO: 3475456 - DNA, 15 bp, Homo sapiens
atgtgactctggctt

SEQ ID NO: 3475457 - DNA, 18 bp, Homo sapiens
atgtgactttgcatcagc

SEQ ID NO: 3475458 - DNA, 12 bp, Homo sapiens
atgtgaggatgt

SEQ ID NO: 3475459 - DNA, 18 bp, Homo sapiens
atgtgagtgccttttgca

SEQ ID NO: 3475460 - DNA, 20 bp, Homo sapiens
atgtgagtgccttttgcaga

SEQ ID NO: 3475461 - DNA, 17 bp, Homo sapiens
atgtgataaggaaatca

SEQ ID NO: 3475462 - DNA, 19 bp, Homo sapiens
atgtgatgaatactgtatt

SEQ ID NO: 3475463 - DNA, 15 bp, Homo sapiens
atgtgattgtggaat

SEQ ID NO: 3475464 - DNA, 17 bp, Homo sapiens
atgtgattgtggaatgg

SEQ ID NO: 3475465 - DNA, 22 bp, Homo sapiens
atgtgattgtggaatggagatt

SEQ ID NO: 3475466 - DNA, 23 bp, Homo sapiens
atgtgcacatgcacgtgtgtgca

SEQ ID NO: 3475467 - DNA, 11 bp, Homo sapiens
atgtgccatgt

SEQ ID NO: 3475468 - DNA, 19 bp, Homo sapiens
atgtgccatgtataatttt

SEQ ID NO: 3475469 - DNA, 16 bp, Homo sapiens
atgtgcctctgtcctt

SEQ ID NO: 3475470 - DNA, 14 bp, Homo sapiens
atgtgcctgggtgg

SEQ ID NO: 3475471 - DNA, 15 bp, Homo sapiens
atgtgctgtaattta

SEQ ID NO: 3475472 - DNA, 14 bp, Homo sapiens
atgtggctggaaga

SEQ ID NO: 3475473 - DNA, 21 bp, Homo sapiens
atgtggcttgagaaatatgga

SEQ ID NO: 3475474 - DNA, 20 bp, Homo sapiens
atgtgggaattaagcaaaat

SEQ ID NO: 3475475 - DNA, 16 bp, Homo sapiens
atgtgggggcttcatc

SEQ ID NO: 3475476 - DNA, 22 bp, Homo sapiens
atgtgggggcttcatctcttta

SEQ ID NO: 3475477 - DNA, 15 bp, Homo sapiens
atgtgtaaggtgaac

SEQ ID NO: 3475478 - DNA, 19 bp, Homo sapiens
atgtgtaggtgaacagtca

SEQ ID NO: 3475479 - DNA, 16 bp, Homo sapiens
atgtgtcaaattataa

SEQ ID NO: 3475480 - DNA, 22 bp, Homo sapiens
atgtgtcaaattataagagaca

SEQ ID NO: 3475481 - DNA, 14 bp, Homo sapiens
atgtgtggcctgca

SEQ ID NO: 3475482 - DNA, 21 bp, Homo sapiens
atgtgtgtccacgactgtctc

SEQ ID NO: 3475483 - DNA, 23 bp, Homo sapiens
atgtgtgtccacgactgtctcca

SEQ ID NO: 3475484 - DNA, 12 bp, Homo sapiens
atgtgtgtgtgt

SEQ ID NO: 3475485 - DNA, 16 bp, Homo sapiens
atgtgtgtgtgtgtgt

SEQ ID NO: 3475486 - DNA, 20 bp, Homo sapiens
atgtgtgtgtgtgtgtgtgt

SEQ ID NO: 3475487 - DNA, 16 bp, Homo sapiens
atgtgttttataaaat

SEQ ID NO: 3475488 - DNA, 21 bp, Homo sapiens
atgttaaactagcatatctgc

SEQ ID NO: 3475489 - DNA, 24 bp, Homo sapiens
atgttaaactagcatatctgcctt

SEQ ID NO: 3475490 - DNA, 17 bp, Homo sapiens
atgttaaataaattgta

SEQ ID NO: 3475491 - DNA, 20 bp, Homo sapiens
atgttaaataaattgtatat

SEQ ID NO: 3475492 - DNA, 15 bp, Homo sapiens
atgttaacctaggca

SEQ ID NO: 3475493 - DNA, 18 bp, Homo sapiens
atgttaacctaggcagtg

SEQ ID NO: 3475494 - DNA, 23 bp, Homo sapiens
atgttaagcagctaaattttctg

SEQ ID NO: 3475495 - DNA, 21 bp, Homo sapiens
atgttaagccctggcaggcag

SEQ ID NO: 3475496 - DNA, 23 bp, Homo sapiens
atgttaagcttctattttttact

SEQ ID NO: 3475497 - DNA, 17 bp, Homo sapiens
atgttaattttttggta

SEQ ID NO: 3475498 - DNA, 23 bp, Homo sapiens
atgttaattttttggtacaaaaa

SEQ ID NO: 3475499 - DNA, 21 bp, Homo sapiens
atgttatcttatactgtacaa

SEQ ID NO: 3475500 - DNA, 13 bp, Homo sapiens
atgttatgtaaaa

SEQ ID NO: 3475501 - DNA, 14 bp, Homo sapiens
atgttatgtaaaag

SEQ ID NO: 3475502 - DNA, 21 bp, Homo sapiens
atgttatgtaaaaggccaaac

SEQ ID NO: 3475503 - DNA, 18 bp, Homo sapiens
atgttcaaagactgtgaa

SEQ ID NO: 3475504 - DNA, 20 bp, Homo sapiens
atgttcacttttgacaaagg

SEQ ID NO: 3475505 - DNA, 20 bp, Homo sapiens
atgttccgaattgagcacaa

SEQ ID NO: 3475506 - DNA, 14 bp, Homo sapiens
atgttctctatcat

SEQ ID NO: 3475507 - DNA, 19 bp, Homo sapiens
atgttctctatcatttaat

SEQ ID NO: 3475508 - DNA, 20 bp, Homo sapiens
atgttctctatcatttaata

SEQ ID NO: 3475509 - DNA, 16 bp, Homo sapiens
atgttctctcttctcc

SEQ ID NO: 3475510 - DNA, 17 bp, Homo sapiens
atgttctctgaggacac

SEQ ID NO: 3475511 - DNA, 13 bp, Homo sapiens
atgttctgctttc

SEQ ID NO: 3475512 - DNA, 11 bp, Homo sapiens
atgttctggga

SEQ ID NO: 3475513 - DNA, 15 bp, Homo sapiens
atgttctgggacaca

SEQ ID NO: 3475514 - DNA, 19 bp, Homo sapiens
atgttctggtggtttgatt

SEQ ID NO: 3475515 - DNA, 16 bp, Homo sapiens
atgttctgtcttccca

SEQ ID NO: 3475516 - DNA, 23 bp, Homo sapiens
atgttctgtcttcccaaacccag

SEQ ID NO: 3475517 - DNA, 16 bp, Homo sapiens
atgttgaaaagtcaaa

SEQ ID NO: 3475518 - DNA, 19 bp, Homo sapiens
atgttgaatactttttaca

SEQ ID NO: 3475519 - DNA, 20 bp, Homo sapiens
atgttgatccatccagcttg

SEQ ID NO: 3475520 - DNA, 21 bp, Homo sapiens
atgttgcacacccactcagct

SEQ ID NO: 3475521 - DNA, 13 bp, Homo sapiens
atgttgcccaggc

SEQ ID NO: 3475522 - DNA, 15 bp, Homo sapiens
atgttgcccaggcag

SEQ ID NO: 3475523 - DNA, 17 bp, Homo sapiens
atgttggataaggaatt

SEQ ID NO: 3475524 - DNA, 22 bp, Homo sapiens
atgttggataaggaattataga

SEQ ID NO: 3475525 - DNA, 13 bp, Homo sapiens
atgttggccaggc

SEQ ID NO: 3475526 - DNA, 17 bp, Homo sapiens
atgttggccaggctggt

SEQ ID NO: 3475527 - DNA, 13 bp, Homo sapiens
atgttgtcaaaga

SEQ ID NO: 3475528 - DNA, 22 bp, Homo sapiens
atgttgtgtttctgttcacctt

SEQ ID NO: 3475529 - DNA, 14 bp, Homo sapiens
atgtttaatctgtt

SEQ ID NO: 3475530 - DNA, 14 bp, Homo sapiens
atgtttcctctagt

SEQ ID NO: 3475531 - DNA, 20 bp, Homo sapiens
atgtttcgtgaagtatactg

SEQ ID NO: 3475532 - DNA, 16 bp, Homo sapiens
atgtttgcacttgtga

SEQ ID NO: 3475533 - DNA, 14 bp, Homo sapiens
atgtttgcctctgc

SEQ ID NO: 3475534 - DNA, 18 bp, Homo sapiens
atgtttgcctctgcctct

SEQ ID NO: 3475535 - DNA, 14 bp, Homo sapiens
atgtttgttaaaaa

SEQ ID NO: 3475536 - DNA, 17 bp, Homo sapiens
atgtttgttaaaaataa

SEQ ID NO: 3475537 - DNA, 22 bp, Homo sapiens
atgttttaaagaatatgacttt

SEQ ID NO: 3475538 - DNA, 16 bp, Homo sapiens
atgttttaacaaaaac

SEQ ID NO: 3475539 - DNA, 18 bp, Homo sapiens
atgttttaagaggcaggg

SEQ ID NO: 3475540 - DNA, 15 bp, Homo sapiens
atgttttatttcatt

SEQ ID NO: 3475541 - DNA, 18 bp, Homo sapiens
atgttttccagctcctca

SEQ ID NO: 3475542 - DNA, 11 bp, Homo sapiens
atgtttttaat

SEQ ID NO: 3475543 - DNA, 13 bp, Homo sapiens
atgtttttaatat

SEQ ID NO: 3475544 - DNA, 23 bp, Homo sapiens
atgtttttctttatttttgttaa

SEQ ID NO: 3475545 - DNA, 19 bp, Homo sapiens
atgtttttgttcaaagcca

SEQ ID NO: 3475546 - DNA, 23 bp, Homo sapiens
atgtttttttccaatgcttctta

SEQ ID NO: 3475547 - DNA, 19 bp, Homo sapiens
attaaaaaagcatacttct

SEQ ID NO: 3475548 - DNA, 19 bp, Homo sapiens
attaaaaaggtttacagaa

SEQ ID NO: 3475549 - DNA, 13 bp, Homo sapiens
attaaaaattata

SEQ ID NO: 3475550 - DNA, 14 bp, Homo sapiens
attaaaacaatatt

SEQ ID NO: 3475551 - DNA, 17 bp, Homo sapiens
caaagggtccagaagga

SEQ ID NO: 3475552 - DNA, 13 bp, Homo sapiens
caaaggtgaagga

SEQ ID NO: 3475553 - DNA, 19 bp, Homo sapiens
caaaggtgaaggaatatat

SEQ ID NO: 3475554 - DNA, 14 bp, Homo sapiens
caaaggttccattc

SEQ ID NO: 3475555 - DNA, 18 bp, Homo sapiens
caaagtaaaacttgctgc

SEQ ID NO: 3475556 - DNA, 21 bp, Homo sapiens
caaagtaaaacttgctgcctg

SEQ ID NO: 3475557 - DNA, 11 bp, Homo sapiens
caaagtactgt

SEQ ID NO: 3475558 - DNA, 14 bp, Homo sapiens
caaagtattgtaaa

SEQ ID NO: 3475559 - DNA, 16 bp, Homo sapiens
caaagtattgtaaatt

SEQ ID NO: 3475560 - DNA, 17 bp, Homo sapiens
caaagtattgtaaatta

SEQ ID NO: 3475561 - DNA, 20 bp, Homo sapiens
caaagtcatgcaaaggctgg

SEQ ID NO: 3475562 - DNA, 22 bp, Homo sapiens
caaagtcatgcaaaggctggga

SEQ ID NO: 3475563 - DNA, 14 bp, Homo sapiens
caaagtcctttttt

SEQ ID NO: 3475564 - DNA, 19 bp, Homo sapiens
caaagtcctttttttccat

SEQ ID NO: 3475565 - DNA, 19 bp, Homo sapiens
caaagtgctgggattacag

SEQ ID NO: 3475566 - DNA, 22 bp, Homo sapiens
caaagtggtaggtactttttgt

SEQ ID NO: 3475567 - DNA, 19 bp, Homo sapiens
caaagtgttttgtaccagt

SEQ ID NO: 3475568 - DNA, 13 bp, Homo sapiens
caaataatgtctc

SEQ ID NO: 3475569 - DNA, 20 bp, Homo sapiens
caaataatgtctctgtgaga

SEQ ID NO: 3475570 - DNA, 15 bp, Homo sapiens
caaatagcacttgac

SEQ ID NO: 3475571 - DNA, 22 bp, Homo sapiens
caaatataagaataaaatgttg

SEQ ID NO: 3475572 - DNA, 13 bp, Homo sapiens
caaatcaaagcag

SEQ ID NO: 3475573 - DNA, 15 bp, Homo sapiens
caaatcaaagcagat

SEQ ID NO: 3475574 - DNA, 19 bp, Homo sapiens
caaatcaccacaaactgta

SEQ ID NO: 3475575 - DNA, 13 bp, Homo sapiens
caaatcatagctg

SEQ ID NO: 3475576 - DNA, 17 bp, Homo sapiens
caaatctatttaattag

SEQ ID NO: 3475577 - DNA, 21 bp, Homo sapiens
caaatctcaatgaagccagct

SEQ ID NO: 3475578 - DNA, 13 bp, Homo sapiens
caaatctggaagc

SEQ ID NO: 3475579 - DNA, 19 bp, Homo sapiens
caaatcttgttattgaagt

SEQ ID NO: 3475580 - DNA, 23 bp, Homo sapiens
caaatcttgttattgaagtgttc

SEQ ID NO: 3475581 - DNA, 22 bp, Homo sapiens
caaatgaccagcagattcaaat

SEQ ID NO: 3475582 - DNA, 22 bp, Homo sapiens
caaatgctctctcttcttatta

SEQ ID NO: 3475583 - DNA, 15 bp, Homo sapiens
caaatgctgtattct

SEQ ID NO: 3475584 - DNA, 22 bp, Homo sapiens
caaatggcgtctggaagtccaa

SEQ ID NO: 3475585 - DNA, 14 bp, Homo sapiens
caaatggggccaga

SEQ ID NO: 3475586 - DNA, 19 bp, Homo sapiens
caaatggggccagatccag

SEQ ID NO: 3475587 - DNA, 15 bp, Homo sapiens
caaatggtggaggat

SEQ ID NO: 3475588 - DNA, 22 bp, Homo sapiens
caaatggtggaggattgctgcc

SEQ ID NO: 3475589 - DNA, 13 bp, Homo sapiens
caaatgttatgca

SEQ ID NO: 3475590 - DNA, 18 bp, Homo sapiens
caaatgtttaaacatttt

SEQ ID NO: 3475591 - DNA, 24 bp, Homo sapiens
caaattataagagacagacacttg

SEQ ID NO: 3475592 - DNA, 15 bp, Homo sapiens
caaattctgtttctt

SEQ ID NO: 3475593 - DNA, 21 bp, Homo sapiens
caaatttagaaactaattgac

SEQ ID NO: 3475594 - DNA, 22 bp, Homo sapiens
caaatttagaaactaattgact

SEQ ID NO: 3475595 - DNA, 12 bp, Homo sapiens
caacaaaggaag

SEQ ID NO: 3475596 - DNA, 15 bp, Homo sapiens
caacaataaaatttt

SEQ ID NO: 3475597 - DNA, 18 bp, Homo sapiens
caacaatttctactttga

SEQ ID NO: 3475598 - DNA, 19 bp, Homo sapiens
caacaatttctactttgaa

SEQ ID NO: 3475599 - DNA, 17 bp, Homo sapiens
caacacgcacctgcctc

SEQ ID NO: 3475600 - DNA, 15 bp, Homo sapiens
caacacgcaggagca

SEQ ID NO: 3475601 - DNA, 19 bp, Homo sapiens
caacactgtgggtgtgtga

SEQ ID NO: 3475602 - DNA, 23 bp, Homo sapiens
caacagatctggaacctcagcct

SEQ ID NO: 3475603 - DNA, 17 bp, Homo sapiens
caacaggaatctcagag

SEQ ID NO: 3475604 - DNA, 20 bp, Homo sapiens
caacaggaatctcagagaca

SEQ ID NO: 3475605 - DNA, 21 bp, Homo sapiens
caacaggaatctcagagacag

SEQ ID NO: 3475606 - DNA, 22 bp, Homo sapiens
caacaggagctgggatcctaag

SEQ ID NO: 3475607 - DNA, 21 bp, Homo sapiens
caacaggccattgtgaaccaa

SEQ ID NO: 3475608 - DNA, 17 bp, Homo sapiens
caacaggctgggcttca

SEQ ID NO: 3475609 - DNA, 21 bp, Homo sapiens
caacaggttttcaccatagcc

SEQ ID NO: 3475610 - DNA, 17 bp, Homo sapiens
caacagtggggaagagt

SEQ ID NO: 3475611 - DNA, 12 bp, Homo sapiens
caacagttcaaa

SEQ ID NO: 3475612 - DNA, 16 bp, Homo sapiens
caacagttcaaagaag

SEQ ID NO: 3475613 - DNA, 12 bp, Homo sapiens
caacagttttcc

SEQ ID NO: 3475614 - DNA, 13 bp, Homo sapiens
caacagttttcct

SEQ ID NO: 3475615 - DNA, 18 bp, Homo sapiens
caacatggtgaaaccccg

SEQ ID NO: 3475616 - DNA, 17 bp, Homo sapiens
caacatgtggctcctcc

SEQ ID NO: 3475617 - DNA, 22 bp, Homo sapiens
caacatgttgggaaacttggct

SEQ ID NO: 3475618 - DNA, 20 bp, Homo sapiens
caacattaaaacaatattgt

SEQ ID NO: 3475619 - DNA, 10 bp, Homo sapiens
caacattgtg

SEQ ID NO: 3475620 - DNA, 18 bp, Homo sapiens
caaccaagtcatgtgcat

SEQ ID NO: 3475621 - DNA, 15 bp, Homo sapiens
caaccagctaagaaa

SEQ ID NO: 3475622 - DNA, 20 bp, Homo sapiens
caaccatgaatgaacccctg

SEQ ID NO: 3475623 - DNA, 23 bp, Homo sapiens
caaccccagctactctgatccct

SEQ ID NO: 3475624 - DNA, 15 bp, Homo sapiens
caacccccagcctgc

SEQ ID NO: 3475625 - DNA, 16 bp, Homo sapiens
caacccccagcctgct

SEQ ID NO: 3475626 - DNA, 15 bp, Homo sapiens
caaccccccagcact

SEQ ID NO: 3475627 - DNA, 22 bp, Homo sapiens
caacccctctttcgtctactgc

SEQ ID NO: 3475628 - DNA, 19 bp, Homo sapiens
caaccccttaagccctggc

SEQ ID NO: 3475629 - DNA, 10 bp, Homo sapiens
caacccttct

SEQ ID NO: 3475630 - DNA, 21 bp, Homo sapiens
caacccttctcctcttgtaaa

SEQ ID NO: 3475631 - DNA, 14 bp, Homo sapiens
caacctaagcaaca

SEQ ID NO: 3475632 - DNA, 15 bp, Homo sapiens
caacctattttgaag

SEQ ID NO: 3475633 - DNA, 19 bp, Homo sapiens
caacctctgtctcccgggt

SEQ ID NO: 3475634 - DNA, 13 bp, Homo sapiens
caacctcttggcc

SEQ ID NO: 3475635 - DNA, 14 bp, Homo sapiens
caacctgtttctac

SEQ ID NO: 3475636 - DNA, 17 bp, Homo sapiens
caaccttagatgttcta

SEQ ID NO: 3475637 - DNA, 12 bp, Homo sapiens
caacgaggaagc

SEQ ID NO: 3475638 - DNA, 19 bp, Homo sapiens
caacggccctgcagccagc

SEQ ID NO: 3475639 - DNA, 12 bp, Homo sapiens
caacgtcttttt

SEQ ID NO: 3475640 - DNA, 14 bp, Homo sapiens
caacgtctttttgt

SEQ ID NO: 3475641 - DNA, 18 bp, Homo sapiens
caacgtctttttgtttgt

SEQ ID NO: 3475642 - DNA, 19 bp, Homo sapiens
caacgtctttttgtttgtt

SEQ ID NO: 3475643 - DNA, 22 bp, Homo sapiens
caactacccaaaacaagcctgg

SEQ ID NO: 3475644 - DNA, 18 bp, Homo sapiens
caactagatcaaggagcc

SEQ ID NO: 3475645 - DNA, 21 bp, Homo sapiens
caactagtggggtttcctggc

SEQ ID NO: 3475646 - DNA, 16 bp, Homo sapiens
caactatggatcagaa

SEQ ID NO: 3475647 - DNA, 17 bp, Homo sapiens
caactatggatcagaat

SEQ ID NO: 3475648 - DNA, 21 bp, Homo sapiens
caactattttcagatgtgaac

SEQ ID NO: 3475649 - DNA, 18 bp, Homo sapiens
caactcaaaaaacattgt

SEQ ID NO: 3475650 - DNA, 12 bp, Homo sapiens
caactcattcca

SEQ ID NO: 3475651 - DNA, 19 bp, Homo sapiens
caactcctagggccactga

SEQ ID NO: 3475652 - DNA, 16 bp, Homo sapiens
caactcgtatagcatg

SEQ ID NO: 3475653 - DNA, 18 bp, Homo sapiens
caactctcccctgacctg

SEQ ID NO: 3475654 - DNA, 24 bp, Homo sapiens
caactctcccctgacctgtgagcc

SEQ ID NO: 3475655 - DNA, 13 bp, Homo sapiens
caactctttgaga

SEQ ID NO: 3475656 - DNA, 21 bp, Homo sapiens
caactgcctcgaaacacagaa

SEQ ID NO: 3475657 - DNA, 18 bp, Homo sapiens
caactgctcagctctggt

SEQ ID NO: 3475658 - DNA, 16 bp, Homo sapiens
caactttaagaggaca

SEQ ID NO: 3475659 - DNA, 16 bp, Homo sapiens
caactttgaataaaga

SEQ ID NO: 3475660 - DNA, 14 bp, Homo sapiens
caactttttattgc

SEQ ID NO: 3475661 - DNA, 17 bp, Homo sapiens
caactttttattgcctt

SEQ ID NO: 3475662 - DNA, 15 bp, Homo sapiens
caagaaagaaacccg

SEQ ID NO: 3475663 - DNA, 14 bp, Homo sapiens
caagaaagatgtat

SEQ ID NO: 3475664 - DNA, 17 bp, Homo sapiens
caagaacatgatgggcc

SEQ ID NO: 3475665 - DNA, 19 bp, Homo sapiens
caagaactcatcactgtgg

SEQ ID NO: 3475666 - DNA, 13 bp, Homo sapiens
caagaagcaggct

SEQ ID NO: 3475667 - DNA, 14 bp, Homo sapiens
caagaagcaggcta

SEQ ID NO: 3475668 - DNA, 20 bp, Homo sapiens
caagaagcaggctacactga

SEQ ID NO: 3475669 - DNA, 15 bp, Homo sapiens
caagaagggctgcat

SEQ ID NO: 3475670 - DNA, 17 bp, Homo sapiens
caagaagggctgcatga

SEQ ID NO: 3475671 - DNA, 20 bp, Homo sapiens
caagaagggctgcatgatgt

SEQ ID NO: 3475672 - DNA, 13 bp, Homo sapiens
caagaagtcttga

SEQ ID NO: 3475673 - DNA, 22 bp, Homo sapiens
caagaatagcatctgtacaaag

SEQ ID NO: 3475674 - DNA, 19 bp, Homo sapiens
caagaccaccacttcgaaa

SEQ ID NO: 3475675 - DNA, 16 bp, Homo sapiens
caagacccaagtagct

SEQ ID NO: 3475676 - DNA, 15 bp, Homo sapiens
caagacccccagcac

SEQ ID NO: 3475677 - DNA, 23 bp, Homo sapiens
caagacctcagggcacaaagatg

SEQ ID NO: 3475678 - DNA, 16 bp, Homo sapiens
caagacttcagtatgt

SEQ ID NO: 3475679 - DNA, 14 bp, Homo sapiens
caagagaacatttt

SEQ ID NO: 3475680 - DNA, 19 bp, Homo sapiens
caagagaacattttactgt

SEQ ID NO: 3475681 - DNA, 13 bp, Homo sapiens
caagagcacactt

SEQ ID NO: 3475682 - DNA, 12 bp, Homo sapiens
caagagccaagt

SEQ ID NO: 3475683 - DNA, 21 bp, Homo sapiens
caagagccatgtagaagctgc

SEQ ID NO: 3475684 - DNA, 14 bp, Homo sapiens
cacctataaaacag

SEQ ID NO: 3475685 - DNA, 16 bp, Homo sapiens
cacctataaaacaggt

SEQ ID NO: 3475686 - DNA, 23 bp, Homo sapiens
cacctcaagaagaagaggggcat

SEQ ID NO: 3475687 - DNA, 22 bp, Homo sapiens
cacctcagagtatggagctcag

SEQ ID NO: 3475688 - DNA, 14 bp, Homo sapiens
cacctcagcctccc

SEQ ID NO: 3475689 - DNA, 19 bp, Homo sapiens
cacctcattctgaaccctt

SEQ ID NO: 3475690 - DNA, 13 bp, Homo sapiens
cacctcccatcct

SEQ ID NO: 3475691 - DNA, 16 bp, Homo sapiens
cacctcccatcctaat

SEQ ID NO: 3475692 - DNA, 10 bp, Homo sapiens
cacctccctg

SEQ ID NO: 3475693 - DNA, 12 bp, Homo sapiens
cacctccctgcc

SEQ ID NO: 3475694 - DNA, 15 bp, Homo sapiens
cacctccctgcctcc

SEQ ID NO: 3475695 - DNA, 11 bp, Homo sapiens
cacctcctgcc

SEQ ID NO: 3475696 - DNA, 13 bp, Homo sapiens
cacctcctgcctc

SEQ ID NO: 3475697 - DNA, 18 bp, Homo sapiens
cacctctgcacaagctgc

SEQ ID NO: 3475698 - DNA, 13 bp, Homo sapiens
cacctcttccgac

SEQ ID NO: 3475699 - DNA, 23 bp, Homo sapiens
cacctgaagactcattcttctgt

SEQ ID NO: 3475700 - DNA, 19 bp, Homo sapiens
cacctgagcaggacctctg

SEQ ID NO: 3475701 - DNA, 21 bp, Homo sapiens
cacctgagcaggacctctgaa

SEQ ID NO: 3475702 - DNA, 15 bp, Homo sapiens
cacctgattcaacta

SEQ ID NO: 3475703 - DNA, 17 bp, Homo sapiens
cacctgattcaactaaa

SEQ ID NO: 3475704 - DNA, 23 bp, Homo sapiens
cacctgccaccctgggcctggca

SEQ ID NO: 3475705 - DNA, 13 bp, Homo sapiens
cacctgccctttt

SEQ ID NO: 3475706 - DNA, 22 bp, Homo sapiens
cacctgcccttttttctgcctc

SEQ ID NO: 3475707 - DNA, 23 bp, Homo sapiens
cacctgcccttttttctgcctcc

SEQ ID NO: 3475708 - DNA, 20 bp, Homo sapiens
cacctgcctcaggactgcga

SEQ ID NO: 3475709 - DNA, 14 bp, Homo sapiens
cacctggggctgct

SEQ ID NO: 3475710 - DNA, 21 bp, Homo sapiens
cacctgtaatcccagctactt

SEQ ID NO: 3475711 - DNA, 18 bp, Homo sapiens
cacctgtagcacttactg

SEQ ID NO: 3475712 - DNA, 21 bp, Homo sapiens
cacctgtcaaacaaagccaga

SEQ ID NO: 3475713 - DNA, 19 bp, Homo sapiens
cacctgtgagtttaaagca

SEQ ID NO: 3475714 - DNA, 20 bp, Homo sapiens
cacctgtgagtttaaagcaa

SEQ ID NO: 3475715 - DNA, 19 bp, Homo sapiens
cacctgtgcttcgggccct

SEQ ID NO: 3475716 - DNA, 14 bp, Homo sapiens
caccttaatatgct

SEQ ID NO: 3475717 - DNA, 17 bp, Homo sapiens
caccttaggcagggaag

SEQ ID NO: 3475718 - DNA, 18 bp, Homo sapiens
caccttaggcagggaagt

SEQ ID NO: 3475719 - DNA, 22 bp, Homo sapiens
caccttgaagaacctctcactt

SEQ ID NO: 3475720 - DNA, 13 bp, Homo sapiens
caccttgacaggg

SEQ ID NO: 3475721 - DNA, 17 bp, Homo sapiens
caccttggacatcctcc

SEQ ID NO: 3475722 - DNA, 22 bp, Homo sapiens
caccttggacatcctcctccca

SEQ ID NO: 3475723 - DNA, 13 bp, Homo sapiens
caccttggctcaa

SEQ ID NO: 3475724 - DNA, 18 bp, Homo sapiens
caccttggctgcagggag

SEQ ID NO: 3475725 - DNA, 17 bp, Homo sapiens
caccttggggccttgat

SEQ ID NO: 3475726 - DNA, 20 bp, Homo sapiens
cacctttgtagcactcaggc

SEQ ID NO: 3475727 - DNA, 21 bp, Homo sapiens
cacctttgtagcactcaggct

SEQ ID NO: 3475728 - DNA, 20 bp, Homo sapiens
cacctttgttttttgttgga

SEQ ID NO: 3475729 - DNA, 17 bp, Homo sapiens
cacgaatttctgtgccc

SEQ ID NO: 3475730 - DNA, 23 bp, Homo sapiens
cacgaatttctgtgccctcctga

SEQ ID NO: 3475731 - DNA, 17 bp, Homo sapiens
cacgactgcccggcagg

SEQ ID NO: 3475732 - DNA, 17 bp, Homo sapiens
cacgactggccagggcc

SEQ ID NO: 3475733 - DNA, 16 bp, Homo sapiens
cacgactgtctccatg

SEQ ID NO: 3475734 - DNA, 20 bp, Homo sapiens
cacgagctgtttactaggga

SEQ ID NO: 3475735 - DNA, 13 bp, Homo sapiens
cacgagggctggc

SEQ ID NO: 3475736 - DNA, 12 bp, Homo sapiens
cacgcacctgcc

SEQ ID NO: 3475737 - DNA, 17 bp, Homo sapiens
cacgcacttcgggaggt

SEQ ID NO: 3475738 - DNA, 12 bp, Homo sapiens
cacgcaggagca

SEQ ID NO: 3475739 - DNA, 14 bp, Homo sapiens
cacgcccgtcctgc

SEQ ID NO: 3475740 - DNA, 13 bp, Homo sapiens
cacgcctcccact

SEQ ID NO: 3475741 - DNA, 17 bp, Homo sapiens
cacgcctgcaaacgctg

SEQ ID NO: 3475742 - DNA, 21 bp, Homo sapiens
cacgcctgcaaacgctgcctg

SEQ ID NO: 3475743 - DNA, 22 bp, Homo sapiens
cacgcctgcaaacgctgcctgc

SEQ ID NO: 3475744 - DNA, 23 bp, Homo sapiens
cacgcctgcaaacgctgcctgcc

SEQ ID NO: 3475745 - DNA, 18 bp, Homo sapiens
cacgcctgtaatcccagc

SEQ ID NO: 3475746 - DNA, 20 bp, Homo sapiens
cacgcctgtaatcccagcac

SEQ ID NO: 3475747 - DNA, 21 bp, Homo sapiens
cacgcgtgcacacaccagagc

SEQ ID NO: 3475748 - DNA, 23 bp, Homo sapiens
cacgcgtgcacacaccagagccc

SEQ ID NO: 3475749 - DNA, 14 bp, Homo sapiens
cacgctccagctgc

SEQ ID NO: 3475750 - DNA, 15 bp, Homo sapiens
cacgctccagctgcc

SEQ ID NO: 3475751 - DNA, 18 bp, Homo sapiens
cacgctccagctgccccg

SEQ ID NO: 3475752 - DNA, 17 bp, Homo sapiens
cacgctggaccttgaac

SEQ ID NO: 3475753 - DNA, 20 bp, Homo sapiens
cacgctggaccttgaactgg

SEQ ID NO: 3475754 - DNA, 15 bp, Homo sapiens
cacgctggagtgcag

SEQ ID NO: 3475755 - DNA, 14 bp, Homo sapiens
cacgctttctagct

SEQ ID NO: 3475756 - DNA, 23 bp, Homo sapiens
cacggagccactcctctgactca

SEQ ID NO: 3475757 - DNA, 19 bp, Homo sapiens
cacggatcacgatgtaaat

SEQ ID NO: 3475758 - DNA, 14 bp, Homo sapiens
cacggccaggccag

SEQ ID NO: 3475759 - DNA, 23 bp, Homo sapiens
cacggcctgcccagtcgacccca

SEQ ID NO: 3475760 - DNA, 15 bp, Homo sapiens
cacggcgttgtacct

SEQ ID NO: 3475761 - DNA, 18 bp, Homo sapiens
cacggctcccccaggcct

SEQ ID NO: 3475762 - DNA, 19 bp, Homo sapiens
cacggctcccccaggcctg

SEQ ID NO: 3475763 - DNA, 22 bp, Homo sapiens
cacggctcccccaggcctgagc

SEQ ID NO: 3475764 - DNA, 12 bp, Homo sapiens
cacggctgctga

SEQ ID NO: 3475765 - DNA, 15 bp, Homo sapiens
cacgggggcagctga

SEQ ID NO: 3475766 - DNA, 17 bp, Homo sapiens
cacggtgactctgtcca

SEQ ID NO: 3475767 - DNA, 20 bp, Homo sapiens
cacggtgactctgtccagct

SEQ ID NO: 3475768 - DNA, 15 bp, Homo sapiens
cacggtgcctttttt

SEQ ID NO: 3475769 - DNA, 18 bp, Homo sapiens
cacggtttgaagcctgga

SEQ ID NO: 3475770 - DNA, 19 bp, Homo sapiens
cacggtttgaagcctggaa

SEQ ID NO: 3475771 - DNA, 14 bp, Homo sapiens
cacgtacacacaca

SEQ ID NO: 3475772 - DNA, 17 bp, Homo sapiens
cacgtgacacaaacaca

SEQ ID NO: 3475773 - DNA, 18 bp, Homo sapiens
cacgtgcctgtgggcctg

SEQ ID NO: 3475774 - DNA, 21 bp, Homo sapiens
cacgtgcctgtgggcctggga

SEQ ID NO: 3475775 - DNA, 20 bp, Homo sapiens
cacgtggaggagcagtgcag

SEQ ID NO: 3475776 - DNA, 21 bp, Homo sapiens
cacgtggaggagcagtgcagg

SEQ ID NO: 3475777 - DNA, 15 bp, Homo sapiens
cactaaccacgctgg

SEQ ID NO: 3475778 - DNA, 18 bp, Homo sapiens
cactaaccacgctggacc

SEQ ID NO: 3475779 - DNA, 14 bp, Homo sapiens
cactaagcagagga

SEQ ID NO: 3475780 - DNA, 18 bp, Homo sapiens
cactaagcagaggagggg

SEQ ID NO: 3475781 - DNA, 12 bp, Homo sapiens
cactaaggggcc

SEQ ID NO: 3475782 - DNA, 23 bp, Homo sapiens
cactaaggggcccggccagccat

SEQ ID NO: 3475783 - DNA, 13 bp, Homo sapiens
cactactaaaagt

SEQ ID NO: 3475784 - DNA, 19 bp, Homo sapiens
cactactaaaagtttagaa

SEQ ID NO: 3475785 - DNA, 22 bp, Homo sapiens
cactactaaaagtttagaactt

SEQ ID NO: 3475786 - DNA, 23 bp, Homo sapiens
cactactaaaagtttagaacttg

SEQ ID NO: 3475787 - DNA, 18 bp, Homo sapiens
cactactcttacatgtat

SEQ ID NO: 3475788 - DNA, 20 bp, Homo sapiens
cactactcttacatgtataa

SEQ ID NO: 3475789 - DNA, 14 bp, Homo sapiens
cactagacaagcca

SEQ ID NO: 3475790 - DNA, 14 bp, Homo sapiens
cactagcagctgca

SEQ ID NO: 3475791 - DNA, 21 bp, Homo sapiens
cactatagcctaggtgacaga

SEQ ID NO: 3475792 - DNA, 15 bp, Homo sapiens
cactatgctttcctt

SEQ ID NO: 3475793 - DNA, 18 bp, Homo sapiens
cactatgttgcccaggca

SEQ ID NO: 3475794 - DNA, 19 bp, Homo sapiens
cactatttatctgtgcaaa

SEQ ID NO: 3475795 - DNA, 14 bp, Homo sapiens
cactattttcaaag

SEQ ID NO: 3475796 - DNA, 17 bp, Homo sapiens
cactcaaaagctgggca

SEQ ID NO: 3475797 - DNA, 15 bp, Homo sapiens
cactcaagaagcagg

SEQ ID NO: 3475798 - DNA, 17 bp, Homo sapiens
cactcaagaagcaggct

SEQ ID NO: 3475799 - DNA, 19 bp, Homo sapiens
cactcaagaagcaggctac

SEQ ID NO: 3475800 - DNA, 23 bp, Homo sapiens
cactcaagaagcaggctacactg

SEQ ID NO: 3475801 - DNA, 18 bp, Homo sapiens
cactcaagccaagcagcc

SEQ ID NO: 3475802 - DNA, 19 bp, Homo sapiens
cactcaaggcggtgcttga

SEQ ID NO: 3475803 - DNA, 16 bp, Homo sapiens
cactcagaagacactg

SEQ ID NO: 3475804 - DNA, 12 bp, Homo sapiens
cactcaggctgg

SEQ ID NO: 3475805 - DNA, 16 bp, Homo sapiens
cactcagtccatagca

SEQ ID NO: 3475806 - DNA, 13 bp, Homo sapiens
cactccagcctgg

SEQ ID NO: 3475807 - DNA, 15 bp, Homo sapiens
cactccagcctgggt

SEQ ID NO: 3475808 - DNA, 16 bp, Homo sapiens
cactccagcctgggtg

SEQ ID NO: 3475809 - DNA, 13 bp, Homo sapiens
cactccagtcctg

SEQ ID NO: 3475810 - DNA, 19 bp, Homo sapiens
cactccccgaagtcttttg

SEQ ID NO: 3475811 - DNA, 22 bp, Homo sapiens
cactccctcctggagctctgtg

SEQ ID NO: 3475812 - DNA, 12 bp, Homo sapiens
cactcctccctc

SEQ ID NO: 3475813 - DNA, 13 bp, Homo sapiens
cactcctccctcc

SEQ ID NO: 3475814 - DNA, 21 bp, Homo sapiens
cactcctctgactcagggctc

SEQ ID NO: 3475815 - DNA, 14 bp, Homo sapiens
cactcctgccaagg

SEQ ID NO: 3475816 - DNA, 20 bp, Homo sapiens
cagaactcttaaaaatgttt

SEQ ID NO: 3475817 - DNA, 17 bp, Homo sapiens
cagaactgcttactagc

SEQ ID NO: 3475818 - DNA, 17 bp, Homo sapiens
cagaactgtgccacaat

SEQ ID NO: 3475819 - DNA, 18 bp, Homo sapiens
cagaagacaaaaagacaa

SEQ ID NO: 3475820 - DNA, 17 bp, Homo sapiens
cagaagcagagagcaca

SEQ ID NO: 3475821 - DNA, 18 bp, Homo sapiens
cagaaggagacaggcaga

SEQ ID NO: 3475822 - DNA, 22 bp, Homo sapiens
cagaaggagacaggcagagctg

SEQ ID NO: 3475823 - DNA, 20 bp, Homo sapiens
cagaagggggtggtgtctcc

SEQ ID NO: 3475824 - DNA, 13 bp, Homo sapiens
cagaagtaagcct

SEQ ID NO: 3475825 - DNA, 16 bp, Homo sapiens
cagaagtaagcctcat

SEQ ID NO: 3475826 - DNA, 21 bp, Homo sapiens
cagaagtcctgtatgtctgtc

SEQ ID NO: 3475827 - DNA, 14 bp, Homo sapiens
cagaatacacttaa

SEQ ID NO: 3475828 - DNA, 15 bp, Homo sapiens
cagaatagccacatt

SEQ ID NO: 3475829 - DNA, 17 bp, Homo sapiens
cagaatatttctattga

SEQ ID NO: 3475830 - DNA, 18 bp, Homo sapiens
cagaatctacccaaagga

SEQ ID NO: 3475831 - DNA, 13 bp, Homo sapiens
cagaatctcatta

SEQ ID NO: 3475832 - DNA, 17 bp, Homo sapiens
cagaatctcattactgc

SEQ ID NO: 3475833 - DNA, 13 bp, Homo sapiens
cagaatgtaactg

SEQ ID NO: 3475834 - DNA, 22 bp, Homo sapiens
cagaatgttgattacagtgcag

SEQ ID NO: 3475835 - DNA, 22 bp, Homo sapiens
cagaattactgtaactgattac

SEQ ID NO: 3475836 - DNA, 23 bp, Homo sapiens
cagaattactgtaactgattaca

SEQ ID NO: 3475837 - DNA, 22 bp, Homo sapiens
cagaatttgtgttgaaggaact

SEQ ID NO: 3475838 - DNA, 11 bp, Homo sapiens
cagacaaaatg

SEQ ID NO: 3475839 - DNA, 20 bp, Homo sapiens
cagacaaaatggatacataa

SEQ ID NO: 3475840 - DNA, 22 bp, Homo sapiens
cagacaaatgtggttacacact

SEQ ID NO: 3475841 - DNA, 14 bp, Homo sapiens
cagacacaggcccg

SEQ ID NO: 3475842 - DNA, 21 bp, Homo sapiens
cagacacagggacttgaagtt

SEQ ID NO: 3475843 - DNA, 15 bp, Homo sapiens
cagacaccctcaacc

SEQ ID NO: 3475844 - DNA, 22 bp, Homo sapiens
cagacaccttgacagggcacac

SEQ ID NO: 3475845 - DNA, 16 bp, Homo sapiens
cagacagacacacaca

SEQ ID NO: 3475846 - DNA, 20 bp, Homo sapiens
cagacagagaatatgtctgc

SEQ ID NO: 3475847 - DNA, 22 bp, Homo sapiens
cagacagagaatatgtctgctc

SEQ ID NO: 3475848 - DNA, 12 bp, Homo sapiens
cagacagaggat

SEQ ID NO: 3475849 - DNA, 18 bp, Homo sapiens
cagacaggcaaataaaag

SEQ ID NO: 3475850 - DNA, 22 bp, Homo sapiens
cagacaggcaagcacctcctgc

SEQ ID NO: 3475851 - DNA, 23 bp, Homo sapiens
cagacaggtggaaaaactgagac

SEQ ID NO: 3475852 - DNA, 13 bp, Homo sapiens
cagacatatttaa

SEQ ID NO: 3475853 - DNA, 14 bp, Homo sapiens
cagacattggcacc

SEQ ID NO: 3475854 - DNA, 15 bp, Homo sapiens
cagacattttctttt

SEQ ID NO: 3475855 - DNA, 23 bp, Homo sapiens
cagaccacgcccgtcctgcctgt

SEQ ID NO: 3475856 - DNA, 24 bp, Homo sapiens
cagaccacgcccgtcctgcctgtg

SEQ ID NO: 3475857 - DNA, 13 bp, Homo sapiens
cagaccacggctc

SEQ ID NO: 3475858 - DNA, 16 bp, Homo sapiens
cagaccccgagccacc

SEQ ID NO: 3475859 - DNA, 12 bp, Homo sapiens
cagacccggctg

SEQ ID NO: 3475860 - DNA, 14 bp, Homo sapiens
cagacccggctgcg

SEQ ID NO: 3475861 - DNA, 16 bp, Homo sapiens
cagacctaatgctcct

SEQ ID NO: 3475862 - DNA, 20 bp, Homo sapiens
cagacctgatcctggaggcc

SEQ ID NO: 3475863 - DNA, 23 bp, Homo sapiens
cagacctgatcctggaggcccag

SEQ ID NO: 3475864 - DNA, 15 bp, Homo sapiens
cagacctgtcaccct

SEQ ID NO: 3475865 - DNA, 19 bp, Homo sapiens
cagacctgtcaccctgcag

SEQ ID NO: 3475866 - DNA, 19 bp, Homo sapiens
cagacgttaggcatttcct

SEQ ID NO: 3475867 - DNA, 19 bp, Homo sapiens
cagactcacaacctgaacc

SEQ ID NO: 3475868 - DNA, 17 bp, Homo sapiens
cagactcccattcctga

SEQ ID NO: 3475869 - DNA, 17 bp, Homo sapiens
cagactccgcctgaggc

SEQ ID NO: 3475870 - DNA, 18 bp, Homo sapiens
cagactccgcctgaggcc

SEQ ID NO: 3475871 - DNA, 21 bp, Homo sapiens
cagactcctgtgcaactttcc

SEQ ID NO: 3475872 - DNA, 20 bp, Homo sapiens
cagactctacagaggccatg

SEQ ID NO: 3475873 - DNA, 13 bp, Homo sapiens
cagactggaagca

SEQ ID NO: 3475874 - DNA, 14 bp, Homo sapiens
cagactggaagcac

SEQ ID NO: 3475875 - DNA, 20 bp, Homo sapiens
cagactggaagcacagcttc

SEQ ID NO: 3475876 - DNA, 15 bp, Homo sapiens
cagacttcccagcta

SEQ ID NO: 3475877 - DNA, 21 bp, Homo sapiens
cagacttccctgaatgtattg

SEQ ID NO: 3475878 - DNA, 18 bp, Homo sapiens
cagacttgccatgtgact

SEQ ID NO: 3475879 - DNA, 13 bp, Homo sapiens
cagacttgtcaag

SEQ ID NO: 3475880 - DNA, 19 bp, Homo sapiens
cagactttggaaaatgcat

SEQ ID NO: 3475881 - DNA, 17 bp, Homo sapiens
cagagaaagaggaagct

SEQ ID NO: 3475882 - DNA, 18 bp, Homo sapiens
cagagaaagaggaagctt

SEQ ID NO: 3475883 - DNA, 18 bp, Homo sapiens
cagagaaaggggagccca

SEQ ID NO: 3475884 - DNA, 16 bp, Homo sapiens
cagagaaggctatgta

SEQ ID NO: 3475885 - DNA, 17 bp, Homo sapiens
cagagaaggctatgtaa

SEQ ID NO: 3475886 - DNA, 18 bp, Homo sapiens
cagagaagtctggtcaga

SEQ ID NO: 3475887 - DNA, 22 bp, Homo sapiens
cagagaagtctggtcagagcca

SEQ ID NO: 3475888 - DNA, 23 bp, Homo sapiens
cagagaagtctggtcagagccac

SEQ ID NO: 3475889 - DNA, 22 bp, Homo sapiens
cagagacaaggtcacctgggct

SEQ ID NO: 3475890 - DNA, 18 bp, Homo sapiens
cagagacaggtggcctag

SEQ ID NO: 3475891 - DNA, 17 bp, Homo sapiens
cagagaccaaacaagga

SEQ ID NO: 3475892 - DNA, 15 bp, Homo sapiens
cagagaccaggccct

SEQ ID NO: 3475893 - DNA, 16 bp, Homo sapiens
cagagaccaggccctg

SEQ ID NO: 3475894 - DNA, 18 bp, Homo sapiens
cagagaccaggctgtgtc

SEQ ID NO: 3475895 - DNA, 21 bp, Homo sapiens
cagagacccagatctcatgga

SEQ ID NO: 3475896 - DNA, 23 bp, Homo sapiens
cagagagaatgagagcgacacag

SEQ ID NO: 3475897 - DNA, 17 bp, Homo sapiens
cagagagagagaatgga

SEQ ID NO: 3475898 - DNA, 17 bp, Homo sapiens
cagagagagcaaggaag

SEQ ID NO: 3475899 - DNA, 20 bp, Homo sapiens
cagagagcctggtgctgctg

SEQ ID NO: 3475900 - DNA, 20 bp, Homo sapiens
cagagaggactgtagggagg

SEQ ID NO: 3475901 - DNA, 15 bp, Homo sapiens
cagagagggcaggca

SEQ ID NO: 3475902 - DNA, 18 bp, Homo sapiens
cagagagggcaggcatga

SEQ ID NO: 3475903 - DNA, 12 bp, Homo sapiens
cagagagggtgg

SEQ ID NO: 3475904 - DNA, 23 bp, Homo sapiens
cagagagggtggtgacctctgcc

SEQ ID NO: 3475905 - DNA, 19 bp, Homo sapiens
cagagatccaaaagaagcc

SEQ ID NO: 3475906 - DNA, 21 bp, Homo sapiens
cagagatccaaaagaagcccc

SEQ ID NO: 3475907 - DNA, 12 bp, Homo sapiens
cagagatggaca

SEQ ID NO: 3475908 - DNA, 16 bp, Homo sapiens
cagagatggacagaga

SEQ ID NO: 3475909 - DNA, 19 bp, Homo sapiens
cagagattcattttctaga

SEQ ID NO: 3475910 - DNA, 21 bp, Homo sapiens
cagagattcattttctagata

SEQ ID NO: 3475911 - DNA, 21 bp, Homo sapiens
cagagattggaatgggcagct

SEQ ID NO: 3475912 - DNA, 14 bp, Homo sapiens
cagagcagatggca

SEQ ID NO: 3475913 - DNA, 18 bp, Homo sapiens
cagagcagatggcagatg

SEQ ID NO: 3475914 - DNA, 21 bp, Homo sapiens
cagagcagatggcagatgcac

SEQ ID NO: 3475915 - DNA, 22 bp, Homo sapiens
cagagcagggggacctaggctc

SEQ ID NO: 3475916 - DNA, 15 bp, Homo sapiens
cagagcattttttat

SEQ ID NO: 3475917 - DNA, 16 bp, Homo sapiens
cagagccacagggtct

SEQ ID NO: 3475918 - DNA, 15 bp, Homo sapiens
cagagcccaccttgg

SEQ ID NO: 3475919 - DNA, 23 bp, Homo sapiens
cagagcccggagctccggcctgc

SEQ ID NO: 3475920 - DNA, 19 bp, Homo sapiens
cagagccgtggtcctttgg

SEQ ID NO: 3475921 - DNA, 20 bp, Homo sapiens
cagagccgtggtcctttggg

SEQ ID NO: 3475922 - DNA, 13 bp, Homo sapiens
cagagcctgcagt

SEQ ID NO: 3475923 - DNA, 20 bp, Homo sapiens
cagagcctttttcacaattc

SEQ ID NO: 3475924 - DNA, 17 bp, Homo sapiens
cagagcgcgcccctagc

SEQ ID NO: 3475925 - DNA, 18 bp, Homo sapiens
cagagcgcgcccctagcc

SEQ ID NO: 3475926 - DNA, 19 bp, Homo sapiens
cagagcgcgcccctagccg

SEQ ID NO: 3475927 - DNA, 16 bp, Homo sapiens
cagagctgaagagttg

SEQ ID NO: 3475928 - DNA, 21 bp, Homo sapiens
cagagctgaagagttgccccg

SEQ ID NO: 3475929 - DNA, 13 bp, Homo sapiens
cagagctggctct

SEQ ID NO: 3475930 - DNA, 17 bp, Homo sapiens
cagagctggctctgagc

SEQ ID NO: 3475931 - DNA, 17 bp, Homo sapiens
cagagctggtggaccca

SEQ ID NO: 3475932 - DNA, 23 bp, Homo sapiens
cagagcttccctgactcattctg

SEQ ID NO: 3475933 - DNA, 20 bp, Homo sapiens
cagagcttcttccaggtgcc

SEQ ID NO: 3475934 - DNA, 13 bp, Homo sapiens
cagagcttttcag

SEQ ID NO: 3475935 - DNA, 14 bp, Homo sapiens
cagaggaagcccct

SEQ ID NO: 3475936 - DNA, 19 bp, Homo sapiens
cagaggaaggggccagagg

SEQ ID NO: 3475937 - DNA, 20 bp, Homo sapiens
cagaggagagatagcctgtg

SEQ ID NO: 3475938 - DNA, 13 bp, Homo sapiens
cagaggaggatgt

SEQ ID NO: 3475939 - DNA, 20 bp, Homo sapiens
cagaggaggatgtaaggcct

SEQ ID NO: 3475940 - DNA, 13 bp, Homo sapiens
cagaggaggggcc

SEQ ID NO: 3475941 - DNA, 20 bp, Homo sapiens
cagaggaggggccgctgcca

SEQ ID NO: 3475942 - DNA, 19 bp, Homo sapiens
cagaggatgagctctaccc

SEQ ID NO: 3475943 - DNA, 21 bp, Homo sapiens
cagaggattgctgccccatca

SEQ ID NO: 3475944 - DNA, 19 bp, Homo sapiens
cagaggcagccccattctg

SEQ ID NO: 3475945 - DNA, 21 bp, Homo sapiens
cagaggccatgggcctcctgt

SEQ ID NO: 3475946 - DNA, 14 bp, Homo sapiens
cagaggccccagcc

SEQ ID NO: 3475947 - DNA, 13 bp, Homo sapiens
caggccccaggaa

SEQ ID NO: 3475948 - DNA, 15 bp, Homo sapiens
caggccccaggaaag

SEQ ID NO: 3475949 - DNA, 15 bp, Homo sapiens
caggcccccaagcct

SEQ ID NO: 3475950 - DNA, 18 bp, Homo sapiens
caggcccccaagcctgca

SEQ ID NO: 3475951 - DNA, 16 bp, Homo sapiens
caggcccctctcctcc

SEQ ID NO: 3475952 - DNA, 17 bp, Homo sapiens
caggcccctgccaccct

SEQ ID NO: 3475953 - DNA, 14 bp, Homo sapiens
caggcccctggagg

SEQ ID NO: 3475954 - DNA, 19 bp, Homo sapiens
caggcccctggaggctgcc

SEQ ID NO: 3475955 - DNA, 14 bp, Homo sapiens
caggcccggctcca

SEQ ID NO: 3475956 - DNA, 16 bp, Homo sapiens
caggcccggctccagg

SEQ ID NO: 3475957 - DNA, 23 bp, Homo sapiens
caggccctccctgttccccagag

SEQ ID NO: 3475958 - DNA, 13 bp, Homo sapiens
caggccctgccag

SEQ ID NO: 3475959 - DNA, 14 bp, Homo sapiens
caggccctggcctc

SEQ ID NO: 3475960 - DNA, 17 bp, Homo sapiens
caggccctggcctcccc

SEQ ID NO: 3475961 - DNA, 20 bp, Homo sapiens
caggccctggcctcccctgc

SEQ ID NO: 3475962 - DNA, 22 bp, Homo sapiens
caggccctggcctcccctgcca

SEQ ID NO: 3475963 - DNA, 19 bp, Homo sapiens
caggccggcgagccctgtg

SEQ ID NO: 3475964 - DNA, 20 bp, Homo sapiens
caggcctaggtgcagctcct

SEQ ID NO: 3475965 - DNA, 22 bp, Homo sapiens
caggcctaggtgcagctcctca

SEQ ID NO: 3475966 - DNA, 23 bp, Homo sapiens
caggcctaggtgcagctcctcag

SEQ ID NO: 3475967 - DNA, 15 bp, Homo sapiens
caggcctcttggcag

SEQ ID NO: 3475968 - DNA, 19 bp, Homo sapiens
caggcctgagatttcatct

SEQ ID NO: 3475969 - DNA, 21 bp, Homo sapiens
caggcctgagatttcatctgc

SEQ ID NO: 3475970 - DNA, 23 bp, Homo sapiens
caggcctgagatttcatctgctc

SEQ ID NO: 3475971 - DNA, 17 bp, Homo sapiens
caggcctgggccagagt

SEQ ID NO: 3475972 - DNA, 16 bp, Homo sapiens
caggccttatctccaa

SEQ ID NO: 3475973 - DNA, 22 bp, Homo sapiens
caggccttatctccaagaccag

SEQ ID NO: 3475974 - DNA, 19 bp, Homo sapiens
caggcgatccacctgtctc

SEQ ID NO: 3475975 - DNA, 21 bp, Homo sapiens
caggcgcggtggctcacgcct

SEQ ID NO: 3475976 - DNA, 17 bp, Homo sapiens
caggcgggacagtgctg

SEQ ID NO: 3475977 - DNA, 19 bp, Homo sapiens
caggcgggacagtgctgca

SEQ ID NO: 3475978 - DNA, 13 bp, Homo sapiens
caggctacactga

SEQ ID NO: 3475979 - DNA, 20 bp, Homo sapiens
caggctacactgacactggt

SEQ ID NO: 3475980 - DNA, 19 bp, Homo sapiens
caggctcccagggacacct

SEQ ID NO: 3475981 - DNA, 20 bp, Homo sapiens
caggctcctttagcgcccag

SEQ ID NO: 3475982 - DNA, 16 bp, Homo sapiens
caggctcgccaaggcc

SEQ ID NO: 3475983 - DNA, 21 bp, Homo sapiens
caggctcgccaaggcctagga

SEQ ID NO: 3475984 - DNA, 16 bp, Homo sapiens
caggctcttctttccc

SEQ ID NO: 3475985 - DNA, 17 bp, Homo sapiens
caggctcttctttccca

SEQ ID NO: 3475986 - DNA, 20 bp, Homo sapiens
caggctgaccacagcacagc

SEQ ID NO: 3475987 - DNA, 22 bp, Homo sapiens
caggctgaccacagcacagcca

SEQ ID NO: 3475988 - DNA, 16 bp, Homo sapiens
caggctgccgtggggc

SEQ ID NO: 3475989 - DNA, 18 bp, Homo sapiens
caggctggccagtccagg

SEQ ID NO: 3475990 - DNA, 21 bp, Homo sapiens
caggctggccagtccaggctg

SEQ ID NO: 3475991 - DNA, 17 bp, Homo sapiens
caggctggctccagatg

SEQ ID NO: 3475992 - DNA, 12 bp, Homo sapiens
caggctgggaac

SEQ ID NO: 3475993 - DNA, 15 bp, Homo sapiens
caggctgggcttcag

SEQ ID NO: 3475994 - DNA, 19 bp, Homo sapiens
caggctgggcttcagtggc

SEQ ID NO: 3475995 - DNA, 19 bp, Homo sapiens
caggctggtctcaaactct

SEQ ID NO: 3475996 - DNA, 21 bp, Homo sapiens
caggctggtcttgaagtcctg

SEQ ID NO: 3475997 - DNA, 22 bp, Homo sapiens
caggctgtatcccatgagcctc

SEQ ID NO: 3475998 - DNA, 19 bp, Homo sapiens
caggctgtgactcttctct

SEQ ID NO: 3475999 - DNA, 19 bp, Homo sapiens
caggctgtggggcagctga

SEQ ID NO: 3476000 - DNA, 22 bp, Homo sapiens
caggctgtgtttggctttcagg

SEQ ID NO: 3476001 - DNA, 21 bp, Homo sapiens
caggcttatgaatatatttaa

SEQ ID NO: 3476002 - DNA, 17 bp, Homo sapiens
cagggaaaagcagctct

SEQ ID NO: 3476003 - DNA, 21 bp, Homo sapiens
cagggaaaagcagctctcccc

SEQ ID NO: 3476004 - DNA, 20 bp, Homo sapiens
cagggaaaatgcagcaggga

SEQ ID NO: 3476005 - DNA, 17 bp, Homo sapiens
cagggaaatggccttcc

SEQ ID NO: 3476006 - DNA, 16 bp, Homo sapiens
cagggaagtccccagg

SEQ ID NO: 3476007 - DNA, 18 bp, Homo sapiens
cagggaagtccccaggcc

SEQ ID NO: 3476008 - DNA, 12 bp, Homo sapiens
cagggagaagct

SEQ ID NO: 3476009 - DNA, 11 bp, Homo sapiens
cagggagacaa

SEQ ID NO: 3476010 - DNA, 20 bp, Homo sapiens
cagggagcattttcctccat

SEQ ID NO: 3476011 - DNA, 17 bp, Homo sapiens
cagggagcggccggcca

SEQ ID NO: 3476012 - DNA, 21 bp, Homo sapiens
cagggagcggccggccagccc

SEQ ID NO: 3476013 - DNA, 19 bp, Homo sapiens
cagggatgagcatggagct

SEQ ID NO: 3476014 - DNA, 23 bp, Homo sapiens
cagggatgagcatggagctggcc

SEQ ID NO: 3476015 - DNA, 20 bp, Homo sapiens
cagggatgattcaagccatt

SEQ ID NO: 3476016 - DNA, 13 bp, Homo sapiens
cagggatgccctg

SEQ ID NO: 3476017 - DNA, 20 bp, Homo sapiens
cagggatgccctggaggtgg

SEQ ID NO: 3476018 - DNA, 23 bp, Homo sapiens
cagggatgggaggtatgggctgg

SEQ ID NO: 3476019 - DNA, 20 bp, Homo sapiens
cagggcaagggttaaggcct

SEQ ID NO: 3476020 - DNA, 21 bp, Homo sapiens
cagggcaagggttaaggcctg

SEQ ID NO: 3476021 - DNA, 22 bp, Homo sapiens
cagggcacaccgggcactcaga

SEQ ID NO: 3476022 - DNA, 15 bp, Homo sapiens
cagggcacctgccac

SEQ ID NO: 3476023 - DNA, 14 bp, Homo sapiens
cagggcagcgccag

SEQ ID NO: 3476024 - DNA, 15 bp, Homo sapiens
cagggcagcgccagg

SEQ ID NO: 3476025 - DNA, 17 bp, Homo sapiens
cagggcagcgccaggct

SEQ ID NO: 3476026 - DNA, 19 bp, Homo sapiens
cagggcagcgccaggctga

SEQ ID NO: 3476027 - DNA, 22 bp, Homo sapiens
cagggcagcgccaggctgacca

SEQ ID NO: 3476028 - DNA, 13 bp, Homo sapiens
cagggcagggccc

SEQ ID NO: 3476029 - DNA, 13 bp, Homo sapiens
cagggcaggtggg

SEQ ID NO: 3476030 - DNA, 15 bp, Homo sapiens
cagggcatcttgctg

SEQ ID NO: 3476031 - DNA, 20 bp, Homo sapiens
cagggccaaacgctgagcca

SEQ ID NO: 3476032 - DNA, 16 bp, Homo sapiens
cagggccacgctccag

SEQ ID NO: 3476033 - DNA, 18 bp, Homo sapiens
cagggccacgctccagct

SEQ ID NO: 3476034 - DNA, 22 bp, Homo sapiens
cagggccacgctccagctgccc

SEQ ID NO: 3476035 - DNA, 21 bp, Homo sapiens
cagggccatgctgaggcctgg

SEQ ID NO: 3476036 - DNA, 12 bp, Homo sapiens
cagggcccagag

SEQ ID NO: 3476037 - DNA, 19 bp, Homo sapiens
cagggcccagagcccagct

SEQ ID NO: 3476038 - DNA, 20 bp, Homo sapiens
cagggccccaggcattgcca

SEQ ID NO: 3476039 - DNA, 15 bp, Homo sapiens
cagggcccccacagg

SEQ ID NO: 3476040 - DNA, 16 bp, Homo sapiens
cagggcccccatctca

SEQ ID NO: 3476041 - DNA, 16 bp, Homo sapiens
cagggcctgagcctgg

SEQ ID NO: 3476042 - DNA, 19 bp, Homo sapiens
cagggcctgagcctggcca

SEQ ID NO: 3476043 - DNA, 12 bp, Homo sapiens
cagggcctggtt

SEQ ID NO: 3476044 - DNA, 16 bp, Homo sapiens
cagggcgggcagaggg

SEQ ID NO: 3476045 - DNA, 17 bp, Homo sapiens
cagggcgggcagagggc

SEQ ID NO: 3476046 - DNA, 20 bp, Homo sapiens
cagggcgggcagagggctgg

SEQ ID NO: 3476047 - DNA, 18 bp, Homo sapiens
cagggctaccctgagctg

SEQ ID NO: 3476048 - DNA, 20 bp, Homo sapiens
cagggctcagcggggacagc

SEQ ID NO: 3476049 - DNA, 12 bp, Homo sapiens
cagggctcctgc

SEQ ID NO: 3476050 - DNA, 14 bp, Homo sapiens
cagggctcctgcac

SEQ ID NO: 3476051 - DNA, 13 bp, Homo sapiens
cagggctcctggg

SEQ ID NO: 3476052 - DNA, 12 bp, Homo sapiens
cagggctctgac

SEQ ID NO: 3476053 - DNA, 20 bp, Homo sapiens
cagggctgcattgggagcat

SEQ ID NO: 3476054 - DNA, 19 bp, Homo sapiens
cagggctggactgaggcct

SEQ ID NO: 3476055 - DNA, 20 bp, Homo sapiens
cagggctggactgaggcctg

SEQ ID NO: 3476056 - DNA, 22 bp, Homo sapiens
cagggctggactgaggcctgag

SEQ ID NO: 3476057 - DNA, 23 bp, Homo sapiens
cagggctggactgaggcctgagc

SEQ ID NO: 3476058 - DNA, 13 bp, Homo sapiens
cagggctgtgctt

SEQ ID NO: 3476059 - DNA, 14 bp, Homo sapiens
cagggctgtgcttg

SEQ ID NO: 3476060 - DNA, 23 bp, Homo sapiens
cagggctgtgcttgaaggccctg

SEQ ID NO: 3476061 - DNA, 17 bp, Homo sapiens
caggggaaaatcagcct

SEQ ID NO: 3476062 - DNA, 22 bp, Homo sapiens
caggggacaggagtccactttg

SEQ ID NO: 3476063 - DNA, 16 bp, Homo sapiens
caggggattggcgccc

SEQ ID NO: 3476064 - DNA, 13 bp, Homo sapiens
caggggctgcttc

SEQ ID NO: 3476065 - DNA, 20 bp, Homo sapiens
cagggggggaaatgcattta

SEQ ID NO: 3476066 - DNA, 19 bp, Homo sapiens
caggggggtgaggagctgg

SEQ ID NO: 3476067 - DNA, 17 bp, Homo sapiens
caggggtctgggagtca

SEQ ID NO: 3476068 - DNA, 18 bp, Homo sapiens
caggggtctgggagtcag

SEQ ID NO: 3476069 - DNA, 21 bp, Homo sapiens
caggggtctgggagtcaggcc

SEQ ID NO: 3476070 - DNA, 23 bp, Homo sapiens
cagggtatggactatctgtctgg

SEQ ID NO: 3476071 - DNA, 10 bp, Homo sapiens
cagggtcaga

SEQ ID NO: 3476072 - DNA, 22 bp, Homo sapiens
cagggtccacaggaagtgaaga

SEQ ID NO: 3476073 - DNA, 14 bp, Homo sapiens
cagggtccagaccc

SEQ ID NO: 3476074 - DNA, 18 bp, Homo sapiens
cagggtccagaccctgaa

SEQ ID NO: 3476075 - DNA, 16 bp, Homo sapiens
cagggtccctctgtgt

SEQ ID NO: 3476076 - DNA, 12 bp, Homo sapiens
cagggtccctgg

SEQ ID NO: 3476077 - DNA, 15 bp, Homo sapiens
cagggtctcactctg

SEQ ID NO: 3476078 - DNA, 16 bp, Homo sapiens
catgaatgatttgtgt

SEQ ID NO: 3476079 - DNA, 12 bp, Homo sapiens
catgacagccag

SEQ ID NO: 3476080 - DNA, 19 bp, Homo sapiens
catgacagccagagcctgt

SEQ ID NO: 3476081 - DNA, 13 bp, Homo sapiens
catgacagcctgc

SEQ ID NO: 3476082 - DNA, 20 bp, Homo sapiens
catgacagcctgcagcagga

SEQ ID NO: 3476083 - DNA, 20 bp, Homo sapiens
catgactgaggaccaatgac

SEQ ID NO: 3476084 - DNA, 12 bp, Homo sapiens
catgagcctcag

SEQ ID NO: 3476085 - DNA, 17 bp, Homo sapiens
catgagcctcagcatcc

SEQ ID NO: 3476086 - DNA, 18 bp, Homo sapiens
catgagcctcagcatcct

SEQ ID NO: 3476087 - DNA, 19 bp, Homo sapiens
catgagcctcagcatcctg

SEQ ID NO: 3476088 - DNA, 21 bp, Homo sapiens
catgagcctcagcatcctggc

SEQ ID NO: 3476089 - DNA, 15 bp, Homo sapiens
catgagcctgctgga

SEQ ID NO: 3476090 - DNA, 19 bp, Homo sapiens
catgagcctgctggaagcc

SEQ ID NO: 3476091 - DNA, 13 bp, Homo sapiens
catgaggaggggc

SEQ ID NO: 3476092 - DNA, 21 bp, Homo sapiens
catgaggaggggcccccctgc

SEQ ID NO: 3476093 - DNA, 23 bp, Homo sapiens
catgaggaggggcccccctgccc

SEQ ID NO: 3476094 - DNA, 16 bp, Homo sapiens
catgagttctgctgaa

SEQ ID NO: 3476095 - DNA, 22 bp, Homo sapiens
catgatgcctctgtcttctgga

SEQ ID NO: 3476096 - DNA, 16 bp, Homo sapiens
catgatgcttttactg

SEQ ID NO: 3476097 - DNA, 22 bp, Homo sapiens
catgattaaccacttcagctga

SEQ ID NO: 3476098 - DNA, 14 bp, Homo sapiens
catgattctattta

SEQ ID NO: 3476099 - DNA, 20 bp, Homo sapiens
catgcaagaactcatcactg

SEQ ID NO: 3476100 - DNA, 22 bp, Homo sapiens
catgcaagaactcatcactgtg

SEQ ID NO: 3476101 - DNA, 16 bp, Homo sapiens
catgcacgtgtgtgca

SEQ ID NO: 3476102 - DNA, 20 bp, Homo sapiens
catgcactgtgaaggaccct

SEQ ID NO: 3476103 - DNA, 19 bp, Homo sapiens
catgcactgttccccctgt

SEQ ID NO: 3476104 - DNA, 10 bp, Homo sapiens
catgcagttt

SEQ ID NO: 3476105 - DNA, 16 bp, Homo sapiens
catgcagtttgaaatt

SEQ ID NO: 3476106 - DNA, 20 bp, Homo sapiens
catgcagtttgaaattctga

SEQ ID NO: 3476107 - DNA, 14 bp, Homo sapiens
catgcatcttactg

SEQ ID NO: 3476108 - DNA, 16 bp, Homo sapiens
catgcatcttactgaa

SEQ ID NO: 3476109 - DNA, 19 bp, Homo sapiens
catgccagcttatctcagg

SEQ ID NO: 3476110 - DNA, 21 bp, Homo sapiens
catgcccggctaatttttgta

SEQ ID NO: 3476111 - DNA, 13 bp, Homo sapiens
catgccctcctct

SEQ ID NO: 3476112 - DNA, 15 bp, Homo sapiens
catgccctcctctcc

SEQ ID NO: 3476113 - DNA, 20 bp, Homo sapiens
catgccctcctctcccattg

SEQ ID NO: 3476114 - DNA, 14 bp, Homo sapiens
catgccctctcagg

SEQ ID NO: 3476115 - DNA, 21 bp, Homo sapiens
catgccctctcaggccggcag

SEQ ID NO: 3476116 - DNA, 18 bp, Homo sapiens
catgccctgtgcaacctc

SEQ ID NO: 3476117 - DNA, 23 bp, Homo sapiens
catgccctgtgcaacctcttggc

SEQ ID NO: 3476118 - DNA, 16 bp, Homo sapiens
catgcctggtattttc

SEQ ID NO: 3476119 - DNA, 17 bp, Homo sapiens
catgcctggtattttca

SEQ ID NO: 3476120 - DNA, 14 bp, Homo sapiens
catgcctgtcctga

SEQ ID NO: 3476121 - DNA, 20 bp, Homo sapiens
catgccttaaacctacctcc

SEQ ID NO: 3476122 - DNA, 22 bp, Homo sapiens
catgcgacactgggaggccagt

SEQ ID NO: 3476123 - DNA, 14 bp, Homo sapiens
catgcggagaacaa

SEQ ID NO: 3476124 - DNA, 13 bp, Homo sapiens
catgcggtagcca

SEQ ID NO: 3476125 - DNA, 16 bp, Homo sapiens
catgcggtagccagca

SEQ ID NO: 3476126 - DNA, 19 bp, Homo sapiens
catgcggtagccagcacac

SEQ ID NO: 3476127 - DNA, 19 bp, Homo sapiens
catgctatgttctgtcttc

SEQ ID NO: 3476128 - DNA, 21 bp, Homo sapiens
catgctatgttctgtcttccc

SEQ ID NO: 3476129 - DNA, 22 bp, Homo sapiens
catgctatgttctgtcttccca

SEQ ID NO: 3476130 - DNA, 13 bp, Homo sapiens
catgctcctggcc

SEQ ID NO: 3476131 - DNA, 16 bp, Homo sapiens
catgctcctggcccac

SEQ ID NO: 3476132 - DNA, 20 bp, Homo sapiens
catgctcctggcccactgca

SEQ ID NO: 3476133 - DNA, 17 bp, Homo sapiens
catgctggaaaataata

SEQ ID NO: 3476134 - DNA, 19 bp, Homo sapiens
catgcttgatgtttggcct

SEQ ID NO: 3476135 - DNA, 12 bp, Homo sapiens
catggaaaaaaa

SEQ ID NO: 3476136 - DNA, 16 bp, Homo sapiens
catggaaactggccag

SEQ ID NO: 3476137 - DNA, 18 bp, Homo sapiens
catggaaggggcttctgg

SEQ ID NO: 3476138 - DNA, 16 bp, Homo sapiens
catggagagctggagc

SEQ ID NO: 3476139 - DNA, 20 bp, Homo sapiens
catggagagctggagcctgg

SEQ ID NO: 3476140 - DNA, 21 bp, Homo sapiens
catggagagctggagcctggt

SEQ ID NO: 3476141 - DNA, 10 bp, Homo sapiens
catggagcca

SEQ ID NO: 3476142 - DNA, 13 bp, Homo sapiens
catggagctggcc

SEQ ID NO: 3476143 - DNA, 13 bp, Homo sapiens
catggcagaaggc

SEQ ID NO: 3476144 - DNA, 18 bp, Homo sapiens
catggcccaaatccagtg

SEQ ID NO: 3476145 - DNA, 16 bp, Homo sapiens
catggcccctgtgagt

SEQ ID NO: 3476146 - DNA, 23 bp, Homo sapiens
catggccctcccagtacctcctg

SEQ ID NO: 3476147 - DNA, 16 bp, Homo sapiens
catggccctgccatgc

SEQ ID NO: 3476148 - DNA, 16 bp, Homo sapiens
catggcctcttgaaga

SEQ ID NO: 3476149 - DNA, 16 bp, Homo sapiens
catgggaaggggagga

SEQ ID NO: 3476150 - DNA, 17 bp, Homo sapiens
catgggcagagcccaag

SEQ ID NO: 3476151 - DNA, 11 bp, Homo sapiens
catggggaggg

SEQ ID NO: 3476152 - DNA, 14 bp, Homo sapiens
catgggggacccct

SEQ ID NO: 3476153 - DNA, 13 bp, Homo sapiens
catgggtcgggag

SEQ ID NO: 3476154 - DNA, 23 bp, Homo sapiens
catgggtcgggagaggggacgca

SEQ ID NO: 3476155 - DNA, 15 bp, Homo sapiens
catggtatgtaactc

SEQ ID NO: 3476156 - DNA, 14 bp, Homo sapiens
catggtcacacact

SEQ ID NO: 3476157 - DNA, 16 bp, Homo sapiens
catggtcacacactga

SEQ ID NO: 3476158 - DNA, 21 bp, Homo sapiens
catggtcacacactgatgctt

SEQ ID NO: 3476159 - DNA, 15 bp, Homo sapiens
catggtgaaaagctc

SEQ ID NO: 3476160 - DNA, 15 bp, Homo sapiens
catggtgccccagga

SEQ ID NO: 3476161 - DNA, 19 bp, Homo sapiens
catggtgccccaggaccag

SEQ ID NO: 3476162 - DNA, 16 bp, Homo sapiens
catggtgtttttataa

SEQ ID NO: 3476163 - DNA, 15 bp, Homo sapiens
catgtaaataatctg

SEQ ID NO: 3476164 - DNA, 21 bp, Homo sapiens
catgtaaatccccactgggac

SEQ ID NO: 3476165 - DNA, 17 bp, Homo sapiens
catgtaaccggcatgtt

SEQ ID NO: 3476166 - DNA, 14 bp, Homo sapiens
catgtaatcctcaa

SEQ ID NO: 3476167 - DNA, 16 bp, Homo sapiens
catgtacagacagaga

SEQ ID NO: 3476168 - DNA, 21 bp, Homo sapiens
catgtacttgtttgcaagcag

SEQ ID NO: 3476169 - DNA, 22 bp, Homo sapiens
catgtactttttagtaatttct

SEQ ID NO: 3476170 - DNA, 15 bp, Homo sapiens
catgtagaagctgca

SEQ ID NO: 3476171 - DNA, 13 bp, Homo sapiens
catgtagccccct

SEQ ID NO: 3476172 - DNA, 21 bp, Homo sapiens
catgtagccccctggcctctg

SEQ ID NO: 3476173 - DNA, 18 bp, Homo sapiens
catgtataaagtgattga

SEQ ID NO: 3476174 - DNA, 19 bp, Homo sapiens
catgtatcataattaccaa

SEQ ID NO: 3476175 - DNA, 22 bp, Homo sapiens
catgtatggaatcccactgtat

SEQ ID NO: 3476176 - DNA, 14 bp, Homo sapiens
catgtattcacaca

SEQ ID NO: 3476177 - DNA, 19 bp, Homo sapiens
catgtcagagcttggccct

SEQ ID NO: 3476178 - DNA, 14 bp, Homo sapiens
catgtcagcaaaaa

SEQ ID NO: 3476179 - DNA, 23 bp, Homo sapiens
catgtcagcaaaaagcaaaatca

SEQ ID NO: 3476180 - DNA, 13 bp, Homo sapiens
catgtccccctta

SEQ ID NO: 3476181 - DNA, 18 bp, Homo sapiens
catgtcctaattcttctg

SEQ ID NO: 3476182 - DNA, 18 bp, Homo sapiens
catgtctattccattccc

SEQ ID NO: 3476183 - DNA, 17 bp, Homo sapiens
catgtctgcagtgtgcc

SEQ ID NO: 3476184 - DNA, 14 bp, Homo sapiens
catgtctgcatttc

SEQ ID NO: 3476185 - DNA, 15 bp, Homo sapiens
catgtctgcatttcg

SEQ ID NO: 3476186 - DNA, 14 bp, Homo sapiens
catgtcttaatgaa

SEQ ID NO: 3476187 - DNA, 21 bp, Homo sapiens
catgtcttaatgaagtttgaa

SEQ ID NO: 3476188 - DNA, 22 bp, Homo sapiens
catgtcttaatgaagtttgaat

SEQ ID NO: 3476189 - DNA, 23 bp, Homo sapiens
catgtcttaatgaagtttgaatg

SEQ ID NO: 3476190 - DNA, 18 bp, Homo sapiens
catgtgaaactcatctca

SEQ ID NO: 3476191 - DNA, 12 bp, Homo sapiens
catgtgactctg

SEQ ID NO: 3476192 - DNA, 22 bp, Homo sapiens
catgtgagcatggtcacaagca

SEQ ID NO: 3476193 - DNA, 22 bp, Homo sapiens
catgtgccagggcaatgatgaa

SEQ ID NO: 3476194 - DNA, 22 bp, Homo sapiens
catgtgccaggtttttggtctg

SEQ ID NO: 3476195 - DNA, 17 bp, Homo sapiens
catgtggagacttcatc

SEQ ID NO: 3476196 - DNA, 19 bp, Homo sapiens
catgtggccatggcctctg

SEQ ID NO: 3476197 - DNA, 20 bp, Homo sapiens
catgtggccatggcctctgc

SEQ ID NO: 3476198 - DNA, 12 bp, Homo sapiens
catgtggctgga

SEQ ID NO: 3476199 - DNA, 15 bp, Homo sapiens
catgtggctggaaga

SEQ ID NO: 3476200 - DNA, 21 bp, Homo sapiens
catgtgtgtccacgactgtct

SEQ ID NO: 3476201 - DNA, 19 bp, Homo sapiens
catgtgtgtgtgtgtgtgt

SEQ ID NO: 3476202 - DNA, 21 bp, Homo sapiens
catgtgtgtgtgtgtgtgtgt

SEQ ID NO: 3476203 - DNA, 19 bp, Homo sapiens
catgttaggaaaatttcac

SEQ ID NO: 3476204 - DNA, 14 bp, Homo sapiens
catgttctgctttc

SEQ ID NO: 3476205 - DNA, 18 bp, Homo sapiens
catgttctggtggtttga

SEQ ID NO: 3476206 - DNA, 20 bp, Homo sapiens
catgttgaccatgtctatga

SEQ ID NO: 3476207 - DNA, 17 bp, Homo sapiens
catgttgatcatgtact

SEQ ID NO: 3476208 - DNA, 18 bp, Homo sapiens
catgttgcacacccactc

SEQ ID NO: 3476209 - DNA, 22 bp, Homo sapiens
catgttgcccctttctcttttc

SEQ ID NO: 3476210 - DNA, 21 bp, Homo sapiens
ccactgtatgatttataaaca

SEQ ID NO: 3476211 - DNA, 21 bp, Homo sapiens
ccactgtcctgggcctgcaga

SEQ ID NO: 3476212 - DNA, 14 bp, Homo sapiens
ccactgtgaagaga

SEQ ID NO: 3476213 - DNA, 19 bp, Homo sapiens
ccactgtgccatgtgccag

SEQ ID NO: 3476214 - DNA, 13 bp, Homo sapiens
ccactgtggtggc

SEQ ID NO: 3476215 - DNA, 21 bp, Homo sapiens
ccacttcattcttgaaagctg

SEQ ID NO: 3476216 - DNA, 15 bp, Homo sapiens
ccacttctgggtggg

SEQ ID NO: 3476217 - DNA, 14 bp, Homo sapiens
ccacttctggtcaa

SEQ ID NO: 3476218 - DNA, 18 bp, Homo sapiens
ccacttggcatcagctgg

SEQ ID NO: 3476219 - DNA, 21 bp, Homo sapiens
ccacttggctacacagggatg

SEQ ID NO: 3476220 - DNA, 16 bp, Homo sapiens
ccacttgtttgcactg

SEQ ID NO: 3476221 - DNA, 18 bp, Homo sapiens
ccacttgtttgcactgtg

SEQ ID NO: 3476222 - DNA, 17 bp, Homo sapiens
ccactttttgcagcttt

SEQ ID NO: 3476223 - DNA, 17 bp, Homo sapiens
ccagaaaacctccagta

SEQ ID NO: 3476224 - DNA, 18 bp, Homo sapiens
ccagaaaacctccagtag

SEQ ID NO: 3476225 - DNA, 17 bp, Homo sapiens
ccagaacacactccatc

SEQ ID NO: 3476226 - DNA, 15 bp, Homo sapiens
ccagaacagtatgaa

SEQ ID NO: 3476227 - DNA, 23 bp, Homo sapiens
ccagaattcattccccagctcca

SEQ ID NO: 3476228 - DNA, 20 bp, Homo sapiens
ccagacaatgttgtgtttgg

SEQ ID NO: 3476229 - DNA, 19 bp, Homo sapiens
ccagacacaggccctccct

SEQ ID NO: 3476230 - DNA, 16 bp, Homo sapiens
ccagacacccaggact

SEQ ID NO: 3476231 - DNA, 19 bp, Homo sapiens
ccagacagaccttcacaga

SEQ ID NO: 3476232 - DNA, 22 bp, Homo sapiens
ccagacattctcgcttccctga

SEQ ID NO: 3476233 - DNA, 13 bp, Homo sapiens
ccagaccctgaag

SEQ ID NO: 3476234 - DNA, 19 bp, Homo sapiens
ccagacctgatcctggagg

SEQ ID NO: 3476235 - DNA, 21 bp, Homo sapiens
ccagacctgatcctggaggcc

SEQ ID NO: 3476236 - DNA, 15 bp, Homo sapiens
ccagaccttctagga

SEQ ID NO: 3476237 - DNA, 16 bp, Homo sapiens
ccagagaaaggggagc

SEQ ID NO: 3476238 - DNA, 20 bp, Homo sapiens
ccagagaaaggggagcccac

SEQ ID NO: 3476239 - DNA, 19 bp, Homo sapiens
ccagagaaggggtgtgcat

SEQ ID NO: 3476240 - DNA, 22 bp, Homo sapiens
ccagagaagtctggtcagagcc

SEQ ID NO: 3476241 - DNA, 20 bp, Homo sapiens
ccagagaccaggctgtgtcc

SEQ ID NO: 3476242 - DNA, 13 bp, Homo sapiens
ccagagagggtgg

SEQ ID NO: 3476243 - DNA, 13 bp, Homo sapiens
ccagagccaaggg

SEQ ID NO: 3476244 - DNA, 14 bp, Homo sapiens
ccagagcccacctt

SEQ ID NO: 3476245 - DNA, 16 bp, Homo sapiens
ccagagcccaccttgg

SEQ ID NO: 3476246 - DNA, 13 bp, Homo sapiens
ccagagcccagct

SEQ ID NO: 3476247 - DNA, 14 bp, Homo sapiens
ccagagctggtgga

SEQ ID NO: 3476248 - DNA, 18 bp, Homo sapiens
ccagagctggtggaccca

SEQ ID NO: 3476249 - DNA, 22 bp, Homo sapiens
ccagagctggtggacccaggga

SEQ ID NO: 3476250 - DNA, 19 bp, Homo sapiens
ccagaggaaggggccagag

SEQ ID NO: 3476251 - DNA, 22 bp, Homo sapiens
ccagaggagggcagcagaaggg

SEQ ID NO: 3476252 - DNA, 22 bp, Homo sapiens
ccagaggcacctcaagaagaag

SEQ ID NO: 3476253 - DNA, 19 bp, Homo sapiens
ccagaggccaacactgtgg

SEQ ID NO: 3476254 - DNA, 21 bp, Homo sapiens
ccagaggcccccagcccaggg

SEQ ID NO: 3476255 - DNA, 11 bp, Homo sapiens
ccagaggctcg

SEQ ID NO: 3476256 - DNA, 12 bp, Homo sapiens
ccagaggctggg

SEQ ID NO: 3476257 - DNA, 18 bp, Homo sapiens
ccagagggagtgacagag

SEQ ID NO: 3476258 - DNA, 19 bp, Homo sapiens
ccagagggagtgacagagg

SEQ ID NO: 3476259 - DNA, 22 bp, Homo sapiens
ccagagggagtgacagaggcag

SEQ ID NO: 3476260 - DNA, 17 bp, Homo sapiens
ccagatcatgttttggt

SEQ ID NO: 3476261 - DNA, 15 bp, Homo sapiens
ccagatccagcctgg

SEQ ID NO: 3476262 - DNA, 16 bp, Homo sapiens
ccagatcctctctggg

SEQ ID NO: 3476263 - DNA, 16 bp, Homo sapiens
ccagatgcagctcaag

SEQ ID NO: 3476264 - DNA, 16 bp, Homo sapiens
ccagatggactccagc

SEQ ID NO: 3476265 - DNA, 20 bp, Homo sapiens
ccagatgggggaaagcacag

SEQ ID NO: 3476266 - DNA, 16 bp, Homo sapiens
ccagatggtgggatgt

SEQ ID NO: 3476267 - DNA, 23 bp, Homo sapiens
ccagatggttgtgtatgggtagc

SEQ ID NO: 3476268 - DNA, 17 bp, Homo sapiens
ccagatgtttccagact

SEQ ID NO: 3476269 - DNA, 23 bp, Homo sapiens
ccagatgtttccagacttccttg

SEQ ID NO: 3476270 - DNA, 23 bp, Homo sapiens
ccagattatctatttgtgtgtgt

SEQ ID NO: 3476271 - DNA, 13 bp, Homo sapiens
ccagattcttcag

SEQ ID NO: 3476272 - DNA, 18 bp, Homo sapiens
ccagattgcaacaggctg

SEQ ID NO: 3476273 - DNA, 22 bp, Homo sapiens
ccagattgcaacaggctgggct

SEQ ID NO: 3476274 - DNA, 16 bp, Homo sapiens
ccagattggctcacac

SEQ ID NO: 3476275 - DNA, 22 bp, Homo sapiens
ccagattggctcacactgagaa

SEQ ID NO: 3476276 - DNA, 23 bp, Homo sapiens
ccagatttgtctttttgttgtaa

SEQ ID NO: 3476277 - DNA, 15 bp, Homo sapiens
ccagcaaaaggttgt

SEQ ID NO: 3476278 - DNA, 18 bp, Homo sapiens
ccagcaagtgagagctgg

SEQ ID NO: 3476279 - DNA, 19 bp, Homo sapiens
ccagcaagtgagagctggg

SEQ ID NO: 3476280 - DNA, 17 bp, Homo sapiens
ccagcacagcttgacct

SEQ ID NO: 3476281 - DNA, 21 bp, Homo sapiens
ccagcacatccatcagcaccc

SEQ ID NO: 3476282 - DNA, 14 bp, Homo sapiens
ccagcactgaggaa

SEQ ID NO: 3476283 - DNA, 17 bp, Homo sapiens
ccagcactgaggaagaa

SEQ ID NO: 3476284 - DNA, 22 bp, Homo sapiens
ccagcactgaggaagaacgggg

SEQ ID NO: 3476285 - DNA, 19 bp, Homo sapiens
ccagcactgcttgaggaaa

SEQ ID NO: 3476286 - DNA, 17 bp, Homo sapiens
ccagcacttccatggga

SEQ ID NO: 3476287 - DNA, 18 bp, Homo sapiens
ccagcagaaccagcctca

SEQ ID NO: 3476288 - DNA, 22 bp, Homo sapiens
ccagcagaagacaaaaagacaa

SEQ ID NO: 3476289 - DNA, 19 bp, Homo sapiens
ccagcagcctggaccctgt

SEQ ID NO: 3476290 - DNA, 19 bp, Homo sapiens
ccagcagcgcctttcccaa

SEQ ID NO: 3476291 - DNA, 22 bp, Homo sapiens
ccagcagtctctgccttgcctt

SEQ ID NO: 3476292 - DNA, 15 bp, Homo sapiens
ccagcatcccttgac

SEQ ID NO: 3476293 - DNA, 21 bp, Homo sapiens
ccagcatcccttgaccaggcc

SEQ ID NO: 3476294 - DNA, 14 bp, Homo sapiens
ccagcattccagcc

SEQ ID NO: 3476295 - DNA, 17 bp, Homo sapiens
ccagcattccagcccct

SEQ ID NO: 3476296 - DNA, 19 bp, Homo sapiens
ccagcattccagcccctct

SEQ ID NO: 3476297 - DNA, 16 bp, Homo sapiens
ccagcattctcaggca

SEQ ID NO: 3476298 - DNA, 20 bp, Homo sapiens
ccagcattctcaggcaccag

SEQ ID NO: 3476299 - DNA, 14 bp, Homo sapiens
ccagcatttgggta

SEQ ID NO: 3476300 - DNA, 18 bp, Homo sapiens
ccagccaaagcctcctcc

SEQ ID NO: 3476301 - DNA, 19 bp, Homo sapiens
ccagccaaagcctcctcca

SEQ ID NO: 3476302 - DNA, 21 bp, Homo sapiens
ccagccagatggactccagcc

SEQ ID NO: 3476303 - DNA, 16 bp, Homo sapiens
ccagccagcagcagcc

SEQ ID NO: 3476304 - DNA, 12 bp, Homo sapiens
ccagccagctcc

SEQ ID NO: 3476305 - DNA, 13 bp, Homo sapiens
ccagccagctcct

SEQ ID NO: 3476306 - DNA, 16 bp, Homo sapiens
ccagccatcaaaatgc

SEQ ID NO: 3476307 - DNA, 17 bp, Homo sapiens
ccagccatgtctgcatt

SEQ ID NO: 3476308 - DNA, 13 bp, Homo sapiens
ccagcccagagac

SEQ ID NO: 3476309 - DNA, 21 bp, Homo sapiens
ccagcccagattcccctgtgt

SEQ ID NO: 3476310 - DNA, 17 bp, Homo sapiens
ccagcccagattgtctt

SEQ ID NO: 3476311 - DNA, 13 bp, Homo sapiens
ccagcccagggct

SEQ ID NO: 3476312 - DNA, 13 bp, Homo sapiens
ccagccccagtgc

SEQ ID NO: 3476313 - DNA, 20 bp, Homo sapiens
ccagccccggtggctgggca

SEQ ID NO: 3476314 - DNA, 13 bp, Homo sapiens
ccagcccctctgg

SEQ ID NO: 3476315 - DNA, 23 bp, Homo sapiens
ccagcccctctggtcgctcctgc

SEQ ID NO: 3476316 - DNA, 16 bp, Homo sapiens
ccagccccttctcaga

SEQ ID NO: 3476317 - DNA, 14 bp, Homo sapiens
ccagccctccccat

SEQ ID NO: 3476318 - DNA, 17 bp, Homo sapiens
ccagcccttagcaggga

SEQ ID NO: 3476319 - DNA, 21 bp, Homo sapiens
ccagcctcagcgcggccctcc

SEQ ID NO: 3476320 - DNA, 18 bp, Homo sapiens
ccagcctgcctggcaggc

SEQ ID NO: 3476321 - DNA, 19 bp, Homo sapiens
ccagcctgcctggcaggct

SEQ ID NO: 3476322 - DNA, 14 bp, Homo sapiens
ccagcctgcgcctg

SEQ ID NO: 3476323 - DNA, 19 bp, Homo sapiens
ccagcctgcgggaagctga

SEQ ID NO: 3476324 - DNA, 21 bp, Homo sapiens
ccagcctgcgggaagctgacc

SEQ ID NO: 3476325 - DNA, 22 bp, Homo sapiens
ccagcctgcgggaagctgacct

SEQ ID NO: 3476326 - DNA, 11 bp, Homo sapiens
ccagcctggcc

SEQ ID NO: 3476327 - DNA, 21 bp, Homo sapiens
ccagcgagccctggtggcagt

SEQ ID NO: 3476328 - DNA, 15 bp, Homo sapiens
ccagcgagctctcaa

SEQ ID NO: 3476329 - DNA, 23 bp, Homo sapiens
ccagcgggaatggcagctgccac

SEQ ID NO: 3476330 - DNA, 19 bp, Homo sapiens
ccagcgtatatataagaaa

SEQ ID NO: 3476331 - DNA, 14 bp, Homo sapiens
ccagctaaataatc

SEQ ID NO: 3476332 - DNA, 13 bp, Homo sapiens
ccagctaagaacc

SEQ ID NO: 3476333 - DNA, 14 bp, Homo sapiens
ccagctaagaacct

SEQ ID NO: 3476334 - DNA, 15 bp, Homo sapiens
ccagctaagaacctg

SEQ ID NO: 3476335 - DNA, 17 bp, Homo sapiens
ccagctaagaacctgga

SEQ ID NO: 3476336 - DNA, 18 bp, Homo sapiens
ccagctaagaacctggaa

SEQ ID NO: 3476337 - DNA, 19 bp, Homo sapiens
ccagctaagaacctggaac

SEQ ID NO: 3476338 - DNA, 20 bp, Homo sapiens
ccagctaatacccagagcac

SEQ ID NO: 3476339 - DNA, 15 bp, Homo sapiens
ccagctactcgggag

SEQ ID NO: 3476340 - DNA, 22 bp, Homo sapiens
ccagctcaccagccccagtgcc

SEQ ID NO: 3476341 - DNA, 20 bp, Homo sapiens
ccagctcaggacagatgcca

SEQ ID NO: 3476342 - DNA, 22 bp, Homo sapiens
cccagggagcggaaagcagctc

SEQ ID NO: 3476343 - DNA, 18 bp, Homo sapiens
cccagggcaagctccgca

SEQ ID NO: 3476344 - DNA, 20 bp, Homo sapiens
cccagggcccagagcccagc

SEQ ID NO: 3476345 - DNA, 18 bp, Homo sapiens
cccagggcccccacaggc

SEQ ID NO: 3476346 - DNA, 15 bp, Homo sapiens
cccagggctcctgca

SEQ ID NO: 3476347 - DNA, 17 bp, Homo sapiens
cccaggtccagctctgg

SEQ ID NO: 3476348 - DNA, 14 bp, Homo sapiens
cccagtacctcctg

SEQ ID NO: 3476349 - DNA, 22 bp, Homo sapiens
cccagtacctcctgtctctggc

SEQ ID NO: 3476350 - DNA, 16 bp, Homo sapiens
cccagtagaccttgtt

SEQ ID NO: 3476351 - DNA, 18 bp, Homo sapiens
cccagtcgaccccaaagg

SEQ ID NO: 3476352 - DNA, 18 bp, Homo sapiens
cccagtctggaatgcagt

SEQ ID NO: 3476353 - DNA, 20 bp, Homo sapiens
cccagtgcccacaggatcag

SEQ ID NO: 3476354 - DNA, 22 bp, Homo sapiens
cccagtgcccccactgaccaga

SEQ ID NO: 3476355 - DNA, 14 bp, Homo sapiens
cccagtggctgctg

SEQ ID NO: 3476356 - DNA, 16 bp, Homo sapiens
cccagtgttttctttg

SEQ ID NO: 3476357 - DNA, 20 bp, Homo sapiens
cccagttcctatgacacagt

SEQ ID NO: 3476358 - DNA, 21 bp, Homo sapiens
cccagttttttgaacatggaa

SEQ ID NO: 3476359 - DNA, 23 bp, Homo sapiens
cccataaggggtcaaaatttgct

SEQ ID NO: 3476360 - DNA, 15 bp, Homo sapiens
cccatagtccctgcc

SEQ ID NO: 3476361 - DNA, 22 bp, Homo sapiens
cccatcagtgctccctcacatg

SEQ ID NO: 3476362 - DNA, 23 bp, Homo sapiens
cccatcagtgctccctcacatgt

SEQ ID NO: 3476363 - DNA, 20 bp, Homo sapiens
cccatccagtctcccaactt

SEQ ID NO: 3476364 - DNA, 15 bp, Homo sapiens
cccatcccccactgc

SEQ ID NO: 3476365 - DNA, 13 bp, Homo sapiens
cccatccctgtct

SEQ ID NO: 3476366 - DNA, 14 bp, Homo sapiens
cccatcctccagca

SEQ ID NO: 3476367 - DNA, 16 bp, Homo sapiens
cccatcctccagcagg

SEQ ID NO: 3476368 - DNA, 12 bp, Homo sapiens
cccatctccccc

SEQ ID NO: 3476369 - DNA, 20 bp, Homo sapiens
cccatctcgctccctcccag

SEQ ID NO: 3476370 - DNA, 14 bp, Homo sapiens
cccatctggctgtg

SEQ ID NO: 3476371 - DNA, 14 bp, Homo sapiens
cccatctgtctaaa

SEQ ID NO: 3476372 - DNA, 15 bp, Homo sapiens
cccatcttcgggacc

SEQ ID NO: 3476373 - DNA, 15 bp, Homo sapiens
cccatgagcctcagc

SEQ ID NO: 3476374 - DNA, 16 bp, Homo sapiens
cccatgagcctcagca

SEQ ID NO: 3476375 - DNA, 23 bp, Homo sapiens
cccatgagttggggtctggcagc

SEQ ID NO: 3476376 - DNA, 14 bp, Homo sapiens
cccatgcactgtga

SEQ ID NO: 3476377 - DNA, 18 bp, Homo sapiens
cccatgcactgtgaagga

SEQ ID NO: 3476378 - DNA, 22 bp, Homo sapiens
cccatgcactgtgaaggaccct

SEQ ID NO: 3476379 - DNA, 17 bp, Homo sapiens
cccatggaatatttcca

SEQ ID NO: 3476380 - DNA, 15 bp, Homo sapiens
cccatggacaggctg

SEQ ID NO: 3476381 - DNA, 20 bp, Homo sapiens
cccatggacaggctggctcc

SEQ ID NO: 3476382 - DNA, 13 bp, Homo sapiens
cccatggagccag

SEQ ID NO: 3476383 - DNA, 24 bp, Homo sapiens
cccatgggacaaattgcacagaag

SEQ ID NO: 3476384 - DNA, 15 bp, Homo sapiens
cccatgtagccccct

SEQ ID NO: 3476385 - DNA, 21 bp, Homo sapiens
cccatgtagccccctggcctc

SEQ ID NO: 3476386 - DNA, 23 bp, Homo sapiens
cccatgtagccccctggcctctg

SEQ ID NO: 3476387 - DNA, 23 bp, Homo sapiens
cccatgtggtgatgatgtgtata

SEQ ID NO: 3476388 - DNA, 13 bp, Homo sapiens
cccattcacagag

SEQ ID NO: 3476389 - DNA, 13 bp, Homo sapiens
cccattcagacac

SEQ ID NO: 3476390 - DNA, 18 bp, Homo sapiens
cccattcctgaagaacca

SEQ ID NO: 3476391 - DNA, 14 bp, Homo sapiens
cccattcctgggaa

SEQ ID NO: 3476392 - DNA, 18 bp, Homo sapiens
cccattctacacagagca

SEQ ID NO: 3476393 - DNA, 13 bp, Homo sapiens
cccattctgcctg

SEQ ID NO: 3476394 - DNA, 15 bp, Homo sapiens
cccattctgcctgcc

SEQ ID NO: 3476395 - DNA, 20 bp, Homo sapiens
cccattctgcctgcccaggc

SEQ ID NO: 3476396 - DNA, 23 bp, Homo sapiens
cccattctgcctgcccaggcccc

SEQ ID NO: 3476397 - DNA, 20 bp, Homo sapiens
cccatttttatatcgatctc

SEQ ID NO: 3476398 - DNA, 14 bp, Homo sapiens
ccccaaaacccggg

SEQ ID NO: 3476399 - DNA, 17 bp, Homo sapiens
ccccaaaggaacactga

SEQ ID NO: 3476400 - DNA, 15 bp, Homo sapiens
ccccaaagtaaaaga

SEQ ID NO: 3476401 - DNA, 19 bp, Homo sapiens
ccccaaatccgaacctcct

SEQ ID NO: 3476402 - DNA, 14 bp, Homo sapiens
ccccaacactgagc

SEQ ID NO: 3476403 - DNA, 23 bp, Homo sapiens
ccccaagcatgggggaccccttc

SEQ ID NO: 3476404 - DNA, 13 bp, Homo sapiens
ccccaatcccagc

SEQ ID NO: 3476405 - DNA, 14 bp, Homo sapiens
ccccacccctccag

SEQ ID NO: 3476406 - DNA, 12 bp, Homo sapiens
ccccaccctcat

SEQ ID NO: 3476407 - DNA, 16 bp, Homo sapiens
ccccacgagggctggc

SEQ ID NO: 3476408 - DNA, 14 bp, Homo sapiens
ccccactgtatcta

SEQ ID NO: 3476409 - DNA, 13 bp, Homo sapiens
ccccacttgcctc

SEQ ID NO: 3476410 - DNA, 15 bp, Homo sapiens
ccccacttgcctctt

SEQ ID NO: 3476411 - DNA, 15 bp, Homo sapiens
ccccagattgcaaca

SEQ ID NO: 3476412 - DNA, 21 bp, Homo sapiens
ccccagattgcaacaggctgg

SEQ ID NO: 3476413 - DNA, 22 bp, Homo sapiens
ccccagattgcaacaggctggg

SEQ ID NO: 3476414 - DNA, 19 bp, Homo sapiens
ccccagcaagtgagagctg

SEQ ID NO: 3476415 - DNA, 13 bp, Homo sapiens
ccccagcactgag

SEQ ID NO: 3476416 - DNA, 18 bp, Homo sapiens
ccccagcaggtgctgact

SEQ ID NO: 3476417 - DNA, 20 bp, Homo sapiens
ccccagcattctcaggcacc

SEQ ID NO: 3476418 - DNA, 21 bp, Homo sapiens
ccccagcattctcaggcacca

SEQ ID NO: 3476419 - DNA, 22 bp, Homo sapiens
ccccagcattctcaggcaccag

SEQ ID NO: 3476420 - DNA, 12 bp, Homo sapiens
ccccagcccaga

SEQ ID NO: 3476421 - DNA, 14 bp, Homo sapiens
ccccagcccagggc

SEQ ID NO: 3476422 - DNA, 19 bp, Homo sapiens
ccccagctaagaacctgga

SEQ ID NO: 3476423 - DNA, 21 bp, Homo sapiens
ccccagctaagaacctggaac

SEQ ID NO: 3476424 - DNA, 21 bp, Homo sapiens
ccccagctaatacccagagca

SEQ ID NO: 3476425 - DNA, 10 bp, Homo sapiens
ccccagctcc

SEQ ID NO: 3476426 - DNA, 14 bp, Homo sapiens
ccccagctccccag

SEQ ID NO: 3476427 - DNA, 15 bp, Homo sapiens
ccccagctccccagg

SEQ ID NO: 3476428 - DNA, 17 bp, Homo sapiens
ccccagctccccaggac

SEQ ID NO: 3476429 - DNA, 13 bp, Homo sapiens
ccccagctccggc

SEQ ID NO: 3476430 - DNA, 17 bp, Homo sapiens
ccccaggaaaagcacaa

SEQ ID NO: 3476431 - DNA, 16 bp, Homo sapiens
ccccaggaccagctca

SEQ ID NO: 3476432 - DNA, 18 bp, Homo sapiens
ccccaggaccagctcagg

SEQ ID NO: 3476433 - DNA, 15 bp, Homo sapiens
ccccaggacctggct

SEQ ID NO: 3476434 - DNA, 17 bp, Homo sapiens
ccccaggacctggctgc

SEQ ID NO: 3476435 - DNA, 20 bp, Homo sapiens
ccccaggacctggctgccat

SEQ ID NO: 3476436 - DNA, 16 bp, Homo sapiens
ccccaggactcaccct

SEQ ID NO: 3476437 - DNA, 19 bp, Homo sapiens
ccccaggactcaccctcat

SEQ ID NO: 3476438 - DNA, 15 bp, Homo sapiens
ccccaggcctgagct

SEQ ID NO: 3476439 - DNA, 21 bp, Homo sapiens
ccccaggcctgagctgcttca

SEQ ID NO: 3476440 - DNA, 17 bp, Homo sapiens
ccccagggcccccacag

SEQ ID NO: 3476441 - DNA, 17 bp, Homo sapiens
ccccaggtccagctctg

SEQ ID NO: 3476442 - DNA, 22 bp, Homo sapiens
ccccaggtccagctctggaggg

SEQ ID NO: 3476443 - DNA, 14 bp, Homo sapiens
ccccagtaaaattg

SEQ ID NO: 3476444 - DNA, 14 bp, Homo sapiens
ccccagtgcccaca

SEQ ID NO: 3476445 - DNA, 15 bp, Homo sapiens
ccccagtgcccacag

SEQ ID NO: 3476446 - DNA, 20 bp, Homo sapiens
ccccagtgcccacaggatca

SEQ ID NO: 3476447 - DNA, 12 bp, Homo sapiens
ccccatccccca

SEQ ID NO: 3476448 - DNA, 15 bp, Homo sapiens
ccccatcctccagca

SEQ ID NO: 3476449 - DNA, 16 bp, Homo sapiens
ccccatctctccctcc

SEQ ID NO: 3476450 - DNA, 12 bp, Homo sapiens
ccccatcttgct

SEQ ID NO: 3476451 - DNA, 18 bp, Homo sapiens
ccccatggggctgcggga

SEQ ID NO: 3476452 - DNA, 19 bp, Homo sapiens
ccccatggtcagccctagg

SEQ ID NO: 3476453 - DNA, 14 bp, Homo sapiens
ccccattcacagag

SEQ ID NO: 3476454 - DNA, 15 bp, Homo sapiens
ccccattcttttgta

SEQ ID NO: 3476455 - DNA, 20 bp, Homo sapiens
ccccatttctatttatttac

SEQ ID NO: 3476456 - DNA, 13 bp, Homo sapiens
cccccaagcctgc

SEQ ID NO: 3476457 - DNA, 13 bp, Homo sapiens
cccccagcactga

SEQ ID NO: 3476458 - DNA, 12 bp, Homo sapiens
cccccagcactt

SEQ ID NO: 3476459 - DNA, 18 bp, Homo sapiens
cccccagctaagaacctg

SEQ ID NO: 3476460 - DNA, 11 bp, Homo sapiens
cccccaggact

SEQ ID NO: 3476461 - DNA, 17 bp, Homo sapiens
cccccaggactgggcca

SEQ ID NO: 3476462 - DNA, 16 bp, Homo sapiens
cccccaggcctgagct

SEQ ID NO: 3476463 - DNA, 14 bp, Homo sapiens
cccccatgcactgt

SEQ ID NO: 3476464 - DNA, 12 bp, Homo sapiens
ccccccacccca

SEQ ID NO: 3476465 - DNA, 13 bp, Homo sapiens
ccccccacccctg

SEQ ID NO: 3476466 - DNA, 12 bp, Homo sapiens
ccccccagcact

SEQ ID NO: 3476467 - DNA, 13 bp, Homo sapiens
ccccccagcactg

SEQ ID NO: 3476468 - DNA, 12 bp, Homo sapiens
cccccgccccct

SEQ ID NO: 3476469 - DNA, 16 bp, Homo sapiens
cccccgccccctgccc

SEQ ID NO: 3476470 - DNA, 19 bp, Homo sapiens
ccccctccgccctgccact

SEQ ID NO: 3476471 - DNA, 15 bp, Homo sapiens
ccccctggcctctgt

SEQ ID NO: 3476472 - DNA, 19 bp, Homo sapiens
ccccctggcctctgtgcct

SEQ ID NO: 3476473 - DNA, 22 bp, Homo sapiens
ccccctggcctctgtgccttct

SEQ ID NO: 3476474 - DNA, 21 bp, Homo sapiens
ccccctttggtttggcctcca

SEQ ID NO: 3476475 - DNA, 15 bp, Homo sapiens
ccctgagaaacccac

SEQ ID NO: 3476476 - DNA, 11 bp, Homo sapiens
ccctgagctga

SEQ ID NO: 3476477 - DNA, 21 bp, Homo sapiens
ccctgagctgaggcagcagtg

SEQ ID NO: 3476478 - DNA, 14 bp, Homo sapiens
ccctgcagccagct

SEQ ID NO: 3476479 - DNA, 17 bp, Homo sapiens
ccctgccaccctgggga

SEQ ID NO: 3476480 - DNA, 20 bp, Homo sapiens
ccctgccacctcctgcctca

SEQ ID NO: 3476481 - DNA, 14 bp, Homo sapiens
ccctgccagagcag

SEQ ID NO: 3476482 - DNA, 13 bp, Homo sapiens
ccctgccagctct

SEQ ID NO: 3476483 - DNA, 12 bp, Homo sapiens
ccctgccagggc

SEQ ID NO: 3476484 - DNA, 10 bp, Homo sapiens
ccctgcccat

SEQ ID NO: 3476485 - DNA, 22 bp, Homo sapiens
ccctgcccccaggactgggcca

SEQ ID NO: 3476486 - DNA, 23 bp, Homo sapiens
ccctgcccccaggactgggccac

SEQ ID NO: 3476487 - DNA, 17 bp, Homo sapiens
ccctgcccgtgtacata

SEQ ID NO: 3476488 - DNA, 14 bp, Homo sapiens
ccctgccctgtggg

SEQ ID NO: 3476489 - DNA, 17 bp, Homo sapiens
ccctgcggtagatggga

SEQ ID NO: 3476490 - DNA, 19 bp, Homo sapiens
ccctgctccagaagatagc

SEQ ID NO: 3476491 - DNA, 21 bp, Homo sapiens
ccctgctctccgaccagacac

SEQ ID NO: 3476492 - DNA, 22 bp, Homo sapiens
ccctgctctccgaccagacacc

SEQ ID NO: 3476493 - DNA, 19 bp, Homo sapiens
ccctgctgctgtcacctct

SEQ ID NO: 3476494 - DNA, 20 bp, Homo sapiens
ccctgctggttcagggttgg

SEQ ID NO: 3476495 - DNA, 14 bp, Homo sapiens
ccctgctgtctctc

SEQ ID NO: 3476496 - DNA, 15 bp, Homo sapiens
ccctgctgtctctct

SEQ ID NO: 3476497 - DNA, 16 bp, Homo sapiens
ccctggaagagcccag

SEQ ID NO: 3476498 - DNA, 17 bp, Homo sapiens
ccctggaagagcccagt

SEQ ID NO: 3476499 - DNA, 18 bp, Homo sapiens
ccctggaagagcccagtc

SEQ ID NO: 3476500 - DNA, 16 bp, Homo sapiens
ccctggacatgcctgt

SEQ ID NO: 3476501 - DNA, 20 bp, Homo sapiens
ccctggacatgcctgtcctg

SEQ ID NO: 3476502 - DNA, 17 bp, Homo sapiens
ccctggaccagtggtct

SEQ ID NO: 3476503 - DNA, 15 bp, Homo sapiens
ccctggaggctgcct

SEQ ID NO: 3476504 - DNA, 13 bp, Homo sapiens
ccctggaggtggc

SEQ ID NO: 3476505 - DNA, 20 bp, Homo sapiens
ccctggcctcccctgccacc

SEQ ID NO: 3476506 - DNA, 19 bp, Homo sapiens
ccctggcctctgtgccttc

SEQ ID NO: 3476507 - DNA, 15 bp, Homo sapiens
ccctggctaagaccc

SEQ ID NO: 3476508 - DNA, 12 bp, Homo sapiens
ccctggctcctt

SEQ ID NO: 3476509 - DNA, 16 bp, Homo sapiens
ccctggctccttcacc

SEQ ID NO: 3476510 - DNA, 16 bp, Homo sapiens
ccctggctctgggccg

SEQ ID NO: 3476511 - DNA, 23 bp, Homo sapiens
ccctggctgggacgtggctcagc

SEQ ID NO: 3476512 - DNA, 14 bp, Homo sapiens
ccctggcttctgtg

SEQ ID NO: 3476513 - DNA, 17 bp, Homo sapiens
ccctggggacagcaagg

SEQ ID NO: 3476514 - DNA, 19 bp, Homo sapiens
ccctggggacagcaagggc

SEQ ID NO: 3476515 - DNA, 20 bp, Homo sapiens
ccctggggacagcaagggct

SEQ ID NO: 3476516 - DNA, 21 bp, Homo sapiens
ccctggggctaggctggagcc

SEQ ID NO: 3476517 - DNA, 13 bp, Homo sapiens
ccctggggctggc

SEQ ID NO: 3476518 - DNA, 18 bp, Homo sapiens
ccctggggctggcttttc

SEQ ID NO: 3476519 - DNA, 15 bp, Homo sapiens
ccctggtggcagtgg

SEQ ID NO: 3476520 - DNA, 19 bp, Homo sapiens
ccctggtggcagtgggagc

SEQ ID NO: 3476521 - DNA, 23 bp, Homo sapiens
ccctggtgggccaacaaagaaca

SEQ ID NO: 3476522 - DNA, 22 bp, Homo sapiens
ccctggttctgatgatgtgcct

SEQ ID NO: 3476523 - DNA, 21 bp, Homo sapiens
ccctgtagagtgggagctgag

SEQ ID NO: 3476524 - DNA, 19 bp, Homo sapiens
ccctgtagttaggcctggc

SEQ ID NO: 3476525 - DNA, 17 bp, Homo sapiens
ccctgtatatagcccag

SEQ ID NO: 3476526 - DNA, 18 bp, Homo sapiens
ccctgtatatagcccagc

SEQ ID NO: 3476527 - DNA, 21 bp, Homo sapiens
ccctgtccggaatgccaccca

SEQ ID NO: 3476528 - DNA, 22 bp, Homo sapiens
ccctgtccggaatgccacccac

SEQ ID NO: 3476529 - DNA, 21 bp, Homo sapiens
ccctgtcgggctttgtgtgaa

SEQ ID NO: 3476530 - DNA, 23 bp, Homo sapiens
ccctgtgagtttgtacagtcttg

SEQ ID NO: 3476531 - DNA, 20 bp, Homo sapiens
ccctgtggatgagccctcag

SEQ ID NO: 3476532 - DNA, 22 bp, Homo sapiens
ccctgtggatgagccctcagaa

SEQ ID NO: 3476533 - DNA, 23 bp, Homo sapiens
ccctgtggatgagccctcagaac

SEQ ID NO: 3476534 - DNA, 20 bp, Homo sapiens
ccctgtgttagtaaaggggc

SEQ ID NO: 3476535 - DNA, 14 bp, Homo sapiens
ccctgttccccaga

SEQ ID NO: 3476536 - DNA, 17 bp, Homo sapiens
ccctgttccccagagaa

SEQ ID NO: 3476537 - DNA, 22 bp, Homo sapiens
ccctgttgaattttgttctctg

SEQ ID NO: 3476538 - DNA, 19 bp, Homo sapiens
cccttacctcggtgccttc

SEQ ID NO: 3476539 - DNA, 22 bp, Homo sapiens
cccttatagtttgggcttcagc

SEQ ID NO: 3476540 - DNA, 16 bp, Homo sapiens
cccttatctgtgctca

SEQ ID NO: 3476541 - DNA, 13 bp, Homo sapiens
cccttcacaaagc

SEQ ID NO: 3476542 - DNA, 16 bp, Homo sapiens
cccttcatcttcctgt

SEQ ID NO: 3476543 - DNA, 14 bp, Homo sapiens
cccttcccacagga

SEQ ID NO: 3476544 - DNA, 21 bp, Homo sapiens
cccttcccatgacccaggctg

SEQ ID NO: 3476545 - DNA, 14 bp, Homo sapiens
cccttcgctcctgt

SEQ ID NO: 3476546 - DNA, 16 bp, Homo sapiens
cccttctcagaatcta

SEQ ID NO: 3476547 - DNA, 23 bp, Homo sapiens
cccttctccatccacatgggagc

SEQ ID NO: 3476548 - DNA, 18 bp, Homo sapiens
cccttctcctcttgtaaa

SEQ ID NO: 3476549 - DNA, 23 bp, Homo sapiens
cccttctgctcagctctgggcca

SEQ ID NO: 3476550 - DNA, 16 bp, Homo sapiens
cccttctgtccctcac

SEQ ID NO: 3476551 - DNA, 17 bp, Homo sapiens
cccttgactttgctcct

SEQ ID NO: 3476552 - DNA, 19 bp, Homo sapiens
cccttgactttgctcctca

SEQ ID NO: 3476553 - DNA, 22 bp, Homo sapiens
cccttgaggaaacaacagcttt

SEQ ID NO: 3476554 - DNA, 19 bp, Homo sapiens
cccttgatttaaacacaca

SEQ ID NO: 3476555 - DNA, 20 bp, Homo sapiens
cccttgatttaaacacacag

SEQ ID NO: 3476556 - DNA, 19 bp, Homo sapiens
cccttgccatccattctgg

SEQ ID NO: 3476557 - DNA, 21 bp, Homo sapiens
cccttgctgtatgctgatcat

SEQ ID NO: 3476558 - DNA, 17 bp, Homo sapiens
cccttggaggccagcca

SEQ ID NO: 3476559 - DNA, 15 bp, Homo sapiens
cccttgtcccactca

SEQ ID NO: 3476560 - DNA, 22 bp, Homo sapiens
cccttgttgtaaaaagcccagc

SEQ ID NO: 3476561 - DNA, 21 bp, Homo sapiens
ccctttattgaaaaaataaaa

SEQ ID NO: 3476562 - DNA, 12 bp, Homo sapiens
ccctttgctgtc

SEQ ID NO: 3476563 - DNA, 23 bp, Homo sapiens
ccctttggagatgctgagggtgt

SEQ ID NO: 3476564 - DNA, 18 bp, Homo sapiens
ccctttggtttggcctcc

SEQ ID NO: 3476565 - DNA, 19 bp, Homo sapiens
ccctttggtttggcctcca

SEQ ID NO: 3476566 - DNA, 19 bp, Homo sapiens
cccttttttctgcctcctt

SEQ ID NO: 3476567 - DNA, 19 bp, Homo sapiens
ccgaaagggacttggaagc

SEQ ID NO: 3476568 - DNA, 18 bp, Homo sapiens
ccgaagccgcctgtggac

SEQ ID NO: 3476569 - DNA, 16 bp, Homo sapiens
ccgaatagctgggact

SEQ ID NO: 3476570 - DNA, 13 bp, Homo sapiens
ccgacagagggaa

SEQ ID NO: 3476571 - DNA, 17 bp, Homo sapiens
ccgactgctttggacct

SEQ ID NO: 3476572 - DNA, 20 bp, Homo sapiens
ccgagacagaccctctgccg

SEQ ID NO: 3476573 - DNA, 15 bp, Homo sapiens
ccgagaggtgggcca

SEQ ID NO: 3476574 - DNA, 19 bp, Homo sapiens
ccgagctttgaaaattcag

SEQ ID NO: 3476575 - DNA, 14 bp, Homo sapiens
ccgaggccttctct

SEQ ID NO: 3476576 - DNA, 22 bp, Homo sapiens
ccgagggaggggaagcttctgt

SEQ ID NO: 3476577 - DNA, 19 bp, Homo sapiens
ccgagtagctgggattaca

SEQ ID NO: 3476578 - DNA, 15 bp, Homo sapiens
ccgagtccaagctgg

SEQ ID NO: 3476579 - DNA, 15 bp, Homo sapiens
ccgcaaaccacactg

SEQ ID NO: 3476580 - DNA, 16 bp, Homo sapiens
ccgcagacaccttgga

SEQ ID NO: 3476581 - DNA, 14 bp, Homo sapiens
ccgcaggaagctgc

SEQ ID NO: 3476582 - DNA, 17 bp, Homo sapiens
ccgccaaggctggggga

SEQ ID NO: 3476583 - DNA, 20 bp, Homo sapiens
ccgccagggagacctggaca

SEQ ID NO: 3476584 - DNA, 17 bp, Homo sapiens
ccgccccctgccctccc

SEQ ID NO: 3476585 - DNA, 19 bp, Homo sapiens
ccgccggaggccagctatc

SEQ ID NO: 3476586 - DNA, 22 bp, Homo sapiens
ccgccggaggccagctatctgc

SEQ ID NO: 3476587 - DNA, 16 bp, Homo sapiens
ccgcctgaggccagcc

SEQ ID NO: 3476588 - DNA, 13 bp, Homo sapiens
ccgcctggccggc

SEQ ID NO: 3476589 - DNA, 14 bp, Homo sapiens
ccgcctggccggct

SEQ ID NO: 3476590 - DNA, 18 bp, Homo sapiens
ccgcctggccggctccag

SEQ ID NO: 3476591 - DNA, 14 bp, Homo sapiens
ccgcctggtactca

SEQ ID NO: 3476592 - DNA, 16 bp, Homo sapiens
ccgcgccacaggaccc

SEQ ID NO: 3476593 - DNA, 13 bp, Homo sapiens
ccgcgttgtaaaa

SEQ ID NO: 3476594 - DNA, 23 bp, Homo sapiens
ccgctgagcgaggagatgctcct

SEQ ID NO: 3476595 - DNA, 15 bp, Homo sapiens
ccgctgattctcagg

SEQ ID NO: 3476596 - DNA, 12 bp, Homo sapiens
ccgctgccaccc

SEQ ID NO: 3476597 - DNA, 14 bp, Homo sapiens
ccgctgccacccac

SEQ ID NO: 3476598 - DNA, 16 bp, Homo sapiens
ccgctgccacccacct

SEQ ID NO: 3476599 - DNA, 20 bp, Homo sapiens
ccgctgccacgttggagaag

SEQ ID NO: 3476600 - DNA, 18 bp, Homo sapiens
ccgcttccccacagaact

SEQ ID NO: 3476601 - DNA, 13 bp, Homo sapiens
ccgctttggcctg

SEQ ID NO: 3476602 - DNA, 14 bp, Homo sapiens
ccgctttggcctga

SEQ ID NO: 3476603 - DNA, 16 bp, Homo sapiens
ccgctttggcctgagt

SEQ ID NO: 3476604 - DNA, 16 bp, Homo sapiens
ccggaatgccacccac

SEQ ID NO: 3476605 - DNA, 12 bp, Homo sapiens
ccggactggtgc

SEQ ID NO: 3476606 - DNA, 16 bp, Homo sapiens
ccggactggtgccctc

SEQ ID NO: 3476607 - DNA, 21 bp, Homo sapiens
cctgccctgtaggaaggcaga

SEQ ID NO: 3476608 - DNA, 20 bp, Homo sapiens
cctgccgggctgagggcctg

SEQ ID NO: 3476609 - DNA, 15 bp, Homo sapiens
cctgccggtaaacac

SEQ ID NO: 3476610 - DNA, 20 bp, Homo sapiens
cctgccggtaaacacgcctg

SEQ ID NO: 3476611 - DNA, 11 bp, Homo sapiens
cctgcctcagc

SEQ ID NO: 3476612 - DNA, 17 bp, Homo sapiens
cctgcctccagggctgg

SEQ ID NO: 3476613 - DNA, 20 bp, Homo sapiens
cctgcctccagggctggact

SEQ ID NO: 3476614 - DNA, 21 bp, Homo sapiens
cctgcctccagggctggactg

SEQ ID NO: 3476615 - DNA, 17 bp, Homo sapiens
cctgcctcccttgactt

SEQ ID NO: 3476616 - DNA, 14 bp, Homo sapiens
cctgcctccttgaa

SEQ ID NO: 3476617 - DNA, 15 bp, Homo sapiens
cctgcctcttctcta

SEQ ID NO: 3476618 - DNA, 14 bp, Homo sapiens
cctgcctgccaccc

SEQ ID NO: 3476619 - DNA, 16 bp, Homo sapiens
cctgcctgtagcccac

SEQ ID NO: 3476620 - DNA, 19 bp, Homo sapiens
cctgccttaccgagagcca

SEQ ID NO: 3476621 - DNA, 14 bp, Homo sapiens
cctgccttcctcct

SEQ ID NO: 3476622 - DNA, 11 bp, Homo sapiens
cctgcctttgc

SEQ ID NO: 3476623 - DNA, 14 bp, Homo sapiens
cctgcctttgcctc

SEQ ID NO: 3476624 - DNA, 20 bp, Homo sapiens
cctgcgccaccgcccagaga

SEQ ID NO: 3476625 - DNA, 14 bp, Homo sapiens
cctgcgcctgctgc

SEQ ID NO: 3476626 - DNA, 14 bp, Homo sapiens
cctgcgcctgtgat

SEQ ID NO: 3476627 - DNA, 15 bp, Homo sapiens
cctgcgcctgtgatg

SEQ ID NO: 3476628 - DNA, 16 bp, Homo sapiens
cctgcggcaggactgc

SEQ ID NO: 3476629 - DNA, 22 bp, Homo sapiens
cctgcggcaggactgcagagca

SEQ ID NO: 3476630 - DNA, 24 bp, Homo sapiens
cctgcggcaggactgcagagcaga

SEQ ID NO: 3476631 - DNA, 15 bp, Homo sapiens
cctgcgggaagctga

SEQ ID NO: 3476632 - DNA, 18 bp, Homo sapiens
cctgcgggaagctgacct

SEQ ID NO: 3476633 - DNA, 19 bp, Homo sapiens
cctgcgggaagctgacctt

SEQ ID NO: 3476634 - DNA, 24 bp, Homo sapiens
cctgcgggtggggcttggggctca

SEQ ID NO: 3476635 - DNA, 23 bp, Homo sapiens
cctgcggtagatgggagggaggc

SEQ ID NO: 3476636 - DNA, 13 bp, Homo sapiens
cctgctactctgt

SEQ ID NO: 3476637 - DNA, 15 bp, Homo sapiens
cctgctccagacctg

SEQ ID NO: 3476638 - DNA, 16 bp, Homo sapiens
cctgctccagacctga

SEQ ID NO: 3476639 - DNA, 12 bp, Homo sapiens
cctgctccagct

SEQ ID NO: 3476640 - DNA, 13 bp, Homo sapiens
cctgctccagctg

SEQ ID NO: 3476641 - DNA, 22 bp, Homo sapiens
cctgctccagctgttcagctgg

SEQ ID NO: 3476642 - DNA, 21 bp, Homo sapiens
cctgctgcatgccctctcagg

SEQ ID NO: 3476643 - DNA, 23 bp, Homo sapiens
cctgctgcatgccctctcaggcc

SEQ ID NO: 3476644 - DNA, 18 bp, Homo sapiens
cctgctgctgccagggct

SEQ ID NO: 3476645 - DNA, 20 bp, Homo sapiens
cctgctgctgccagggcttc

SEQ ID NO: 3476646 - DNA, 16 bp, Homo sapiens
cctgctgctgcctgcc

SEQ ID NO: 3476647 - DNA, 16 bp, Homo sapiens
cctgctgctgtcacct

SEQ ID NO: 3476648 - DNA, 23 bp, Homo sapiens
cctgctgctgtcacctctcccac

SEQ ID NO: 3476649 - DNA, 12 bp, Homo sapiens
cctgctgcttct

SEQ ID NO: 3476650 - DNA, 13 bp, Homo sapiens
cctgctggaagcc

SEQ ID NO: 3476651 - DNA, 17 bp, Homo sapiens
cctgctggaagcccagc

SEQ ID NO: 3476652 - DNA, 16 bp, Homo sapiens
cctgctggaggcctca

SEQ ID NO: 3476653 - DNA, 21 bp, Homo sapiens
cctgctggaggcctcaggtgc

SEQ ID NO: 3476654 - DNA, 22 bp, Homo sapiens
cctgctggaggcctcaggtgct

SEQ ID NO: 3476655 - DNA, 13 bp, Homo sapiens
cctgctggttcag

SEQ ID NO: 3476656 - DNA, 13 bp, Homo sapiens
cctgctggtttta

SEQ ID NO: 3476657 - DNA, 19 bp, Homo sapiens
cctgctgtctctctgggct

SEQ ID NO: 3476658 - DNA, 22 bp, Homo sapiens
cctgctgttggtcctctctctg

SEQ ID NO: 3476659 - DNA, 23 bp, Homo sapiens
cctgctgttggtcctctctctgt

SEQ ID NO: 3476660 - DNA, 15 bp, Homo sapiens
cctgctttggcgggc

SEQ ID NO: 3476661 - DNA, 15 bp, Homo sapiens
cctggaagacagaga

SEQ ID NO: 3476662 - DNA, 15 bp, Homo sapiens
cctggaagagcccag

SEQ ID NO: 3476663 - DNA, 24 bp, Homo sapiens
cctggacatgaagattctttccca

SEQ ID NO: 3476664 - DNA, 12 bp, Homo sapiens
cctggacatgcc

SEQ ID NO: 3476665 - DNA, 14 bp, Homo sapiens
cctggacatgcctg

SEQ ID NO: 3476666 - DNA, 18 bp, Homo sapiens
cctggacatgcctgtcct

SEQ ID NO: 3476667 - DNA, 14 bp, Homo sapiens
cctggaccctgtgg

SEQ ID NO: 3476668 - DNA, 19 bp, Homo sapiens
cctggagacttagggcacc

SEQ ID NO: 3476669 - DNA, 23 bp, Homo sapiens
cctggagacttagggcaccaggg

SEQ ID NO: 3476670 - DNA, 16 bp, Homo sapiens
cctggagatcctcctg

SEQ ID NO: 3476671 - DNA, 18 bp, Homo sapiens
cctggagatcctcctgca

SEQ ID NO: 3476672 - DNA, 14 bp, Homo sapiens
cctggagctctgtg

SEQ ID NO: 3476673 - DNA, 17 bp, Homo sapiens
cctggaggctgcctccc

SEQ ID NO: 3476674 - DNA, 22 bp, Homo sapiens
cctggaggtggctgagcccctg

SEQ ID NO: 3476675 - DNA, 23 bp, Homo sapiens
cctggaggtggctgagcccctgt

SEQ ID NO: 3476676 - DNA, 22 bp, Homo sapiens
cctggagtgtatgactgcacat

SEQ ID NO: 3476677 - DNA, 16 bp, Homo sapiens
cctggagttgcattga

SEQ ID NO: 3476678 - DNA, 23 bp, Homo sapiens
cctggatgggcctttgagcctga

SEQ ID NO: 3476679 - DNA, 18 bp, Homo sapiens
cctggatgtctgaacttt

SEQ ID NO: 3476680 - DNA, 18 bp, Homo sapiens
cctggcacccggcccctg

SEQ ID NO: 3476681 - DNA, 20 bp, Homo sapiens
cctggcacccggcccctgct

SEQ ID NO: 3476682 - DNA, 21 bp, Homo sapiens
cctggcacccggcccctgctg

SEQ ID NO: 3476683 - DNA, 12 bp, Homo sapiens
cctggcagctct

SEQ ID NO: 3476684 - DNA, 15 bp, Homo sapiens
cctggcagctctgga

SEQ ID NO: 3476685 - DNA, 23 bp, Homo sapiens
cctggcatcgcaccattctgact

SEQ ID NO: 3476686 - DNA, 13 bp, Homo sapiens
cctggcatttcac

SEQ ID NO: 3476687 - DNA, 15 bp, Homo sapiens
cctggccagatgcac

SEQ ID NO: 3476688 - DNA, 20 bp, Homo sapiens
cctggccagatgcaccagcc

SEQ ID NO: 3476689 - DNA, 14 bp, Homo sapiens
cctggccagggcct

SEQ ID NO: 3476690 - DNA, 17 bp, Homo sapiens
cctggccccgcctgcct

SEQ ID NO: 3476691 - DNA, 14 bp, Homo sapiens
cctggcccggcccc

SEQ ID NO: 3476692 - DNA, 18 bp, Homo sapiens
cctggccctgttctcctc

SEQ ID NO: 3476693 - DNA, 19 bp, Homo sapiens
cctggccgcctccaggagc

SEQ ID NO: 3476694 - DNA, 13 bp, Homo sapiens
cctggccggctcc

SEQ ID NO: 3476695 - DNA, 15 bp, Homo sapiens
cctggccggctccag

SEQ ID NO: 3476696 - DNA, 16 bp, Homo sapiens
cctggccggctccagt

SEQ ID NO: 3476697 - DNA, 15 bp, Homo sapiens
cctggctccttcacc

SEQ ID NO: 3476698 - DNA, 11 bp, Homo sapiens
cctggctctga

SEQ ID NO: 3476699 - DNA, 13 bp, Homo sapiens
cctggctctgggc

SEQ ID NO: 3476700 - DNA, 22 bp, Homo sapiens
cctggcttcaggcaattctcct

SEQ ID NO: 3476701 - DNA, 14 bp, Homo sapiens
cctggcttctgtgg

SEQ ID NO: 3476702 - DNA, 16 bp, Homo sapiens
cctggcttctgtgggg

SEQ ID NO: 3476703 - DNA, 23 bp, Homo sapiens
cctgggacatcaggagactgggc

SEQ ID NO: 3476704 - DNA, 22 bp, Homo sapiens
cctgggagaaatctggcttctg

SEQ ID NO: 3476705 - DNA, 20 bp, Homo sapiens
cctgggaggtcaaggctgca

SEQ ID NO: 3476706 - DNA, 16 bp, Homo sapiens
cctgggagtgagctgg

SEQ ID NO: 3476707 - DNA, 18 bp, Homo sapiens
cctgggagtgagctggtt

SEQ ID NO: 3476708 - DNA, 13 bp, Homo sapiens
cctgggcaaagcc

SEQ ID NO: 3476709 - DNA, 19 bp, Homo sapiens
cctgggcagcatactgaga

SEQ ID NO: 3476710 - DNA, 18 bp, Homo sapiens
cctgggccctctctgctc

SEQ ID NO: 3476711 - DNA, 14 bp, Homo sapiens
cctgggccctgggc

SEQ ID NO: 3476712 - DNA, 16 bp, Homo sapiens
cctgggccctgggctg

SEQ ID NO: 3476713 - DNA, 13 bp, Homo sapiens
cctgggccgctgc

SEQ ID NO: 3476714 - DNA, 19 bp, Homo sapiens
cctgggctgggtggcccct

SEQ ID NO: 3476715 - DNA, 21 bp, Homo sapiens
cctgggctgggtggcccctgt

SEQ ID NO: 3476716 - DNA, 17 bp, Homo sapiens
cctgggctgtgatgtga

SEQ ID NO: 3476717 - DNA, 13 bp, Homo sapiens
cctggggacccac

SEQ ID NO: 3476718 - DNA, 13 bp, Homo sapiens
cctggggcctgac

SEQ ID NO: 3476719 - DNA, 20 bp, Homo sapiens
cctggggctaggctggagcc

SEQ ID NO: 3476720 - DNA, 14 bp, Homo sapiens
cctggggctggctt

SEQ ID NO: 3476721 - DNA, 16 bp, Homo sapiens
cctgggggctctcatg

SEQ ID NO: 3476722 - DNA, 14 bp, Homo sapiens
cctgggggtgccag

SEQ ID NO: 3476723 - DNA, 22 bp, Homo sapiens
cctggggtaccaagagactcct

SEQ ID NO: 3476724 - DNA, 21 bp, Homo sapiens
cctggggtggggatagggagc

SEQ ID NO: 3476725 - DNA, 13 bp, Homo sapiens
cctggggttgtca

SEQ ID NO: 3476726 - DNA, 18 bp, Homo sapiens
cctgggtggtctgcaggc

SEQ ID NO: 3476727 - DNA, 21 bp, Homo sapiens
cctgggtggtctgcaggcagg

SEQ ID NO: 3476728 - DNA, 17 bp, Homo sapiens
cctgggttgcagacagg

SEQ ID NO: 3476729 - DNA, 19 bp, Homo sapiens
cctgggttttgtattctct

SEQ ID NO: 3476730 - DNA, 20 bp, Homo sapiens
cctgggttttgtattctctg

SEQ ID NO: 3476731 - DNA, 17 bp, Homo sapiens
cctgggttttgttccct

SEQ ID NO: 3476732 - DNA, 15 bp, Homo sapiens
cctggtactcaagcc

SEQ ID NO: 3476733 - DNA, 10 bp, Homo sapiens
cctggtgccc

SEQ ID NO: 3476734 - DNA, 20 bp, Homo sapiens
cctggtgctgcctctacctg

SEQ ID NO: 3476735 - DNA, 13 bp, Homo sapiens
cctggtggcagct

SEQ ID NO: 3476736 - DNA, 14 bp, Homo sapiens
cctggtggcagctg

SEQ ID NO: 3476737 - DNA, 16 bp, Homo sapiens
cctggtggcagctgcg

SEQ ID NO: 3476738 - DNA, 14 bp, Homo sapiens
cctggtgggccaac

SEQ ID NO: 3476739 - DNA, 23 bp, Homo sapiens
cctggtgggccaacaaagaacac

SEQ ID NO: 3476740 - DNA, 20 bp, Homo sapiens
cggagtcccaccttggctgc

SEQ ID NO: 3476741 - DNA, 22 bp, Homo sapiens
cggagtcccaccttggctgcag

SEQ ID NO: 3476742 - DNA, 16 bp, Homo sapiens
cggatctgagaatctt

SEQ ID NO: 3476743 - DNA, 12 bp, Homo sapiens
cggcaacatcaa

SEQ ID NO: 3476744 - DNA, 14 bp, Homo sapiens
cggcacagatgctc

SEQ ID NO: 3476745 - DNA, 18 bp, Homo sapiens
cggcacagatgctccagg

SEQ ID NO: 3476746 - DNA, 17 bp, Homo sapiens
cggcacggtcttccctc

SEQ ID NO: 3476747 - DNA, 15 bp, Homo sapiens
cggcagccccagcct

SEQ ID NO: 3476748 - DNA, 21 bp, Homo sapiens
cggcaggacaacgaggaagcc

SEQ ID NO: 3476749 - DNA, 22 bp, Homo sapiens
cggcaggacaacgaggaagccc

SEQ ID NO: 3476750 - DNA, 15 bp, Homo sapiens
cggcaggactgcaga

SEQ ID NO: 3476751 - DNA, 17 bp, Homo sapiens
cggcaggggcctggaga

SEQ ID NO: 3476752 - DNA, 18 bp, Homo sapiens
cggcaggggcctggagat

SEQ ID NO: 3476753 - DNA, 18 bp, Homo sapiens
cggcatgtttccagcaga

SEQ ID NO: 3476754 - DNA, 20 bp, Homo sapiens
cggccaaacagacaggtgga

SEQ ID NO: 3476755 - DNA, 16 bp, Homo sapiens
cggccagggagaagct

SEQ ID NO: 3476756 - DNA, 20 bp, Homo sapiens
cggcccatccccaggcacct

SEQ ID NO: 3476757 - DNA, 17 bp, Homo sapiens
cggccctgcagccagct

SEQ ID NO: 3476758 - DNA, 16 bp, Homo sapiens
cggccggccagcccct

SEQ ID NO: 3476759 - DNA, 23 bp, Homo sapiens
cggccggccagcccctggcccca

SEQ ID NO: 3476760 - DNA, 20 bp, Homo sapiens
cggcctagggcccccacagt

SEQ ID NO: 3476761 - DNA, 15 bp, Homo sapiens
cggcctcccaaagtg

SEQ ID NO: 3476762 - DNA, 15 bp, Homo sapiens
cggcctgtcctccaa

SEQ ID NO: 3476763 - DNA, 16 bp, Homo sapiens
cggctcactgcagcct

SEQ ID NO: 3476764 - DNA, 15 bp, Homo sapiens
cggctccaggctcct

SEQ ID NO: 3476765 - DNA, 14 bp, Homo sapiens
cggctcccagcctc

SEQ ID NO: 3476766 - DNA, 17 bp, Homo sapiens
cggctcccagcctcagc

SEQ ID NO: 3476767 - DNA, 19 bp, Homo sapiens
cggctcccagcctcagcgc

SEQ ID NO: 3476768 - DNA, 16 bp, Homo sapiens
cggctcccccaggcct

SEQ ID NO: 3476769 - DNA, 19 bp, Homo sapiens
cggctcccccaggcctgag

SEQ ID NO: 3476770 - DNA, 21 bp, Homo sapiens
cggctcccccaggcctgagct

SEQ ID NO: 3476771 - DNA, 20 bp, Homo sapiens
cggctcgagcagtcctgcct

SEQ ID NO: 3476772 - DNA, 16 bp, Homo sapiens
cggctcggaggaagcc

SEQ ID NO: 3476773 - DNA, 11 bp, Homo sapiens
cggctgaccat

SEQ ID NO: 3476774 - DNA, 22 bp, Homo sapiens
cggctgaccatgctcatctgct

SEQ ID NO: 3476775 - DNA, 23 bp, Homo sapiens
cggctgaccatgctcatctgctg

SEQ ID NO: 3476776 - DNA, 15 bp, Homo sapiens
cggctgcagaggcca

SEQ ID NO: 3476777 - DNA, 14 bp, Homo sapiens
cggctggcagccca

SEQ ID NO: 3476778 - DNA, 12 bp, Homo sapiens
cggctgggcaca

SEQ ID NO: 3476779 - DNA, 16 bp, Homo sapiens
cggctgggcacacgcc

SEQ ID NO: 3476780 - DNA, 19 bp, Homo sapiens
cggcttggatcctgggctg

SEQ ID NO: 3476781 - DNA, 16 bp, Homo sapiens
cggcttttctcagctg

SEQ ID NO: 3476782 - DNA, 22 bp, Homo sapiens
cgggactcaggcgggacagtgc

SEQ ID NO: 3476783 - DNA, 21 bp, Homo sapiens
cgggaggatgttctgggacac

SEQ ID NO: 3476784 - DNA, 20 bp, Homo sapiens
cgggaggtcgaggcaggagg

SEQ ID NO: 3476785 - DNA, 14 bp, Homo sapiens
cgggcagagggctg

SEQ ID NO: 3476786 - DNA, 18 bp, Homo sapiens
cgggcagagggctggagg

SEQ ID NO: 3476787 - DNA, 12 bp, Homo sapiens
cgggccacagag

SEQ ID NO: 3476788 - DNA, 18 bp, Homo sapiens
cgggccagggctgcccct

SEQ ID NO: 3476789 - DNA, 19 bp, Homo sapiens
cgggcccagaccggcttct

SEQ ID NO: 3476790 - DNA, 19 bp, Homo sapiens
cgggctcagcaaaagatgc

SEQ ID NO: 3476791 - DNA, 14 bp, Homo sapiens
cgggctccagccat

SEQ ID NO: 3476792 - DNA, 14 bp, Homo sapiens
cggggacagctcct

SEQ ID NO: 3476793 - DNA, 15 bp, Homo sapiens
cggggacagctcctt

SEQ ID NO: 3476794 - DNA, 22 bp, Homo sapiens
cggggagggtgacagtggccgc

SEQ ID NO: 3476795 - DNA, 23 bp, Homo sapiens
cggggctcttctcatttcacccc

SEQ ID NO: 3476796 - DNA, 16 bp, Homo sapiens
cgggggcaggtgctgg

SEQ ID NO: 3476797 - DNA, 14 bp, Homo sapiens
cggggtagaggctg

SEQ ID NO: 3476798 - DNA, 19 bp, Homo sapiens
cggggtagaggctgggagg

SEQ ID NO: 3476799 - DNA, 15 bp, Homo sapiens
cggggtatcctgggg

SEQ ID NO: 3476800 - DNA, 21 bp, Homo sapiens
cggggtatcctgggggaccca

SEQ ID NO: 3476801 - DNA, 20 bp, Homo sapiens
cggggttcgcgcaccaggtg

SEQ ID NO: 3476802 - DNA, 17 bp, Homo sapiens
cgggtccccagctcccc

SEQ ID NO: 3476803 - DNA, 20 bp, Homo sapiens
cgggtccccagctccccagg

SEQ ID NO: 3476804 - DNA, 20 bp, Homo sapiens
cgggtgaacaaagcagccac

SEQ ID NO: 3476805 - DNA, 16 bp, Homo sapiens
cgggtggggcttgggg

SEQ ID NO: 3476806 - DNA, 21 bp, Homo sapiens
cggtagccagcacacagggca

SEQ ID NO: 3476807 - DNA, 18 bp, Homo sapiens
cggtaggttcagccaagg

SEQ ID NO: 3476808 - DNA, 18 bp, Homo sapiens
cggtatccccccatcttg

SEQ ID NO: 3476809 - DNA, 16 bp, Homo sapiens
cggtccacccaggagc

SEQ ID NO: 3476810 - DNA, 20 bp, Homo sapiens
cggtccacccaggagccccg

SEQ ID NO: 3476811 - DNA, 14 bp, Homo sapiens
cggtgccatgtctg

SEQ ID NO: 3476812 - DNA, 14 bp, Homo sapiens
cggtgcccaagcca

SEQ ID NO: 3476813 - DNA, 18 bp, Homo sapiens
cggtgcccaagccagagg

SEQ ID NO: 3476814 - DNA, 22 bp, Homo sapiens
cggtgccttttttcacggaagt

SEQ ID NO: 3476815 - DNA, 14 bp, Homo sapiens
cggtgctccaggca

SEQ ID NO: 3476816 - DNA, 16 bp, Homo sapiens
cggtgctgtcctcagg

SEQ ID NO: 3476817 - DNA, 22 bp, Homo sapiens
cggtggctcacgcctgtaatcc

SEQ ID NO: 3476818 - DNA, 12 bp, Homo sapiens
cggtggctgggc

SEQ ID NO: 3476819 - DNA, 14 bp, Homo sapiens
cggtgtccccagag

SEQ ID NO: 3476820 - DNA, 15 bp, Homo sapiens
cggtgtcttgttctg

SEQ ID NO: 3476821 - DNA, 18 bp, Homo sapiens
cggtgtggagaagcggct

SEQ ID NO: 3476822 - DNA, 16 bp, Homo sapiens
cggttcctgtccctgc

SEQ ID NO: 3476823 - DNA, 15 bp, Homo sapiens
cggtttgaagcctgg

SEQ ID NO: 3476824 - DNA, 12 bp, Homo sapiens
cgtacacagaga

SEQ ID NO: 3476825 - DNA, 16 bp, Homo sapiens
cgtagaattccttcga

SEQ ID NO: 3476826 - DNA, 16 bp, Homo sapiens
cgtagccagctgctcc

SEQ ID NO: 3476827 - DNA, 21 bp, Homo sapiens
cgtatctccggctcccagcct

SEQ ID NO: 3476828 - DNA, 15 bp, Homo sapiens
cgtcaacgttgtact

SEQ ID NO: 3476829 - DNA, 21 bp, Homo sapiens
cgtcaacgttgtactgtatgt

SEQ ID NO: 3476830 - DNA, 12 bp, Homo sapiens
cgtcatctcagg

SEQ ID NO: 3476831 - DNA, 13 bp, Homo sapiens
cgtcatctcaggg

SEQ ID NO: 3476832 - DNA, 14 bp, Homo sapiens
cgtccacagcttcc

SEQ ID NO: 3476833 - DNA, 16 bp, Homo sapiens
cgtccacagcttcctg

SEQ ID NO: 3476834 - DNA, 20 bp, Homo sapiens
cgtccggcagttctgggtgc

SEQ ID NO: 3476835 - DNA, 18 bp, Homo sapiens
cgtcctccgtccatatca

SEQ ID NO: 3476836 - DNA, 14 bp, Homo sapiens
cgtcctcctctgtg

SEQ ID NO: 3476837 - DNA, 15 bp, Homo sapiens
cgtcctcctctgtga

SEQ ID NO: 3476838 - DNA, 14 bp, Homo sapiens
cgtcctgcctgtgg

SEQ ID NO: 3476839 - DNA, 15 bp, Homo sapiens
cgtcctgcctgtggc

SEQ ID NO: 3476840 - DNA, 16 bp, Homo sapiens
cgtcctgcctgtggcg

SEQ ID NO: 3476841 - DNA, 14 bp, Homo sapiens
cgtctccaggggct

SEQ ID NO: 3476842 - DNA, 20 bp, Homo sapiens
cgtctgacaggcaatgctgg

SEQ ID NO: 3476843 - DNA, 14 bp, Homo sapiens
cgtctgttccccct

SEQ ID NO: 3476844 - DNA, 17 bp, Homo sapiens
cgtgaaaacggagctga

SEQ ID NO: 3476845 - DNA, 17 bp, Homo sapiens
cgtgaagtatactgtat

SEQ ID NO: 3476846 - DNA, 20 bp, Homo sapiens
cgtgaccctctgctgaagac

SEQ ID NO: 3476847 - DNA, 14 bp, Homo sapiens
cgtgagccccatct

SEQ ID NO: 3476848 - DNA, 15 bp, Homo sapiens
cgtgagctcttgtga

SEQ ID NO: 3476849 - DNA, 22 bp, Homo sapiens
cgtgatcaaagccacactctgg

SEQ ID NO: 3476850 - DNA, 13 bp, Homo sapiens
cgtgatcttggct

SEQ ID NO: 3476851 - DNA, 18 bp, Homo sapiens
cgtgcacacaccagagcc

SEQ ID NO: 3476852 - DNA, 15 bp, Homo sapiens
cgtgcacttcccaga

SEQ ID NO: 3476853 - DNA, 21 bp, Homo sapiens
cgtgcagtggtgcgatctggg

SEQ ID NO: 3476854 - DNA, 13 bp, Homo sapiens
cgtgcccctgctg

SEQ ID NO: 3476855 - DNA, 15 bp, Homo sapiens
cgtgcctgtgtccat

SEQ ID NO: 3476856 - DNA, 12 bp, Homo sapiens
cgtgctatgaca

SEQ ID NO: 3476857 - DNA, 22 bp, Homo sapiens
cgtgcttgtttgctcacctggg

SEQ ID NO: 3476858 - DNA, 16 bp, Homo sapiens
cgtggacaggtgtgcc

SEQ ID NO: 3476859 - DNA, 17 bp, Homo sapiens
cgtggattcgcttgagt

SEQ ID NO: 3476860 - DNA, 22 bp, Homo sapiens
cgtggctaagagtgtcctagga

SEQ ID NO: 3476861 - DNA, 15 bp, Homo sapiens
cgtggctcagccagc

SEQ ID NO: 3476862 - DNA, 18 bp, Homo sapiens
cgtggctcagccagcact

SEQ ID NO: 3476863 - DNA, 17 bp, Homo sapiens
cgtggtatgtctgccat

SEQ ID NO: 3476864 - DNA, 20 bp, Homo sapiens
cgtgtaaccatggacccaat

SEQ ID NO: 3476865 - DNA, 22 bp, Homo sapiens
cgtgtagctatggaagttgcat

SEQ ID NO: 3476866 - DNA, 22 bp, Homo sapiens
cgtgtgagaagtgaatgctggg

SEQ ID NO: 3476867 - DNA, 23 bp, Homo sapiens
cgtgtgagaagtgaatgctggga

SEQ ID NO: 3476868 - DNA, 19 bp, Homo sapiens
cgttaggcatttcctgctg

SEQ ID NO: 3476869 - DNA, 12 bp, Homo sapiens
cgttctgtgcac

SEQ ID NO: 3476870 - DNA, 17 bp, Homo sapiens
cgttgatgttggctggg

SEQ ID NO: 3476871 - DNA, 14 bp, Homo sapiens
cgttgctttcactc

SEQ ID NO: 3476872 - DNA, 23 bp, Homo sapiens
cgttggtctctgcatttttctgc

SEQ ID NO: 3476873 - DNA, 21 bp, Homo sapiens
ctcctcttgtaaataaagccc

SEQ ID NO: 3476874 - DNA, 18 bp, Homo sapiens
ctcctgacccattgctgt

SEQ ID NO: 3476875 - DNA, 20 bp, Homo sapiens
ctcctgagaaaaaaggttcc

SEQ ID NO: 3476876 - DNA, 17 bp, Homo sapiens
ctcctgaggctttggat

SEQ ID NO: 3476877 - DNA, 22 bp, Homo sapiens
ctcctgcacttacttgcttatt

SEQ ID NO: 3476878 - DNA, 21 bp, Homo sapiens
ctcctgcccgcagacctctgg

SEQ ID NO: 3476879 - DNA, 22 bp, Homo sapiens
ctcctgcccgcagacctctgga

SEQ ID NO: 3476880 - DNA, 14 bp, Homo sapiens
ctcctgcctcagcc

SEQ ID NO: 3476881 - DNA, 15 bp, Homo sapiens
ctcctgcctcagcct

SEQ ID NO: 3476882 - DNA, 20 bp, Homo sapiens
ctcctgcctcgaactggctg

SEQ ID NO: 3476883 - DNA, 15 bp, Homo sapiens
ctcctgcctttgcct

SEQ ID NO: 3476884 - DNA, 16 bp, Homo sapiens
ctcctgcctttgcctc

SEQ ID NO: 3476885 - DNA, 19 bp, Homo sapiens
ctcctggcccactgcatcg

SEQ ID NO: 3476886 - DNA, 12 bp, Homo sapiens
ctcctgggccct

SEQ ID NO: 3476887 - DNA, 19 bp, Homo sapiens
ctcctgggccctctctgct

SEQ ID NO: 3476888 - DNA, 13 bp, Homo sapiens
ctcctgtggcccc

SEQ ID NO: 3476889 - DNA, 19 bp, Homo sapiens
ctcctgtggccccaccctg

SEQ ID NO: 3476890 - DNA, 13 bp, Homo sapiens
ctccttcaccacc

SEQ ID NO: 3476891 - DNA, 14 bp, Homo sapiens
ctccttcagccctc

SEQ ID NO: 3476892 - DNA, 20 bp, Homo sapiens
ctccttcagccctcacccct

SEQ ID NO: 3476893 - DNA, 14 bp, Homo sapiens
ctccttccagtgtc

SEQ ID NO: 3476894 - DNA, 11 bp, Homo sapiens
ctccttcccaa

SEQ ID NO: 3476895 - DNA, 15 bp, Homo sapiens
ctccttccccacttc

SEQ ID NO: 3476896 - DNA, 16 bp, Homo sapiens
ctccttcctggcctga

SEQ ID NO: 3476897 - DNA, 20 bp, Homo sapiens
ctccttgagagaccaggcaa

SEQ ID NO: 3476898 - DNA, 18 bp, Homo sapiens
ctccttggaggacagtgg

SEQ ID NO: 3476899 - DNA, 16 bp, Homo sapiens
ctccttgtggcctggg

SEQ ID NO: 3476900 - DNA, 13 bp, Homo sapiens
ctccttgttccta

SEQ ID NO: 3476901 - DNA, 15 bp, Homo sapiens
ctcctttcaccacat

SEQ ID NO: 3476902 - DNA, 18 bp, Homo sapiens
ctcctttccccttccttt

SEQ ID NO: 3476903 - DNA, 17 bp, Homo sapiens
ctcctttgtactttgtg

SEQ ID NO: 3476904 - DNA, 20 bp, Homo sapiens
ctcctttgtactttgtgctt

SEQ ID NO: 3476905 - DNA, 14 bp, Homo sapiens
ctcgaactggctgc

SEQ ID NO: 3476906 - DNA, 14 bp, Homo sapiens
ctcgaatctctgtg

SEQ ID NO: 3476907 - DNA, 15 bp, Homo sapiens
ctcgaatctctgtgc

SEQ ID NO: 3476908 - DNA, 19 bp, Homo sapiens
ctcgacatcactgttcatg

SEQ ID NO: 3476909 - DNA, 19 bp, Homo sapiens
ctcgagaactttcattttt

SEQ ID NO: 3476910 - DNA, 21 bp, Homo sapiens
ctcgaggtgccttcttcaggg

SEQ ID NO: 3476911 - DNA, 16 bp, Homo sapiens
ctcgagtactgtgggc

SEQ ID NO: 3476912 - DNA, 17 bp, Homo sapiens
ctcgagtactgtgggca

SEQ ID NO: 3476913 - DNA, 22 bp, Homo sapiens
ctcgagtactgtgggcaattta

SEQ ID NO: 3476914 - DNA, 20 bp, Homo sapiens
ctcgattttgtatctgcagg

SEQ ID NO: 3476915 - DNA, 14 bp, Homo sapiens
ctcgcaagctgggt

SEQ ID NO: 3476916 - DNA, 14 bp, Homo sapiens
ctcgcatcttccca

SEQ ID NO: 3476917 - DNA, 12 bp, Homo sapiens
ctcgctgccagc

SEQ ID NO: 3476918 - DNA, 22 bp, Homo sapiens
ctcgcttggacggctgggcaca

SEQ ID NO: 3476919 - DNA, 22 bp, Homo sapiens
ctcggaactgcatgctgctgga

SEQ ID NO: 3476920 - DNA, 22 bp, Homo sapiens
ctcggctcagtgcaacctctgc

SEQ ID NO: 3476921 - DNA, 17 bp, Homo sapiens
ctcggcttggatcctgg

SEQ ID NO: 3476922 - DNA, 18 bp, Homo sapiens
ctcggcttttctcagctg

SEQ ID NO: 3476923 - DNA, 13 bp, Homo sapiens
ctcggtttctcca

SEQ ID NO: 3476924 - DNA, 16 bp, Homo sapiens
ctcggtttgccaaaat

SEQ ID NO: 3476925 - DNA, 21 bp, Homo sapiens
ctctaaagagtttattttaag

SEQ ID NO: 3476926 - DNA, 18 bp, Homo sapiens
ctctaaatgggaaagtat

SEQ ID NO: 3476927 - DNA, 16 bp, Homo sapiens
ctctaacagctcagga

SEQ ID NO: 3476928 - DNA, 14 bp, Homo sapiens
ctctaacctcgccc

SEQ ID NO: 3476929 - DNA, 13 bp, Homo sapiens
ctctacaaaaagc

SEQ ID NO: 3476930 - DNA, 23 bp, Homo sapiens
ctctaccagataactgaggaggg

SEQ ID NO: 3476931 - DNA, 13 bp, Homo sapiens
ctctacccagggc

SEQ ID NO: 3476932 - DNA, 17 bp, Homo sapiens
ctctacccagggcctgc

SEQ ID NO: 3476933 - DNA, 22 bp, Homo sapiens
ctctacctgacactcccttggg

SEQ ID NO: 3476934 - DNA, 21 bp, Homo sapiens
ctctactaacaatcagctcct

SEQ ID NO: 3476935 - DNA, 18 bp, Homo sapiens
ctctactgttgcaaagct

SEQ ID NO: 3476936 - DNA, 17 bp, Homo sapiens
ctctacttaatccaatg

SEQ ID NO: 3476937 - DNA, 21 bp, Homo sapiens
ctctagaaataggttaaactg

SEQ ID NO: 3476938 - DNA, 20 bp, Homo sapiens
ctctagaagtgccatctcaa

SEQ ID NO: 3476939 - DNA, 21 bp, Homo sapiens
ctctagaagtgccatctcaat

SEQ ID NO: 3476940 - DNA, 20 bp, Homo sapiens
ctctagctgggggtgggcca

SEQ ID NO: 3476941 - DNA, 12 bp, Homo sapiens
ctctaggctctg

SEQ ID NO: 3476942 - DNA, 22 bp, Homo sapiens
ctctaggtgcccttggaggcca

SEQ ID NO: 3476943 - DNA, 14 bp, Homo sapiens
ctctagtgccttct

SEQ ID NO: 3476944 - DNA, 16 bp, Homo sapiens
ctctagtgccttctaa

SEQ ID NO: 3476945 - DNA, 12 bp, Homo sapiens
ctctagttcaaa

SEQ ID NO: 3476946 - DNA, 11 bp, Homo sapiens
ctctatattta

SEQ ID NO: 3476947 - DNA, 14 bp, Homo sapiens
ctctatcatttaat

SEQ ID NO: 3476948 - DNA, 14 bp, Homo sapiens
ctctatgataatta

SEQ ID NO: 3476949 - DNA, 16 bp, Homo sapiens
ctctatgctttccaaa

SEQ ID NO: 3476950 - DNA, 15 bp, Homo sapiens
ctctcacctcagcct

SEQ ID NO: 3476951 - DNA, 21 bp, Homo sapiens
ctctcactgtgttactgcttt

SEQ ID NO: 3476952 - DNA, 14 bp, Homo sapiens
ctctcagtctctga

SEQ ID NO: 3476953 - DNA, 15 bp, Homo sapiens
ctctcagtctctgag

SEQ ID NO: 3476954 - DNA, 15 bp, Homo sapiens
ctctcagttgcagcc

SEQ ID NO: 3476955 - DNA, 17 bp, Homo sapiens
ctctcatctcttagctc

SEQ ID NO: 3476956 - DNA, 18 bp, Homo sapiens
ctctccactgctctcagc

SEQ ID NO: 3476957 - DNA, 10 bp, Homo sapiens
ctctccaggg

SEQ ID NO: 3476958 - DNA, 20 bp, Homo sapiens
ctctcccacgggacctgggg

SEQ ID NO: 3476959 - DNA, 21 bp, Homo sapiens
ctctcccacgggacctggggc

SEQ ID NO: 3476960 - DNA, 21 bp, Homo sapiens
ctctcccattgtccctctgcc

SEQ ID NO: 3476961 - DNA, 19 bp, Homo sapiens
ctctccccacgagggctgg

SEQ ID NO: 3476962 - DNA, 21 bp, Homo sapiens
ctctccccacgagggctggct

SEQ ID NO: 3476963 - DNA, 11 bp, Homo sapiens
ctctccccagc

SEQ ID NO: 3476964 - DNA, 24 bp, Homo sapiens
ctctccccagcaagtgagagctgg

SEQ ID NO: 3476965 - DNA, 18 bp, Homo sapiens
ctctccccagcccagaga

SEQ ID NO: 3476966 - DNA, 15 bp, Homo sapiens
ctctccccaggtcca

SEQ ID NO: 3476967 - DNA, 16 bp, Homo sapiens
ctctccccaggtccag

SEQ ID NO: 3476968 - DNA, 16 bp, Homo sapiens
ctctcccccaccccct

SEQ ID NO: 3476969 - DNA, 15 bp, Homo sapiens
ctctccctctaggct

SEQ ID NO: 3476970 - DNA, 20 bp, Homo sapiens
ctctccctgaccctgtatat

SEQ ID NO: 3476971 - DNA, 22 bp, Homo sapiens
ctctccctgcactccctcctgg

SEQ ID NO: 3476972 - DNA, 12 bp, Homo sapiens
ctctccctgttg

SEQ ID NO: 3476973 - DNA, 16 bp, Homo sapiens
ctctccgaccagacac

SEQ ID NO: 3476974 - DNA, 14 bp, Homo sapiens
ctctcctcatctct

SEQ ID NO: 3476975 - DNA, 20 bp, Homo sapiens
ctctcctccccaaggagaca

SEQ ID NO: 3476976 - DNA, 15 bp, Homo sapiens
ctctcctcctgccca

SEQ ID NO: 3476977 - DNA, 21 bp, Homo sapiens
ctctcctgacttttaatgtca

SEQ ID NO: 3476978 - DNA, 18 bp, Homo sapiens
ctctcctgtactttttcc

SEQ ID NO: 3476979 - DNA, 18 bp, Homo sapiens
ctctcctttgttcccggc

SEQ ID NO: 3476980 - DNA, 21 bp, Homo sapiens
ctctcggaactgcatgctgct

SEQ ID NO: 3476981 - DNA, 14 bp, Homo sapiens
ctctctccagatgt

SEQ ID NO: 3476982 - DNA, 13 bp, Homo sapiens
ctctctcctccct

SEQ ID NO: 3476983 - DNA, 20 bp, Homo sapiens
ctctctcctcctgcccacct

SEQ ID NO: 3476984 - DNA, 15 bp, Homo sapiens
ctctctcctgtactt

SEQ ID NO: 3476985 - DNA, 18 bp, Homo sapiens
ctctctgcaccgtactgt

SEQ ID NO: 3476986 - DNA, 15 bp, Homo sapiens
ctctctgccctgtgt

SEQ ID NO: 3476987 - DNA, 12 bp, Homo sapiens
ctctctgctctg

SEQ ID NO: 3476988 - DNA, 14 bp, Homo sapiens
ctctctgctctgcg

SEQ ID NO: 3476989 - DNA, 20 bp, Homo sapiens
ctctctgggcctcagaggcc

SEQ ID NO: 3476990 - DNA, 12 bp, Homo sapiens
ctctctgggctg

SEQ ID NO: 3476991 - DNA, 17 bp, Homo sapiens
ctctctggggctgtgtt

SEQ ID NO: 3476992 - DNA, 19 bp, Homo sapiens
ctctctggtcttttttccc

SEQ ID NO: 3476993 - DNA, 15 bp, Homo sapiens
ctctctgtggggctg

SEQ ID NO: 3476994 - DNA, 21 bp, Homo sapiens
ctctcttcttattacccaaac

SEQ ID NO: 3476995 - DNA, 18 bp, Homo sapiens
ctctcttgaaccccaaat

SEQ ID NO: 3476996 - DNA, 15 bp, Homo sapiens
ctctctttgggaatg

SEQ ID NO: 3476997 - DNA, 17 bp, Homo sapiens
ctctctttgggaatgtt

SEQ ID NO: 3476998 - DNA, 9 bp, Homo sapiens
ctctgaaac

SEQ ID NO: 3476999 - DNA, 19 bp, Homo sapiens
ctctgaaacagctgcctta

SEQ ID NO: 3477000 - DNA, 12 bp, Homo sapiens
ctctgaaaccag

SEQ ID NO: 3477001 - DNA, 16 bp, Homo sapiens
ctctgaaagttgtaca

SEQ ID NO: 3477002 - DNA, 18 bp, Homo sapiens
ctctgaaagttgtacatg

SEQ ID NO: 3477003 - DNA, 22 bp, Homo sapiens
ctctgaagagtgggtttcacaa

SEQ ID NO: 3477004 - DNA, 15 bp, Homo sapiens
ctctgaagcaaggcg

SEQ ID NO: 3477005 - DNA, 23 bp, Homo sapiens
ctctgaagcaaggcggtggactt

SEQ ID NO: 3477006 - DNA, 18 bp, Homo sapiens
ctgcaggccctggcctcc

SEQ ID NO: 3477007 - DNA, 21 bp, Homo sapiens
ctgcaggccctggcctcccct

SEQ ID NO: 3477008 - DNA, 19 bp, Homo sapiens
ctgcagggccgccagggag

SEQ ID NO: 3477009 - DNA, 22 bp, Homo sapiens
ctgcagtcatcttgaccaagca

SEQ ID NO: 3477010 - DNA, 21 bp, Homo sapiens
ctgcagttcatccgcactgta

SEQ ID NO: 3477011 - DNA, 23 bp, Homo sapiens
ctgcagttcatccgcactgtaaa

SEQ ID NO: 3477012 - DNA, 19 bp, Homo sapiens
ctgcagtttgagacaggag

SEQ ID NO: 3477013 - DNA, 21 bp, Homo sapiens
ctgcagtttgagacaggagac

SEQ ID NO: 3477014 - DNA, 14 bp, Homo sapiens
ctgcatacaatctg

SEQ ID NO: 3477015 - DNA, 14 bp, Homo sapiens
ctgcatatgttgaa

SEQ ID NO: 3477016 - DNA, 16 bp, Homo sapiens
ctgcatcgtttcatct

SEQ ID NO: 3477017 - DNA, 16 bp, Homo sapiens
ctgcatctcaaaaaaa

SEQ ID NO: 3477018 - DNA, 17 bp, Homo sapiens
ctgcatctgaccagcag

SEQ ID NO: 3477019 - DNA, 18 bp, Homo sapiens
ctgcatctgaccagcagc

SEQ ID NO: 3477020 - DNA, 21 bp, Homo sapiens
ctgcatctgaccagcagcgcc

SEQ ID NO: 3477021 - DNA, 18 bp, Homo sapiens
ctgcatctggggcccata

SEQ ID NO: 3477022 - DNA, 15 bp, Homo sapiens
ctgcatgatgtttgc

SEQ ID NO: 3477023 - DNA, 15 bp, Homo sapiens
ctgcatgccctctca

SEQ ID NO: 3477024 - DNA, 18 bp, Homo sapiens
ctgcatgccctctcaggc

SEQ ID NO: 3477025 - DNA, 15 bp, Homo sapiens
ctgcatgctgctgga

SEQ ID NO: 3477026 - DNA, 12 bp, Homo sapiens
ctgcatgtacta

SEQ ID NO: 3477027 - DNA, 23 bp, Homo sapiens
ctgcattaccgcgttgtaaaata

SEQ ID NO: 3477028 - DNA, 18 bp, Homo sapiens
ctgcattttcaccccacc

SEQ ID NO: 3477029 - DNA, 15 bp, Homo sapiens
ctgcatttttctgca

SEQ ID NO: 3477030 - DNA, 16 bp, Homo sapiens
ctgcatttttctgcag

SEQ ID NO: 3477031 - DNA, 16 bp, Homo sapiens
ctgccaaaatgctcta

SEQ ID NO: 3477032 - DNA, 21 bp, Homo sapiens
ctgccaaagggaaatatcatt

SEQ ID NO: 3477033 - DNA, 22 bp, Homo sapiens
ctgccaacttcttcagagctga

SEQ ID NO: 3477034 - DNA, 23 bp, Homo sapiens
ctgccaatccttaaatatgtgaa

SEQ ID NO: 3477035 - DNA, 15 bp, Homo sapiens
ctgccacaccctccc

SEQ ID NO: 3477036 - DNA, 20 bp, Homo sapiens
ctgccaccaccctgtcttcc

SEQ ID NO: 3477037 - DNA, 17 bp, Homo sapiens
ctgccaccaggccacct

SEQ ID NO: 3477038 - DNA, 23 bp, Homo sapiens
ctgccaccaggccacctccccag

SEQ ID NO: 3477039 - DNA, 18 bp, Homo sapiens
ctgccacccacctccctg

SEQ ID NO: 3477040 - DNA, 23 bp, Homo sapiens
ctgccacccacctccctgcctcc

SEQ ID NO: 3477041 - DNA, 21 bp, Homo sapiens
ctgccaccctgccccttgcca

SEQ ID NO: 3477042 - DNA, 17 bp, Homo sapiens
ctgccaccctgggcctg

SEQ ID NO: 3477043 - DNA, 14 bp, Homo sapiens
ctgccaccctgggg

SEQ ID NO: 3477044 - DNA, 16 bp, Homo sapiens
ctgccaccctggggag

SEQ ID NO: 3477045 - DNA, 14 bp, Homo sapiens
ctgccacctcctgc

SEQ ID NO: 3477046 - DNA, 16 bp, Homo sapiens
ctgccacctcctgcct

SEQ ID NO: 3477047 - DNA, 19 bp, Homo sapiens
ctgccacctcctgcctcag

SEQ ID NO: 3477048 - DNA, 21 bp, Homo sapiens
ctgccactccagtcctgccac

SEQ ID NO: 3477049 - DNA, 23 bp, Homo sapiens
ctgccactccagtcctgccacca

SEQ ID NO: 3477050 - DNA, 21 bp, Homo sapiens
ctgccagagaagtctggtcag

SEQ ID NO: 3477051 - DNA, 23 bp, Homo sapiens
ctgccagagaagtctggtcagag

SEQ ID NO: 3477052 - DNA, 16 bp, Homo sapiens
ctgccagagcaggggg

SEQ ID NO: 3477053 - DNA, 17 bp, Homo sapiens
ctgccagctgcactgat

SEQ ID NO: 3477054 - DNA, 11 bp, Homo sapiens
ctgccaggcat

SEQ ID NO: 3477055 - DNA, 21 bp, Homo sapiens
ctgccaggcccccaagcctgc

SEQ ID NO: 3477056 - DNA, 22 bp, Homo sapiens
ctgccaggcccccaagcctgca

SEQ ID NO: 3477057 - DNA, 11 bp, Homo sapiens
ctgccagggca

SEQ ID NO: 3477058 - DNA, 13 bp, Homo sapiens
ctgccagggcagg

SEQ ID NO: 3477059 - DNA, 15 bp, Homo sapiens
ctgccagggcagggc

SEQ ID NO: 3477060 - DNA, 12 bp, Homo sapiens
ctgccagggctt

SEQ ID NO: 3477061 - DNA, 13 bp, Homo sapiens
ctgccataaaaca

SEQ ID NO: 3477062 - DNA, 17 bp, Homo sapiens
ctgccatagccaggagc

SEQ ID NO: 3477063 - DNA, 20 bp, Homo sapiens
ctgccatattctgttggcca

SEQ ID NO: 3477064 - DNA, 21 bp, Homo sapiens
ctgccatattctgttggccag

SEQ ID NO: 3477065 - DNA, 19 bp, Homo sapiens
ctgccatccaggttcagct

SEQ ID NO: 3477066 - DNA, 21 bp, Homo sapiens
ctgccatgcaccaggactggc

SEQ ID NO: 3477067 - DNA, 16 bp, Homo sapiens
ctgccatgcagggcct

SEQ ID NO: 3477068 - DNA, 14 bp, Homo sapiens
ctgccatgccagct

SEQ ID NO: 3477069 - DNA, 18 bp, Homo sapiens
ctgccatggaactgtttc

SEQ ID NO: 3477070 - DNA, 20 bp, Homo sapiens
ctgccatggaactgtttcct

SEQ ID NO: 3477071 - DNA, 20 bp, Homo sapiens
ctgcccaacccttccctcac

SEQ ID NO: 3477072 - DNA, 16 bp, Homo sapiens
ctgcccaggcactgca

SEQ ID NO: 3477073 - DNA, 13 bp, Homo sapiens
ctgcccaggcccc

SEQ ID NO: 3477074 - DNA, 18 bp, Homo sapiens
ctgcccaggcccctgcca

SEQ ID NO: 3477075 - DNA, 19 bp, Homo sapiens
ctgcccaggcccctgccac

SEQ ID NO: 3477076 - DNA, 20 bp, Homo sapiens
ctgcccaggcccctgccacc

SEQ ID NO: 3477077 - DNA, 22 bp, Homo sapiens
ctgcccatttcgtgagccccat

SEQ ID NO: 3477078 - DNA, 23 bp, Homo sapiens
ctgccccacccctccccattagc

SEQ ID NO: 3477079 - DNA, 14 bp, Homo sapiens
ctgccccagccaga

SEQ ID NO: 3477080 - DNA, 14 bp, Homo sapiens
ctgccccagcccag

SEQ ID NO: 3477081 - DNA, 18 bp, Homo sapiens
ctgccccatcctccagca

SEQ ID NO: 3477082 - DNA, 17 bp, Homo sapiens
ctgccccatctcccctc

SEQ ID NO: 3477083 - DNA, 14 bp, Homo sapiens
ctgcccccaggact

SEQ ID NO: 3477084 - DNA, 15 bp, Homo sapiens
ctgcccccaggactg

SEQ ID NO: 3477085 - DNA, 16 bp, Homo sapiens
ctgcccccaggactgg

SEQ ID NO: 3477086 - DNA, 19 bp, Homo sapiens
ctgcccccaggactgggcc

SEQ ID NO: 3477087 - DNA, 14 bp, Homo sapiens
ctgccccgcttccc

SEQ ID NO: 3477088 - DNA, 22 bp, Homo sapiens
ctgccccggcccctccccctga

SEQ ID NO: 3477089 - DNA, 20 bp, Homo sapiens
ctgccccgggtccccagctc

SEQ ID NO: 3477090 - DNA, 13 bp, Homo sapiens
ctgcccctcccag

SEQ ID NO: 3477091 - DNA, 16 bp, Homo sapiens
ctgcccctcccagaac

SEQ ID NO: 3477092 - DNA, 16 bp, Homo sapiens
ctgcccctctctgggc

SEQ ID NO: 3477093 - DNA, 11 bp, Homo sapiens
ctgcccctggc

SEQ ID NO: 3477094 - DNA, 16 bp, Homo sapiens
ctgcccctggctctga

SEQ ID NO: 3477095 - DNA, 19 bp, Homo sapiens
ctgcccgcagacctctgga

SEQ ID NO: 3477096 - DNA, 20 bp, Homo sapiens
ctgcccggcagggtcctaga

SEQ ID NO: 3477097 - DNA, 11 bp, Homo sapiens
ctgcccggctg

SEQ ID NO: 3477098 - DNA, 23 bp, Homo sapiens
ctgccctagttttctttcctcct

SEQ ID NO: 3477099 - DNA, 16 bp, Homo sapiens
ctgccctatgggcctg

SEQ ID NO: 3477100 - DNA, 21 bp, Homo sapiens
ctgccctatgggcctgccggg

SEQ ID NO: 3477101 - DNA, 22 bp, Homo sapiens
ctgccctccagctctttcctcc

SEQ ID NO: 3477102 - DNA, 13 bp, Homo sapiens
ctgccctgtgtac

SEQ ID NO: 3477103 - DNA, 15 bp, Homo sapiens
ctgcccttgtcccac

SEQ ID NO: 3477104 - DNA, 17 bp, Homo sapiens
ctgcccttgtcccactc

SEQ ID NO: 3477105 - DNA, 23 bp, Homo sapiens
ctgcccttgtcccactcaagcca

SEQ ID NO: 3477106 - DNA, 21 bp, Homo sapiens
ctgcccttttttctgcctcct

SEQ ID NO: 3477107 - DNA, 21 bp, Homo sapiens
ctgccgagacagaccctctgc

SEQ ID NO: 3477108 - DNA, 14 bp, Homo sapiens
ctgccgcagagctg

SEQ ID NO: 3477109 - DNA, 16 bp, Homo sapiens
ctgccgcagagctggc

SEQ ID NO: 3477110 - DNA, 16 bp, Homo sapiens
ctgccgccccacccag

SEQ ID NO: 3477111 - DNA, 22 bp, Homo sapiens
ctgccgctgcttccaggctggg

SEQ ID NO: 3477112 - DNA, 16 bp, Homo sapiens
ctgccggagaggaaga

SEQ ID NO: 3477113 - DNA, 17 bp, Homo sapiens
ctgccggagaggaagag

SEQ ID NO: 3477114 - DNA, 18 bp, Homo sapiens
ctgccggcacagctggga

SEQ ID NO: 3477115 - DNA, 21 bp, Homo sapiens
ctgccggcaggatgcagcgcc

SEQ ID NO: 3477116 - DNA, 21 bp, Homo sapiens
ctgccggccctggggctaggc

SEQ ID NO: 3477117 - DNA, 15 bp, Homo sapiens
ctgccgggctgaggg

SEQ ID NO: 3477118 - DNA, 18 bp, Homo sapiens
ctgccggtaaacacgcct

SEQ ID NO: 3477119 - DNA, 13 bp, Homo sapiens
ctgccgtcagtgc

SEQ ID NO: 3477120 - DNA, 20 bp, Homo sapiens
ctgccgtcagtgctgtgctg

SEQ ID NO: 3477121 - DNA, 13 bp, Homo sapiens
ctgccgtggggcc

SEQ ID NO: 3477122 - DNA, 21 bp, Homo sapiens
ctgcctaggtcccccaagcat

SEQ ID NO: 3477123 - DNA, 19 bp, Homo sapiens
ctgcctcagcctcccaaag

SEQ ID NO: 3477124 - DNA, 18 bp, Homo sapiens
ctgcctcagcctcccaag

SEQ ID NO: 3477125 - DNA, 18 bp, Homo sapiens
ctgcctcagcctcccgag

SEQ ID NO: 3477126 - DNA, 10 bp, Homo sapiens
ctgcctcagg

SEQ ID NO: 3477127 - DNA, 22 bp, Homo sapiens
ctgcctcaggaggcaggacctt

SEQ ID NO: 3477128 - DNA, 22 bp, Homo sapiens
ctgcctccagccaaacgggagc

SEQ ID NO: 3477129 - DNA, 14 bp, Homo sapiens
ctgcctccagggct

SEQ ID NO: 3477130 - DNA, 18 bp, Homo sapiens
ctgcctccagggctggac

SEQ ID NO: 3477131 - DNA, 20 bp, Homo sapiens
ctgcctccagggctggactg

SEQ ID NO: 3477132 - DNA, 22 bp, Homo sapiens
ctgcctccagggctggactgag

SEQ ID NO: 3477133 - DNA, 21 bp, Homo sapiens
ctgcctccattatccattccc

SEQ ID NO: 3477134 - DNA, 21 bp, Homo sapiens
ctgcctcccaacagtggggaa

SEQ ID NO: 3477135 - DNA, 15 bp, Homo sapiens
ctgcctcgaaacaca

SEQ ID NO: 3477136 - DNA, 14 bp, Homo sapiens
ctgcctcgaactgg

SEQ ID NO: 3477137 - DNA, 21 bp, Homo sapiens
cttaatgaagtttgaatgtta

SEQ ID NO: 3477138 - DNA, 22 bp, Homo sapiens
cttaatgaagtttgaatgttaa

SEQ ID NO: 3477139 - DNA, 23 bp, Homo sapiens
cttaatgaagtttgaatgttaaa

SEQ ID NO: 3477140 - DNA, 19 bp, Homo sapiens
cttaatggaaggttggatc

SEQ ID NO: 3477141 - DNA, 22 bp, Homo sapiens
cttaatgtgattactgctctat

SEQ ID NO: 3477142 - DNA, 14 bp, Homo sapiens
cttaatgttcacat

SEQ ID NO: 3477143 - DNA, 22 bp, Homo sapiens
cttaatgttcacatagtgaaat

SEQ ID NO: 3477144 - DNA, 22 bp, Homo sapiens
cttaattttctgtggatcattt

SEQ ID NO: 3477145 - DNA, 22 bp, Homo sapiens
cttacagctgggtggcactgcc

SEQ ID NO: 3477146 - DNA, 22 bp, Homo sapiens
cttacatctggaatctgaggca

SEQ ID NO: 3477147 - DNA, 21 bp, Homo sapiens
cttacatgtataaagtgattg

SEQ ID NO: 3477148 - DNA, 12 bp, Homo sapiens
cttacattctct

SEQ ID NO: 3477149 - DNA, 22 bp, Homo sapiens
cttacattctctaataagaaaa

SEQ ID NO: 3477150 - DNA, 22 bp, Homo sapiens
cttacccggagaaggccgctgc

SEQ ID NO: 3477151 - DNA, 21 bp, Homo sapiens
cttacccttagaatccacgta

SEQ ID NO: 3477152 - DNA, 16 bp, Homo sapiens
cttaccgagagccaaa

SEQ ID NO: 3477153 - DNA, 21 bp, Homo sapiens
cttaccgagagccaaacagag

SEQ ID NO: 3477154 - DNA, 12 bp, Homo sapiens
cttactaggaag

SEQ ID NO: 3477155 - DNA, 20 bp, Homo sapiens
cttactatgatctcaggagc

SEQ ID NO: 3477156 - DNA, 15 bp, Homo sapiens
cttactctttcctat

SEQ ID NO: 3477157 - DNA, 23 bp, Homo sapiens
cttactctttcctatttcagtgt

SEQ ID NO: 3477158 - DNA, 16 bp, Homo sapiens
cttacttcttgccctg

SEQ ID NO: 3477159 - DNA, 20 bp, Homo sapiens
cttagaaaaaccaccaccat

SEQ ID NO: 3477160 - DNA, 15 bp, Homo sapiens
cttagaaatttattt

SEQ ID NO: 3477161 - DNA, 22 bp, Homo sapiens
cttagagcagtttctgtcctgc

SEQ ID NO: 3477162 - DNA, 19 bp, Homo sapiens
cttagagggatttctttgc

SEQ ID NO: 3477163 - DNA, 20 bp, Homo sapiens
cttagagggatttctttgct

SEQ ID NO: 3477164 - DNA, 18 bp, Homo sapiens
cttagatacactaaaaat

SEQ ID NO: 3477165 - DNA, 15 bp, Homo sapiens
cttagatctggcatg

SEQ ID NO: 3477166 - DNA, 16 bp, Homo sapiens
cttagatctggcatgt

SEQ ID NO: 3477167 - DNA, 16 bp, Homo sapiens
cttagatggattctcc

SEQ ID NO: 3477168 - DNA, 18 bp, Homo sapiens
cttagatgttctaagtct

SEQ ID NO: 3477169 - DNA, 16 bp, Homo sapiens
cttagatgtttcacac

SEQ ID NO: 3477170 - DNA, 19 bp, Homo sapiens
cttagctagttttattctt

SEQ ID NO: 3477171 - DNA, 15 bp, Homo sapiens
cttaggcagggaagt

SEQ ID NO: 3477172 - DNA, 17 bp, Homo sapiens
cttaggccttcctctct

SEQ ID NO: 3477173 - DNA, 15 bp, Homo sapiens
cttagggcaccaggg

SEQ ID NO: 3477174 - DNA, 13 bp, Homo sapiens
cttataatttaaa

SEQ ID NO: 3477175 - DNA, 15 bp, Homo sapiens
cttatactgtacaat

SEQ ID NO: 3477176 - DNA, 17 bp, Homo sapiens
cttatagttaatatttt

SEQ ID NO: 3477177 - DNA, 20 bp, Homo sapiens
cttatagtttgggcttcagc

SEQ ID NO: 3477178 - DNA, 20 bp, Homo sapiens
cttatattaatagtaatttg

SEQ ID NO: 3477179 - DNA, 21 bp, Homo sapiens
cttatattaatagtaatttgt

SEQ ID NO: 3477180 - DNA, 20 bp, Homo sapiens
cttatcacccccttgttgta

SEQ ID NO: 3477181 - DNA, 14 bp, Homo sapiens
cttatcatggtctc

SEQ ID NO: 3477182 - DNA, 15 bp, Homo sapiens
cttatcatggtctca

SEQ ID NO: 3477183 - DNA, 15 bp, Homo sapiens
cttatccctgcccat

SEQ ID NO: 3477184 - DNA, 19 bp, Homo sapiens
cttatccctgcccatttca

SEQ ID NO: 3477185 - DNA, 21 bp, Homo sapiens
cttatcctaaaacaaatagtt

SEQ ID NO: 3477186 - DNA, 19 bp, Homo sapiens
cttatccttcatcttttaa

SEQ ID NO: 3477187 - DNA, 22 bp, Homo sapiens
cttatccttcatcttttaaaga

SEQ ID NO: 3477188 - DNA, 13 bp, Homo sapiens
cttatctccaaga

SEQ ID NO: 3477189 - DNA, 21 bp, Homo sapiens
cttatctcttttatatttgta

SEQ ID NO: 3477190 - DNA, 15 bp, Homo sapiens
cttatgaatatattt

SEQ ID NO: 3477191 - DNA, 20 bp, Homo sapiens
cttatgagggtcctctactt

SEQ ID NO: 3477192 - DNA, 16 bp, Homo sapiens
cttatggaattgattt

SEQ ID NO: 3477193 - DNA, 21 bp, Homo sapiens
cttatggaattgatttgcatt

SEQ ID NO: 3477194 - DNA, 21 bp, Homo sapiens
cttattagagtgtctttccac

SEQ ID NO: 3477195 - DNA, 17 bp, Homo sapiens
cttattagggagaaaat

SEQ ID NO: 3477196 - DNA, 16 bp, Homo sapiens
cttattgcgctgctac

SEQ ID NO: 3477197 - DNA, 17 bp, Homo sapiens
cttattgcgctgctacc

SEQ ID NO: 3477198 - DNA, 18 bp, Homo sapiens
cttatttgccagagccaa

SEQ ID NO: 3477199 - DNA, 23 bp, Homo sapiens
cttcaaactagggccaagcccag

SEQ ID NO: 3477200 - DNA, 19 bp, Homo sapiens
cttcaaccctcagccttga

SEQ ID NO: 3477201 - DNA, 17 bp, Homo sapiens
cttcaaggcttcagtct

SEQ ID NO: 3477202 - DNA, 21 bp, Homo sapiens
cttcaatcggcttgtgggtga

SEQ ID NO: 3477203 - DNA, 17 bp, Homo sapiens
cttcacccaggcctatg

SEQ ID NO: 3477204 - DNA, 18 bp, Homo sapiens
cttcaccccaatcccagc

SEQ ID NO: 3477205 - DNA, 19 bp, Homo sapiens
cttcacggaagagccttgc

SEQ ID NO: 3477206 - DNA, 20 bp, Homo sapiens
cttcactagggaatcctgcg

SEQ ID NO: 3477207 - DNA, 23 bp, Homo sapiens
cttcactagggaatcctgcggca

SEQ ID NO: 3477208 - DNA, 18 bp, Homo sapiens
cttcactattcctaggag

SEQ ID NO: 3477209 - DNA, 20 bp, Homo sapiens
cttcagacacatgctatgtt

SEQ ID NO: 3477210 - DNA, 20 bp, Homo sapiens
cttcagacagagaggactgt

SEQ ID NO: 3477211 - DNA, 14 bp, Homo sapiens
cttcagagctgaca

SEQ ID NO: 3477212 - DNA, 18 bp, Homo sapiens
cttcagagctgacacagg

SEQ ID NO: 3477213 - DNA, 13 bp, Homo sapiens
cttcagccttaat

SEQ ID NO: 3477214 - DNA, 21 bp, Homo sapiens
cttcaggatacgctgctctca

SEQ ID NO: 3477215 - DNA, 16 bp, Homo sapiens
cttcaggcaattctcc

SEQ ID NO: 3477216 - DNA, 14 bp, Homo sapiens
cttcagggcaggtg

SEQ ID NO: 3477217 - DNA, 15 bp, Homo sapiens
cttcagggcctggtt

SEQ ID NO: 3477218 - DNA, 18 bp, Homo sapiens
cttcaggtccaggctgtg

SEQ ID NO: 3477219 - DNA, 16 bp, Homo sapiens
cttcagtaagccgtga

SEQ ID NO: 3477220 - DNA, 18 bp, Homo sapiens
cttcagtatgttgtcaaa

SEQ ID NO: 3477221 - DNA, 15 bp, Homo sapiens
cttcagtggcagctg

SEQ ID NO: 3477222 - DNA, 22 bp, Homo sapiens
cttcagtttatttccactattt

SEQ ID NO: 3477223 - DNA, 18 bp, Homo sapiens
cttcatagcagattttaa

SEQ ID NO: 3477224 - DNA, 20 bp, Homo sapiens
cttcatatgaaaggtgccat

SEQ ID NO: 3477225 - DNA, 17 bp, Homo sapiens
cttcatcattccctctc

SEQ ID NO: 3477226 - DNA, 18 bp, Homo sapiens
cttcatcattccctctca

SEQ ID NO: 3477227 - DNA, 15 bp, Homo sapiens
cttcatctctttaga

SEQ ID NO: 3477228 - DNA, 14 bp, Homo sapiens
cttcatctgcccaa

SEQ ID NO: 3477229 - DNA, 22 bp, Homo sapiens
cttcatcttcctgtgtcctgaa

SEQ ID NO: 3477230 - DNA, 16 bp, Homo sapiens
cttcatgtctattcca

SEQ ID NO: 3477231 - DNA, 17 bp, Homo sapiens
cttcattgatttcctgt

SEQ ID NO: 3477232 - DNA, 14 bp, Homo sapiens
cttcatttttgtaa

SEQ ID NO: 3477233 - DNA, 18 bp, Homo sapiens
cttccaacaggagctggg

SEQ ID NO: 3477234 - DNA, 23 bp, Homo sapiens
cttccacaaagaaaattcctata

SEQ ID NO: 3477235 - DNA, 17 bp, Homo sapiens
cttccaccattgtccta

SEQ ID NO: 3477236 - DNA, 18 bp, Homo sapiens
cttccactccttctctca

SEQ ID NO: 3477237 - DNA, 15 bp, Homo sapiens
cttccactgagggca

SEQ ID NO: 3477238 - DNA, 16 bp, Homo sapiens
cttccagaaaacaaaa

SEQ ID NO: 3477239 - DNA, 22 bp, Homo sapiens
cttccagatcctctctggggct

SEQ ID NO: 3477240 - DNA, 13 bp, Homo sapiens
cttccagcccaga

SEQ ID NO: 3477241 - DNA, 20 bp, Homo sapiens
cttccaggtgttactgtaat

SEQ ID NO: 3477242 - DNA, 18 bp, Homo sapiens
cttccagtgtccttagaa

SEQ ID NO: 3477243 - DNA, 15 bp, Homo sapiens
cttccatagctgctg

SEQ ID NO: 3477244 - DNA, 17 bp, Homo sapiens
cttccatagctgctgcc

SEQ ID NO: 3477245 - DNA, 21 bp, Homo sapiens
cttccatagctgctgccctag

SEQ ID NO: 3477246 - DNA, 18 bp, Homo sapiens
cttccatctttcctgatg

SEQ ID NO: 3477247 - DNA, 17 bp, Homo sapiens
cttccatgattctattt

SEQ ID NO: 3477248 - DNA, 19 bp, Homo sapiens
cttccatggccctcattaa

SEQ ID NO: 3477249 - DNA, 13 bp, Homo sapiens
cttccatttgcaa

SEQ ID NO: 3477250 - DNA, 17 bp, Homo sapiens
cttcccaagtaagaggc

SEQ ID NO: 3477251 - DNA, 21 bp, Homo sapiens
cttcccaagtaagaggctgga

SEQ ID NO: 3477252 - DNA, 19 bp, Homo sapiens
cttcccagtggctgctgcc

SEQ ID NO: 3477253 - DNA, 17 bp, Homo sapiens
cttcccatgacccaggc

SEQ ID NO: 3477254 - DNA, 20 bp, Homo sapiens
cttcccatgacccaggctgg

SEQ ID NO: 3477255 - DNA, 21 bp, Homo sapiens
cttcccatgacccaggctggg

SEQ ID NO: 3477256 - DNA, 23 bp, Homo sapiens
cttcccatgacccaggctgggca

SEQ ID NO: 3477257 - DNA, 20 bp, Homo sapiens
cttccccacttctgtgccac

SEQ ID NO: 3477258 - DNA, 18 bp, Homo sapiens
cttccccggagggctgcg

SEQ ID NO: 3477259 - DNA, 20 bp, Homo sapiens
cttcccctctctcctcctgc

SEQ ID NO: 3477260 - DNA, 19 bp, Homo sapiens
cttcccgccggaggccagc

SEQ ID NO: 3477261 - DNA, 20 bp, Homo sapiens
cttcccgccggaggccagct

SEQ ID NO: 3477262 - DNA, 21 bp, Homo sapiens
cttcccgccggaggccagcta

SEQ ID NO: 3477263 - DNA, 12 bp, Homo sapiens
cttccctaatct

SEQ ID NO: 3477264 - DNA, 14 bp, Homo sapiens
cttccctcttccct

SEQ ID NO: 3477265 - DNA, 20 bp, Homo sapiens
cttccctgactcattctgaa

SEQ ID NO: 3477266 - DNA, 15 bp, Homo sapiens
cttccctgtgtcttt

SEQ ID NO: 3477267 - DNA, 17 bp, Homo sapiens
cttccgatgacagtgct

SEQ ID NO: 3477268 - DNA, 16 bp, Homo sapiens
gaataataagcaggat

SEQ ID NO: 3477269 - DNA, 13 bp, Homo sapiens
gaataatgggctt

SEQ ID NO: 3477270 - DNA, 21 bp, Homo sapiens
gaataatttatagtaatgagt

SEQ ID NO: 3477271 - DNA, 18 bp, Homo sapiens
gaatactgttaaaggaaa

SEQ ID NO: 3477272 - DNA, 23 bp, Homo sapiens
gaatagaaataaaggatgtgatt

SEQ ID NO: 3477273 - DNA, 15 bp, Homo sapiens
gaatagccacatttg

SEQ ID NO: 3477274 - DNA, 15 bp, Homo sapiens
gaatagctgggacta

SEQ ID NO: 3477275 - DNA, 20 bp, Homo sapiens
gaataggcattaacacaaag

SEQ ID NO: 3477276 - DNA, 19 bp, Homo sapiens
gaatataatatatttgtgt

SEQ ID NO: 3477277 - DNA, 15 bp, Homo sapiens
gaatatatggcagag

SEQ ID NO: 3477278 - DNA, 20 bp, Homo sapiens
gaatatcaatataatgtttt

SEQ ID NO: 3477279 - DNA, 15 bp, Homo sapiens
gaatatcatctttta

SEQ ID NO: 3477280 - DNA, 21 bp, Homo sapiens
gaatattgacaagtgtctttt

SEQ ID NO: 3477281 - DNA, 13 bp, Homo sapiens
gaatattgtccat

SEQ ID NO: 3477282 - DNA, 12 bp, Homo sapiens
gaatatttatta

SEQ ID NO: 3477283 - DNA, 17 bp, Homo sapiens
gaatatttattacctct

SEQ ID NO: 3477284 - DNA, 13 bp, Homo sapiens
gaatatttgaatc

SEQ ID NO: 3477285 - DNA, 14 bp, Homo sapiens
gaatatttgaatct

SEQ ID NO: 3477286 - DNA, 22 bp, Homo sapiens
gaatatttgaatcttgtctcaa

SEQ ID NO: 3477287 - DNA, 12 bp, Homo sapiens
gaatcagcttct

SEQ ID NO: 3477288 - DNA, 21 bp, Homo sapiens
gaatcaggaatattttccaaa

SEQ ID NO: 3477289 - DNA, 21 bp, Homo sapiens
gaatcagtataaacaaagtta

SEQ ID NO: 3477290 - DNA, 18 bp, Homo sapiens
gaatcatgagcctgctgg

SEQ ID NO: 3477291 - DNA, 18 bp, Homo sapiens
gaatcatggcctcttgaa

SEQ ID NO: 3477292 - DNA, 13 bp, Homo sapiens
gaatccaaacttg

SEQ ID NO: 3477293 - DNA, 18 bp, Homo sapiens
gaatccagacccggctgc

SEQ ID NO: 3477294 - DNA, 20 bp, Homo sapiens
gaatccagacccggctgcgt

SEQ ID NO: 3477295 - DNA, 16 bp, Homo sapiens
gaatcccactgtatga

SEQ ID NO: 3477296 - DNA, 17 bp, Homo sapiens
gaatcccactgtatgat

SEQ ID NO: 3477297 - DNA, 23 bp, Homo sapiens
gaatccctttctcacttttggaa

SEQ ID NO: 3477298 - DNA, 19 bp, Homo sapiens
gaatcctttggtgccaact

SEQ ID NO: 3477299 - DNA, 22 bp, Homo sapiens
gaatctacccccagatccaagc

SEQ ID NO: 3477300 - DNA, 13 bp, Homo sapiens
gaatctatttaag

SEQ ID NO: 3477301 - DNA, 14 bp, Homo sapiens
gaatctcagagaca

SEQ ID NO: 3477302 - DNA, 15 bp, Homo sapiens
gaatctcattactgc

SEQ ID NO: 3477303 - DNA, 15 bp, Homo sapiens
gaatctctgtgcctt

SEQ ID NO: 3477304 - DNA, 20 bp, Homo sapiens
gaatctgaggcatcctctga

SEQ ID NO: 3477305 - DNA, 16 bp, Homo sapiens
gaatctgctcacttta

SEQ ID NO: 3477306 - DNA, 23 bp, Homo sapiens
gaatcttggtttgccttccagaa

SEQ ID NO: 3477307 - DNA, 13 bp, Homo sapiens
gaatcttgtctca

SEQ ID NO: 3477308 - DNA, 16 bp, Homo sapiens
gaatcttgtctcaatg

SEQ ID NO: 3477309 - DNA, 18 bp, Homo sapiens
gaatcttgtctcaatgct

SEQ ID NO: 3477310 - DNA, 21 bp, Homo sapiens
gaatcttgtctcaatgctcat

SEQ ID NO: 3477311 - DNA, 18 bp, Homo sapiens
gaatctttattgagaaag

SEQ ID NO: 3477312 - DNA, 14 bp, Homo sapiens
gaatctttgttaag

SEQ ID NO: 3477313 - DNA, 21 bp, Homo sapiens
gaatgaaagggcccagagagg

SEQ ID NO: 3477314 - DNA, 14 bp, Homo sapiens
gaatgaaatgtatg

SEQ ID NO: 3477315 - DNA, 22 bp, Homo sapiens
gaatgaaccacatcttgctctg

SEQ ID NO: 3477316 - DNA, 15 bp, Homo sapiens
gaatgaaccactgcc

SEQ ID NO: 3477317 - DNA, 19 bp, Homo sapiens
gaatgaacccctggctcct

SEQ ID NO: 3477318 - DNA, 15 bp, Homo sapiens
gaatgaaccttctgg

SEQ ID NO: 3477319 - DNA, 17 bp, Homo sapiens
gaatgaaccttctggcc

SEQ ID NO: 3477320 - DNA, 16 bp, Homo sapiens
gaatgagaatgtgcca

SEQ ID NO: 3477321 - DNA, 18 bp, Homo sapiens
gaatgagagcgacacaga

SEQ ID NO: 3477322 - DNA, 20 bp, Homo sapiens
gaatgatgatcctaggcatt

SEQ ID NO: 3477323 - DNA, 15 bp, Homo sapiens
gaatgattcagtgtt

SEQ ID NO: 3477324 - DNA, 19 bp, Homo sapiens
gaatgcagaggtctccaaa

SEQ ID NO: 3477325 - DNA, 17 bp, Homo sapiens
gaatgccacccacatct

SEQ ID NO: 3477326 - DNA, 22 bp, Homo sapiens
gaatgccactgccttcgcttct

SEQ ID NO: 3477327 - DNA, 19 bp, Homo sapiens
gaatgccgcgatgggtcag

SEQ ID NO: 3477328 - DNA, 19 bp, Homo sapiens
gaatgcctgagtgcctggc

SEQ ID NO: 3477329 - DNA, 17 bp, Homo sapiens
gaatgctgggactcagc

SEQ ID NO: 3477330 - DNA, 20 bp, Homo sapiens
gaatgctgtacatctatttt

SEQ ID NO: 3477331 - DNA, 12 bp, Homo sapiens
gaatgtaaccaa

SEQ ID NO: 3477332 - DNA, 18 bp, Homo sapiens
gaatgtgataaggaaatc

SEQ ID NO: 3477333 - DNA, 18 bp, Homo sapiens
gaatgtggcttgagaaat

SEQ ID NO: 3477334 - DNA, 22 bp, Homo sapiens
gaattatctatacatatcttta

SEQ ID NO: 3477335 - DNA, 21 bp, Homo sapiens
gaattcaaactggggcctcca

SEQ ID NO: 3477336 - DNA, 23 bp, Homo sapiens
gaattcaaactggggcctccaga

SEQ ID NO: 3477337 - DNA, 15 bp, Homo sapiens
gaattccttcgaaag

SEQ ID NO: 3477338 - DNA, 20 bp, Homo sapiens
gaattccttcgaaaggcctt

SEQ ID NO: 3477339 - DNA, 22 bp, Homo sapiens
gaattccttcgaaaggccttca

SEQ ID NO: 3477340 - DNA, 19 bp, Homo sapiens
gaattcttggttgaggaaa

SEQ ID NO: 3477341 - DNA, 20 bp, Homo sapiens
gaattcttggttgaggaaac

SEQ ID NO: 3477342 - DNA, 18 bp, Homo sapiens
gaattgaggggattaata

SEQ ID NO: 3477343 - DNA, 12 bp, Homo sapiens
gaattgatttgc

SEQ ID NO: 3477344 - DNA, 22 bp, Homo sapiens
gaattgatttgcattgaacaca

SEQ ID NO: 3477345 - DNA, 12 bp, Homo sapiens
gaattgcattga

SEQ ID NO: 3477346 - DNA, 13 bp, Homo sapiens
gaattgcattgac

SEQ ID NO: 3477347 - DNA, 23 bp, Homo sapiens
gaattgccaggggcgaggccctt

SEQ ID NO: 3477348 - DNA, 16 bp, Homo sapiens
gaattgggcggctctg

SEQ ID NO: 3477349 - DNA, 20 bp, Homo sapiens
gaattgggcggctctgaagc

SEQ ID NO: 3477350 - DNA, 20 bp, Homo sapiens
gaattgttacctgtcatttt

SEQ ID NO: 3477351 - DNA, 22 bp, Homo sapiens
gaatttaaaaggtgtcaacttt

SEQ ID NO: 3477352 - DNA, 16 bp, Homo sapiens
gaatttaataatctgt

SEQ ID NO: 3477353 - DNA, 13 bp, Homo sapiens
gaatttattcaat

SEQ ID NO: 3477354 - DNA, 19 bp, Homo sapiens
gaatttattgcacattgtt

SEQ ID NO: 3477355 - DNA, 12 bp, Homo sapiens
gaatttcacaag

SEQ ID NO: 3477356 - DNA, 17 bp, Homo sapiens
gaatttcccaggaccct

SEQ ID NO: 3477357 - DNA, 11 bp, Homo sapiens
gaatttgcaaa

SEQ ID NO: 3477358 - DNA, 17 bp, Homo sapiens
gaatttgcaaagtactg

SEQ ID NO: 3477359 - DNA, 15 bp, Homo sapiens
gaatttttaaaataa

SEQ ID NO: 3477360 - DNA, 19 bp, Homo sapiens
gaatttttaaaataaactg

SEQ ID NO: 3477361 - DNA, 21 bp, Homo sapiens
gaatttttgcaataatgcagt

SEQ ID NO: 3477362 - DNA, 23 bp, Homo sapiens
gaatttttgcttgacttcagtta

SEQ ID NO: 3477363 - DNA, 16 bp, Homo sapiens
gaatttttttcatctt

SEQ ID NO: 3477364 - DNA, 20 bp, Homo sapiens
gaatttttttctgcacagct

SEQ ID NO: 3477365 - DNA, 18 bp, Homo sapiens
gaattttttttaatgctt

SEQ ID NO: 3477366 - DNA, 20 bp, Homo sapiens
gaattttttttaatgcttaa

SEQ ID NO: 3477367 - DNA, 17 bp, Homo sapiens
gacaaaaattatttttt

SEQ ID NO: 3477368 - DNA, 17 bp, Homo sapiens
gacaaaatggatacata

SEQ ID NO: 3477369 - DNA, 19 bp, Homo sapiens
gacaaagaattccaaagca

SEQ ID NO: 3477370 - DNA, 19 bp, Homo sapiens
gacaaattcatattctttt

SEQ ID NO: 3477371 - DNA, 15 bp, Homo sapiens
gacaaattctgtttc

SEQ ID NO: 3477372 - DNA, 17 bp, Homo sapiens
gacaaattctgtttctt

SEQ ID NO: 3477373 - DNA, 20 bp, Homo sapiens
gacaaattctgtttcttgag

SEQ ID NO: 3477374 - DNA, 11 bp, Homo sapiens
gacaacatctg

SEQ ID NO: 3477375 - DNA, 12 bp, Homo sapiens
gacaacattaaa

SEQ ID NO: 3477376 - DNA, 15 bp, Homo sapiens
gacaacgaggaagcc

SEQ ID NO: 3477377 - DNA, 17 bp, Homo sapiens
gacaacgtttcagcgac

SEQ ID NO: 3477378 - DNA, 15 bp, Homo sapiens
gacaactggcaggca

SEQ ID NO: 3477379 - DNA, 16 bp, Homo sapiens
gacaagacttcagtat

SEQ ID NO: 3477380 - DNA, 24 bp, Homo sapiens
gacaagacttcagtatgttgtcaa

SEQ ID NO: 3477381 - DNA, 19 bp, Homo sapiens
gacaagcaattagacaaga

SEQ ID NO: 3477382 - DNA, 18 bp, Homo sapiens
gacaaggaaggaaaagaa

SEQ ID NO: 3477383 - DNA, 15 bp, Homo sapiens
gacaaggccagcacc

SEQ ID NO: 3477384 - DNA, 15 bp, Homo sapiens
gacaataaaatatta

SEQ ID NO: 3477385 - DNA, 19 bp, Homo sapiens
gacaatatgtgagtgcctt

SEQ ID NO: 3477386 - DNA, 19 bp, Homo sapiens
gacaatcatgaaatatgca

SEQ ID NO: 3477387 - DNA, 17 bp, Homo sapiens
gacaatgtctgcagccc

SEQ ID NO: 3477388 - DNA, 12 bp, Homo sapiens
gacaatgtgaaa

SEQ ID NO: 3477389 - DNA, 20 bp, Homo sapiens
gacaatgtgaaaagaaaaat

SEQ ID NO: 3477390 - DNA, 15 bp, Homo sapiens
gacacaaacacacac

SEQ ID NO: 3477391 - DNA, 17 bp, Homo sapiens
gacacaaacctgcctgg

SEQ ID NO: 3477392 - DNA, 18 bp, Homo sapiens
gacacaaacctgcctggg

SEQ ID NO: 3477393 - DNA, 20 bp, Homo sapiens
gacacaaacctgcctgggtt

SEQ ID NO: 3477394 - DNA, 12 bp, Homo sapiens
gacacacacaca

SEQ ID NO: 3477395 - DNA, 14 bp, Homo sapiens
gacacacagctctg

SEQ ID NO: 3477396 - DNA, 21 bp, Homo sapiens
gacacacagctctgtcctggg

SEQ ID NO: 3477397 - DNA, 12 bp, Homo sapiens
gacacagctctt

SEQ ID NO: 3477398 - DNA, 13 bp, Homo sapiens
gacacagctcttc

SEQ ID NO: 3477399 - DNA, 19 bp, Homo sapiens
gacacagctcttctccagg

SEQ ID NO: 3477400 - DNA, 13 bp, Homo sapiens
gagcccctcggct

SEQ ID NO: 3477401 - DNA, 15 bp, Homo sapiens
gagcccctcggctct

SEQ ID NO: 3477402 - DNA, 20 bp, Homo sapiens
gagcccctcggctctggagg

SEQ ID NO: 3477403 - DNA, 16 bp, Homo sapiens
gagcccctggacatgc

SEQ ID NO: 3477404 - DNA, 20 bp, Homo sapiens
gagcccctggacatgcctgt

SEQ ID NO: 3477405 - DNA, 22 bp, Homo sapiens
gagcccctggacatgcctgtcc

SEQ ID NO: 3477406 - DNA, 22 bp, Homo sapiens
gagccccttctgctcagctctg

SEQ ID NO: 3477407 - DNA, 14 bp, Homo sapiens
gagcccggagctcc

SEQ ID NO: 3477408 - DNA, 13 bp, Homo sapiens
gagccctcagaac

SEQ ID NO: 3477409 - DNA, 15 bp, Homo sapiens
gagccctccgccttc

SEQ ID NO: 3477410 - DNA, 21 bp, Homo sapiens
gagccctgtggatgagccctc

SEQ ID NO: 3477411 - DNA, 19 bp, Homo sapiens
gagcccttatctgtgctca

SEQ ID NO: 3477412 - DNA, 19 bp, Homo sapiens
gagccgagatcacgccact

SEQ ID NO: 3477413 - DNA, 23 bp, Homo sapiens
gagccggcacctacatccccagg

SEQ ID NO: 3477414 - DNA, 16 bp, Homo sapiens
gagccgtggtccctga

SEQ ID NO: 3477415 - DNA, 13 bp, Homo sapiens
gagccgtggtcct

SEQ ID NO: 3477416 - DNA, 17 bp, Homo sapiens
gagccgtggtcctttgg

SEQ ID NO: 3477417 - DNA, 14 bp, Homo sapiens
gagcctcagcatcc

SEQ ID NO: 3477418 - DNA, 21 bp, Homo sapiens
gagcctcagcatcctggcacc

SEQ ID NO: 3477419 - DNA, 16 bp, Homo sapiens
gagcctctgctcccca

SEQ ID NO: 3477420 - DNA, 17 bp, Homo sapiens
gagcctctgctccccag

SEQ ID NO: 3477421 - DNA, 15 bp, Homo sapiens
gagcctcttggggaa

SEQ ID NO: 3477422 - DNA, 15 bp, Homo sapiens
gagcctgagggatct

SEQ ID NO: 3477423 - DNA, 15 bp, Homo sapiens
gagcctgcagttatt

SEQ ID NO: 3477424 - DNA, 15 bp, Homo sapiens
gagcctgctggaagc

SEQ ID NO: 3477425 - DNA, 16 bp, Homo sapiens
gagcctgctggaagcc

SEQ ID NO: 3477426 - DNA, 15 bp, Homo sapiens
gagcctggcaagaat

SEQ ID NO: 3477427 - DNA, 16 bp, Homo sapiens
gagcctggtgctgctg

SEQ ID NO: 3477428 - DNA, 17 bp, Homo sapiens
gagcctggtgctgctgc

SEQ ID NO: 3477429 - DNA, 14 bp, Homo sapiens
gagccttgggagcc

SEQ ID NO: 3477430 - DNA, 21 bp, Homo sapiens
gagccttgggagccactgcca

SEQ ID NO: 3477431 - DNA, 18 bp, Homo sapiens
gagcgaggagatgctcct

SEQ ID NO: 3477432 - DNA, 13 bp, Homo sapiens
gagcgcctgcccc

SEQ ID NO: 3477433 - DNA, 16 bp, Homo sapiens
gagcgcgcccctagcc

SEQ ID NO: 3477434 - DNA, 16 bp, Homo sapiens
gagcggaaagcagctc

SEQ ID NO: 3477435 - DNA, 19 bp, Homo sapiens
gagcggtgctgtcctcagg

SEQ ID NO: 3477436 - DNA, 20 bp, Homo sapiens
gagctaaactccttcctggc

SEQ ID NO: 3477437 - DNA, 12 bp, Homo sapiens
gagctagccaga

SEQ ID NO: 3477438 - DNA, 18 bp, Homo sapiens
gagctcacctgtttgaaa

SEQ ID NO: 3477439 - DNA, 21 bp, Homo sapiens
gagctcagacattttcttttt

SEQ ID NO: 3477440 - DNA, 18 bp, Homo sapiens
gagctcagagagggcagg

SEQ ID NO: 3477441 - DNA, 12 bp, Homo sapiens
gagctccactct

SEQ ID NO: 3477442 - DNA, 20 bp, Homo sapiens
gagctcccaggtgcagccag

SEQ ID NO: 3477443 - DNA, 20 bp, Homo sapiens
gagctctacccagggcctgc

SEQ ID NO: 3477444 - DNA, 21 bp, Homo sapiens
gagctctacccagggcctgca

SEQ ID NO: 3477445 - DNA, 17 bp, Homo sapiens
gagctcttgtgaggaaa

SEQ ID NO: 3477446 - DNA, 18 bp, Homo sapiens
gagctgacacaaacctgc

SEQ ID NO: 3477447 - DNA, 23 bp, Homo sapiens
gagctgacacaaacctgcctggg

SEQ ID NO: 3477448 - DNA, 17 bp, Homo sapiens
gagctgacacaggatga

SEQ ID NO: 3477449 - DNA, 15 bp, Homo sapiens
gagctgcccctctct

SEQ ID NO: 3477450 - DNA, 19 bp, Homo sapiens
gagctgcccctctctgggc

SEQ ID NO: 3477451 - DNA, 15 bp, Homo sapiens
gagctgcctgttcag

SEQ ID NO: 3477452 - DNA, 18 bp, Homo sapiens
gagctgccttggctcaga

SEQ ID NO: 3477453 - DNA, 18 bp, Homo sapiens
gagctgctatagcctggg

SEQ ID NO: 3477454 - DNA, 20 bp, Homo sapiens
gagctgctatagcctggggt

SEQ ID NO: 3477455 - DNA, 21 bp, Homo sapiens
gagctgctatagcctggggtg

SEQ ID NO: 3477456 - DNA, 14 bp, Homo sapiens
gagctgcttcacta

SEQ ID NO: 3477457 - DNA, 20 bp, Homo sapiens
gagctggagcctggtgccct

SEQ ID NO: 3477458 - DNA, 18 bp, Homo sapiens
gagctggccaaagagcct

SEQ ID NO: 3477459 - DNA, 20 bp, Homo sapiens
gagctggccaaagagccttt

SEQ ID NO: 3477460 - DNA, 16 bp, Homo sapiens
gagctggccccgccgc

SEQ ID NO: 3477461 - DNA, 17 bp, Homo sapiens
gagctggccgtgggcct

SEQ ID NO: 3477462 - DNA, 23 bp, Homo sapiens
gagctggctctataaggcagcct

SEQ ID NO: 3477463 - DNA, 17 bp, Homo sapiens
gagctggctctgagcgc

SEQ ID NO: 3477464 - DNA, 16 bp, Homo sapiens
gagctggtggacccag

SEQ ID NO: 3477465 - DNA, 23 bp, Homo sapiens
gagctggtggacccagggaacag

SEQ ID NO: 3477466 - DNA, 18 bp, Homo sapiens
gagctgtattaagccact

SEQ ID NO: 3477467 - DNA, 18 bp, Homo sapiens
gagctgtcaccaaggaaa

SEQ ID NO: 3477468 - DNA, 16 bp, Homo sapiens
gagcttagcatatctg

SEQ ID NO: 3477469 - DNA, 22 bp, Homo sapiens
gagcttataaaatttaacttct

SEQ ID NO: 3477470 - DNA, 19 bp, Homo sapiens
gagcttcatggcagaaggc

SEQ ID NO: 3477471 - DNA, 17 bp, Homo sapiens
gagcttccctgactcat

SEQ ID NO: 3477472 - DNA, 10 bp, Homo sapiens
gagcttctct

SEQ ID NO: 3477473 - DNA, 14 bp, Homo sapiens
gagcttgcaagaag

SEQ ID NO: 3477474 - DNA, 20 bp, Homo sapiens
gaggaaacgggttaaaaatt

SEQ ID NO: 3477475 - DNA, 21 bp, Homo sapiens
gaggaaagggaggagtggagg

SEQ ID NO: 3477476 - DNA, 18 bp, Homo sapiens
gaggaaagtcattggctt

SEQ ID NO: 3477477 - DNA, 20 bp, Homo sapiens
gaggaaagtcattggcttta

SEQ ID NO: 3477478 - DNA, 22 bp, Homo sapiens
gaggaaccaggagaagggctgg

SEQ ID NO: 3477479 - DNA, 17 bp, Homo sapiens
gaggaagagaaaaaata

SEQ ID NO: 3477480 - DNA, 19 bp, Homo sapiens
gaggaaggggccagaggct

SEQ ID NO: 3477481 - DNA, 14 bp, Homo sapiens
gaggaatccagacc

SEQ ID NO: 3477482 - DNA, 15 bp, Homo sapiens
gaggaatccagaccc

SEQ ID NO: 3477483 - DNA, 22 bp, Homo sapiens
gaggaatctgtgggtctgggag

SEQ ID NO: 3477484 - DNA, 13 bp, Homo sapiens
gaggacagggagg

SEQ ID NO: 3477485 - DNA, 23 bp, Homo sapiens
gaggacagggaggtgaccccagg

SEQ ID NO: 3477486 - DNA, 20 bp, Homo sapiens
gaggacataatggggtcctg

SEQ ID NO: 3477487 - DNA, 19 bp, Homo sapiens
gaggacgtgttacccactg

SEQ ID NO: 3477488 - DNA, 20 bp, Homo sapiens
gaggacttcggggtagaggc

SEQ ID NO: 3477489 - DNA, 16 bp, Homo sapiens
gaggagagaaaatata

SEQ ID NO: 3477490 - DNA, 15 bp, Homo sapiens
gaggagagagacaga

SEQ ID NO: 3477491 - DNA, 20 bp, Homo sapiens
gaggagagatagcctgtggc

SEQ ID NO: 3477492 - DNA, 17 bp, Homo sapiens
gaggagcagtgcaggca

SEQ ID NO: 3477493 - DNA, 13 bp, Homo sapiens
gaggagccccatc

SEQ ID NO: 3477494 - DNA, 21 bp, Homo sapiens
gaggagcccctggacatgcct

SEQ ID NO: 3477495 - DNA, 18 bp, Homo sapiens
gaggaggctccagagggc

SEQ ID NO: 3477496 - DNA, 19 bp, Homo sapiens
gaggaggggcccccctgcc

SEQ ID NO: 3477497 - DNA, 21 bp, Homo sapiens
gaggaggggcccccctgccct

SEQ ID NO: 3477498 - DNA, 16 bp, Homo sapiens
gaggaggggccgctgc

SEQ ID NO: 3477499 - DNA, 21 bp, Homo sapiens
gaggaggtgtgaggaggaggc

SEQ ID NO: 3477500 - DNA, 15 bp, Homo sapiens
gaggagttagccaaa

SEQ ID NO: 3477501 - DNA, 13 bp, Homo sapiens
gaggatctcttga

SEQ ID NO: 3477502 - DNA, 14 bp, Homo sapiens
gaggattgctgcca

SEQ ID NO: 3477503 - DNA, 15 bp, Homo sapiens
gaggattgctgccag

SEQ ID NO: 3477504 - DNA, 16 bp, Homo sapiens
gaggattgctgccaga

SEQ ID NO: 3477505 - DNA, 16 bp, Homo sapiens
gaggattgcttgagct

SEQ ID NO: 3477506 - DNA, 13 bp, Homo sapiens
gaggcactgaagc

SEQ ID NO: 3477507 - DNA, 22 bp, Homo sapiens
gaggcagcagtgtgaggccagg

SEQ ID NO: 3477508 - DNA, 18 bp, Homo sapiens
gaggcagccccattctgc

SEQ ID NO: 3477509 - DNA, 22 bp, Homo sapiens
gaggcagccccattctgcctgc

SEQ ID NO: 3477510 - DNA, 12 bp, Homo sapiens
gaggcagcccgc

SEQ ID NO: 3477511 - DNA, 22 bp, Homo sapiens
gaggcagggaagtccccaggcc

SEQ ID NO: 3477512 - DNA, 14 bp, Homo sapiens
gaggcagggtctca

SEQ ID NO: 3477513 - DNA, 18 bp, Homo sapiens
gaggcagggtctcactct

SEQ ID NO: 3477514 - DNA, 20 bp, Homo sapiens
gaggcagggtctcactctgt

SEQ ID NO: 3477515 - DNA, 21 bp, Homo sapiens
gaggcatcatggaaagactgg

SEQ ID NO: 3477516 - DNA, 18 bp, Homo sapiens
gaggcatccagcagtctc

SEQ ID NO: 3477517 - DNA, 21 bp, Homo sapiens
gaggcatccagcagtctctgc

SEQ ID NO: 3477518 - DNA, 19 bp, Homo sapiens
gaggccagctatctgcctg

SEQ ID NO: 3477519 - DNA, 20 bp, Homo sapiens
gaggccagctatctgcctga

SEQ ID NO: 3477520 - DNA, 15 bp, Homo sapiens
gaggccagggcagag

SEQ ID NO: 3477521 - DNA, 17 bp, Homo sapiens
gaggccagtacctttcc

SEQ ID NO: 3477522 - DNA, 14 bp, Homo sapiens
gaggccatgggcct

SEQ ID NO: 3477523 - DNA, 20 bp, Homo sapiens
gaggccatgggcctcctgtg

SEQ ID NO: 3477524 - DNA, 16 bp, Homo sapiens
gaggcccaggctggga

SEQ ID NO: 3477525 - DNA, 18 bp, Homo sapiens
gaggcccagttcaccctg

SEQ ID NO: 3477526 - DNA, 20 bp, Homo sapiens
gaggcccccagcccagggct

SEQ ID NO: 3477527 - DNA, 24 bp, Homo sapiens
gaggcccctatgtagtccgtgctg

SEQ ID NO: 3477528 - DNA, 17 bp, Homo sapiens
gaggccctctggagtgg

SEQ ID NO: 3477529 - DNA, 22 bp, Homo sapiens
gaggccctgtgccccttgacaa

SEQ ID NO: 3477530 - DNA, 18 bp, Homo sapiens
gaggcctaccccgcagac

SEQ ID NO: 3477531 - DNA, 18 bp, Homo sapiens
gaggcctactcttccatc

SEQ ID NO: 3477532 - DNA, 17 bp, Homo sapiens
gcaaattcttttgaatt

SEQ ID NO: 3477533 - DNA, 20 bp, Homo sapiens
gcaacaaggtcctctgtcag

SEQ ID NO: 3477534 - DNA, 12 bp, Homo sapiens
gcaacagatctg

SEQ ID NO: 3477535 - DNA, 18 bp, Homo sapiens
gcaacaggaatctcagag

SEQ ID NO: 3477536 - DNA, 14 bp, Homo sapiens
gcaacaggctgggc

SEQ ID NO: 3477537 - DNA, 22 bp, Homo sapiens
gcaacagggtatggactatctg

SEQ ID NO: 3477538 - DNA, 13 bp, Homo sapiens
gcaacatccaaaa

SEQ ID NO: 3477539 - DNA, 17 bp, Homo sapiens
gcaacatccaaaatagt

SEQ ID NO: 3477540 - DNA, 18 bp, Homo sapiens
gcaacatctagcaaatgt

SEQ ID NO: 3477541 - DNA, 13 bp, Homo sapiens
gcaacatcttttt

SEQ ID NO: 3477542 - DNA, 21 bp, Homo sapiens
gcaacattgttcacctttgta

SEQ ID NO: 3477543 - DNA, 22 bp, Homo sapiens
gcaacattttcttgaatttttt

SEQ ID NO: 3477544 - DNA, 16 bp, Homo sapiens
gcaacctcttggcctg

SEQ ID NO: 3477545 - DNA, 22 bp, Homo sapiens
gcaactacccaaaacaagcctg

SEQ ID NO: 3477546 - DNA, 14 bp, Homo sapiens
gcaactcatcttag

SEQ ID NO: 3477547 - DNA, 18 bp, Homo sapiens
gcaactgctcagctctgg

SEQ ID NO: 3477548 - DNA, 22 bp, Homo sapiens
gcaactggagccagcaaccagc

SEQ ID NO: 3477549 - DNA, 17 bp, Homo sapiens
gcaagaaagaaacccga

SEQ ID NO: 3477550 - DNA, 13 bp, Homo sapiens
gcaagattgctta

SEQ ID NO: 3477551 - DNA, 18 bp, Homo sapiens
gcaagcacctcctgcctc

SEQ ID NO: 3477552 - DNA, 22 bp, Homo sapiens
gcaagcatgtaacttatattaa

SEQ ID NO: 3477553 - DNA, 23 bp, Homo sapiens
gcaagccctgttgacacaggtct

SEQ ID NO: 3477554 - DNA, 16 bp, Homo sapiens
gcaaggaaaaacaggt

SEQ ID NO: 3477555 - DNA, 13 bp, Homo sapiens
gcaaggctgtgct

SEQ ID NO: 3477556 - DNA, 22 bp, Homo sapiens
gcaagggcacaagtcctggatg

SEQ ID NO: 3477557 - DNA, 16 bp, Homo sapiens
gcaagggttccctcaa

SEQ ID NO: 3477558 - DNA, 18 bp, Homo sapiens
gcaagtccttttgtaaag

SEQ ID NO: 3477559 - DNA, 20 bp, Homo sapiens
gcaagtgaatttttctctaa

SEQ ID NO: 3477560 - DNA, 19 bp, Homo sapiens
gcaagtgagagctgggtgt

SEQ ID NO: 3477561 - DNA, 12 bp, Homo sapiens
gcaagtgctcag

SEQ ID NO: 3477562 - DNA, 16 bp, Homo sapiens
gcaataaatctgaccc

SEQ ID NO: 3477563 - DNA, 17 bp, Homo sapiens
gcaatcctctcacctca

SEQ ID NO: 3477564 - DNA, 23 bp, Homo sapiens
gcaatctccccttgatttaaaca

SEQ ID NO: 3477565 - DNA, 23 bp, Homo sapiens
gcaatgccatcctcaaacactgc

SEQ ID NO: 3477566 - DNA, 13 bp, Homo sapiens
gcaatgctggctg

SEQ ID NO: 3477567 - DNA, 13 bp, Homo sapiens
gcaatggcagcct

SEQ ID NO: 3477568 - DNA, 20 bp, Homo sapiens
gcaatgggagctgaggccac

SEQ ID NO: 3477569 - DNA, 19 bp, Homo sapiens
gcaatgtctgagtgaacct

SEQ ID NO: 3477570 - DNA, 16 bp, Homo sapiens
gcaatttccccctaaa

SEQ ID NO: 3477571 - DNA, 23 bp, Homo sapiens
gcacaaagatgggtgaaggctgg

SEQ ID NO: 3477572 - DNA, 13 bp, Homo sapiens
gcacaaagctcaa

SEQ ID NO: 3477573 - DNA, 19 bp, Homo sapiens
gcacaagatgccccaggga

SEQ ID NO: 3477574 - DNA, 12 bp, Homo sapiens
gcacacaccaga

SEQ ID NO: 3477575 - DNA, 14 bp, Homo sapiens
gcacacaccagagc

SEQ ID NO: 3477576 - DNA, 11 bp, Homo sapiens
gcacacactgt

SEQ ID NO: 3477577 - DNA, 13 bp, Homo sapiens
gcacacagctact

SEQ ID NO: 3477578 - DNA, 15 bp, Homo sapiens
gcacacccaggtttg

SEQ ID NO: 3477579 - DNA, 20 bp, Homo sapiens
gcacaccgggcactcagaag

SEQ ID NO: 3477580 - DNA, 14 bp, Homo sapiens
gcacacgcctccca

SEQ ID NO: 3477581 - DNA, 20 bp, Homo sapiens
gcacacttggcccaagtggc

SEQ ID NO: 3477582 - DNA, 15 bp, Homo sapiens
gcacagaagtcctgt

SEQ ID NO: 3477583 - DNA, 16 bp, Homo sapiens
gcacagaagtcctgta

SEQ ID NO: 3477584 - DNA, 18 bp, Homo sapiens
gcacagaagtcctgtatg

SEQ ID NO: 3477585 - DNA, 22 bp, Homo sapiens
gcacagccaacacgcacctgcc

SEQ ID NO: 3477586 - DNA, 13 bp, Homo sapiens
gcacagctgggat

SEQ ID NO: 3477587 - DNA, 16 bp, Homo sapiens
gcacagcttcatttcc

SEQ ID NO: 3477588 - DNA, 23 bp, Homo sapiens
gcacagcttcatttcctgtgtct

SEQ ID NO: 3477589 - DNA, 21 bp, Homo sapiens
gcacagcttgacctgaggctg

SEQ ID NO: 3477590 - DNA, 22 bp, Homo sapiens
gcacagcttgacctgaggctgt

SEQ ID NO: 3477591 - DNA, 15 bp, Homo sapiens
gcacaggacacctgg

SEQ ID NO: 3477592 - DNA, 21 bp, Homo sapiens
gcacaggacatgcggtagcca

SEQ ID NO: 3477593 - DNA, 20 bp, Homo sapiens
gcacaggtgggcttcccagt

SEQ ID NO: 3477594 - DNA, 20 bp, Homo sapiens
gcacatattagtgcagccaa

SEQ ID NO: 3477595 - DNA, 13 bp, Homo sapiens
gcacatctctgct

SEQ ID NO: 3477596 - DNA, 17 bp, Homo sapiens
gcacatgtcttaatgaa

SEQ ID NO: 3477597 - DNA, 21 bp, Homo sapiens
gcacatgtcttaatgaagttt

SEQ ID NO: 3477598 - DNA, 20 bp, Homo sapiens
gcacatgttggaggagagag

SEQ ID NO: 3477599 - DNA, 21 bp, Homo sapiens
gcacatgttggaggagagagc

SEQ ID NO: 3477600 - DNA, 15 bp, Homo sapiens
gcacattcctttggg

SEQ ID NO: 3477601 - DNA, 15 bp, Homo sapiens
gcaccaagcaggaaa

SEQ ID NO: 3477602 - DNA, 19 bp, Homo sapiens
gcaccaagggacaggagaa

SEQ ID NO: 3477603 - DNA, 20 bp, Homo sapiens
gcaccaagggacaggagaag

SEQ ID NO: 3477604 - DNA, 17 bp, Homo sapiens
gcaccaccaagccaagg

SEQ ID NO: 3477605 - DNA, 18 bp, Homo sapiens
gcaccaccaagccaaggg

SEQ ID NO: 3477606 - DNA, 19 bp, Homo sapiens
gcaccactgcactccagcc

SEQ ID NO: 3477607 - DNA, 18 bp, Homo sapiens
gcaccagacacccaggac

SEQ ID NO: 3477608 - DNA, 13 bp, Homo sapiens
gcaccagcagcct

SEQ ID NO: 3477609 - DNA, 13 bp, Homo sapiens
gcaccagccagcg

SEQ ID NO: 3477610 - DNA, 19 bp, Homo sapiens
gcaccagccagcgtagcag

SEQ ID NO: 3477611 - DNA, 16 bp, Homo sapiens
gcaccaggggtttctc

SEQ ID NO: 3477612 - DNA, 19 bp, Homo sapiens
gcaccaggggtttctcgca

SEQ ID NO: 3477613 - DNA, 23 bp, Homo sapiens
gcaccagttttatccataatgat

SEQ ID NO: 3477614 - DNA, 15 bp, Homo sapiens
gcaccattctgactc

SEQ ID NO: 3477615 - DNA, 17 bp, Homo sapiens
gcaccattctgactcgg

SEQ ID NO: 3477616 - DNA, 19 bp, Homo sapiens
gcaccattttaagtccctg

SEQ ID NO: 3477617 - DNA, 15 bp, Homo sapiens
gcacccaaagggtta

SEQ ID NO: 3477618 - DNA, 18 bp, Homo sapiens
gcacccggcccctgctgg

SEQ ID NO: 3477619 - DNA, 24 bp, Homo sapiens
gcaccctgcagagcacacaggtac

SEQ ID NO: 3477620 - DNA, 22 bp, Homo sapiens
gcaccgcggcgcttcccagcac

SEQ ID NO: 3477621 - DNA, 14 bp, Homo sapiens
gcaccgggccacag

SEQ ID NO: 3477622 - DNA, 23 bp, Homo sapiens
gcaccgggccacagagaaagtac

SEQ ID NO: 3477623 - DNA, 16 bp, Homo sapiens
gcacctaatccaggca

SEQ ID NO: 3477624 - DNA, 17 bp, Homo sapiens
gcacctacatccccagg

SEQ ID NO: 3477625 - DNA, 17 bp, Homo sapiens
gcacctcccatcctaat

SEQ ID NO: 3477626 - DNA, 12 bp, Homo sapiens
gcacctcctgcc

SEQ ID NO: 3477627 - DNA, 15 bp, Homo sapiens
gcacctcctgcctcg

SEQ ID NO: 3477628 - DNA, 24 bp, Homo sapiens
gcacctctcttgaaccccaaatgc

SEQ ID NO: 3477629 - DNA, 13 bp, Homo sapiens
gcacctgcctcag

SEQ ID NO: 3477630 - DNA, 21 bp, Homo sapiens
gcacggaccatgcgacactgg

SEQ ID NO: 3477631 - DNA, 18 bp, Homo sapiens
gcacggtgactctgtcca

SEQ ID NO: 3477632 - DNA, 14 bp, Homo sapiens
gcacgtgcctgtgg

SEQ ID NO: 3477633 - DNA, 19 bp, Homo sapiens
gcacgtgcctgtgggcctg

SEQ ID NO: 3477634 - DNA, 23 bp, Homo sapiens
gcactaaggggcccggccagcca

SEQ ID NO: 3477635 - DNA, 19 bp, Homo sapiens
gcactaaggtgtgctctga

SEQ ID NO: 3477636 - DNA, 20 bp, Homo sapiens
gcactaccactcctgccaag

SEQ ID NO: 3477637 - DNA, 18 bp, Homo sapiens
gcactatctttcagctcc

SEQ ID NO: 3477638 - DNA, 19 bp, Homo sapiens
gcactatctttcagctcca

SEQ ID NO: 3477639 - DNA, 15 bp, Homo sapiens
gcactccagcctggg

SEQ ID NO: 3477640 - DNA, 15 bp, Homo sapiens
gcactccctcctgga

SEQ ID NO: 3477641 - DNA, 13 bp, Homo sapiens
gcactgatgctgc

SEQ ID NO: 3477642 - DNA, 18 bp, Homo sapiens
gcactgatgctgcccctc

SEQ ID NO: 3477643 - DNA, 17 bp, Homo sapiens
gcactgcttgaggaaaa

SEQ ID NO: 3477644 - DNA, 22 bp, Homo sapiens
gcactgtaagacgtatgtaaca

SEQ ID NO: 3477645 - DNA, 11 bp, Homo sapiens
gcactgtgaag

SEQ ID NO: 3477646 - DNA, 19 bp, Homo sapiens
gcactgtgacccccagctc

SEQ ID NO: 3477647 - DNA, 18 bp, Homo sapiens
gcactgtgctcagggcta

SEQ ID NO: 3477648 - DNA, 19 bp, Homo sapiens
gcactgttccccctgtgca

SEQ ID NO: 3477649 - DNA, 18 bp, Homo sapiens
gcacttatttaatgccga

SEQ ID NO: 3477650 - DNA, 23 bp, Homo sapiens
gcacttcatctggctgcctttgc

SEQ ID NO: 3477651 - DNA, 14 bp, Homo sapiens
gcacttgcagactc

SEQ ID NO: 3477652 - DNA, 21 bp, Homo sapiens
gcacttgtgattatttattat

SEQ ID NO: 3477653 - DNA, 20 bp, Homo sapiens
gcactttagggctgtaaaat

SEQ ID NO: 3477654 - DNA, 22 bp, Homo sapiens
gcactttctacaatgtgaactt

SEQ ID NO: 3477655 - DNA, 18 bp, Homo sapiens
gcagaaaataaaggaagc

SEQ ID NO: 3477656 - DNA, 18 bp, Homo sapiens
gcagaaaccctgagcaga

SEQ ID NO: 3477657 - DNA, 15 bp, Homo sapiens
gcagaaccagcctca

SEQ ID NO: 3477658 - DNA, 12 bp, Homo sapiens
gcagaagagggt

SEQ ID NO: 3477659 - DNA, 22 bp, Homo sapiens
gcagaagggggtggtgtctcca

SEQ ID NO: 3477660 - DNA, 16 bp, Homo sapiens
gcagacacagggactt

SEQ ID NO: 3477661 - DNA, 21 bp, Homo sapiens
gcagacacagggacttgaagt

SEQ ID NO: 3477662 - DNA, 22 bp, Homo sapiens
gcagacacagggacttgaagtt

SEQ ID NO: 3477663 - DNA, 19 bp, Homo sapiens
gcagacaggcaagcacctc

SEQ ID NO: 3477664 - DNA, 20 bp, Homo sapiens
gccaccaccctgtcttcctc

SEQ ID NO: 3477665 - DNA, 14 bp, Homo sapiens
gccaccacgtccag

SEQ ID NO: 3477666 - DNA, 15 bp, Homo sapiens
gccaccacgtccagc

SEQ ID NO: 3477667 - DNA, 16 bp, Homo sapiens
gccaccacgtccagct

SEQ ID NO: 3477668 - DNA, 22 bp, Homo sapiens
gccaccatgcctcactaatttt

SEQ ID NO: 3477669 - DNA, 16 bp, Homo sapiens
gccacccacctccctg

SEQ ID NO: 3477670 - DNA, 18 bp, Homo sapiens
gccacccccccaccccag

SEQ ID NO: 3477671 - DNA, 20 bp, Homo sapiens
gccacccctaaactccaggg

SEQ ID NO: 3477672 - DNA, 13 bp, Homo sapiens
gccaccctgggga

SEQ ID NO: 3477673 - DNA, 19 bp, Homo sapiens
gccaccctggggagaaagt

SEQ ID NO: 3477674 - DNA, 13 bp, Homo sapiens
gccacgctccagc

SEQ ID NO: 3477675 - DNA, 15 bp, Homo sapiens
gccacgctccagctg

SEQ ID NO: 3477676 - DNA, 15 bp, Homo sapiens
gccacggccaggcca

SEQ ID NO: 3477677 - DNA, 16 bp, Homo sapiens
gccacggccaggccag

SEQ ID NO: 3477678 - DNA, 20 bp, Homo sapiens
gccactaagaacccctctgc

SEQ ID NO: 3477679 - DNA, 13 bp, Homo sapiens
gccactaagcaga

SEQ ID NO: 3477680 - DNA, 23 bp, Homo sapiens
gccactaagcagaggaggggccg

SEQ ID NO: 3477681 - DNA, 18 bp, Homo sapiens
gccactcactaggccccc

SEQ ID NO: 3477682 - DNA, 16 bp, Homo sapiens
gccactccagtcctgc

SEQ ID NO: 3477683 - DNA, 21 bp, Homo sapiens
gccactccgagaggtgggcca

SEQ ID NO: 3477684 - DNA, 12 bp, Homo sapiens
gccactcctccc

SEQ ID NO: 3477685 - DNA, 21 bp, Homo sapiens
gccactcctctgactcagggc

SEQ ID NO: 3477686 - DNA, 12 bp, Homo sapiens
gccactgccact

SEQ ID NO: 3477687 - DNA, 16 bp, Homo sapiens
gccactgccactccag

SEQ ID NO: 3477688 - DNA, 22 bp, Homo sapiens
gccactgccttcgcttcttgcc

SEQ ID NO: 3477689 - DNA, 19 bp, Homo sapiens
gccactgggccctgagcca

SEQ ID NO: 3477690 - DNA, 20 bp, Homo sapiens
gccactgggccctgagccag

SEQ ID NO: 3477691 - DNA, 18 bp, Homo sapiens
gccactggtttctcagaa

SEQ ID NO: 3477692 - DNA, 20 bp, Homo sapiens
gccactggtttctcagaatc

SEQ ID NO: 3477693 - DNA, 19 bp, Homo sapiens
gccactgtgaagagaacca

SEQ ID NO: 3477694 - DNA, 23 bp, Homo sapiens
gccacttctgggtggggcagtgg

SEQ ID NO: 3477695 - DNA, 23 bp, Homo sapiens
gccagaagcctctgcctccctag

SEQ ID NO: 3477696 - DNA, 19 bp, Homo sapiens
gccagacagaccttcacag

SEQ ID NO: 3477697 - DNA, 15 bp, Homo sapiens
gccagagacaaggtc

SEQ ID NO: 3477698 - DNA, 13 bp, Homo sapiens
gccagaggcacct

SEQ ID NO: 3477699 - DNA, 12 bp, Homo sapiens
gccagaggctgg

SEQ ID NO: 3477700 - DNA, 20 bp, Homo sapiens
gccagagggagtgacagagg

SEQ ID NO: 3477701 - DNA, 21 bp, Homo sapiens
gccagagggagtgacagaggc

SEQ ID NO: 3477702 - DNA, 13 bp, Homo sapiens
gccagaggtgctt

SEQ ID NO: 3477703 - DNA, 17 bp, Homo sapiens
gccagatccagcctggg

SEQ ID NO: 3477704 - DNA, 20 bp, Homo sapiens
gccagatccagcctggggtc

SEQ ID NO: 3477705 - DNA, 14 bp, Homo sapiens
gccagatgcaccag

SEQ ID NO: 3477706 - DNA, 16 bp, Homo sapiens
gccagatgcaccagcc

SEQ ID NO: 3477707 - DNA, 13 bp, Homo sapiens
gccagcacacagg

SEQ ID NO: 3477708 - DNA, 15 bp, Homo sapiens
gccagcacccaaagg

SEQ ID NO: 3477709 - DNA, 18 bp, Homo sapiens
gccagcacccaaagggtt

SEQ ID NO: 3477710 - DNA, 14 bp, Homo sapiens
gccagcacttgtcc

SEQ ID NO: 3477711 - DNA, 13 bp, Homo sapiens
gccagccagaagc

SEQ ID NO: 3477712 - DNA, 15 bp, Homo sapiens
gccagccaggccctg

SEQ ID NO: 3477713 - DNA, 22 bp, Homo sapiens
gccagccagtgacctgaggaag

SEQ ID NO: 3477714 - DNA, 13 bp, Homo sapiens
gccagccatgtct

SEQ ID NO: 3477715 - DNA, 20 bp, Homo sapiens
gccagcctgcgggaagctga

SEQ ID NO: 3477716 - DNA, 13 bp, Homo sapiens
gccagcgtcctcc

SEQ ID NO: 3477717 - DNA, 19 bp, Homo sapiens
gccagcgtcctcctctgtg

SEQ ID NO: 3477718 - DNA, 17 bp, Homo sapiens
gccagctatctgcctga

SEQ ID NO: 3477719 - DNA, 22 bp, Homo sapiens
gccagctatctgcctgacaggc

SEQ ID NO: 3477720 - DNA, 23 bp, Homo sapiens
gccagctctgtatcaggacccag

SEQ ID NO: 3477721 - DNA, 14 bp, Homo sapiens
gccagctgcactga

SEQ ID NO: 3477722 - DNA, 17 bp, Homo sapiens
gccagctgccccagcca

SEQ ID NO: 3477723 - DNA, 18 bp, Homo sapiens
gccagctgccccagccag

SEQ ID NO: 3477724 - DNA, 12 bp, Homo sapiens
gccagctgccta

SEQ ID NO: 3477725 - DNA, 13 bp, Homo sapiens
gccagctgcctag

SEQ ID NO: 3477726 - DNA, 21 bp, Homo sapiens
gccaggaatttcccaggaccc

SEQ ID NO: 3477727 - DNA, 23 bp, Homo sapiens
gccaggaatttcccaggaccctg

SEQ ID NO: 3477728 - DNA, 23 bp, Homo sapiens
gccaggccactgggccctgagcc

SEQ ID NO: 3477729 - DNA, 12 bp, Homo sapiens
gccaggccagct

SEQ ID NO: 3477730 - DNA, 19 bp, Homo sapiens
gccaggcccccaagcctgc

SEQ ID NO: 3477731 - DNA, 19 bp, Homo sapiens
gccaggccggcgagccctg

SEQ ID NO: 3477732 - DNA, 22 bp, Homo sapiens
gccaggcgcggtggctcacgcc

SEQ ID NO: 3477733 - DNA, 17 bp, Homo sapiens
gccaggctgaccacagc

SEQ ID NO: 3477734 - DNA, 18 bp, Homo sapiens
gccaggctgaccacagca

SEQ ID NO: 3477735 - DNA, 13 bp, Homo sapiens
gccaggctggtct

SEQ ID NO: 3477736 - DNA, 15 bp, Homo sapiens
gccaggctggtctca

SEQ ID NO: 3477737 - DNA, 14 bp, Homo sapiens
gccagggagaagct

SEQ ID NO: 3477738 - DNA, 15 bp, Homo sapiens
gccagggagaagctc

SEQ ID NO: 3477739 - DNA, 20 bp, Homo sapiens
gccagggagaagctcctctc

SEQ ID NO: 3477740 - DNA, 15 bp, Homo sapiens
gccagggagacctgg

SEQ ID NO: 3477741 - DNA, 21 bp, Homo sapiens
gccagggagacctggacacag

SEQ ID NO: 3477742 - DNA, 15 bp, Homo sapiens
gccagggcagagtga

SEQ ID NO: 3477743 - DNA, 16 bp, Homo sapiens
gccagggcagagtgag

SEQ ID NO: 3477744 - DNA, 14 bp, Homo sapiens
gccagggcagggcc

SEQ ID NO: 3477745 - DNA, 15 bp, Homo sapiens
gccagggccacgctc

SEQ ID NO: 3477746 - DNA, 11 bp, Homo sapiens
gccagggctgc

SEQ ID NO: 3477747 - DNA, 14 bp, Homo sapiens
gccagggctgcccc

SEQ ID NO: 3477748 - DNA, 21 bp, Homo sapiens
gccaggggaaaatcagcctgc

SEQ ID NO: 3477749 - DNA, 16 bp, Homo sapiens
gccagtacttgtcata

SEQ ID NO: 3477750 - DNA, 17 bp, Homo sapiens
gccagtcaagaagaaaa

SEQ ID NO: 3477751 - DNA, 21 bp, Homo sapiens
gccagtccaggctgccgtggg

SEQ ID NO: 3477752 - DNA, 18 bp, Homo sapiens
gccagtgacctgaggaag

SEQ ID NO: 3477753 - DNA, 13 bp, Homo sapiens
gccataaaacatt

SEQ ID NO: 3477754 - DNA, 14 bp, Homo sapiens
gccataaaacatta

SEQ ID NO: 3477755 - DNA, 20 bp, Homo sapiens
gccataaaacattaagaaaa

SEQ ID NO: 3477756 - DNA, 16 bp, Homo sapiens
gccataatatgatgca

SEQ ID NO: 3477757 - DNA, 17 bp, Homo sapiens
gccataatatgatgcaa

SEQ ID NO: 3477758 - DNA, 15 bp, Homo sapiens
gccatagccaggagc

SEQ ID NO: 3477759 - DNA, 18 bp, Homo sapiens
gccatagccaggagcgca

SEQ ID NO: 3477760 - DNA, 20 bp, Homo sapiens
gccatattctgttggccagt

SEQ ID NO: 3477761 - DNA, 19 bp, Homo sapiens
gccatcatcagtggagcca

SEQ ID NO: 3477762 - DNA, 14 bp, Homo sapiens
gccatccaggttca

SEQ ID NO: 3477763 - DNA, 15 bp, Homo sapiens
gccatccattctgga

SEQ ID NO: 3477764 - DNA, 20 bp, Homo sapiens
gccatcctcaaacactgcag

SEQ ID NO: 3477765 - DNA, 20 bp, Homo sapiens
gccatctcaattgtgctttg

SEQ ID NO: 3477766 - DNA, 22 bp, Homo sapiens
gccatctcaattgtgctttgta

SEQ ID NO: 3477767 - DNA, 12 bp, Homo sapiens
gccatctctgga

SEQ ID NO: 3477768 - DNA, 15 bp, Homo sapiens
gccatgatctgcagg

SEQ ID NO: 3477769 - DNA, 21 bp, Homo sapiens
gccatgatctgcaggggtctg

SEQ ID NO: 3477770 - DNA, 15 bp, Homo sapiens
gccatgatgcctctg

SEQ ID NO: 3477771 - DNA, 14 bp, Homo sapiens
gccatgcaagaact

SEQ ID NO: 3477772 - DNA, 19 bp, Homo sapiens
gccatgccagcttatctca

SEQ ID NO: 3477773 - DNA, 13 bp, Homo sapiens
gccatgcctcagc

SEQ ID NO: 3477774 - DNA, 17 bp, Homo sapiens
gccatgcctcagccctg

SEQ ID NO: 3477775 - DNA, 24 bp, Homo sapiens
gccatgctcctggcccactgcatc

SEQ ID NO: 3477776 - DNA, 14 bp, Homo sapiens
gccatgctgaggcc

SEQ ID NO: 3477777 - DNA, 21 bp, Homo sapiens
gccatgctgaggcctgggccg

SEQ ID NO: 3477778 - DNA, 14 bp, Homo sapiens
gccatggcctctgc

SEQ ID NO: 3477779 - DNA, 17 bp, Homo sapiens
gccatgtacagacagag

SEQ ID NO: 3477780 - DNA, 15 bp, Homo sapiens
gccatgtagaagctg

SEQ ID NO: 3477781 - DNA, 18 bp, Homo sapiens
gccatgtagaagctgcat

SEQ ID NO: 3477782 - DNA, 15 bp, Homo sapiens
gccatgtgactctgg

SEQ ID NO: 3477783 - DNA, 23 bp, Homo sapiens
gccatgtgactctggcttggcct

SEQ ID NO: 3477784 - DNA, 15 bp, Homo sapiens
gccatgttgcccctt

SEQ ID NO: 3477785 - DNA, 14 bp, Homo sapiens
gccatgttggccag

SEQ ID NO: 3477786 - DNA, 15 bp, Homo sapiens
gccatgttggccagg

SEQ ID NO: 3477787 - DNA, 18 bp, Homo sapiens
gccatgttggccaggctg

SEQ ID NO: 3477788 - DNA, 20 bp, Homo sapiens
gccattagccagatttgtct

SEQ ID NO: 3477789 - DNA, 16 bp, Homo sapiens
gccattattctatgta

SEQ ID NO: 3477790 - DNA, 21 bp, Homo sapiens
gccattgcacccagcccagat

SEQ ID NO: 3477791 - DNA, 12 bp, Homo sapiens
gccattgtgaac

SEQ ID NO: 3477792 - DNA, 18 bp, Homo sapiens
gccatttttcaaagcaat

SEQ ID NO: 3477793 - DNA, 13 bp, Homo sapiens
gcccaaaatttat

SEQ ID NO: 3477794 - DNA, 15 bp, Homo sapiens
gcccaagccagaggc

SEQ ID NO: 3477795 - DNA, 16 bp, Homo sapiens
gcccaagccagaggct

SEQ ID NO: 3477796 - DNA, 21 bp, Homo sapiens
gcccaagccagaggctgggtt

SEQ ID NO: 3477797 - DNA, 15 bp, Homo sapiens
gcctttcaaatttag

SEQ ID NO: 3477798 - DNA, 21 bp, Homo sapiens
gcctttcctcaaaactggagt

SEQ ID NO: 3477799 - DNA, 13 bp, Homo sapiens
gcctttcctctct

SEQ ID NO: 3477800 - DNA, 17 bp, Homo sapiens
gcctttgaatgtaacca

SEQ ID NO: 3477801 - DNA, 17 bp, Homo sapiens
gcctttgatgttacaga

SEQ ID NO: 3477802 - DNA, 14 bp, Homo sapiens
gccttttaattttt

SEQ ID NO: 3477803 - DNA, 19 bp, Homo sapiens
gccttttttcacggaagtt

SEQ ID NO: 3477804 - DNA, 23 bp, Homo sapiens
gccttttttcacggaagttttca

SEQ ID NO: 3477805 - DNA, 20 bp, Homo sapiens
gcgactccgttggccactcc

SEQ ID NO: 3477806 - DNA, 12 bp, Homo sapiens
gcgactttctgc

SEQ ID NO: 3477807 - DNA, 17 bp, Homo sapiens
gcgactttctgcctgga

SEQ ID NO: 3477808 - DNA, 23 bp, Homo sapiens
gcgagatggggtggggtggagaa

SEQ ID NO: 3477809 - DNA, 21 bp, Homo sapiens
gcgagcccctcggctctggag

SEQ ID NO: 3477810 - DNA, 15 bp, Homo sapiens
gcgagccctggtggc

SEQ ID NO: 3477811 - DNA, 15 bp, Homo sapiens
gcgatcccacacagg

SEQ ID NO: 3477812 - DNA, 20 bp, Homo sapiens
gcgatcccacacaggctggc

SEQ ID NO: 3477813 - DNA, 22 bp, Homo sapiens
gcgatctgggttcactgcaacc

SEQ ID NO: 3477814 - DNA, 13 bp, Homo sapiens
gcgattcttctgc

SEQ ID NO: 3477815 - DNA, 17 bp, Homo sapiens
gcgattcttctgcttca

SEQ ID NO: 3477816 - DNA, 19 bp, Homo sapiens
gcgcagccccatctgtgca

SEQ ID NO: 3477817 - DNA, 13 bp, Homo sapiens
gcgccacaggacc

SEQ ID NO: 3477818 - DNA, 22 bp, Homo sapiens
gcgccaggctgaccacagcaca

SEQ ID NO: 3477819 - DNA, 19 bp, Homo sapiens
gcgcccagtccttccacct

SEQ ID NO: 3477820 - DNA, 22 bp, Homo sapiens
gcgccccctccgccctgccact

SEQ ID NO: 3477821 - DNA, 17 bp, Homo sapiens
gcgccgcaaaccacact

SEQ ID NO: 3477822 - DNA, 18 bp, Homo sapiens
gcgccgcaaaccacactg

SEQ ID NO: 3477823 - DNA, 19 bp, Homo sapiens
gcgccgcaaaccacactgg

SEQ ID NO: 3477824 - DNA, 21 bp, Homo sapiens
gcgccgcaaaccacactggac

SEQ ID NO: 3477825 - DNA, 15 bp, Homo sapiens
gcgcctacaggagtg

SEQ ID NO: 3477826 - DNA, 19 bp, Homo sapiens
gcgcctccatccaaggcca

SEQ ID NO: 3477827 - DNA, 17 bp, Homo sapiens
gcgcctgcccctcccag

SEQ ID NO: 3477828 - DNA, 16 bp, Homo sapiens
gcgcctgctgcatgcc

SEQ ID NO: 3477829 - DNA, 15 bp, Homo sapiens
gcgcctttcccaact

SEQ ID NO: 3477830 - DNA, 21 bp, Homo sapiens
gcgcgatcccacacaggctgg

SEQ ID NO: 3477831 - DNA, 19 bp, Homo sapiens
gcgcgtgcatgtgtgcgtg

SEQ ID NO: 3477832 - DNA, 19 bp, Homo sapiens
gcgctcctgccgcagagct

SEQ ID NO: 3477833 - DNA, 20 bp, Homo sapiens
gcgctcctgccgcagagctg

SEQ ID NO: 3477834 - DNA, 23 bp, Homo sapiens
gcgctgccccatctcccctcagc

SEQ ID NO: 3477835 - DNA, 15 bp, Homo sapiens
gcgctgggcacttcc

SEQ ID NO: 3477836 - DNA, 18 bp, Homo sapiens
gcgctgggcacttccctg

SEQ ID NO: 3477837 - DNA, 22 bp, Homo sapiens
gcgctgggcacttccctgctgc

SEQ ID NO: 3477838 - DNA, 15 bp, Homo sapiens
gcggaaagcagctca

SEQ ID NO: 3477839 - DNA, 18 bp, Homo sapiens
gcggagccggcacctaca

SEQ ID NO: 3477840 - DNA, 14 bp, Homo sapiens
gcggagctggcccc

SEQ ID NO: 3477841 - DNA, 20 bp, Homo sapiens
gcggaggctgctcagatggc

SEQ ID NO: 3477842 - DNA, 12 bp, Homo sapiens
gcggcaggactg

SEQ ID NO: 3477843 - DNA, 13 bp, Homo sapiens
gcggcaggactgc

SEQ ID NO: 3477844 - DNA, 18 bp, Homo sapiens
gcggcaggactgcagagc

SEQ ID NO: 3477845 - DNA, 11 bp, Homo sapiens
gcggccagagc

SEQ ID NO: 3477846 - DNA, 15 bp, Homo sapiens
gcggctggcagccca

SEQ ID NO: 3477847 - DNA, 12 bp, Homo sapiens
gcgggaagctga

SEQ ID NO: 3477848 - DNA, 19 bp, Homo sapiens
gcgggaatggcagctgcca

SEQ ID NO: 3477849 - DNA, 21 bp, Homo sapiens
gcgggagccatgcgccccctc

SEQ ID NO: 3477850 - DNA, 15 bp, Homo sapiens
gcgggcagagggctg

SEQ ID NO: 3477851 - DNA, 17 bp, Homo sapiens
gcgggcagagggctgga

SEQ ID NO: 3477852 - DNA, 18 bp, Homo sapiens
gcgggcagagggctggag

SEQ ID NO: 3477853 - DNA, 13 bp, Homo sapiens
gcggggacagctc

SEQ ID NO: 3477854 - DNA, 14 bp, Homo sapiens
gcggggacagctcc

SEQ ID NO: 3477855 - DNA, 15 bp, Homo sapiens
gcggggacagctcct

SEQ ID NO: 3477856 - DNA, 19 bp, Homo sapiens
gcggggacagctccttctg

SEQ ID NO: 3477857 - DNA, 19 bp, Homo sapiens
gcggggactcggtaagcac

SEQ ID NO: 3477858 - DNA, 18 bp, Homo sapiens
gcggggctgtcggcgctg

SEQ ID NO: 3477859 - DNA, 22 bp, Homo sapiens
gcggggctgtcggcgctgcccc

SEQ ID NO: 3477860 - DNA, 13 bp, Homo sapiens
gcggtccacccag

SEQ ID NO: 3477861 - DNA, 14 bp, Homo sapiens
gcggtccacccagg

SEQ ID NO: 3477862 - DNA, 19 bp, Homo sapiens
gcggtccacccaggagccc

SEQ ID NO: 3477863 - DNA, 23 bp, Homo sapiens
gcggtccacccaggagccccgag

SEQ ID NO: 3477864 - DNA, 22 bp, Homo sapiens
gcggtcccctccgccaggcgag

SEQ ID NO: 3477865 - DNA, 16 bp, Homo sapiens
gcggtgctgtcctcag

SEQ ID NO: 3477866 - DNA, 14 bp, Homo sapiens
gcggtgggggagga

SEQ ID NO: 3477867 - DNA, 15 bp, Homo sapiens
gcgtacacagagaag

SEQ ID NO: 3477868 - DNA, 20 bp, Homo sapiens
gcgtagcgtgcccgtgtgca

SEQ ID NO: 3477869 - DNA, 14 bp, Homo sapiens
gcgtcctcctctgt

SEQ ID NO: 3477870 - DNA, 13 bp, Homo sapiens
gcgtcctgtccac

SEQ ID NO: 3477871 - DNA, 21 bp, Homo sapiens
gcgtcctgtccacacccagct

SEQ ID NO: 3477872 - DNA, 24 bp, Homo sapiens
gcgtcctgtccacacccagctcag

SEQ ID NO: 3477873 - DNA, 14 bp, Homo sapiens
gcgtgagccactgc

SEQ ID NO: 3477874 - DNA, 16 bp, Homo sapiens
gcgtgagccactgcac

SEQ ID NO: 3477875 - DNA, 18 bp, Homo sapiens
gcgtgagccactgcaccg

SEQ ID NO: 3477876 - DNA, 23 bp, Homo sapiens
gcgtgagccactgcaccgggcca

SEQ ID NO: 3477877 - DNA, 19 bp, Homo sapiens
gcgtgatcaaagccacact

SEQ ID NO: 3477878 - DNA, 14 bp, Homo sapiens
gcgtgcacacacca

SEQ ID NO: 3477879 - DNA, 23 bp, Homo sapiens
gcgtgcacacaccagagcccacc

SEQ ID NO: 3477880 - DNA, 23 bp, Homo sapiens
gcgtgccagtcaagaagaaaaag

SEQ ID NO: 3477881 - DNA, 21 bp, Homo sapiens
gcgtgctcagttcagaatcac

SEQ ID NO: 3477882 - DNA, 15 bp, Homo sapiens
gcgtggagctgcctg

SEQ ID NO: 3477883 - DNA, 23 bp, Homo sapiens
gcgttcttaggctgctgggatgg

SEQ ID NO: 3477884 - DNA, 14 bp, Homo sapiens
gcgttgctttcact

SEQ ID NO: 3477885 - DNA, 15 bp, Homo sapiens
gcgttgtaaaatata

SEQ ID NO: 3477886 - DNA, 22 bp, Homo sapiens
gctaaactccttcctggcctga

SEQ ID NO: 3477887 - DNA, 13 bp, Homo sapiens
gctaaatgtgaat

SEQ ID NO: 3477888 - DNA, 13 bp, Homo sapiens
gctaactgtaaat

SEQ ID NO: 3477889 - DNA, 14 bp, Homo sapiens
gctaagaaaagatt

SEQ ID NO: 3477890 - DNA, 17 bp, Homo sapiens
gctaagccccagcaagc

SEQ ID NO: 3477891 - DNA, 21 bp, Homo sapiens
gctaatgaccaacctgtttct

SEQ ID NO: 3477892 - DNA, 13 bp, Homo sapiens
gctaatttgcatt

SEQ ID NO: 3477893 - DNA, 17 bp, Homo sapiens
gctaatttttgtaattt

SEQ ID NO: 3477894 - DNA, 17 bp, Homo sapiens
gctacacccttttccag

SEQ ID NO: 3477895 - DNA, 19 bp, Homo sapiens
gctaccctgagctgaggca

SEQ ID NO: 3477896 - DNA, 12 bp, Homo sapiens
gctacctccctc

SEQ ID NO: 3477897 - DNA, 14 bp, Homo sapiens
gctacctccctccc

SEQ ID NO: 3477898 - DNA, 16 bp, Homo sapiens
gctacctctctgtccc

SEQ ID NO: 3477899 - DNA, 21 bp, Homo sapiens
gctacctctctgtcccttgct

SEQ ID NO: 3477900 - DNA, 12 bp, Homo sapiens
gctacgcctctt

SEQ ID NO: 3477901 - DNA, 15 bp, Homo sapiens
gctactataaagaga

SEQ ID NO: 3477902 - DNA, 22 bp, Homo sapiens
gctactgccgtcagtgctgtgc

SEQ ID NO: 3477903 - DNA, 20 bp, Homo sapiens
gctactgtcctacccaccct

SEQ ID NO: 3477904 - DNA, 18 bp, Homo sapiens
gctactgtgtgtgtgaat

SEQ ID NO: 3477905 - DNA, 18 bp, Homo sapiens
gctagagacgctgatcca

SEQ ID NO: 3477906 - DNA, 15 bp, Homo sapiens
gctagccagaggact

SEQ ID NO: 3477907 - DNA, 20 bp, Homo sapiens
gctaggacccctccatgtgg

SEQ ID NO: 3477908 - DNA, 14 bp, Homo sapiens
gctaggcctggcca

SEQ ID NO: 3477909 - DNA, 17 bp, Homo sapiens
gctaggcctggccagat

SEQ ID NO: 3477910 - DNA, 18 bp, Homo sapiens
gctagttggttgaatttt

SEQ ID NO: 3477911 - DNA, 23 bp, Homo sapiens
gctataaattcctctttgctttg

SEQ ID NO: 3477912 - DNA, 15 bp, Homo sapiens
gctataactaagcat

SEQ ID NO: 3477913 - DNA, 15 bp, Homo sapiens
gctatacctgtgcct

SEQ ID NO: 3477914 - DNA, 17 bp, Homo sapiens
gctatagcctggggtgg

SEQ ID NO: 3477915 - DNA, 17 bp, Homo sapiens
gctataggtcagagatg

SEQ ID NO: 3477916 - DNA, 12 bp, Homo sapiens
gctatccaccaa

SEQ ID NO: 3477917 - DNA, 13 bp, Homo sapiens
gctatctgcctga

SEQ ID NO: 3477918 - DNA, 14 bp, Homo sapiens
gctatctgcctgac

SEQ ID NO: 3477919 - DNA, 19 bp, Homo sapiens
gctatgttctgtcttccca

SEQ ID NO: 3477920 - DNA, 14 bp, Homo sapiens
gctattgacaataa

SEQ ID NO: 3477921 - DNA, 15 bp, Homo sapiens
gctattgcactccag

SEQ ID NO: 3477922 - DNA, 15 bp, Homo sapiens
gctattggcctccca

SEQ ID NO: 3477923 - DNA, 23 bp, Homo sapiens
gctattggcctcccaaaagactc

SEQ ID NO: 3477924 - DNA, 14 bp, Homo sapiens
gctcaaaggcacag

SEQ ID NO: 3477925 - DNA, 17 bp, Homo sapiens
gctcaagatgacagctc

SEQ ID NO: 3477926 - DNA, 21 bp, Homo sapiens
gctcaagcaatcctctcacct

SEQ ID NO: 3477927 - DNA, 19 bp, Homo sapiens
gctcaaggaaaggcctgaa

SEQ ID NO: 3477928 - DNA, 20 bp, Homo sapiens
gctcaaggaaaggcctgaaa

SEQ ID NO: 3477929 - DNA, 15 bp, Homo sapiens
gctttcaaacatgtt

SEQ ID NO: 3477930 - DNA, 19 bp, Homo sapiens
gctttcctgcctccttgaa

SEQ ID NO: 3477931 - DNA, 17 bp, Homo sapiens
gctttccttttttaaaa

SEQ ID NO: 3477932 - DNA, 16 bp, Homo sapiens
gctttcgaactgctag

SEQ ID NO: 3477933 - DNA, 13 bp, Homo sapiens
gctttctacccag

SEQ ID NO: 3477934 - DNA, 23 bp, Homo sapiens
gctttctacccagcgagccctgg

SEQ ID NO: 3477935 - DNA, 18 bp, Homo sapiens
gctttctccccaatgaga

SEQ ID NO: 3477936 - DNA, 14 bp, Homo sapiens
gctttctgcatcac

SEQ ID NO: 3477937 - DNA, 13 bp, Homo sapiens
gctttctgccacc

SEQ ID NO: 3477938 - DNA, 19 bp, Homo sapiens
gctttctgctcagcttctc

SEQ ID NO: 3477939 - DNA, 11 bp, Homo sapiens
gctttctgtct

SEQ ID NO: 3477940 - DNA, 15 bp, Homo sapiens
gctttgatccctgac

SEQ ID NO: 3477941 - DNA, 21 bp, Homo sapiens
gctttgattagttttcttgtt

SEQ ID NO: 3477942 - DNA, 12 bp, Homo sapiens
gctttgattcat

SEQ ID NO: 3477943 - DNA, 15 bp, Homo sapiens
gctttgattcatagt

SEQ ID NO: 3477944 - DNA, 14 bp, Homo sapiens
gctttgcaaagacc

SEQ ID NO: 3477945 - DNA, 13 bp, Homo sapiens
gctttgctctgcc

SEQ ID NO: 3477946 - DNA, 12 bp, Homo sapiens
gctttgctgctg

SEQ ID NO: 3477947 - DNA, 19 bp, Homo sapiens
gctttgctgctgaaggctc

SEQ ID NO: 3477948 - DNA, 18 bp, Homo sapiens
gctttgctttctgctcag

SEQ ID NO: 3477949 - DNA, 17 bp, Homo sapiens
gctttggatttgacatt

SEQ ID NO: 3477950 - DNA, 14 bp, Homo sapiens
gctttgttttgcac

SEQ ID NO: 3477951 - DNA, 19 bp, Homo sapiens
gcttttactgaactttctt

SEQ ID NO: 3477952 - DNA, 23 bp, Homo sapiens
gcttttcagattgtggaatgttg

SEQ ID NO: 3477953 - DNA, 13 bp, Homo sapiens
gcttttgcttcta

SEQ ID NO: 3477954 - DNA, 14 bp, Homo sapiens
gcttttggcctgga

SEQ ID NO: 3477955 - DNA, 18 bp, Homo sapiens
gcttttgtctatgggact

SEQ ID NO: 3477956 - DNA, 18 bp, Homo sapiens
gcttttgttccaatgtca

SEQ ID NO: 3477957 - DNA, 18 bp, Homo sapiens
gctttttactattaacat

SEQ ID NO: 3477958 - DNA, 15 bp, Homo sapiens
gctttttatttctgc

SEQ ID NO: 3477959 - DNA, 14 bp, Homo sapiens
gctttttcttctct

SEQ ID NO: 3477960 - DNA, 19 bp, Homo sapiens
ggaaaaaaatcgtccaggg

SEQ ID NO: 3477961 - DNA, 13 bp, Homo sapiens
ggaaaaaaatgtt

SEQ ID NO: 3477962 - DNA, 20 bp, Homo sapiens
ggaaaaactgagacaggcag

SEQ ID NO: 3477963 - DNA, 14 bp, Homo sapiens
ggaaaagctgctga

SEQ ID NO: 3477964 - DNA, 18 bp, Homo sapiens
ggaaaagctgctgacagt

SEQ ID NO: 3477965 - DNA, 13 bp, Homo sapiens
ggaaacaacagct

SEQ ID NO: 3477966 - DNA, 20 bp, Homo sapiens
ggaaacagctaatgggacac

SEQ ID NO: 3477967 - DNA, 15 bp, Homo sapiens
ggaaacaggttggga

SEQ ID NO: 3477968 - DNA, 15 bp, Homo sapiens
ggaaaccacagctgc

SEQ ID NO: 3477969 - DNA, 16 bp, Homo sapiens
ggaaactactgccttt

SEQ ID NO: 3477970 - DNA, 15 bp, Homo sapiens
ggaaagaaagttgca

SEQ ID NO: 3477971 - DNA, 16 bp, Homo sapiens
ggaaagcacaggtggg

SEQ ID NO: 3477972 - DNA, 22 bp, Homo sapiens
ggaaagcagctcaaaggcacag

SEQ ID NO: 3477973 - DNA, 19 bp, Homo sapiens
ggaaaggggacaaggaagg

SEQ ID NO: 3477974 - DNA, 16 bp, Homo sapiens
ggaaagtcattggctt

SEQ ID NO: 3477975 - DNA, 21 bp, Homo sapiens
ggaaagtcattggctttatcc

SEQ ID NO: 3477976 - DNA, 18 bp, Homo sapiens
ggaaataacagagagaat

SEQ ID NO: 3477977 - DNA, 19 bp, Homo sapiens
ggaaataacagagagaatg

SEQ ID NO: 3477978 - DNA, 14 bp, Homo sapiens
ggaaatggccttcc

SEQ ID NO: 3477979 - DNA, 14 bp, Homo sapiens
ggaacacaaagacc

SEQ ID NO: 3477980 - DNA, 14 bp, Homo sapiens
ggaacacggccaca

SEQ ID NO: 3477981 - DNA, 17 bp, Homo sapiens
ggaacagactggaagca

SEQ ID NO: 3477982 - DNA, 20 bp, Homo sapiens
ggaacagactggaagcacag

SEQ ID NO: 3477983 - DNA, 22 bp, Homo sapiens
ggaacatcatcaaggcactgcc

SEQ ID NO: 3477984 - DNA, 24 bp, Homo sapiens
ggaaccaacaaggaaactttcctt

SEQ ID NO: 3477985 - DNA, 11 bp, Homo sapiens
ggaacccagac

SEQ ID NO: 3477986 - DNA, 13 bp, Homo sapiens
ggaacccagactc

SEQ ID NO: 3477987 - DNA, 21 bp, Homo sapiens
ggaaccccggggtgcccacag

SEQ ID NO: 3477988 - DNA, 15 bp, Homo sapiens
ggaaccgcaggaagc

SEQ ID NO: 3477989 - DNA, 16 bp, Homo sapiens
ggaaccgtaggaccca

SEQ ID NO: 3477990 - DNA, 17 bp, Homo sapiens
ggaacctccccagcctg

SEQ ID NO: 3477991 - DNA, 18 bp, Homo sapiens
ggaacctccccagcctgc

SEQ ID NO: 3477992 - DNA, 21 bp, Homo sapiens
ggaacctccccagcctgcgcc

SEQ ID NO: 3477993 - DNA, 16 bp, Homo sapiens
ggaacctcgagtactg

SEQ ID NO: 3477994 - DNA, 19 bp, Homo sapiens
ggaacctcgagtactgtgg

SEQ ID NO: 3477995 - DNA, 18 bp, Homo sapiens
ggaacctgacgtagctgc

SEQ ID NO: 3477996 - DNA, 15 bp, Homo sapiens
ggaacctgcaaaaaa

SEQ ID NO: 3477997 - DNA, 13 bp, Homo sapiens
ggaactatgaaga

SEQ ID NO: 3477998 - DNA, 21 bp, Homo sapiens
ggaactatgaagacttaaaag

SEQ ID NO: 3477999 - DNA, 17 bp, Homo sapiens
ggaactcagatccaggg

SEQ ID NO: 3478000 - DNA, 19 bp, Homo sapiens
ggaactcagatccagggac

SEQ ID NO: 3478001 - DNA, 16 bp, Homo sapiens
ggaactgtcctttcct

SEQ ID NO: 3478002 - DNA, 14 bp, Homo sapiens
ggaagaaaagagct

SEQ ID NO: 3478003 - DNA, 21 bp, Homo sapiens
ggaagaacggggctcttctca

SEQ ID NO: 3478004 - DNA, 14 bp, Homo sapiens
ggaagacctggcaa

SEQ ID NO: 3478005 - DNA, 13 bp, Homo sapiens
ggaagagaaacca

SEQ ID NO: 3478006 - DNA, 23 bp, Homo sapiens
ggaagagcaggactccaggccca

SEQ ID NO: 3478007 - DNA, 13 bp, Homo sapiens
ggaagagccttgc

SEQ ID NO: 3478008 - DNA, 16 bp, Homo sapiens
ggaagatcctgtgagg

SEQ ID NO: 3478009 - DNA, 19 bp, Homo sapiens
ggaagatctctgcagggcc

SEQ ID NO: 3478010 - DNA, 17 bp, Homo sapiens
ggaagatttggaagctc

SEQ ID NO: 3478011 - DNA, 16 bp, Homo sapiens
ggaagattttcattga

SEQ ID NO: 3478012 - DNA, 22 bp, Homo sapiens
ggaagccaaaatgtaggcttag

SEQ ID NO: 3478013 - DNA, 22 bp, Homo sapiens
ggaagcccccaccgtgggcagg

SEQ ID NO: 3478014 - DNA, 16 bp, Homo sapiens
ggaagccgtgccctgc

SEQ ID NO: 3478015 - DNA, 13 bp, Homo sapiens
ggaagctgctccg

SEQ ID NO: 3478016 - DNA, 13 bp, Homo sapiens
ggaagcttctgtc

SEQ ID NO: 3478017 - DNA, 15 bp, Homo sapiens
ggaaggaccctgtgc

SEQ ID NO: 3478018 - DNA, 19 bp, Homo sapiens
ggaaggcttgttgtgcttt

SEQ ID NO: 3478019 - DNA, 17 bp, Homo sapiens
ggaaggggacccccgcc

SEQ ID NO: 3478020 - DNA, 17 bp, Homo sapiens
ggaaggggccagaggct

SEQ ID NO: 3478021 - DNA, 16 bp, Homo sapiens
ggaaggtggggacagg

SEQ ID NO: 3478022 - DNA, 16 bp, Homo sapiens
ggaagtaggaagtaaa

SEQ ID NO: 3478023 - DNA, 18 bp, Homo sapiens
ggaagtccccaggcccca

SEQ ID NO: 3478024 - DNA, 11 bp, Homo sapiens
ggaagttttca

SEQ ID NO: 3478025 - DNA, 11 bp, Homo sapiens
ggaatatttga

SEQ ID NO: 3478026 - DNA, 13 bp, Homo sapiens
ggaatgcagaggt

SEQ ID NO: 3478027 - DNA, 14 bp, Homo sapiens
ggaatgcctgagtg

SEQ ID NO: 3478028 - DNA, 15 bp, Homo sapiens
ggaatgtgtggcctg

SEQ ID NO: 3478029 - DNA, 15 bp, Homo sapiens
ggaattgatttgcat

SEQ ID NO: 3478030 - DNA, 17 bp, Homo sapiens
ggaattgatttgcattg

SEQ ID NO: 3478031 - DNA, 18 bp, Homo sapiens
ggaattgatttgcattga

SEQ ID NO: 3478032 - DNA, 18 bp, Homo sapiens
ggaatttcccaggaccct

SEQ ID NO: 3478033 - DNA, 21 bp, Homo sapiens
ggaatttgttcaagttttggg

SEQ ID NO: 3478034 - DNA, 12 bp, Homo sapiens
ggaatttttaaa

SEQ ID NO: 3478035 - DNA, 19 bp, Homo sapiens
ggacaatcatgaaatatgc

SEQ ID NO: 3478036 - DNA, 21 bp, Homo sapiens
ggacaatcatgaaatatgcat

SEQ ID NO: 3478037 - DNA, 16 bp, Homo sapiens
ggacacagatgaaaca

SEQ ID NO: 3478038 - DNA, 18 bp, Homo sapiens
ggacacaggcctgctctc

SEQ ID NO: 3478039 - DNA, 17 bp, Homo sapiens
ggacacctggccgcctc

SEQ ID NO: 3478040 - DNA, 23 bp, Homo sapiens
ggacacctggccgcctccaggag

SEQ ID NO: 3478041 - DNA, 22 bp, Homo sapiens
ggacactaaccacgctggacct

SEQ ID NO: 3478042 - DNA, 20 bp, Homo sapiens
ggacagaggccccagcctcc

SEQ ID NO: 3478043 - DNA, 16 bp, Homo sapiens
ggacagccccaccctg

SEQ ID NO: 3478044 - DNA, 17 bp, Homo sapiens
ggacagccccaccctgg

SEQ ID NO: 3478045 - DNA, 16 bp, Homo sapiens
ggacagctccttctgt

SEQ ID NO: 3478046 - DNA, 21 bp, Homo sapiens
ggacaggctcttctttcccaa

SEQ ID NO: 3478047 - DNA, 13 bp, Homo sapiens
ggacaggctggct

SEQ ID NO: 3478048 - DNA, 20 bp, Homo sapiens
ggacaggtgtgccgacagaa

SEQ ID NO: 3478049 - DNA, 19 bp, Homo sapiens
ggacagtctgctctagatg

SEQ ID NO: 3478050 - DNA, 19 bp, Homo sapiens
ggacataatggggtcctgg

SEQ ID NO: 3478051 - DNA, 17 bp, Homo sapiens
ggacatgcctgtcctga

SEQ ID NO: 3478052 - DNA, 18 bp, Homo sapiens
ggacatgcctgtcctgaa

SEQ ID NO: 3478053 - DNA, 21 bp, Homo sapiens
ggacatgcctgtcctgaaagc

SEQ ID NO: 3478054 - DNA, 21 bp, Homo sapiens
ggacatgcggtagccagcaca

SEQ ID NO: 3478055 - DNA, 19 bp, Homo sapiens
ggacatgctgaagccaaag

SEQ ID NO: 3478056 - DNA, 12 bp, Homo sapiens
ggacattcttgt

SEQ ID NO: 3478057 - DNA, 14 bp, Homo sapiens
ggacatttctctaa

SEQ ID NO: 3478058 - DNA, 17 bp, Homo sapiens
ggaccaaccctggggaa

SEQ ID NO: 3478059 - DNA, 16 bp, Homo sapiens
ggaccaagcatcttgg

SEQ ID NO: 3478060 - DNA, 13 bp, Homo sapiens
ggaccaggcaatg

SEQ ID NO: 3478061 - DNA, 19 bp, Homo sapiens
ggacccaatgtaggagctg

SEQ ID NO: 3478062 - DNA, 18 bp, Homo sapiens
ggacccagcgggcaggtt

SEQ ID NO: 3478063 - DNA, 20 bp, Homo sapiens
ggcctcaactcctcccatag

SEQ ID NO: 3478064 - DNA, 14 bp, Homo sapiens
ggcctcaagtgatt

SEQ ID NO: 3478065 - DNA, 22 bp, Homo sapiens
ggcctcaagtgattctcctgcc

SEQ ID NO: 3478066 - DNA, 20 bp, Homo sapiens
ggcctcagccagagaagcta

SEQ ID NO: 3478067 - DNA, 13 bp, Homo sapiens
ggcctcaggtgct

SEQ ID NO: 3478068 - DNA, 16 bp, Homo sapiens
ggcctcaggtgctgtc

SEQ ID NO: 3478069 - DNA, 17 bp, Homo sapiens
ggcctcaggtgctgtcc

SEQ ID NO: 3478070 - DNA, 16 bp, Homo sapiens
ggcctcagtgccccat

SEQ ID NO: 3478071 - DNA, 16 bp, Homo sapiens
ggcctcatgtggctgg

SEQ ID NO: 3478072 - DNA, 19 bp, Homo sapiens
ggcctcatgtggctggaag

SEQ ID NO: 3478073 - DNA, 20 bp, Homo sapiens
ggcctcatgtggctggaaga

SEQ ID NO: 3478074 - DNA, 15 bp, Homo sapiens
ggcctccagaactca

SEQ ID NO: 3478075 - DNA, 14 bp, Homo sapiens
ggcctccatcctca

SEQ ID NO: 3478076 - DNA, 19 bp, Homo sapiens
ggcctccatcctcatctct

SEQ ID NO: 3478077 - DNA, 17 bp, Homo sapiens
ggcctcccaaaagactc

SEQ ID NO: 3478078 - DNA, 16 bp, Homo sapiens
ggcctcccaaagtgct

SEQ ID NO: 3478079 - DNA, 22 bp, Homo sapiens
ggcctcctcacaacatggtgtc

SEQ ID NO: 3478080 - DNA, 20 bp, Homo sapiens
ggcctcggtgtggagaagcg

SEQ ID NO: 3478081 - DNA, 19 bp, Homo sapiens
ggcctctccttgtggcctg

SEQ ID NO: 3478082 - DNA, 23 bp, Homo sapiens
ggcctctgcaactgctcagctct

SEQ ID NO: 3478083 - DNA, 23 bp, Homo sapiens
ggcctctttgtctaaaacaataa

SEQ ID NO: 3478084 - DNA, 16 bp, Homo sapiens
ggcctgaaaggagccc

SEQ ID NO: 3478085 - DNA, 19 bp, Homo sapiens
ggcctgaagagtcctctga

SEQ ID NO: 3478086 - DNA, 15 bp, Homo sapiens
ggcctgaagccagct

SEQ ID NO: 3478087 - DNA, 19 bp, Homo sapiens
ggcctgaagccagctgccc

SEQ ID NO: 3478088 - DNA, 23 bp, Homo sapiens
ggcctgaatcatgagcctgctgg

SEQ ID NO: 3478089 - DNA, 22 bp, Homo sapiens
ggcctgaatgcttataggtggc

SEQ ID NO: 3478090 - DNA, 20 bp, Homo sapiens
ggcctgaccaaacagccaac

SEQ ID NO: 3478091 - DNA, 15 bp, Homo sapiens
ggcctgagctgcttc

SEQ ID NO: 3478092 - DNA, 15 bp, Homo sapiens
ggcctgatcagacca

SEQ ID NO: 3478093 - DNA, 18 bp, Homo sapiens
ggcctgatcagaccacgg

SEQ ID NO: 3478094 - DNA, 17 bp, Homo sapiens
ggcctgcaggacctgcc

SEQ ID NO: 3478095 - DNA, 21 bp, Homo sapiens
ggcctgcaggacctgcctgta

SEQ ID NO: 3478096 - DNA, 13 bp, Homo sapiens
ggcctgctccaga

SEQ ID NO: 3478097 - DNA, 15 bp, Homo sapiens
ggcctgctccagacc

SEQ ID NO: 3478098 - DNA, 16 bp, Homo sapiens
ggcctgctccagacct

SEQ ID NO: 3478099 - DNA, 16 bp, Homo sapiens
ggcctgctggaggcct

SEQ ID NO: 3478100 - DNA, 17 bp, Homo sapiens
ggcctgctggaggcctc

SEQ ID NO: 3478101 - DNA, 18 bp, Homo sapiens
ggcctgctggaggcctca

SEQ ID NO: 3478102 - DNA, 11 bp, Homo sapiens
ggcctggagat

SEQ ID NO: 3478103 - DNA, 14 bp, Homo sapiens
ggcctggagatcct

SEQ ID NO: 3478104 - DNA, 20 bp, Homo sapiens
ggcctggagatcctcctgca

SEQ ID NO: 3478105 - DNA, 17 bp, Homo sapiens
ggcctggccagggcctg

SEQ ID NO: 3478106 - DNA, 18 bp, Homo sapiens
ggcctggccagggcctgg

SEQ ID NO: 3478107 - DNA, 11 bp, Homo sapiens
ggcctggctca

SEQ ID NO: 3478108 - DNA, 18 bp, Homo sapiens
ggccttctcccctcttct

SEQ ID NO: 3478109 - DNA, 20 bp, Homo sapiens
ggccttctcccctcttctga

SEQ ID NO: 3478110 - DNA, 15 bp, Homo sapiens
ggcctttgagcctga

SEQ ID NO: 3478111 - DNA, 18 bp, Homo sapiens
ggcgaggcccttcctctt

SEQ ID NO: 3478112 - DNA, 18 bp, Homo sapiens
ggcgatccacctgtctca

SEQ ID NO: 3478113 - DNA, 22 bp, Homo sapiens
ggcgatccacctgtctcagcct

SEQ ID NO: 3478114 - DNA, 21 bp, Homo sapiens
ggcgatcgcggcggagctggc

SEQ ID NO: 3478115 - DNA, 12 bp, Homo sapiens
ggcgcactgtga

SEQ ID NO: 3478116 - DNA, 21 bp, Homo sapiens
ggcgccgtctccaggggctgc

SEQ ID NO: 3478117 - DNA, 23 bp, Homo sapiens
ggcggagctggccccgccgcctg

SEQ ID NO: 3478118 - DNA, 20 bp, Homo sapiens
ggcggaggttccagtgagcc

SEQ ID NO: 3478119 - DNA, 21 bp, Homo sapiens
ggcggcccctggacgaaggtc

SEQ ID NO: 3478120 - DNA, 18 bp, Homo sapiens
ggcgggcagagggctgga

SEQ ID NO: 3478121 - DNA, 18 bp, Homo sapiens
ggcgggcccagaccggct

SEQ ID NO: 3478122 - DNA, 17 bp, Homo sapiens
ggcggtgcccacaccgg

SEQ ID NO: 3478123 - DNA, 21 bp, Homo sapiens
ggcgtctgttcccccttcaca

SEQ ID NO: 3478124 - DNA, 19 bp, Homo sapiens
ggctaagagtgtcctagga

SEQ ID NO: 3478125 - DNA, 20 bp, Homo sapiens
ggctaagtgatcctcccacc

SEQ ID NO: 3478126 - DNA, 13 bp, Homo sapiens
ggctaatttttgt

SEQ ID NO: 3478127 - DNA, 15 bp, Homo sapiens
ggctacacagggatg

SEQ ID NO: 3478128 - DNA, 19 bp, Homo sapiens
ggctaccctgagctgaggc

SEQ ID NO: 3478129 - DNA, 22 bp, Homo sapiens
ggctaggacccctccatgtggg

SEQ ID NO: 3478130 - DNA, 23 bp, Homo sapiens
ggctagtcaagctcctcctccct

SEQ ID NO: 3478131 - DNA, 21 bp, Homo sapiens
ggctcaagtcctcttttctga

SEQ ID NO: 3478132 - DNA, 14 bp, Homo sapiens
ggctcacactgaga

SEQ ID NO: 3478133 - DNA, 23 bp, Homo sapiens
ggctcacgcctgtaatcccagca

SEQ ID NO: 3478134 - DNA, 15 bp, Homo sapiens
ggctcactgcagcct

SEQ ID NO: 3478135 - DNA, 23 bp, Homo sapiens
ggctcagcaaaagatgcttctca

SEQ ID NO: 3478136 - DNA, 15 bp, Homo sapiens
ggctcagccagcact

SEQ ID NO: 3478137 - DNA, 18 bp, Homo sapiens
ggctcagcggggacagct

SEQ ID NO: 3478138 - DNA, 23 bp, Homo sapiens
ggctcagcggggacagctccttc

SEQ ID NO: 3478139 - DNA, 21 bp, Homo sapiens
ggctcagtgcaacctctgctt

SEQ ID NO: 3478140 - DNA, 15 bp, Homo sapiens
ggctcagttctgcct

SEQ ID NO: 3478141 - DNA, 21 bp, Homo sapiens
ggctcattctgcaccttgcca

SEQ ID NO: 3478142 - DNA, 13 bp, Homo sapiens
ggctccagagggc

SEQ ID NO: 3478143 - DNA, 12 bp, Homo sapiens
ggctccaggctc

SEQ ID NO: 3478144 - DNA, 13 bp, Homo sapiens
ggctccaggctcc

SEQ ID NO: 3478145 - DNA, 15 bp, Homo sapiens
ggctccaggctcctt

SEQ ID NO: 3478146 - DNA, 16 bp, Homo sapiens
ggctccaggctccttt

SEQ ID NO: 3478147 - DNA, 22 bp, Homo sapiens
ggctccagtttccccatggggc

SEQ ID NO: 3478148 - DNA, 13 bp, Homo sapiens
ggctcccagcctc

SEQ ID NO: 3478149 - DNA, 15 bp, Homo sapiens
ggctcccccaggcct

SEQ ID NO: 3478150 - DNA, 17 bp, Homo sapiens
ggctcccccaggcctga

SEQ ID NO: 3478151 - DNA, 16 bp, Homo sapiens
ggctcccgtggcctgt

SEQ ID NO: 3478152 - DNA, 17 bp, Homo sapiens
ggctccctgactgggag

SEQ ID NO: 3478153 - DNA, 13 bp, Homo sapiens
ggctcgaatctct

SEQ ID NO: 3478154 - DNA, 15 bp, Homo sapiens
ggctcgaatctctgt

SEQ ID NO: 3478155 - DNA, 13 bp, Homo sapiens
ggctcgccaaggc

SEQ ID NO: 3478156 - DNA, 22 bp, Homo sapiens
ggctcgccaaggcctaggacct

SEQ ID NO: 3478157 - DNA, 18 bp, Homo sapiens
ggctcgttgactggctgt

SEQ ID NO: 3478158 - DNA, 21 bp, Homo sapiens
ggctctatttcttcttcacat

SEQ ID NO: 3478159 - DNA, 23 bp, Homo sapiens
ggctctcatgttttcaactgcca

SEQ ID NO: 3478160 - DNA, 22 bp, Homo sapiens
ggctctgaagcaaggcggtgga

SEQ ID NO: 3478161 - DNA, 23 bp, Homo sapiens
ggctctgaagcaaggcggtggac

SEQ ID NO: 3478162 - DNA, 14 bp, Homo sapiens
ggctctgagcgcct

SEQ ID NO: 3478163 - DNA, 16 bp, Homo sapiens
ggctctggccaagggc

SEQ ID NO: 3478164 - DNA, 18 bp, Homo sapiens
ggctctggccaagggcca

SEQ ID NO: 3478165 - DNA, 20 bp, Homo sapiens
ggctctggccaagggccaga

SEQ ID NO: 3478166 - DNA, 23 bp, Homo sapiens
ggctctgttcggcctttgggtgt

SEQ ID NO: 3478167 - DNA, 12 bp, Homo sapiens
ggctcttctcat

SEQ ID NO: 3478168 - DNA, 20 bp, Homo sapiens
ggctcttctcatttcacccc

SEQ ID NO: 3478169 - DNA, 21 bp, Homo sapiens
ggctcttctccttggaggaca

SEQ ID NO: 3478170 - DNA, 23 bp, Homo sapiens
ggctcttctccttggaggacagt

SEQ ID NO: 3478171 - DNA, 14 bp, Homo sapiens
ggctgaaattctcc

SEQ ID NO: 3478172 - DNA, 22 bp, Homo sapiens
ggctgaaattctcctggaggtc

SEQ ID NO: 3478173 - DNA, 18 bp, Homo sapiens
ggctgaccacagcacagc

SEQ ID NO: 3478174 - DNA, 22 bp, Homo sapiens
ggctgaccacagcacagccaac

SEQ ID NO: 3478175 - DNA, 22 bp, Homo sapiens
ggctgaggaaaggccagctggc

SEQ ID NO: 3478176 - DNA, 15 bp, Homo sapiens
ggctgagggagcctg

SEQ ID NO: 3478177 - DNA, 17 bp, Homo sapiens
ggctgagggcctgctgg

SEQ ID NO: 3478178 - DNA, 23 bp, Homo sapiens
ggctgagggtgcccttttccagc

SEQ ID NO: 3478179 - DNA, 15 bp, Homo sapiens
ggctgatggagtaaa

SEQ ID NO: 3478180 - DNA, 22 bp, Homo sapiens
ggctgcaaggtttaggctggtg

SEQ ID NO: 3478181 - DNA, 13 bp, Homo sapiens
ggctgcagaggcc

SEQ ID NO: 3478182 - DNA, 12 bp, Homo sapiens
ggctgcagggag

SEQ ID NO: 3478183 - DNA, 17 bp, Homo sapiens
ggctgcagggagtccga

SEQ ID NO: 3478184 - DNA, 16 bp, Homo sapiens
ggctgcatgatgtttg

SEQ ID NO: 3478185 - DNA, 22 bp, Homo sapiens
ggctgcatgatgtttgcccaaa

SEQ ID NO: 3478186 - DNA, 21 bp, Homo sapiens
ggctgcatttgcctgtcatgc

SEQ ID NO: 3478187 - DNA, 20 bp, Homo sapiens
ggctgcccctaatctctgta

SEQ ID NO: 3478188 - DNA, 23 bp, Homo sapiens
ggctgcccctaatctctgtagga

SEQ ID NO: 3478189 - DNA, 17 bp, Homo sapiens
ggctgcctccattatcc

SEQ ID NO: 3478190 - DNA, 12 bp, Homo sapiens
ggctgcctccca

SEQ ID NO: 3478191 - DNA, 19 bp, Homo sapiens
ggctgcggcgtacaggctg

SEQ ID NO: 3478192 - DNA, 20 bp, Homo sapiens
ggctgcgggacagaggacca

SEQ ID NO: 3478193 - DNA, 22 bp, Homo sapiens
ggctggaacagattcacactgt

SEQ ID NO: 3478194 - DNA, 16 bp, Homo sapiens
ggtgccagatcctctt

SEQ ID NO: 3478195 - DNA, 23 bp, Homo sapiens
ggtgcccaagccagaggctgggt

SEQ ID NO: 3478196 - DNA, 21 bp, Homo sapiens
ggtgcccacaccggggacagg

SEQ ID NO: 3478197 - DNA, 13 bp, Homo sapiens
ggtgcccacaggc

SEQ ID NO: 3478198 - DNA, 13 bp, Homo sapiens
ggtgccccaggac

SEQ ID NO: 3478199 - DNA, 23 bp, Homo sapiens
ggtgccccaggaccagctcagga

SEQ ID NO: 3478200 - DNA, 22 bp, Homo sapiens
ggtgccccccacccctggaaga

SEQ ID NO: 3478201 - DNA, 17 bp, Homo sapiens
ggtgcccttggaggcca

SEQ ID NO: 3478202 - DNA, 22 bp, Homo sapiens
ggtgcccttggaggccagccag

SEQ ID NO: 3478203 - DNA, 10 bp, Homo sapiens
ggtgcctgcc

SEQ ID NO: 3478204 - DNA, 13 bp, Homo sapiens
ggtgcctgccata

SEQ ID NO: 3478205 - DNA, 15 bp, Homo sapiens
ggtgcgatctgggtt

SEQ ID NO: 3478206 - DNA, 14 bp, Homo sapiens
ggtgcgtctgggag

SEQ ID NO: 3478207 - DNA, 15 bp, Homo sapiens
ggtgctccctctgtc

SEQ ID NO: 3478208 - DNA, 16 bp, Homo sapiens
ggtgctgacggccagg

SEQ ID NO: 3478209 - DNA, 17 bp, Homo sapiens
ggtgctgacggccaggg

SEQ ID NO: 3478210 - DNA, 21 bp, Homo sapiens
ggtgctgccatccaggttcag

SEQ ID NO: 3478211 - DNA, 20 bp, Homo sapiens
ggtgctggagcactgggctc

SEQ ID NO: 3478212 - DNA, 15 bp, Homo sapiens
ggtgctgtcctcagg

SEQ ID NO: 3478213 - DNA, 21 bp, Homo sapiens
ggtgcttgttccctctccctg

SEQ ID NO: 3478214 - DNA, 13 bp, Homo sapiens
ggtggacccaggg

SEQ ID NO: 3478215 - DNA, 18 bp, Homo sapiens
ggtggacccagggaacag

SEQ ID NO: 3478216 - DNA, 21 bp, Homo sapiens
ggtggagccagtaaacagagg

SEQ ID NO: 3478217 - DNA, 22 bp, Homo sapiens
ggtggaggattgctgccagaga

SEQ ID NO: 3478218 - DNA, 13 bp, Homo sapiens
ggtggagggccac

SEQ ID NO: 3478219 - DNA, 23 bp, Homo sapiens
ggtggcacaggagtgtcctcttc

SEQ ID NO: 3478220 - DNA, 15 bp, Homo sapiens
ggtggcagtggaggt

SEQ ID NO: 3478221 - DNA, 16 bp, Homo sapiens
ggtggcagtgggagct

SEQ ID NO: 3478222 - DNA, 19 bp, Homo sapiens
ggtggcagtgggagctgcc

SEQ ID NO: 3478223 - DNA, 22 bp, Homo sapiens
ggtggcagtgggagctgcctgt

SEQ ID NO: 3478224 - DNA, 19 bp, Homo sapiens
ggtggcctaagagttgagc

SEQ ID NO: 3478225 - DNA, 19 bp, Homo sapiens
ggtggcgggtgcctgtaat

SEQ ID NO: 3478226 - DNA, 23 bp, Homo sapiens
ggtggctagtcaagctcctcctc

SEQ ID NO: 3478227 - DNA, 20 bp, Homo sapiens
ggtgggaggatctcttgagc

SEQ ID NO: 3478228 - DNA, 20 bp, Homo sapiens
ggtgggaggattgcttgagc

SEQ ID NO: 3478229 - DNA, 17 bp, Homo sapiens
ggtgggcacccaccctg

SEQ ID NO: 3478230 - DNA, 16 bp, Homo sapiens
ggtgggcttcagggca

SEQ ID NO: 3478231 - DNA, 14 bp, Homo sapiens
ggtgggcttcccag

SEQ ID NO: 3478232 - DNA, 12 bp, Homo sapiens
ggtgggggagga

SEQ ID NO: 3478233 - DNA, 13 bp, Homo sapiens
ggtgggggcctcg

SEQ ID NO: 3478234 - DNA, 16 bp, Homo sapiens
ggtgggggtgggtcag

SEQ ID NO: 3478235 - DNA, 15 bp, Homo sapiens
ggtggggtcatgccc

SEQ ID NO: 3478236 - DNA, 14 bp, Homo sapiens
ggtgggtataaaag

SEQ ID NO: 3478237 - DNA, 17 bp, Homo sapiens
ggtgggtccatgggcag

SEQ ID NO: 3478238 - DNA, 19 bp, Homo sapiens
ggtgggtcccggctctgtg

SEQ ID NO: 3478239 - DNA, 20 bp, Homo sapiens
ggtgggtcccggctctgtgg

SEQ ID NO: 3478240 - DNA, 16 bp, Homo sapiens
ggtggtctgcaggcag

SEQ ID NO: 3478241 - DNA, 18 bp, Homo sapiens
ggtggtctgcaggcaggg

SEQ ID NO: 3478242 - DNA, 21 bp, Homo sapiens
ggtggtctgttggcaggctgg

SEQ ID NO: 3478243 - DNA, 21 bp, Homo sapiens
ggtggtgtctccaacccccca

SEQ ID NO: 3478244 - DNA, 21 bp, Homo sapiens
ggtggttatggagagggtgtc

SEQ ID NO: 3478245 - DNA, 14 bp, Homo sapiens
ggtggtttgattgt

SEQ ID NO: 3478246 - DNA, 17 bp, Homo sapiens
ggtgtcaagagggtctg

SEQ ID NO: 3478247 - DNA, 20 bp, Homo sapiens
ggtgtcagccattgcaccca

SEQ ID NO: 3478248 - DNA, 21 bp, Homo sapiens
ggtgtcctgcctgtctgcccc

SEQ ID NO: 3478249 - DNA, 18 bp, Homo sapiens
ggtgtgagtcaccaagcc

SEQ ID NO: 3478250 - DNA, 16 bp, Homo sapiens
ggtgtgcacatctctg

SEQ ID NO: 3478251 - DNA, 21 bp, Homo sapiens
ggtgtgcggcctttggcttca

SEQ ID NO: 3478252 - DNA, 19 bp, Homo sapiens
ggtgtgctgggagctccac

SEQ ID NO: 3478253 - DNA, 13 bp, Homo sapiens
ggtgtgggggaag

SEQ ID NO: 3478254 - DNA, 22 bp, Homo sapiens
ggtgtgggtgtcctgcctgtct

SEQ ID NO: 3478255 - DNA, 17 bp, Homo sapiens
ggtgtggtgcagtgtga

SEQ ID NO: 3478256 - DNA, 22 bp, Homo sapiens
ggttaacccttcatcttcctgt

SEQ ID NO: 3478257 - DNA, 14 bp, Homo sapiens
ggttaaggcctgaa

SEQ ID NO: 3478258 - DNA, 22 bp, Homo sapiens
ggttaaggctgaggaaaggcca

SEQ ID NO: 3478259 - DNA, 22 bp, Homo sapiens
ggttaatttttacatggagaaa

SEQ ID NO: 3478260 - DNA, 15 bp, Homo sapiens
ggttatctgtcccag

SEQ ID NO: 3478261 - DNA, 23 bp, Homo sapiens
ggttcaagcgattcttctgcttc

SEQ ID NO: 3478262 - DNA, 20 bp, Homo sapiens
ggttcacgtgcagctcaagg

SEQ ID NO: 3478263 - DNA, 15 bp, Homo sapiens
ggttcactaaagcag

SEQ ID NO: 3478264 - DNA, 12 bp, Homo sapiens
ggttcaggcccg

SEQ ID NO: 3478265 - DNA, 22 bp, Homo sapiens
ggttcagggttggcccctgccc

SEQ ID NO: 3478266 - DNA, 15 bp, Homo sapiens
ggttccgcttggagc

SEQ ID NO: 3478267 - DNA, 22 bp, Homo sapiens
ggttccgcttggagcagagggg

SEQ ID NO: 3478268 - DNA, 11 bp, Homo sapiens
ggttcctgtga

SEQ ID NO: 3478269 - DNA, 21 bp, Homo sapiens
ggttctaggcatctctgtact

SEQ ID NO: 3478270 - DNA, 19 bp, Homo sapiens
ggttctgcctgccagctgc

SEQ ID NO: 3478271 - DNA, 22 bp, Homo sapiens
ggttgaactctggtggcacagg

SEQ ID NO: 3478272 - DNA, 16 bp, Homo sapiens
ggttgaccccagagga

SEQ ID NO: 3478273 - DNA, 11 bp, Homo sapiens
ggttgaggaaa

SEQ ID NO: 3478274 - DNA, 13 bp, Homo sapiens
ggttgaggtttca

SEQ ID NO: 3478275 - DNA, 14 bp, Homo sapiens
ggttgcagacagga

SEQ ID NO: 3478276 - DNA, 21 bp, Homo sapiens
ggttgctgctgtccagtgcct

SEQ ID NO: 3478277 - DNA, 18 bp, Homo sapiens
ggttgctgttttcctccc

SEQ ID NO: 3478278 - DNA, 17 bp, Homo sapiens
ggttggagcccagggca

SEQ ID NO: 3478279 - DNA, 14 bp, Homo sapiens
ggttggatggatgg

SEQ ID NO: 3478280 - DNA, 13 bp, Homo sapiens
ggttggtgggggc

SEQ ID NO: 3478281 - DNA, 13 bp, Homo sapiens
ggttgtgaatgtt

SEQ ID NO: 3478282 - DNA, 20 bp, Homo sapiens
ggttgttttttcctttgctc

SEQ ID NO: 3478283 - DNA, 13 bp, Homo sapiens
ggtttaagctgtt

SEQ ID NO: 3478284 - DNA, 19 bp, Homo sapiens
ggtttaatccccagtaaaa

SEQ ID NO: 3478285 - DNA, 22 bp, Homo sapiens
ggtttaatccccagtaaaattg

SEQ ID NO: 3478286 - DNA, 17 bp, Homo sapiens
ggtttacaatttacaaa

SEQ ID NO: 3478287 - DNA, 20 bp, Homo sapiens
ggtttcctggcactggaccc

SEQ ID NO: 3478288 - DNA, 16 bp, Homo sapiens
ggtttcgcagcctgag

SEQ ID NO: 3478289 - DNA, 12 bp, Homo sapiens
ggtttggcctcc

SEQ ID NO: 3478290 - DNA, 18 bp, Homo sapiens
ggttttaggtagaaaaac

SEQ ID NO: 3478291 - DNA, 17 bp, Homo sapiens
ggttttataaggctgat

SEQ ID NO: 3478292 - DNA, 22 bp, Homo sapiens
ggttttatctgagtgaaatact

SEQ ID NO: 3478293 - DNA, 22 bp, Homo sapiens
ggttttgttcccctcctccact

SEQ ID NO: 3478294 - DNA, 19 bp, Homo sapiens
ggtttttaaaaaatgtttt

SEQ ID NO: 3478295 - DNA, 17 bp, Homo sapiens
ggtttttacttaactgt

SEQ ID NO: 3478296 - DNA, 12 bp, Homo sapiens
ggtttttagaga

SEQ ID NO: 3478297 - DNA, 15 bp, Homo sapiens
ggtttttattagtac

SEQ ID NO: 3478298 - DNA, 17 bp, Homo sapiens
ggttttttaaaaggaaa

SEQ ID NO: 3478299 - DNA, 15 bp, Homo sapiens
gtaaaacaaaacaaa

SEQ ID NO: 3478300 - DNA, 15 bp, Homo sapiens
gtaaaatatagctgt

SEQ ID NO: 3478301 - DNA, 18 bp, Homo sapiens
gtaaaatatagctgtaca

SEQ ID NO: 3478302 - DNA, 15 bp, Homo sapiens
gtaaaatggaggtgg

SEQ ID NO: 3478303 - DNA, 19 bp, Homo sapiens
gtaaacagcctctttttga

SEQ ID NO: 3478304 - DNA, 21 bp, Homo sapiens
gtaaaccgctttggcctgagt

SEQ ID NO: 3478305 - DNA, 20 bp, Homo sapiens
gtaaacgctgtccctagtaa

SEQ ID NO: 3478306 - DNA, 22 bp, Homo sapiens
gtaaagggcgcaaagggcatgg

SEQ ID NO: 3478307 - DNA, 14 bp, Homo sapiens
gtaaagtgaagaat

SEQ ID NO: 3478308 - DNA, 17 bp, Homo sapiens
gtaaagtgataatttct

SEQ ID NO: 3478309 - DNA, 18 bp, Homo sapiens
gtaaagtgataatttctg

SEQ ID NO: 3478310 - DNA, 14 bp, Homo sapiens
gtaaataaagccct

SEQ ID NO: 3478311 - DNA, 16 bp, Homo sapiens
gtaaatatataaatat

SEQ ID NO: 3478312 - DNA, 21 bp, Homo sapiens
gtaaatatcccaaactgtgat

SEQ ID NO: 3478313 - DNA, 23 bp, Homo sapiens
gtaaatatgaatctgctcacttt

SEQ ID NO: 3478314 - DNA, 14 bp, Homo sapiens
gtaaatcttttaca

SEQ ID NO: 3478315 - DNA, 17 bp, Homo sapiens
gtaaatgtttaggtttt

SEQ ID NO: 3478316 - DNA, 23 bp, Homo sapiens
gtaaattatatttgtgctatagt

SEQ ID NO: 3478317 - DNA, 19 bp, Homo sapiens
gtaaattgaatcagtataa

SEQ ID NO: 3478318 - DNA, 16 bp, Homo sapiens
gtaacaagccacccca

SEQ ID NO: 3478319 - DNA, 16 bp, Homo sapiens
gtaacactgcaagaag

SEQ ID NO: 3478320 - DNA, 14 bp, Homo sapiens
gtaacataataaat

SEQ ID NO: 3478321 - DNA, 14 bp, Homo sapiens
gtaaccctggtggt

SEQ ID NO: 3478322 - DNA, 22 bp, Homo sapiens
gtaactgcattgagaactgcat

SEQ ID NO: 3478323 - DNA, 18 bp, Homo sapiens
gtaactttttacattaca

SEQ ID NO: 3478324 - DNA, 14 bp, Homo sapiens
gtaagaaaatattt

SEQ ID NO: 3478325 - DNA, 22 bp, Homo sapiens
gtaagaaaatattttgtctaaa

SEQ ID NO: 3478326 - DNA, 16 bp, Homo sapiens
gtctgccatgttgccc

SEQ ID NO: 3478327 - DNA, 15 bp, Homo sapiens
gtctgcctccagcca

SEQ ID NO: 3478328 - DNA, 14 bp, Homo sapiens
gtctggaagtccaa

SEQ ID NO: 3478329 - DNA, 15 bp, Homo sapiens
gtctggaatgcagtg

SEQ ID NO: 3478330 - DNA, 15 bp, Homo sapiens
gtctgggagtcaggc

SEQ ID NO: 3478331 - DNA, 16 bp, Homo sapiens
gtctgggagtcaggcc

SEQ ID NO: 3478332 - DNA, 17 bp, Homo sapiens
gtctggtcagagccaca

SEQ ID NO: 3478333 - DNA, 13 bp, Homo sapiens
gtctggtggcccc

SEQ ID NO: 3478334 - DNA, 17 bp, Homo sapiens
gtctggtttcaccgagg

SEQ ID NO: 3478335 - DNA, 12 bp, Homo sapiens
gtctgtaaaatc

SEQ ID NO: 3478336 - DNA, 13 bp, Homo sapiens
gtctgtaaaatct

SEQ ID NO: 3478337 - DNA, 18 bp, Homo sapiens
gtctgtaaaatctttctt

SEQ ID NO: 3478338 - DNA, 22 bp, Homo sapiens
gtctgtagtgtcactcaaggcg

SEQ ID NO: 3478339 - DNA, 13 bp, Homo sapiens
gtctgtggatcag

SEQ ID NO: 3478340 - DNA, 21 bp, Homo sapiens
gtctgtttggactgcagaagc

SEQ ID NO: 3478341 - DNA, 17 bp, Homo sapiens
gtcttaatgaagtttga

SEQ ID NO: 3478342 - DNA, 20 bp, Homo sapiens
gtcttaatgaagtttgaatg

SEQ ID NO: 3478343 - DNA, 13 bp, Homo sapiens
gtcttcaccaaca

SEQ ID NO: 3478344 - DNA, 15 bp, Homo sapiens
gtcttcacggcagga

SEQ ID NO: 3478345 - DNA, 14 bp, Homo sapiens
gtcttcagcctctt

SEQ ID NO: 3478346 - DNA, 23 bp, Homo sapiens
gtcttcagcctctttctgtccct

SEQ ID NO: 3478347 - DNA, 19 bp, Homo sapiens
gtcttccacaaagaaaatt

SEQ ID NO: 3478348 - DNA, 11 bp, Homo sapiens
gtcttcctctg

SEQ ID NO: 3478349 - DNA, 12 bp, Homo sapiens
gtcttcctctgc

SEQ ID NO: 3478350 - DNA, 19 bp, Homo sapiens
gtcttcctctgcaagtgct

SEQ ID NO: 3478351 - DNA, 20 bp, Homo sapiens
gtcttcctctgcaagtgctc

SEQ ID NO: 3478352 - DNA, 22 bp, Homo sapiens
gtcttcctctgcaagtgctcag

SEQ ID NO: 3478353 - DNA, 23 bp, Homo sapiens
gtcttcctctgcaagtgctcagg

SEQ ID NO: 3478354 - DNA, 14 bp, Homo sapiens
gtcttctaaacttc

SEQ ID NO: 3478355 - DNA, 23 bp, Homo sapiens
gtcttctaaacttccccatcttc

SEQ ID NO: 3478356 - DNA, 20 bp, Homo sapiens
gtcttctcacaagccagcca

SEQ ID NO: 3478357 - DNA, 18 bp, Homo sapiens
gtcttgaactcctggcct

SEQ ID NO: 3478358 - DNA, 13 bp, Homo sapiens
gtcttgaagtcct

SEQ ID NO: 3478359 - DNA, 19 bp, Homo sapiens
gtcttgatgtgtcatctaa

SEQ ID NO: 3478360 - DNA, 17 bp, Homo sapiens
gtcttgcaatggcagcc

SEQ ID NO: 3478361 - DNA, 18 bp, Homo sapiens
gtcttgcaatggcagcct

SEQ ID NO: 3478362 - DNA, 21 bp, Homo sapiens
gtcttgcaatggcagccttgg

SEQ ID NO: 3478363 - DNA, 23 bp, Homo sapiens
gtcttgcaatggcagccttggca

SEQ ID NO: 3478364 - DNA, 23 bp, Homo sapiens
gtcttgctatattgcccaggctg

SEQ ID NO: 3478365 - DNA, 13 bp, Homo sapiens
gtcttgttcattt

SEQ ID NO: 3478366 - DNA, 14 bp, Homo sapiens
gtcttgttcatttt

SEQ ID NO: 3478367 - DNA, 13 bp, Homo sapiens
gtcttgttctgtc

SEQ ID NO: 3478368 - DNA, 18 bp, Homo sapiens
gtctttactcctcacact

SEQ ID NO: 3478369 - DNA, 22 bp, Homo sapiens
gtctttaggtctttgtaagaac

SEQ ID NO: 3478370 - DNA, 14 bp, Homo sapiens
gtctttcagcattc

SEQ ID NO: 3478371 - DNA, 16 bp, Homo sapiens
gtctttcagcattcag

SEQ ID NO: 3478372 - DNA, 22 bp, Homo sapiens
gtctttcagtacttttttaaat

SEQ ID NO: 3478373 - DNA, 20 bp, Homo sapiens
gtctttccattggatctcat

SEQ ID NO: 3478374 - DNA, 12 bp, Homo sapiens
gtctttcctaga

SEQ ID NO: 3478375 - DNA, 16 bp, Homo sapiens
gtctttcggaattttt

SEQ ID NO: 3478376 - DNA, 17 bp, Homo sapiens
gtctttcggaattttta

SEQ ID NO: 3478377 - DNA, 13 bp, Homo sapiens
gtcttttaaaatg

SEQ ID NO: 3478378 - DNA, 16 bp, Homo sapiens
gtcttttgcttttggc

SEQ ID NO: 3478379 - DNA, 14 bp, Homo sapiens
gtctttttgtttgt

SEQ ID NO: 3478380 - DNA, 16 bp, Homo sapiens
gtcttttttcactaca

SEQ ID NO: 3478381 - DNA, 14 bp, Homo sapiens
gtgaaaagaaaaat

SEQ ID NO: 3478382 - DNA, 17 bp, Homo sapiens
gtgaaaatggtccagga

SEQ ID NO: 3478383 - DNA, 20 bp, Homo sapiens
gtgaaagttgccattattct

SEQ ID NO: 3478384 - DNA, 18 bp, Homo sapiens
gtgaacaaagcagccacg

SEQ ID NO: 3478385 - DNA, 19 bp, Homo sapiens
gtgaacaagcaaacccaga

SEQ ID NO: 3478386 - DNA, 18 bp, Homo sapiens
gtgaacagcttgctgtca

SEQ ID NO: 3478387 - DNA, 21 bp, Homo sapiens
gtgaacagtcacgcctgaaac

SEQ ID NO: 3478388 - DNA, 15 bp, Homo sapiens
gtgaaccaatgcaag

SEQ ID NO: 3478389 - DNA, 19 bp, Homo sapiens
gtgaaccaccacacccagc

SEQ ID NO: 3478390 - DNA, 22 bp, Homo sapiens
gtgaaccaccacacccagccca

SEQ ID NO: 3478391 - DNA, 14 bp, Homo sapiens
gtgaaccctggggc

SEQ ID NO: 3478392 - DNA, 18 bp, Homo sapiens
gtgaaccctggggcctga

SEQ ID NO: 3478393 - DNA, 19 bp, Homo sapiens
gtgaaccctggggcctgac

SEQ ID NO: 3478394 - DNA, 21 bp, Homo sapiens
gtgaacgtccacatgaaacct

SEQ ID NO: 3478395 - DNA, 22 bp, Homo sapiens
gtgaactggaccctgttgctaa

SEQ ID NO: 3478396 - DNA, 15 bp, Homo sapiens
gtgaactttattaaa

SEQ ID NO: 3478397 - DNA, 23 bp, Homo sapiens
gtgaagaatccttttgtagaatg

SEQ ID NO: 3478398 - DNA, 14 bp, Homo sapiens
gtgaagacagaagt

SEQ ID NO: 3478399 - DNA, 18 bp, Homo sapiens
gtgaagcaccaagctcaa

SEQ ID NO: 3478400 - DNA, 10 bp, Homo sapiens
gtgaagccaa

SEQ ID NO: 3478401 - DNA, 22 bp, Homo sapiens
gtgaagccaattcagacaggca

SEQ ID NO: 3478402 - DNA, 20 bp, Homo sapiens
gtgaaggccgagaagcaaga

SEQ ID NO: 3478403 - DNA, 14 bp, Homo sapiens
gtgaaggctggcat

SEQ ID NO: 3478404 - DNA, 19 bp, Homo sapiens
gtgaagtatactgtatttt

SEQ ID NO: 3478405 - DNA, 21 bp, Homo sapiens
gtgaatgatgatcctaggcat

SEQ ID NO: 3478406 - DNA, 20 bp, Homo sapiens
gtgaatgctgggactcagcc

SEQ ID NO: 3478407 - DNA, 12 bp, Homo sapiens
gtgaattttcaa

SEQ ID NO: 3478408 - DNA, 18 bp, Homo sapiens
gtgaattttcaaggcctt

SEQ ID NO: 3478409 - DNA, 17 bp, Homo sapiens
gtgaatttttgcaataa

SEQ ID NO: 3478410 - DNA, 21 bp, Homo sapiens
gtgaatttttgcaataatgca

SEQ ID NO: 3478411 - DNA, 12 bp, Homo sapiens
gtgacaaaccat

SEQ ID NO: 3478412 - DNA, 13 bp, Homo sapiens
gtgacacaaacac

SEQ ID NO: 3478413 - DNA, 14 bp, Homo sapiens
gtgacacaaacaca

SEQ ID NO: 3478414 - DNA, 21 bp, Homo sapiens
gtgacacaaacacacacaaaa

SEQ ID NO: 3478415 - DNA, 19 bp, Homo sapiens
gtgacacatcgttttgggg

SEQ ID NO: 3478416 - DNA, 16 bp, Homo sapiens
gtgacacccaagaggg

SEQ ID NO: 3478417 - DNA, 14 bp, Homo sapiens
gtgacagaggcagc

SEQ ID NO: 3478418 - DNA, 15 bp, Homo sapiens
gtgacagaggcagcc

SEQ ID NO: 3478419 - DNA, 16 bp, Homo sapiens
gtgacagaggcagccc

SEQ ID NO: 3478420 - DNA, 18 bp, Homo sapiens
gtgacagaggcagcccca

SEQ ID NO: 3478421 - DNA, 23 bp, Homo sapiens
gtgacagaggcagccccattctg

SEQ ID NO: 3478422 - DNA, 22 bp, Homo sapiens
gtgacagagtgagactctgtct

SEQ ID NO: 3478423 - DNA, 15 bp, Homo sapiens
gtgaccaatgtcttg

SEQ ID NO: 3478424 - DNA, 15 bp, Homo sapiens
gtgaccggacttttc

SEQ ID NO: 3478425 - DNA, 21 bp, Homo sapiens
gtgaccggacttttctgcaaa

SEQ ID NO: 3478426 - DNA, 13 bp, Homo sapiens
gtgacctctgcct

SEQ ID NO: 3478427 - DNA, 14 bp, Homo sapiens
gtgacctctgcctg

SEQ ID NO: 3478428 - DNA, 15 bp, Homo sapiens
gtgacctctgcctga

SEQ ID NO: 3478429 - DNA, 15 bp, Homo sapiens
gtgactcttctctca

SEQ ID NO: 3478430 - DNA, 19 bp, Homo sapiens
gtgagacagtccagcctgg

SEQ ID NO: 3478431 - DNA, 20 bp, Homo sapiens
gtgagacccagccctcatcc

SEQ ID NO: 3478432 - DNA, 14 bp, Homo sapiens
gtgagactctgtct

SEQ ID NO: 3478433 - DNA, 18 bp, Homo sapiens
gtgagactctgtctcaaa

SEQ ID NO: 3478434 - DNA, 13 bp, Homo sapiens
gtgagagctgggt

SEQ ID NO: 3478435 - DNA, 15 bp, Homo sapiens
gtgagaggaagggtg

SEQ ID NO: 3478436 - DNA, 16 bp, Homo sapiens
gtgagaggggaacaga

SEQ ID NO: 3478437 - DNA, 19 bp, Homo sapiens
gtgagcatgtttggaaggg

SEQ ID NO: 3478438 - DNA, 20 bp, Homo sapiens
gtgagccactgcaccgggcc

SEQ ID NO: 3478439 - DNA, 17 bp, Homo sapiens
gtgagcccatggccctc

SEQ ID NO: 3478440 - DNA, 18 bp, Homo sapiens
gtgagcccatggccctcc

SEQ ID NO: 3478441 - DNA, 17 bp, Homo sapiens
gtgagcctagccctggg

SEQ ID NO: 3478442 - DNA, 22 bp, Homo sapiens
gtgagctcccaggtgcagccag

SEQ ID NO: 3478443 - DNA, 17 bp, Homo sapiens
gtgaggccagggcagag

SEQ ID NO: 3478444 - DNA, 16 bp, Homo sapiens
gtgaggcctgtctgtg

SEQ ID NO: 3478445 - DNA, 19 bp, Homo sapiens
gtgaggcctgtctgtgacc

SEQ ID NO: 3478446 - DNA, 21 bp, Homo sapiens
gtgaggcctgtctgtgacctg

SEQ ID NO: 3478447 - DNA, 14 bp, Homo sapiens
gtgagggccttctt

SEQ ID NO: 3478448 - DNA, 22 bp, Homo sapiens
gtgagtcgaggacagggaggtg

SEQ ID NO: 3478449 - DNA, 13 bp, Homo sapiens
gtgagtgcctttt

SEQ ID NO: 3478450 - DNA, 12 bp, Homo sapiens
gtgataaggaca

SEQ ID NO: 3478451 - DNA, 21 bp, Homo sapiens
gtgataaggacatgatgcttt

SEQ ID NO: 3478452 - DNA, 16 bp, Homo sapiens
gtgatacatttctgaa

SEQ ID NO: 3478453 - DNA, 22 bp, Homo sapiens
gtgatagtcttttgcttttggc

SEQ ID NO: 3478454 - DNA, 24 bp, Homo sapiens
gtgatccacccacctcagcctccc

SEQ ID NO: 3478455 - DNA, 15 bp, Homo sapiens
gtgatcctcccacct

SEQ ID NO: 3478456 - DNA, 14 bp, Homo sapiens
gtgatgaatactgt

SEQ ID NO: 3478457 - DNA, 22 bp, Homo sapiens
gtgattcaattcaacactccct

SEQ ID NO: 3478458 - DNA, 17 bp, Homo sapiens
gtgattctcctgcctca

SEQ ID NO: 3478459 - DNA, 22 bp, Homo sapiens
gtttacaggatattccaaaata

SEQ ID NO: 3478460 - DNA, 19 bp, Homo sapiens
gtttagagaatgagaaatg

SEQ ID NO: 3478461 - DNA, 23 bp, Homo sapiens
gtttagcagcagcctttaatgca

SEQ ID NO: 3478462 - DNA, 15 bp, Homo sapiens
gtttatacctttgcc

SEQ ID NO: 3478463 - DNA, 18 bp, Homo sapiens
gtttatgtaaatgtttgt

SEQ ID NO: 3478464 - DNA, 15 bp, Homo sapiens
gtttcaaaataaaaa

SEQ ID NO: 3478465 - DNA, 23 bp, Homo sapiens
gtttcaaaataaaaaccaagaag

SEQ ID NO: 3478466 - DNA, 22 bp, Homo sapiens
gtttcaaagccaagacctcaca

SEQ ID NO: 3478467 - DNA, 23 bp, Homo sapiens
gtttcaaccaagtcatgtgcatt

SEQ ID NO: 3478468 - DNA, 18 bp, Homo sapiens
gtttcatgtaatcctcaa

SEQ ID NO: 3478469 - DNA, 14 bp, Homo sapiens
gtttcattttggtt

SEQ ID NO: 3478470 - DNA, 19 bp, Homo sapiens
gtttccagacttccttgag

SEQ ID NO: 3478471 - DNA, 16 bp, Homo sapiens
gtttcctgcaggccag

SEQ ID NO: 3478472 - DNA, 17 bp, Homo sapiens
gtttccttccagcccag

SEQ ID NO: 3478473 - DNA, 16 bp, Homo sapiens
gtttcgcagcctgagt

SEQ ID NO: 3478474 - DNA, 18 bp, Homo sapiens
gtttcgcagcctgagtcc

SEQ ID NO: 3478475 - DNA, 20 bp, Homo sapiens
gtttcgtgaagtatactgta

SEQ ID NO: 3478476 - DNA, 18 bp, Homo sapiens
gtttctaataaacttgga

SEQ ID NO: 3478477 - DNA, 17 bp, Homo sapiens
gtttctacctatatgca

SEQ ID NO: 3478478 - DNA, 18 bp, Homo sapiens
gtttctacctatatgcag

SEQ ID NO: 3478479 - DNA, 18 bp, Homo sapiens
gtttctagggaaatgaaa

SEQ ID NO: 3478480 - DNA, 20 bp, Homo sapiens
gtttctatgagtggaaaaag

SEQ ID NO: 3478481 - DNA, 18 bp, Homo sapiens
gtttctccaaactgaagc

SEQ ID NO: 3478482 - DNA, 23 bp, Homo sapiens
gtttctctgccgctacctccctc

SEQ ID NO: 3478483 - DNA, 14 bp, Homo sapiens
gtttctggaaatgt

SEQ ID NO: 3478484 - DNA, 20 bp, Homo sapiens
gtttctggtctctaggctgg

SEQ ID NO: 3478485 - DNA, 18 bp, Homo sapiens
gtttctggtggtctgttg

SEQ ID NO: 3478486 - DNA, 17 bp, Homo sapiens
gtttctgtcctgctggt

SEQ ID NO: 3478487 - DNA, 18 bp, Homo sapiens
gtttgaaattctgaattt

SEQ ID NO: 3478488 - DNA, 19 bp, Homo sapiens
gtttgaaattctgaatttg

SEQ ID NO: 3478489 - DNA, 20 bp, Homo sapiens
gtttgaacagatatgttttt

SEQ ID NO: 3478490 - DNA, 14 bp, Homo sapiens
gtttgaagcctgga

SEQ ID NO: 3478491 - DNA, 20 bp, Homo sapiens
gtttgaagctgctgtctcta

SEQ ID NO: 3478492 - DNA, 14 bp, Homo sapiens
gtttgaatgttaaa

SEQ ID NO: 3478493 - DNA, 16 bp, Homo sapiens
gtttgaccaatttgca

SEQ ID NO: 3478494 - DNA, 15 bp, Homo sapiens
gtttgagaccagcct

SEQ ID NO: 3478495 - DNA, 22 bp, Homo sapiens
gtttgagttaatgtgctgagca

SEQ ID NO: 3478496 - DNA, 12 bp, Homo sapiens
gtttgattgttt

SEQ ID NO: 3478497 - DNA, 23 bp, Homo sapiens
gtttgcccaaaatttattttata

SEQ ID NO: 3478498 - DNA, 11 bp, Homo sapiens
gtttgctttct

SEQ ID NO: 3478499 - DNA, 15 bp, Homo sapiens
gtttggcaaggaaag

SEQ ID NO: 3478500 - DNA, 15 bp, Homo sapiens
gtttggctgtgtcta

SEQ ID NO: 3478501 - DNA, 18 bp, Homo sapiens
gtttggctgtgtctaaac

SEQ ID NO: 3478502 - DNA, 19 bp, Homo sapiens
gtttggctgtgtctaaact

SEQ ID NO: 3478503 - DNA, 20 bp, Homo sapiens
gtttggctgtgtctaaactg

SEQ ID NO: 3478504 - DNA, 21 bp, Homo sapiens
gtttggctgtgtctaaactgc

SEQ ID NO: 3478505 - DNA, 13 bp, Homo sapiens
gtttggctttcag

SEQ ID NO: 3478506 - DNA, 13 bp, Homo sapiens
gtttgggcttcag

SEQ ID NO: 3478507 - DNA, 15 bp, Homo sapiens
gtttggtattgtatt

SEQ ID NO: 3478508 - DNA, 17 bp, Homo sapiens
gtttggtattgtattta

SEQ ID NO: 3478509 - DNA, 18 bp, Homo sapiens
gtttgtaactttttacat

SEQ ID NO: 3478510 - DNA, 22 bp, Homo sapiens
gtttgtaactttttacattaca

SEQ ID NO: 3478511 - DNA, 15 bp, Homo sapiens
gtttgtcattagcct

SEQ ID NO: 3478512 - DNA, 18 bp, Homo sapiens
gtttgtcgctcatgtgtg

SEQ ID NO: 3478513 - DNA, 18 bp, Homo sapiens
gtttgtctgtcttcatag

SEQ ID NO: 3478514 - DNA, 22 bp, Homo sapiens
gtttgtgtatttacgctttgat

SEQ ID NO: 3478515 - DNA, 16 bp, Homo sapiens
gtttgttaaaaataaa

SEQ ID NO: 3478516 - DNA, 17 bp, Homo sapiens
gtttgttgatcttttaa

SEQ ID NO: 3478517 - DNA, 21 bp, Homo sapiens
gtttgttggatccgtttgacc

SEQ ID NO: 3478518 - DNA, 14 bp, Homo sapiens
gtttgttttggatt

SEQ ID NO: 3478519 - DNA, 13 bp, Homo sapiens
gttttaaatgtac

SEQ ID NO: 3478520 - DNA, 12 bp, Homo sapiens
gttttaaattct

SEQ ID NO: 3478521 - DNA, 19 bp, Homo sapiens
gttttaactagaatttatt

SEQ ID NO: 3478522 - DNA, 16 bp, Homo sapiens
gttttaactcttttgg

SEQ ID NO: 3478523 - DNA, 16 bp, Homo sapiens
gttttaagaggcaggg

SEQ ID NO: 3478524 - DNA, 12 bp, Homo sapiens
gttttacaaagg

SEQ ID NO: 3478525 - DNA, 14 bp, Homo sapiens
gttttaggatactt

SEQ ID NO: 3478526 - DNA, 23 bp, Homo sapiens
gttttaggatacttaacaaatac

SEQ ID NO: 3478527 - DNA, 13 bp, Homo sapiens
gttttatccataa

SEQ ID NO: 3478528 - DNA, 19 bp, Homo sapiens
gttttatgagatggatcac

SEQ ID NO: 3478529 - DNA, 15 bp, Homo sapiens
gttttcaagtcaaat

SEQ ID NO: 3478530 - DNA, 18 bp, Homo sapiens
gttttcaagtcaaattaa

SEQ ID NO: 3478531 - DNA, 11 bp, Homo sapiens
gttttcactct

SEQ ID NO: 3478532 - DNA, 17 bp, Homo sapiens
gttttcatttggttcat

SEQ ID NO: 3478533 - DNA, 14 bp, Homo sapiens
gttttcctcccttc

SEQ ID NO: 3478534 - DNA, 22 bp, Homo sapiens
gttttcctcccttctgctactg

SEQ ID NO: 3478535 - DNA, 16 bp, Homo sapiens
gttttctttcctcctt

SEQ ID NO: 3478536 - DNA, 20 bp, Homo sapiens
gttttctttcctcctttcct

SEQ ID NO: 3478537 - DNA, 21 bp, Homo sapiens
gttttgccatgttggccaggc

SEQ ID NO: 3478538 - DNA, 22 bp, Homo sapiens
gttttgccatgttggccaggct

SEQ ID NO: 3478539 - DNA, 15 bp, Homo sapiens
gttttggattcttta

SEQ ID NO: 3478540 - DNA, 23 bp, Homo sapiens
gttttggctgaaattctcctgga

SEQ ID NO: 3478541 - DNA, 15 bp, Homo sapiens
gttttgggtatgttt

SEQ ID NO: 3478542 - DNA, 14 bp, Homo sapiens
gttttgtaccagtg

SEQ ID NO: 3478543 - DNA, 15 bp, Homo sapiens
gttttgttcccctcc

SEQ ID NO: 3478544 - DNA, 16 bp, Homo sapiens
gttttgttcccctcct

SEQ ID NO: 3478545 - DNA, 17 bp, Homo sapiens
gttttgttttaaaatta

SEQ ID NO: 3478546 - DNA, 18 bp, Homo sapiens
gtttttaatataaagcct

SEQ ID NO: 3478547 - DNA, 11 bp, Homo sapiens
gtttttacagc

SEQ ID NO: 3478548 - DNA, 17 bp, Homo sapiens
gtttttacagctgtgtt

SEQ ID NO: 3478549 - DNA, 17 bp, Homo sapiens
gtttttatattaatgta

SEQ ID NO: 3478550 - DNA, 18 bp, Homo sapiens
gtttttctaggcctgggg

SEQ ID NO: 3478551 - DNA, 18 bp, Homo sapiens
gtttttggtttttaaaac

SEQ ID NO: 3478552 - DNA, 15 bp, Homo sapiens
gtttttgttcaaagc

SEQ ID NO: 3478553 - DNA, 22 bp, Homo sapiens
gttttttgcctaaatccaaaga

SEQ ID NO: 3478554 - DNA, 19 bp, Homo sapiens
gttttttggcttgcttatg

SEQ ID NO: 3478555 - DNA, 21 bp, Homo sapiens
gttttttggcttgcttatgtg

SEQ ID NO: 3478556 - DNA, 13 bp, Homo sapiens
gttttttgtttct

SEQ ID NO: 3478557 - DNA, 15 bp, Homo sapiens
gttttttgtttgagt

SEQ ID NO: 3478558 - DNA, 23 bp, Homo sapiens
gtttttttcattgccaaaaacta

SEQ ID NO: 3478559 - DNA, 20 bp, Homo sapiens
gttttttttttttttatgtg

SEQ ID NO: 3478560 - DNA, 16 bp, Homo sapiens
taaaaaaaaaaaagta

SEQ ID NO: 3478561 - DNA, 16 bp, Homo sapiens
taaaaaaataaaacag

SEQ ID NO: 3478562 - DNA, 14 bp, Homo sapiens
taaaaaacaaagaa

SEQ ID NO: 3478563 - DNA, 14 bp, Homo sapiens
taaaaaacaaatat

SEQ ID NO: 3478564 - DNA, 13 bp, Homo sapiens
taaaaaatatttt

SEQ ID NO: 3478565 - DNA, 14 bp, Homo sapiens
taaaaaattcacat

SEQ ID NO: 3478566 - DNA, 15 bp, Homo sapiens
taaaaaattcacata

SEQ ID NO: 3478567 - DNA, 14 bp, Homo sapiens
taaaaaccaagaag

SEQ ID NO: 3478568 - DNA, 11 bp, Homo sapiens
taaaaagcaac

SEQ ID NO: 3478569 - DNA, 20 bp, Homo sapiens
taaaaagcttccatgattct

SEQ ID NO: 3478570 - DNA, 18 bp, Homo sapiens
taaaaatacacatggaaa

SEQ ID NO: 3478571 - DNA, 10 bp, Homo sapiens
taaaaatata

SEQ ID NO: 3478572 - DNA, 18 bp, Homo sapiens
taaaaatattttttctgt

SEQ ID NO: 3478573 - DNA, 15 bp, Homo sapiens
taaaaatctcttttc

SEQ ID NO: 3478574 - DNA, 20 bp, Homo sapiens
taaaaatgcaaatcctatgt

SEQ ID NO: 3478575 - DNA, 23 bp, Homo sapiens
taaaaatgttttttcatgtgttt

SEQ ID NO: 3478576 - DNA, 21 bp, Homo sapiens
taaaacaaaatttgactaatt

SEQ ID NO: 3478577 - DNA, 14 bp, Homo sapiens
taaaacaaagggca

SEQ ID NO: 3478578 - DNA, 18 bp, Homo sapiens
taaaacaatattgtttct

SEQ ID NO: 3478579 - DNA, 14 bp, Homo sapiens
taaaacagaagcct

SEQ ID NO: 3478580 - DNA, 16 bp, Homo sapiens
taaaacagcattagat

SEQ ID NO: 3478581 - DNA, 13 bp, Homo sapiens
taaaacattaaga

SEQ ID NO: 3478582 - DNA, 16 bp, Homo sapiens
taaaacattaagaaaa

SEQ ID NO: 3478583 - DNA, 16 bp, Homo sapiens
taaaacttaagatatt

SEQ ID NO: 3478584 - DNA, 13 bp, Homo sapiens
taaaacttgctgc

SEQ ID NO: 3478585 - DNA, 15 bp, Homo sapiens
taaaactttgctgcc

SEQ ID NO: 3478586 - DNA, 16 bp, Homo sapiens
taaaactttgctgcca

SEQ ID NO: 3478587 - DNA, 22 bp, Homo sapiens
taaaagacaaatcaaagcagat

SEQ ID NO: 3478588 - DNA, 14 bp, Homo sapiens
taaaagagtagaat

SEQ ID NO: 3478589 - DNA, 13 bp, Homo sapiens
taaaagatataag

SEQ ID NO: 3478590 - DNA, 18 bp, Homo sapiens
taaaagatataagtgctg

SEQ ID NO: 3478591 - DNA, 15 bp, Homo sapiens
taaaagatgctttta

SEQ ID NO: 3478592 - DNA, 16 bp, Homo sapiens
tagctactaattttaa

SEQ ID NO: 3478593 - DNA, 17 bp, Homo sapiens
tagctagtttgcttttt

SEQ ID NO: 3478594 - DNA, 20 bp, Homo sapiens
tagctcaggtgtccctgcac

SEQ ID NO: 3478595 - DNA, 21 bp, Homo sapiens
tagctccccgcttctgcctgc

SEQ ID NO: 3478596 - DNA, 15 bp, Homo sapiens
tagctgctaccttct

SEQ ID NO: 3478597 - DNA, 11 bp, Homo sapiens
tagctgggact

SEQ ID NO: 3478598 - DNA, 20 bp, Homo sapiens
tagctgggactacaggcacc

SEQ ID NO: 3478599 - DNA, 20 bp, Homo sapiens
tagctgggggtgggccaggc

SEQ ID NO: 3478600 - DNA, 12 bp, Homo sapiens
tagctgtacaaa

SEQ ID NO: 3478601 - DNA, 17 bp, Homo sapiens
tagctgttgagctgttt

SEQ ID NO: 3478602 - DNA, 15 bp, Homo sapiens
tagcttcaggaacct

SEQ ID NO: 3478603 - DNA, 16 bp, Homo sapiens
tagctttgctctgcca

SEQ ID NO: 3478604 - DNA, 14 bp, Homo sapiens
tagcttttcacctt

SEQ ID NO: 3478605 - DNA, 22 bp, Homo sapiens
taggaaccaacaaggaaacttt

SEQ ID NO: 3478606 - DNA, 20 bp, Homo sapiens
taggaacggtaaatttctgt

SEQ ID NO: 3478607 - DNA, 23 bp, Homo sapiens
taggaagaacgttttttcctcag

SEQ ID NO: 3478608 - DNA, 19 bp, Homo sapiens
taggaagagaaaccaggga

SEQ ID NO: 3478609 - DNA, 12 bp, Homo sapiens
taggaatcagca

SEQ ID NO: 3478610 - DNA, 15 bp, Homo sapiens
taggaatcagcaaga

SEQ ID NO: 3478611 - DNA, 20 bp, Homo sapiens
taggaccaggatccagcctc

SEQ ID NO: 3478612 - DNA, 16 bp, Homo sapiens
taggacccaagcagag

SEQ ID NO: 3478613 - DNA, 17 bp, Homo sapiens
taggagaaccaaatctg

SEQ ID NO: 3478614 - DNA, 15 bp, Homo sapiens
taggagaagggctga

SEQ ID NO: 3478615 - DNA, 15 bp, Homo sapiens
taggcagacacaggg

SEQ ID NO: 3478616 - DNA, 22 bp, Homo sapiens
taggcaggaagcccaattgctg

SEQ ID NO: 3478617 - DNA, 22 bp, Homo sapiens
taggcaggacatgctgaagcca

SEQ ID NO: 3478618 - DNA, 20 bp, Homo sapiens
taggcagtaggccggtgtgc

SEQ ID NO: 3478619 - DNA, 16 bp, Homo sapiens
taggcattaacacaaa

SEQ ID NO: 3478620 - DNA, 12 bp, Homo sapiens
taggcatttcct

SEQ ID NO: 3478621 - DNA, 21 bp, Homo sapiens
taggcccccacttgcctcttc

SEQ ID NO: 3478622 - DNA, 20 bp, Homo sapiens
taggcctcaactcctcccat

SEQ ID NO: 3478623 - DNA, 22 bp, Homo sapiens
taggcctcaactcctcccatag

SEQ ID NO: 3478624 - DNA, 22 bp, Homo sapiens
taggcctcagccagagaagcta

SEQ ID NO: 3478625 - DNA, 15 bp, Homo sapiens
taggcctggccagat

SEQ ID NO: 3478626 - DNA, 15 bp, Homo sapiens
taggctattcacaac

SEQ ID NO: 3478627 - DNA, 22 bp, Homo sapiens
taggctgccccgggtccccagc

SEQ ID NO: 3478628 - DNA, 18 bp, Homo sapiens
taggctggtggcccagga

SEQ ID NO: 3478629 - DNA, 13 bp, Homo sapiens
tagggaaagaaag

SEQ ID NO: 3478630 - DNA, 23 bp, Homo sapiens
tagggaatcctgcggcaggactg

SEQ ID NO: 3478631 - DNA, 15 bp, Homo sapiens
tagggaattcttctg

SEQ ID NO: 3478632 - DNA, 12 bp, Homo sapiens
tagggagccatg

SEQ ID NO: 3478633 - DNA, 17 bp, Homo sapiens
tagggagccatttgaga

SEQ ID NO: 3478634 - DNA, 23 bp, Homo sapiens
tagggagctcttgacagaaagca

SEQ ID NO: 3478635 - DNA, 20 bp, Homo sapiens
tagggcaccaggggtttctc

SEQ ID NO: 3478636 - DNA, 14 bp, Homo sapiens
tagggctgtaaaat

SEQ ID NO: 3478637 - DNA, 21 bp, Homo sapiens
tagggtttaatccccagtaaa

SEQ ID NO: 3478638 - DNA, 11 bp, Homo sapiens
taggtattttg

SEQ ID NO: 3478639 - DNA, 16 bp, Homo sapiens
taggtcccccaagcat

SEQ ID NO: 3478640 - DNA, 16 bp, Homo sapiens
taggtggcaaggctgt

SEQ ID NO: 3478641 - DNA, 13 bp, Homo sapiens
taggtgtggggga

SEQ ID NO: 3478642 - DNA, 13 bp, Homo sapiens
taggttaataaag

SEQ ID NO: 3478643 - DNA, 19 bp, Homo sapiens
taggttaataaagatgatt

SEQ ID NO: 3478644 - DNA, 14 bp, Homo sapiens
taggttcagccaag

SEQ ID NO: 3478645 - DNA, 12 bp, Homo sapiens
taggttcttctt

SEQ ID NO: 3478646 - DNA, 15 bp, Homo sapiens
taggtttttattagt

SEQ ID NO: 3478647 - DNA, 21 bp, Homo sapiens
tagtaaaaaatcaattaacca

SEQ ID NO: 3478648 - DNA, 13 bp, Homo sapiens
tagtaaatgttat

SEQ ID NO: 3478649 - DNA, 15 bp, Homo sapiens
tagtaatttcctaga

SEQ ID NO: 3478650 - DNA, 19 bp, Homo sapiens
tagtaccatttatacaaat

SEQ ID NO: 3478651 - DNA, 14 bp, Homo sapiens
tagtagtttttaca

SEQ ID NO: 3478652 - DNA, 16 bp, Homo sapiens
tagtatggtggctggg

SEQ ID NO: 3478653 - DNA, 22 bp, Homo sapiens
tagtattgaatacttacattct

SEQ ID NO: 3478654 - DNA, 18 bp, Homo sapiens
tagtcaatcaagtctgtt

SEQ ID NO: 3478655 - DNA, 19 bp, Homo sapiens
tagtcaatcaagtctgttt

SEQ ID NO: 3478656 - DNA, 19 bp, Homo sapiens
tagtcagaattagctgctt

SEQ ID NO: 3478657 - DNA, 22 bp, Homo sapiens
tagtccgtgctgacagctgctc

SEQ ID NO: 3478658 - DNA, 21 bp, Homo sapiens
tagtctaacacagttgaccct

SEQ ID NO: 3478659 - DNA, 18 bp, Homo sapiens
tagtctagatggctcctc

SEQ ID NO: 3478660 - DNA, 16 bp, Homo sapiens
tagtctagtgtagtat

SEQ ID NO: 3478661 - DNA, 19 bp, Homo sapiens
tagtctgagcttctttagc

SEQ ID NO: 3478662 - DNA, 13 bp, Homo sapiens
tagtcttacctaa

SEQ ID NO: 3478663 - DNA, 16 bp, Homo sapiens
tagtcttttgcttttg

SEQ ID NO: 3478664 - DNA, 22 bp, Homo sapiens
tagtgaaataaattctgattct

SEQ ID NO: 3478665 - DNA, 18 bp, Homo sapiens
tagtgaagctctcaccca

SEQ ID NO: 3478666 - DNA, 20 bp, Homo sapiens
tagtgatcacagcagcttct

SEQ ID NO: 3478667 - DNA, 16 bp, Homo sapiens
tagtgccttctaaagg

SEQ ID NO: 3478668 - DNA, 19 bp, Homo sapiens
tagtgctaagtgtgaactg

SEQ ID NO: 3478669 - DNA, 23 bp, Homo sapiens
tagtgctttccttttttaaaaat

SEQ ID NO: 3478670 - DNA, 20 bp, Homo sapiens
tagtggcttcattagagcag

SEQ ID NO: 3478671 - DNA, 20 bp, Homo sapiens
tagtggtttatcagcaaaaa

SEQ ID NO: 3478672 - DNA, 19 bp, Homo sapiens
tagtggttttaggatactt

SEQ ID NO: 3478673 - DNA, 14 bp, Homo sapiens
tagttaagacatga

SEQ ID NO: 3478674 - DNA, 15 bp, Homo sapiens
tagttctgtagaaat

SEQ ID NO: 3478675 - DNA, 15 bp, Homo sapiens
tagttgacaattctg

SEQ ID NO: 3478676 - DNA, 17 bp, Homo sapiens
tagttggcagaaataca

SEQ ID NO: 3478677 - DNA, 14 bp, Homo sapiens
tagttttcttgttg

SEQ ID NO: 3478678 - DNA, 14 bp, Homo sapiens
tataaaaaatatgt

SEQ ID NO: 3478679 - DNA, 16 bp, Homo sapiens
tataaaaaatatgtat

SEQ ID NO: 3478680 - DNA, 17 bp, Homo sapiens
tataaaaaatatgtatt

SEQ ID NO: 3478681 - DNA, 17 bp, Homo sapiens
tataaaacaggtcaata

SEQ ID NO: 3478682 - DNA, 22 bp, Homo sapiens
tataaaactgcgttaaaggctc

SEQ ID NO: 3478683 - DNA, 21 bp, Homo sapiens
tataaaagatggggtctgtaa

SEQ ID NO: 3478684 - DNA, 15 bp, Homo sapiens
tataaaagctttctg

SEQ ID NO: 3478685 - DNA, 19 bp, Homo sapiens
tataaaataaatatatata

SEQ ID NO: 3478686 - DNA, 20 bp, Homo sapiens
tataaacctaaaaaagatat

SEQ ID NO: 3478687 - DNA, 23 bp, Homo sapiens
tataaagaaggttggtgaatttc

SEQ ID NO: 3478688 - DNA, 13 bp, Homo sapiens
tataaagtgattg

SEQ ID NO: 3478689 - DNA, 16 bp, Homo sapiens
tataacaacgtctttt

SEQ ID NO: 3478690 - DNA, 13 bp, Homo sapiens
tataagaaaaact

SEQ ID NO: 3478691 - DNA, 15 bp, Homo sapiens
tataagaaaaacttt

SEQ ID NO: 3478692 - DNA, 14 bp, Homo sapiens
tataagaaagacat

SEQ ID NO: 3478693 - DNA, 14 bp, Homo sapiens
tataaggaagattt

SEQ ID NO: 3478694 - DNA, 16 bp, Homo sapiens
tataaggcagccttga

SEQ ID NO: 3478695 - DNA, 23 bp, Homo sapiens
tataagtaaagtgattaaagtgc

SEQ ID NO: 3478696 - DNA, 18 bp, Homo sapiens
tataagtcattgtatgtt

SEQ ID NO: 3478697 - DNA, 13 bp, Homo sapiens
tataagtgctgta

SEQ ID NO: 3478698 - DNA, 15 bp, Homo sapiens
tataagtgctgtata

SEQ ID NO: 3478699 - DNA, 17 bp, Homo sapiens
tataagtgctgtataaa

SEQ ID NO: 3478700 - DNA, 19 bp, Homo sapiens
tataagtggaggcacttta

SEQ ID NO: 3478701 - DNA, 20 bp, Homo sapiens
tataagtggtgcttagaaaa

SEQ ID NO: 3478702 - DNA, 21 bp, Homo sapiens
tataagttatttttgtacatg

SEQ ID NO: 3478703 - DNA, 22 bp, Homo sapiens
tataagttatttttgtacatgt

SEQ ID NO: 3478704 - DNA, 19 bp, Homo sapiens
tataagttgagaaggtgcc

SEQ ID NO: 3478705 - DNA, 21 bp, Homo sapiens
tataatttttttcaatattta

SEQ ID NO: 3478706 - DNA, 13 bp, Homo sapiens
tatacaaattaga

SEQ ID NO: 3478707 - DNA, 16 bp, Homo sapiens
tatacaaattagaaaa

SEQ ID NO: 3478708 - DNA, 15 bp, Homo sapiens
tatacaataacataa

SEQ ID NO: 3478709 - DNA, 21 bp, Homo sapiens
tatacaataatgtaatttagt

SEQ ID NO: 3478710 - DNA, 21 bp, Homo sapiens
tatacatatctttattaatca

SEQ ID NO: 3478711 - DNA, 23 bp, Homo sapiens
tataccatttcaaatatttacag

SEQ ID NO: 3478712 - DNA, 16 bp, Homo sapiens
tatacctttgccttgg

SEQ ID NO: 3478713 - DNA, 15 bp, Homo sapiens
tataccttttttgtt

SEQ ID NO: 3478714 - DNA, 20 bp, Homo sapiens
tatacgcagcgtgctttaaa

SEQ ID NO: 3478715 - DNA, 19 bp, Homo sapiens
tatactattaaaaaggttt

SEQ ID NO: 3478716 - DNA, 17 bp, Homo sapiens
tatactctttctgtata

SEQ ID NO: 3478717 - DNA, 19 bp, Homo sapiens
tatactctttctgtatata

SEQ ID NO: 3478718 - DNA, 22 bp, Homo sapiens
tatactctttctgtatatactt

SEQ ID NO: 3478719 - DNA, 17 bp, Homo sapiens
tatactgtacaataaaa

SEQ ID NO: 3478720 - DNA, 22 bp, Homo sapiens
tatactgtacaataaaaacatt

SEQ ID NO: 3478721 - DNA, 17 bp, Homo sapiens
tatactttaatgtttta

SEQ ID NO: 3478722 - DNA, 22 bp, Homo sapiens
tatagaattagctttttcatcc

SEQ ID NO: 3478723 - DNA, 16 bp, Homo sapiens
tatagacaaataataa

SEQ ID NO: 3478724 - DNA, 22 bp, Homo sapiens
tcacactgggtggtggcctggt

SEQ ID NO: 3478725 - DNA, 22 bp, Homo sapiens
tcacacttactgtaagacatta

SEQ ID NO: 3478726 - DNA, 18 bp, Homo sapiens
tcacagatcgcatttcct

SEQ ID NO: 3478727 - DNA, 22 bp, Homo sapiens
tcacagatgagttatctaagaa

SEQ ID NO: 3478728 - DNA, 14 bp, Homo sapiens
tcacagatgcctac

SEQ ID NO: 3478729 - DNA, 21 bp, Homo sapiens
tcacagatgcctacttttggc

SEQ ID NO: 3478730 - DNA, 12 bp, Homo sapiens
tcacaggcaggt

SEQ ID NO: 3478731 - DNA, 17 bp, Homo sapiens
tcacaggcaggtccagg

SEQ ID NO: 3478732 - DNA, 23 bp, Homo sapiens
tcacagggactgaaaacctctcc

SEQ ID NO: 3478733 - DNA, 20 bp, Homo sapiens
tcacaggtgtcagccattgc

SEQ ID NO: 3478734 - DNA, 17 bp, Homo sapiens
tcacagtgttgcccagg

SEQ ID NO: 3478735 - DNA, 19 bp, Homo sapiens
tcacagttcaaaattctaa

SEQ ID NO: 3478736 - DNA, 23 bp, Homo sapiens
tcacagttcaaaattctaaatgt

SEQ ID NO: 3478737 - DNA, 22 bp, Homo sapiens
tcacagttctttgggccagaca

SEQ ID NO: 3478738 - DNA, 14 bp, Homo sapiens
tcacataataaacg

SEQ ID NO: 3478739 - DNA, 17 bp, Homo sapiens
tcacataataaacgatg

SEQ ID NO: 3478740 - DNA, 20 bp, Homo sapiens
tcacataataaacgatgttg

SEQ ID NO: 3478741 - DNA, 23 bp, Homo sapiens
tcacataataaacgatgttgtga

SEQ ID NO: 3478742 - DNA, 21 bp, Homo sapiens
tcacatccattgtctcttcat

SEQ ID NO: 3478743 - DNA, 22 bp, Homo sapiens
tcacatccattgtctcttcatg

SEQ ID NO: 3478744 - DNA, 17 bp, Homo sapiens
tcacatcctgtgtttct

SEQ ID NO: 3478745 - DNA, 21 bp, Homo sapiens
tcacattcccctggggaccca

SEQ ID NO: 3478746 - DNA, 14 bp, Homo sapiens
tcacattctgctta

SEQ ID NO: 3478747 - DNA, 18 bp, Homo sapiens
tcacattgtttgctgcta

SEQ ID NO: 3478748 - DNA, 22 bp, Homo sapiens
tcaccacaaactgtaatacaat

SEQ ID NO: 3478749 - DNA, 17 bp, Homo sapiens
tcaccaccccctccttc

SEQ ID NO: 3478750 - DNA, 18 bp, Homo sapiens
tcaccacgactggccagg

SEQ ID NO: 3478751 - DNA, 13 bp, Homo sapiens
tcaccagccccag

SEQ ID NO: 3478752 - DNA, 16 bp, Homo sapiens
tcaccagccccagtgc

SEQ ID NO: 3478753 - DNA, 13 bp, Homo sapiens
tcaccagctgcaa

SEQ ID NO: 3478754 - DNA, 17 bp, Homo sapiens
tcaccagctgcaaagtg

SEQ ID NO: 3478755 - DNA, 18 bp, Homo sapiens
tcaccagctgcaaagtgt

SEQ ID NO: 3478756 - DNA, 14 bp, Homo sapiens
tcaccatgatgggg

SEQ ID NO: 3478757 - DNA, 11 bp, Homo sapiens
tcaccatggcc

SEQ ID NO: 3478758 - DNA, 23 bp, Homo sapiens
tcaccatttggcaatgccatcat

SEQ ID NO: 3478759 - DNA, 20 bp, Homo sapiens
tcacccataataaaggttgt

SEQ ID NO: 3478760 - DNA, 19 bp, Homo sapiens
tcaccccagggcctgagcc

SEQ ID NO: 3478761 - DNA, 18 bp, Homo sapiens
tcacccccttctccatcc

SEQ ID NO: 3478762 - DNA, 21 bp, Homo sapiens
tcaccctagccctctccctct

SEQ ID NO: 3478763 - DNA, 20 bp, Homo sapiens
tcaccctcataccatctgct

SEQ ID NO: 3478764 - DNA, 12 bp, Homo sapiens
tcaccctgcagg

SEQ ID NO: 3478765 - DNA, 18 bp, Homo sapiens
tcaccgtgggctccctga

SEQ ID NO: 3478766 - DNA, 19 bp, Homo sapiens
tcaccgtgggctccctgac

SEQ ID NO: 3478767 - DNA, 14 bp, Homo sapiens
tcacctcttccgac

SEQ ID NO: 3478768 - DNA, 23 bp, Homo sapiens
tcacctgaagactcattcttctg

SEQ ID NO: 3478769 - DNA, 12 bp, Homo sapiens
tcacctgattca

SEQ ID NO: 3478770 - DNA, 18 bp, Homo sapiens
tcacctgattcaactaaa

SEQ ID NO: 3478771 - DNA, 19 bp, Homo sapiens
tcacctggggtgtgggagg

SEQ ID NO: 3478772 - DNA, 15 bp, Homo sapiens
tcacctgtactattg

SEQ ID NO: 3478773 - DNA, 19 bp, Homo sapiens
tcacctgtttttaagctgt

SEQ ID NO: 3478774 - DNA, 19 bp, Homo sapiens
tcaccttggcaccagacac

SEQ ID NO: 3478775 - DNA, 14 bp, Homo sapiens
tcaccttggggcct

SEQ ID NO: 3478776 - DNA, 21 bp, Homo sapiens
tcacgattgtcatcaggagaa

SEQ ID NO: 3478777 - DNA, 12 bp, Homo sapiens
tcacgcctgaaa

SEQ ID NO: 3478778 - DNA, 17 bp, Homo sapiens
tcacgcctgaaactttg

SEQ ID NO: 3478779 - DNA, 23 bp, Homo sapiens
tcacgcctgtaatcccagcactt

SEQ ID NO: 3478780 - DNA, 17 bp, Homo sapiens
tcacggaagagccttgc

SEQ ID NO: 3478781 - DNA, 15 bp, Homo sapiens
tcacggctcactgca

SEQ ID NO: 3478782 - DNA, 17 bp, Homo sapiens
tcacgtgcagctcaagg

SEQ ID NO: 3478783 - DNA, 17 bp, Homo sapiens
tcacgttagaggaaaaa

SEQ ID NO: 3478784 - DNA, 22 bp, Homo sapiens
tcacgtttcatgtaatcctcaa

SEQ ID NO: 3478785 - DNA, 23 bp, Homo sapiens
tcactaggcccccacttgcctct

SEQ ID NO: 3478786 - DNA, 19 bp, Homo sapiens
tcactagggaatcctgcgg

SEQ ID NO: 3478787 - DNA, 20 bp, Homo sapiens
tcactatgttgcccaggcag

SEQ ID NO: 3478788 - DNA, 20 bp, Homo sapiens
tcactcattgctgagcctct

SEQ ID NO: 3478789 - DNA, 22 bp, Homo sapiens
tcactcattgctgagcctctgc

SEQ ID NO: 3478790 - DNA, 23 bp, Homo sapiens
tcactcccacctgcatctggggc

SEQ ID NO: 3478791 - DNA, 17 bp, Homo sapiens
tcactctgagtgtttta

SEQ ID NO: 3478792 - DNA, 19 bp, Homo sapiens
tcactctgtcgcccagtct

SEQ ID NO: 3478793 - DNA, 22 bp, Homo sapiens
tcactctgtcgcccagtctgga

SEQ ID NO: 3478794 - DNA, 17 bp, Homo sapiens
tcactcttattgcccac

SEQ ID NO: 3478795 - DNA, 20 bp, Homo sapiens
tcactcttattgcccacgct

SEQ ID NO: 3478796 - DNA, 21 bp, Homo sapiens
tcactcttattgcccacgctg

SEQ ID NO: 3478797 - DNA, 14 bp, Homo sapiens
tcactctttagaaa

SEQ ID NO: 3478798 - DNA, 16 bp, Homo sapiens
tcactgatgggaaaac

SEQ ID NO: 3478799 - DNA, 18 bp, Homo sapiens
tcactgatgggaaaactg

SEQ ID NO: 3478800 - DNA, 18 bp, Homo sapiens
tcactgcaacctccgcct

SEQ ID NO: 3478801 - DNA, 12 bp, Homo sapiens
tcactgcagcct

SEQ ID NO: 3478802 - DNA, 13 bp, Homo sapiens
tcactgcagcctc

SEQ ID NO: 3478803 - DNA, 14 bp, Homo sapiens
tcactgcagcctca

SEQ ID NO: 3478804 - DNA, 20 bp, Homo sapiens
tcactgccagagataaacta

SEQ ID NO: 3478805 - DNA, 18 bp, Homo sapiens
tcactgccatgccagctt

SEQ ID NO: 3478806 - DNA, 20 bp, Homo sapiens
tcactggcgacacgtagcag

SEQ ID NO: 3478807 - DNA, 22 bp, Homo sapiens
tcactggcgaggtgcggccacc

SEQ ID NO: 3478808 - DNA, 17 bp, Homo sapiens
tcactggggcctacagc

SEQ ID NO: 3478809 - DNA, 22 bp, Homo sapiens
tcactggggtcacttgggaaga

SEQ ID NO: 3478810 - DNA, 15 bp, Homo sapiens
tcactgtcctccaag

SEQ ID NO: 3478811 - DNA, 14 bp, Homo sapiens
tcactgtctttcct

SEQ ID NO: 3478812 - DNA, 15 bp, Homo sapiens
tcactgttgcccagg

SEQ ID NO: 3478813 - DNA, 23 bp, Homo sapiens
tcactgttgcccaggctggcgtg

SEQ ID NO: 3478814 - DNA, 15 bp, Homo sapiens
tcacttcaccctgga

SEQ ID NO: 3478815 - DNA, 18 bp, Homo sapiens
tcacttcggccagagctg

SEQ ID NO: 3478816 - DNA, 19 bp, Homo sapiens
tcacttcggccagagctga

SEQ ID NO: 3478817 - DNA, 12 bp, Homo sapiens
tcacttcttcac

SEQ ID NO: 3478818 - DNA, 18 bp, Homo sapiens
tcacttgaacccgggagg

SEQ ID NO: 3478819 - DNA, 12 bp, Homo sapiens
tcacttgagacc

SEQ ID NO: 3478820 - DNA, 10 bp, Homo sapiens
tcacttgagt

SEQ ID NO: 3478821 - DNA, 20 bp, Homo sapiens
tcagaaatacagattttgat

SEQ ID NO: 3478822 - DNA, 13 bp, Homo sapiens
tcagaaatttaaa

SEQ ID NO: 3478823 - DNA, 18 bp, Homo sapiens
tcagaaatttaaaagcag

SEQ ID NO: 3478824 - DNA, 23 bp, Homo sapiens
tcagaaatttaattcatgtttct

SEQ ID NO: 3478825 - DNA, 18 bp, Homo sapiens
tcagaacccttggcttgc

SEQ ID NO: 3478826 - DNA, 22 bp, Homo sapiens
tcagaactcaaatggggccaga

SEQ ID NO: 3478827 - DNA, 16 bp, Homo sapiens
tcagaacttgctgctg

SEQ ID NO: 3478828 - DNA, 21 bp, Homo sapiens
tcagaagggagctagccagag

SEQ ID NO: 3478829 - DNA, 21 bp, Homo sapiens
tcagaatagccacatttggaa

SEQ ID NO: 3478830 - DNA, 16 bp, Homo sapiens
tcagaatatcatcttt

SEQ ID NO: 3478831 - DNA, 17 bp, Homo sapiens
tcagaatcacttctgag

SEQ ID NO: 3478832 - DNA, 14 bp, Homo sapiens
tcagaatctaccca

SEQ ID NO: 3478833 - DNA, 20 bp, Homo sapiens
tcagaatctacccaaaggat

SEQ ID NO: 3478834 - DNA, 19 bp, Homo sapiens
tcagaattactgagttttt

SEQ ID NO: 3478835 - DNA, 14 bp, Homo sapiens
tcagacaaaatgga

SEQ ID NO: 3478836 - DNA, 22 bp, Homo sapiens
tcagacaaaatggatacataaa

SEQ ID NO: 3478837 - DNA, 20 bp, Homo sapiens
tcagacacttcatggaccaa

SEQ ID NO: 3478838 - DNA, 22 bp, Homo sapiens
tcagacagagaggactgtaggg

SEQ ID NO: 3478839 - DNA, 20 bp, Homo sapiens
tcagacatgttttccgtgaa

SEQ ID NO: 3478840 - DNA, 14 bp, Homo sapiens
tcagaccagctctt

SEQ ID NO: 3478841 - DNA, 21 bp, Homo sapiens
tcagactcccattcctgaaga

SEQ ID NO: 3478842 - DNA, 14 bp, Homo sapiens
tcagacttgtcaag

SEQ ID NO: 3478843 - DNA, 22 bp, Homo sapiens
tcagagatgcaccaccaagcca

SEQ ID NO: 3478844 - DNA, 20 bp, Homo sapiens
tcagagatggacagagaact

SEQ ID NO: 3478845 - DNA, 13 bp, Homo sapiens
tcagagcctgcag

SEQ ID NO: 3478846 - DNA, 14 bp, Homo sapiens
tcagagcctgcagt

SEQ ID NO: 3478847 - DNA, 15 bp, Homo sapiens
tcagagcctgcagtt

SEQ ID NO: 3478848 - DNA, 18 bp, Homo sapiens
tcagagcctgcagttatt

SEQ ID NO: 3478849 - DNA, 20 bp, Homo sapiens
tcagagcctttcctcaaaac

SEQ ID NO: 3478850 - DNA, 14 bp, Homo sapiens
tcagagctgacaca

SEQ ID NO: 3478851 - DNA, 12 bp, Homo sapiens
tcagaggaagac

SEQ ID NO: 3478852 - DNA, 18 bp, Homo sapiens
tcagaggccctcgctgcc

SEQ ID NO: 3478853 - DNA, 13 bp, Homo sapiens
tcagaggctgcag

SEQ ID NO: 3478854 - DNA, 14 bp, Homo sapiens
tcagaggctgcagg

SEQ ID NO: 3478855 - DNA, 13 bp, Homo sapiens
tcccaagctctgc

SEQ ID NO: 3478856 - DNA, 17 bp, Homo sapiens
tcccaagctctgctcct

SEQ ID NO: 3478857 - DNA, 16 bp, Homo sapiens
tcccaagctggctggg

SEQ ID NO: 3478858 - DNA, 21 bp, Homo sapiens
tcccaagggatggtgccctgt

SEQ ID NO: 3478859 - DNA, 20 bp, Homo sapiens
tcccaaggttggagcccagg

SEQ ID NO: 3478860 - DNA, 21 bp, Homo sapiens
tcccaaggttggagcccaggg

SEQ ID NO: 3478861 - DNA, 23 bp, Homo sapiens
tcccaaggttggagcccagggca

SEQ ID NO: 3478862 - DNA, 18 bp, Homo sapiens
tcccaagtaagaggctgg

SEQ ID NO: 3478863 - DNA, 21 bp, Homo sapiens
tcccaagtagctgggattaca

SEQ ID NO: 3478864 - DNA, 17 bp, Homo sapiens
tcccaatcttctttttc

SEQ ID NO: 3478865 - DNA, 22 bp, Homo sapiens
tcccaatcttctttttcaggct

SEQ ID NO: 3478866 - DNA, 14 bp, Homo sapiens
tcccacaaaggaga

SEQ ID NO: 3478867 - DNA, 16 bp, Homo sapiens
tcccacaaaggagagc

SEQ ID NO: 3478868 - DNA, 11 bp, Homo sapiens
tcccacacagg

SEQ ID NO: 3478869 - DNA, 13 bp, Homo sapiens
tcccacaccctgg

SEQ ID NO: 3478870 - DNA, 17 bp, Homo sapiens
tcccacaggacatttct

SEQ ID NO: 3478871 - DNA, 18 bp, Homo sapiens
tcccacaggacatttctc

SEQ ID NO: 3478872 - DNA, 20 bp, Homo sapiens
tcccacccccatctctccct

SEQ ID NO: 3478873 - DNA, 17 bp, Homo sapiens
tcccacctagcagcacc

SEQ ID NO: 3478874 - DNA, 13 bp, Homo sapiens
tcccacctcagcc

SEQ ID NO: 3478875 - DNA, 17 bp, Homo sapiens
tcccaccttggctgcag

SEQ ID NO: 3478876 - DNA, 18 bp, Homo sapiens
tcccaccttggctgcagg

SEQ ID NO: 3478877 - DNA, 21 bp, Homo sapiens
tcccaccttggctgcagggag

SEQ ID NO: 3478878 - DNA, 18 bp, Homo sapiens
tcccactgtatgatttat

SEQ ID NO: 3478879 - DNA, 12 bp, Homo sapiens
tcccactttctt

SEQ ID NO: 3478880 - DNA, 20 bp, Homo sapiens
tcccactttcttctaccaga

SEQ ID NO: 3478881 - DNA, 19 bp, Homo sapiens
tcccagaacacactccatc

SEQ ID NO: 3478882 - DNA, 16 bp, Homo sapiens
tcccagaggctgcccc

SEQ ID NO: 3478883 - DNA, 15 bp, Homo sapiens
tcccagagtgctggg

SEQ ID NO: 3478884 - DNA, 21 bp, Homo sapiens
tcccagattggctcacactga

SEQ ID NO: 3478885 - DNA, 18 bp, Homo sapiens
tcccagcactttgggagg

SEQ ID NO: 3478886 - DNA, 17 bp, Homo sapiens
tcccagctgtgctctgg

SEQ ID NO: 3478887 - DNA, 21 bp, Homo sapiens
tcccaggcccctggaggctgc

SEQ ID NO: 3478888 - DNA, 17 bp, Homo sapiens
tcccagtacctcctgtc

SEQ ID NO: 3478889 - DNA, 23 bp, Homo sapiens
tcccagtacctcctgtctctggc

SEQ ID NO: 3478890 - DNA, 22 bp, Homo sapiens
tcccagtgccgagaaggaagcc

SEQ ID NO: 3478891 - DNA, 19 bp, Homo sapiens
tcccagtggctgctgccca

SEQ ID NO: 3478892 - DNA, 23 bp, Homo sapiens
tcccagtggctgctgcccaggcc

SEQ ID NO: 3478893 - DNA, 18 bp, Homo sapiens
tcccataaccgctgattc

SEQ ID NO: 3478894 - DNA, 15 bp, Homo sapiens
tcccataagctatag

SEQ ID NO: 3478895 - DNA, 16 bp, Homo sapiens
tcccatctcttccttg

SEQ ID NO: 3478896 - DNA, 15 bp, Homo sapiens
tcccatctggtcatt

SEQ ID NO: 3478897 - DNA, 15 bp, Homo sapiens
tcccatgacccaggc

SEQ ID NO: 3478898 - DNA, 14 bp, Homo sapiens
tcccatggggaggg

SEQ ID NO: 3478899 - DNA, 13 bp, Homo sapiens
tcccatgtatgga

SEQ ID NO: 3478900 - DNA, 13 bp, Homo sapiens
tcccattcctgaa

SEQ ID NO: 3478901 - DNA, 16 bp, Homo sapiens
tcccattgtccctctg

SEQ ID NO: 3478902 - DNA, 18 bp, Homo sapiens
tcccattgtccctctgcc

SEQ ID NO: 3478903 - DNA, 15 bp, Homo sapiens
tcccatttgtaattt

SEQ ID NO: 3478904 - DNA, 17 bp, Homo sapiens
tccccaatgagacttgc

SEQ ID NO: 3478905 - DNA, 19 bp, Homo sapiens
tccccaatgagacttgcct

SEQ ID NO: 3478906 - DNA, 20 bp, Homo sapiens
tccccacgagggctggctgg

SEQ ID NO: 3478907 - DNA, 11 bp, Homo sapiens
tccccagagaa

SEQ ID NO: 3478908 - DNA, 22 bp, Homo sapiens
tccccagagaaaggggagccca

SEQ ID NO: 3478909 - DNA, 13 bp, Homo sapiens
tccccagattgca

SEQ ID NO: 3478910 - DNA, 13 bp, Homo sapiens
tccccagcccaga

SEQ ID NO: 3478911 - DNA, 16 bp, Homo sapiens
tccccagcccagagac

SEQ ID NO: 3478912 - DNA, 13 bp, Homo sapiens
tccccagcctgcg

SEQ ID NO: 3478913 - DNA, 17 bp, Homo sapiens
tccccagcctgcgcctg

SEQ ID NO: 3478914 - DNA, 19 bp, Homo sapiens
tccccagctccccaggact

SEQ ID NO: 3478915 - DNA, 20 bp, Homo sapiens
tccccagctccccaggactc

SEQ ID NO: 3478916 - DNA, 17 bp, Homo sapiens
tccccaggactcaccct

SEQ ID NO: 3478917 - DNA, 16 bp, Homo sapiens
tccccaggcacctcac

SEQ ID NO: 3478918 - DNA, 20 bp, Homo sapiens
tccccaggccccaggaagcc

SEQ ID NO: 3478919 - DNA, 21 bp, Homo sapiens
tccccaggccccaggaagccg

SEQ ID NO: 3478920 - DNA, 16 bp, Homo sapiens
tccccaggtccagctc

SEQ ID NO: 3478921 - DNA, 14 bp, Homo sapiens
tccccaggtctctc

SEQ ID NO: 3478922 - DNA, 23 bp, Homo sapiens
tccccagttcgcctggagccctc

SEQ ID NO: 3478923 - DNA, 14 bp, Homo sapiens
tccccattttctgg

SEQ ID NO: 3478924 - DNA, 14 bp, Homo sapiens
tcccccactgccat

SEQ ID NO: 3478925 - DNA, 14 bp, Homo sapiens
tcccccagcagaac

SEQ ID NO: 3478926 - DNA, 12 bp, Homo sapiens
tcccccaggcct

SEQ ID NO: 3478927 - DNA, 13 bp, Homo sapiens
tcccccaggcctg

SEQ ID NO: 3478928 - DNA, 17 bp, Homo sapiens
tcccccaggcctgagct

SEQ ID NO: 3478929 - DNA, 13 bp, Homo sapiens
tcccccatccccc

SEQ ID NO: 3478930 - DNA, 18 bp, Homo sapiens
tcccccatcccccactgc

SEQ ID NO: 3478931 - DNA, 12 bp, Homo sapiens
tccccccatctt

SEQ ID NO: 3478932 - DNA, 22 bp, Homo sapiens
tccccccatcttgcttccctaa

SEQ ID NO: 3478933 - DNA, 17 bp, Homo sapiens
tcccccccatgcactgt

SEQ ID NO: 3478934 - DNA, 19 bp, Homo sapiens
tccccgcagtgtgcactaa

SEQ ID NO: 3478935 - DNA, 22 bp, Homo sapiens
tccccgcagtgtgcactaaggg

SEQ ID NO: 3478936 - DNA, 18 bp, Homo sapiens
tccccgcttctgcctgca

SEQ ID NO: 3478937 - DNA, 20 bp, Homo sapiens
tcccctaagcagaccactga

SEQ ID NO: 3478938 - DNA, 12 bp, Homo sapiens
tcccctcagctc

SEQ ID NO: 3478939 - DNA, 18 bp, Homo sapiens
tcccctccggactggtgc

SEQ ID NO: 3478940 - DNA, 12 bp, Homo sapiens
tcccctcctcca

SEQ ID NO: 3478941 - DNA, 16 bp, Homo sapiens
tcccctcttctgagct

SEQ ID NO: 3478942 - DNA, 17 bp, Homo sapiens
tcccctgccaccaggcc

SEQ ID NO: 3478943 - DNA, 19 bp, Homo sapiens
tcccctgccaccaggccac

SEQ ID NO: 3478944 - DNA, 20 bp, Homo sapiens
tcccctgcccccaggactgg

SEQ ID NO: 3478945 - DNA, 22 bp, Homo sapiens
tcccctgcccccaggactgggc

SEQ ID NO: 3478946 - DNA, 22 bp, Homo sapiens
tcccctgcccctttacggacac

SEQ ID NO: 3478947 - DNA, 18 bp, Homo sapiens
tcccctgcctcctactcc

SEQ ID NO: 3478948 - DNA, 20 bp, Homo sapiens
tcccctgcctcctactccag

SEQ ID NO: 3478949 - DNA, 19 bp, Homo sapiens
tcccctggggacagcaagg

SEQ ID NO: 3478950 - DNA, 19 bp, Homo sapiens
tcccctgtagagtgggagc

SEQ ID NO: 3478951 - DNA, 18 bp, Homo sapiens
tccccttccactgagggc

SEQ ID NO: 3478952 - DNA, 13 bp, Homo sapiens
tccccttctctca

SEQ ID NO: 3478953 - DNA, 16 bp, Homo sapiens
tccccttctctcatct

SEQ ID NO: 3478954 - DNA, 13 bp, Homo sapiens
tcccctttcctgt

SEQ ID NO: 3478955 - DNA, 14 bp, Homo sapiens
tcccctttcctgtc

SEQ ID NO: 3478956 - DNA, 17 bp, Homo sapiens
tcccctttcctgtccca

SEQ ID NO: 3478957 - DNA, 23 bp, Homo sapiens
tcccgaaccccaaggagggagat

SEQ ID NO: 3478958 - DNA, 15 bp, Homo sapiens
tcccgaatagctggg

SEQ ID NO: 3478959 - DNA, 16 bp, Homo sapiens
tcccgaatagctggga

SEQ ID NO: 3478960 - DNA, 18 bp, Homo sapiens
tcccgaatagctgggact

SEQ ID NO: 3478961 - DNA, 20 bp, Homo sapiens
tcccgagtagctgggactac

SEQ ID NO: 3478962 - DNA, 16 bp, Homo sapiens
tcccgccggaggccag

SEQ ID NO: 3478963 - DNA, 17 bp, Homo sapiens
tcccgccggaggccagc

SEQ ID NO: 3478964 - DNA, 18 bp, Homo sapiens
tcccgccggaggccagct

SEQ ID NO: 3478965 - DNA, 15 bp, Homo sapiens
tcccgggacgcagca

SEQ ID NO: 3478966 - DNA, 15 bp, Homo sapiens
tcccgggccagggct

SEQ ID NO: 3478967 - DNA, 17 bp, Homo sapiens
tcccgggccccacagac

SEQ ID NO: 3478968 - DNA, 16 bp, Homo sapiens
tcccggggccagcact

SEQ ID NO: 3478969 - DNA, 21 bp, Homo sapiens
tcccggggccagcacttccat

SEQ ID NO: 3478970 - DNA, 16 bp, Homo sapiens
tccctaacacttaccc

SEQ ID NO: 3478971 - DNA, 22 bp, Homo sapiens
tccctaaggcatgtgtgaaaca

SEQ ID NO: 3478972 - DNA, 16 bp, Homo sapiens
tccctaatctatggtc

SEQ ID NO: 3478973 - DNA, 15 bp, Homo sapiens
tccctacccagtccc

SEQ ID NO: 3478974 - DNA, 16 bp, Homo sapiens
tccctagtaaaaatac

SEQ ID NO: 3478975 - DNA, 15 bp, Homo sapiens
tccctatactgcttg

SEQ ID NO: 3478976 - DNA, 16 bp, Homo sapiens
tccctattagagaaga

SEQ ID NO: 3478977 - DNA, 20 bp, Homo sapiens
tccctatttttctctcctgt

SEQ ID NO: 3478978 - DNA, 15 bp, Homo sapiens
tccctcaccttggca

SEQ ID NO: 3478979 - DNA, 22 bp, Homo sapiens
tccctcaccttggcaccagaca

SEQ ID NO: 3478980 - DNA, 21 bp, Homo sapiens
tccctcatctgtccctccggg

SEQ ID NO: 3478981 - DNA, 15 bp, Homo sapiens
tccctcatttcagga

SEQ ID NO: 3478982 - DNA, 13 bp, Homo sapiens
tccctcccaggac

SEQ ID NO: 3478983 - DNA, 12 bp, Homo sapiens
tccctccccccc

SEQ ID NO: 3478984 - DNA, 19 bp, Homo sapiens
tccctccggcttgacctgt

SEQ ID NO: 3478985 - DNA, 14 bp, Homo sapiens
tccctcctgctact

SEQ ID NO: 3478986 - DNA, 14 bp, Homo sapiens
tccctcctggagct

SEQ ID NO: 3478987 - DNA, 19 bp, Homo sapiens
tccctcctggagctctgtg

SEQ ID NO: 3478988 - DNA, 14 bp, Homo sapiens
tctatggcagtcca

SEQ ID NO: 3478989 - DNA, 18 bp, Homo sapiens
tctatggcagtccagcca

SEQ ID NO: 3478990 - DNA, 12 bp, Homo sapiens
tctatgggactc

SEQ ID NO: 3478991 - DNA, 23 bp, Homo sapiens
tctatgggactcaatgcactgac

SEQ ID NO: 3478992 - DNA, 18 bp, Homo sapiens
tctatgtaggaaaaaaat

SEQ ID NO: 3478993 - DNA, 19 bp, Homo sapiens
tctatgtaggaaaaaaata

SEQ ID NO: 3478994 - DNA, 12 bp, Homo sapiens
tctatgtagtgg

SEQ ID NO: 3478995 - DNA, 15 bp, Homo sapiens
tctatgtagtggttt

SEQ ID NO: 3478996 - DNA, 16 bp, Homo sapiens
tctatgtagtggtttt

SEQ ID NO: 3478997 - DNA, 14 bp, Homo sapiens
tctatgttcaaaga

SEQ ID NO: 3478998 - DNA, 15 bp, Homo sapiens
tctatgttcaaagac

SEQ ID NO: 3478999 - DNA, 17 bp, Homo sapiens
tctattgactttcttaa

SEQ ID NO: 3479000 - DNA, 20 bp, Homo sapiens
tctattgactttcttaaaaa

SEQ ID NO: 3479001 - DNA, 15 bp, Homo sapiens
tctatttaagtaaaa

SEQ ID NO: 3479002 - DNA, 22 bp, Homo sapiens
tctatttatttactgagcttct

SEQ ID NO: 3479003 - DNA, 18 bp, Homo sapiens
tctattttggattgtata

SEQ ID NO: 3479004 - DNA, 21 bp, Homo sapiens
tctattttttacttgttttcg

SEQ ID NO: 3479005 - DNA, 14 bp, Homo sapiens
tctcaaaagaactt

SEQ ID NO: 3479006 - DNA, 18 bp, Homo sapiens
tctcaaaagaacttaccc

SEQ ID NO: 3479007 - DNA, 15 bp, Homo sapiens
tctcaaagctgggat

SEQ ID NO: 3479008 - DNA, 20 bp, Homo sapiens
tctcaaccttggccttctcc

SEQ ID NO: 3479009 - DNA, 21 bp, Homo sapiens
tctcaagatgggggcagggct

SEQ ID NO: 3479010 - DNA, 19 bp, Homo sapiens
tctcaatcctgcagtgggg

SEQ ID NO: 3479011 - DNA, 22 bp, Homo sapiens
tctcacatggtgctacgcctgc

SEQ ID NO: 3479012 - DNA, 23 bp, Homo sapiens
tctcacatggtgctacgcctgca

SEQ ID NO: 3479013 - DNA, 17 bp, Homo sapiens
tctcaccagctgcaaag

SEQ ID NO: 3479014 - DNA, 19 bp, Homo sapiens
tctcaccagctgcaaagtg

SEQ ID NO: 3479015 - DNA, 20 bp, Homo sapiens
tctcaccagctgcaaagtgt

SEQ ID NO: 3479016 - DNA, 16 bp, Homo sapiens
tctcactatgttgccc

SEQ ID NO: 3479017 - DNA, 17 bp, Homo sapiens
tctcactatgttgccca

SEQ ID NO: 3479018 - DNA, 21 bp, Homo sapiens
tctcactatgttgcccaggca

SEQ ID NO: 3479019 - DNA, 23 bp, Homo sapiens
tctcactatgttgcccaggcagg

SEQ ID NO: 3479020 - DNA, 18 bp, Homo sapiens
tctcactctgtcgcccag

SEQ ID NO: 3479021 - DNA, 23 bp, Homo sapiens
tctcactctgtcgcccagtctgg

SEQ ID NO: 3479022 - DNA, 20 bp, Homo sapiens
tctcactgtgggaaggccag

SEQ ID NO: 3479023 - DNA, 20 bp, Homo sapiens
tctcactgtgttactgcttt

SEQ ID NO: 3479024 - DNA, 18 bp, Homo sapiens
tctcactgttgcccaggc

SEQ ID NO: 3479025 - DNA, 21 bp, Homo sapiens
tctcactgttgcccaggctgg

SEQ ID NO: 3479026 - DNA, 17 bp, Homo sapiens
tctcagaatccaaagat

SEQ ID NO: 3479027 - DNA, 12 bp, Homo sapiens
tctcagaatcta

SEQ ID NO: 3479028 - DNA, 21 bp, Homo sapiens
tctcagactttggaaaatgca

SEQ ID NO: 3479029 - DNA, 22 bp, Homo sapiens
tctcagactttggaaaatgcat

SEQ ID NO: 3479030 - DNA, 23 bp, Homo sapiens
tctcaggaccaaagctttcatgt

SEQ ID NO: 3479031 - DNA, 13 bp, Homo sapiens
tctcaggcaccag

SEQ ID NO: 3479032 - DNA, 12 bp, Homo sapiens
tctcagggcctg

SEQ ID NO: 3479033 - DNA, 19 bp, Homo sapiens
tctcagggcctggtcgttt

SEQ ID NO: 3479034 - DNA, 18 bp, Homo sapiens
tctcagggtccagaccct

SEQ ID NO: 3479035 - DNA, 18 bp, Homo sapiens
tctcagggtctctgctgc

SEQ ID NO: 3479036 - DNA, 20 bp, Homo sapiens
tctcagggtctctgctgccg

SEQ ID NO: 3479037 - DNA, 13 bp, Homo sapiens
tctcagtctctga

SEQ ID NO: 3479038 - DNA, 15 bp, Homo sapiens
tctcagtgttttgga

SEQ ID NO: 3479039 - DNA, 19 bp, Homo sapiens
tctcagtgttttggactcc

SEQ ID NO: 3479040 - DNA, 20 bp, Homo sapiens
tctcataggttgagcaattt

SEQ ID NO: 3479041 - DNA, 15 bp, Homo sapiens
tctcatcctgcaggc

SEQ ID NO: 3479042 - DNA, 17 bp, Homo sapiens
tctcatctgtgattccc

SEQ ID NO: 3479043 - DNA, 21 bp, Homo sapiens
tctcatgcccctggctgggac

SEQ ID NO: 3479044 - DNA, 19 bp, Homo sapiens
tctcatggaaactggccag

SEQ ID NO: 3479045 - DNA, 16 bp, Homo sapiens
tctcatgggaagggga

SEQ ID NO: 3479046 - DNA, 17 bp, Homo sapiens
tctcatgggaaggggag

SEQ ID NO: 3479047 - DNA, 18 bp, Homo sapiens
tctcatgttttcaactgc

SEQ ID NO: 3479048 - DNA, 18 bp, Homo sapiens
tctcattccgttgtctgt

SEQ ID NO: 3479049 - DNA, 18 bp, Homo sapiens
tctcattcctgttctttc

SEQ ID NO: 3479050 - DNA, 20 bp, Homo sapiens
tctcattggacccttccatg

SEQ ID NO: 3479051 - DNA, 17 bp, Homo sapiens
tctcatttcacccctcc

SEQ ID NO: 3479052 - DNA, 16 bp, Homo sapiens
tctcatttgtcacaca

SEQ ID NO: 3479053 - DNA, 19 bp, Homo sapiens
tctccaaccccccagcact

SEQ ID NO: 3479054 - DNA, 20 bp, Homo sapiens
tctccaaccccccagcactg

SEQ ID NO: 3479055 - DNA, 21 bp, Homo sapiens
tctccaaccccccagcactga

SEQ ID NO: 3479056 - DNA, 23 bp, Homo sapiens
tctccaaccccccagcactgagg

SEQ ID NO: 3479057 - DNA, 14 bp, Homo sapiens
tctccaccctgctc

SEQ ID NO: 3479058 - DNA, 16 bp, Homo sapiens
tctccactgctctcag

SEQ ID NO: 3479059 - DNA, 19 bp, Homo sapiens
tctccagatgtttccagac

SEQ ID NO: 3479060 - DNA, 22 bp, Homo sapiens
tctccagccccttctcagaatc

SEQ ID NO: 3479061 - DNA, 13 bp, Homo sapiens
tctccagcttccc

SEQ ID NO: 3479062 - DNA, 21 bp, Homo sapiens
tctccagggtcagaaacagga

SEQ ID NO: 3479063 - DNA, 14 bp, Homo sapiens
tctccatggccctg

SEQ ID NO: 3479064 - DNA, 17 bp, Homo sapiens
tctccatggccctgcca

SEQ ID NO: 3479065 - DNA, 17 bp, Homo sapiens
tctccattttagcccag

SEQ ID NO: 3479066 - DNA, 14 bp, Homo sapiens
tctcccacctagca

SEQ ID NO: 3479067 - DNA, 23 bp, Homo sapiens
tctcccagataatgtgaaaatgg

SEQ ID NO: 3479068 - DNA, 18 bp, Homo sapiens
tctcccattgtccctctg

SEQ ID NO: 3479069 - DNA, 20 bp, Homo sapiens
tctccccacgagggctggct

SEQ ID NO: 3479070 - DNA, 23 bp, Homo sapiens
tctccccagcaagtgagagctgg

SEQ ID NO: 3479071 - DNA, 15 bp, Homo sapiens
tctccccaggtccag

SEQ ID NO: 3479072 - DNA, 20 bp, Homo sapiens
tctccccaggtccagctctg

SEQ ID NO: 3479073 - DNA, 15 bp, Homo sapiens
tctcccccaccccct

SEQ ID NO: 3479074 - DNA, 20 bp, Homo sapiens
tctcccccatcccccactgc

SEQ ID NO: 3479075 - DNA, 13 bp, Homo sapiens
tctcccctcagag

SEQ ID NO: 3479076 - DNA, 13 bp, Homo sapiens
tctcccctcagct

SEQ ID NO: 3479077 - DNA, 14 bp, Homo sapiens
tctcccctcttctg

SEQ ID NO: 3479078 - DNA, 17 bp, Homo sapiens
tctcccctcttctgagc

SEQ ID NO: 3479079 - DNA, 19 bp, Homo sapiens
tctcccctcttctgagcta

SEQ ID NO: 3479080 - DNA, 20 bp, Homo sapiens
tctcccctgcccccaggact

SEQ ID NO: 3479081 - DNA, 18 bp, Homo sapiens
tctccctctaggctctgc

SEQ ID NO: 3479082 - DNA, 23 bp, Homo sapiens
tctccgaccagacaccttgacag

SEQ ID NO: 3479083 - DNA, 16 bp, Homo sapiens
tctccggctcccagcc

SEQ ID NO: 3479084 - DNA, 17 bp, Homo sapiens
tctccggctcccagcct

SEQ ID NO: 3479085 - DNA, 21 bp, Homo sapiens
tctccggctcccagcctcagc

SEQ ID NO: 3479086 - DNA, 22 bp, Homo sapiens
tctccggctcccagcctcagcg

SEQ ID NO: 3479087 - DNA, 19 bp, Homo sapiens
tctccgttagctcctgtgg

SEQ ID NO: 3479088 - DNA, 20 bp, Homo sapiens
tctccgttagctcctgtggc

SEQ ID NO: 3479089 - DNA, 21 bp, Homo sapiens
tctccgttagctcctgtggcc

SEQ ID NO: 3479090 - DNA, 15 bp, Homo sapiens
tctcctatgtgtaag

SEQ ID NO: 3479091 - DNA, 19 bp, Homo sapiens
tctcctatgtgtaaggtga

SEQ ID NO: 3479092 - DNA, 18 bp, Homo sapiens
tctcctcatctctaacag

SEQ ID NO: 3479093 - DNA, 16 bp, Homo sapiens
tctcctccatgggaga

SEQ ID NO: 3479094 - DNA, 20 bp, Homo sapiens
tctcctccatgggagaaaat

SEQ ID NO: 3479095 - DNA, 13 bp, Homo sapiens
tctcctccgtggc

SEQ ID NO: 3479096 - DNA, 16 bp, Homo sapiens
tctcctcgcaagctgg

SEQ ID NO: 3479097 - DNA, 14 bp, Homo sapiens
tctcctctccattt

SEQ ID NO: 3479098 - DNA, 14 bp, Homo sapiens
tctcctgactttta

SEQ ID NO: 3479099 - DNA, 16 bp, Homo sapiens
tctcctgccttcctcc

SEQ ID NO: 3479100 - DNA, 13 bp, Homo sapiens
tctcctgcctttg

SEQ ID NO: 3479101 - DNA, 16 bp, Homo sapiens
tctcctgcctttgcct

SEQ ID NO: 3479102 - DNA, 20 bp, Homo sapiens
tctccttcagccctcacccc

SEQ ID NO: 3479103 - DNA, 16 bp, Homo sapiens
tctccttcctgtgtgt

SEQ ID NO: 3479104 - DNA, 12 bp, Homo sapiens
tctccttggagg

SEQ ID NO: 3479105 - DNA, 13 bp, Homo sapiens
tctccttggagga

SEQ ID NO: 3479106 - DNA, 12 bp, Homo sapiens
tctcgagcttgg

SEQ ID NO: 3479107 - DNA, 14 bp, Homo sapiens
tctcggctcagtgc

SEQ ID NO: 3479108 - DNA, 13 bp, Homo sapiens
tctcggggcttgc

SEQ ID NO: 3479109 - DNA, 18 bp, Homo sapiens
tctctaactcagaaacat

SEQ ID NO: 3479110 - DNA, 20 bp, Homo sapiens
tctctaactcagaaacatca

SEQ ID NO: 3479111 - DNA, 15 bp, Homo sapiens
tctctaataagaaaa

SEQ ID NO: 3479112 - DNA, 15 bp, Homo sapiens
tctctacaaaaagca

SEQ ID NO: 3479113 - DNA, 15 bp, Homo sapiens
tctctacccatctcc

SEQ ID NO: 3479114 - DNA, 15 bp, Homo sapiens
tctctaggctgggga

SEQ ID NO: 3479115 - DNA, 14 bp, Homo sapiens
tctctatcatttaa

SEQ ID NO: 3479116 - DNA, 16 bp, Homo sapiens
tctctatcatttaata

SEQ ID NO: 3479117 - DNA, 21 bp, Homo sapiens
tctctcaaccttggccttctc

SEQ ID NO: 3479118 - DNA, 22 bp, Homo sapiens
tctctcaaccttggccttctcc

SEQ ID NO: 3479119 - DNA, 22 bp, Homo sapiens
tctctcactgtgttactgcttt

SEQ ID NO: 3479120 - DNA, 13 bp, Homo sapiens
tgacctccctcta

SEQ ID NO: 3479121 - DNA, 22 bp, Homo sapiens
tgacctccctctaatttatctt

SEQ ID NO: 3479122 - DNA, 15 bp, Homo sapiens
tgacctgaggaagcg

SEQ ID NO: 3479123 - DNA, 12 bp, Homo sapiens
tgacctgaggct

SEQ ID NO: 3479124 - DNA, 15 bp, Homo sapiens
tgacctgaggctgtg

SEQ ID NO: 3479125 - DNA, 17 bp, Homo sapiens
tgacctgcattgtaaat

SEQ ID NO: 3479126 - DNA, 20 bp, Homo sapiens
tgacctgtgagcccagctgg

SEQ ID NO: 3479127 - DNA, 15 bp, Homo sapiens
tgacctgtttctctg

SEQ ID NO: 3479128 - DNA, 20 bp, Homo sapiens
tgaccttcagagccagccgg

SEQ ID NO: 3479129 - DNA, 12 bp, Homo sapiens
tgaccttcagct

SEQ ID NO: 3479130 - DNA, 19 bp, Homo sapiens
tgaccttcagctcacgctt

SEQ ID NO: 3479131 - DNA, 13 bp, Homo sapiens
tgaccttcatttc

SEQ ID NO: 3479132 - DNA, 14 bp, Homo sapiens
tgacctttgtacag

SEQ ID NO: 3479133 - DNA, 21 bp, Homo sapiens
tgacctttgtacagcccagag

SEQ ID NO: 3479134 - DNA, 23 bp, Homo sapiens
tgacgtcagtagtttgagaccag

SEQ ID NO: 3479135 - DNA, 17 bp, Homo sapiens
tgacgtgaccggacttt

SEQ ID NO: 3479136 - DNA, 14 bp, Homo sapiens
tgactaatggcatg

SEQ ID NO: 3479137 - DNA, 15 bp, Homo sapiens
tgactaatggcatga

SEQ ID NO: 3479138 - DNA, 17 bp, Homo sapiens
tgactacagtcaggaaa

SEQ ID NO: 3479139 - DNA, 23 bp, Homo sapiens
tgactagatgatggatgccaata

SEQ ID NO: 3479140 - DNA, 13 bp, Homo sapiens
tgactagggagcc

SEQ ID NO: 3479141 - DNA, 17 bp, Homo sapiens
tgactagggagccatgt

SEQ ID NO: 3479142 - DNA, 24 bp, Homo sapiens
tgactatgcagaggcctgggggac

SEQ ID NO: 3479143 - DNA, 22 bp, Homo sapiens
tgactatgtctagagcctcttg

SEQ ID NO: 3479144 - DNA, 17 bp, Homo sapiens
tgactcagggctcctgg

SEQ ID NO: 3479145 - DNA, 19 bp, Homo sapiens
tgactcagggctcctgggt

SEQ ID NO: 3479146 - DNA, 15 bp, Homo sapiens
tgactcatcatttgt

SEQ ID NO: 3479147 - DNA, 16 bp, Homo sapiens
tgactccactcaaaga

SEQ ID NO: 3479148 - DNA, 20 bp, Homo sapiens
tgactccactcaaagagggt

SEQ ID NO: 3479149 - DNA, 22 bp, Homo sapiens
tgactcgggccttagaactttg

SEQ ID NO: 3479150 - DNA, 17 bp, Homo sapiens
tgactcgggggtgggga

SEQ ID NO: 3479151 - DNA, 18 bp, Homo sapiens
tgactcgggggtggggaa

SEQ ID NO: 3479152 - DNA, 18 bp, Homo sapiens
tgactcggtttctccaaa

SEQ ID NO: 3479153 - DNA, 11 bp, Homo sapiens
tgactctgggt

SEQ ID NO: 3479154 - DNA, 16 bp, Homo sapiens
tgactcttctctcaac

SEQ ID NO: 3479155 - DNA, 21 bp, Homo sapiens
tgactgggtttctctgtatag

SEQ ID NO: 3479156 - DNA, 21 bp, Homo sapiens
tgactgttttctcttgagagg

SEQ ID NO: 3479157 - DNA, 16 bp, Homo sapiens
tgacttaatgtgatta

SEQ ID NO: 3479158 - DNA, 17 bp, Homo sapiens
tgacttacctgttcagt

SEQ ID NO: 3479159 - DNA, 18 bp, Homo sapiens
tgacttacctgttcagta

SEQ ID NO: 3479160 - DNA, 16 bp, Homo sapiens
tgacttcccctgcctc

SEQ ID NO: 3479161 - DNA, 13 bp, Homo sapiens
tgacttctgcctg

SEQ ID NO: 3479162 - DNA, 15 bp, Homo sapiens
tgacttctgcctgga

SEQ ID NO: 3479163 - DNA, 16 bp, Homo sapiens
tgactttaatttatgt

SEQ ID NO: 3479164 - DNA, 17 bp, Homo sapiens
tgactttaatttatgta

SEQ ID NO: 3479165 - DNA, 20 bp, Homo sapiens
tgagaaacaacaatttctac

SEQ ID NO: 3479166 - DNA, 17 bp, Homo sapiens
tgagaaacccaccagcc

SEQ ID NO: 3479167 - DNA, 14 bp, Homo sapiens
tgagaaagagcact

SEQ ID NO: 3479168 - DNA, 13 bp, Homo sapiens
tgagaaagccctg

SEQ ID NO: 3479169 - DNA, 17 bp, Homo sapiens
tgagaaatatggacact

SEQ ID NO: 3479170 - DNA, 12 bp, Homo sapiens
tgagaacctggg

SEQ ID NO: 3479171 - DNA, 21 bp, Homo sapiens
tgagaacgtaaagaacttttt

SEQ ID NO: 3479172 - DNA, 20 bp, Homo sapiens
tgagaagcagaggaaggaga

SEQ ID NO: 3479173 - DNA, 14 bp, Homo sapiens
tgagaaggtgcctg

SEQ ID NO: 3479174 - DNA, 16 bp, Homo sapiens
tgagaaggtgcctgcc

SEQ ID NO: 3479175 - DNA, 17 bp, Homo sapiens
tgagaaggtgcctgcca

SEQ ID NO: 3479176 - DNA, 18 bp, Homo sapiens
tgagaagtgaatgctggg

SEQ ID NO: 3479177 - DNA, 21 bp, Homo sapiens
tgagaagtgaatgctgggact

SEQ ID NO: 3479178 - DNA, 23 bp, Homo sapiens
tgagaatacaagatattatgtat

SEQ ID NO: 3479179 - DNA, 13 bp, Homo sapiens
tgagaatcccaaa

SEQ ID NO: 3479180 - DNA, 20 bp, Homo sapiens
tgagaatcccaaatttgatt

SEQ ID NO: 3479181 - DNA, 12 bp, Homo sapiens
tgagaatctacc

SEQ ID NO: 3479182 - DNA, 21 bp, Homo sapiens
tgagaatctttattgagaaag

SEQ ID NO: 3479183 - DNA, 15 bp, Homo sapiens
tgagaatgtaagaac

SEQ ID NO: 3479184 - DNA, 19 bp, Homo sapiens
tgagaattgggcggctctg

SEQ ID NO: 3479185 - DNA, 20 bp, Homo sapiens
tgagaatttgagtgctctga

SEQ ID NO: 3479186 - DNA, 21 bp, Homo sapiens
tgagacacggagcccagccct

SEQ ID NO: 3479187 - DNA, 22 bp, Homo sapiens
tgagacacggagcccagccctc

SEQ ID NO: 3479188 - DNA, 14 bp, Homo sapiens
tgagacagagcctc

SEQ ID NO: 3479189 - DNA, 11 bp, Homo sapiens
tgagacagagt

SEQ ID NO: 3479190 - DNA, 21 bp, Homo sapiens
tgagacagagttttcactctt

SEQ ID NO: 3479191 - DNA, 18 bp, Homo sapiens
tgagacagtccagcctgg

SEQ ID NO: 3479192 - DNA, 18 bp, Homo sapiens
tgagacccagccctcatc

SEQ ID NO: 3479193 - DNA, 12 bp, Homo sapiens
tgagactcgaga

SEQ ID NO: 3479194 - DNA, 16 bp, Homo sapiens
tgagactcgagaactt

SEQ ID NO: 3479195 - DNA, 12 bp, Homo sapiens
tgagactctgtc

SEQ ID NO: 3479196 - DNA, 18 bp, Homo sapiens
tgagactgggtctcgctt

SEQ ID NO: 3479197 - DNA, 13 bp, Homo sapiens
tgagacttgcctt

SEQ ID NO: 3479198 - DNA, 22 bp, Homo sapiens
tgagagaaatatggaacttaca

SEQ ID NO: 3479199 - DNA, 24 bp, Homo sapiens
tgagagaccaggcaaagcaagtga

SEQ ID NO: 3479200 - DNA, 15 bp, Homo sapiens
tgagagcgacacaga

SEQ ID NO: 3479201 - DNA, 16 bp, Homo sapiens
tgagagcgacacagac

SEQ ID NO: 3479202 - DNA, 23 bp, Homo sapiens
tgagaggacttttctttgtggct

SEQ ID NO: 3479203 - DNA, 18 bp, Homo sapiens
tgagaggggaacagactg

SEQ ID NO: 3479204 - DNA, 22 bp, Homo sapiens
tgagagtcagctctctgccctg

SEQ ID NO: 3479205 - DNA, 22 bp, Homo sapiens
tgagagtgtcttcacggcagga

SEQ ID NO: 3479206 - DNA, 19 bp, Homo sapiens
tgagagttttggatgcagt

SEQ ID NO: 3479207 - DNA, 14 bp, Homo sapiens
tgagatacatacag

SEQ ID NO: 3479208 - DNA, 21 bp, Homo sapiens
tgagataccagcgaggaggct

SEQ ID NO: 3479209 - DNA, 14 bp, Homo sapiens
tgagatcagcctgg

SEQ ID NO: 3479210 - DNA, 17 bp, Homo sapiens
tgagatgctggcttggg

SEQ ID NO: 3479211 - DNA, 17 bp, Homo sapiens
tgagatgctggttttct

SEQ ID NO: 3479212 - DNA, 16 bp, Homo sapiens
tgagattgtcctcatt

SEQ ID NO: 3479213 - DNA, 13 bp, Homo sapiens
tgagatttcatct

SEQ ID NO: 3479214 - DNA, 18 bp, Homo sapiens
tgagatttcatctgctct

SEQ ID NO: 3479215 - DNA, 21 bp, Homo sapiens
tgagcaagtaacattaactca

SEQ ID NO: 3479216 - DNA, 22 bp, Homo sapiens
tgagcacaactttaagaggaca

SEQ ID NO: 3479217 - DNA, 16 bp, Homo sapiens
tgagcaccaggggatg

SEQ ID NO: 3479218 - DNA, 22 bp, Homo sapiens
tgagcaccgtgtcaagctgctc

SEQ ID NO: 3479219 - DNA, 22 bp, Homo sapiens
tgagcactaaggtgtgctctga

SEQ ID NO: 3479220 - DNA, 18 bp, Homo sapiens
tgagcagagcccggagct

SEQ ID NO: 3479221 - DNA, 21 bp, Homo sapiens
tgagcagagcccggagctccg

SEQ ID NO: 3479222 - DNA, 16 bp, Homo sapiens
tgagcagggctcagcg

SEQ ID NO: 3479223 - DNA, 15 bp, Homo sapiens
tgagcatcacagaat

SEQ ID NO: 3479224 - DNA, 18 bp, Homo sapiens
tgagcatcacagaatgtg

SEQ ID NO: 3479225 - DNA, 23 bp, Homo sapiens
tgagcatttttttaaaagaagct

SEQ ID NO: 3479226 - DNA, 23 bp, Homo sapiens
tgagccaatctgcaatttctact

SEQ ID NO: 3479227 - DNA, 13 bp, Homo sapiens
tgagccacctgcc

SEQ ID NO: 3479228 - DNA, 19 bp, Homo sapiens
tgagccacctgcccttttt

SEQ ID NO: 3479229 - DNA, 23 bp, Homo sapiens
tgagccactgcaccgggccacag

SEQ ID NO: 3479230 - DNA, 21 bp, Homo sapiens
tgagcccagctgggtcaggca

SEQ ID NO: 3479231 - DNA, 16 bp, Homo sapiens
tgagccccatcttcac

SEQ ID NO: 3479232 - DNA, 17 bp, Homo sapiens
tgagcccctgtctagag

SEQ ID NO: 3479233 - DNA, 12 bp, Homo sapiens
tgagccctcaga

SEQ ID NO: 3479234 - DNA, 14 bp, Homo sapiens
tgagccctcagaac

SEQ ID NO: 3479235 - DNA, 21 bp, Homo sapiens
tgagccgagatcacgccactg

SEQ ID NO: 3479236 - DNA, 23 bp, Homo sapiens
tgagccgagatcacgccactgca

SEQ ID NO: 3479237 - DNA, 16 bp, Homo sapiens
tgagcctctgctcccc

SEQ ID NO: 3479238 - DNA, 11 bp, Homo sapiens
tgagcctggcc

SEQ ID NO: 3479239 - DNA, 12 bp, Homo sapiens
tgagcctggcca

SEQ ID NO: 3479240 - DNA, 14 bp, Homo sapiens
tgagcctgggaggt

SEQ ID NO: 3479241 - DNA, 12 bp, Homo sapiens
tgagcgccagga

SEQ ID NO: 3479242 - DNA, 20 bp, Homo sapiens
tgagcggtgctgtcctcagg

SEQ ID NO: 3479243 - DNA, 13 bp, Homo sapiens
tgagctacaaatg

SEQ ID NO: 3479244 - DNA, 16 bp, Homo sapiens
tgagctacaaatgcat

SEQ ID NO: 3479245 - DNA, 15 bp, Homo sapiens
tgagctaggagaagg

SEQ ID NO: 3479246 - DNA, 18 bp, Homo sapiens
tgagctaggagaagggct

SEQ ID NO: 3479247 - DNA, 16 bp, Homo sapiens
tgagctattgctgttc

SEQ ID NO: 3479248 - DNA, 11 bp, Homo sapiens
tgagctcagga

SEQ ID NO: 3479249 - DNA, 19 bp, Homo sapiens
tgagctcaggagtttgaga

SEQ ID NO: 3479250 - DNA, 16 bp, Homo sapiens
tgagctctcggaactg

SEQ ID NO: 3479251 - DNA, 21 bp, Homo sapiens
tgagctctcggaactgcatgc

SEQ ID NO: 3479252 - DNA, 19 bp, Homo sapiens
tgcccacaggatcagtctg

SEQ ID NO: 3479253 - DNA, 11 bp, Homo sapiens
tgcccacctgt

SEQ ID NO: 3479254 - DNA, 18 bp, Homo sapiens
tgcccacgctggagtgca

SEQ ID NO: 3479255 - DNA, 19 bp, Homo sapiens
tgcccacggagtcgtgggg

SEQ ID NO: 3479256 - DNA, 14 bp, Homo sapiens
tgcccaggcaggtc

SEQ ID NO: 3479257 - DNA, 17 bp, Homo sapiens
tgcccaggcaggtcttg

SEQ ID NO: 3479258 - DNA, 12 bp, Homo sapiens
tgcccaggcccc

SEQ ID NO: 3479259 - DNA, 22 bp, Homo sapiens
tgcccaggcccctgccaccctg

SEQ ID NO: 3479260 - DNA, 11 bp, Homo sapiens
tgcccaggctg

SEQ ID NO: 3479261 - DNA, 23 bp, Homo sapiens
tgcccaggctggcgtgcagtggt

SEQ ID NO: 3479262 - DNA, 17 bp, Homo sapiens
tgcccagtcgaccccaa

SEQ ID NO: 3479263 - DNA, 17 bp, Homo sapiens
tgcccagtctttcatgt

SEQ ID NO: 3479264 - DNA, 21 bp, Homo sapiens
tgcccatttcatattctttca

SEQ ID NO: 3479265 - DNA, 14 bp, Homo sapiens
tgccccaaacaaat

SEQ ID NO: 3479266 - DNA, 19 bp, Homo sapiens
tgccccactctgcctgcct

SEQ ID NO: 3479267 - DNA, 13 bp, Homo sapiens
tgccccagccaga

SEQ ID NO: 3479268 - DNA, 13 bp, Homo sapiens
tgccccagcccag

SEQ ID NO: 3479269 - DNA, 13 bp, Homo sapiens
tgccccaggacca

SEQ ID NO: 3479270 - DNA, 20 bp, Homo sapiens
tgccccaggaccagctcagg

SEQ ID NO: 3479271 - DNA, 14 bp, Homo sapiens
tgccccagggatgg

SEQ ID NO: 3479272 - DNA, 16 bp, Homo sapiens
tgccccatcagtgctc

SEQ ID NO: 3479273 - DNA, 19 bp, Homo sapiens
tgccccatcctccagcagg

SEQ ID NO: 3479274 - DNA, 21 bp, Homo sapiens
tgccccatcctccagcaggga

SEQ ID NO: 3479275 - DNA, 18 bp, Homo sapiens
tgccccattcttttgtaa

SEQ ID NO: 3479276 - DNA, 17 bp, Homo sapiens
tgcccccactgaccaga

SEQ ID NO: 3479277 - DNA, 14 bp, Homo sapiens
tgcccccaggactg

SEQ ID NO: 3479278 - DNA, 16 bp, Homo sapiens
tgcccccaggactggg

SEQ ID NO: 3479279 - DNA, 17 bp, Homo sapiens
tgcccccaggactgggc

SEQ ID NO: 3479280 - DNA, 23 bp, Homo sapiens
tgccccgcttccccacagaactg

SEQ ID NO: 3479281 - DNA, 18 bp, Homo sapiens
tgccccgggtccccagct

SEQ ID NO: 3479282 - DNA, 23 bp, Homo sapiens
tgccccgggtccccagctcccca

SEQ ID NO: 3479283 - DNA, 14 bp, Homo sapiens
tgccccgtctctgt

SEQ ID NO: 3479284 - DNA, 17 bp, Homo sapiens
tgcccctaatctctgta

SEQ ID NO: 3479285 - DNA, 20 bp, Homo sapiens
tgcccctaatctctgtagga

SEQ ID NO: 3479286 - DNA, 21 bp, Homo sapiens
tgcccctaatctctgtaggaa

SEQ ID NO: 3479287 - DNA, 12 bp, Homo sapiens
tgcccctctctg

SEQ ID NO: 3479288 - DNA, 22 bp, Homo sapiens
tgccccttcattgatttcctgt

SEQ ID NO: 3479289 - DNA, 13 bp, Homo sapiens
tgccccttgccat

SEQ ID NO: 3479290 - DNA, 18 bp, Homo sapiens
tgcccctttctcttttcc

SEQ ID NO: 3479291 - DNA, 15 bp, Homo sapiens
tgcccgctcagccca

SEQ ID NO: 3479292 - DNA, 22 bp, Homo sapiens
tgcccggcacagatgctccagg

SEQ ID NO: 3479293 - DNA, 15 bp, Homo sapiens
tgccctatgggcctg

SEQ ID NO: 3479294 - DNA, 12 bp, Homo sapiens
tgccctcctctc

SEQ ID NO: 3479295 - DNA, 22 bp, Homo sapiens
tgccctccttcccaatcttctt

SEQ ID NO: 3479296 - DNA, 11 bp, Homo sapiens
tgccctgcccc

SEQ ID NO: 3479297 - DNA, 22 bp, Homo sapiens
tgccctggcagggtcatcctgt

SEQ ID NO: 3479298 - DNA, 23 bp, Homo sapiens
tgccctggcagggtcatcctgtg

SEQ ID NO: 3479299 - DNA, 12 bp, Homo sapiens
tgccctgtgcaa

SEQ ID NO: 3479300 - DNA, 17 bp, Homo sapiens
tgccctgttctctacca

SEQ ID NO: 3479301 - DNA, 19 bp, Homo sapiens
tgcccttggaggccagcca

SEQ ID NO: 3479302 - DNA, 18 bp, Homo sapiens
tgcccttggcacccaaga

SEQ ID NO: 3479303 - DNA, 20 bp, Homo sapiens
tgcccttttttctgcctcct

SEQ ID NO: 3479304 - DNA, 20 bp, Homo sapiens
tgccgagacagaccctctgc

SEQ ID NO: 3479305 - DNA, 21 bp, Homo sapiens
tgccgatatactctagatgaa

SEQ ID NO: 3479306 - DNA, 15 bp, Homo sapiens
tgccgcagagctggc

SEQ ID NO: 3479307 - DNA, 14 bp, Homo sapiens
tgccgccccaccca

SEQ ID NO: 3479308 - DNA, 15 bp, Homo sapiens
tgccgctacctccct

SEQ ID NO: 3479309 - DNA, 16 bp, Homo sapiens
tgccgctacctccctc

SEQ ID NO: 3479310 - DNA, 18 bp, Homo sapiens
tgccgctacctccctccc

SEQ ID NO: 3479311 - DNA, 15 bp, Homo sapiens
tgccggagaggaaga

SEQ ID NO: 3479312 - DNA, 18 bp, Homo sapiens
tgccggatacaaactggt

SEQ ID NO: 3479313 - DNA, 23 bp, Homo sapiens
tgccgggctgagggcctgctgga

SEQ ID NO: 3479314 - DNA, 15 bp, Homo sapiens
tgcctaaatccaaag

SEQ ID NO: 3479315 - DNA, 17 bp, Homo sapiens
tgcctaaatccaaagaa

SEQ ID NO: 3479316 - DNA, 18 bp, Homo sapiens
tgcctacatcccgggcct

SEQ ID NO: 3479317 - DNA, 20 bp, Homo sapiens
tgcctacatcccgggcctca

SEQ ID NO: 3479318 - DNA, 22 bp, Homo sapiens
tgcctacatcccgggcctcagt

SEQ ID NO: 3479319 - DNA, 19 bp, Homo sapiens
tgcctacttttggcctcat

SEQ ID NO: 3479320 - DNA, 20 bp, Homo sapiens
tgcctacttttggcctcatc

SEQ ID NO: 3479321 - DNA, 15 bp, Homo sapiens
tgcctatcctgctgt

SEQ ID NO: 3479322 - DNA, 23 bp, Homo sapiens
tgcctcaccttggggccttgatg

SEQ ID NO: 3479323 - DNA, 15 bp, Homo sapiens
tgcctcactaatttt

SEQ ID NO: 3479324 - DNA, 22 bp, Homo sapiens
tgcctcactaatttttgtatta

SEQ ID NO: 3479325 - DNA, 16 bp, Homo sapiens
tgcctcagccctgacc

SEQ ID NO: 3479326 - DNA, 19 bp, Homo sapiens
tgcctcagccctgaccctg

SEQ ID NO: 3479327 - DNA, 12 bp, Homo sapiens
tgcctcagcctc

SEQ ID NO: 3479328 - DNA, 19 bp, Homo sapiens
tgcctcagtgtatttgtat

SEQ ID NO: 3479329 - DNA, 14 bp, Homo sapiens
tgcctccaggaacc

SEQ ID NO: 3479330 - DNA, 14 bp, Homo sapiens
tgcctccagggctg

SEQ ID NO: 3479331 - DNA, 21 bp, Homo sapiens
tgcctccattatccattccca

SEQ ID NO: 3479332 - DNA, 24 bp, Homo sapiens
tgcctcggcttttctcagctggat

SEQ ID NO: 3479333 - DNA, 17 bp, Homo sapiens
tgcctctacctgacact

SEQ ID NO: 3479334 - DNA, 23 bp, Homo sapiens
tgcctctacctgacactcccttg

SEQ ID NO: 3479335 - DNA, 14 bp, Homo sapiens
tgcctctgacacac

SEQ ID NO: 3479336 - DNA, 22 bp, Homo sapiens
tgcctctgacacacagctctgt

SEQ ID NO: 3479337 - DNA, 11 bp, Homo sapiens
tgcctctgcct

SEQ ID NO: 3479338 - DNA, 13 bp, Homo sapiens
tgcctctgcctct

SEQ ID NO: 3479339 - DNA, 18 bp, Homo sapiens
tgcctctgcctctgacac

SEQ ID NO: 3479340 - DNA, 21 bp, Homo sapiens
tgcctctgtccccttctctca

SEQ ID NO: 3479341 - DNA, 15 bp, Homo sapiens
tgcctcttctgggag

SEQ ID NO: 3479342 - DNA, 16 bp, Homo sapiens
tgcctcttctgggagg

SEQ ID NO: 3479343 - DNA, 22 bp, Homo sapiens
tgcctcttttacctgctgcttc

SEQ ID NO: 3479344 - DNA, 18 bp, Homo sapiens
tgcctgaagtcacacagt

SEQ ID NO: 3479345 - DNA, 22 bp, Homo sapiens
tgcctgaagtcacacagtgagt

SEQ ID NO: 3479346 - DNA, 14 bp, Homo sapiens
tgcctgacaaggcc

SEQ ID NO: 3479347 - DNA, 17 bp, Homo sapiens
tgcctgacaaggccagc

SEQ ID NO: 3479348 - DNA, 18 bp, Homo sapiens
tgcctgacatttggagtg

SEQ ID NO: 3479349 - DNA, 16 bp, Homo sapiens
tgcctgagtgcctggc

SEQ ID NO: 3479350 - DNA, 20 bp, Homo sapiens
tgcctgattgccaagctcag

SEQ ID NO: 3479351 - DNA, 20 bp, Homo sapiens
tgcctgcaaccttgcatcca

SEQ ID NO: 3479352 - DNA, 17 bp, Homo sapiens
tgcctgcacaaactcac

SEQ ID NO: 3479353 - DNA, 20 bp, Homo sapiens
tgcctgccatagccaggagc

SEQ ID NO: 3479354 - DNA, 13 bp, Homo sapiens
tgcctgcccaggc

SEQ ID NO: 3479355 - DNA, 15 bp, Homo sapiens
tgcctgcccaggccc

SEQ ID NO: 3479356 - DNA, 16 bp, Homo sapiens
tgcctgcccaggcccc

SEQ ID NO: 3479357 - DNA, 18 bp, Homo sapiens
tgcctgcccaggcccctg

SEQ ID NO: 3479358 - DNA, 20 bp, Homo sapiens
tgcctgcccaggcccctgcc

SEQ ID NO: 3479359 - DNA, 22 bp, Homo sapiens
tgcctgcccaggcccctgccac

SEQ ID NO: 3479360 - DNA, 23 bp, Homo sapiens
tgcctgcccaggcccctgccacc

SEQ ID NO: 3479361 - DNA, 20 bp, Homo sapiens
tgcctgccccaaacaaatat

SEQ ID NO: 3479362 - DNA, 20 bp, Homo sapiens
tgcctggagacttagggcac

SEQ ID NO: 3479363 - DNA, 14 bp, Homo sapiens
tgcctggtggcagc

SEQ ID NO: 3479364 - DNA, 16 bp, Homo sapiens
tgcctgtagtcccagg

SEQ ID NO: 3479365 - DNA, 13 bp, Homo sapiens
tgcctgtcctgaa

SEQ ID NO: 3479366 - DNA, 16 bp, Homo sapiens
tgcctgtcctgaaagc

SEQ ID NO: 3479367 - DNA, 19 bp, Homo sapiens
tgcctgtgtccatgcgctc

SEQ ID NO: 3479368 - DNA, 14 bp, Homo sapiens
tgcctgtgtcttct

SEQ ID NO: 3479369 - DNA, 15 bp, Homo sapiens
tgcctgttcagctcc

SEQ ID NO: 3479370 - DNA, 17 bp, Homo sapiens
tgcctgttcagctccag

SEQ ID NO: 3479371 - DNA, 18 bp, Homo sapiens
tgcctgttcagctccagc

SEQ ID NO: 3479372 - DNA, 21 bp, Homo sapiens
tgcctgttcagctccagctca

SEQ ID NO: 3479373 - DNA, 19 bp, Homo sapiens
tgccttaccgagagccaaa

SEQ ID NO: 3479374 - DNA, 20 bp, Homo sapiens
tgccttaccgagagccaaac

SEQ ID NO: 3479375 - DNA, 13 bp, Homo sapiens
tgccttagcttca

SEQ ID NO: 3479376 - DNA, 17 bp, Homo sapiens
tgccttagcttcaggaa

SEQ ID NO: 3479377 - DNA, 21 bp, Homo sapiens
tgccttatctaaatcaccaga

SEQ ID NO: 3479378 - DNA, 21 bp, Homo sapiens
tgccttattagagtgtctttc

SEQ ID NO: 3479379 - DNA, 17 bp, Homo sapiens
tgccttccagatcctct

SEQ ID NO: 3479380 - DNA, 14 bp, Homo sapiens
tgccttcctaagcc

SEQ ID NO: 3479381 - DNA, 23 bp, Homo sapiens
tgccttcctaagcctgtggctgt

SEQ ID NO: 3479382 - DNA, 16 bp, Homo sapiens
tgccttcctcctgggc

SEQ ID NO: 3479383 - DNA, 17 bp, Homo sapiens
tgccttcctcctgggcc

SEQ ID NO: 3479384 - DNA, 22 bp, Homo sapiens
tggccaccaggtgcctttcaaa

SEQ ID NO: 3479385 - DNA, 19 bp, Homo sapiens
tggccactaagcagaggag

SEQ ID NO: 3479386 - DNA, 14 bp, Homo sapiens
tggccactccgaga

SEQ ID NO: 3479387 - DNA, 18 bp, Homo sapiens
tggccactccgagaggtg

SEQ ID NO: 3479388 - DNA, 20 bp, Homo sapiens
tggccactccgagaggtggg

SEQ ID NO: 3479389 - DNA, 23 bp, Homo sapiens
tggccactccgagaggtgggcca

SEQ ID NO: 3479390 - DNA, 13 bp, Homo sapiens
tggccagagagcc

SEQ ID NO: 3479391 - DNA, 18 bp, Homo sapiens
tggccagatgcaccagcc

SEQ ID NO: 3479392 - DNA, 20 bp, Homo sapiens
tggccagatgcaccagccct

SEQ ID NO: 3479393 - DNA, 21 bp, Homo sapiens
tggccagccaacttttgcatg

SEQ ID NO: 3479394 - DNA, 13 bp, Homo sapiens
tggccaggctggt

SEQ ID NO: 3479395 - DNA, 15 bp, Homo sapiens
tggccaggctggtct

SEQ ID NO: 3479396 - DNA, 16 bp, Homo sapiens
tggccagtccaggctg

SEQ ID NO: 3479397 - DNA, 17 bp, Homo sapiens
tggccagtccaggctgc

SEQ ID NO: 3479398 - DNA, 23 bp, Homo sapiens
tggccagtccaggctgccgtggg

SEQ ID NO: 3479399 - DNA, 13 bp, Homo sapiens
tggccatcccaca

SEQ ID NO: 3479400 - DNA, 16 bp, Homo sapiens
tggccatctctggatg

SEQ ID NO: 3479401 - DNA, 15 bp, Homo sapiens
tggccatgcctcagc

SEQ ID NO: 3479402 - DNA, 17 bp, Homo sapiens
tggccatggcctctgca

SEQ ID NO: 3479403 - DNA, 19 bp, Homo sapiens
tggcccaagtggcagagct

SEQ ID NO: 3479404 - DNA, 19 bp, Homo sapiens
tggcccacgcacttcggga

SEQ ID NO: 3479405 - DNA, 17 bp, Homo sapiens
tggcccaggaccatcat

SEQ ID NO: 3479406 - DNA, 14 bp, Homo sapiens
tggcccagggccca

SEQ ID NO: 3479407 - DNA, 15 bp, Homo sapiens
tggcccagggcccag

SEQ ID NO: 3479408 - DNA, 16 bp, Homo sapiens
tggcccagggcccaga

SEQ ID NO: 3479409 - DNA, 20 bp, Homo sapiens
tggcccagggcccagagccc

SEQ ID NO: 3479410 - DNA, 16 bp, Homo sapiens
tggccccaccctgggc

SEQ ID NO: 3479411 - DNA, 18 bp, Homo sapiens
tggccccaccctgggccc

SEQ ID NO: 3479412 - DNA, 16 bp, Homo sapiens
tggccccgtttctggt

SEQ ID NO: 3479413 - DNA, 14 bp, Homo sapiens
tggcccctgcccgg

SEQ ID NO: 3479414 - DNA, 21 bp, Homo sapiens
tggcccctgcccggctgcgga

SEQ ID NO: 3479415 - DNA, 22 bp, Homo sapiens
tggcccctgctgtctctctggg

SEQ ID NO: 3479416 - DNA, 18 bp, Homo sapiens
tggcccctgtctcggggc

SEQ ID NO: 3479417 - DNA, 13 bp, Homo sapiens
tggcccggccccg

SEQ ID NO: 3479418 - DNA, 21 bp, Homo sapiens
tggccgcacgcctctccctgc

SEQ ID NO: 3479419 - DNA, 13 bp, Homo sapiens
tggccgcctccag

SEQ ID NO: 3479420 - DNA, 15 bp, Homo sapiens
tggccgcctccagga

SEQ ID NO: 3479421 - DNA, 19 bp, Homo sapiens
tggccgttgatgttggctg

SEQ ID NO: 3479422 - DNA, 21 bp, Homo sapiens
tggccgttgatgttggctggg

SEQ ID NO: 3479423 - DNA, 17 bp, Homo sapiens
tggcctcatctctgcct

SEQ ID NO: 3479424 - DNA, 17 bp, Homo sapiens
tggcctcatgtggctgg

SEQ ID NO: 3479425 - DNA, 12 bp, Homo sapiens
tggcctccatcc

SEQ ID NO: 3479426 - DNA, 20 bp, Homo sapiens
tggcctcccaaatgagccat

SEQ ID NO: 3479427 - DNA, 15 bp, Homo sapiens
tggcctcccctgcca

SEQ ID NO: 3479428 - DNA, 23 bp, Homo sapiens
tggcctcccctgccaccaggcca

SEQ ID NO: 3479429 - DNA, 15 bp, Homo sapiens
tggcctcttgaagag

SEQ ID NO: 3479430 - DNA, 19 bp, Homo sapiens
tggcctgagagtcagctct

SEQ ID NO: 3479431 - DNA, 22 bp, Homo sapiens
tggcctgatcagaccacggctc

SEQ ID NO: 3479432 - DNA, 18 bp, Homo sapiens
tggcctgatgatggtggg

SEQ ID NO: 3479433 - DNA, 19 bp, Homo sapiens
tggcctgtagaatagcctg

SEQ ID NO: 3479434 - DNA, 23 bp, Homo sapiens
tggcctgtagaatagcctgtggc

SEQ ID NO: 3479435 - DNA, 22 bp, Homo sapiens
tggcctgtgtggccacttctgt

SEQ ID NO: 3479436 - DNA, 18 bp, Homo sapiens
tggcctgtttcaacacag

SEQ ID NO: 3479437 - DNA, 24 bp, Homo sapiens
tggccttcccgccggaggccagct

SEQ ID NO: 3479438 - DNA, 19 bp, Homo sapiens
tggccttctcccctcttct

SEQ ID NO: 3479439 - DNA, 19 bp, Homo sapiens
tggcgagtgaatgccagtg

SEQ ID NO: 3479440 - DNA, 17 bp, Homo sapiens
tggcgccgtctccaggg

SEQ ID NO: 3479441 - DNA, 22 bp, Homo sapiens
tggcgtgcagtggtgcgatctg

SEQ ID NO: 3479442 - DNA, 12 bp, Homo sapiens
tggctaagaccc

SEQ ID NO: 3479443 - DNA, 19 bp, Homo sapiens
tggctacgcctcttctgtc

SEQ ID NO: 3479444 - DNA, 23 bp, Homo sapiens
tggctacgcctcttctgtccctg

SEQ ID NO: 3479445 - DNA, 21 bp, Homo sapiens
tggctagtcaagctcctcctc

SEQ ID NO: 3479446 - DNA, 22 bp, Homo sapiens
tggctagtcaagctcctcctcc

SEQ ID NO: 3479447 - DNA, 16 bp, Homo sapiens
tggctatttaaagaca

SEQ ID NO: 3479448 - DNA, 19 bp, Homo sapiens
tggctcacacctgtaatcc

SEQ ID NO: 3479449 - DNA, 18 bp, Homo sapiens
tggctcagacatgttttc

SEQ ID NO: 3479450 - DNA, 18 bp, Homo sapiens
tggctcattctgcacctt

SEQ ID NO: 3479451 - DNA, 19 bp, Homo sapiens
tggctcccgcggtgccatg

SEQ ID NO: 3479452 - DNA, 14 bp, Homo sapiens
tggctccttcacca

SEQ ID NO: 3479453 - DNA, 18 bp, Homo sapiens
tggctcgaatctctgtgc

SEQ ID NO: 3479454 - DNA, 19 bp, Homo sapiens
tggctcgaatctctgtgcc

SEQ ID NO: 3479455 - DNA, 20 bp, Homo sapiens
tggctcgaatctctgtgcct

SEQ ID NO: 3479456 - DNA, 21 bp, Homo sapiens
tggctcgaatctctgtgcctt

SEQ ID NO: 3479457 - DNA, 17 bp, Homo sapiens
tggctctatttcttctt

SEQ ID NO: 3479458 - DNA, 11 bp, Homo sapiens
tggctctgggc

SEQ ID NO: 3479459 - DNA, 13 bp, Homo sapiens
tggctgagcccct

SEQ ID NO: 3479460 - DNA, 17 bp, Homo sapiens
tggctgagcccctgtct

SEQ ID NO: 3479461 - DNA, 15 bp, Homo sapiens
tggctgcagggagtc

SEQ ID NO: 3479462 - DNA, 20 bp, Homo sapiens
tggctgcatcccccccacct

SEQ ID NO: 3479463 - DNA, 15 bp, Homo sapiens
tggctgcctgcatct

SEQ ID NO: 3479464 - DNA, 19 bp, Homo sapiens
tggctggaagatcctgcgg

SEQ ID NO: 3479465 - DNA, 10 bp, Homo sapiens
tggctgggca

SEQ ID NO: 3479466 - DNA, 14 bp, Homo sapiens
tggctgggggcctc

SEQ ID NO: 3479467 - DNA, 20 bp, Homo sapiens
tggctgggggcctcagtgcc

SEQ ID NO: 3479468 - DNA, 18 bp, Homo sapiens
tggctggggtggcctgtg

SEQ ID NO: 3479469 - DNA, 22 bp, Homo sapiens
tggctggggtggcctgtgtggc

SEQ ID NO: 3479470 - DNA, 14 bp, Homo sapiens
tggctgtgtctaaa

SEQ ID NO: 3479471 - DNA, 14 bp, Homo sapiens
tggcttcacggaag

SEQ ID NO: 3479472 - DNA, 18 bp, Homo sapiens
tggcttcattagagcagg

SEQ ID NO: 3479473 - DNA, 16 bp, Homo sapiens
tggcttctggccagga

SEQ ID NO: 3479474 - DNA, 21 bp, Homo sapiens
tggcttctggccaggaagctt

SEQ ID NO: 3479475 - DNA, 17 bp, Homo sapiens
tggcttgggcagggtct

SEQ ID NO: 3479476 - DNA, 14 bp, Homo sapiens
tggcttgtcctcac

SEQ ID NO: 3479477 - DNA, 22 bp, Homo sapiens
tggcttgttattgcctctactt

SEQ ID NO: 3479478 - DNA, 19 bp, Homo sapiens
tggctttgcggaggctgct

SEQ ID NO: 3479479 - DNA, 17 bp, Homo sapiens
tggctttggcttcttgg

SEQ ID NO: 3479480 - DNA, 14 bp, Homo sapiens
tggcttttctgttt

SEQ ID NO: 3479481 - DNA, 18 bp, Homo sapiens
tggcttttctgtttcctg

SEQ ID NO: 3479482 - DNA, 23 bp, Homo sapiens
tgggaaaaatgcccttaaatcat

SEQ ID NO: 3479483 - DNA, 18 bp, Homo sapiens
tgggaaacaaaaggataa

SEQ ID NO: 3479484 - DNA, 21 bp, Homo sapiens
tgggaacagcatggaggcaga

SEQ ID NO: 3479485 - DNA, 15 bp, Homo sapiens
tgggaactcacctgg

SEQ ID NO: 3479486 - DNA, 14 bp, Homo sapiens
tgggaagaggactt

SEQ ID NO: 3479487 - DNA, 12 bp, Homo sapiens
tgggaaggggag

SEQ ID NO: 3479488 - DNA, 17 bp, Homo sapiens
tgggaaggggaggaccc

SEQ ID NO: 3479489 - DNA, 14 bp, Homo sapiens
tgggaatatttgaa

SEQ ID NO: 3479490 - DNA, 16 bp, Homo sapiens
tgggaatatttgaatc

SEQ ID NO: 3479491 - DNA, 10 bp, Homo sapiens
tgggaatgtt

SEQ ID NO: 3479492 - DNA, 17 bp, Homo sapiens
tgggacaggctcttctt

SEQ ID NO: 3479493 - DNA, 21 bp, Homo sapiens
tgggacaggctcttctttccc

SEQ ID NO: 3479494 - DNA, 17 bp, Homo sapiens
tgggaccacaactattt

SEQ ID NO: 3479495 - DNA, 14 bp, Homo sapiens
tgggacggtgccca

SEQ ID NO: 3479496 - DNA, 23 bp, Homo sapiens
tgggacggtgcccaagccagagg

SEQ ID NO: 3479497 - DNA, 20 bp, Homo sapiens
tgggacgtggctcagccagc

SEQ ID NO: 3479498 - DNA, 16 bp, Homo sapiens
tgggactacaggcacc

SEQ ID NO: 3479499 - DNA, 17 bp, Homo sapiens
tgggactcagccttcag

SEQ ID NO: 3479500 - DNA, 19 bp, Homo sapiens
tgggagaaatctggcttct

SEQ ID NO: 3479501 - DNA, 22 bp, Homo sapiens
tgggagaattcttacatgtttt

SEQ ID NO: 3479502 - DNA, 14 bp, Homo sapiens
tgggagatgttaga

SEQ ID NO: 3479503 - DNA, 12 bp, Homo sapiens
tgggagccactg

SEQ ID NO: 3479504 - DNA, 23 bp, Homo sapiens
tgggagccgggtctgcctcttct

SEQ ID NO: 3479505 - DNA, 22 bp, Homo sapiens
tgggagctccactctgcttctc

SEQ ID NO: 3479506 - DNA, 20 bp, Homo sapiens
tgggagctgaggccacactc

SEQ ID NO: 3479507 - DNA, 21 bp, Homo sapiens
tgggagctgcctgttcagctc

SEQ ID NO: 3479508 - DNA, 14 bp, Homo sapiens
tgggaggagcccct

SEQ ID NO: 3479509 - DNA, 16 bp, Homo sapiens
tgggaggccccactgg

SEQ ID NO: 3479510 - DNA, 20 bp, Homo sapiens
tgggaggccccactggggaa

SEQ ID NO: 3479511 - DNA, 22 bp, Homo sapiens
tgggaggctcacccccttctcc

SEQ ID NO: 3479512 - DNA, 11 bp, Homo sapiens
tgggaggctga

SEQ ID NO: 3479513 - DNA, 17 bp, Homo sapiens
tgggagggaggctcagg

SEQ ID NO: 3479514 - DNA, 17 bp, Homo sapiens
tgggaggtatgggctgg

SEQ ID NO: 3479515 - DNA, 22 bp, Homo sapiens
tgggaggtatgggctgggggct

SEQ ID NO: 3479516 - DNA, 15 bp, Homo sapiens
tgtggcctgggcctc

SEQ ID NO: 3479517 - DNA, 19 bp, Homo sapiens
tgtggcgccgtctccaggg

SEQ ID NO: 3479518 - DNA, 23 bp, Homo sapiens
tgtggcgccgtctccaggggctg

SEQ ID NO: 3479519 - DNA, 20 bp, Homo sapiens
tgtggctcctcccagcccat

SEQ ID NO: 3479520 - DNA, 17 bp, Homo sapiens
tgtgggcgggcccagca

SEQ ID NO: 3479521 - DNA, 12 bp, Homo sapiens
tgtggggcacag

SEQ ID NO: 3479522 - DNA, 15 bp, Homo sapiens
tgtgggtacctgtat

SEQ ID NO: 3479523 - DNA, 13 bp, Homo sapiens
tgtgggtgtcctg

SEQ ID NO: 3479524 - DNA, 15 bp, Homo sapiens
tgtgggtgtcctgcc

SEQ ID NO: 3479525 - DNA, 21 bp, Homo sapiens
tgtgggtgtcctgcctgtctg

SEQ ID NO: 3479526 - DNA, 23 bp, Homo sapiens
tgtgggtgtcctgcctgtctgcc

SEQ ID NO: 3479527 - DNA, 18 bp, Homo sapiens
tgtgggtttttcatcttt

SEQ ID NO: 3479528 - DNA, 19 bp, Homo sapiens
tgtggtgatgatgtgtata

SEQ ID NO: 3479529 - DNA, 21 bp, Homo sapiens
tgtggtgtttcctgcaggcca

SEQ ID NO: 3479530 - DNA, 13 bp, Homo sapiens
tgtgtaacatatt

SEQ ID NO: 3479531 - DNA, 19 bp, Homo sapiens
tgtgtaacctcttcacctt

SEQ ID NO: 3479532 - DNA, 15 bp, Homo sapiens
tgtgtaggtgaacag

SEQ ID NO: 3479533 - DNA, 17 bp, Homo sapiens
tgtgtatctctttcaca

SEQ ID NO: 3479534 - DNA, 18 bp, Homo sapiens
tgtgtatgagtgtgaatg

SEQ ID NO: 3479535 - DNA, 18 bp, Homo sapiens
tgtgtatgggtagcacta

SEQ ID NO: 3479536 - DNA, 18 bp, Homo sapiens
tgtgtatttaacagggag

SEQ ID NO: 3479537 - DNA, 19 bp, Homo sapiens
tgtgtcaggtggggcagct

SEQ ID NO: 3479538 - DNA, 16 bp, Homo sapiens
tgtgtccaaaactgcc

SEQ ID NO: 3479539 - DNA, 17 bp, Homo sapiens
tgtgtccacgactgtct

SEQ ID NO: 3479540 - DNA, 20 bp, Homo sapiens
tgtgtccatgcgctcagggc

SEQ ID NO: 3479541 - DNA, 18 bp, Homo sapiens
tgtgtcctccaggagctt

SEQ ID NO: 3479542 - DNA, 21 bp, Homo sapiens
tgtgtcctccaggagcttctt

SEQ ID NO: 3479543 - DNA, 13 bp, Homo sapiens
tgtgtctaaactg

SEQ ID NO: 3479544 - DNA, 21 bp, Homo sapiens
tgtgtctaaactgcattaccg

SEQ ID NO: 3479545 - DNA, 20 bp, Homo sapiens
tgtgtcttgcaatggcagcc

SEQ ID NO: 3479546 - DNA, 9 bp, Homo sapiens
tgtgtcttt

SEQ ID NO: 3479547 - DNA, 18 bp, Homo sapiens
tgtgtctttttcgccaaa

SEQ ID NO: 3479548 - DNA, 13 bp, Homo sapiens
tgtgtgaaggcag

SEQ ID NO: 3479549 - DNA, 16 bp, Homo sapiens
tgtgtgaatgaacact

SEQ ID NO: 3479550 - DNA, 16 bp, Homo sapiens
tgtgtgagactactaa

SEQ ID NO: 3479551 - DNA, 12 bp, Homo sapiens
tgtgtgataaat

SEQ ID NO: 3479552 - DNA, 18 bp, Homo sapiens
tgtgtgattgacagcttt

SEQ ID NO: 3479553 - DNA, 19 bp, Homo sapiens
tgtgtgttgccacaggaca

SEQ ID NO: 3479554 - DNA, 16 bp, Homo sapiens
tgtgttgccaagctcc

SEQ ID NO: 3479555 - DNA, 18 bp, Homo sapiens
tgtgttgccacaggacac

SEQ ID NO: 3479556 - DNA, 23 bp, Homo sapiens
tgtgttgccacaggacacagtca

SEQ ID NO: 3479557 - DNA, 15 bp, Homo sapiens
tgtgtttcaagttca

SEQ ID NO: 3479558 - DNA, 14 bp, Homo sapiens
tgtgtttctttata

SEQ ID NO: 3479559 - DNA, 15 bp, Homo sapiens
tgtgtttggatttgt

SEQ ID NO: 3479560 - DNA, 12 bp, Homo sapiens
tgttaaaataac

SEQ ID NO: 3479561 - DNA, 22 bp, Homo sapiens
tgttaaactagcatatctgcct

SEQ ID NO: 3479562 - DNA, 13 bp, Homo sapiens
tgttaaataaatt

SEQ ID NO: 3479563 - DNA, 22 bp, Homo sapiens
tgttaacctaggcagtgggagg

SEQ ID NO: 3479564 - DNA, 14 bp, Homo sapiens
tgttaactacatat

SEQ ID NO: 3479565 - DNA, 17 bp, Homo sapiens
tgttaagtattttcata

SEQ ID NO: 3479566 - DNA, 18 bp, Homo sapiens
tgttaagtcctccctgac

SEQ ID NO: 3479567 - DNA, 22 bp, Homo sapiens
tgttaagtcctccctgactttt

SEQ ID NO: 3479568 - DNA, 15 bp, Homo sapiens
tgttaattacaccat

SEQ ID NO: 3479569 - DNA, 19 bp, Homo sapiens
tgttaattttttggtacaa

SEQ ID NO: 3479570 - DNA, 21 bp, Homo sapiens
tgttaattttttggtacaaaa

SEQ ID NO: 3479571 - DNA, 18 bp, Homo sapiens
tgttacaaagttgtatgt

SEQ ID NO: 3479572 - DNA, 15 bp, Homo sapiens
tgttacccatgaaaa

SEQ ID NO: 3479573 - DNA, 15 bp, Homo sapiens
tgttacctgaaaaca

SEQ ID NO: 3479574 - DNA, 23 bp, Homo sapiens
tgttacctgaaaacactgtgcac

SEQ ID NO: 3479575 - DNA, 17 bp, Homo sapiens
tgttacctgtgtgcttg

SEQ ID NO: 3479576 - DNA, 13 bp, Homo sapiens
tgttactaactaa

SEQ ID NO: 3479577 - DNA, 14 bp, Homo sapiens
tgttactaactaaa

SEQ ID NO: 3479578 - DNA, 13 bp, Homo sapiens
tgttactgctttg

SEQ ID NO: 3479579 - DNA, 17 bp, Homo sapiens
tgttactgctttgcaaa

SEQ ID NO: 3479580 - DNA, 18 bp, Homo sapiens
tgttactgctttgcaaag

SEQ ID NO: 3479581 - DNA, 14 bp, Homo sapiens
tgttagcagacagg

SEQ ID NO: 3479582 - DNA, 15 bp, Homo sapiens
tgttagtaaaggggc

SEQ ID NO: 3479583 - DNA, 13 bp, Homo sapiens
tgttagtaacatg

SEQ ID NO: 3479584 - DNA, 18 bp, Homo sapiens
tgttataggttgttggat

SEQ ID NO: 3479585 - DNA, 15 bp, Homo sapiens
tgttatatcatatgt

SEQ ID NO: 3479586 - DNA, 19 bp, Homo sapiens
tgttatcttatactgtaca

SEQ ID NO: 3479587 - DNA, 21 bp, Homo sapiens
tgttatcttatactgtacaat

SEQ ID NO: 3479588 - DNA, 22 bp, Homo sapiens
tgttatgtaaaaggccaaacct

SEQ ID NO: 3479589 - DNA, 12 bp, Homo sapiens
tgttatgtattt

SEQ ID NO: 3479590 - DNA, 14 bp, Homo sapiens
tgttatgtatttcc

SEQ ID NO: 3479591 - DNA, 19 bp, Homo sapiens
tgttattatatttgacatg

SEQ ID NO: 3479592 - DNA, 16 bp, Homo sapiens
tgttattgttttgtta

SEQ ID NO: 3479593 - DNA, 18 bp, Homo sapiens
tgttatttaacagctgaa

SEQ ID NO: 3479594 - DNA, 19 bp, Homo sapiens
tgttcaagttttcagcttt

SEQ ID NO: 3479595 - DNA, 16 bp, Homo sapiens
tgttcaatgtttaatg

SEQ ID NO: 3479596 - DNA, 14 bp, Homo sapiens
tgttcatagcccag

SEQ ID NO: 3479597 - DNA, 23 bp, Homo sapiens
tgttcatagcccagtagaccttg

SEQ ID NO: 3479598 - DNA, 12 bp, Homo sapiens
tgttcattttga

SEQ ID NO: 3479599 - DNA, 16 bp, Homo sapiens
tgttccaaggccaggg

SEQ ID NO: 3479600 - DNA, 16 bp, Homo sapiens
tgttccacttgtttgc

SEQ ID NO: 3479601 - DNA, 14 bp, Homo sapiens
tgttccagcagttt

SEQ ID NO: 3479602 - DNA, 14 bp, Homo sapiens
tgttccccagagaa

SEQ ID NO: 3479603 - DNA, 13 bp, Homo sapiens
tgttcccctcctc

SEQ ID NO: 3479604 - DNA, 17 bp, Homo sapiens
tgttccccttccactga

SEQ ID NO: 3479605 - DNA, 20 bp, Homo sapiens
tgttccccttccactgaggg

SEQ ID NO: 3479606 - DNA, 21 bp, Homo sapiens
tgttccccttccactgagggc

SEQ ID NO: 3479607 - DNA, 23 bp, Homo sapiens
tgttccccttccactgagggcag

SEQ ID NO: 3479608 - DNA, 21 bp, Homo sapiens
tgttccctatttttctctcct

SEQ ID NO: 3479609 - DNA, 16 bp, Homo sapiens
tgttcctagagtagag

SEQ ID NO: 3479610 - DNA, 18 bp, Homo sapiens
tgttccttcacatcctgt

SEQ ID NO: 3479611 - DNA, 17 bp, Homo sapiens
tgttctaagtctttcca

SEQ ID NO: 3479612 - DNA, 15 bp, Homo sapiens
tgttctagttttcag

SEQ ID NO: 3479613 - DNA, 16 bp, Homo sapiens
tgttctattcatctca

SEQ ID NO: 3479614 - DNA, 23 bp, Homo sapiens
tgttctcattcctgttctttctt

SEQ ID NO: 3479615 - DNA, 18 bp, Homo sapiens
tgttctctatcatttaat

SEQ ID NO: 3479616 - DNA, 20 bp, Homo sapiens
tgttctctatcatttaataa

SEQ ID NO: 3479617 - DNA, 16 bp, Homo sapiens
tgttctctcttctcca

SEQ ID NO: 3479618 - DNA, 14 bp, Homo sapiens
tgttctgggacaca

SEQ ID NO: 3479619 - DNA, 16 bp, Homo sapiens
tgttctgggacacagt

SEQ ID NO: 3479620 - DNA, 17 bp, Homo sapiens
tgttctggtggtttgat

SEQ ID NO: 3479621 - DNA, 14 bp, Homo sapiens
tgttctgtcttccc

SEQ ID NO: 3479622 - DNA, 22 bp, Homo sapiens
tgttctgtgatacagaactctt

SEQ ID NO: 3479623 - DNA, 14 bp, Homo sapiens
tgttctgtttgtta

SEQ ID NO: 3479624 - DNA, 23 bp, Homo sapiens
tgttcttgaatttaataatctgt

SEQ ID NO: 3479625 - DNA, 21 bp, Homo sapiens
tgttcttgatggagattaaga

SEQ ID NO: 3479626 - DNA, 23 bp, Homo sapiens
tgttcttgatggagattaagatg

SEQ ID NO: 3479627 - DNA, 23 bp, Homo sapiens
tgttgaaggaacttgtctcttca

SEQ ID NO: 3479628 - DNA, 17 bp, Homo sapiens
tgttgaagggaggtggc

SEQ ID NO: 3479629 - DNA, 19 bp, Homo sapiens
tgttgacatatttaatgtt

SEQ ID NO: 3479630 - DNA, 23 bp, Homo sapiens
tgttgagaatcccaaatttgatt

SEQ ID NO: 3479631 - DNA, 20 bp, Homo sapiens
tgttgagcatcacagaatgt

SEQ ID NO: 3479632 - DNA, 16 bp, Homo sapiens
tgttgaggtgaccact

SEQ ID NO: 3479633 - DNA, 22 bp, Homo sapiens
tgttgagttagttaagttgggt

SEQ ID NO: 3479634 - DNA, 23 bp, Homo sapiens
tgttgatcatgtactttttagta

SEQ ID NO: 3479635 - DNA, 20 bp, Homo sapiens
tgttgatccatccagcttgc

SEQ ID NO: 3479636 - DNA, 11 bp, Homo sapiens
tgttgcaaagc

SEQ ID NO: 3479637 - DNA, 15 bp, Homo sapiens
tgttgcaaagcttcc

SEQ ID NO: 3479638 - DNA, 17 bp, Homo sapiens
tgttgcactgaaatgga

SEQ ID NO: 3479639 - DNA, 17 bp, Homo sapiens
tgttgcaggttcatgga

SEQ ID NO: 3479640 - DNA, 16 bp, Homo sapiens
tgttgccacaggacac

SEQ ID NO: 3479641 - DNA, 13 bp, Homo sapiens
tgttgcccaggca

SEQ ID NO: 3479642 - DNA, 15 bp, Homo sapiens
tgttgcccaggcagg

SEQ ID NO: 3479643 - DNA, 13 bp, Homo sapiens
tgttgcccaggct

SEQ ID NO: 3479644 - DNA, 11 bp, Homo sapiens
tgttgccccag

SEQ ID NO: 3479645 - DNA, 16 bp, Homo sapiens
tgttgcccctttctct

SEQ ID NO: 3479646 - DNA, 17 bp, Homo sapiens
tgttgcccctttctctt

SEQ ID NO: 3479647 - DNA, 21 bp, Homo sapiens
tgttgcccctttctcttttcc

SEQ ID NO: 3479648 - DNA, 11 bp, Homo sapiens
tgttgctaagc

SEQ ID NO: 3479649 - DNA, 23 bp, Homo sapiens
tttgataatgacactgtttcctg

SEQ ID NO: 3479650 - DNA, 17 bp, Homo sapiens
tttgatatccaaagctg

SEQ ID NO: 3479651 - DNA, 23 bp, Homo sapiens
tttgatatccaaagctgaataca

SEQ ID NO: 3479652 - DNA, 22 bp, Homo sapiens
tttgatgcatgtcttttaaaat

SEQ ID NO: 3479653 - DNA, 15 bp, Homo sapiens
tttgattaacatttg

SEQ ID NO: 3479654 - DNA, 19 bp, Homo sapiens
tttgattaggtatgtttgt

SEQ ID NO: 3479655 - DNA, 22 bp, Homo sapiens
tttgattaggtatgtttgtaac

SEQ ID NO: 3479656 - DNA, 14 bp, Homo sapiens
tttgattctccttc

SEQ ID NO: 3479657 - DNA, 21 bp, Homo sapiens
tttgattctccttcagccctc

SEQ ID NO: 3479658 - DNA, 15 bp, Homo sapiens
tttgcaaagtactgt

SEQ ID NO: 3479659 - DNA, 22 bp, Homo sapiens
tttgcactgtaaattgctggca

SEQ ID NO: 3479660 - DNA, 14 bp, Homo sapiens
tttgcagacaggca

SEQ ID NO: 3479661 - DNA, 11 bp, Homo sapiens
tttgcagcttt

SEQ ID NO: 3479662 - DNA, 16 bp, Homo sapiens
tttgcataacaattcc

SEQ ID NO: 3479663 - DNA, 22 bp, Homo sapiens
tttgcataacaattcctctact

SEQ ID NO: 3479664 - DNA, 21 bp, Homo sapiens
tttgcattaaattcacaaact

SEQ ID NO: 3479665 - DNA, 22 bp, Homo sapiens
tttgcattaaattcacaaactt

SEQ ID NO: 3479666 - DNA, 19 bp, Homo sapiens
tttgcattgaacacaaact

SEQ ID NO: 3479667 - DNA, 23 bp, Homo sapiens
tttgccaaaattcatttctaatt

SEQ ID NO: 3479668 - DNA, 21 bp, Homo sapiens
tttgcccaaaatttattttat

SEQ ID NO: 3479669 - DNA, 19 bp, Homo sapiens
tttgcctaaatccaaagaa

SEQ ID NO: 3479670 - DNA, 22 bp, Homo sapiens
tttgcctaaatccaaagaaaaa

SEQ ID NO: 3479671 - DNA, 13 bp, Homo sapiens
tttgcctctgcct

SEQ ID NO: 3479672 - DNA, 19 bp, Homo sapiens
tttgctgccaaatgcgtat

SEQ ID NO: 3479673 - DNA, 13 bp, Homo sapiens
tttgctgcttctg

SEQ ID NO: 3479674 - DNA, 18 bp, Homo sapiens
tttgctttaccttcctga

SEQ ID NO: 3479675 - DNA, 15 bp, Homo sapiens
tttgctttctgctca

SEQ ID NO: 3479676 - DNA, 15 bp, Homo sapiens
tttgctttgctttct

SEQ ID NO: 3479677 - DNA, 18 bp, Homo sapiens
tttgctttgctttctgct

SEQ ID NO: 3479678 - DNA, 15 bp, Homo sapiens
tttggaaaatgcatt

SEQ ID NO: 3479679 - DNA, 13 bp, Homo sapiens
tttggaataaagt

SEQ ID NO: 3479680 - DNA, 20 bp, Homo sapiens
tttggagagggggcctggga

SEQ ID NO: 3479681 - DNA, 14 bp, Homo sapiens
tttggatttgacat

SEQ ID NO: 3479682 - DNA, 20 bp, Homo sapiens
tttggctgaaattctcctgg

SEQ ID NO: 3479683 - DNA, 14 bp, Homo sapiens
tttggctgtgtcta

SEQ ID NO: 3479684 - DNA, 17 bp, Homo sapiens
tttggctgtgtctaaac

SEQ ID NO: 3479685 - DNA, 19 bp, Homo sapiens
tttggctgtgtctaaactg

SEQ ID NO: 3479686 - DNA, 13 bp, Homo sapiens
tttggctttcagg

SEQ ID NO: 3479687 - DNA, 17 bp, Homo sapiens
tttgggaatgtttgtct

SEQ ID NO: 3479688 - DNA, 22 bp, Homo sapiens
tttggggtacccactgctctgg

SEQ ID NO: 3479689 - DNA, 20 bp, Homo sapiens
tttggggtagctagaggaac

SEQ ID NO: 3479690 - DNA, 15 bp, Homo sapiens
tttgggttacagtat

SEQ ID NO: 3479691 - DNA, 14 bp, Homo sapiens
tttgggttctgcct

SEQ ID NO: 3479692 - DNA, 16 bp, Homo sapiens
tttgggttctgcctgc

SEQ ID NO: 3479693 - DNA, 16 bp, Homo sapiens
tttggtacaaaaataa

SEQ ID NO: 3479694 - DNA, 14 bp, Homo sapiens
tttggtgagaacct

SEQ ID NO: 3479695 - DNA, 15 bp, Homo sapiens
tttggtgagaaggtg

SEQ ID NO: 3479696 - DNA, 20 bp, Homo sapiens
tttggttcattaattctata

SEQ ID NO: 3479697 - DNA, 13 bp, Homo sapiens
tttggttcccttc

SEQ ID NO: 3479698 - DNA, 12 bp, Homo sapiens
tttggttctgtg

SEQ ID NO: 3479699 - DNA, 15 bp, Homo sapiens
tttgtaaatcacatc

SEQ ID NO: 3479700 - DNA, 21 bp, Homo sapiens
tttgtaacccagattttgctg

SEQ ID NO: 3479701 - DNA, 20 bp, Homo sapiens
tttgtaactttttacattac

SEQ ID NO: 3479702 - DNA, 18 bp, Homo sapiens
tttgtaagaactaaagaa

SEQ ID NO: 3479703 - DNA, 15 bp, Homo sapiens
tttgtaataacattt

SEQ ID NO: 3479704 - DNA, 16 bp, Homo sapiens
tttgtaataacattta

SEQ ID NO: 3479705 - DNA, 17 bp, Homo sapiens
tttgtaataacatttaa

SEQ ID NO: 3479706 - DNA, 18 bp, Homo sapiens
tttgtaataacatttaat

SEQ ID NO: 3479707 - DNA, 15 bp, Homo sapiens
tttgtacataaataa

SEQ ID NO: 3479708 - DNA, 23 bp, Homo sapiens
tttgtaccagtgaatttttgcaa

SEQ ID NO: 3479709 - DNA, 14 bp, Homo sapiens
tttgtactgtttaa

SEQ ID NO: 3479710 - DNA, 18 bp, Homo sapiens
tttgtactgtttaatgtt

SEQ ID NO: 3479711 - DNA, 18 bp, Homo sapiens
tttgtagcaaccatttgt

SEQ ID NO: 3479712 - DNA, 21 bp, Homo sapiens
tttgtatctgcaggcagacac

SEQ ID NO: 3479713 - DNA, 18 bp, Homo sapiens
tttgtatgttttttttct

SEQ ID NO: 3479714 - DNA, 20 bp, Homo sapiens
tttgtattgtaaaaaattca

SEQ ID NO: 3479715 - DNA, 22 bp, Homo sapiens
tttgtcccatctctaccccctc

SEQ ID NO: 3479716 - DNA, 21 bp, Homo sapiens
tttgtcgggcaccagccagcg

SEQ ID NO: 3479717 - DNA, 14 bp, Homo sapiens
tttgtctaaaacaa

SEQ ID NO: 3479718 - DNA, 16 bp, Homo sapiens
tttgtctaaaacaata

SEQ ID NO: 3479719 - DNA, 19 bp, Homo sapiens
tttgtctaaaacaataaaa

SEQ ID NO: 3479720 - DNA, 13 bp, Homo sapiens
tttgtcttaaaaa

SEQ ID NO: 3479721 - DNA, 13 bp, Homo sapiens
tttgtctttttgt

SEQ ID NO: 3479722 - DNA, 20 bp, Homo sapiens
tttgtgctagaaattttcaa

SEQ ID NO: 3479723 - DNA, 20 bp, Homo sapiens
tttgtgctatagtatttgat

SEQ ID NO: 3479724 - DNA, 15 bp, Homo sapiens
tttgtgtgtgtgtca

SEQ ID NO: 3479725 - DNA, 17 bp, Homo sapiens
tttgtgtgttgtctctt

SEQ ID NO: 3479726 - DNA, 18 bp, Homo sapiens
tttgttaaggtcctgaaa

SEQ ID NO: 3479727 - DNA, 14 bp, Homo sapiens
tttgttactatgta

SEQ ID NO: 3479728 - DNA, 23 bp, Homo sapiens
tttgttcaagttttgggtatgtt

SEQ ID NO: 3479729 - DNA, 15 bp, Homo sapiens
tttgttcccctcctc

SEQ ID NO: 3479730 - DNA, 16 bp, Homo sapiens
tttgttctagttttca

SEQ ID NO: 3479731 - DNA, 14 bp, Homo sapiens
tttgttctttttat

SEQ ID NO: 3479732 - DNA, 23 bp, Homo sapiens
tttgttggatccgtttgaccaat

SEQ ID NO: 3479733 - DNA, 15 bp, Homo sapiens
tttgtttggtattgt

SEQ ID NO: 3479734 - DNA, 20 bp, Homo sapiens
tttgtttggttttacatttt

SEQ ID NO: 3479735 - DNA, 15 bp, Homo sapiens
tttgttttaaaatta

SEQ ID NO: 3479736 - DNA, 23 bp, Homo sapiens
tttgttttggggttttgttttgt

SEQ ID NO: 3479737 - DNA, 12 bp, Homo sapiens
tttgtttttcat

SEQ ID NO: 3479738 - DNA, 18 bp, Homo sapiens
ttttaaaaaactgctgac

SEQ ID NO: 3479739 - DNA, 14 bp, Homo sapiens
ttttaaaaatgcaa

SEQ ID NO: 3479740 - DNA, 21 bp, Homo sapiens
ttttaaaataaactgtaaact

SEQ ID NO: 3479741 - DNA, 16 bp, Homo sapiens
ttttaaaatgcaatgt

SEQ ID NO: 3479742 - DNA, 11 bp, Homo sapiens
ttttaaagaat

SEQ ID NO: 3479743 - DNA, 14 bp, Homo sapiens
ttttaaatgtacag

SEQ ID NO: 3479744 - DNA, 15 bp, Homo sapiens
ttttaaattttgtaa

SEQ ID NO: 3479745 - DNA, 16 bp, Homo sapiens
ttttaaattttgtaat

SEQ ID NO: 3479746 - DNA, 17 bp, Homo sapiens
ttttaaattttgtaatg

SEQ ID NO: 3479747 - DNA, 12 bp, Homo sapiens
ttttaagctgtt

SEQ ID NO: 3479748 - DNA, 17 bp, Homo sapiens
ttttaaggtctttcagt

SEQ ID NO: 3479749 - DNA, 23 bp, Homo sapiens
ttttaaggtctttcagtactttt

SEQ ID NO: 3479750 - DNA, 21 bp, Homo sapiens
ttttaagtattgcatctgtat

SEQ ID NO: 3479751 - DNA, 15 bp, Homo sapiens
ttttaagttaataga

SEQ ID NO: 3479752 - DNA, 23 bp, Homo sapiens
ttttaagttaatagattttttca

SEQ ID NO: 3479753 - DNA, 12 bp, Homo sapiens
ttttaatttagt

SEQ ID NO: 3479754 - DNA, 16 bp, Homo sapiens
ttttacaattgaaatg

SEQ ID NO: 3479755 - DNA, 18 bp, Homo sapiens
ttttacactttatggtaa

SEQ ID NO: 3479756 - DNA, 18 bp, Homo sapiens
ttttacatgtttataaat

SEQ ID NO: 3479757 - DNA, 23 bp, Homo sapiens
ttttacattacagaatatgaatg

SEQ ID NO: 3479758 - DNA, 18 bp, Homo sapiens
ttttactagaaatgggaa

SEQ ID NO: 3479759 - DNA, 12 bp, Homo sapiens
ttttactattaa

SEQ ID NO: 3479760 - DNA, 19 bp, Homo sapiens
ttttactgaagcctttctt

SEQ ID NO: 3479761 - DNA, 14 bp, Homo sapiens
ttttagaaagcatt

SEQ ID NO: 3479762 - DNA, 16 bp, Homo sapiens
ttttagaaagcatttg

SEQ ID NO: 3479763 - DNA, 18 bp, Homo sapiens
ttttagaaagcatttgaa

SEQ ID NO: 3479764 - DNA, 23 bp, Homo sapiens
ttttagaaagcatttgaatgcat

SEQ ID NO: 3479765 - DNA, 21 bp, Homo sapiens
ttttagaggcagggctgcatt

SEQ ID NO: 3479766 - DNA, 21 bp, Homo sapiens
ttttagcaatttatacaatat

SEQ ID NO: 3479767 - DNA, 14 bp, Homo sapiens
ttttaggatactta

SEQ ID NO: 3479768 - DNA, 22 bp, Homo sapiens
ttttataaaatggctgtaatca

SEQ ID NO: 3479769 - DNA, 14 bp, Homo sapiens
ttttatatgtcaaa

SEQ ID NO: 3479770 - DNA, 17 bp, Homo sapiens
ttttatattaatgtact

SEQ ID NO: 3479771 - DNA, 13 bp, Homo sapiens
ttttatatttgta

SEQ ID NO: 3479772 - DNA, 18 bp, Homo sapiens
ttttatgccagttgttaa

SEQ ID NO: 3479773 - DNA, 11 bp, Homo sapiens
ttttattcagc

SEQ ID NO: 3479774 - DNA, 12 bp, Homo sapiens
ttttattcagca

SEQ ID NO: 3479775 - DNA, 19 bp, Homo sapiens
ttttattcagcagactttc

SEQ ID NO: 3479776 - DNA, 19 bp, Homo sapiens
ttttattgaatctatttaa

SEQ ID NO: 3479777 - DNA, 13 bp, Homo sapiens
ttttattgccttc

SEQ ID NO: 3479778 - DNA, 18 bp, Homo sapiens
ttttatttttagacagag

SEQ ID NO: 3479779 - DNA, 14 bp, Homo sapiens
ttttcaaaagataa

SEQ ID NO: 3479780 - DNA, 18 bp, Homo sapiens
ttttcaaaagataatatt

SEQ ID NO: 3479781 - DNA, 21 bp, Homo sapiens
caaagttgagggaaagagctt

SEQ ID NO: 3479782 - DNA, 14 bp, Homo sapiens
caaataataagcaa

SEQ ID NO: 3479783 - DNA, 14 bp, Homo sapiens
caaatactcttagg

SEQ ID NO: 3479784 - DNA, 18 bp, Homo sapiens
caaatataagaataaaat

SEQ ID NO: 3479785 - DNA, 20 bp, Homo sapiens
caaatcaccacaaactgtaa

SEQ ID NO: 3479786 - DNA, 21 bp, Homo sapiens
caaatccgaacctcctctgtg

SEQ ID NO: 3479787 - DNA, 22 bp, Homo sapiens
caaatccgaacctcctctgtga

SEQ ID NO: 3479788 - DNA, 15 bp, Homo sapiens
caaatcctatgtgat

SEQ ID NO: 3479789 - DNA, 17 bp, Homo sapiens
caaatcctatgtgattt

SEQ ID NO: 3479790 - DNA, 17 bp, Homo sapiens
caaatccttagatctgg

SEQ ID NO: 3479791 - DNA, 23 bp, Homo sapiens
caaatctatttaattaggaaaaa

SEQ ID NO: 3479792 - DNA, 13 bp, Homo sapiens
caaatcttgaaat

SEQ ID NO: 3479793 - DNA, 13 bp, Homo sapiens
caaatgagccatg

SEQ ID NO: 3479794 - DNA, 18 bp, Homo sapiens
caaatgcagtatatttct

SEQ ID NO: 3479795 - DNA, 19 bp, Homo sapiens
caaatggaagacacattga

SEQ ID NO: 3479796 - DNA, 15 bp, Homo sapiens
caaatggcactgcag

SEQ ID NO: 3479797 - DNA, 19 bp, Homo sapiens
caaatggcgtctggaagtc

SEQ ID NO: 3479798 - DNA, 19 bp, Homo sapiens
caaatgggatggtatgtga

SEQ ID NO: 3479799 - DNA, 16 bp, Homo sapiens
caaatggggccagatc

SEQ ID NO: 3479800 - DNA, 20 bp, Homo sapiens
caaatggggccagatccagc

SEQ ID NO: 3479801 - DNA, 13 bp, Homo sapiens
caaatggtaggca

SEQ ID NO: 3479802 - DNA, 20 bp, Homo sapiens
caaatggtaggcatttccta

SEQ ID NO: 3479803 - DNA, 16 bp, Homo sapiens
caaatgtttaaacatt

SEQ ID NO: 3479804 - DNA, 18 bp, Homo sapiens
caaattaagatggtaaga

SEQ ID NO: 3479805 - DNA, 17 bp, Homo sapiens
caaattaataatcttat

SEQ ID NO: 3479806 - DNA, 23 bp, Homo sapiens
caaattacaaaaggctcgtttgg

SEQ ID NO: 3479807 - DNA, 12 bp, Homo sapiens
caaattagaaaa

SEQ ID NO: 3479808 - DNA, 14 bp, Homo sapiens
caaattctgtttct

SEQ ID NO: 3479809 - DNA, 16 bp, Homo sapiens
caaattcttttgaatt

SEQ ID NO: 3479810 - DNA, 22 bp, Homo sapiens
caaattgcacagaagtcctgta

SEQ ID NO: 3479811 - DNA, 21 bp, Homo sapiens
caaatttatttttttcttttg

SEQ ID NO: 3479812 - DNA, 15 bp, Homo sapiens
caaattttatctgga

SEQ ID NO: 3479813 - DNA, 22 bp, Homo sapiens
caacaaaggattaattgctgca

SEQ ID NO: 3479814 - DNA, 23 bp, Homo sapiens
caacaaaggattaattgctgcaa

SEQ ID NO: 3479815 - DNA, 18 bp, Homo sapiens
caacaaggaaactttcct

SEQ ID NO: 3479816 - DNA, 17 bp, Homo sapiens
caacaatcctagtgctt

SEQ ID NO: 3479817 - DNA, 18 bp, Homo sapiens
caacaatcctagtgcttt

SEQ ID NO: 3479818 - DNA, 13 bp, Homo sapiens
caacaccaagcac

SEQ ID NO: 3479819 - DNA, 15 bp, Homo sapiens
caacaccaagcacag

SEQ ID NO: 3479820 - DNA, 22 bp, Homo sapiens
caacacctctgcacaagctgca

SEQ ID NO: 3479821 - DNA, 15 bp, Homo sapiens
caacacgcacctgcc

SEQ ID NO: 3479822 - DNA, 13 bp, Homo sapiens
caacactgtgggt

SEQ ID NO: 3479823 - DNA, 21 bp, Homo sapiens
caacactgtgggtgtgtgact

SEQ ID NO: 3479824 - DNA, 15 bp, Homo sapiens
caacagaagaactgt

SEQ ID NO: 3479825 - DNA, 16 bp, Homo sapiens
caacagcctttgaatg

SEQ ID NO: 3479826 - DNA, 23 bp, Homo sapiens
caacagcctttgaatgtaaccaa

SEQ ID NO: 3479827 - DNA, 16 bp, Homo sapiens
caacaggaatctcaga

SEQ ID NO: 3479828 - DNA, 23 bp, Homo sapiens
caacaggctgggcttcagtggca

SEQ ID NO: 3479829 - DNA, 22 bp, Homo sapiens
caacagttttcctatgctttga

SEQ ID NO: 3479830 - DNA, 14 bp, Homo sapiens
caacatctgagtgc

SEQ ID NO: 3479831 - DNA, 13 bp, Homo sapiens
caacatcttttta

SEQ ID NO: 3479832 - DNA, 15 bp, Homo sapiens
caacatggtgtctgg

SEQ ID NO: 3479833 - DNA, 16 bp, Homo sapiens
caacatggtgtctgga

SEQ ID NO: 3479834 - DNA, 18 bp, Homo sapiens
caacatgtggctcctccc

SEQ ID NO: 3479835 - DNA, 21 bp, Homo sapiens
caacatgtggctcctcccagc

SEQ ID NO: 3479836 - DNA, 19 bp, Homo sapiens
caacatgttgggaaacttg

SEQ ID NO: 3479837 - DNA, 16 bp, Homo sapiens
caacattgtgatgtat

SEQ ID NO: 3479838 - DNA, 17 bp, Homo sapiens
caacatttattttgaga

SEQ ID NO: 3479839 - DNA, 14 bp, Homo sapiens
caacattttcttga

SEQ ID NO: 3479840 - DNA, 17 bp, Homo sapiens
caacattttcttgaatt

SEQ ID NO: 3479841 - DNA, 19 bp, Homo sapiens
caacattttgagaacaaag

SEQ ID NO: 3479842 - DNA, 21 bp, Homo sapiens
caaccactaagaattcaaact

SEQ ID NO: 3479843 - DNA, 22 bp, Homo sapiens
caaccagcatcccttgaccagg

SEQ ID NO: 3479844 - DNA, 17 bp, Homo sapiens
caaccagctaagaaaag

SEQ ID NO: 3479845 - DNA, 14 bp, Homo sapiens
caaccataaaagaa

SEQ ID NO: 3479846 - DNA, 20 bp, Homo sapiens
caaccccagggcccccacag

SEQ ID NO: 3479847 - DNA, 22 bp, Homo sapiens
caaccccagggcccccacaggc

SEQ ID NO: 3479848 - DNA, 14 bp, Homo sapiens
caacccccagcctg

SEQ ID NO: 3479849 - DNA, 17 bp, Homo sapiens
caacccccagcctgcta

SEQ ID NO: 3479850 - DNA, 16 bp, Homo sapiens
caaccccttcgctcct

SEQ ID NO: 3479851 - DNA, 19 bp, Homo sapiens
caaccccttcgctcctgtg

SEQ ID NO: 3479852 - DNA, 22 bp, Homo sapiens
caaccccttcgctcctgtgtct

SEQ ID NO: 3479853 - DNA, 12 bp, Homo sapiens
caaccctcagcc

SEQ ID NO: 3479854 - DNA, 13 bp, Homo sapiens
caaccctcagcct

SEQ ID NO: 3479855 - DNA, 14 bp, Homo sapiens
caaccctcagcctt

SEQ ID NO: 3479856 - DNA, 16 bp, Homo sapiens
caaccctggggaagga

SEQ ID NO: 3479857 - DNA, 21 bp, Homo sapiens
caaccctggggaaggagccag

SEQ ID NO: 3479858 - DNA, 17 bp, Homo sapiens
caacccttccctcacct

SEQ ID NO: 3479859 - DNA, 16 bp, Homo sapiens
caacctattttgaagt

SEQ ID NO: 3479860 - DNA, 15 bp, Homo sapiens
caacctcctgggcta

SEQ ID NO: 3479861 - DNA, 17 bp, Homo sapiens
caacctcttctggctca

SEQ ID NO: 3479862 - DNA, 13 bp, Homo sapiens
caacctgaaccta

SEQ ID NO: 3479863 - DNA, 17 bp, Homo sapiens
caacctgcaaagatctg

SEQ ID NO: 3479864 - DNA, 21 bp, Homo sapiens
caacctgcctgacatttggag

SEQ ID NO: 3479865 - DNA, 20 bp, Homo sapiens
caacctggggggcagtggtg

SEQ ID NO: 3479866 - DNA, 18 bp, Homo sapiens
caaccttagatgttctaa

SEQ ID NO: 3479867 - DNA, 14 bp, Homo sapiens
caaccttggccttc

SEQ ID NO: 3479868 - DNA, 16 bp, Homo sapiens
caaccttggccttctc

SEQ ID NO: 3479869 - DNA, 20 bp, Homo sapiens
caacggccctgcagccagct

SEQ ID NO: 3479870 - DNA, 19 bp, Homo sapiens
caacgtgcaaagccaaggc

SEQ ID NO: 3479871 - DNA, 16 bp, Homo sapiens
caacgtgcattgtgct

SEQ ID NO: 3479872 - DNA, 17 bp, Homo sapiens
caacgtgcattgtgctt

SEQ ID NO: 3479873 - DNA, 18 bp, Homo sapiens
caacgtgcattgtgcttc

SEQ ID NO: 3479874 - DNA, 23 bp, Homo sapiens
caacgttgtactgtatgtgatga

SEQ ID NO: 3479875 - DNA, 22 bp, Homo sapiens
caacgtttggaagatcctgtga

SEQ ID NO: 3479876 - DNA, 16 bp, Homo sapiens
caactacccaaaacaa

SEQ ID NO: 3479877 - DNA, 18 bp, Homo sapiens
caactagcccctggggtg

SEQ ID NO: 3479878 - DNA, 12 bp, Homo sapiens
caactatgtagg

SEQ ID NO: 3479879 - DNA, 13 bp, Homo sapiens
caactatgtaggt

SEQ ID NO: 3479880 - DNA, 23 bp, Homo sapiens
caactcagtccctaaaaacacag

SEQ ID NO: 3479881 - DNA, 14 bp, Homo sapiens
caactcattccaga

SEQ ID NO: 3479882 - DNA, 15 bp, Homo sapiens
caactcattccagat

SEQ ID NO: 3479883 - DNA, 12 bp, Homo sapiens
caactcctccca

SEQ ID NO: 3479884 - DNA, 18 bp, Homo sapiens
caactcttgattatccat

SEQ ID NO: 3479885 - DNA, 14 bp, Homo sapiens
caactctttgagaa

SEQ ID NO: 3479886 - DNA, 15 bp, Homo sapiens
caactctttgagaaa

SEQ ID NO: 3479887 - DNA, 21 bp, Homo sapiens
caactgaaggctaaaaagcaa

SEQ ID NO: 3479888 - DNA, 16 bp, Homo sapiens
caactgcattggcttt

SEQ ID NO: 3479889 - DNA, 13 bp, Homo sapiens
caactgctcagct

SEQ ID NO: 3479890 - DNA, 14 bp, Homo sapiens
caacttacaaaaac

SEQ ID NO: 3479891 - DNA, 18 bp, Homo sapiens
caacttacaaaaacactt

SEQ ID NO: 3479892 - DNA, 11 bp, Homo sapiens
caacttattaa

SEQ ID NO: 3479893 - DNA, 14 bp, Homo sapiens
caacttgcttatca

SEQ ID NO: 3479894 - DNA, 18 bp, Homo sapiens
caacttgtatccaggcct

SEQ ID NO: 3479895 - DNA, 23 bp, Homo sapiens
caacttgtattaaagacagaggc

SEQ ID NO: 3479896 - DNA, 12 bp, Homo sapiens
caactttgaata

SEQ ID NO: 3479897 - DNA, 22 bp, Homo sapiens
caactttgaataaagaatactt

SEQ ID NO: 3479898 - DNA, 21 bp, Homo sapiens
caccatccctttttgaagtgt

SEQ ID NO: 3479899 - DNA, 23 bp, Homo sapiens
caccatcttaagagatgcctcat

SEQ ID NO: 3479900 - DNA, 15 bp, Homo sapiens
caccatgatggccag

SEQ ID NO: 3479901 - DNA, 20 bp, Homo sapiens
caccatgttgcccaggctgg

SEQ ID NO: 3479902 - DNA, 14 bp, Homo sapiens
cacccaagagggct

SEQ ID NO: 3479903 - DNA, 14 bp, Homo sapiens
cacccaattccact

SEQ ID NO: 3479904 - DNA, 22 bp, Homo sapiens
cacccaccatcatgtctggcta

SEQ ID NO: 3479905 - DNA, 14 bp, Homo sapiens
cacccacccctgca

SEQ ID NO: 3479906 - DNA, 14 bp, Homo sapiens
cacccaccctggga

SEQ ID NO: 3479907 - DNA, 18 bp, Homo sapiens
cacccacctcagcctccc

SEQ ID NO: 3479908 - DNA, 15 bp, Homo sapiens
cacccacctccctgc

SEQ ID NO: 3479909 - DNA, 17 bp, Homo sapiens
cacccagatcagactct

SEQ ID NO: 3479910 - DNA, 12 bp, Homo sapiens
cacccagcccac

SEQ ID NO: 3479911 - DNA, 20 bp, Homo sapiens
cacccaggagccccgaggcc

SEQ ID NO: 3479912 - DNA, 24 bp, Homo sapiens
cacccaggagccccgaggccttct

SEQ ID NO: 3479913 - DNA, 19 bp, Homo sapiens
caccccaggaaaagcacaa

SEQ ID NO: 3479914 - DNA, 22 bp, Homo sapiens
caccccagggcctgagcctggc

SEQ ID NO: 3479915 - DNA, 12 bp, Homo sapiens
caccccatccca

SEQ ID NO: 3479916 - DNA, 14 bp, Homo sapiens
cacccccagttcct

SEQ ID NO: 3479917 - DNA, 16 bp, Homo sapiens
caccccctccccgccc

SEQ ID NO: 3479918 - DNA, 18 bp, Homo sapiens
cacccccttctccatcca

SEQ ID NO: 3479919 - DNA, 17 bp, Homo sapiens
cacccctaaactccagg

SEQ ID NO: 3479920 - DNA, 20 bp, Homo sapiens
cacccctcaacacctctgca

SEQ ID NO: 3479921 - DNA, 13 bp, Homo sapiens
cacccctccccat

SEQ ID NO: 3479922 - DNA, 15 bp, Homo sapiens
cacccggctgcagag

SEQ ID NO: 3479923 - DNA, 21 bp, Homo sapiens
cacccggctgcagaggccaga

SEQ ID NO: 3479924 - DNA, 14 bp, Homo sapiens
caccctcaggcagg

SEQ ID NO: 3479925 - DNA, 19 bp, Homo sapiens
caccctcataccatctgct

SEQ ID NO: 3479926 - DNA, 17 bp, Homo sapiens
caccctcattctactga

SEQ ID NO: 3479927 - DNA, 12 bp, Homo sapiens
caccctcctttc

SEQ ID NO: 3479928 - DNA, 14 bp, Homo sapiens
caccctgcagagca

SEQ ID NO: 3479929 - DNA, 19 bp, Homo sapiens
caccctgcagagcacacag

SEQ ID NO: 3479930 - DNA, 12 bp, Homo sapiens
caccctgctctc

SEQ ID NO: 3479931 - DNA, 21 bp, Homo sapiens
caccctggccgagtccaagct

SEQ ID NO: 3479932 - DNA, 22 bp, Homo sapiens
caccctggccgagtccaagctg

SEQ ID NO: 3479933 - DNA, 12 bp, Homo sapiens
caccctgggccc

SEQ ID NO: 3479934 - DNA, 21 bp, Homo sapiens
caccctgggccctgggctgga

SEQ ID NO: 3479935 - DNA, 22 bp, Homo sapiens
caccctgggccctgggctggaa

SEQ ID NO: 3479936 - DNA, 17 bp, Homo sapiens
caccctggggagaaagt

SEQ ID NO: 3479937 - DNA, 16 bp, Homo sapiens
caccctgtcttcctct

SEQ ID NO: 3479938 - DNA, 14 bp, Homo sapiens
caccgggcactcag

SEQ ID NO: 3479939 - DNA, 17 bp, Homo sapiens
caccgtgggctccctga

SEQ ID NO: 3479940 - DNA, 18 bp, Homo sapiens
caccgtgggctccctgac

SEQ ID NO: 3479941 - DNA, 17 bp, Homo sapiens
cacctaatccaggcaga

SEQ ID NO: 3479942 - DNA, 22 bp, Homo sapiens
cacctaatccaggcagatccag

SEQ ID NO: 3479943 - DNA, 14 bp, Homo sapiens
cacctacatcccca

SEQ ID NO: 3479944 - DNA, 22 bp, Homo sapiens
cacctagagcttttttataaca

SEQ ID NO: 3479945 - DNA, 13 bp, Homo sapiens
cacctatttccat

SEQ ID NO: 3479946 - DNA, 13 bp, Homo sapiens
cacctcagcctcc

SEQ ID NO: 3479947 - DNA, 21 bp, Homo sapiens
cacctccctatactgcttgga

SEQ ID NO: 3479948 - DNA, 14 bp, Homo sapiens
cacctccttcaatt

SEQ ID NO: 3479949 - DNA, 19 bp, Homo sapiens
cacctctgcacaagctgca

SEQ ID NO: 3479950 - DNA, 19 bp, Homo sapiens
cacctcttccactccttct

SEQ ID NO: 3479951 - DNA, 17 bp, Homo sapiens
cacctgacgtcagtagt

SEQ ID NO: 3479952 - DNA, 16 bp, Homo sapiens
cacctgagcaggacct

SEQ ID NO: 3479953 - DNA, 16 bp, Homo sapiens
cacctgattcaactaa

SEQ ID NO: 3479954 - DNA, 18 bp, Homo sapiens
cacctgattcaactaaaa

SEQ ID NO: 3479955 - DNA, 15 bp, Homo sapiens
cacctgccccaactc

SEQ ID NO: 3479956 - DNA, 16 bp, Homo sapiens
cacctgccccaactct

SEQ ID NO: 3479957 - DNA, 18 bp, Homo sapiens
cacctgccctgtgcatgt

SEQ ID NO: 3479958 - DNA, 19 bp, Homo sapiens
cacctggccgcctccagga

SEQ ID NO: 3479959 - DNA, 22 bp, Homo sapiens
cacctggccgcctccaggagcc

SEQ ID NO: 3479960 - DNA, 19 bp, Homo sapiens
cacctgtaggcagaggctg

SEQ ID NO: 3479961 - DNA, 13 bp, Homo sapiens
cacctgtcaaaca

SEQ ID NO: 3479962 - DNA, 23 bp, Homo sapiens
cacctgtcaaacaaagccagaag

SEQ ID NO: 3479963 - DNA, 19 bp, Homo sapiens
cacctgtctcagcctccca

SEQ ID NO: 3479964 - DNA, 23 bp, Homo sapiens
caccttcgtttactatgcctgtg

SEQ ID NO: 3479965 - DNA, 15 bp, Homo sapiens
caccttgacagggca

SEQ ID NO: 3479966 - DNA, 19 bp, Homo sapiens
caccttgacagggcacacc

SEQ ID NO: 3479967 - DNA, 18 bp, Homo sapiens
caccttggacatcctcct

SEQ ID NO: 3479968 - DNA, 15 bp, Homo sapiens
caccttggctcaagt

SEQ ID NO: 3479969 - DNA, 13 bp, Homo sapiens
caccttggctgca

SEQ ID NO: 3479970 - DNA, 16 bp, Homo sapiens
caccttggctgcaggg

SEQ ID NO: 3479971 - DNA, 14 bp, Homo sapiens
cacctttactttag

SEQ ID NO: 3479972 - DNA, 13 bp, Homo sapiens
cacctttgtagca

SEQ ID NO: 3479973 - DNA, 17 bp, Homo sapiens
cacgacctaggcagtag

SEQ ID NO: 3479974 - DNA, 13 bp, Homo sapiens
cacgactgtctcc

SEQ ID NO: 3479975 - DNA, 12 bp, Homo sapiens
cacgagccacct

SEQ ID NO: 3479976 - DNA, 23 bp, Homo sapiens
cacgaggaatctgtgggtctggg

SEQ ID NO: 3479977 - DNA, 22 bp, Homo sapiens
cacgagggctggctggcctcac

SEQ ID NO: 3479978 - DNA, 22 bp, Homo sapiens
cacgattggtatgatgctgccg

SEQ ID NO: 3479979 - DNA, 12 bp, Homo sapiens
cacgcacctccc

SEQ ID NO: 3479980 - DNA, 14 bp, Homo sapiens
cacgcacctcccat

SEQ ID NO: 3479981 - DNA, 19 bp, Homo sapiens
cacgcacctcccatcctaa

SEQ ID NO: 3479982 - DNA, 15 bp, Homo sapiens
cacgcacctgcctca

SEQ ID NO: 3479983 - DNA, 11 bp, Homo sapiens
cacgccacagc

SEQ ID NO: 3479984 - DNA, 16 bp, Homo sapiens
cacgcccgtcctgcct

SEQ ID NO: 3479985 - DNA, 20 bp, Homo sapiens
cacgcccgtcctgcctgtgg

SEQ ID NO: 3479986 - DNA, 16 bp, Homo sapiens
cacgcctcccactggg

SEQ ID NO: 3479987 - DNA, 22 bp, Homo sapiens
cacgcctcccactggggtccag

SEQ ID NO: 3479988 - DNA, 13 bp, Homo sapiens
cacgcctgaaact

SEQ ID NO: 3479989 - DNA, 16 bp, Homo sapiens
cacgcctgaaactttg

SEQ ID NO: 3479990 - DNA, 19 bp, Homo sapiens
cacgcctgtaatcccagca

SEQ ID NO: 3479991 - DNA, 19 bp, Homo sapiens
cacgcctgtaatcctagca

SEQ ID NO: 3479992 - DNA, 20 bp, Homo sapiens
cacgcctgtaatcctagcac

SEQ ID NO: 3479993 - DNA, 12 bp, Homo sapiens
cacgctccagct

SEQ ID NO: 3479994 - DNA, 18 bp, Homo sapiens
cacgctggagtgcagtga

SEQ ID NO: 3479995 - DNA, 14 bp, Homo sapiens
cacgcttcacagtg

SEQ ID NO: 3479996 - DNA, 20 bp, Homo sapiens
cacggagcagttcagagtgg

SEQ ID NO: 3479997 - DNA, 17 bp, Homo sapiens
cacggagccactcctct

SEQ ID NO: 3479998 - DNA, 19 bp, Homo sapiens
cacggagcccagccctccc

SEQ ID NO: 3479999 - DNA, 13 bp, Homo sapiens
cacggatctgaga

SEQ ID NO: 3480000 - DNA, 14 bp, Homo sapiens
cacggatctgagaa

SEQ ID NO: 3480001 - DNA, 20 bp, Homo sapiens
cacggcaggacaacgaggaa

SEQ ID NO: 3480002 - DNA, 21 bp, Homo sapiens
cacggcaggacaacgaggaag

SEQ ID NO: 3480003 - DNA, 22 bp, Homo sapiens
cacggcaggacaacgaggaagc

SEQ ID NO: 3480004 - DNA, 19 bp, Homo sapiens
cacggccacatcaaagagg

SEQ ID NO: 3480005 - DNA, 12 bp, Homo sapiens
cacggccaggcc

SEQ ID NO: 3480006 - DNA, 13 bp, Homo sapiens
cacggccaggcca

SEQ ID NO: 3480007 - DNA, 15 bp, Homo sapiens
cacggccaggccaga

SEQ ID NO: 3480008 - DNA, 16 bp, Homo sapiens
cacggctcactgcagc

SEQ ID NO: 3480009 - DNA, 17 bp, Homo sapiens
cacggctcactgcagcc

SEQ ID NO: 3480010 - DNA, 23 bp, Homo sapiens
cacggctcccccaggcctgagct

SEQ ID NO: 3480011 - DNA, 13 bp, Homo sapiens
cacggctgctgag

SEQ ID NO: 3480012 - DNA, 16 bp, Homo sapiens
cacggtcttccctctt

SEQ ID NO: 3480013 - DNA, 17 bp, Homo sapiens
cacggtgccttttttca

SEQ ID NO: 3480014 - DNA, 17 bp, Homo sapiens
cacggtttgaagcctgg

SEQ ID NO: 3480015 - DNA, 20 bp, Homo sapiens
cacggtttgaagcctggaac

SEQ ID NO: 3480016 - DNA, 18 bp, Homo sapiens
cacgtacacacacataca

SEQ ID NO: 3480017 - DNA, 16 bp, Homo sapiens
cacgtgtttgtgctgt

SEQ ID NO: 3480018 - DNA, 16 bp, Homo sapiens
cacgttgcctctactt

SEQ ID NO: 3480019 - DNA, 18 bp, Homo sapiens
cacgttttgttttgtgcc

SEQ ID NO: 3480020 - DNA, 17 bp, Homo sapiens
cactaaagtatcctgac

SEQ ID NO: 3480021 - DNA, 14 bp, Homo sapiens
cactaaccacgctg

SEQ ID NO: 3480022 - DNA, 13 bp, Homo sapiens
cactaagcagagg

SEQ ID NO: 3480023 - DNA, 15 bp, Homo sapiens
cactaagcagaggag

SEQ ID NO: 3480024 - DNA, 20 bp, Homo sapiens
cactaagcagaggaggggcc

SEQ ID NO: 3480025 - DNA, 21 bp, Homo sapiens
cactaagcagaggaggggccg

SEQ ID NO: 3480026 - DNA, 17 bp, Homo sapiens
cactaaggtgtgctctg

SEQ ID NO: 3480027 - DNA, 18 bp, Homo sapiens
cactaatttttgtattat

SEQ ID NO: 3480028 - DNA, 19 bp, Homo sapiens
cactaatttttgtattatt

SEQ ID NO: 3480029 - DNA, 20 bp, Homo sapiens
cactaatttttgtattattt

SEQ ID NO: 3480030 - DNA, 23 bp, Homo sapiens
cactaatttttgtattatttttg

SEQ ID NO: 3480031 - DNA, 22 bp, Homo sapiens
cagagctaaactccttcctggc

SEQ ID NO: 3480032 - DNA, 19 bp, Homo sapiens
cagagctgacacaggatga

SEQ ID NO: 3480033 - DNA, 18 bp, Homo sapiens
cagagctggtggacccag

SEQ ID NO: 3480034 - DNA, 20 bp, Homo sapiens
cagagctggtggacccaggg

SEQ ID NO: 3480035 - DNA, 21 bp, Homo sapiens
cagagctggtggacccaggga

SEQ ID NO: 3480036 - DNA, 23 bp, Homo sapiens
cagagcttcttccaggtgcccag

SEQ ID NO: 3480037 - DNA, 16 bp, Homo sapiens
cagagcttggactgga

SEQ ID NO: 3480038 - DNA, 20 bp, Homo sapiens
cagaggaaggggccagaggc

SEQ ID NO: 3480039 - DNA, 14 bp, Homo sapiens
cagaggactgtgat

SEQ ID NO: 3480040 - DNA, 22 bp, Homo sapiens
cagaggagagatagcctgtggc

SEQ ID NO: 3480041 - DNA, 23 bp, Homo sapiens
cagaggagagatagcctgtggcc

SEQ ID NO: 3480042 - DNA, 15 bp, Homo sapiens
cagaggatgagctct

SEQ ID NO: 3480043 - DNA, 17 bp, Homo sapiens
cagaggatgagctctac

SEQ ID NO: 3480044 - DNA, 23 bp, Homo sapiens
cagaggcagccccattctgcctg

SEQ ID NO: 3480045 - DNA, 14 bp, Homo sapiens
cagaggccaacact

SEQ ID NO: 3480046 - DNA, 20 bp, Homo sapiens
cagaggccagaggcccccag

SEQ ID NO: 3480047 - DNA, 16 bp, Homo sapiens
cagaggccatgggcct

SEQ ID NO: 3480048 - DNA, 13 bp, Homo sapiens
cagaggccccagc

SEQ ID NO: 3480049 - DNA, 24 bp, Homo sapiens
cagaggcccccagcccagggctcc

SEQ ID NO: 3480050 - DNA, 12 bp, Homo sapiens
cagaggcctctt

SEQ ID NO: 3480051 - DNA, 23 bp, Homo sapiens
cagaggcctgggggacccctggc

SEQ ID NO: 3480052 - DNA, 15 bp, Homo sapiens
cagaggctgcaggac

SEQ ID NO: 3480053 - DNA, 14 bp, Homo sapiens
cagaggctgcccca

SEQ ID NO: 3480054 - DNA, 18 bp, Homo sapiens
cagagggagtgacagagg

SEQ ID NO: 3480055 - DNA, 21 bp, Homo sapiens
cagagggagtgacagaggcag

SEQ ID NO: 3480056 - DNA, 23 bp, Homo sapiens
cagagggagtgacagaggcagcc

SEQ ID NO: 3480057 - DNA, 14 bp, Homo sapiens
cagagggcactctg

SEQ ID NO: 3480058 - DNA, 15 bp, Homo sapiens
cagagggctggaggc

SEQ ID NO: 3480059 - DNA, 18 bp, Homo sapiens
cagaggtctccaaactga

SEQ ID NO: 3480060 - DNA, 14 bp, Homo sapiens
cagaggtgcttcac

SEQ ID NO: 3480061 - DNA, 21 bp, Homo sapiens
cagaggttatctgtcccaggt

SEQ ID NO: 3480062 - DNA, 14 bp, Homo sapiens
cagagtatggagct

SEQ ID NO: 3480063 - DNA, 19 bp, Homo sapiens
cagagtcacaagcctcgag

SEQ ID NO: 3480064 - DNA, 22 bp, Homo sapiens
cagagtcacaagcctcgaggtg

SEQ ID NO: 3480065 - DNA, 18 bp, Homo sapiens
cagagtcggaacggagaa

SEQ ID NO: 3480066 - DNA, 23 bp, Homo sapiens
cagagtcggaacggagaaaggtg

SEQ ID NO: 3480067 - DNA, 13 bp, Homo sapiens
cagagtctcactg

SEQ ID NO: 3480068 - DNA, 20 bp, Homo sapiens
cagagtctcactgttgccca

SEQ ID NO: 3480069 - DNA, 22 bp, Homo sapiens
cagagtgacacccaagagggct

SEQ ID NO: 3480070 - DNA, 23 bp, Homo sapiens
cagagtgacacccaagagggctg

SEQ ID NO: 3480071 - DNA, 13 bp, Homo sapiens
cagagttgtaaat

SEQ ID NO: 3480072 - DNA, 19 bp, Homo sapiens
cagagttgtaaatatataa

SEQ ID NO: 3480073 - DNA, 22 bp, Homo sapiens
cagataaggtaaaatgccatga

SEQ ID NO: 3480074 - DNA, 14 bp, Homo sapiens
cagataatgtgaaa

SEQ ID NO: 3480075 - DNA, 14 bp, Homo sapiens
cagatacacacaca

SEQ ID NO: 3480076 - DNA, 19 bp, Homo sapiens
cagatacttggggggctga

SEQ ID NO: 3480077 - DNA, 21 bp, Homo sapiens
cagatatgtttttatttaaaa

SEQ ID NO: 3480078 - DNA, 14 bp, Homo sapiens
cagatcacagtgtc

SEQ ID NO: 3480079 - DNA, 16 bp, Homo sapiens
cagatcagtgtaccat

SEQ ID NO: 3480080 - DNA, 15 bp, Homo sapiens
cagatccagcctggg

SEQ ID NO: 3480081 - DNA, 17 bp, Homo sapiens
cagatccagcctggggt

SEQ ID NO: 3480082 - DNA, 13 bp, Homo sapiens
cagatccagggac

SEQ ID NO: 3480083 - DNA, 19 bp, Homo sapiens
cagatcctctctggggctg

SEQ ID NO: 3480084 - DNA, 22 bp, Homo sapiens
cagatctcatggaaactggcca

SEQ ID NO: 3480085 - DNA, 18 bp, Homo sapiens
cagatctggaacctcagc

SEQ ID NO: 3480086 - DNA, 15 bp, Homo sapiens
cagatcttggactca

SEQ ID NO: 3480087 - DNA, 19 bp, Homo sapiens
cagatcttggactcatgag

SEQ ID NO: 3480088 - DNA, 23 bp, Homo sapiens
cagatgaatgtatttatttggga

SEQ ID NO: 3480089 - DNA, 17 bp, Homo sapiens
cagatgacaacagccgt

SEQ ID NO: 3480090 - DNA, 16 bp, Homo sapiens
cagatgaggctttcca

SEQ ID NO: 3480091 - DNA, 18 bp, Homo sapiens
cagatgatttcccccctc

SEQ ID NO: 3480092 - DNA, 23 bp, Homo sapiens
cagatgcaaagaggcaagaggct

SEQ ID NO: 3480093 - DNA, 14 bp, Homo sapiens
cagatgcaccagcc

SEQ ID NO: 3480094 - DNA, 22 bp, Homo sapiens
cagatgcaccagcccttagcag

SEQ ID NO: 3480095 - DNA, 19 bp, Homo sapiens
cagatgcccgagggagggg

SEQ ID NO: 3480096 - DNA, 21 bp, Homo sapiens
cagatgcctacttttggcctc

SEQ ID NO: 3480097 - DNA, 14 bp, Homo sapiens
cagatggaaccgca

SEQ ID NO: 3480098 - DNA, 18 bp, Homo sapiens
cagatggaaccgcaggaa

SEQ ID NO: 3480099 - DNA, 18 bp, Homo sapiens
cagatggactccagcctg

SEQ ID NO: 3480100 - DNA, 19 bp, Homo sapiens
cagatggactccagcctgc

SEQ ID NO: 3480101 - DNA, 14 bp, Homo sapiens
cagatggcagatgc

SEQ ID NO: 3480102 - DNA, 19 bp, Homo sapiens
cagatgggggaaagcacag

SEQ ID NO: 3480103 - DNA, 14 bp, Homo sapiens
cagatggttgtgta

SEQ ID NO: 3480104 - DNA, 17 bp, Homo sapiens
cagatggttgtgtatgg

SEQ ID NO: 3480105 - DNA, 19 bp, Homo sapiens
cagatggtttccacattta

SEQ ID NO: 3480106 - DNA, 15 bp, Homo sapiens
cagatgtaatgtttt

SEQ ID NO: 3480107 - DNA, 17 bp, Homo sapiens
cagatgttcccccatct

SEQ ID NO: 3480108 - DNA, 14 bp, Homo sapiens
cagatgtttccaga

SEQ ID NO: 3480109 - DNA, 22 bp, Homo sapiens
cagatgtttcttttgtatgtaa

SEQ ID NO: 3480110 - DNA, 12 bp, Homo sapiens
cagattaatatt

SEQ ID NO: 3480111 - DNA, 22 bp, Homo sapiens
cagattatctatttgtgtgtgt

SEQ ID NO: 3480112 - DNA, 14 bp, Homo sapiens
cagattcacactgt

SEQ ID NO: 3480113 - DNA, 12 bp, Homo sapiens
cagattcttcag

SEQ ID NO: 3480114 - DNA, 20 bp, Homo sapiens
cagattgtcttaatttctat

SEQ ID NO: 3480115 - DNA, 20 bp, Homo sapiens
cagattgtggaatgttggat

SEQ ID NO: 3480116 - DNA, 16 bp, Homo sapiens
cagatttccagtctcc

SEQ ID NO: 3480117 - DNA, 14 bp, Homo sapiens
cagatttgggctgg

SEQ ID NO: 3480118 - DNA, 15 bp, Homo sapiens
cagatttgggctgga

SEQ ID NO: 3480119 - DNA, 18 bp, Homo sapiens
cagatttgggctggaaca

SEQ ID NO: 3480120 - DNA, 16 bp, Homo sapiens
cagattttgatagcaa

SEQ ID NO: 3480121 - DNA, 18 bp, Homo sapiens
cagattttgatagcaaag

SEQ ID NO: 3480122 - DNA, 17 bp, Homo sapiens
cagattttgctgtatat

SEQ ID NO: 3480123 - DNA, 19 bp, Homo sapiens
cagattttgctgtatattt

SEQ ID NO: 3480124 - DNA, 12 bp, Homo sapiens
cagcaaaccatt

SEQ ID NO: 3480125 - DNA, 20 bp, Homo sapiens
cagcaacaggaatctcagag

SEQ ID NO: 3480126 - DNA, 14 bp, Homo sapiens
cagcaacattttct

SEQ ID NO: 3480127 - DNA, 13 bp, Homo sapiens
cagcaaccccagg

SEQ ID NO: 3480128 - DNA, 16 bp, Homo sapiens
cagcaaccccaggctg

SEQ ID NO: 3480129 - DNA, 12 bp, Homo sapiens
cagcaagtgaga

SEQ ID NO: 3480130 - DNA, 19 bp, Homo sapiens
cagcaagtgagagctgggt

SEQ ID NO: 3480131 - DNA, 22 bp, Homo sapiens
cagcaagtggtcctagaggccc

SEQ ID NO: 3480132 - DNA, 13 bp, Homo sapiens
cagcacaaggcca

SEQ ID NO: 3480133 - DNA, 13 bp, Homo sapiens
cagcacacagggc

SEQ ID NO: 3480134 - DNA, 19 bp, Homo sapiens
cagcacacagggcagtgag

SEQ ID NO: 3480135 - DNA, 16 bp, Homo sapiens
cagcacagcttgacct

SEQ ID NO: 3480136 - DNA, 20 bp, Homo sapiens
cagcacagcttgacctgagg

SEQ ID NO: 3480137 - DNA, 12 bp, Homo sapiens
cagcaccccagt

SEQ ID NO: 3480138 - DNA, 13 bp, Homo sapiens
cagcacctgtctc

SEQ ID NO: 3480139 - DNA, 20 bp, Homo sapiens
cagcactatgacattttggg

SEQ ID NO: 3480140 - DNA, 13 bp, Homo sapiens
cagcactgaggaa

SEQ ID NO: 3480141 - DNA, 12 bp, Homo sapiens
cagcacttccat

SEQ ID NO: 3480142 - DNA, 14 bp, Homo sapiens
cagcagaaccagcc

SEQ ID NO: 3480143 - DNA, 16 bp, Homo sapiens
cagcagaaccagcctc

SEQ ID NO: 3480144 - DNA, 17 bp, Homo sapiens
cagcagaaccagcctca

SEQ ID NO: 3480145 - DNA, 15 bp, Homo sapiens
cagcagaagacaaaa

SEQ ID NO: 3480146 - DNA, 21 bp, Homo sapiens
cagcagactggtttgcagtga

SEQ ID NO: 3480147 - DNA, 19 bp, Homo sapiens
cagcagactttctctgtgt

SEQ ID NO: 3480148 - DNA, 15 bp, Homo sapiens
cagcagcaaattttc

SEQ ID NO: 3480149 - DNA, 18 bp, Homo sapiens
cagcagcctggaccctgt

SEQ ID NO: 3480150 - DNA, 17 bp, Homo sapiens
cagcagcggaaccgccc

SEQ ID NO: 3480151 - DNA, 22 bp, Homo sapiens
cagcaggatcgaagggttttta

SEQ ID NO: 3480152 - DNA, 23 bp, Homo sapiens
cagcagggaaaatgcagcaggga

SEQ ID NO: 3480153 - DNA, 18 bp, Homo sapiens
cagcagggagggcttctg

SEQ ID NO: 3480154 - DNA, 22 bp, Homo sapiens
cagcagggatgccctggaggtg

SEQ ID NO: 3480155 - DNA, 11 bp, Homo sapiens
cagcagggcta

SEQ ID NO: 3480156 - DNA, 21 bp, Homo sapiens
cagcagggctaccctgagctg

SEQ ID NO: 3480157 - DNA, 16 bp, Homo sapiens
cagcaggtagcctgct

SEQ ID NO: 3480158 - DNA, 17 bp, Homo sapiens
cagcagtctctgccttg

SEQ ID NO: 3480159 - DNA, 19 bp, Homo sapiens
cagcagtgtgaggccaggg

SEQ ID NO: 3480160 - DNA, 20 bp, Homo sapiens
cagcagtgtgaggccagggc

SEQ ID NO: 3480161 - DNA, 17 bp, Homo sapiens
cagcatagaagtaactt

SEQ ID NO: 3480162 - DNA, 16 bp, Homo sapiens
cagcatatacaataat

SEQ ID NO: 3480163 - DNA, 19 bp, Homo sapiens
caggggctgcttcctcctg

SEQ ID NO: 3480164 - DNA, 22 bp, Homo sapiens
caggggctgcttcctcctggaa

SEQ ID NO: 3480165 - DNA, 17 bp, Homo sapiens
cagggggacctaggctc

SEQ ID NO: 3480166 - DNA, 22 bp, Homo sapiens
cagggggatgccactcctccct

SEQ ID NO: 3480167 - DNA, 19 bp, Homo sapiens
cagggtcagaaacaggacc

SEQ ID NO: 3480168 - DNA, 21 bp, Homo sapiens
cagggtctcactatgttgccc

SEQ ID NO: 3480169 - DNA, 22 bp, Homo sapiens
cagggtctcactatgttgccca

SEQ ID NO: 3480170 - DNA, 16 bp, Homo sapiens
cagggtctcactctgt

SEQ ID NO: 3480171 - DNA, 21 bp, Homo sapiens
cagggtctcactctgtcgccc

SEQ ID NO: 3480172 - DNA, 21 bp, Homo sapiens
cagggtctctaccatcccctg

SEQ ID NO: 3480173 - DNA, 15 bp, Homo sapiens
cagggtctgggcagg

SEQ ID NO: 3480174 - DNA, 15 bp, Homo sapiens
cagggttaagaagac

SEQ ID NO: 3480175 - DNA, 22 bp, Homo sapiens
cagggttcaagccttccaggga

SEQ ID NO: 3480176 - DNA, 14 bp, Homo sapiens
cagggttggcccct

SEQ ID NO: 3480177 - DNA, 17 bp, Homo sapiens
cagggttggcccctgcc

SEQ ID NO: 3480178 - DNA, 14 bp, Homo sapiens
caggtaacaggcag

SEQ ID NO: 3480179 - DNA, 15 bp, Homo sapiens
caggtaacaggcaga

SEQ ID NO: 3480180 - DNA, 14 bp, Homo sapiens
caggtacagcaaca

SEQ ID NO: 3480181 - DNA, 15 bp, Homo sapiens
caggtagctgcccct

SEQ ID NO: 3480182 - DNA, 16 bp, Homo sapiens
caggtagctgcccctg

SEQ ID NO: 3480183 - DNA, 18 bp, Homo sapiens
caggtagctgcccctggc

SEQ ID NO: 3480184 - DNA, 23 bp, Homo sapiens
caggtagctgcccctggctctga

SEQ ID NO: 3480185 - DNA, 13 bp, Homo sapiens
caggtagggggga

SEQ ID NO: 3480186 - DNA, 22 bp, Homo sapiens
caggtcaatacagtacaggcag

SEQ ID NO: 3480187 - DNA, 23 bp, Homo sapiens
caggtcaatacagtacaggcagc

SEQ ID NO: 3480188 - DNA, 20 bp, Homo sapiens
caggtctctccactgctctc

SEQ ID NO: 3480189 - DNA, 22 bp, Homo sapiens
caggtctctccactgctctcag

SEQ ID NO: 3480190 - DNA, 20 bp, Homo sapiens
caggtcttcatcgaatctac

SEQ ID NO: 3480191 - DNA, 19 bp, Homo sapiens
caggtcttgaactcctggc

SEQ ID NO: 3480192 - DNA, 21 bp, Homo sapiens
caggtcttgaactcctggcct

SEQ ID NO: 3480193 - DNA, 19 bp, Homo sapiens
caggtctttcctaaggctg

SEQ ID NO: 3480194 - DNA, 21 bp, Homo sapiens
caggtctttcctaaggctgca

SEQ ID NO: 3480195 - DNA, 20 bp, Homo sapiens
caggtgagaagcagaggaag

SEQ ID NO: 3480196 - DNA, 15 bp, Homo sapiens
caggtgagcagacag

SEQ ID NO: 3480197 - DNA, 22 bp, Homo sapiens
caggtgagtcctagagctacag

SEQ ID NO: 3480198 - DNA, 23 bp, Homo sapiens
caggtgatccacccacctcagcc

SEQ ID NO: 3480199 - DNA, 14 bp, Homo sapiens
caggtgcagccaga

SEQ ID NO: 3480200 - DNA, 17 bp, Homo sapiens
caggtgcagccagaggc

SEQ ID NO: 3480201 - DNA, 19 bp, Homo sapiens
caggtgcagccagaggcac

SEQ ID NO: 3480202 - DNA, 23 bp, Homo sapiens
caggtgcccagctatacctgtgc

SEQ ID NO: 3480203 - DNA, 21 bp, Homo sapiens
caggtgctacacccttttcca

SEQ ID NO: 3480204 - DNA, 14 bp, Homo sapiens
caggtgctcccctg

SEQ ID NO: 3480205 - DNA, 23 bp, Homo sapiens
caggtgctcccctgacagtccct

SEQ ID NO: 3480206 - DNA, 23 bp, Homo sapiens
caggtgctgacttcatctcccac

SEQ ID NO: 3480207 - DNA, 15 bp, Homo sapiens
caggtgctggagcac

SEQ ID NO: 3480208 - DNA, 18 bp, Homo sapiens
caggtgctggagcactgg

SEQ ID NO: 3480209 - DNA, 19 bp, Homo sapiens
caggtgctggagcactggg

SEQ ID NO: 3480210 - DNA, 18 bp, Homo sapiens
caggtggaaaaactgaga

SEQ ID NO: 3480211 - DNA, 21 bp, Homo sapiens
caggtggaaaaactgagacag

SEQ ID NO: 3480212 - DNA, 12 bp, Homo sapiens
caggtggatcac

SEQ ID NO: 3480213 - DNA, 15 bp, Homo sapiens
caggtggccatgcct

SEQ ID NO: 3480214 - DNA, 19 bp, Homo sapiens
caggtggcctagcaggcac

SEQ ID NO: 3480215 - DNA, 22 bp, Homo sapiens
caggtggggagactgggctgag

SEQ ID NO: 3480216 - DNA, 23 bp, Homo sapiens
caggtggggagtcagggacccct

SEQ ID NO: 3480217 - DNA, 21 bp, Homo sapiens
caggtgggggttgctgtataa

SEQ ID NO: 3480218 - DNA, 18 bp, Homo sapiens
caggtggttatggagagg

SEQ ID NO: 3480219 - DNA, 11 bp, Homo sapiens
caggtgtccct

SEQ ID NO: 3480220 - DNA, 15 bp, Homo sapiens
caggtgtccctgcac

SEQ ID NO: 3480221 - DNA, 22 bp, Homo sapiens
caggtgtgagtcaccaagccca

SEQ ID NO: 3480222 - DNA, 18 bp, Homo sapiens
caggtgtgccgacagaag

SEQ ID NO: 3480223 - DNA, 22 bp, Homo sapiens
caggtgttactgtaattcctca

SEQ ID NO: 3480224 - DNA, 16 bp, Homo sapiens
caggttatctgggcat

SEQ ID NO: 3480225 - DNA, 16 bp, Homo sapiens
caggttcaacccacag

SEQ ID NO: 3480226 - DNA, 19 bp, Homo sapiens
caggttcaacccacagcta

SEQ ID NO: 3480227 - DNA, 13 bp, Homo sapiens
caggttcagcttg

SEQ ID NO: 3480228 - DNA, 22 bp, Homo sapiens
caggttcatggattacttctct

SEQ ID NO: 3480229 - DNA, 17 bp, Homo sapiens
caggttcccaagctcag

SEQ ID NO: 3480230 - DNA, 21 bp, Homo sapiens
caggttctccgttagctcctg

SEQ ID NO: 3480231 - DNA, 21 bp, Homo sapiens
caggttggaactatgcagtgt

SEQ ID NO: 3480232 - DNA, 15 bp, Homo sapiens
caggttgggatggga

SEQ ID NO: 3480233 - DNA, 14 bp, Homo sapiens
caggtttaagctgt

SEQ ID NO: 3480234 - DNA, 21 bp, Homo sapiens
caggttttcaccatagcctac

SEQ ID NO: 3480235 - DNA, 20 bp, Homo sapiens
caggttttgttttttttcag

SEQ ID NO: 3480236 - DNA, 11 bp, Homo sapiens
cagtaaaattg

SEQ ID NO: 3480237 - DNA, 21 bp, Homo sapiens
cagtaaaattgccatattgca

SEQ ID NO: 3480238 - DNA, 19 bp, Homo sapiens
cagtaaacgtgtttgtggt

SEQ ID NO: 3480239 - DNA, 12 bp, Homo sapiens
cagtaaatcttt

SEQ ID NO: 3480240 - DNA, 23 bp, Homo sapiens
cagtaataagaatggaaaagaga

SEQ ID NO: 3480241 - DNA, 13 bp, Homo sapiens
cagtacaggcagc

SEQ ID NO: 3480242 - DNA, 12 bp, Homo sapiens
cagtacctcctg

SEQ ID NO: 3480243 - DNA, 16 bp, Homo sapiens
cagtactttggaggcc

SEQ ID NO: 3480244 - DNA, 19 bp, Homo sapiens
cagtactttggaggcccct

SEQ ID NO: 3480245 - DNA, 18 bp, Homo sapiens
cagtagaaataatatgca

SEQ ID NO: 3480246 - DNA, 18 bp, Homo sapiens
cagtagattttccaaatg

SEQ ID NO: 3480247 - DNA, 13 bp, Homo sapiens
cagtaggccggtg

SEQ ID NO: 3480248 - DNA, 17 bp, Homo sapiens
cagtagtttgagaccag

SEQ ID NO: 3480249 - DNA, 16 bp, Homo sapiens
cagtatcatgccctgt

SEQ ID NO: 3480250 - DNA, 15 bp, Homo sapiens
cagtatctcagggcc

SEQ ID NO: 3480251 - DNA, 11 bp, Homo sapiens
cagtatctctt

SEQ ID NO: 3480252 - DNA, 15 bp, Homo sapiens
cagtatgatttataa

SEQ ID NO: 3480253 - DNA, 15 bp, Homo sapiens
cagtatggtacattt

SEQ ID NO: 3480254 - DNA, 16 bp, Homo sapiens
cagtatggtacatttt

SEQ ID NO: 3480255 - DNA, 17 bp, Homo sapiens
cagtatggtacattttt

SEQ ID NO: 3480256 - DNA, 16 bp, Homo sapiens
cagtatgtcccatagg

SEQ ID NO: 3480257 - DNA, 23 bp, Homo sapiens
cagtatgtgggggcttcatctct

SEQ ID NO: 3480258 - DNA, 18 bp, Homo sapiens
cagtatgttgtcaaagag

SEQ ID NO: 3480259 - DNA, 16 bp, Homo sapiens
cagtattacttctgct

SEQ ID NO: 3480260 - DNA, 14 bp, Homo sapiens
cagtattttgtgtc

SEQ ID NO: 3480261 - DNA, 16 bp, Homo sapiens
cagtattttgtgtcct

SEQ ID NO: 3480262 - DNA, 19 bp, Homo sapiens
cagtatttttgctgcttct

SEQ ID NO: 3480263 - DNA, 16 bp, Homo sapiens
cagtcaaatctgggct

SEQ ID NO: 3480264 - DNA, 14 bp, Homo sapiens
cagtcaacagttca

SEQ ID NO: 3480265 - DNA, 21 bp, Homo sapiens
cagtcaacctgggcaaagcct

SEQ ID NO: 3480266 - DNA, 20 bp, Homo sapiens
cagtcaagaagaaaaaggtt

SEQ ID NO: 3480267 - DNA, 16 bp, Homo sapiens
cagtcaagctgttgaa

SEQ ID NO: 3480268 - DNA, 20 bp, Homo sapiens
cagtcaagctgttgaagtct

SEQ ID NO: 3480269 - DNA, 15 bp, Homo sapiens
cagtcaatattttta

SEQ ID NO: 3480270 - DNA, 22 bp, Homo sapiens
cagtcacttcggccagagctga

SEQ ID NO: 3480271 - DNA, 18 bp, Homo sapiens
cagtcagctcttcatctg

SEQ ID NO: 3480272 - DNA, 17 bp, Homo sapiens
cagtcagtgctggagaa

SEQ ID NO: 3480273 - DNA, 22 bp, Homo sapiens
cagtcagtgctggagaaatctt

SEQ ID NO: 3480274 - DNA, 22 bp, Homo sapiens
cagtcatcttgaccaagcagga

SEQ ID NO: 3480275 - DNA, 21 bp, Homo sapiens
cagtcattggctgtctcctag

SEQ ID NO: 3480276 - DNA, 22 bp, Homo sapiens
cagtccaaggaaaccacagctg

SEQ ID NO: 3480277 - DNA, 24 bp, Homo sapiens
cagtccaaggaaaccacagctgct

SEQ ID NO: 3480278 - DNA, 17 bp, Homo sapiens
cagtccagccagctcct

SEQ ID NO: 3480279 - DNA, 13 bp, Homo sapiens
cagtccagcctgg

SEQ ID NO: 3480280 - DNA, 14 bp, Homo sapiens
cagtccccccaccc

SEQ ID NO: 3480281 - DNA, 18 bp, Homo sapiens
cagtcccgaaatttggat

SEQ ID NO: 3480282 - DNA, 17 bp, Homo sapiens
cagtcctgcctcagcct

SEQ ID NO: 3480283 - DNA, 12 bp, Homo sapiens
cagtccttccac

SEQ ID NO: 3480284 - DNA, 15 bp, Homo sapiens
cagtccttccacctc

SEQ ID NO: 3480285 - DNA, 13 bp, Homo sapiens
cagtcgaccccaa

SEQ ID NO: 3480286 - DNA, 15 bp, Homo sapiens
cagtcgaccccaaag

SEQ ID NO: 3480287 - DNA, 15 bp, Homo sapiens
cagtcgatagagctg

SEQ ID NO: 3480288 - DNA, 14 bp, Homo sapiens
cagtcgtgcctgtg

SEQ ID NO: 3480289 - DNA, 15 bp, Homo sapiens
cagtcgtgcctgtgt

SEQ ID NO: 3480290 - DNA, 23 bp, Homo sapiens
cagtctcactgtgggaaggccag

SEQ ID NO: 3480291 - DNA, 12 bp, Homo sapiens
cagtctctgcct

SEQ ID NO: 3480292 - DNA, 14 bp, Homo sapiens
cagtctctgccttg

SEQ ID NO: 3480293 - DNA, 17 bp, Homo sapiens
cagtctctgccttgcct

SEQ ID NO: 3480294 - DNA, 12 bp, Homo sapiens
catttatacaaa

SEQ ID NO: 3480295 - DNA, 15 bp, Homo sapiens
catttatacaaatta

SEQ ID NO: 3480296 - DNA, 19 bp, Homo sapiens
catttatacaaattagaaa

SEQ ID NO: 3480297 - DNA, 14 bp, Homo sapiens
catttatagatcat

SEQ ID NO: 3480298 - DNA, 21 bp, Homo sapiens
catttatgtgtcagttcattt

SEQ ID NO: 3480299 - DNA, 15 bp, Homo sapiens
catttattctgctca

SEQ ID NO: 3480300 - DNA, 18 bp, Homo sapiens
catttatttttctcatga

SEQ ID NO: 3480301 - DNA, 18 bp, Homo sapiens
catttcacccctcccttt

SEQ ID NO: 3480302 - DNA, 19 bp, Homo sapiens
catttcacccctccctttc

SEQ ID NO: 3480303 - DNA, 23 bp, Homo sapiens
catttcacccctccctttctccc

SEQ ID NO: 3480304 - DNA, 19 bp, Homo sapiens
catttcatattctttcaat

SEQ ID NO: 3480305 - DNA, 20 bp, Homo sapiens
catttcatattctttcaatt

SEQ ID NO: 3480306 - DNA, 12 bp, Homo sapiens
catttcctgctg

SEQ ID NO: 3480307 - DNA, 14 bp, Homo sapiens
catttcctgctgaa

SEQ ID NO: 3480308 - DNA, 13 bp, Homo sapiens
catttcctgtgtc

SEQ ID NO: 3480309 - DNA, 19 bp, Homo sapiens
catttcgtgagccccatct

SEQ ID NO: 3480310 - DNA, 23 bp, Homo sapiens
catttctaattaaccttactaat

SEQ ID NO: 3480311 - DNA, 23 bp, Homo sapiens
catttctagaacatccctgccag

SEQ ID NO: 3480312 - DNA, 13 bp, Homo sapiens
catttctatttat

SEQ ID NO: 3480313 - DNA, 15 bp, Homo sapiens
catttctctaagaga

SEQ ID NO: 3480314 - DNA, 14 bp, Homo sapiens
catttctgtatttt

SEQ ID NO: 3480315 - DNA, 18 bp, Homo sapiens
catttctttgtgctttgg

SEQ ID NO: 3480316 - DNA, 11 bp, Homo sapiens
catttgaatgc

SEQ ID NO: 3480317 - DNA, 23 bp, Homo sapiens
catttgaatgcattttgtttggt

SEQ ID NO: 3480318 - DNA, 20 bp, Homo sapiens
catttgagcagggctcagcg

SEQ ID NO: 3480319 - DNA, 17 bp, Homo sapiens
catttgatctgttgcaa

SEQ ID NO: 3480320 - DNA, 22 bp, Homo sapiens
catttgatgcatgtcttttaaa

SEQ ID NO: 3480321 - DNA, 22 bp, Homo sapiens
catttgcaagggaaaagtctct

SEQ ID NO: 3480322 - DNA, 19 bp, Homo sapiens
catttgcagggtcctcttc

SEQ ID NO: 3480323 - DNA, 21 bp, Homo sapiens
catttgcgaatggttccattc

SEQ ID NO: 3480324 - DNA, 21 bp, Homo sapiens
catttgcgttccatgatgctg

SEQ ID NO: 3480325 - DNA, 22 bp, Homo sapiens
catttgcgttccatgatgctgg

SEQ ID NO: 3480326 - DNA, 13 bp, Homo sapiens
catttgctgaata

SEQ ID NO: 3480327 - DNA, 19 bp, Homo sapiens
catttggcagagcttcttc

SEQ ID NO: 3480328 - DNA, 16 bp, Homo sapiens
catttgtctctacttt

SEQ ID NO: 3480329 - DNA, 21 bp, Homo sapiens
catttgtgctagaaattttca

SEQ ID NO: 3480330 - DNA, 23 bp, Homo sapiens
catttgtggcagtcccttataat

SEQ ID NO: 3480331 - DNA, 13 bp, Homo sapiens
cattttaaaaaca

SEQ ID NO: 3480332 - DNA, 15 bp, Homo sapiens
cattttactgttgta

SEQ ID NO: 3480333 - DNA, 19 bp, Homo sapiens
cattttactgttgtacaat

SEQ ID NO: 3480334 - DNA, 12 bp, Homo sapiens
cattttagccca

SEQ ID NO: 3480335 - DNA, 16 bp, Homo sapiens
cattttatatgtcaaa

SEQ ID NO: 3480336 - DNA, 19 bp, Homo sapiens
cattttatatgtcaaagca

SEQ ID NO: 3480337 - DNA, 13 bp, Homo sapiens
cattttcagagtg

SEQ ID NO: 3480338 - DNA, 14 bp, Homo sapiens
cattttcagagtga

SEQ ID NO: 3480339 - DNA, 21 bp, Homo sapiens
cattttccatatcctggtgcc

SEQ ID NO: 3480340 - DNA, 18 bp, Homo sapiens
cattttctagatacaata

SEQ ID NO: 3480341 - DNA, 21 bp, Homo sapiens
cattttctagatacaataaat

SEQ ID NO: 3480342 - DNA, 20 bp, Homo sapiens
cattttcttattgcgctgct

SEQ ID NO: 3480343 - DNA, 23 bp, Homo sapiens
cattttcttattgcgctgctacc

SEQ ID NO: 3480344 - DNA, 18 bp, Homo sapiens
cattttctttttttaact

SEQ ID NO: 3480345 - DNA, 15 bp, Homo sapiens
cattttgagtatttt

SEQ ID NO: 3480346 - DNA, 13 bp, Homo sapiens
cattttgcactgt

SEQ ID NO: 3480347 - DNA, 14 bp, Homo sapiens
cattttgcactgta

SEQ ID NO: 3480348 - DNA, 18 bp, Homo sapiens
cattttgctaaatgtgaa

SEQ ID NO: 3480349 - DNA, 21 bp, Homo sapiens
cattttgctaaatgtgaatga

SEQ ID NO: 3480350 - DNA, 22 bp, Homo sapiens
cattttggagagtttcctgaaa

SEQ ID NO: 3480351 - DNA, 21 bp, Homo sapiens
cattttggggtacccactgct

SEQ ID NO: 3480352 - DNA, 21 bp, Homo sapiens
cattttgtttggtattgtatt

SEQ ID NO: 3480353 - DNA, 23 bp, Homo sapiens
cattttgtttggtattgtattta

SEQ ID NO: 3480354 - DNA, 18 bp, Homo sapiens
catttttagtagagacag

SEQ ID NO: 3480355 - DNA, 19 bp, Homo sapiens
catttttagtagagacagg

SEQ ID NO: 3480356 - DNA, 18 bp, Homo sapiens
catttttcaactttgaat

SEQ ID NO: 3480357 - DNA, 13 bp, Homo sapiens
catttttgagcca

SEQ ID NO: 3480358 - DNA, 13 bp, Homo sapiens
catttttgtaata

SEQ ID NO: 3480359 - DNA, 20 bp, Homo sapiens
cattttttaaaaaagcaagg

SEQ ID NO: 3480360 - DNA, 17 bp, Homo sapiens
cattttttatgatatca

SEQ ID NO: 3480361 - DNA, 22 bp, Homo sapiens
cattttttatgatatcattgtt

SEQ ID NO: 3480362 - DNA, 15 bp, Homo sapiens
catttttttccaggc

SEQ ID NO: 3480363 - DNA, 18 bp, Homo sapiens
catttttttccaggctgg

SEQ ID NO: 3480364 - DNA, 23 bp, Homo sapiens
ccaaaaaagctgtattttgaaaa

SEQ ID NO: 3480365 - DNA, 23 bp, Homo sapiens
ccaaaaaggttgctgtttcacaa

SEQ ID NO: 3480366 - DNA, 16 bp, Homo sapiens
ccaaaacaagcctggt

SEQ ID NO: 3480367 - DNA, 21 bp, Homo sapiens
ccaaaacatcgtctaaacttt

SEQ ID NO: 3480368 - DNA, 15 bp, Homo sapiens
ccaaaagtggcctct

SEQ ID NO: 3480369 - DNA, 20 bp, Homo sapiens
ccaaaataaaaaccttccaa

SEQ ID NO: 3480370 - DNA, 14 bp, Homo sapiens
ccaaaatactccaa

SEQ ID NO: 3480371 - DNA, 15 bp, Homo sapiens
ccaaacagagcccag

SEQ ID NO: 3480372 - DNA, 11 bp, Homo sapiens
ccaaaccactt

SEQ ID NO: 3480373 - DNA, 22 bp, Homo sapiens
ccaaaccactttttgcagcttt

SEQ ID NO: 3480374 - DNA, 16 bp, Homo sapiens
ccaaacccatggctct

SEQ ID NO: 3480375 - DNA, 22 bp, Homo sapiens
ccaaacccatggctctatttct

SEQ ID NO: 3480376 - DNA, 11 bp, Homo sapiens
ccaaacctctg

SEQ ID NO: 3480377 - DNA, 13 bp, Homo sapiens
ccaaacgcctccc

SEQ ID NO: 3480378 - DNA, 15 bp, Homo sapiens
ccaaacgctgagcca

SEQ ID NO: 3480379 - DNA, 12 bp, Homo sapiens
ccaaagatgact

SEQ ID NO: 3480380 - DNA, 13 bp, Homo sapiens
ccaaagcagacag

SEQ ID NO: 3480381 - DNA, 12 bp, Homo sapiens
ccaaagcagggt

SEQ ID NO: 3480382 - DNA, 17 bp, Homo sapiens
ccaaagcctcctccagc

SEQ ID NO: 3480383 - DNA, 15 bp, Homo sapiens
ccaaagctaggcctg

SEQ ID NO: 3480384 - DNA, 17 bp, Homo sapiens
ccaaagctaggcctggc

SEQ ID NO: 3480385 - DNA, 21 bp, Homo sapiens
ccaaagctaggcctggccaga

SEQ ID NO: 3480386 - DNA, 13 bp, Homo sapiens
ccaaaggctggtg

SEQ ID NO: 3480387 - DNA, 15 bp, Homo sapiens
ccaaaggtgaaggaa

SEQ ID NO: 3480388 - DNA, 16 bp, Homo sapiens
ccaaataatgtctctg

SEQ ID NO: 3480389 - DNA, 21 bp, Homo sapiens
ccaaatccgaacctcctctgt

SEQ ID NO: 3480390 - DNA, 20 bp, Homo sapiens
ccaaatccttagatctggca

SEQ ID NO: 3480391 - DNA, 20 bp, Homo sapiens
ccaaatttgattgatttgaa

SEQ ID NO: 3480392 - DNA, 11 bp, Homo sapiens
ccaacaaacca

SEQ ID NO: 3480393 - DNA, 17 bp, Homo sapiens
ccaacaccaagcacagc

SEQ ID NO: 3480394 - DNA, 13 bp, Homo sapiens
ccaacacgcagga

SEQ ID NO: 3480395 - DNA, 14 bp, Homo sapiens
ccaacactcaagaa

SEQ ID NO: 3480396 - DNA, 23 bp, Homo sapiens
ccaacaggagctgggatcctaag

SEQ ID NO: 3480397 - DNA, 22 bp, Homo sapiens
ccaacatgtggctcctcccagc

SEQ ID NO: 3480398 - DNA, 15 bp, Homo sapiens
ccaaccccccagcac

SEQ ID NO: 3480399 - DNA, 19 bp, Homo sapiens
ccaaccccttaagccctgg

SEQ ID NO: 3480400 - DNA, 17 bp, Homo sapiens
ccaaccctggggaagga

SEQ ID NO: 3480401 - DNA, 11 bp, Homo sapiens
ccaacccttct

SEQ ID NO: 3480402 - DNA, 21 bp, Homo sapiens
ccaacccttctcctcttgtaa

SEQ ID NO: 3480403 - DNA, 17 bp, Homo sapiens
ccaacctgcaaagatct

SEQ ID NO: 3480404 - DNA, 18 bp, Homo sapiens
ccaacctgcaaagatctg

SEQ ID NO: 3480405 - DNA, 14 bp, Homo sapiens
ccaacctggggggc

SEQ ID NO: 3480406 - DNA, 23 bp, Homo sapiens
ccaaccttagatgttctaagtct

SEQ ID NO: 3480407 - DNA, 22 bp, Homo sapiens
ccaacggagagcgcctgcccct

SEQ ID NO: 3480408 - DNA, 17 bp, Homo sapiens
ccaacgtgcaaagccaa

SEQ ID NO: 3480409 - DNA, 20 bp, Homo sapiens
ccaacgtgcaaagccaaggc

SEQ ID NO: 3480410 - DNA, 23 bp, Homo sapiens
ccaacgtttggaagatcctgtga

SEQ ID NO: 3480411 - DNA, 11 bp, Homo sapiens
ccaactattta

SEQ ID NO: 3480412 - DNA, 21 bp, Homo sapiens
ccaactctagctgggggtggg

SEQ ID NO: 3480413 - DNA, 12 bp, Homo sapiens
ccaactgaaggc

SEQ ID NO: 3480414 - DNA, 18 bp, Homo sapiens
ccaactgcctaaggccct

SEQ ID NO: 3480415 - DNA, 23 bp, Homo sapiens
ccaacttgtattaaagacagagg

SEQ ID NO: 3480416 - DNA, 22 bp, Homo sapiens
ccaagaaagatgtatataggtg

SEQ ID NO: 3480417 - DNA, 13 bp, Homo sapiens
ccaagaaagcagg

SEQ ID NO: 3480418 - DNA, 22 bp, Homo sapiens
ccaagaatagcatctgtacaaa

SEQ ID NO: 3480419 - DNA, 21 bp, Homo sapiens
ccaagaggaagttcagatctt

SEQ ID NO: 3480420 - DNA, 15 bp, Homo sapiens
ccaagcaagactgag

SEQ ID NO: 3480421 - DNA, 13 bp, Homo sapiens
ccaagcacagcag

SEQ ID NO: 3480422 - DNA, 18 bp, Homo sapiens
ccaagcacagcagcctgg

SEQ ID NO: 3480423 - DNA, 14 bp, Homo sapiens
ccaagcactgtgct

SEQ ID NO: 3480424 - DNA, 19 bp, Homo sapiens
ccaagcactttcagtccaa

SEQ ID NO: 3480425 - DNA, 18 bp, Homo sapiens
ccaagcagccaagctcct

SEQ ID NO: 3480426 - DNA, 20 bp, Homo sapiens
ccagcacttgtccagctgag

SEQ ID NO: 3480427 - DNA, 13 bp, Homo sapiens
ccagcagaaccag

SEQ ID NO: 3480428 - DNA, 11 bp, Homo sapiens
ccagcagcctg

SEQ ID NO: 3480429 - DNA, 14 bp, Homo sapiens
ccagcagcctggac

SEQ ID NO: 3480430 - DNA, 20 bp, Homo sapiens
ccagcagcctggaccctgtg

SEQ ID NO: 3480431 - DNA, 18 bp, Homo sapiens
ccagcagcgcctttccca

SEQ ID NO: 3480432 - DNA, 15 bp, Homo sapiens
ccagcaggtgctgac

SEQ ID NO: 3480433 - DNA, 17 bp, Homo sapiens
ccagcagtcacttcggc

SEQ ID NO: 3480434 - DNA, 16 bp, Homo sapiens
ccagcagtctctgcct

SEQ ID NO: 3480435 - DNA, 22 bp, Homo sapiens
ccagcagttttcaagtcaaatt

SEQ ID NO: 3480436 - DNA, 15 bp, Homo sapiens
ccagcattccagccc

SEQ ID NO: 3480437 - DNA, 18 bp, Homo sapiens
ccagcattccagcccctc

SEQ ID NO: 3480438 - DNA, 13 bp, Homo sapiens
ccagcattccttt

SEQ ID NO: 3480439 - DNA, 14 bp, Homo sapiens
ccagcattcctttt

SEQ ID NO: 3480440 - DNA, 14 bp, Homo sapiens
ccagcattctcagg

SEQ ID NO: 3480441 - DNA, 19 bp, Homo sapiens
ccagccaaaccctgtctga

SEQ ID NO: 3480442 - DNA, 16 bp, Homo sapiens
ccagccaaacgggagc

SEQ ID NO: 3480443 - DNA, 15 bp, Homo sapiens
ccagccagaagcctc

SEQ ID NO: 3480444 - DNA, 21 bp, Homo sapiens
ccagccagaagcctctgcctc

SEQ ID NO: 3480445 - DNA, 19 bp, Homo sapiens
ccagccagcagcagcccaa

SEQ ID NO: 3480446 - DNA, 14 bp, Homo sapiens
ccagccagctcctg

SEQ ID NO: 3480447 - DNA, 15 bp, Homo sapiens
ccagccagggctgct

SEQ ID NO: 3480448 - DNA, 19 bp, Homo sapiens
ccagccagtgacctgagga

SEQ ID NO: 3480449 - DNA, 22 bp, Homo sapiens
ccagccagtgacctgaggaagc

SEQ ID NO: 3480450 - DNA, 23 bp, Homo sapiens
ccagccagtgacctgaggaagcg

SEQ ID NO: 3480451 - DNA, 18 bp, Homo sapiens
ccagccatcaaaatgctt

SEQ ID NO: 3480452 - DNA, 18 bp, Homo sapiens
ccagccatgtctgcattt

SEQ ID NO: 3480453 - DNA, 16 bp, Homo sapiens
ccagcccacttctgcc

SEQ ID NO: 3480454 - DNA, 14 bp, Homo sapiens
ccagcccagagaca

SEQ ID NO: 3480455 - DNA, 22 bp, Homo sapiens
ccagcccagagacatacttgaa

SEQ ID NO: 3480456 - DNA, 14 bp, Homo sapiens
ccagcccagggctc

SEQ ID NO: 3480457 - DNA, 17 bp, Homo sapiens
ccagcccagggctcctg

SEQ ID NO: 3480458 - DNA, 19 bp, Homo sapiens
ccagcccagggctcctgca

SEQ ID NO: 3480459 - DNA, 21 bp, Homo sapiens
ccagcccagggctcctgcact

SEQ ID NO: 3480460 - DNA, 16 bp, Homo sapiens
ccagccccagtgccca

SEQ ID NO: 3480461 - DNA, 18 bp, Homo sapiens
ccagccccggtggctggg

SEQ ID NO: 3480462 - DNA, 22 bp, Homo sapiens
ccagcccctctggtcgctcctg

SEQ ID NO: 3480463 - DNA, 14 bp, Homo sapiens
ccagccccttgaga

SEQ ID NO: 3480464 - DNA, 13 bp, Homo sapiens
ccagccctcatcc

SEQ ID NO: 3480465 - DNA, 21 bp, Homo sapiens
ccagccctccccatggagcca

SEQ ID NO: 3480466 - DNA, 16 bp, Homo sapiens
ccagcccttagcaggg

SEQ ID NO: 3480467 - DNA, 13 bp, Homo sapiens
ccagcctcagcct

SEQ ID NO: 3480468 - DNA, 12 bp, Homo sapiens
ccagcctcagcg

SEQ ID NO: 3480469 - DNA, 13 bp, Homo sapiens
ccagcctcagcgc

SEQ ID NO: 3480470 - DNA, 13 bp, Homo sapiens
ccagcctccctga

SEQ ID NO: 3480471 - DNA, 17 bp, Homo sapiens
ccagcctccctgaagcc

SEQ ID NO: 3480472 - DNA, 16 bp, Homo sapiens
ccagcctgcctggcag

SEQ ID NO: 3480473 - DNA, 20 bp, Homo sapiens
ccagcctgcctggcaggctg

SEQ ID NO: 3480474 - DNA, 21 bp, Homo sapiens
ccagcctgcctggcaggctgt

SEQ ID NO: 3480475 - DNA, 16 bp, Homo sapiens
ccagcctgcgcctgct

SEQ ID NO: 3480476 - DNA, 17 bp, Homo sapiens
ccagcctgcgcctgctg

SEQ ID NO: 3480477 - DNA, 12 bp, Homo sapiens
ccagcctgctag

SEQ ID NO: 3480478 - DNA, 13 bp, Homo sapiens
ccagcctgctagc

SEQ ID NO: 3480479 - DNA, 14 bp, Homo sapiens
ccagcctgctagct

SEQ ID NO: 3480480 - DNA, 19 bp, Homo sapiens
ccagcctgctagctagctc

SEQ ID NO: 3480481 - DNA, 21 bp, Homo sapiens
ccagcctgctagctagctcaa

SEQ ID NO: 3480482 - DNA, 17 bp, Homo sapiens
ccagcctggccaacatg

SEQ ID NO: 3480483 - DNA, 13 bp, Homo sapiens
ccagcctggggtc

SEQ ID NO: 3480484 - DNA, 23 bp, Homo sapiens
ccagcgtatatataagaaagaca

SEQ ID NO: 3480485 - DNA, 17 bp, Homo sapiens
ccagcgtcctcctctgt

SEQ ID NO: 3480486 - DNA, 19 bp, Homo sapiens
ccagcgtcctcctctgtga

SEQ ID NO: 3480487 - DNA, 19 bp, Homo sapiens
ccagctacacctttctcct

SEQ ID NO: 3480488 - DNA, 18 bp, Homo sapiens
ccagctatacctgtgcct

SEQ ID NO: 3480489 - DNA, 22 bp, Homo sapiens
ccagctatgttatattgaaaaa

SEQ ID NO: 3480490 - DNA, 22 bp, Homo sapiens
ccagctcatatgctgacagctc

SEQ ID NO: 3480491 - DNA, 21 bp, Homo sapiens
ccagctcccgctgtggccgca

SEQ ID NO: 3480492 - DNA, 18 bp, Homo sapiens
ccagctccggcctgtcct

SEQ ID NO: 3480493 - DNA, 20 bp, Homo sapiens
ccagctccggcctgtcctcc

SEQ ID NO: 3480494 - DNA, 18 bp, Homo sapiens
ccagctcctcactcacct

SEQ ID NO: 3480495 - DNA, 18 bp, Homo sapiens
ccagctcctgggcagctt

SEQ ID NO: 3480496 - DNA, 14 bp, Homo sapiens
ccagctctggaggg

SEQ ID NO: 3480497 - DNA, 14 bp, Homo sapiens
ccagctctttcctc

SEQ ID NO: 3480498 - DNA, 20 bp, Homo sapiens
ccagctgagcgccaggatgg

SEQ ID NO: 3480499 - DNA, 13 bp, Homo sapiens
ccagctgcaaagt

SEQ ID NO: 3480500 - DNA, 16 bp, Homo sapiens
ccagctgcaaagtgtt

SEQ ID NO: 3480501 - DNA, 14 bp, Homo sapiens
ccagctgcactgat

SEQ ID NO: 3480502 - DNA, 19 bp, Homo sapiens
ccagctgcactgatgctgc

SEQ ID NO: 3480503 - DNA, 16 bp, Homo sapiens
ccagctgccctatggg

SEQ ID NO: 3480504 - DNA, 11 bp, Homo sapiens
ccagctgccta

SEQ ID NO: 3480505 - DNA, 9 bp, Homo sapiens
ccagctgct

SEQ ID NO: 3480506 - DNA, 12 bp, Homo sapiens
ccagctgctccc

SEQ ID NO: 3480507 - DNA, 21 bp, Homo sapiens
ccagctgtgctctggacaggc

SEQ ID NO: 3480508 - DNA, 22 bp, Homo sapiens
ccagctgtgctctggacaggca

SEQ ID NO: 3480509 - DNA, 23 bp, Homo sapiens
ccagctgtgctctggacaggcat

SEQ ID NO: 3480510 - DNA, 19 bp, Homo sapiens
ccagcttaaaggggctaga

SEQ ID NO: 3480511 - DNA, 15 bp, Homo sapiens
ccagcttgccagatg

SEQ ID NO: 3480512 - DNA, 20 bp, Homo sapiens
ccagcttggacatcagtgtt

SEQ ID NO: 3480513 - DNA, 21 bp, Homo sapiens
ccagcttggacatcagtgttt

SEQ ID NO: 3480514 - DNA, 15 bp, Homo sapiens
ccagcttgttattta

SEQ ID NO: 3480515 - DNA, 11 bp, Homo sapiens
ccaggaagccg

SEQ ID NO: 3480516 - DNA, 14 bp, Homo sapiens
ccaggaatttccca

SEQ ID NO: 3480517 - DNA, 19 bp, Homo sapiens
ccaggaatttcccaggacc

SEQ ID NO: 3480518 - DNA, 21 bp, Homo sapiens
ccaggaatttcccaggaccct

SEQ ID NO: 3480519 - DNA, 23 bp, Homo sapiens
ccaggaatttcccaggaccctga

SEQ ID NO: 3480520 - DNA, 17 bp, Homo sapiens
ccaggaccagctcagga

SEQ ID NO: 3480521 - DNA, 23 bp, Homo sapiens
ccaggaccagtcaacctgggcaa

SEQ ID NO: 3480522 - DNA, 23 bp, Homo sapiens
ccaggaccctgaaggggccatga

SEQ ID NO: 3480523 - DNA, 18 bp, Homo sapiens
ccaggacctggctgccat

SEQ ID NO: 3480524 - DNA, 21 bp, Homo sapiens
ccaggactatatttgggcctg

SEQ ID NO: 3480525 - DNA, 13 bp, Homo sapiens
ccaggactctgac

SEQ ID NO: 3480526 - DNA, 20 bp, Homo sapiens
ccaggagaagggctggggcc

SEQ ID NO: 3480527 - DNA, 15 bp, Homo sapiens
ccaggagctgtcacc

SEQ ID NO: 3480528 - DNA, 18 bp, Homo sapiens
ccaggaggagttagccaa

SEQ ID NO: 3480529 - DNA, 14 bp, Homo sapiens
ccaggatcagccag

SEQ ID NO: 3480530 - DNA, 20 bp, Homo sapiens
ccaggatgagcatcccagga

SEQ ID NO: 3480531 - DNA, 12 bp, Homo sapiens
ccaggcactgca

SEQ ID NO: 3480532 - DNA, 12 bp, Homo sapiens
ccaggcaggtct

SEQ ID NO: 3480533 - DNA, 23 bp, Homo sapiens
ccaggcaggtcttgaactcctgg

SEQ ID NO: 3480534 - DNA, 21 bp, Homo sapiens
ccaggccacctccccagcatt

SEQ ID NO: 3480535 - DNA, 16 bp, Homo sapiens
ccaggccactgggccc

SEQ ID NO: 3480536 - DNA, 17 bp, Homo sapiens
ccaggcccaaggctccc

SEQ ID NO: 3480537 - DNA, 19 bp, Homo sapiens
ccaggcccaaggctcccgg

SEQ ID NO: 3480538 - DNA, 15 bp, Homo sapiens
ccaggccccaggaag

SEQ ID NO: 3480539 - DNA, 17 bp, Homo sapiens
ccaggccccaggaagcc

SEQ ID NO: 3480540 - DNA, 16 bp, Homo sapiens
ccaggcccctgccacc

SEQ ID NO: 3480541 - DNA, 19 bp, Homo sapiens
ccaggcccctgccaccctg

SEQ ID NO: 3480542 - DNA, 21 bp, Homo sapiens
ccaggcccctggaggctgcct

SEQ ID NO: 3480543 - DNA, 23 bp, Homo sapiens
ccaggcccctggaggctgcctcc

SEQ ID NO: 3480544 - DNA, 23 bp, Homo sapiens
ccaggccctgccagagcaggggg

SEQ ID NO: 3480545 - DNA, 24 bp, Homo sapiens
ccaggcctatgttgatccatccag

SEQ ID NO: 3480546 - DNA, 19 bp, Homo sapiens
ccaggcctcttggcagtca

SEQ ID NO: 3480547 - DNA, 13 bp, Homo sapiens
ccaggctgaagca

SEQ ID NO: 3480548 - DNA, 19 bp, Homo sapiens
ccaggctgaccacagcaca

SEQ ID NO: 3480549 - DNA, 14 bp, Homo sapiens
ccaggctgccgtgg

SEQ ID NO: 3480550 - DNA, 12 bp, Homo sapiens
ccaggctggcgt

SEQ ID NO: 3480551 - DNA, 18 bp, Homo sapiens
ccaggctggcgtgcagtg

SEQ ID NO: 3480552 - DNA, 20 bp, Homo sapiens
ccaggctgggcaaggaggcc

SEQ ID NO: 3480553 - DNA, 13 bp, Homo sapiens
ccaggctggtctt

SEQ ID NO: 3480554 - DNA, 20 bp, Homo sapiens
ccaggctgtatcccatgagc

SEQ ID NO: 3480555 - DNA, 17 bp, Homo sapiens
ccaggcttgcctgcagg

SEQ ID NO: 3480556 - DNA, 20 bp, Homo sapiens
ccagggacagaggccccagc

SEQ ID NO: 3480557 - DNA, 13 bp, Homo sapiens
ccagggagccttt

SEQ ID NO: 3480558 - DNA, 13 bp, Homo sapiens
cccccaatccatg

SEQ ID NO: 3480559 - DNA, 12 bp, Homo sapiens
cccccacaggcc

SEQ ID NO: 3480560 - DNA, 14 bp, Homo sapiens
cccccactgccaca

SEQ ID NO: 3480561 - DNA, 15 bp, Homo sapiens
cccccagcactgagg

SEQ ID NO: 3480562 - DNA, 17 bp, Homo sapiens
cccccagcactgaggaa

SEQ ID NO: 3480563 - DNA, 20 bp, Homo sapiens
cccccagcagaaccagcctc

SEQ ID NO: 3480564 - DNA, 14 bp, Homo sapiens
cccccagcccaggg

SEQ ID NO: 3480565 - DNA, 21 bp, Homo sapiens
cccccagcccagggctcctgc

SEQ ID NO: 3480566 - DNA, 13 bp, Homo sapiens
cccccaggactgg

SEQ ID NO: 3480567 - DNA, 13 bp, Homo sapiens
cccccagttccta

SEQ ID NO: 3480568 - DNA, 18 bp, Homo sapiens
cccccatcttcgggacca

SEQ ID NO: 3480569 - DNA, 14 bp, Homo sapiens
ccccccatgcactg

SEQ ID NO: 3480570 - DNA, 11 bp, Homo sapiens
ccccccttcca

SEQ ID NO: 3480571 - DNA, 13 bp, Homo sapiens
cccccgcagcacc

SEQ ID NO: 3480572 - DNA, 20 bp, Homo sapiens
cccccgcagcaccctgcaga

SEQ ID NO: 3480573 - DNA, 13 bp, Homo sapiens
cccccgccccctg

SEQ ID NO: 3480574 - DNA, 14 bp, Homo sapiens
cccccgccccctgc

SEQ ID NO: 3480575 - DNA, 23 bp, Homo sapiens
ccccctaagcttctagaggctca

SEQ ID NO: 3480576 - DNA, 22 bp, Homo sapiens
ccccctcaaaccctgccctcct

SEQ ID NO: 3480577 - DNA, 17 bp, Homo sapiens
ccccctccgcctccagg

SEQ ID NO: 3480578 - DNA, 12 bp, Homo sapiens
ccccctctgtcc

SEQ ID NO: 3480579 - DNA, 23 bp, Homo sapiens
ccccgaggccttctctgaaggac

SEQ ID NO: 3480580 - DNA, 14 bp, Homo sapiens
ccccgcagacacct

SEQ ID NO: 3480581 - DNA, 13 bp, Homo sapiens
ccccgcagcaccc

SEQ ID NO: 3480582 - DNA, 12 bp, Homo sapiens
ccccgcctgcct

SEQ ID NO: 3480583 - DNA, 21 bp, Homo sapiens
ccccgcttccccacagaactg

SEQ ID NO: 3480584 - DNA, 14 bp, Homo sapiens
ccccgcttctgcct

SEQ ID NO: 3480585 - DNA, 13 bp, Homo sapiens
ccccgtctctgtt

SEQ ID NO: 3480586 - DNA, 16 bp, Homo sapiens
cccctcaacacctctg

SEQ ID NO: 3480587 - DNA, 16 bp, Homo sapiens
cccctcagttgtgcag

SEQ ID NO: 3480588 - DNA, 18 bp, Homo sapiens
cccctcagttgtgcagct

SEQ ID NO: 3480589 - DNA, 22 bp, Homo sapiens
cccctcatcatagcaataacat

SEQ ID NO: 3480590 - DNA, 20 bp, Homo sapiens
cccctccccattagctttca

SEQ ID NO: 3480591 - DNA, 20 bp, Homo sapiens
cccctccccctgagattcag

SEQ ID NO: 3480592 - DNA, 15 bp, Homo sapiens
cccctccctttctcc

SEQ ID NO: 3480593 - DNA, 18 bp, Homo sapiens
cccctccgccctgccact

SEQ ID NO: 3480594 - DNA, 17 bp, Homo sapiens
cccctccggactggtgc

SEQ ID NO: 3480595 - DNA, 12 bp, Homo sapiens
cccctcctccac

SEQ ID NO: 3480596 - DNA, 18 bp, Homo sapiens
cccctcctctgaaacagc

SEQ ID NO: 3480597 - DNA, 16 bp, Homo sapiens
cccctcggctctggag

SEQ ID NO: 3480598 - DNA, 14 bp, Homo sapiens
cccctctccttcct

SEQ ID NO: 3480599 - DNA, 19 bp, Homo sapiens
cccctctccttcctgtgtg

SEQ ID NO: 3480600 - DNA, 12 bp, Homo sapiens
cccctctctggg

SEQ ID NO: 3480601 - DNA, 20 bp, Homo sapiens
cccctctgaaagttgtacat

SEQ ID NO: 3480602 - DNA, 19 bp, Homo sapiens
cccctctggtcgctcctgc

SEQ ID NO: 3480603 - DNA, 20 bp, Homo sapiens
cccctctggtcgctcctgcc

SEQ ID NO: 3480604 - DNA, 13 bp, Homo sapiens
cccctcttctgag

SEQ ID NO: 3480605 - DNA, 14 bp, Homo sapiens
cccctcttctgagc

SEQ ID NO: 3480606 - DNA, 19 bp, Homo sapiens
cccctctttcgtctactgc

SEQ ID NO: 3480607 - DNA, 21 bp, Homo sapiens
cccctgaaagtgacagagacc

SEQ ID NO: 3480608 - DNA, 20 bp, Homo sapiens
cccctgacctgtgagcccag

SEQ ID NO: 3480609 - DNA, 16 bp, Homo sapiens
cccctgccaccctggg

SEQ ID NO: 3480610 - DNA, 19 bp, Homo sapiens
cccctgccagggcagggcc

SEQ ID NO: 3480611 - DNA, 19 bp, Homo sapiens
cccctgcccccaggactgg

SEQ ID NO: 3480612 - DNA, 23 bp, Homo sapiens
cccctgccctcccctctctgcac

SEQ ID NO: 3480613 - DNA, 12 bp, Homo sapiens
cccctgccctgt

SEQ ID NO: 3480614 - DNA, 20 bp, Homo sapiens
cccctgctgctgtcacctct

SEQ ID NO: 3480615 - DNA, 21 bp, Homo sapiens
cccctgctgtctctctgggct

SEQ ID NO: 3480616 - DNA, 17 bp, Homo sapiens
cccctggacatgcctgt

SEQ ID NO: 3480617 - DNA, 22 bp, Homo sapiens
cccctggacatgcctgtcctga

SEQ ID NO: 3480618 - DNA, 17 bp, Homo sapiens
cccctggaggctgcctc

SEQ ID NO: 3480619 - DNA, 20 bp, Homo sapiens
cccctggaggctgcctccca

SEQ ID NO: 3480620 - DNA, 21 bp, Homo sapiens
cccctggaggctgcctcccaa

SEQ ID NO: 3480621 - DNA, 19 bp, Homo sapiens
cccctggccccgcctgcct

SEQ ID NO: 3480622 - DNA, 13 bp, Homo sapiens
cccctggctcctt

SEQ ID NO: 3480623 - DNA, 17 bp, Homo sapiens
cccctggctctgggccg

SEQ ID NO: 3480624 - DNA, 23 bp, Homo sapiens
cccctggctgggacgtggctcag

SEQ ID NO: 3480625 - DNA, 14 bp, Homo sapiens
cccctggggaccca

SEQ ID NO: 3480626 - DNA, 20 bp, Homo sapiens
cccctggggtggccaccagt

SEQ ID NO: 3480627 - DNA, 18 bp, Homo sapiens
cccctggttctcatcttt

SEQ ID NO: 3480628 - DNA, 18 bp, Homo sapiens
cccctgtctagagaggga

SEQ ID NO: 3480629 - DNA, 21 bp, Homo sapiens
ccccttactatgatctcagga

SEQ ID NO: 3480630 - DNA, 23 bp, Homo sapiens
ccccttactatgatctcaggagc

SEQ ID NO: 3480631 - DNA, 13 bp, Homo sapiens
ccccttcctttta

SEQ ID NO: 3480632 - DNA, 14 bp, Homo sapiens
ccccttcgctcctg

SEQ ID NO: 3480633 - DNA, 17 bp, Homo sapiens
ccccttcgctcctgtgt

SEQ ID NO: 3480634 - DNA, 22 bp, Homo sapiens
ccccttctaggtggcaaggctg

SEQ ID NO: 3480635 - DNA, 14 bp, Homo sapiens
ccccttctcagaat

SEQ ID NO: 3480636 - DNA, 14 bp, Homo sapiens
ccccttctgctcag

SEQ ID NO: 3480637 - DNA, 20 bp, Homo sapiens
ccccttctgctcagctctgg

SEQ ID NO: 3480638 - DNA, 21 bp, Homo sapiens
ccccttctgctcagctctggg

SEQ ID NO: 3480639 - DNA, 17 bp, Homo sapiens
cccctttggtttggcct

SEQ ID NO: 3480640 - DNA, 19 bp, Homo sapiens
cccctttggtttggcctcc

SEQ ID NO: 3480641 - DNA, 22 bp, Homo sapiens
cccctttggtttggcctccatc

SEQ ID NO: 3480642 - DNA, 14 bp, Homo sapiens
cccgaatagctggg

SEQ ID NO: 3480643 - DNA, 12 bp, Homo sapiens
cccgacagaggg

SEQ ID NO: 3480644 - DNA, 20 bp, Homo sapiens
cccgaggccttctctgaagg

SEQ ID NO: 3480645 - DNA, 21 bp, Homo sapiens
cccgaggccttctctgaagga

SEQ ID NO: 3480646 - DNA, 15 bp, Homo sapiens
cccgagtagctggga

SEQ ID NO: 3480647 - DNA, 17 bp, Homo sapiens
cccgagtagctgggact

SEQ ID NO: 3480648 - DNA, 21 bp, Homo sapiens
cccgagtagctgggactacag

SEQ ID NO: 3480649 - DNA, 14 bp, Homo sapiens
cccgcagacctctg

SEQ ID NO: 3480650 - DNA, 17 bp, Homo sapiens
cccgcagacctctggat

SEQ ID NO: 3480651 - DNA, 12 bp, Homo sapiens
cccgcagcaccc

SEQ ID NO: 3480652 - DNA, 19 bp, Homo sapiens
cccgcagcaccctgcagag

SEQ ID NO: 3480653 - DNA, 19 bp, Homo sapiens
cccgcagtgtgcactaagg

SEQ ID NO: 3480654 - DNA, 22 bp, Homo sapiens
cccgcagtgtgcactaaggggc

SEQ ID NO: 3480655 - DNA, 23 bp, Homo sapiens
cccgcatatactttaatgtttta

SEQ ID NO: 3480656 - DNA, 15 bp, Homo sapiens
cccgccaaaagctgc

SEQ ID NO: 3480657 - DNA, 16 bp, Homo sapiens
cccgccccctgccctc

SEQ ID NO: 3480658 - DNA, 15 bp, Homo sapiens
cccgccggaggccag

SEQ ID NO: 3480659 - DNA, 16 bp, Homo sapiens
cccgccggaggccagc

SEQ ID NO: 3480660 - DNA, 17 bp, Homo sapiens
cccgctcagcccagctg

SEQ ID NO: 3480661 - DNA, 19 bp, Homo sapiens
cccggaattccgtcaccac

SEQ ID NO: 3480662 - DNA, 11 bp, Homo sapiens
cccggagctcc

SEQ ID NO: 3480663 - DNA, 22 bp, Homo sapiens
cccggagctgcccctctctggg

SEQ ID NO: 3480664 - DNA, 23 bp, Homo sapiens
cccggcctattgcttgggtctct

SEQ ID NO: 3480665 - DNA, 23 bp, Homo sapiens
cccgggaggcggaggttccagtg

SEQ ID NO: 3480666 - DNA, 11 bp, Homo sapiens
cccgggcccca

SEQ ID NO: 3480667 - DNA, 22 bp, Homo sapiens
cccggggaaaggcaaggtccgg

SEQ ID NO: 3480668 - DNA, 21 bp, Homo sapiens
cccggggtgcccacaggccgc

SEQ ID NO: 3480669 - DNA, 18 bp, Homo sapiens
cccgggtccccagctccc

SEQ ID NO: 3480670 - DNA, 21 bp, Homo sapiens
cccgggtccccagctccccag

SEQ ID NO: 3480671 - DNA, 16 bp, Homo sapiens
cccggtgctccctctg

SEQ ID NO: 3480672 - DNA, 21 bp, Homo sapiens
ccctaattcagccatgtacag

SEQ ID NO: 3480673 - DNA, 20 bp, Homo sapiens
ccctacagttgaaaaacagc

SEQ ID NO: 3480674 - DNA, 14 bp, Homo sapiens
ccctacccagtccc

SEQ ID NO: 3480675 - DNA, 17 bp, Homo sapiens
ccctagccggttcctgt

SEQ ID NO: 3480676 - DNA, 23 bp, Homo sapiens
ccctagccggttcctgtccctgc

SEQ ID NO: 3480677 - DNA, 15 bp, Homo sapiens
ccctagtaaaaatac

SEQ ID NO: 3480678 - DNA, 21 bp, Homo sapiens
ccctatgggcctgccgggctg

SEQ ID NO: 3480679 - DNA, 20 bp, Homo sapiens
ccctatttttctctcctgtc

SEQ ID NO: 3480680 - DNA, 19 bp, Homo sapiens
ccctcaaaaaaagccttta

SEQ ID NO: 3480681 - DNA, 20 bp, Homo sapiens
ccctcacccctggttctcat

SEQ ID NO: 3480682 - DNA, 20 bp, Homo sapiens
ccctcaccttggcaccagac

SEQ ID NO: 3480683 - DNA, 13 bp, Homo sapiens
ccctcagttgtgc

SEQ ID NO: 3480684 - DNA, 16 bp, Homo sapiens
ccctcagttgtgcagc

SEQ ID NO: 3480685 - DNA, 17 bp, Homo sapiens
ccctcagttgtgcagct

SEQ ID NO: 3480686 - DNA, 16 bp, Homo sapiens
ccctcataccatctgc

SEQ ID NO: 3480687 - DNA, 17 bp, Homo sapiens
ccctcatcccgagcacc

SEQ ID NO: 3480688 - DNA, 17 bp, Homo sapiens
ccctcatctctctgccc

SEQ ID NO: 3480689 - DNA, 14 bp, Homo sapiens
ccctcatctgtccc

SEQ ID NO: 3480690 - DNA, 16 bp, Homo sapiens
cctagcaggcacagga

SEQ ID NO: 3480691 - DNA, 20 bp, Homo sapiens
cctagccggttcctgtccct

SEQ ID NO: 3480692 - DNA, 16 bp, Homo sapiens
cctaggcaatgaagaa

SEQ ID NO: 3480693 - DNA, 13 bp, Homo sapiens
cctaggcagtggg

SEQ ID NO: 3480694 - DNA, 23 bp, Homo sapiens
cctaggcagtgggaggcaaatgg

SEQ ID NO: 3480695 - DNA, 14 bp, Homo sapiens
cctaggcctcagcc

SEQ ID NO: 3480696 - DNA, 18 bp, Homo sapiens
cctaggcctcagccagag

SEQ ID NO: 3480697 - DNA, 19 bp, Homo sapiens
cctaggcctcagccagaga

SEQ ID NO: 3480698 - DNA, 12 bp, Homo sapiens
cctaggctcctc

SEQ ID NO: 3480699 - DNA, 14 bp, Homo sapiens
cctaggctcctctt

SEQ ID NO: 3480700 - DNA, 23 bp, Homo sapiens
cctaggctcctcttacccccgtc

SEQ ID NO: 3480701 - DNA, 22 bp, Homo sapiens
cctagggaagggtggtggagcc

SEQ ID NO: 3480702 - DNA, 23 bp, Homo sapiens
cctagggaagggtggtggagcca

SEQ ID NO: 3480703 - DNA, 15 bp, Homo sapiens
cctagggtggcctga

SEQ ID NO: 3480704 - DNA, 21 bp, Homo sapiens
cctagtgaaggcttctctctg

SEQ ID NO: 3480705 - DNA, 13 bp, Homo sapiens
cctagtggcttgt

SEQ ID NO: 3480706 - DNA, 15 bp, Homo sapiens
cctagttttcctact

SEQ ID NO: 3480707 - DNA, 19 bp, Homo sapiens
cctagttttctttcctcct

SEQ ID NO: 3480708 - DNA, 22 bp, Homo sapiens
cctatactgcttggagctgagc

SEQ ID NO: 3480709 - DNA, 23 bp, Homo sapiens
cctatactgcttggagctgagca

SEQ ID NO: 3480710 - DNA, 13 bp, Homo sapiens
cctatatatttct

SEQ ID NO: 3480711 - DNA, 11 bp, Homo sapiens
cctatatgctt

SEQ ID NO: 3480712 - DNA, 22 bp, Homo sapiens
cctatgtaagaattcagaagac

SEQ ID NO: 3480713 - DNA, 16 bp, Homo sapiens
cctatgtctaaattca

SEQ ID NO: 3480714 - DNA, 22 bp, Homo sapiens
cctatgtgattttaactctgtc

SEQ ID NO: 3480715 - DNA, 20 bp, Homo sapiens
cctatgttgatccatccagc

SEQ ID NO: 3480716 - DNA, 19 bp, Homo sapiens
cctatgttgtaattttact

SEQ ID NO: 3480717 - DNA, 23 bp, Homo sapiens
cctatgttgtaattttacttttt

SEQ ID NO: 3480718 - DNA, 22 bp, Homo sapiens
cctatgtttttgttcaaagcca

SEQ ID NO: 3480719 - DNA, 16 bp, Homo sapiens
cctattagagaagaga

SEQ ID NO: 3480720 - DNA, 17 bp, Homo sapiens
cctattccaagcttcca

SEQ ID NO: 3480721 - DNA, 15 bp, Homo sapiens
cctatttttaaataa

SEQ ID NO: 3480722 - DNA, 13 bp, Homo sapiens
cctatttttgtag

SEQ ID NO: 3480723 - DNA, 14 bp, Homo sapiens
cctattttttgaca

SEQ ID NO: 3480724 - DNA, 22 bp, Homo sapiens
cctattttttgacacttccatt

SEQ ID NO: 3480725 - DNA, 17 bp, Homo sapiens
cctcaaacactgcaggc

SEQ ID NO: 3480726 - DNA, 17 bp, Homo sapiens
cctcaactcctcccata

SEQ ID NO: 3480727 - DNA, 20 bp, Homo sapiens
cctcaagtgattctcctgcc

SEQ ID NO: 3480728 - DNA, 16 bp, Homo sapiens
cctcaccatgatgggg

SEQ ID NO: 3480729 - DNA, 15 bp, Homo sapiens
cctcaccttggcacc

SEQ ID NO: 3480730 - DNA, 21 bp, Homo sapiens
cctcaccttggcaccagacac

SEQ ID NO: 3480731 - DNA, 17 bp, Homo sapiens
cctcacgcacctcccat

SEQ ID NO: 3480732 - DNA, 21 bp, Homo sapiens
cctcacggtgccttttttcac

SEQ ID NO: 3480733 - DNA, 21 bp, Homo sapiens
cctcagaacccttggcttgcc

SEQ ID NO: 3480734 - DNA, 14 bp, Homo sapiens
cctcagagtgcaag

SEQ ID NO: 3480735 - DNA, 17 bp, Homo sapiens
cctcagcatcctggcac

SEQ ID NO: 3480736 - DNA, 15 bp, Homo sapiens
cctcagccctgaccc

SEQ ID NO: 3480737 - DNA, 18 bp, Homo sapiens
cctcagccctgaccctgt

SEQ ID NO: 3480738 - DNA, 23 bp, Homo sapiens
cctcagcctcccaaagtgctggg

SEQ ID NO: 3480739 - DNA, 12 bp, Homo sapiens
cctcagcctccg

SEQ ID NO: 3480740 - DNA, 12 bp, Homo sapiens
cctcagcctggc

SEQ ID NO: 3480741 - DNA, 17 bp, Homo sapiens
cctcagcctggccagac

SEQ ID NO: 3480742 - DNA, 21 bp, Homo sapiens
cctcagcctggccagacacag

SEQ ID NO: 3480743 - DNA, 18 bp, Homo sapiens
cctcagccttgccagaga

SEQ ID NO: 3480744 - DNA, 19 bp, Homo sapiens
cctcagccttgccagagat

SEQ ID NO: 3480745 - DNA, 21 bp, Homo sapiens
cctcagccttgccagagatcc

SEQ ID NO: 3480746 - DNA, 13 bp, Homo sapiens
cctcagctcggct

SEQ ID NO: 3480747 - DNA, 15 bp, Homo sapiens
cctcagctcggctca

SEQ ID NO: 3480748 - DNA, 18 bp, Homo sapiens
cctcagctcggctcagct

SEQ ID NO: 3480749 - DNA, 19 bp, Homo sapiens
cctcagctcggctcagctc

SEQ ID NO: 3480750 - DNA, 19 bp, Homo sapiens
cctcaggaggcaggacctt

SEQ ID NO: 3480751 - DNA, 15 bp, Homo sapiens
cctcaggcacacagc

SEQ ID NO: 3480752 - DNA, 16 bp, Homo sapiens
cctcaggcacacagct

SEQ ID NO: 3480753 - DNA, 17 bp, Homo sapiens
cctcaggcacacagcta

SEQ ID NO: 3480754 - DNA, 18 bp, Homo sapiens
cctcaggtgagaagcaga

SEQ ID NO: 3480755 - DNA, 18 bp, Homo sapiens
cctcaggtgctgtccatg

SEQ ID NO: 3480756 - DNA, 16 bp, Homo sapiens
cctcaggtggccatgc

SEQ ID NO: 3480757 - DNA, 18 bp, Homo sapiens
cctcaggtggccatgcct

SEQ ID NO: 3480758 - DNA, 18 bp, Homo sapiens
cctcagtatgtgggggct

SEQ ID NO: 3480759 - DNA, 21 bp, Homo sapiens
cctcagtatgtgggggcttca

SEQ ID NO: 3480760 - DNA, 23 bp, Homo sapiens
cctcagtatgtgggggcttcatc

SEQ ID NO: 3480761 - DNA, 13 bp, Homo sapiens
cctcagtgcccca

SEQ ID NO: 3480762 - DNA, 17 bp, Homo sapiens
cctcataggtcagggag

SEQ ID NO: 3480763 - DNA, 21 bp, Homo sapiens
cctcatagtatggtggctggg

SEQ ID NO: 3480764 - DNA, 15 bp, Homo sapiens
cctcatattttctgt

SEQ ID NO: 3480765 - DNA, 14 bp, Homo sapiens
cctcatccagggct

SEQ ID NO: 3480766 - DNA, 14 bp, Homo sapiens
cctcatcccgagca

SEQ ID NO: 3480767 - DNA, 17 bp, Homo sapiens
cctcatctctctgccca

SEQ ID NO: 3480768 - DNA, 18 bp, Homo sapiens
cctcatctctgcctgaca

SEQ ID NO: 3480769 - DNA, 15 bp, Homo sapiens
cctcatctgtccctc

SEQ ID NO: 3480770 - DNA, 15 bp, Homo sapiens
cctcatgacagccag

SEQ ID NO: 3480771 - DNA, 16 bp, Homo sapiens
cctcatgacagccaga

SEQ ID NO: 3480772 - DNA, 16 bp, Homo sapiens
cctcatgtggctggaa

SEQ ID NO: 3480773 - DNA, 18 bp, Homo sapiens
cctcatgtggctggaaga

SEQ ID NO: 3480774 - DNA, 22 bp, Homo sapiens
cctcatttcaggagcagcctca

SEQ ID NO: 3480775 - DNA, 11 bp, Homo sapiens
cctccacagct

SEQ ID NO: 3480776 - DNA, 14 bp, Homo sapiens
cctccactctcccc

SEQ ID NO: 3480777 - DNA, 19 bp, Homo sapiens
cctccactctcccccaccc

SEQ ID NO: 3480778 - DNA, 21 bp, Homo sapiens
cctccagcacccccagtgcag

SEQ ID NO: 3480779 - DNA, 16 bp, Homo sapiens
cctccagcctgaacag

SEQ ID NO: 3480780 - DNA, 17 bp, Homo sapiens
cctccagctctttcctc

SEQ ID NO: 3480781 - DNA, 12 bp, Homo sapiens
cctccaggagct

SEQ ID NO: 3480782 - DNA, 19 bp, Homo sapiens
cctccaggagcttcttgtt

SEQ ID NO: 3480783 - DNA, 17 bp, Homo sapiens
cctccagggctggactg

SEQ ID NO: 3480784 - DNA, 20 bp, Homo sapiens
cctccagggctggactgagg

SEQ ID NO: 3480785 - DNA, 16 bp, Homo sapiens
cctccagtaccttgct

SEQ ID NO: 3480786 - DNA, 18 bp, Homo sapiens
cctccattatccattccc

SEQ ID NO: 3480787 - DNA, 16 bp, Homo sapiens
cctcccaaagtgctgg

SEQ ID NO: 3480788 - DNA, 15 bp, Homo sapiens
cctcccaaccccagg

SEQ ID NO: 3480789 - DNA, 13 bp, Homo sapiens
cctcccactgggg

SEQ ID NO: 3480790 - DNA, 15 bp, Homo sapiens
cctcccactggggtc

SEQ ID NO: 3480791 - DNA, 18 bp, Homo sapiens
cctcccagaacacactcc

SEQ ID NO: 3480792 - DNA, 22 bp, Homo sapiens
cctcccaggactctgaccccag

SEQ ID NO: 3480793 - DNA, 15 bp, Homo sapiens
cctcccatccagggc

SEQ ID NO: 3480794 - DNA, 21 bp, Homo sapiens
cctccccagcctgcgcctgct

SEQ ID NO: 3480795 - DNA, 16 bp, Homo sapiens
cctccccatggagcca

SEQ ID NO: 3480796 - DNA, 17 bp, Homo sapiens
cctccccattcacagag

SEQ ID NO: 3480797 - DNA, 15 bp, Homo sapiens
cctcccccccatgca

SEQ ID NO: 3480798 - DNA, 12 bp, Homo sapiens
cctcccctgcca

SEQ ID NO: 3480799 - DNA, 14 bp, Homo sapiens
cctcccctgccacc

SEQ ID NO: 3480800 - DNA, 17 bp, Homo sapiens
cctcccctgccaccagg

SEQ ID NO: 3480801 - DNA, 18 bp, Homo sapiens
cctcccctgccagggcag

SEQ ID NO: 3480802 - DNA, 13 bp, Homo sapiens
cctcccctgggga

SEQ ID NO: 3480803 - DNA, 20 bp, Homo sapiens
cctcccctggggacagcaag

SEQ ID NO: 3480804 - DNA, 17 bp, Homo sapiens
cctcccgagtagctggg

SEQ ID NO: 3480805 - DNA, 19 bp, Homo sapiens
cctcccgagtagctgggac

SEQ ID NO: 3480806 - DNA, 20 bp, Homo sapiens
cctccctgcatctgaccagc

SEQ ID NO: 3480807 - DNA, 22 bp, Homo sapiens
cctccctgcatctgaccagcag

SEQ ID NO: 3480808 - DNA, 12 bp, Homo sapiens
cctccctgcctc

SEQ ID NO: 3480809 - DNA, 15 bp, Homo sapiens
cctccctgcctccag

SEQ ID NO: 3480810 - DNA, 18 bp, Homo sapiens
cctccctgttccccagag

SEQ ID NO: 3480811 - DNA, 20 bp, Homo sapiens
cctccctgttccccagagaa

SEQ ID NO: 3480812 - DNA, 13 bp, Homo sapiens
cctcccttctgct

SEQ ID NO: 3480813 - DNA, 16 bp, Homo sapiens
cctcccttctgctact

SEQ ID NO: 3480814 - DNA, 12 bp, Homo sapiens
cctccctttctc

SEQ ID NO: 3480815 - DNA, 14 bp, Homo sapiens
cctccctttctccc

SEQ ID NO: 3480816 - DNA, 15 bp, Homo sapiens
cctccctttctcccc

SEQ ID NO: 3480817 - DNA, 17 bp, Homo sapiens
cctccgacgctgcctct

SEQ ID NO: 3480818 - DNA, 14 bp, Homo sapiens
cctccgccaggcga

SEQ ID NO: 3480819 - DNA, 15 bp, Homo sapiens
cctccgccctgccac

SEQ ID NO: 3480820 - DNA, 16 bp, Homo sapiens
cctccgcctccaggaa

SEQ ID NO: 3480821 - DNA, 13 bp, Homo sapiens
cctccgcctcttg

SEQ ID NO: 3480822 - DNA, 20 bp, Homo sapiens
cctccgcgtgatcaaagcca

SEQ ID NO: 3480823 - DNA, 18 bp, Homo sapiens
cctgggaaatattcccta

SEQ ID NO: 3480824 - DNA, 14 bp, Homo sapiens
cctgggacttccat

SEQ ID NO: 3480825 - DNA, 20 bp, Homo sapiens
cctgggacttccatgcctta

SEQ ID NO: 3480826 - DNA, 14 bp, Homo sapiens
cctgggccctctct

SEQ ID NO: 3480827 - DNA, 22 bp, Homo sapiens
cctgggccgtatctccggctcc

SEQ ID NO: 3480828 - DNA, 14 bp, Homo sapiens
cctgggctggaatc

SEQ ID NO: 3480829 - DNA, 20 bp, Homo sapiens
cctgggctggaatcaggaat

SEQ ID NO: 3480830 - DNA, 13 bp, Homo sapiens
cctggggaaggag

SEQ ID NO: 3480831 - DNA, 18 bp, Homo sapiens
cctggggaaggagccagt

SEQ ID NO: 3480832 - DNA, 22 bp, Homo sapiens
cctggggctaggctggagccca

SEQ ID NO: 3480833 - DNA, 17 bp, Homo sapiens
cctggggctggcctccc

SEQ ID NO: 3480834 - DNA, 16 bp, Homo sapiens
cctgggggtgccagga

SEQ ID NO: 3480835 - DNA, 14 bp, Homo sapiens
cctggggtctggag

SEQ ID NO: 3480836 - DNA, 15 bp, Homo sapiens
cctggggtggggtca

SEQ ID NO: 3480837 - DNA, 20 bp, Homo sapiens
cctggggtgtgggaggcccg

SEQ ID NO: 3480838 - DNA, 20 bp, Homo sapiens
cctgggtaaatgcagcgtga

SEQ ID NO: 3480839 - DNA, 18 bp, Homo sapiens
cctgggtggagggagacg

SEQ ID NO: 3480840 - DNA, 22 bp, Homo sapiens
cctgggttgctgctgtccagtg

SEQ ID NO: 3480841 - DNA, 23 bp, Homo sapiens
cctgggttttgtattctctgagc

SEQ ID NO: 3480842 - DNA, 16 bp, Homo sapiens
cctggtactcaagccc

SEQ ID NO: 3480843 - DNA, 17 bp, Homo sapiens
cctggtccacagggcac

SEQ ID NO: 3480844 - DNA, 15 bp, Homo sapiens
cctggtgctgcctct

SEQ ID NO: 3480845 - DNA, 12 bp, Homo sapiens
cctggtggcagc

SEQ ID NO: 3480846 - DNA, 15 bp, Homo sapiens
cctggtggcagctgc

SEQ ID NO: 3480847 - DNA, 18 bp, Homo sapiens
cctggtggcagtgggagc

SEQ ID NO: 3480848 - DNA, 20 bp, Homo sapiens
cctggtggcagtgggagctg

SEQ ID NO: 3480849 - DNA, 21 bp, Homo sapiens
cctggtggcagtgggagctgc

SEQ ID NO: 3480850 - DNA, 14 bp, Homo sapiens
cctggttctcatct

SEQ ID NO: 3480851 - DNA, 15 bp, Homo sapiens
cctggttctcatctt

SEQ ID NO: 3480852 - DNA, 15 bp, Homo sapiens
cctggttctgatgat

SEQ ID NO: 3480853 - DNA, 21 bp, Homo sapiens
cctggttctgatgatgtgcct

SEQ ID NO: 3480854 - DNA, 22 bp, Homo sapiens
cctgtacagtagattttccaaa

SEQ ID NO: 3480855 - DNA, 17 bp, Homo sapiens
cctgtactattgcagac

SEQ ID NO: 3480856 - DNA, 20 bp, Homo sapiens
cctgtagaatagcctgtggc

SEQ ID NO: 3480857 - DNA, 15 bp, Homo sapiens
cctgtagagtgggag

SEQ ID NO: 3480858 - DNA, 16 bp, Homo sapiens
cctgtagagtgggagc

SEQ ID NO: 3480859 - DNA, 19 bp, Homo sapiens
cctgtagagtgggagctga

SEQ ID NO: 3480860 - DNA, 15 bp, Homo sapiens
cctgtagcacttact

SEQ ID NO: 3480861 - DNA, 17 bp, Homo sapiens
cctgtagttaggcctgg

SEQ ID NO: 3480862 - DNA, 21 bp, Homo sapiens
cctgtagttgacaattctgca

SEQ ID NO: 3480863 - DNA, 22 bp, Homo sapiens
cctgtataagtggaggcacttt

SEQ ID NO: 3480864 - DNA, 19 bp, Homo sapiens
cctgtatgtctgtcattgt

SEQ ID NO: 3480865 - DNA, 16 bp, Homo sapiens
cctgtattcagacaga

SEQ ID NO: 3480866 - DNA, 17 bp, Homo sapiens
cctgtcaccctgcagga

SEQ ID NO: 3480867 - DNA, 16 bp, Homo sapiens
cctgtcacctcttccg

SEQ ID NO: 3480868 - DNA, 20 bp, Homo sapiens
cctgtcattgtattcagata

SEQ ID NO: 3480869 - DNA, 16 bp, Homo sapiens
cctgtccacacccagc

SEQ ID NO: 3480870 - DNA, 18 bp, Homo sapiens
cctgtccacacccagctc

SEQ ID NO: 3480871 - DNA, 16 bp, Homo sapiens
cctgtccccatctgtc

SEQ ID NO: 3480872 - DNA, 13 bp, Homo sapiens
cctgtcctccaac

SEQ ID NO: 3480873 - DNA, 21 bp, Homo sapiens
cctgtcctccaacaccaagca

SEQ ID NO: 3480874 - DNA, 13 bp, Homo sapiens
cctgtcctcccag

SEQ ID NO: 3480875 - DNA, 18 bp, Homo sapiens
cctgtcctgaaagcggct

SEQ ID NO: 3480876 - DNA, 19 bp, Homo sapiens
cctgtcctgaaagcggctg

SEQ ID NO: 3480877 - DNA, 23 bp, Homo sapiens
cctgtcctgaaagcggctgcctc

SEQ ID NO: 3480878 - DNA, 16 bp, Homo sapiens
cctgtcgggctttgtg

SEQ ID NO: 3480879 - DNA, 14 bp, Homo sapiens
cctgtctagagagg

SEQ ID NO: 3480880 - DNA, 23 bp, Homo sapiens
cctgtctcctttcaccccagggc

SEQ ID NO: 3480881 - DNA, 15 bp, Homo sapiens
cctgtctgccagggc

SEQ ID NO: 3480882 - DNA, 11 bp, Homo sapiens
cctgtctgtga

SEQ ID NO: 3480883 - DNA, 13 bp, Homo sapiens
cctgtctgtgacc

SEQ ID NO: 3480884 - DNA, 12 bp, Homo sapiens
cctgtcttcctc

SEQ ID NO: 3480885 - DNA, 14 bp, Homo sapiens
cctgtcttcctctg

SEQ ID NO: 3480886 - DNA, 16 bp, Homo sapiens
cctgtcttcctctgca

SEQ ID NO: 3480887 - DNA, 18 bp, Homo sapiens
cctgtctttcagcattca

SEQ ID NO: 3480888 - DNA, 19 bp, Homo sapiens
cctgtctttcctaagacct

SEQ ID NO: 3480889 - DNA, 19 bp, Homo sapiens
cctgtgaatgccactgcct

SEQ ID NO: 3480890 - DNA, 21 bp, Homo sapiens
cctgtgcagccgctgagcgag

SEQ ID NO: 3480891 - DNA, 18 bp, Homo sapiens
cctgtgccctccttccca

SEQ ID NO: 3480892 - DNA, 20 bp, Homo sapiens
cctgtggatgagccctcaga

SEQ ID NO: 3480893 - DNA, 15 bp, Homo sapiens
cctgtggccccaccc

SEQ ID NO: 3480894 - DNA, 15 bp, Homo sapiens
cctgtgggcctggga

SEQ ID NO: 3480895 - DNA, 13 bp, Homo sapiens
cctgtgtccatgc

SEQ ID NO: 3480896 - DNA, 19 bp, Homo sapiens
cctgtgtccatgcgctcag

SEQ ID NO: 3480897 - DNA, 12 bp, Homo sapiens
cctgtgtctttt

SEQ ID NO: 3480898 - DNA, 13 bp, Homo sapiens
cctgtgtcttttt

SEQ ID NO: 3480899 - DNA, 18 bp, Homo sapiens
cctgtgtctttttcgcca

SEQ ID NO: 3480900 - DNA, 18 bp, Homo sapiens
cctgtgtgattgacagct

SEQ ID NO: 3480901 - DNA, 14 bp, Homo sapiens
cctgtgtgtgtgta

SEQ ID NO: 3480902 - DNA, 19 bp, Homo sapiens
cctgttaacgtcatctcag

SEQ ID NO: 3480903 - DNA, 14 bp, Homo sapiens
cctgttcagctcca

SEQ ID NO: 3480904 - DNA, 16 bp, Homo sapiens
cctgttcagctccagc

SEQ ID NO: 3480905 - DNA, 21 bp, Homo sapiens
cctgttcagctccagctcacc

SEQ ID NO: 3480906 - DNA, 16 bp, Homo sapiens
cctgttctgaaacctt

SEQ ID NO: 3480907 - DNA, 14 bp, Homo sapiens
cctgttctgaactg

SEQ ID NO: 3480908 - DNA, 21 bp, Homo sapiens
cctgttctgaactgtggggtg

SEQ ID NO: 3480909 - DNA, 23 bp, Homo sapiens
cctgttgaattttgttctctggg

SEQ ID NO: 3480910 - DNA, 22 bp, Homo sapiens
cctgttgacacaggtctttcct

SEQ ID NO: 3480911 - DNA, 12 bp, Homo sapiens
cctgttgctaag

SEQ ID NO: 3480912 - DNA, 14 bp, Homo sapiens
cctgttgctaagcc

SEQ ID NO: 3480913 - DNA, 20 bp, Homo sapiens
cctgtttctacctatatgca

SEQ ID NO: 3480914 - DNA, 23 bp, Homo sapiens
cctgttttcccacgaggaatctg

SEQ ID NO: 3480915 - DNA, 16 bp, Homo sapiens
cctgtttttttttcat

SEQ ID NO: 3480916 - DNA, 21 bp, Homo sapiens
ccttaagtccttaatgaagag

SEQ ID NO: 3480917 - DNA, 18 bp, Homo sapiens
ccttaatcttgctttctt

SEQ ID NO: 3480918 - DNA, 17 bp, Homo sapiens
ccttacagtaggagccc

SEQ ID NO: 3480919 - DNA, 21 bp, Homo sapiens
ccttacagtaggagcccagct

SEQ ID NO: 3480920 - DNA, 14 bp, Homo sapiens
ccttacccatctgc

SEQ ID NO: 3480921 - DNA, 17 bp, Homo sapiens
ccttaccctccttggga

SEQ ID NO: 3480922 - DNA, 14 bp, Homo sapiens
ccttacccttagaa

SEQ ID NO: 3480923 - DNA, 15 bp, Homo sapiens
ccttacccttagaat

SEQ ID NO: 3480924 - DNA, 17 bp, Homo sapiens
ccttaccgagagccaaa

SEQ ID NO: 3480925 - DNA, 14 bp, Homo sapiens
ccttactaattata

SEQ ID NO: 3480926 - DNA, 20 bp, Homo sapiens
ccttagaacattttaattca

SEQ ID NO: 3480927 - DNA, 17 bp, Homo sapiens
ccttagaagtcacacag

SEQ ID NO: 3480928 - DNA, 23 bp, Homo sapiens
ccttagattgaagtaaactgcag

SEQ ID NO: 3480929 - DNA, 19 bp, Homo sapiens
ccttagatttagtagtgta

SEQ ID NO: 3480930 - DNA, 20 bp, Homo sapiens
ccttagatttagtagtgtaa

SEQ ID NO: 3480931 - DNA, 19 bp, Homo sapiens
ccttagcagggaaacagct

SEQ ID NO: 3480932 - DNA, 20 bp, Homo sapiens
ccttagcagggaaacagcta

SEQ ID NO: 3480933 - DNA, 16 bp, Homo sapiens
ccttagcttcaggaac

SEQ ID NO: 3480934 - DNA, 13 bp, Homo sapiens
ccttaggcaggga

SEQ ID NO: 3480935 - DNA, 14 bp, Homo sapiens
ccttaggccttcct

SEQ ID NO: 3480936 - DNA, 14 bp, Homo sapiens
ccttatccttcctc

SEQ ID NO: 3480937 - DNA, 12 bp, Homo sapiens
ccttcacaaagc

SEQ ID NO: 3480938 - DNA, 20 bp, Homo sapiens
ccttcacatcctgtgtttct

SEQ ID NO: 3480939 - DNA, 21 bp, Homo sapiens
ccttcacattcccctggggac

SEQ ID NO: 3480940 - DNA, 13 bp, Homo sapiens
ccttcaccacccc

SEQ ID NO: 3480941 - DNA, 17 bp, Homo sapiens
ccttcagacaccctcaa

SEQ ID NO: 3480942 - DNA, 15 bp, Homo sapiens
ccttcagccctcacc

SEQ ID NO: 3480943 - DNA, 21 bp, Homo sapiens
ccttcatcatgagttctgctg

SEQ ID NO: 3480944 - DNA, 23 bp, Homo sapiens
ccttcattctgcaagtatactag

SEQ ID NO: 3480945 - DNA, 20 bp, Homo sapiens
ccttccataaaaaaacaatt

SEQ ID NO: 3480946 - DNA, 21 bp, Homo sapiens
ccttcccaagtaagaggctgg

SEQ ID NO: 3480947 - DNA, 22 bp, Homo sapiens
ccttcccaagtaagaggctgga

SEQ ID NO: 3480948 - DNA, 16 bp, Homo sapiens
ccttcccctccttctc

SEQ ID NO: 3480949 - DNA, 15 bp, Homo sapiens
ccttcccgccggagg

SEQ ID NO: 3480950 - DNA, 22 bp, Homo sapiens
ccttcccgccggaggccagcta

SEQ ID NO: 3480951 - DNA, 18 bp, Homo sapiens
ccttccgatgacagtgct

SEQ ID NO: 3480952 - DNA, 21 bp, Homo sapiens
ccttcctctccttccttgtta

SEQ ID NO: 3480953 - DNA, 21 bp, Homo sapiens
ccttcctggagcccagaggag

SEQ ID NO: 3480954 - DNA, 13 bp, Homo sapiens
ccttcctggcctg

SEQ ID NO: 3480955 - DNA, 15 bp, Homo sapiens
cggcacagctgggat

SEQ ID NO: 3480956 - DNA, 22 bp, Homo sapiens
cggcacctacatccccaggtct

SEQ ID NO: 3480957 - DNA, 15 bp, Homo sapiens
cggcagcatggagct

SEQ ID NO: 3480958 - DNA, 22 bp, Homo sapiens
cggcagggcgggcagagggctg

SEQ ID NO: 3480959 - DNA, 14 bp, Homo sapiens
cggcaggggcctgg

SEQ ID NO: 3480960 - DNA, 16 bp, Homo sapiens
cggcagttctgggtgc

SEQ ID NO: 3480961 - DNA, 20 bp, Homo sapiens
cggcagttctgggtgctccc

SEQ ID NO: 3480962 - DNA, 22 bp, Homo sapiens
cggccagcccctggccccagga

SEQ ID NO: 3480963 - DNA, 11 bp, Homo sapiens
cggccaggcca

SEQ ID NO: 3480964 - DNA, 12 bp, Homo sapiens
cggccaggccag

SEQ ID NO: 3480965 - DNA, 16 bp, Homo sapiens
cggcccgcgccacagg

SEQ ID NO: 3480966 - DNA, 17 bp, Homo sapiens
cggcccgcgccacagga

SEQ ID NO: 3480967 - DNA, 20 bp, Homo sapiens
cggccctcctaccctgcgcc

SEQ ID NO: 3480968 - DNA, 23 bp, Homo sapiens
cggccctcctaccctgcgcccag

SEQ ID NO: 3480969 - DNA, 11 bp, Homo sapiens
cggccctgggg

SEQ ID NO: 3480970 - DNA, 14 bp, Homo sapiens
cggccggccagccc

SEQ ID NO: 3480971 - DNA, 18 bp, Homo sapiens
cggcctattgcttgggtc

SEQ ID NO: 3480972 - DNA, 12 bp, Homo sapiens
cggcctgtcctc

SEQ ID NO: 3480973 - DNA, 16 bp, Homo sapiens
cggcgcttcccagcac

SEQ ID NO: 3480974 - DNA, 21 bp, Homo sapiens
cggcggagctggccccgccgc

SEQ ID NO: 3480975 - DNA, 17 bp, Homo sapiens
cggctcactgcagcctc

SEQ ID NO: 3480976 - DNA, 19 bp, Homo sapiens
cggctcagtgcaacctctg

SEQ ID NO: 3480977 - DNA, 14 bp, Homo sapiens
cggctccaggctcc

SEQ ID NO: 3480978 - DNA, 16 bp, Homo sapiens
cggctccaggctcctt

SEQ ID NO: 3480979 - DNA, 22 bp, Homo sapiens
cggctccagtttccccatgggg

SEQ ID NO: 3480980 - DNA, 15 bp, Homo sapiens
cggctctgaagcaag

SEQ ID NO: 3480981 - DNA, 21 bp, Homo sapiens
cggctctgaagcaaggcggtg

SEQ ID NO: 3480982 - DNA, 11 bp, Homo sapiens
cggctctggag

SEQ ID NO: 3480983 - DNA, 13 bp, Homo sapiens
cggctctggaggc

SEQ ID NO: 3480984 - DNA, 15 bp, Homo sapiens
cggctgaccatgctc

SEQ ID NO: 3480985 - DNA, 15 bp, Homo sapiens
cggctgcctccatta

SEQ ID NO: 3480986 - DNA, 11 bp, Homo sapiens
cggctgctgag

SEQ ID NO: 3480987 - DNA, 17 bp, Homo sapiens
cggctgggcacacgcct

SEQ ID NO: 3480988 - DNA, 20 bp, Homo sapiens
cggctgggcacacgcctccc

SEQ ID NO: 3480989 - DNA, 14 bp, Homo sapiens
cggctgtgctggga

SEQ ID NO: 3480990 - DNA, 21 bp, Homo sapiens
cggcttggatcctgggctggg

SEQ ID NO: 3480991 - DNA, 19 bp, Homo sapiens
cgggaacctccccagcctg

SEQ ID NO: 3480992 - DNA, 20 bp, Homo sapiens
cgggaacctccccagcctgc

SEQ ID NO: 3480993 - DNA, 12 bp, Homo sapiens
cgggagacagca

SEQ ID NO: 3480994 - DNA, 13 bp, Homo sapiens
cgggagactgaac

SEQ ID NO: 3480995 - DNA, 13 bp, Homo sapiens
cgggagaggggac

SEQ ID NO: 3480996 - DNA, 17 bp, Homo sapiens
cgggagaggggacgcag

SEQ ID NO: 3480997 - DNA, 21 bp, Homo sapiens
cgggagaggggacgcaggccc

SEQ ID NO: 3480998 - DNA, 23 bp, Homo sapiens
cgggagaggggacgcaggcccct

SEQ ID NO: 3480999 - DNA, 22 bp, Homo sapiens
cgggagccatgcgccccctccg

SEQ ID NO: 3481000 - DNA, 21 bp, Homo sapiens
cgggagcttttggtgagaagg

SEQ ID NO: 3481001 - DNA, 22 bp, Homo sapiens
cgggagcttttggtgagaaggt

SEQ ID NO: 3481002 - DNA, 13 bp, Homo sapiens
cgggaggaggtgt

SEQ ID NO: 3481003 - DNA, 23 bp, Homo sapiens
cgggaggatgttctgggacacag

SEQ ID NO: 3481004 - DNA, 16 bp, Homo sapiens
cgggcaccagccagcg

SEQ ID NO: 3481005 - DNA, 14 bp, Homo sapiens
cgggcactcagaag

SEQ ID NO: 3481006 - DNA, 10 bp, Homo sapiens
cgggcagaaa

SEQ ID NO: 3481007 - DNA, 14 bp, Homo sapiens
cgggccacagagaa

SEQ ID NO: 3481008 - DNA, 17 bp, Homo sapiens
cgggccacagagaaagt

SEQ ID NO: 3481009 - DNA, 17 bp, Homo sapiens
cgggcccagaccggctt

SEQ ID NO: 3481010 - DNA, 18 bp, Homo sapiens
cgggcctcagtgccccat

SEQ ID NO: 3481011 - DNA, 11 bp, Homo sapiens
cgggctcagca

SEQ ID NO: 3481012 - DNA, 18 bp, Homo sapiens
cgggctccagccatctca

SEQ ID NO: 3481013 - DNA, 12 bp, Homo sapiens
cgggctgtgccc

SEQ ID NO: 3481014 - DNA, 22 bp, Homo sapiens
cggggacagctccttctgtcct

SEQ ID NO: 3481015 - DNA, 15 bp, Homo sapiens
cggggagggtgacag

SEQ ID NO: 3481016 - DNA, 20 bp, Homo sapiens
cggggcccagggcaagctcc

SEQ ID NO: 3481017 - DNA, 16 bp, Homo sapiens
cggggctcttctcatt

SEQ ID NO: 3481018 - DNA, 17 bp, Homo sapiens
cggggctcttctcattt

SEQ ID NO: 3481019 - DNA, 14 bp, Homo sapiens
cggggctgtcggcg

SEQ ID NO: 3481020 - DNA, 19 bp, Homo sapiens
cggggctgtcggcgctgcc

SEQ ID NO: 3481021 - DNA, 21 bp, Homo sapiens
cggggctgtcggcgctgcccc

SEQ ID NO: 3481022 - DNA, 15 bp, Homo sapiens
cggggtgcttccttg

SEQ ID NO: 3481023 - DNA, 15 bp, Homo sapiens
cgggtccccagctcc

SEQ ID NO: 3481024 - DNA, 16 bp, Homo sapiens
cgggtccccagctccc

SEQ ID NO: 3481025 - DNA, 13 bp, Homo sapiens
cgggtctgcctct

SEQ ID NO: 3481026 - DNA, 20 bp, Homo sapiens
cgggtggggcttggggctca

SEQ ID NO: 3481027 - DNA, 17 bp, Homo sapiens
cgggttagacagccaaa

SEQ ID NO: 3481028 - DNA, 22 bp, Homo sapiens
cggtagccagcacacagggcag

SEQ ID NO: 3481029 - DNA, 12 bp, Homo sapiens
cggtcactgatg

SEQ ID NO: 3481030 - DNA, 20 bp, Homo sapiens
cggtgagaggggaacagact

SEQ ID NO: 3481031 - DNA, 21 bp, Homo sapiens
cggtgagaggggaacagactg

SEQ ID NO: 3481032 - DNA, 17 bp, Homo sapiens
cggtgagctacaaatgc

SEQ ID NO: 3481033 - DNA, 23 bp, Homo sapiens
cggtgcccaagccagaggctggg

SEQ ID NO: 3481034 - DNA, 13 bp, Homo sapiens
cggtgctccaggc

SEQ ID NO: 3481035 - DNA, 15 bp, Homo sapiens
cggtgctccaggcag

SEQ ID NO: 3481036 - DNA, 21 bp, Homo sapiens
cggtgctgtcctcaggtggcc

SEQ ID NO: 3481037 - DNA, 21 bp, Homo sapiens
cggtggctagtcaagctcctc

SEQ ID NO: 3481038 - DNA, 14 bp, Homo sapiens
cggtggctgggcag

SEQ ID NO: 3481039 - DNA, 18 bp, Homo sapiens
cggtgggcacccaccctg

SEQ ID NO: 3481040 - DNA, 18 bp, Homo sapiens
cggtgtcttgttctgtca

SEQ ID NO: 3481041 - DNA, 15 bp, Homo sapiens
cggtgtgcaccaggg

SEQ ID NO: 3481042 - DNA, 16 bp, Homo sapiens
cggtgtgcaccagggt

SEQ ID NO: 3481043 - DNA, 18 bp, Homo sapiens
cggtgtggtgcagtgtga

SEQ ID NO: 3481044 - DNA, 20 bp, Homo sapiens
cggtgtggtgcagtgtgaaa

SEQ ID NO: 3481045 - DNA, 21 bp, Homo sapiens
cggttagcgggccgggcgggg

SEQ ID NO: 3481046 - DNA, 11 bp, Homo sapiens
cggtttctcca

SEQ ID NO: 3481047 - DNA, 23 bp, Homo sapiens
cgtacacagagaaggctatgtaa

SEQ ID NO: 3481048 - DNA, 14 bp, Homo sapiens
cgtacttataaaga

SEQ ID NO: 3481049 - DNA, 20 bp, Homo sapiens
cgtagcgtgcccgtgtgcat

SEQ ID NO: 3481050 - DNA, 16 bp, Homo sapiens
cgtataggcatgtaaa

SEQ ID NO: 3481051 - DNA, 22 bp, Homo sapiens
cgtatctccggctcccagcctc

SEQ ID NO: 3481052 - DNA, 19 bp, Homo sapiens
cgtatgtaacatgatgtta

SEQ ID NO: 3481053 - DNA, 16 bp, Homo sapiens
cgtattagttgccaat

SEQ ID NO: 3481054 - DNA, 18 bp, Homo sapiens
cgtattccccttcccact

SEQ ID NO: 3481055 - DNA, 19 bp, Homo sapiens
cgtcacgtgcgctgggcac

SEQ ID NO: 3481056 - DNA, 17 bp, Homo sapiens
cgtcagaagcacccagg

SEQ ID NO: 3481057 - DNA, 24 bp, Homo sapiens
cgtcagtagtttgagaccagcctg

SEQ ID NO: 3481058 - DNA, 14 bp, Homo sapiens
cgtcagtgctgtgc

SEQ ID NO: 3481059 - DNA, 12 bp, Homo sapiens
cgtcctcctctg

SEQ ID NO: 3481060 - DNA, 13 bp, Homo sapiens
cgtcctcctctgt

SEQ ID NO: 3481061 - DNA, 23 bp, Homo sapiens
cgtcctgtccacacccagctcag

SEQ ID NO: 3481062 - DNA, 13 bp, Homo sapiens
cgtctactgcaag

SEQ ID NO: 3481063 - DNA, 19 bp, Homo sapiens
cgtctactgcaagagccaa

SEQ ID NO: 3481064 - DNA, 19 bp, Homo sapiens
cgtctccaggggctgcttc

SEQ ID NO: 3481065 - DNA, 22 bp, Homo sapiens
cgtctgacaggcaatgctggct

SEQ ID NO: 3481066 - DNA, 17 bp, Homo sapiens
cgtctttttgtttgttt

SEQ ID NO: 3481067 - DNA, 15 bp, Homo sapiens
cgtgaaaacggagct

SEQ ID NO: 3481068 - DNA, 16 bp, Homo sapiens
cgtgaaaacggagctg

SEQ ID NO: 3481069 - DNA, 13 bp, Homo sapiens
cgtgaagggattt

SEQ ID NO: 3481070 - DNA, 12 bp, Homo sapiens
cgtgacaacact

SEQ ID NO: 3481071 - DNA, 15 bp, Homo sapiens
cgtgacaacacttgt

SEQ ID NO: 3481072 - DNA, 13 bp, Homo sapiens
cgtgagccccatc

SEQ ID NO: 3481073 - DNA, 19 bp, Homo sapiens
cgtgaggatgtcactcaga

SEQ ID NO: 3481074 - DNA, 20 bp, Homo sapiens
cgtgcacacaccagagccca

SEQ ID NO: 3481075 - DNA, 21 bp, Homo sapiens
cgtgcacacaccagagcccac

SEQ ID NO: 3481076 - DNA, 22 bp, Homo sapiens
cgtgcacacaccagagcccacc

SEQ ID NO: 3481077 - DNA, 22 bp, Homo sapiens
cgtgcagtggtgcgatctgggt

SEQ ID NO: 3481078 - DNA, 12 bp, Homo sapiens
cgtgcattgtgc

SEQ ID NO: 3481079 - DNA, 21 bp, Homo sapiens
cgtgccagtcaagaagaaaaa

SEQ ID NO: 3481080 - DNA, 15 bp, Homo sapiens
cgtgcccctgctgct

SEQ ID NO: 3481081 - DNA, 14 bp, Homo sapiens
cgtgccctaccaca

SEQ ID NO: 3481082 - DNA, 12 bp, Homo sapiens
cgtgcctgtgtc

SEQ ID NO: 3481083 - DNA, 14 bp, Homo sapiens
cgtgcctgtgtcca

SEQ ID NO: 3481084 - DNA, 19 bp, Homo sapiens
cgtgcgctgggcacttccc

SEQ ID NO: 3481085 - DNA, 14 bp, Homo sapiens
cgtggagctgcctg

SEQ ID NO: 3481086 - DNA, 18 bp, Homo sapiens
cgtggatgcgcagtgcct

SEQ ID NO: 3481087 - DNA, 13 bp, Homo sapiens
cgtggcatcacct

SEQ ID NO: 3481088 - DNA, 20 bp, Homo sapiens
ctataacacctgccaccact

SEQ ID NO: 3481089 - DNA, 13 bp, Homo sapiens
ctataatttaaat

SEQ ID NO: 3481090 - DNA, 15 bp, Homo sapiens
ctatacctgtgcctc

SEQ ID NO: 3481091 - DNA, 19 bp, Homo sapiens
ctatacctgtgcctcggct

SEQ ID NO: 3481092 - DNA, 19 bp, Homo sapiens
ctatacgcagcgtgcttta

SEQ ID NO: 3481093 - DNA, 21 bp, Homo sapiens
ctatagcctggggtggggtca

SEQ ID NO: 3481094 - DNA, 22 bp, Homo sapiens
ctatagtatttgattcaaaata

SEQ ID NO: 3481095 - DNA, 17 bp, Homo sapiens
ctatatatccttaatat

SEQ ID NO: 3481096 - DNA, 12 bp, Homo sapiens
ctatatatttct

SEQ ID NO: 3481097 - DNA, 14 bp, Homo sapiens
ctatatatttctat

SEQ ID NO: 3481098 - DNA, 16 bp, Homo sapiens
ctatatatttctatta

SEQ ID NO: 3481099 - DNA, 18 bp, Homo sapiens
ctatattgattgtccttt

SEQ ID NO: 3481100 - DNA, 22 bp, Homo sapiens
ctatatttagattgttaaaata

SEQ ID NO: 3481101 - DNA, 23 bp, Homo sapiens
ctatatttagattgttaaaataa

SEQ ID NO: 3481102 - DNA, 12 bp, Homo sapiens
ctatatttgggc

SEQ ID NO: 3481103 - DNA, 21 bp, Homo sapiens
ctatattttgtcatatcaaat

SEQ ID NO: 3481104 - DNA, 15 bp, Homo sapiens
ctatcaacaataaaa

SEQ ID NO: 3481105 - DNA, 19 bp, Homo sapiens
ctatcaacaataaaatttt

SEQ ID NO: 3481106 - DNA, 19 bp, Homo sapiens
ctatcaacctaagcaacag

SEQ ID NO: 3481107 - DNA, 20 bp, Homo sapiens
ctatcaacctaagcaacaga

SEQ ID NO: 3481108 - DNA, 21 bp, Homo sapiens
ctatcaacctaagcaacagaa

SEQ ID NO: 3481109 - DNA, 13 bp, Homo sapiens
ctatcatttaata

SEQ ID NO: 3481110 - DNA, 15 bp, Homo sapiens
ctatccgtgttgcag

SEQ ID NO: 3481111 - DNA, 20 bp, Homo sapiens
ctatctgcctgacaggctgt

SEQ ID NO: 3481112 - DNA, 16 bp, Homo sapiens
ctatctgtctggtggc

SEQ ID NO: 3481113 - DNA, 18 bp, Homo sapiens
ctatgaagacttaaaaga

SEQ ID NO: 3481114 - DNA, 15 bp, Homo sapiens
ctatgagtggaaaaa

SEQ ID NO: 3481115 - DNA, 14 bp, Homo sapiens
ctatgatctcagga

SEQ ID NO: 3481116 - DNA, 16 bp, Homo sapiens
ctatgatctcaggagc

SEQ ID NO: 3481117 - DNA, 18 bp, Homo sapiens
ctatgcagaggcctgggg

SEQ ID NO: 3481118 - DNA, 19 bp, Homo sapiens
ctatgcatggtgccccagg

SEQ ID NO: 3481119 - DNA, 21 bp, Homo sapiens
ctatgcatggtgccccaggac

SEQ ID NO: 3481120 - DNA, 16 bp, Homo sapiens
ctatgctattgacaat

SEQ ID NO: 3481121 - DNA, 19 bp, Homo sapiens
ctatgctattgacaataaa

SEQ ID NO: 3481122 - DNA, 11 bp, Homo sapiens
ctatgctttga

SEQ ID NO: 3481123 - DNA, 22 bp, Homo sapiens
ctatggacggtgctccaggcag

SEQ ID NO: 3481124 - DNA, 23 bp, Homo sapiens
ctatggacggtgctccaggcagg

SEQ ID NO: 3481125 - DNA, 17 bp, Homo sapiens
ctatggctgcctgcatc

SEQ ID NO: 3481126 - DNA, 18 bp, Homo sapiens
ctatgggactcaatgcac

SEQ ID NO: 3481127 - DNA, 17 bp, Homo sapiens
ctatggtcgggagacag

SEQ ID NO: 3481128 - DNA, 21 bp, Homo sapiens
ctatggtcgggagacagcatc

SEQ ID NO: 3481129 - DNA, 16 bp, Homo sapiens
ctatggtgctctgtct

SEQ ID NO: 3481130 - DNA, 21 bp, Homo sapiens
ctatgtaagaattcagaagac

SEQ ID NO: 3481131 - DNA, 16 bp, Homo sapiens
ctatgtagtggtttta

SEQ ID NO: 3481132 - DNA, 19 bp, Homo sapiens
ctatgtatgtttttttcca

SEQ ID NO: 3481133 - DNA, 16 bp, Homo sapiens
ctatgtcccttgctgt

SEQ ID NO: 3481134 - DNA, 18 bp, Homo sapiens
ctatgtgattttaactct

SEQ ID NO: 3481135 - DNA, 18 bp, Homo sapiens
ctatgttgcccaggcagg

SEQ ID NO: 3481136 - DNA, 19 bp, Homo sapiens
ctatgttgcccaggcaggt

SEQ ID NO: 3481137 - DNA, 18 bp, Homo sapiens
ctattaaaatattttgga

SEQ ID NO: 3481138 - DNA, 12 bp, Homo sapiens
ctattaacatga

SEQ ID NO: 3481139 - DNA, 15 bp, Homo sapiens
ctattataatttaat

SEQ ID NO: 3481140 - DNA, 23 bp, Homo sapiens
ctattcaagaggaaatgtcacag

SEQ ID NO: 3481141 - DNA, 15 bp, Homo sapiens
ctattccattccctt

SEQ ID NO: 3481142 - DNA, 17 bp, Homo sapiens
ctattccattcccttcg

SEQ ID NO: 3481143 - DNA, 14 bp, Homo sapiens
ctattctctccaaa

SEQ ID NO: 3481144 - DNA, 21 bp, Homo sapiens
ctattctttcgaaagaagaaa

SEQ ID NO: 3481145 - DNA, 14 bp, Homo sapiens
ctattgacaataaa

SEQ ID NO: 3481146 - DNA, 16 bp, Homo sapiens
ctattgacaataaaat

SEQ ID NO: 3481147 - DNA, 17 bp, Homo sapiens
ctattgaccaccagtta

SEQ ID NO: 3481148 - DNA, 13 bp, Homo sapiens
ctattgcactcca

SEQ ID NO: 3481149 - DNA, 17 bp, Homo sapiens
ctattgcactccagtct

SEQ ID NO: 3481150 - DNA, 22 bp, Homo sapiens
ctattgcttgggtctctctcca

SEQ ID NO: 3481151 - DNA, 16 bp, Homo sapiens
ctattggaaaaaccac

SEQ ID NO: 3481152 - DNA, 18 bp, Homo sapiens
ctatttaattaggaaaaa

SEQ ID NO: 3481153 - DNA, 17 bp, Homo sapiens
ctatttatatgtacatg

SEQ ID NO: 3481154 - DNA, 14 bp, Homo sapiens
ctatttatttactg

SEQ ID NO: 3481155 - DNA, 16 bp, Homo sapiens
ctatttctcctccatg

SEQ ID NO: 3481156 - DNA, 14 bp, Homo sapiens
ctatttgaacaagt

SEQ ID NO: 3481157 - DNA, 12 bp, Homo sapiens
ctattttgaagt

SEQ ID NO: 3481158 - DNA, 23 bp, Homo sapiens
ctatttttaaataatttcctaca

SEQ ID NO: 3481159 - DNA, 22 bp, Homo sapiens
ctattttttgacacttccattg

SEQ ID NO: 3481160 - DNA, 18 bp, Homo sapiens
ctcaaaaaaagaaaaaga

SEQ ID NO: 3481161 - DNA, 23 bp, Homo sapiens
ctcaaaaacgccctcaagaacat

SEQ ID NO: 3481162 - DNA, 19 bp, Homo sapiens
ctcaaaacccatctgggct

SEQ ID NO: 3481163 - DNA, 19 bp, Homo sapiens
ctcaaaagaacttaccccc

SEQ ID NO: 3481164 - DNA, 14 bp, Homo sapiens
ctcaaacactgcag

SEQ ID NO: 3481165 - DNA, 16 bp, Homo sapiens
ctcaaacttctggctc

SEQ ID NO: 3481166 - DNA, 19 bp, Homo sapiens
ctcaaatgctcagaccagc

SEQ ID NO: 3481167 - DNA, 20 bp, Homo sapiens
ctcaaatggggccagatcca

SEQ ID NO: 3481168 - DNA, 19 bp, Homo sapiens
ctcaacccccatttctatt

SEQ ID NO: 3481169 - DNA, 22 bp, Homo sapiens
ctcaacccccatttctatttat

SEQ ID NO: 3481170 - DNA, 17 bp, Homo sapiens
ctcaacctcctgggcta

SEQ ID NO: 3481171 - DNA, 21 bp, Homo sapiens
ctcaacctcttctggctcaaa

SEQ ID NO: 3481172 - DNA, 15 bp, Homo sapiens
ctcaaccttggcctt

SEQ ID NO: 3481173 - DNA, 16 bp, Homo sapiens
ctcaaccttggccttc

SEQ ID NO: 3481174 - DNA, 16 bp, Homo sapiens
ctcaacgtattgtttc

SEQ ID NO: 3481175 - DNA, 20 bp, Homo sapiens
ctcaactttggttcctgtga

SEQ ID NO: 3481176 - DNA, 20 bp, Homo sapiens
ctcaagaagaagaggggcat

SEQ ID NO: 3481177 - DNA, 14 bp, Homo sapiens
ctcaagaagcaggc

SEQ ID NO: 3481178 - DNA, 15 bp, Homo sapiens
ctcaagagatcccaa

SEQ ID NO: 3481179 - DNA, 21 bp, Homo sapiens
ctcaagatactgctactgtaa

SEQ ID NO: 3481180 - DNA, 15 bp, Homo sapiens
ctcaagatgacagct

SEQ ID NO: 3481181 - DNA, 20 bp, Homo sapiens
ctcaagatgggggcagggct

SEQ ID NO: 3481182 - DNA, 21 bp, Homo sapiens
ctcaagccaagcagccaagct

SEQ ID NO: 3481183 - DNA, 23 bp, Homo sapiens
ctcaaggcggtgcttgatagaaa

SEQ ID NO: 3481184 - DNA, 21 bp, Homo sapiens
ctcaagtcctcttttctgaga

SEQ ID NO: 3481185 - DNA, 21 bp, Homo sapiens
ctcaagtgattctcctgcctc

SEQ ID NO: 3481186 - DNA, 20 bp, Homo sapiens
ctcaagtgttcacaacctgg

SEQ ID NO: 3481187 - DNA, 21 bp, Homo sapiens
ctcaataggaccaggatccag

SEQ ID NO: 3481188 - DNA, 22 bp, Homo sapiens
ctcaatgaaatatgtgaagccc

SEQ ID NO: 3481189 - DNA, 13 bp, Homo sapiens
ctcaatgcactga

SEQ ID NO: 3481190 - DNA, 15 bp, Homo sapiens
ctcaatgcactgaca

SEQ ID NO: 3481191 - DNA, 19 bp, Homo sapiens
ctcaatggaaacatcactg

SEQ ID NO: 3481192 - DNA, 16 bp, Homo sapiens
ctcaattgtgctttgt

SEQ ID NO: 3481193 - DNA, 23 bp, Homo sapiens
ctcacaccaggcttgcctgcagg

SEQ ID NO: 3481194 - DNA, 13 bp, Homo sapiens
ctcacactgagaa

SEQ ID NO: 3481195 - DNA, 19 bp, Homo sapiens
ctcacagattgctgcctca

SEQ ID NO: 3481196 - DNA, 21 bp, Homo sapiens
ctcacatggtgctacgcctgc

SEQ ID NO: 3481197 - DNA, 23 bp, Homo sapiens
ctcacatggtgctacgcctgcat

SEQ ID NO: 3481198 - DNA, 18 bp, Homo sapiens
ctcaccagccccagtgcc

SEQ ID NO: 3481199 - DNA, 20 bp, Homo sapiens
ctcaccagccccagtgccca

SEQ ID NO: 3481200 - DNA, 14 bp, Homo sapiens
ctcaccatctgtgc

SEQ ID NO: 3481201 - DNA, 21 bp, Homo sapiens
ctcaccccatcccacaccctg

SEQ ID NO: 3481202 - DNA, 15 bp, Homo sapiens
ctcaccccctccttc

SEQ ID NO: 3481203 - DNA, 20 bp, Homo sapiens
ctcacccccttctccatcca

SEQ ID NO: 3481204 - DNA, 17 bp, Homo sapiens
ctcacccctggttctca

SEQ ID NO: 3481205 - DNA, 21 bp, Homo sapiens
ctcacccctggttctcatctt

SEQ ID NO: 3481206 - DNA, 16 bp, Homo sapiens
ctcacctgtactattg

SEQ ID NO: 3481207 - DNA, 18 bp, Homo sapiens
ctcacctgtttgaaacca

SEQ ID NO: 3481208 - DNA, 18 bp, Homo sapiens
ctcaccttggggccttga

SEQ ID NO: 3481209 - DNA, 22 bp, Homo sapiens
ctcacctttgttttttgttgga

SEQ ID NO: 3481210 - DNA, 19 bp, Homo sapiens
ctcacgcacctcccatcct

SEQ ID NO: 3481211 - DNA, 16 bp, Homo sapiens
ctcacgtccaggttca

SEQ ID NO: 3481212 - DNA, 22 bp, Homo sapiens
ctcactaggcccccacttgcct

SEQ ID NO: 3481213 - DNA, 23 bp, Homo sapiens
ctcactaggcccccacttgcctc

SEQ ID NO: 3481214 - DNA, 22 bp, Homo sapiens
ctcactatgttgcccaggcagg

SEQ ID NO: 3481215 - DNA, 15 bp, Homo sapiens
ctcactcccttccca

SEQ ID NO: 3481216 - DNA, 21 bp, Homo sapiens
ctcactcccttcccataagct

SEQ ID NO: 3481217 - DNA, 13 bp, Homo sapiens
ctcactctgtcgc

SEQ ID NO: 3481218 - DNA, 21 bp, Homo sapiens
ctcactctgtcgcccagtctg

SEQ ID NO: 3481219 - DNA, 13 bp, Homo sapiens
ctcccctgccccc

SEQ ID NO: 3481220 - DNA, 15 bp, Homo sapiens
ctcccctgcccccag

SEQ ID NO: 3481221 - DNA, 18 bp, Homo sapiens
ctcccgaatagctgggac

SEQ ID NO: 3481222 - DNA, 20 bp, Homo sapiens
ctcccgagtagctgggacta

SEQ ID NO: 3481223 - DNA, 22 bp, Homo sapiens
ctcccgagtagctgggattaca

SEQ ID NO: 3481224 - DNA, 11 bp, Homo sapiens
ctcccgcggtg

SEQ ID NO: 3481225 - DNA, 22 bp, Homo sapiens
ctcccggaattccgtcaccacg

SEQ ID NO: 3481226 - DNA, 21 bp, Homo sapiens
ctccctaaggcatgtgtgaaa

SEQ ID NO: 3481227 - DNA, 18 bp, Homo sapiens
ctccctcaccccctcctt

SEQ ID NO: 3481228 - DNA, 12 bp, Homo sapiens
ctccctcctgga

SEQ ID NO: 3481229 - DNA, 20 bp, Homo sapiens
ctccctcctggagctctgtg

SEQ ID NO: 3481230 - DNA, 19 bp, Homo sapiens
ctccctctaggctctgcct

SEQ ID NO: 3481231 - DNA, 14 bp, Homo sapiens
ctccctctatttat

SEQ ID NO: 3481232 - DNA, 18 bp, Homo sapiens
ctccctgaagcctttgca

SEQ ID NO: 3481233 - DNA, 14 bp, Homo sapiens
ctccctgaccctgt

SEQ ID NO: 3481234 - DNA, 16 bp, Homo sapiens
ctccctgacttttctg

SEQ ID NO: 3481235 - DNA, 22 bp, Homo sapiens
ctccctgcactccctcctggag

SEQ ID NO: 3481236 - DNA, 12 bp, Homo sapiens
ctccctgggcct

SEQ ID NO: 3481237 - DNA, 18 bp, Homo sapiens
ctccctggttctgatgat

SEQ ID NO: 3481238 - DNA, 18 bp, Homo sapiens
ctccctgttccccagaga

SEQ ID NO: 3481239 - DNA, 17 bp, Homo sapiens
ctcccttcccataagct

SEQ ID NO: 3481240 - DNA, 21 bp, Homo sapiens
ctcccttgcctttcgaggcct

SEQ ID NO: 3481241 - DNA, 14 bp, Homo sapiens
ctcccttgggctcc

SEQ ID NO: 3481242 - DNA, 18 bp, Homo sapiens
ctcccttgggctccctgt

SEQ ID NO: 3481243 - DNA, 13 bp, Homo sapiens
ctccctttttaca

SEQ ID NO: 3481244 - DNA, 17 bp, Homo sapiens
ctccctttttacacttt

SEQ ID NO: 3481245 - DNA, 14 bp, Homo sapiens
ctccctttttatat

SEQ ID NO: 3481246 - DNA, 19 bp, Homo sapiens
ctccgaaattccaaggccc

SEQ ID NO: 3481247 - DNA, 17 bp, Homo sapiens
ctccgagaggtgggcca

SEQ ID NO: 3481248 - DNA, 13 bp, Homo sapiens
ctccgaggccagt

SEQ ID NO: 3481249 - DNA, 13 bp, Homo sapiens
ctccgccaggcga

SEQ ID NO: 3481250 - DNA, 13 bp, Homo sapiens
ctccgcctgaggc

SEQ ID NO: 3481251 - DNA, 16 bp, Homo sapiens
ctccgcctgaggccag

SEQ ID NO: 3481252 - DNA, 15 bp, Homo sapiens
ctccggactggtgcc

SEQ ID NO: 3481253 - DNA, 21 bp, Homo sapiens
ctccggccctcctaccctgcg

SEQ ID NO: 3481254 - DNA, 16 bp, Homo sapiens
ctccggcctgctgtca

SEQ ID NO: 3481255 - DNA, 14 bp, Homo sapiens
ctccggctcccagc

SEQ ID NO: 3481256 - DNA, 23 bp, Homo sapiens
ctccgtccatatcagaactgtgc

SEQ ID NO: 3481257 - DNA, 17 bp, Homo sapiens
ctccgttagctcctgtg

SEQ ID NO: 3481258 - DNA, 18 bp, Homo sapiens
ctccgttagctcctgtgg

SEQ ID NO: 3481259 - DNA, 20 bp, Homo sapiens
ctccgttggccactccgaga

SEQ ID NO: 3481260 - DNA, 19 bp, Homo sapiens
ctcctaacctcaagtgatc

SEQ ID NO: 3481261 - DNA, 15 bp, Homo sapiens
ctcctaccctgcgcc

SEQ ID NO: 3481262 - DNA, 18 bp, Homo sapiens
ctcctagagggaggggcc

SEQ ID NO: 3481263 - DNA, 12 bp, Homo sapiens
ctcctatgtgta

SEQ ID NO: 3481264 - DNA, 13 bp, Homo sapiens
ctcctatgtgtaa

SEQ ID NO: 3481265 - DNA, 21 bp, Homo sapiens
ctcctcactcccttcccataa

SEQ ID NO: 3481266 - DNA, 14 bp, Homo sapiens
ctcctcatctctaa

SEQ ID NO: 3481267 - DNA, 16 bp, Homo sapiens
ctcctccactctcccc

SEQ ID NO: 3481268 - DNA, 18 bp, Homo sapiens
ctcctccatgggagaaaa

SEQ ID NO: 3481269 - DNA, 14 bp, Homo sapiens
ctcctcccagccca

SEQ ID NO: 3481270 - DNA, 13 bp, Homo sapiens
ctcctccctgcat

SEQ ID NO: 3481271 - DNA, 14 bp, Homo sapiens
ctcctccctgcatc

SEQ ID NO: 3481272 - DNA, 15 bp, Homo sapiens
ctcctccctgcatct

SEQ ID NO: 3481273 - DNA, 14 bp, Homo sapiens
ctcctcctccctgc

SEQ ID NO: 3481274 - DNA, 15 bp, Homo sapiens
ctcctcctccctgca

SEQ ID NO: 3481275 - DNA, 17 bp, Homo sapiens
ctcctcgacatcactgt

SEQ ID NO: 3481276 - DNA, 15 bp, Homo sapiens
ctcctcgcaagctgg

SEQ ID NO: 3481277 - DNA, 21 bp, Homo sapiens
ctcctctcccattgtccctct

SEQ ID NO: 3481278 - DNA, 14 bp, Homo sapiens
ctcctctccccagc

SEQ ID NO: 3481279 - DNA, 15 bp, Homo sapiens
ctcctctccccagca

SEQ ID NO: 3481280 - DNA, 21 bp, Homo sapiens
ctcctctccccagcccagaga

SEQ ID NO: 3481281 - DNA, 23 bp, Homo sapiens
ctcctctccccagcccagagaca

SEQ ID NO: 3481282 - DNA, 13 bp, Homo sapiens
ctcctctctttgt

SEQ ID NO: 3481283 - DNA, 11 bp, Homo sapiens
ctcctctgaaa

SEQ ID NO: 3481284 - DNA, 15 bp, Homo sapiens
ctcctctgaaacagc

SEQ ID NO: 3481285 - DNA, 17 bp, Homo sapiens
ctcctctgaaacagctg

SEQ ID NO: 3481286 - DNA, 18 bp, Homo sapiens
ctcctctgaaacagctgc

SEQ ID NO: 3481287 - DNA, 19 bp, Homo sapiens
ctcctctgaaacagctgcc

SEQ ID NO: 3481288 - DNA, 20 bp, Homo sapiens
ctcctctgaaacagctgcct

SEQ ID NO: 3481289 - DNA, 21 bp, Homo sapiens
ctcctctgaaacagctgcctt

SEQ ID NO: 3481290 - DNA, 23 bp, Homo sapiens
ctcctctgaaacagctgccttag

SEQ ID NO: 3481291 - DNA, 18 bp, Homo sapiens
ctcctctgactcagggct

SEQ ID NO: 3481292 - DNA, 22 bp, Homo sapiens
ctcctctgactcagggctcctg

SEQ ID NO: 3481293 - DNA, 22 bp, Homo sapiens
ctcctctgtgaccaatgtcttg

SEQ ID NO: 3481294 - DNA, 23 bp, Homo sapiens
ctcctctgtgaccaatgtcttga

SEQ ID NO: 3481295 - DNA, 13 bp, Homo sapiens
ctcctcttgtaaa

SEQ ID NO: 3481296 - DNA, 20 bp, Homo sapiens
ctcctcttgtaaataaagcc

SEQ ID NO: 3481297 - DNA, 15 bp, Homo sapiens
ctcctgcacttactt

SEQ ID NO: 3481298 - DNA, 19 bp, Homo sapiens
ctcctgcacttacttgctt

SEQ ID NO: 3481299 - DNA, 14 bp, Homo sapiens
ctcctgcagaccac

SEQ ID NO: 3481300 - DNA, 14 bp, Homo sapiens
ctcctgccaaggag

SEQ ID NO: 3481301 - DNA, 16 bp, Homo sapiens
ctcctgccgcagagct

SEQ ID NO: 3481302 - DNA, 17 bp, Homo sapiens
ctcctgccgcagagctg

SEQ ID NO: 3481303 - DNA, 12 bp, Homo sapiens
ctcctgcctcag

SEQ ID NO: 3481304 - DNA, 13 bp, Homo sapiens
ctcctgcctcagc

SEQ ID NO: 3481305 - DNA, 17 bp, Homo sapiens
ctcctgcctcagcctcc

SEQ ID NO: 3481306 - DNA, 22 bp, Homo sapiens
ctcctgcctcgaactggctgca

SEQ ID NO: 3481307 - DNA, 14 bp, Homo sapiens
ctcctggcccaggt

SEQ ID NO: 3481308 - DNA, 16 bp, Homo sapiens
ctcctgggcagcttga

SEQ ID NO: 3481309 - DNA, 23 bp, Homo sapiens
ctcctgggcagcttgagagggca

SEQ ID NO: 3481310 - DNA, 17 bp, Homo sapiens
ctcctgggccctctctg

SEQ ID NO: 3481311 - DNA, 21 bp, Homo sapiens
ctcctgggttttgtattctct

SEQ ID NO: 3481312 - DNA, 21 bp, Homo sapiens
ctcctgtggccccaccctggg

SEQ ID NO: 3481313 - DNA, 23 bp, Homo sapiens
ctcctgtgtcttgcaatggcagc

SEQ ID NO: 3481314 - DNA, 14 bp, Homo sapiens
ctcctgtgtgtgcg

SEQ ID NO: 3481315 - DNA, 23 bp, Homo sapiens
ctcctgtgtgtgcgcctacagga

SEQ ID NO: 3481316 - DNA, 24 bp, Homo sapiens
ctcctgtgtgtgcgcctacaggag

SEQ ID NO: 3481317 - DNA, 20 bp, Homo sapiens
ctccttaacactgagctgtc

SEQ ID NO: 3481318 - DNA, 13 bp, Homo sapiens
ctccttcagccct

SEQ ID NO: 3481319 - DNA, 22 bp, Homo sapiens
ctccttcatatgaaaggtgcca

SEQ ID NO: 3481320 - DNA, 18 bp, Homo sapiens
ctccttccaacaggagct

SEQ ID NO: 3481321 - DNA, 14 bp, Homo sapiens
ctccttcccaatct

SEQ ID NO: 3481322 - DNA, 13 bp, Homo sapiens
ctccttcctggag

SEQ ID NO: 3481323 - DNA, 14 bp, Homo sapiens
ctccttcctggaga

SEQ ID NO: 3481324 - DNA, 12 bp, Homo sapiens
ctccttcctggc

SEQ ID NO: 3481325 - DNA, 14 bp, Homo sapiens
ctccttcctggcct

SEQ ID NO: 3481326 - DNA, 18 bp, Homo sapiens
ctccttcctggcctgaga

SEQ ID NO: 3481327 - DNA, 15 bp, Homo sapiens
ctccttctgtcctac

SEQ ID NO: 3481328 - DNA, 20 bp, Homo sapiens
ctccttctgtcctactctgt

SEQ ID NO: 3481329 - DNA, 17 bp, Homo sapiens
ctccttgggaggcccca

SEQ ID NO: 3481330 - DNA, 21 bp, Homo sapiens
ctccttgggaggccccactgg

SEQ ID NO: 3481331 - DNA, 22 bp, Homo sapiens
ctccttgggaggccccactggg

SEQ ID NO: 3481332 - DNA, 12 bp, Homo sapiens
ctccttgggccc

SEQ ID NO: 3481333 - DNA, 16 bp, Homo sapiens
ctccttgggccctttg

SEQ ID NO: 3481334 - DNA, 20 bp, Homo sapiens
ctccttgtggcctgggcctc

SEQ ID NO: 3481335 - DNA, 16 bp, Homo sapiens
ctcctttagcgcccag

SEQ ID NO: 3481336 - DNA, 12 bp, Homo sapiens
ctcctttcacca

SEQ ID NO: 3481337 - DNA, 18 bp, Homo sapiens
ctcctttcatcacactgg

SEQ ID NO: 3481338 - DNA, 24 bp, Homo sapiens
ctccttttgaccttcatttcatgt

SEQ ID NO: 3481339 - DNA, 20 bp, Homo sapiens
ctcgaaacacagaaaccttt

SEQ ID NO: 3481340 - DNA, 15 bp, Homo sapiens
ctcgaactggctgca

SEQ ID NO: 3481341 - DNA, 13 bp, Homo sapiens
ctcgaatctctgt

SEQ ID NO: 3481342 - DNA, 16 bp, Homo sapiens
ctcgaatctctgtgcc

SEQ ID NO: 3481343 - DNA, 17 bp, Homo sapiens
ctcgaatctctgtgcct

SEQ ID NO: 3481344 - DNA, 23 bp, Homo sapiens
ctcgacgtttacaagccccccct

SEQ ID NO: 3481345 - DNA, 15 bp, Homo sapiens
ctcgagcttggggca

SEQ ID NO: 3481346 - DNA, 15 bp, Homo sapiens
ctcgaggtgccttct

SEQ ID NO: 3481347 - DNA, 18 bp, Homo sapiens
ctcgagtactgtgggcaa

SEQ ID NO: 3481348 - DNA, 16 bp, Homo sapiens
ctcgagtcacattctg

SEQ ID NO: 3481349 - DNA, 18 bp, Homo sapiens
ctcgagtcacattctgct

SEQ ID NO: 3481350 - DNA, 20 bp, Homo sapiens
ctcgagtcacattctgctta

SEQ ID NO: 3481351 - DNA, 17 bp, Homo sapiens
ctcgattcatattgaat

SEQ ID NO: 3481352 - DNA, 20 bp, Homo sapiens
ctgaagagtgggtttcacaa

SEQ ID NO: 3481353 - DNA, 23 bp, Homo sapiens
ctgaagatataactattgcccag

SEQ ID NO: 3481354 - DNA, 21 bp, Homo sapiens
ctgaagatttcagaggctgca

SEQ ID NO: 3481355 - DNA, 14 bp, Homo sapiens
ctgaagcaacttga

SEQ ID NO: 3481356 - DNA, 16 bp, Homo sapiens
ctgaagcagcctctcc

SEQ ID NO: 3481357 - DNA, 16 bp, Homo sapiens
ctgaagccaaagccaa

SEQ ID NO: 3481358 - DNA, 17 bp, Homo sapiens
ctgaagccagctgccct

SEQ ID NO: 3481359 - DNA, 21 bp, Homo sapiens
ctgaaggacattgcggacagc

SEQ ID NO: 3481360 - DNA, 23 bp, Homo sapiens
ctgaaggacattgcggacagcca

SEQ ID NO: 3481361 - DNA, 19 bp, Homo sapiens
ctgaaggctaaaaagcaac

SEQ ID NO: 3481362 - DNA, 17 bp, Homo sapiens
ctgaagggaatcacatc

SEQ ID NO: 3481363 - DNA, 19 bp, Homo sapiens
ctgaaggggccatgatggc

SEQ ID NO: 3481364 - DNA, 14 bp, Homo sapiens
ctgaagtcacacag

SEQ ID NO: 3481365 - DNA, 16 bp, Homo sapiens
ctgaagtcacacagtg

SEQ ID NO: 3481366 - DNA, 21 bp, Homo sapiens
ctgaagtcacacagtgagtcg

SEQ ID NO: 3481367 - DNA, 22 bp, Homo sapiens
ctgaagtcccagatacttgggg

SEQ ID NO: 3481368 - DNA, 16 bp, Homo sapiens
ctgaatacagaggcaa

SEQ ID NO: 3481369 - DNA, 18 bp, Homo sapiens
ctgaatacattctgcttt

SEQ ID NO: 3481370 - DNA, 21 bp, Homo sapiens
ctgaatcatgagcctgctgga

SEQ ID NO: 3481371 - DNA, 19 bp, Homo sapiens
ctgaatgcttataggtggc

SEQ ID NO: 3481372 - DNA, 22 bp, Homo sapiens
ctgaatgcttataggtggcctc

SEQ ID NO: 3481373 - DNA, 19 bp, Homo sapiens
ctgaatgggcaattccaga

SEQ ID NO: 3481374 - DNA, 16 bp, Homo sapiens
ctgaatttgcaaagta

SEQ ID NO: 3481375 - DNA, 23 bp, Homo sapiens
ctgacaaggccagcacccaaagg

SEQ ID NO: 3481376 - DNA, 22 bp, Homo sapiens
ctgacaatggtgttatttgaaa

SEQ ID NO: 3481377 - DNA, 18 bp, Homo sapiens
ctgacacaaaaagtagat

SEQ ID NO: 3481378 - DNA, 16 bp, Homo sapiens
ctgacacaaacctgcc

SEQ ID NO: 3481379 - DNA, 19 bp, Homo sapiens
ctgacacaaacctgcctgg

SEQ ID NO: 3481380 - DNA, 15 bp, Homo sapiens
ctgacagacacaggc

SEQ ID NO: 3481381 - DNA, 17 bp, Homo sapiens
ctgacagacacaggccc

SEQ ID NO: 3481382 - DNA, 21 bp, Homo sapiens
ctgacagacacaggcccggct

SEQ ID NO: 3481383 - DNA, 17 bp, Homo sapiens
ctgacagctcttcacag

SEQ ID NO: 3481384 - DNA, 17 bp, Homo sapiens
ctgacagctgctcctag

SEQ ID NO: 3481385 - DNA, 19 bp, Homo sapiens
ctgacagctgctcctagag

SEQ ID NO: 3481386 - DNA, 22 bp, Homo sapiens
ctgacagctgctcctagaggga

SEQ ID NO: 3481387 - DNA, 16 bp, Homo sapiens
ctgacaggcaatgctg

SEQ ID NO: 3481388 - DNA, 20 bp, Homo sapiens
ctgacaggcaatgctggctg

SEQ ID NO: 3481389 - DNA, 16 bp, Homo sapiens
ctgacaggctgtgact

SEQ ID NO: 3481390 - DNA, 23 bp, Homo sapiens
ctgacaggctgtgactcttctct

SEQ ID NO: 3481391 - DNA, 22 bp, Homo sapiens
ctgacagtgtgggacaggctct

SEQ ID NO: 3481392 - DNA, 14 bp, Homo sapiens
ctgacagtttttct

SEQ ID NO: 3481393 - DNA, 16 bp, Homo sapiens
ctgacatctggaatct

SEQ ID NO: 3481394 - DNA, 16 bp, Homo sapiens
ctgacattcacctgcc

SEQ ID NO: 3481395 - DNA, 14 bp, Homo sapiens
ctgacattgccaaa

SEQ ID NO: 3481396 - DNA, 20 bp, Homo sapiens
ctgacattgccaaaaaggat

SEQ ID NO: 3481397 - DNA, 22 bp, Homo sapiens
ctgacattgttggccaaagcca

SEQ ID NO: 3481398 - DNA, 15 bp, Homo sapiens
ctgaccaaacagcca

SEQ ID NO: 3481399 - DNA, 15 bp, Homo sapiens
ctgaccagcagcgcc

SEQ ID NO: 3481400 - DNA, 16 bp, Homo sapiens
ctgaccagcagcgcct

SEQ ID NO: 3481401 - DNA, 23 bp, Homo sapiens
ctgaccagccgtgagcatgtttg

SEQ ID NO: 3481402 - DNA, 20 bp, Homo sapiens
ctgaccatgctcatctgctg

SEQ ID NO: 3481403 - DNA, 12 bp, Homo sapiens
ctgacccagtgc

SEQ ID NO: 3481404 - DNA, 18 bp, Homo sapiens
ctgacccagtgcccccac

SEQ ID NO: 3481405 - DNA, 20 bp, Homo sapiens
ctgacccagtgcccccactg

SEQ ID NO: 3481406 - DNA, 14 bp, Homo sapiens
ctgacccattgctg

SEQ ID NO: 3481407 - DNA, 18 bp, Homo sapiens
ctgaccctgtatatagcc

SEQ ID NO: 3481408 - DNA, 20 bp, Homo sapiens
ctgaccctgtatatagccca

SEQ ID NO: 3481409 - DNA, 20 bp, Homo sapiens
ctgaccgaaacagcgctggg

SEQ ID NO: 3481410 - DNA, 14 bp, Homo sapiens
ctgacctccacagc

SEQ ID NO: 3481411 - DNA, 16 bp, Homo sapiens
ctgacctggtccacag

SEQ ID NO: 3481412 - DNA, 17 bp, Homo sapiens
ctgacctggtccacagg

SEQ ID NO: 3481413 - DNA, 17 bp, Homo sapiens
ctgacctgtgagcccag

SEQ ID NO: 3481414 - DNA, 14 bp, Homo sapiens
ctgaccttcagctc

SEQ ID NO: 3481415 - DNA, 16 bp, Homo sapiens
ctgacctttaactgag

SEQ ID NO: 3481416 - DNA, 20 bp, Homo sapiens
ctgacctttaactgagggct

SEQ ID NO: 3481417 - DNA, 18 bp, Homo sapiens
ctgacctttgtcatcttt

SEQ ID NO: 3481418 - DNA, 21 bp, Homo sapiens
ctgacctttgtcatctttctt

SEQ ID NO: 3481419 - DNA, 21 bp, Homo sapiens
ctgacggccagggagaagctc

SEQ ID NO: 3481420 - DNA, 23 bp, Homo sapiens
ctgacgtagctgcaaaggacaga

SEQ ID NO: 3481421 - DNA, 24 bp, Homo sapiens
ctgacgtcagtagtttgagaccag

SEQ ID NO: 3481422 - DNA, 21 bp, Homo sapiens
ctgactagggagccatgtttc

SEQ ID NO: 3481423 - DNA, 18 bp, Homo sapiens
ctgactcagggctcctgg

SEQ ID NO: 3481424 - DNA, 13 bp, Homo sapiens
ctgactccactca

SEQ ID NO: 3481425 - DNA, 17 bp, Homo sapiens
ctgactcggtttctcca

SEQ ID NO: 3481426 - DNA, 21 bp, Homo sapiens
ctgactctaggtgcccttgga

SEQ ID NO: 3481427 - DNA, 17 bp, Homo sapiens
ctgactggatgtccaga

SEQ ID NO: 3481428 - DNA, 12 bp, Homo sapiens
ctgactgggagt

SEQ ID NO: 3481429 - DNA, 11 bp, Homo sapiens
ctgacttctgc

SEQ ID NO: 3481430 - DNA, 21 bp, Homo sapiens
ctgacttttaatgtcatttgt

SEQ ID NO: 3481431 - DNA, 17 bp, Homo sapiens
ctgagaacactgtgaaa

SEQ ID NO: 3481432 - DNA, 20 bp, Homo sapiens
ctgagaatataatactgtat

SEQ ID NO: 3481433 - DNA, 14 bp, Homo sapiens
ctgagacaggcagt

SEQ ID NO: 3481434 - DNA, 22 bp, Homo sapiens
ctgagacaggcagtttcagaga

SEQ ID NO: 3481435 - DNA, 14 bp, Homo sapiens
ctgagagtcagctc

SEQ ID NO: 3481436 - DNA, 18 bp, Homo sapiens
ctgagagtcagctctctg

SEQ ID NO: 3481437 - DNA, 19 bp, Homo sapiens
ctgagatacatacagaatt

SEQ ID NO: 3481438 - DNA, 18 bp, Homo sapiens
ctgagataccagcgagga

SEQ ID NO: 3481439 - DNA, 14 bp, Homo sapiens
ctgagatttcatct

SEQ ID NO: 3481440 - DNA, 16 bp, Homo sapiens
ctgagcaccctctgga

SEQ ID NO: 3481441 - DNA, 14 bp, Homo sapiens
ctgagccacctgcc

SEQ ID NO: 3481442 - DNA, 15 bp, Homo sapiens
ctgagcccctgtcta

SEQ ID NO: 3481443 - DNA, 16 bp, Homo sapiens
ctgagcccctgtctag

SEQ ID NO: 3481444 - DNA, 16 bp, Homo sapiens
ctgagcctctgctccc

SEQ ID NO: 3481445 - DNA, 13 bp, Homo sapiens
ctgagcctggcca

SEQ ID NO: 3481446 - DNA, 13 bp, Homo sapiens
ctgagcgcctcca

SEQ ID NO: 3481447 - DNA, 22 bp, Homo sapiens
ctgagcgcctccatccaaggcc

SEQ ID NO: 3481448 - DNA, 22 bp, Homo sapiens
ctgagctagttggttgaatttt

SEQ ID NO: 3481449 - DNA, 13 bp, Homo sapiens
ctgagctgaggca

SEQ ID NO: 3481450 - DNA, 18 bp, Homo sapiens
ctgagctgaggcagcagt

SEQ ID NO: 3481451 - DNA, 14 bp, Homo sapiens
ctgagctgcttcac

SEQ ID NO: 3481452 - DNA, 20 bp, Homo sapiens
ctgaggaaaggccagctggc

SEQ ID NO: 3481453 - DNA, 22 bp, Homo sapiens
ctgaggaaaggccagctggcag

SEQ ID NO: 3481454 - DNA, 18 bp, Homo sapiens
ctgaggaagaacggggct

SEQ ID NO: 3481455 - DNA, 20 bp, Homo sapiens
ctgaggacactaaccacgct

SEQ ID NO: 3481456 - DNA, 18 bp, Homo sapiens
ctgaggatgggtcagagc

SEQ ID NO: 3481457 - DNA, 16 bp, Homo sapiens
ctgaggcaagagaatt

SEQ ID NO: 3481458 - DNA, 16 bp, Homo sapiens
ctgaggcagggaagtc

SEQ ID NO: 3481459 - DNA, 20 bp, Homo sapiens
ctgaggcagggaagtcccca

SEQ ID NO: 3481460 - DNA, 21 bp, Homo sapiens
ctgaggcagggaagtccccag

SEQ ID NO: 3481461 - DNA, 15 bp, Homo sapiens
ctgaggcatcctctg

SEQ ID NO: 3481462 - DNA, 18 bp, Homo sapiens
ctgaggcatcctctgact

SEQ ID NO: 3481463 - DNA, 12 bp, Homo sapiens
ctgaggccacac

SEQ ID NO: 3481464 - DNA, 20 bp, Homo sapiens
ctgaggccacactcagcaca

SEQ ID NO: 3481465 - DNA, 14 bp, Homo sapiens
ctgaggcctgggcc

SEQ ID NO: 3481466 - DNA, 11 bp, Homo sapiens
ctgaggctggc

SEQ ID NO: 3481467 - DNA, 13 bp, Homo sapiens
ctgaggctgtggt

SEQ ID NO: 3481468 - DNA, 19 bp, Homo sapiens
ctgaggctgtggtcacagc

SEQ ID NO: 3481469 - DNA, 15 bp, Homo sapiens
ctgaggctttggatt

SEQ ID NO: 3481470 - DNA, 13 bp, Homo sapiens
ctgagggagcctg

SEQ ID NO: 3481471 - DNA, 17 bp, Homo sapiens
ctgagggagcctggccc

SEQ ID NO: 3481472 - DNA, 16 bp, Homo sapiens
ctgagggcctgctgga

SEQ ID NO: 3481473 - DNA, 18 bp, Homo sapiens
ctgagggtctgggcggcg

SEQ ID NO: 3481474 - DNA, 13 bp, Homo sapiens
ctgaggtgggagg

SEQ ID NO: 3481475 - DNA, 12 bp, Homo sapiens
ctgagtagaaag

SEQ ID NO: 3481476 - DNA, 14 bp, Homo sapiens
ctgagtagaaaggc

SEQ ID NO: 3481477 - DNA, 19 bp, Homo sapiens
ctgagtagaaaggccttta

SEQ ID NO: 3481478 - DNA, 20 bp, Homo sapiens
ctgagtagaaaggcctttaa

SEQ ID NO: 3481479 - DNA, 21 bp, Homo sapiens
ctgagtatctcctcgcaagct

SEQ ID NO: 3481480 - DNA, 22 bp, Homo sapiens
ctgagtatctcctcgcaagctg

SEQ ID NO: 3481481 - DNA, 14 bp, Homo sapiens
ctgagtcctggccc

SEQ ID NO: 3481482 - DNA, 15 bp, Homo sapiens
ctgagtcctggccca

SEQ ID NO: 3481483 - DNA, 17 bp, Homo sapiens
ctgagtgccttctgtgg

SEQ ID NO: 3481484 - DNA, 12 bp, Homo sapiens
ctgccaccctgg

SEQ ID NO: 3481485 - DNA, 23 bp, Homo sapiens
ctgccaccctgggcctggcagct

SEQ ID NO: 3481486 - DNA, 19 bp, Homo sapiens
ctgccactcactaggcccc

SEQ ID NO: 3481487 - DNA, 17 bp, Homo sapiens
ctgccactccagtcctg

SEQ ID NO: 3481488 - DNA, 18 bp, Homo sapiens
ctgccagagcagggggac

SEQ ID NO: 3481489 - DNA, 13 bp, Homo sapiens
ctgccagctgcac

SEQ ID NO: 3481490 - DNA, 16 bp, Homo sapiens
ctgccagctgcactga

SEQ ID NO: 3481491 - DNA, 13 bp, Homo sapiens
ctgccaggcatgg

SEQ ID NO: 3481492 - DNA, 16 bp, Homo sapiens
ctgccagggcagggcc

SEQ ID NO: 3481493 - DNA, 14 bp, Homo sapiens
ctgccagggcttcc

SEQ ID NO: 3481494 - DNA, 21 bp, Homo sapiens
ctgccagtggggaaggaggcc

SEQ ID NO: 3481495 - DNA, 22 bp, Homo sapiens
ctgccataaaacattaagaaaa

SEQ ID NO: 3481496 - DNA, 21 bp, Homo sapiens
ctgccatagccaggagcgcat

SEQ ID NO: 3481497 - DNA, 16 bp, Homo sapiens
ctgccatattctgttg

SEQ ID NO: 3481498 - DNA, 18 bp, Homo sapiens
ctgccatccaggttcagc

SEQ ID NO: 3481499 - DNA, 17 bp, Homo sapiens
ctgccatgcagggcctc

SEQ ID NO: 3481500 - DNA, 17 bp, Homo sapiens
ctgccatggaactgttt

SEQ ID NO: 3481501 - DNA, 17 bp, Homo sapiens
ctgcccaacccttccct

SEQ ID NO: 3481502 - DNA, 14 bp, Homo sapiens
ctgcccaactgtgt

SEQ ID NO: 3481503 - DNA, 16 bp, Homo sapiens
ctgcccacttgctccc

SEQ ID NO: 3481504 - DNA, 15 bp, Homo sapiens
ctgcccaggcccctg

SEQ ID NO: 3481505 - DNA, 18 bp, Homo sapiens
ctgcccatggacaggctg

SEQ ID NO: 3481506 - DNA, 12 bp, Homo sapiens
ctgccccaactc

SEQ ID NO: 3481507 - DNA, 13 bp, Homo sapiens
ctgccccaactct

SEQ ID NO: 3481508 - DNA, 13 bp, Homo sapiens
ctgccccagccag

SEQ ID NO: 3481509 - DNA, 15 bp, Homo sapiens
ctgccccagcccaga

SEQ ID NO: 3481510 - DNA, 16 bp, Homo sapiens
ctgccccagcccagat

SEQ ID NO: 3481511 - DNA, 14 bp, Homo sapiens
ctgccccagccccg

SEQ ID NO: 3481512 - DNA, 17 bp, Homo sapiens
ctgccccatcctccagc

SEQ ID NO: 3481513 - DNA, 22 bp, Homo sapiens
ctgccccatcctccagcaggga

SEQ ID NO: 3481514 - DNA, 13 bp, Homo sapiens
ctgccccatctcc

SEQ ID NO: 3481515 - DNA, 16 bp, Homo sapiens
ctgccccatctcccct

SEQ ID NO: 3481516 - DNA, 21 bp, Homo sapiens
ctgccccatctcccctcagct

SEQ ID NO: 3481517 - DNA, 18 bp, Homo sapiens
ctgcccccaggactgggc

SEQ ID NO: 3481518 - DNA, 13 bp, Homo sapiens
ctgccccgcttcc

SEQ ID NO: 3481519 - DNA, 17 bp, Homo sapiens
ctgccccgggtccccag

SEQ ID NO: 3481520 - DNA, 21 bp, Homo sapiens
ctgccccgggtccccagctcc

SEQ ID NO: 3481521 - DNA, 22 bp, Homo sapiens
ctgccccgggtccccagctccc

SEQ ID NO: 3481522 - DNA, 20 bp, Homo sapiens
ctgccccgtaggaggagact

SEQ ID NO: 3481523 - DNA, 14 bp, Homo sapiens
ctgcccctcccaga

SEQ ID NO: 3481524 - DNA, 12 bp, Homo sapiens
ctgcccctctct

SEQ ID NO: 3481525 - DNA, 13 bp, Homo sapiens
ctgcccctctctg

SEQ ID NO: 3481526 - DNA, 15 bp, Homo sapiens
ctgcccctctctggg

SEQ ID NO: 3481527 - DNA, 17 bp, Homo sapiens
ctgcccctctctgggcc

SEQ ID NO: 3481528 - DNA, 18 bp, Homo sapiens
ctgcccctctctgggcct

SEQ ID NO: 3481529 - DNA, 23 bp, Homo sapiens
ctgcccctctctgggcctcagag

SEQ ID NO: 3481530 - DNA, 22 bp, Homo sapiens
ctgccccttcctttaaaaaact

SEQ ID NO: 3481531 - DNA, 17 bp, Homo sapiens
ctgcccgcagacctctg

SEQ ID NO: 3481532 - DNA, 15 bp, Homo sapiens
ctgcccggctgcgga

SEQ ID NO: 3481533 - DNA, 17 bp, Homo sapiens
ctgccctatgggcctgc

SEQ ID NO: 3481534 - DNA, 22 bp, Homo sapiens
ctgccctcccctccggactggt

SEQ ID NO: 3481535 - DNA, 15 bp, Homo sapiens
ctgccctgccctcac

SEQ ID NO: 3481536 - DNA, 17 bp, Homo sapiens
ctgccctggcagggtca

SEQ ID NO: 3481537 - DNA, 11 bp, Homo sapiens
ctgccctgtgg

SEQ ID NO: 3481538 - DNA, 22 bp, Homo sapiens
ctgccctgtgtacttcccgggc

SEQ ID NO: 3481539 - DNA, 15 bp, Homo sapiens
ctgcccttttttctg

SEQ ID NO: 3481540 - DNA, 19 bp, Homo sapiens
ctgccgagacagaccctct

SEQ ID NO: 3481541 - DNA, 15 bp, Homo sapiens
ctgccgcagagctgg

SEQ ID NO: 3481542 - DNA, 18 bp, Homo sapiens
ctgccgcagagctggccg

SEQ ID NO: 3481543 - DNA, 17 bp, Homo sapiens
ctgccgctacctccctc

SEQ ID NO: 3481544 - DNA, 23 bp, Homo sapiens
ctgccggagaggaagagacactc

SEQ ID NO: 3481545 - DNA, 12 bp, Homo sapiens
ctgccggcacag

SEQ ID NO: 3481546 - DNA, 14 bp, Homo sapiens
ctgccggcacagct

SEQ ID NO: 3481547 - DNA, 16 bp, Homo sapiens
ctgccggcacagctgg

SEQ ID NO: 3481548 - DNA, 19 bp, Homo sapiens
ctgccggcacagctgggat

SEQ ID NO: 3481549 - DNA, 15 bp, Homo sapiens
ctgccggccctgggg

SEQ ID NO: 3481550 - DNA, 16 bp, Homo sapiens
ctgccggccctggggc

SEQ ID NO: 3481551 - DNA, 21 bp, Homo sapiens
ctgccgggctgagggcctgct

SEQ ID NO: 3481552 - DNA, 23 bp, Homo sapiens
ctgccgggctgagggcctgctgg

SEQ ID NO: 3481553 - DNA, 19 bp, Homo sapiens
ctgccgtcagtgctgtgct

SEQ ID NO: 3481554 - DNA, 21 bp, Homo sapiens
ctgccgtggggccgccgcctc

SEQ ID NO: 3481555 - DNA, 13 bp, Homo sapiens
ctgcctaggtccc

SEQ ID NO: 3481556 - DNA, 13 bp, Homo sapiens
ctgcctcagcctc

SEQ ID NO: 3481557 - DNA, 11 bp, Homo sapiens
ctgcctcagga

SEQ ID NO: 3481558 - DNA, 12 bp, Homo sapiens
ctgcctcaggac

SEQ ID NO: 3481559 - DNA, 13 bp, Homo sapiens
ctgcctcatttag

SEQ ID NO: 3481560 - DNA, 17 bp, Homo sapiens
ctgcctccaggagctgc

SEQ ID NO: 3481561 - DNA, 15 bp, Homo sapiens
ctgcctccagggctg

SEQ ID NO: 3481562 - DNA, 16 bp, Homo sapiens
ctgcctccattatcca

SEQ ID NO: 3481563 - DNA, 19 bp, Homo sapiens
ctgcctcgaaacacagaaa

SEQ ID NO: 3481564 - DNA, 17 bp, Homo sapiens
ctgcctcgaactggctg

SEQ ID NO: 3481565 - DNA, 14 bp, Homo sapiens
ctgcctctccaggc

SEQ ID NO: 3481566 - DNA, 15 bp, Homo sapiens
ctgcctctccaggca

SEQ ID NO: 3481567 - DNA, 17 bp, Homo sapiens
ctgcctctgacacacag

SEQ ID NO: 3481568 - DNA, 19 bp, Homo sapiens
ctgcctgaacctggggtca

SEQ ID NO: 3481569 - DNA, 16 bp, Homo sapiens
ctgcctgaagtcacac

SEQ ID NO: 3481570 - DNA, 15 bp, Homo sapiens
ctgcctgacaaggcc

SEQ ID NO: 3481571 - DNA, 18 bp, Homo sapiens
ctgcctgacaaggccagc

SEQ ID NO: 3481572 - DNA, 16 bp, Homo sapiens
ctgcctgacaggctgt

SEQ ID NO: 3481573 - DNA, 20 bp, Homo sapiens
ctgcctgacatttggagtgt

SEQ ID NO: 3481574 - DNA, 17 bp, Homo sapiens
ctgcctgccaccctgcc

SEQ ID NO: 3481575 - DNA, 15 bp, Homo sapiens
ctgcctgccagctgc

SEQ ID NO: 3481576 - DNA, 16 bp, Homo sapiens
ctgcctgccagctgca

SEQ ID NO: 3481577 - DNA, 13 bp, Homo sapiens
ctgcctgcccaca

SEQ ID NO: 3481578 - DNA, 17 bp, Homo sapiens
ctgcctgcccaggcccc

SEQ ID NO: 3481579 - DNA, 12 bp, Homo sapiens
ctgcctgctttg

SEQ ID NO: 3481580 - DNA, 23 bp, Homo sapiens
ctgcctggacttggcccctgcca

SEQ ID NO: 3481581 - DNA, 11 bp, Homo sapiens
ctgcctgtctg

SEQ ID NO: 3481582 - DNA, 12 bp, Homo sapiens
ctgcctgtctgc

SEQ ID NO: 3481583 - DNA, 15 bp, Homo sapiens
ctgcctgtctgcccc

SEQ ID NO: 3481584 - DNA, 18 bp, Homo sapiens
ctgcctgtctgccccagc

SEQ ID NO: 3481585 - DNA, 12 bp, Homo sapiens
ctgcctgtggcg

SEQ ID NO: 3481586 - DNA, 22 bp, Homo sapiens
ctgcctgtggcgccgtctccag

SEQ ID NO: 3481587 - DNA, 17 bp, Homo sapiens
ctgcctgttcagctcca

SEQ ID NO: 3481588 - DNA, 19 bp, Homo sapiens
ctgcctgttcagctccagc

SEQ ID NO: 3481589 - DNA, 14 bp, Homo sapiens
ctgccttagcttca

SEQ ID NO: 3481590 - DNA, 16 bp, Homo sapiens
ctgccttagcttcagg

SEQ ID NO: 3481591 - DNA, 13 bp, Homo sapiens
ctgccttcctcct

SEQ ID NO: 3481592 - DNA, 14 bp, Homo sapiens
ctgccttcctcctg

SEQ ID NO: 3481593 - DNA, 15 bp, Homo sapiens
ctgccttcctcctgg

SEQ ID NO: 3481594 - DNA, 18 bp, Homo sapiens
ctgccttcctcctgggcc

SEQ ID NO: 3481595 - DNA, 17 bp, Homo sapiens
ctgccttcgcttcttgc

SEQ ID NO: 3481596 - DNA, 23 bp, Homo sapiens
ctgccttcgcttcttgcctctgt

SEQ ID NO: 3481597 - DNA, 14 bp, Homo sapiens
ctgccttgcctcct

SEQ ID NO: 3481598 - DNA, 18 bp, Homo sapiens
ctgccttggctcagacat

SEQ ID NO: 3481599 - DNA, 17 bp, Homo sapiens
ctgcctttagaaaatat

SEQ ID NO: 3481600 - DNA, 12 bp, Homo sapiens
ctgcctttattg

SEQ ID NO: 3481601 - DNA, 17 bp, Homo sapiens
ctgcctttattgtgttt

SEQ ID NO: 3481602 - DNA, 18 bp, Homo sapiens
ctgcctttgatgttacag

SEQ ID NO: 3481603 - DNA, 20 bp, Homo sapiens
ctgcctttgcctccagaagc

SEQ ID NO: 3481604 - DNA, 16 bp, Homo sapiens
ctgcgactttctgcct

SEQ ID NO: 3481605 - DNA, 16 bp, Homo sapiens
ctgcgccagtcctgct

SEQ ID NO: 3481606 - DNA, 20 bp, Homo sapiens
ctgcgccagtcctgctacct

SEQ ID NO: 3481607 - DNA, 13 bp, Homo sapiens
ctgcgcctgctgc

SEQ ID NO: 3481608 - DNA, 21 bp, Homo sapiens
ctgcggaatgaaccacatctt

SEQ ID NO: 3481609 - DNA, 15 bp, Homo sapiens
ctgcggagccggcac

SEQ ID NO: 3481610 - DNA, 17 bp, Homo sapiens
ctgcggagccggcacct

SEQ ID NO: 3481611 - DNA, 13 bp, Homo sapiens
ctgcggcaggact

SEQ ID NO: 3481612 - DNA, 18 bp, Homo sapiens
ctgcggcaggactgcaga

SEQ ID NO: 3481613 - DNA, 19 bp, Homo sapiens
ctgcggcaggactgcagag

SEQ ID NO: 3481614 - DNA, 17 bp, Homo sapiens
ctgcggcgtacaggctg

SEQ ID NO: 3481615 - DNA, 23 bp, Homo sapiens
ctgcgggtgaacaaagcagccac

SEQ ID NO: 3481616 - DNA, 22 bp, Homo sapiens
ctgcggtagatgggagggaggc

SEQ ID NO: 3481617 - DNA, 19 bp, Homo sapiens
ctgcggtccacccaggagc

SEQ ID NO: 3481618 - DNA, 21 bp, Homo sapiens
ctgtcactcattgctgagcct

SEQ ID NO: 3481619 - DNA, 13 bp, Homo sapiens
ctgtcagtcacag

SEQ ID NO: 3481620 - DNA, 15 bp, Homo sapiens
ctgtcagtcacagcc

SEQ ID NO: 3481621 - DNA, 16 bp, Homo sapiens
ctgtcattttgcactg

SEQ ID NO: 3481622 - DNA, 18 bp, Homo sapiens
ctgtcattttgcactgta

SEQ ID NO: 3481623 - DNA, 13 bp, Homo sapiens
ctgtccagctcca

SEQ ID NO: 3481624 - DNA, 14 bp, Homo sapiens
ctgtccagctccaa

SEQ ID NO: 3481625 - DNA, 21 bp, Homo sapiens
ctgtccagctcccgctgtggc

SEQ ID NO: 3481626 - DNA, 19 bp, Homo sapiens
ctgtccaggcactgagata

SEQ ID NO: 3481627 - DNA, 13 bp, Homo sapiens
ctgtccagtgcct

SEQ ID NO: 3481628 - DNA, 14 bp, Homo sapiens
ctgtccagtgccta

SEQ ID NO: 3481629 - DNA, 17 bp, Homo sapiens
ctgtccagtgcctacat

SEQ ID NO: 3481630 - DNA, 19 bp, Homo sapiens
ctgtcccaggttatctggg

SEQ ID NO: 3481631 - DNA, 21 bp, Homo sapiens
ctgtcccatctggtcatttgg

SEQ ID NO: 3481632 - DNA, 20 bp, Homo sapiens
ctgtcccccaacactgagca

SEQ ID NO: 3481633 - DNA, 19 bp, Homo sapiens
ctgtcccctgcgaggagaa

SEQ ID NO: 3481634 - DNA, 12 bp, Homo sapiens
ctgtccctcaca

SEQ ID NO: 3481635 - DNA, 13 bp, Homo sapiens
ctgtccctcacag

SEQ ID NO: 3481636 - DNA, 16 bp, Homo sapiens
ctgtccctcacagcac

SEQ ID NO: 3481637 - DNA, 17 bp, Homo sapiens
ctgtccctccgggacct

SEQ ID NO: 3481638 - DNA, 18 bp, Homo sapiens
ctgtccctgcgcctttcc

SEQ ID NO: 3481639 - DNA, 14 bp, Homo sapiens
ctgtccgagctttg

SEQ ID NO: 3481640 - DNA, 21 bp, Homo sapiens
ctgtccggaatgccacccaca

SEQ ID NO: 3481641 - DNA, 17 bp, Homo sapiens
ctgtcctactctgtgtc

SEQ ID NO: 3481642 - DNA, 13 bp, Homo sapiens
ctgtcctcagcct

SEQ ID NO: 3481643 - DNA, 14 bp, Homo sapiens
ctgtcctcagcctt

SEQ ID NO: 3481644 - DNA, 20 bp, Homo sapiens
ctgtcctcagccttgccaga

SEQ ID NO: 3481645 - DNA, 12 bp, Homo sapiens
ctgtcctccaag

SEQ ID NO: 3481646 - DNA, 15 bp, Homo sapiens
ctgtcctgaaagcgg

SEQ ID NO: 3481647 - DNA, 22 bp, Homo sapiens
ctgtcctgaaagcggctgcctc

SEQ ID NO: 3481648 - DNA, 23 bp, Homo sapiens
ctgtcctgaaagcggctgcctcc

SEQ ID NO: 3481649 - DNA, 13 bp, Homo sapiens
ctgtcctgctggt

SEQ ID NO: 3481650 - DNA, 14 bp, Homo sapiens
ctgtcctgggagtg

SEQ ID NO: 3481651 - DNA, 19 bp, Homo sapiens
ctgtccttacccatctgca

SEQ ID NO: 3481652 - DNA, 22 bp, Homo sapiens
ctgtcctttctagagcactgcc

SEQ ID NO: 3481653 - DNA, 13 bp, Homo sapiens
ctgtcgcccagtc

SEQ ID NO: 3481654 - DNA, 22 bp, Homo sapiens
ctgtcggcgctgccccatctcc

SEQ ID NO: 3481655 - DNA, 18 bp, Homo sapiens
ctgtctacttgctcaggt

SEQ ID NO: 3481656 - DNA, 20 bp, Homo sapiens
ctgtctacttgctcaggtac

SEQ ID NO: 3481657 - DNA, 13 bp, Homo sapiens
ctgtctagagagg

SEQ ID NO: 3481658 - DNA, 12 bp, Homo sapiens
ctgtctcagcct

SEQ ID NO: 3481659 - DNA, 17 bp, Homo sapiens
ctgtctcagcctcccag

SEQ ID NO: 3481660 - DNA, 15 bp, Homo sapiens
ctgtctcatccatca

SEQ ID NO: 3481661 - DNA, 15 bp, Homo sapiens
ctgtctccagcttcc

SEQ ID NO: 3481662 - DNA, 13 bp, Homo sapiens
ctgtctcctagga

SEQ ID NO: 3481663 - DNA, 23 bp, Homo sapiens
ctgtctcctttcaccccagggcc

SEQ ID NO: 3481664 - DNA, 11 bp, Homo sapiens
ctgtctctctc

SEQ ID NO: 3481665 - DNA, 13 bp, Homo sapiens
ctgtctctctggg

SEQ ID NO: 3481666 - DNA, 14 bp, Homo sapiens
ctgtctctctgggc

SEQ ID NO: 3481667 - DNA, 15 bp, Homo sapiens
ctgtctctctgggct

SEQ ID NO: 3481668 - DNA, 15 bp, Homo sapiens
ctgtctgcagccttg

SEQ ID NO: 3481669 - DNA, 15 bp, Homo sapiens
ctgtctgccccagcc

SEQ ID NO: 3481670 - DNA, 15 bp, Homo sapiens
ctgtctggccaggcc

SEQ ID NO: 3481671 - DNA, 23 bp, Homo sapiens
ctgtctggtggccccgtttctgg

SEQ ID NO: 3481672 - DNA, 14 bp, Homo sapiens
ctgtctgtgacctg

SEQ ID NO: 3481673 - DNA, 17 bp, Homo sapiens
ctgtcttcacctgattc

SEQ ID NO: 3481674 - DNA, 18 bp, Homo sapiens
ctgtcttcacctgattca

SEQ ID NO: 3481675 - DNA, 18 bp, Homo sapiens
ctgtcttcagtaagccgt

SEQ ID NO: 3481676 - DNA, 16 bp, Homo sapiens
ctgtcttcctctgcaa

SEQ ID NO: 3481677 - DNA, 13 bp, Homo sapiens
ctgtcttgccagc

SEQ ID NO: 3481678 - DNA, 15 bp, Homo sapiens
ctgtcttgccagcca

SEQ ID NO: 3481679 - DNA, 16 bp, Homo sapiens
ctgtcttgccagccag

SEQ ID NO: 3481680 - DNA, 17 bp, Homo sapiens
ctgtcttgccagccaga

SEQ ID NO: 3481681 - DNA, 19 bp, Homo sapiens
ctgtcttgccagccagaag

SEQ ID NO: 3481682 - DNA, 21 bp, Homo sapiens
ctgtcttgttcattttgagta

SEQ ID NO: 3481683 - DNA, 17 bp, Homo sapiens
ctgtctttaaaagagag

SEQ ID NO: 3481684 - DNA, 18 bp, Homo sapiens
ctgtctttaaaagagaga

SEQ ID NO: 3481685 - DNA, 13 bp, Homo sapiens
ctgtctttcctag

SEQ ID NO: 3481686 - DNA, 14 bp, Homo sapiens
ctgtgaacagcttg

SEQ ID NO: 3481687 - DNA, 22 bp, Homo sapiens
ctgtgaactgaaattaaaacta

SEQ ID NO: 3481688 - DNA, 14 bp, Homo sapiens
ctgtgaaggaccct

SEQ ID NO: 3481689 - DNA, 21 bp, Homo sapiens
ctgtgaatgccactgccttcg

SEQ ID NO: 3481690 - DNA, 18 bp, Homo sapiens
ctgtgacccccagctccg

SEQ ID NO: 3481691 - DNA, 14 bp, Homo sapiens
ctgtgactcttctc

SEQ ID NO: 3481692 - DNA, 15 bp, Homo sapiens
ctgtgactcttctct

SEQ ID NO: 3481693 - DNA, 20 bp, Homo sapiens
ctgtgagactcgagaacttt

SEQ ID NO: 3481694 - DNA, 15 bp, Homo sapiens
ctgtgagcaagaagt

SEQ ID NO: 3481695 - DNA, 15 bp, Homo sapiens
ctgtgagcccagctg

SEQ ID NO: 3481696 - DNA, 16 bp, Homo sapiens
ctgtgaggagccccat

SEQ ID NO: 3481697 - DNA, 18 bp, Homo sapiens
ctgtgaggagccccatct

SEQ ID NO: 3481698 - DNA, 21 bp, Homo sapiens
ctgtgatacagaactcttaaa

SEQ ID NO: 3481699 - DNA, 14 bp, Homo sapiens
ctgtgatgccctgc

SEQ ID NO: 3481700 - DNA, 14 bp, Homo sapiens
ctgtgatgctgggc

SEQ ID NO: 3481701 - DNA, 19 bp, Homo sapiens
ctgtgcacaaaacccagac

SEQ ID NO: 3481702 - DNA, 20 bp, Homo sapiens
ctgtgcacaaaacccagacc

SEQ ID NO: 3481703 - DNA, 22 bp, Homo sapiens
ctgtgcacaaaacccagacctg

SEQ ID NO: 3481704 - DNA, 17 bp, Homo sapiens
ctgtgcacgcagtggcc

SEQ ID NO: 3481705 - DNA, 14 bp, Homo sapiens
ctgtgcactgccca

SEQ ID NO: 3481706 - DNA, 19 bp, Homo sapiens
ctgtgcagccgctgagcga

SEQ ID NO: 3481707 - DNA, 17 bp, Homo sapiens
ctgtgcatttctggttg

SEQ ID NO: 3481708 - DNA, 20 bp, Homo sapiens
ctgtgccccttgacaactgg

SEQ ID NO: 3481709 - DNA, 16 bp, Homo sapiens
ctgtgccctcctgacc

SEQ ID NO: 3481710 - DNA, 18 bp, Homo sapiens
ctgtgccctccttcccaa

SEQ ID NO: 3481711 - DNA, 21 bp, Homo sapiens
ctgtgctatggtgctctgtct

SEQ ID NO: 3481712 - DNA, 12 bp, Homo sapiens
ctgtgctcagga

SEQ ID NO: 3481713 - DNA, 18 bp, Homo sapiens
ctgtgctcaggactcaga

SEQ ID NO: 3481714 - DNA, 19 bp, Homo sapiens
ctgtgctcaggactcagaa

SEQ ID NO: 3481715 - DNA, 15 bp, Homo sapiens
ctgtgctctggacag

SEQ ID NO: 3481716 - DNA, 13 bp, Homo sapiens
ctgtgctgtgtgt

SEQ ID NO: 3481717 - DNA, 18 bp, Homo sapiens
ctgtgctgtgtgtgacgt

SEQ ID NO: 3481718 - DNA, 16 bp, Homo sapiens
ctgtgcttatggtacc

SEQ ID NO: 3481719 - DNA, 16 bp, Homo sapiens
ctgtgcttgaaggccc

SEQ ID NO: 3481720 - DNA, 22 bp, Homo sapiens
ctgtgcttgaaggccctgctga

SEQ ID NO: 3481721 - DNA, 21 bp, Homo sapiens
ctgtggagtcccaaccccagc

SEQ ID NO: 3481722 - DNA, 22 bp, Homo sapiens
ctgtggccagcttgttatttat

SEQ ID NO: 3481723 - DNA, 14 bp, Homo sapiens
ctgtggccctgtcc

SEQ ID NO: 3481724 - DNA, 15 bp, Homo sapiens
ctgtgggaaggccag

SEQ ID NO: 3481725 - DNA, 14 bp, Homo sapiens
ctgtgggcaattta

SEQ ID NO: 3481726 - DNA, 18 bp, Homo sapiens
ctgtgggcaatttagaaa

SEQ ID NO: 3481727 - DNA, 12 bp, Homo sapiens
ctgtggggctga

SEQ ID NO: 3481728 - DNA, 22 bp, Homo sapiens
ctgtggggtcaacccttctgga

SEQ ID NO: 3481729 - DNA, 15 bp, Homo sapiens
ctgtgggtctctgga

SEQ ID NO: 3481730 - DNA, 16 bp, Homo sapiens
ctgtgggtctgggagt

SEQ ID NO: 3481731 - DNA, 22 bp, Homo sapiens
ctgtgggtctgggagtcacaca

SEQ ID NO: 3481732 - DNA, 21 bp, Homo sapiens
ctgtgggtgatggggaggggc

SEQ ID NO: 3481733 - DNA, 16 bp, Homo sapiens
ctgtggtcacagcgga

SEQ ID NO: 3481734 - DNA, 14 bp, Homo sapiens
ctgtggtgtgtccc

SEQ ID NO: 3481735 - DNA, 22 bp, Homo sapiens
ctgtggtgtgtccccctctgtc

SEQ ID NO: 3481736 - DNA, 19 bp, Homo sapiens
ctgtgtaaaatgtaatgca

SEQ ID NO: 3481737 - DNA, 15 bp, Homo sapiens
ctgtgtaaccttggg

SEQ ID NO: 3481738 - DNA, 14 bp, Homo sapiens
ctgtgtatttgctt

SEQ ID NO: 3481739 - DNA, 15 bp, Homo sapiens
ctgtgtatttgcttt

SEQ ID NO: 3481740 - DNA, 17 bp, Homo sapiens
ctgtgtcaatccagatg

SEQ ID NO: 3481741 - DNA, 20 bp, Homo sapiens
ctgtgtcagcatagaagtaa

SEQ ID NO: 3481742 - DNA, 21 bp, Homo sapiens
ctgtgtcaggtggggcagctt

SEQ ID NO: 3481743 - DNA, 13 bp, Homo sapiens
ctgtgtccatgcg

SEQ ID NO: 3481744 - DNA, 22 bp, Homo sapiens
ctgtgtccatgcgctcagggcc

SEQ ID NO: 3481745 - DNA, 16 bp, Homo sapiens
ctgtgtctaaactgca

SEQ ID NO: 3481746 - DNA, 16 bp, Homo sapiens
ctgtgtctgtgtttta

SEQ ID NO: 3481747 - DNA, 14 bp, Homo sapiens
ctgtgtcttgcaat

SEQ ID NO: 3481748 - DNA, 16 bp, Homo sapiens
ctgtgtcttgcaatgg

SEQ ID NO: 3481749 - DNA, 20 bp, Homo sapiens
ctgtgtcttgcaatggcagc

SEQ ID NO: 3481750 - DNA, 22 bp, Homo sapiens
ctgtgtcttgcaatggcagcct

SEQ ID NO: 3481751 - DNA, 20 bp, Homo sapiens
cttcgctgtcccccaacact

SEQ ID NO: 3481752 - DNA, 18 bp, Homo sapiens
cttcggccaaacagacag

SEQ ID NO: 3481753 - DNA, 16 bp, Homo sapiens
cttcggccagagctga

SEQ ID NO: 3481754 - DNA, 15 bp, Homo sapiens
cttcgggaccaggat

SEQ ID NO: 3481755 - DNA, 19 bp, Homo sapiens
cttcgggaggtcgaggcag

SEQ ID NO: 3481756 - DNA, 16 bp, Homo sapiens
cttcgggcccttccca

SEQ ID NO: 3481757 - DNA, 19 bp, Homo sapiens
cttcgggctggccatctgg

SEQ ID NO: 3481758 - DNA, 21 bp, Homo sapiens
cttcggggtagaggctgggag

SEQ ID NO: 3481759 - DNA, 21 bp, Homo sapiens
cttcgtctttcccatggggag

SEQ ID NO: 3481760 - DNA, 19 bp, Homo sapiens
cttcgttctttttaagtta

SEQ ID NO: 3481761 - DNA, 18 bp, Homo sapiens
cttcgtttactatgcctg

SEQ ID NO: 3481762 - DNA, 19 bp, Homo sapiens
cttcgtttactatgcctgt

SEQ ID NO: 3481763 - DNA, 21 bp, Homo sapiens
cttctaaaggtgttgtccctt

SEQ ID NO: 3481764 - DNA, 22 bp, Homo sapiens
cttctaaaggtgttgtcccttc

SEQ ID NO: 3481765 - DNA, 23 bp, Homo sapiens
cttctaaaggtgttgtcccttct

SEQ ID NO: 3481766 - DNA, 13 bp, Homo sapiens
cttctacttctgc

SEQ ID NO: 3481767 - DNA, 21 bp, Homo sapiens
cttctacttctgcccttgcca

SEQ ID NO: 3481768 - DNA, 20 bp, Homo sapiens
cttctagaggctcatggccc

SEQ ID NO: 3481769 - DNA, 21 bp, Homo sapiens
cttctagaggctcatggccct

SEQ ID NO: 3481770 - DNA, 22 bp, Homo sapiens
cttctaggatagctaactgtaa

SEQ ID NO: 3481771 - DNA, 16 bp, Homo sapiens
cttctcaaaagaactt

SEQ ID NO: 3481772 - DNA, 13 bp, Homo sapiens
cttctcacattta

SEQ ID NO: 3481773 - DNA, 17 bp, Homo sapiens
cttctcaccagctgcaa

SEQ ID NO: 3481774 - DNA, 21 bp, Homo sapiens
cttctcaccagctgcaaagtg

SEQ ID NO: 3481775 - DNA, 22 bp, Homo sapiens
cttctcaccagctgcaaagtgt

SEQ ID NO: 3481776 - DNA, 15 bp, Homo sapiens
cttctcatcctgcag

SEQ ID NO: 3481777 - DNA, 12 bp, Homo sapiens
cttctcatctgt

SEQ ID NO: 3481778 - DNA, 21 bp, Homo sapiens
cttctcatttcacccctccct

SEQ ID NO: 3481779 - DNA, 22 bp, Homo sapiens
cttctccaaaaatctgcctggg

SEQ ID NO: 3481780 - DNA, 14 bp, Homo sapiens
cttctccaccctgc

SEQ ID NO: 3481781 - DNA, 15 bp, Homo sapiens
cttctccaccctgct

SEQ ID NO: 3481782 - DNA, 16 bp, Homo sapiens
cttctccaccctgctc

SEQ ID NO: 3481783 - DNA, 14 bp, Homo sapiens
cttctccatccaca

SEQ ID NO: 3481784 - DNA, 19 bp, Homo sapiens
cttctccatggccctgcca

SEQ ID NO: 3481785 - DNA, 18 bp, Homo sapiens
cttctcccatctcttcct

SEQ ID NO: 3481786 - DNA, 19 bp, Homo sapiens
cttctcccctcttctgagc

SEQ ID NO: 3481787 - DNA, 22 bp, Homo sapiens
cttctccctcatttcaggagca

SEQ ID NO: 3481788 - DNA, 16 bp, Homo sapiens
cttctcctatgtgtaa

SEQ ID NO: 3481789 - DNA, 18 bp, Homo sapiens
cttctcctcttgtaaata

SEQ ID NO: 3481790 - DNA, 15 bp, Homo sapiens
cttctccttggagga

SEQ ID NO: 3481791 - DNA, 16 bp, Homo sapiens
cttctccttggaggac

SEQ ID NO: 3481792 - DNA, 18 bp, Homo sapiens
cttctccttggaggacag

SEQ ID NO: 3481793 - DNA, 18 bp, Homo sapiens
cttctctacccatctccc

SEQ ID NO: 3481794 - DNA, 20 bp, Homo sapiens
cttctctacccatctccccc

SEQ ID NO: 3481795 - DNA, 21 bp, Homo sapiens
cttctctacccatctccccca

SEQ ID NO: 3481796 - DNA, 17 bp, Homo sapiens
cttctctataaaaaata

SEQ ID NO: 3481797 - DNA, 16 bp, Homo sapiens
cttctctatgataatt

SEQ ID NO: 3481798 - DNA, 13 bp, Homo sapiens
cttctctctgtgg

SEQ ID NO: 3481799 - DNA, 12 bp, Homo sapiens
cttctctgactt

SEQ ID NO: 3481800 - DNA, 15 bp, Homo sapiens
cttctctgacttctg

SEQ ID NO: 3481801 - DNA, 21 bp, Homo sapiens
cttctctgtgaacgatttaga

SEQ ID NO: 3481802 - DNA, 13 bp, Homo sapiens
cttctgcctggag

SEQ ID NO: 3481803 - DNA, 19 bp, Homo sapiens
cttctgctactggcaaaag

SEQ ID NO: 3481804 - DNA, 14 bp, Homo sapiens
cttctgctcagctc

SEQ ID NO: 3481805 - DNA, 18 bp, Homo sapiens
cttctgctcagctctggg

SEQ ID NO: 3481806 - DNA, 13 bp, Homo sapiens
cttctgcttcagc

SEQ ID NO: 3481807 - DNA, 16 bp, Homo sapiens
cttctgcttcagcctc

SEQ ID NO: 3481808 - DNA, 15 bp, Homo sapiens
cttctggactggttt

SEQ ID NO: 3481809 - DNA, 13 bp, Homo sapiens
cttctggccagga

SEQ ID NO: 3481810 - DNA, 19 bp, Homo sapiens
cttctgggagggcagcagg

SEQ ID NO: 3481811 - DNA, 16 bp, Homo sapiens
cttctgggcctgacca

SEQ ID NO: 3481812 - DNA, 14 bp, Homo sapiens
cttctgtccctcac

SEQ ID NO: 3481813 - DNA, 21 bp, Homo sapiens
cttctgtcctactctgtgtca

SEQ ID NO: 3481814 - DNA, 14 bp, Homo sapiens
cttctgtgccaccc

SEQ ID NO: 3481815 - DNA, 19 bp, Homo sapiens
cttctgtggggactccggc

SEQ ID NO: 3481816 - DNA, 16 bp, Homo sapiens
cttctgtggggcccct

SEQ ID NO: 3481817 - DNA, 20 bp, Homo sapiens
cttctgtggggcccctcacc

SEQ ID NO: 3481818 - DNA, 13 bp, Homo sapiens
cttctgtgtatct

SEQ ID NO: 3481819 - DNA, 12 bp, Homo sapiens
cttctgttttga

SEQ ID NO: 3481820 - DNA, 21 bp, Homo sapiens
cttctgttttgagttttgtag

SEQ ID NO: 3481821 - DNA, 21 bp, Homo sapiens
cttcttaagatacaaatggtg

SEQ ID NO: 3481822 - DNA, 19 bp, Homo sapiens
cttcttatggaattgattt

SEQ ID NO: 3481823 - DNA, 17 bp, Homo sapiens
cttcttattacccaaac

SEQ ID NO: 3481824 - DNA, 14 bp, Homo sapiens
cttcttcacatcca

SEQ ID NO: 3481825 - DNA, 14 bp, Homo sapiens
cttcttcacctctt

SEQ ID NO: 3481826 - DNA, 12 bp, Homo sapiens
cttcttcagggc

SEQ ID NO: 3481827 - DNA, 16 bp, Homo sapiens
cttcttcatattctaa

SEQ ID NO: 3481828 - DNA, 12 bp, Homo sapiens
cttcttctccta

SEQ ID NO: 3481829 - DNA, 19 bp, Homo sapiens
cttcttctcctatgtgtaa

SEQ ID NO: 3481830 - DNA, 12 bp, Homo sapiens
cttcttgaaggt

SEQ ID NO: 3481831 - DNA, 13 bp, Homo sapiens
cttcttgcctctg

SEQ ID NO: 3481832 - DNA, 18 bp, Homo sapiens
cttcttgcctctgtgctg

SEQ ID NO: 3481833 - DNA, 15 bp, Homo sapiens
cttcttgttctgaga

SEQ ID NO: 3481834 - DNA, 16 bp, Homo sapiens
cttcttgttctgagat

SEQ ID NO: 3481835 - DNA, 15 bp, Homo sapiens
cttctttttcaggct

SEQ ID NO: 3481836 - DNA, 12 bp, Homo sapiens
cttgaaaaacaa

SEQ ID NO: 3481837 - DNA, 15 bp, Homo sapiens
cttgaaaagggtgtt

SEQ ID NO: 3481838 - DNA, 22 bp, Homo sapiens
cttgaaaataagaatagaaata

SEQ ID NO: 3481839 - DNA, 18 bp, Homo sapiens
cttgaaatatcctgcttg

SEQ ID NO: 3481840 - DNA, 20 bp, Homo sapiens
cttgaaattaagaaggcaaa

SEQ ID NO: 3481841 - DNA, 16 bp, Homo sapiens
cttgaaccccaaatgc

SEQ ID NO: 3481842 - DNA, 18 bp, Homo sapiens
cttgaactcctggactca

SEQ ID NO: 3481843 - DNA, 19 bp, Homo sapiens
cttgaactcctggcctcaa

SEQ ID NO: 3481844 - DNA, 20 bp, Homo sapiens
cttgaactgggtacttgtgg

SEQ ID NO: 3481845 - DNA, 23 bp, Homo sapiens
cttgaactttcctggatgtctga

SEQ ID NO: 3481846 - DNA, 18 bp, Homo sapiens
cttgaagaactgcaggcc

SEQ ID NO: 3481847 - DNA, 20 bp, Homo sapiens
cttgaagaactgcaggccct

SEQ ID NO: 3481848 - DNA, 16 bp, Homo sapiens
cttgaagaatattccc

SEQ ID NO: 3481849 - DNA, 19 bp, Homo sapiens
cttgaagagaaaaaagtca

SEQ ID NO: 3481850 - DNA, 18 bp, Homo sapiens
cttgaaggccctgctgag

SEQ ID NO: 3481851 - DNA, 14 bp, Homo sapiens
cttgaagggccaga

SEQ ID NO: 3481852 - DNA, 16 bp, Homo sapiens
cttgaagggccagagc

SEQ ID NO: 3481853 - DNA, 14 bp, Homo sapiens
cttgaaggtgctga

SEQ ID NO: 3481854 - DNA, 22 bp, Homo sapiens
cttgaaggtgctgacggccagg

SEQ ID NO: 3481855 - DNA, 13 bp, Homo sapiens
cttgaagtcctgg

SEQ ID NO: 3481856 - DNA, 15 bp, Homo sapiens
cttgaagtcctggct

SEQ ID NO: 3481857 - DNA, 10 bp, Homo sapiens
cttgaagttg

SEQ ID NO: 3481858 - DNA, 20 bp, Homo sapiens
cttgaatttttttctgcaca

SEQ ID NO: 3481859 - DNA, 22 bp, Homo sapiens
cttgaatttttttctgcacagc

SEQ ID NO: 3481860 - DNA, 20 bp, Homo sapiens
cttgacacatagtttttcag

SEQ ID NO: 3481861 - DNA, 16 bp, Homo sapiens
cttgacagaaagcagt

SEQ ID NO: 3481862 - DNA, 23 bp, Homo sapiens
cttgacagaaagcagttctgatg

SEQ ID NO: 3481863 - DNA, 13 bp, Homo sapiens
cttgacagggcac

SEQ ID NO: 3481864 - DNA, 15 bp, Homo sapiens
cttgacagggcacac

SEQ ID NO: 3481865 - DNA, 19 bp, Homo sapiens
cttgaccaagcaggaagct

SEQ ID NO: 3481866 - DNA, 14 bp, Homo sapiens
cttgacctgaggct

SEQ ID NO: 3481867 - DNA, 23 bp, Homo sapiens
cttgacctgaggctgtggtcaca

SEQ ID NO: 3481868 - DNA, 20 bp, Homo sapiens
cttgacctgcattgtaaata

SEQ ID NO: 3481869 - DNA, 13 bp, Homo sapiens
cttgacctttgta

SEQ ID NO: 3481870 - DNA, 22 bp, Homo sapiens
cttgacctttgtacagcccaga

SEQ ID NO: 3481871 - DNA, 21 bp, Homo sapiens
cttgactatgtctagagcctc

SEQ ID NO: 3481872 - DNA, 20 bp, Homo sapiens
cttgactttagtctgcaaaa

SEQ ID NO: 3481873 - DNA, 22 bp, Homo sapiens
cttgagaaatatggacacttaa

SEQ ID NO: 3481874 - DNA, 16 bp, Homo sapiens
cttgagcccaggagtt

SEQ ID NO: 3481875 - DNA, 17 bp, Homo sapiens
cttgagggttgggctgg

SEQ ID NO: 3481876 - DNA, 18 bp, Homo sapiens
cttgagttgattcagctc

SEQ ID NO: 3481877 - DNA, 19 bp, Homo sapiens
cttgagtttaaattgtaat

SEQ ID NO: 3481878 - DNA, 13 bp, Homo sapiens
cttgagtttgtcg

SEQ ID NO: 3481879 - DNA, 14 bp, Homo sapiens
cttgatagaaatgc

SEQ ID NO: 3481880 - DNA, 21 bp, Homo sapiens
cttgatgaccaaagtcctttt

SEQ ID NO: 3481881 - DNA, 14 bp, Homo sapiens
cttgatgactgcct

SEQ ID NO: 3481882 - DNA, 21 bp, Homo sapiens
cttgatgtttagaaaagtatt

SEQ ID NO: 3481883 - DNA, 17 bp, Homo sapiens
gaaagacatctttctct

SEQ ID NO: 3481884 - DNA, 14 bp, Homo sapiens
gaaagagaaggtgg

SEQ ID NO: 3481885 - DNA, 18 bp, Homo sapiens
gaaagagcacttaagaga

SEQ ID NO: 3481886 - DNA, 14 bp, Homo sapiens
gaaagataactagg

SEQ ID NO: 3481887 - DNA, 15 bp, Homo sapiens
gaaagcacaggtggg

SEQ ID NO: 3481888 - DNA, 23 bp, Homo sapiens
gaaagcacaggtgggcttcccag

SEQ ID NO: 3481889 - DNA, 17 bp, Homo sapiens
gaaagcatttgaatgca

SEQ ID NO: 3481890 - DNA, 16 bp, Homo sapiens
gaaagcggctgcctcc

SEQ ID NO: 3481891 - DNA, 17 bp, Homo sapiens
gaaagcggctgcctcca

SEQ ID NO: 3481892 - DNA, 16 bp, Homo sapiens
gaaaggagtagaaaaa

SEQ ID NO: 3481893 - DNA, 19 bp, Homo sapiens
gaaaggccagctggcagca

SEQ ID NO: 3481894 - DNA, 21 bp, Homo sapiens
gaaaggccagctggcagcaga

SEQ ID NO: 3481895 - DNA, 16 bp, Homo sapiens
gaaaggccttcagaca

SEQ ID NO: 3481896 - DNA, 20 bp, Homo sapiens
gaaaggccttcagacacatg

SEQ ID NO: 3481897 - DNA, 22 bp, Homo sapiens
gaaagggacttggaagctccgc

SEQ ID NO: 3481898 - DNA, 16 bp, Homo sapiens
gaaaggggacaaggaa

SEQ ID NO: 3481899 - DNA, 21 bp, Homo sapiens
gaaagggggggaaaaaagcaa

SEQ ID NO: 3481900 - DNA, 17 bp, Homo sapiens
gaaaggggtcggctgac

SEQ ID NO: 3481901 - DNA, 23 bp, Homo sapiens
gaaaggtgccatggaagaggcta

SEQ ID NO: 3481902 - DNA, 14 bp, Homo sapiens
gaaaggtttacatt

SEQ ID NO: 3481903 - DNA, 16 bp, Homo sapiens
gaaaggtttacattgt

SEQ ID NO: 3481904 - DNA, 22 bp, Homo sapiens
gaaagtacttctccaccctgct

SEQ ID NO: 3481905 - DNA, 21 bp, Homo sapiens
gaaagtcattggctttatcct

SEQ ID NO: 3481906 - DNA, 14 bp, Homo sapiens
gaaagtgacagaga

SEQ ID NO: 3481907 - DNA, 20 bp, Homo sapiens
gaaagtgaggaaataaagtt

SEQ ID NO: 3481908 - DNA, 12 bp, Homo sapiens
gaaagttgccat

SEQ ID NO: 3481909 - DNA, 17 bp, Homo sapiens
gaaagttgccattattc

SEQ ID NO: 3481910 - DNA, 13 bp, Homo sapiens
gaaagttgtacat

SEQ ID NO: 3481911 - DNA, 23 bp, Homo sapiens
gaaataaaaggaagccaaagagt

SEQ ID NO: 3481912 - DNA, 13 bp, Homo sapiens
gaaataatatgca

SEQ ID NO: 3481913 - DNA, 14 bp, Homo sapiens
gaaataatatgcat

SEQ ID NO: 3481914 - DNA, 21 bp, Homo sapiens
gaaatacaattctacattgtc

SEQ ID NO: 3481915 - DNA, 16 bp, Homo sapiens
gaaatacagtcttcca

SEQ ID NO: 3481916 - DNA, 18 bp, Homo sapiens
gaaatatcccgggggtgg

SEQ ID NO: 3481917 - DNA, 16 bp, Homo sapiens
gaaatatgtgaagccc

SEQ ID NO: 3481918 - DNA, 13 bp, Homo sapiens
gaaatgaaagaaa

SEQ ID NO: 3481919 - DNA, 20 bp, Homo sapiens
gaaatgcatttatagatcat

SEQ ID NO: 3481920 - DNA, 21 bp, Homo sapiens
gaaatgcatttatagatcatt

SEQ ID NO: 3481921 - DNA, 17 bp, Homo sapiens
gaaatgctgctggccaa

SEQ ID NO: 3481922 - DNA, 14 bp, Homo sapiens
gaaatggaaatttt

SEQ ID NO: 3481923 - DNA, 16 bp, Homo sapiens
gaaatgggaatcatgg

SEQ ID NO: 3481924 - DNA, 14 bp, Homo sapiens
gaaatggttgtatt

SEQ ID NO: 3481925 - DNA, 19 bp, Homo sapiens
gaaatggttgtattagatg

SEQ ID NO: 3481926 - DNA, 20 bp, Homo sapiens
gaaatggttgtattagatgt

SEQ ID NO: 3481927 - DNA, 16 bp, Homo sapiens
gaaatgtggttttcct

SEQ ID NO: 3481928 - DNA, 17 bp, Homo sapiens
gaaattctcctggaggt

SEQ ID NO: 3481929 - DNA, 14 bp, Homo sapiens
gaaattctgaattt

SEQ ID NO: 3481930 - DNA, 17 bp, Homo sapiens
gaaattctgaatttgca

SEQ ID NO: 3481931 - DNA, 20 bp, Homo sapiens
gaaattctttatacattcta

SEQ ID NO: 3481932 - DNA, 20 bp, Homo sapiens
gaaatttaattcatgtttct

SEQ ID NO: 3481933 - DNA, 23 bp, Homo sapiens
gaaatttaattcatgtttcttaa

SEQ ID NO: 3481934 - DNA, 19 bp, Homo sapiens
gaacaaaaaaatctgcaga

SEQ ID NO: 3481935 - DNA, 21 bp, Homo sapiens
gaacaaaaaaatctgcagaag

SEQ ID NO: 3481936 - DNA, 16 bp, Homo sapiens
gaacaaagcagccacg

SEQ ID NO: 3481937 - DNA, 21 bp, Homo sapiens
gaacaagcaaacccagacggc

SEQ ID NO: 3481938 - DNA, 20 bp, Homo sapiens
gaacaatattgactttgtct

SEQ ID NO: 3481939 - DNA, 14 bp, Homo sapiens
gaacacactccatc

SEQ ID NO: 3481940 - DNA, 17 bp, Homo sapiens
gaacacgcgtatttaca

SEQ ID NO: 3481941 - DNA, 18 bp, Homo sapiens
gaacactagacaagccag

SEQ ID NO: 3481942 - DNA, 20 bp, Homo sapiens
gaacactagacaagccagaa

SEQ ID NO: 3481943 - DNA, 18 bp, Homo sapiens
gaacactcttttgcttta

SEQ ID NO: 3481944 - DNA, 14 bp, Homo sapiens
gaacagaagaaaat

SEQ ID NO: 3481945 - DNA, 22 bp, Homo sapiens
gaacagactggaagcacagctt

SEQ ID NO: 3481946 - DNA, 22 bp, Homo sapiens
gaacagatcttttactttggcc

SEQ ID NO: 3481947 - DNA, 21 bp, Homo sapiens
gaacagattcacactgtctgg

SEQ ID NO: 3481948 - DNA, 14 bp, Homo sapiens
gaacagtaactgcc

SEQ ID NO: 3481949 - DNA, 14 bp, Homo sapiens
gaacatccctgcca

SEQ ID NO: 3481950 - DNA, 15 bp, Homo sapiens
gaacatccctgccag

SEQ ID NO: 3481951 - DNA, 19 bp, Homo sapiens
gaacatgcagtttgaaatt

SEQ ID NO: 3481952 - DNA, 22 bp, Homo sapiens
gaacatgtcctaattcttctgt

SEQ ID NO: 3481953 - DNA, 17 bp, Homo sapiens
gaacattagttgcacta

SEQ ID NO: 3481954 - DNA, 12 bp, Homo sapiens
gaacattttact

SEQ ID NO: 3481955 - DNA, 19 bp, Homo sapiens
gaacattttactgttgtac

SEQ ID NO: 3481956 - DNA, 17 bp, Homo sapiens
gaaccaaatctggaagc

SEQ ID NO: 3481957 - DNA, 18 bp, Homo sapiens
gaaccaacaaggaaactt

SEQ ID NO: 3481958 - DNA, 19 bp, Homo sapiens
gaaccaacaaggaaacttt

SEQ ID NO: 3481959 - DNA, 18 bp, Homo sapiens
gaaccacatcttgctctg

SEQ ID NO: 3481960 - DNA, 20 bp, Homo sapiens
gaaccacatcttgctctgct

SEQ ID NO: 3481961 - DNA, 21 bp, Homo sapiens
gaaccacatcttgctctgctg

SEQ ID NO: 3481962 - DNA, 20 bp, Homo sapiens
gaaccaccacacccagccca

SEQ ID NO: 3481963 - DNA, 23 bp, Homo sapiens
gaaccagcctcaaaaacgccctc

SEQ ID NO: 3481964 - DNA, 16 bp, Homo sapiens
gaaccattaaccagat

SEQ ID NO: 3481965 - DNA, 16 bp, Homo sapiens
gaacccagactcagac

SEQ ID NO: 3481966 - DNA, 17 bp, Homo sapiens
gaacccctggctccttc

SEQ ID NO: 3481967 - DNA, 19 bp, Homo sapiens
gaacccctggctccttcac

SEQ ID NO: 3481968 - DNA, 20 bp, Homo sapiens
gaaccctggggcctgactgc

SEQ ID NO: 3481969 - DNA, 12 bp, Homo sapiens
gaacccttggct

SEQ ID NO: 3481970 - DNA, 18 bp, Homo sapiens
gaacccttggcttgccca

SEQ ID NO: 3481971 - DNA, 19 bp, Homo sapiens
gaaccgtggtatgtctgcc

SEQ ID NO: 3481972 - DNA, 19 bp, Homo sapiens
gaaccgttttgaagctact

SEQ ID NO: 3481973 - DNA, 20 bp, Homo sapiens
gaacctcacgcacctcccat

SEQ ID NO: 3481974 - DNA, 12 bp, Homo sapiens
gaacctcagcct

SEQ ID NO: 3481975 - DNA, 14 bp, Homo sapiens
gaacctcagcctgg

SEQ ID NO: 3481976 - DNA, 15 bp, Homo sapiens
gaacctccccagcct

SEQ ID NO: 3481977 - DNA, 20 bp, Homo sapiens
gaacctcgagtactgtgggc

SEQ ID NO: 3481978 - DNA, 16 bp, Homo sapiens
gaacctgcaaaaaata

SEQ ID NO: 3481979 - DNA, 16 bp, Homo sapiens
gaaccttggcctgggc

SEQ ID NO: 3481980 - DNA, 21 bp, Homo sapiens
gaacgaaccttggcctgggcc

SEQ ID NO: 3481981 - DNA, 19 bp, Homo sapiens
gaacgcccccccccacccc

SEQ ID NO: 3481982 - DNA, 19 bp, Homo sapiens
gaacggggctcttctcatt

SEQ ID NO: 3481983 - DNA, 19 bp, Homo sapiens
gaacgttttttcctcagtg

SEQ ID NO: 3481984 - DNA, 17 bp, Homo sapiens
gaactaaactcatttat

SEQ ID NO: 3481985 - DNA, 12 bp, Homo sapiens
gaactaaagaag

SEQ ID NO: 3481986 - DNA, 22 bp, Homo sapiens
gaactacaaacaaaatttctat

SEQ ID NO: 3481987 - DNA, 19 bp, Homo sapiens
gaactaccttggttccccc

SEQ ID NO: 3481988 - DNA, 22 bp, Homo sapiens
gaactagcatataattctatat

SEQ ID NO: 3481989 - DNA, 19 bp, Homo sapiens
gaactataacacctgccac

SEQ ID NO: 3481990 - DNA, 17 bp, Homo sapiens
gaactatggacggtgct

SEQ ID NO: 3481991 - DNA, 14 bp, Homo sapiens
gaactcactggggc

SEQ ID NO: 3481992 - DNA, 13 bp, Homo sapiens
gaactcagatcca

SEQ ID NO: 3481993 - DNA, 21 bp, Homo sapiens
gaactcagatccagggacaga

SEQ ID NO: 3481994 - DNA, 15 bp, Homo sapiens
gaactcctggcctca

SEQ ID NO: 3481995 - DNA, 14 bp, Homo sapiens
gaactctggtggca

SEQ ID NO: 3481996 - DNA, 14 bp, Homo sapiens
gaactgagcctagc

SEQ ID NO: 3481997 - DNA, 18 bp, Homo sapiens
gaactgcaggccctggcc

SEQ ID NO: 3481998 - DNA, 21 bp, Homo sapiens
gaactgcaggccctggcctcc

SEQ ID NO: 3481999 - DNA, 23 bp, Homo sapiens
gaactggaccctgttgctaagcc

SEQ ID NO: 3482000 - DNA, 22 bp, Homo sapiens
gaactgggtacttgtggacaca

SEQ ID NO: 3482001 - DNA, 20 bp, Homo sapiens
gaactgtgtttcaagttcaa

SEQ ID NO: 3482002 - DNA, 20 bp, Homo sapiens
gaacttatcctaaaacaaat

SEQ ID NO: 3482003 - DNA, 12 bp, Homo sapiens
gaacttgcctct

SEQ ID NO: 3482004 - DNA, 14 bp, Homo sapiens
gaacttgctgctgt

SEQ ID NO: 3482005 - DNA, 18 bp, Homo sapiens
gaacttgctgctgtcttg

SEQ ID NO: 3482006 - DNA, 23 bp, Homo sapiens
gaactttcatttttttccaggct

SEQ ID NO: 3482007 - DNA, 12 bp, Homo sapiens
gaactttcctgg

SEQ ID NO: 3482008 - DNA, 19 bp, Homo sapiens
gaactttgcatagcagctg

SEQ ID NO: 3482009 - DNA, 23 bp, Homo sapiens
gaagaaaatggaaccaggcttgg

SEQ ID NO: 3482010 - DNA, 15 bp, Homo sapiens
gaagaaagtggaaaa

SEQ ID NO: 3482011 - DNA, 13 bp, Homo sapiens
gaagaaccagtcc

SEQ ID NO: 3482012 - DNA, 19 bp, Homo sapiens
gaagaaccagtccccccac

SEQ ID NO: 3482013 - DNA, 22 bp, Homo sapiens
gaagaacggggctcttctcatt

SEQ ID NO: 3482014 - DNA, 18 bp, Homo sapiens
gagccctgtggatgagcc

SEQ ID NO: 3482015 - DNA, 18 bp, Homo sapiens
gagcccttatctgtgctc

SEQ ID NO: 3482016 - DNA, 20 bp, Homo sapiens
gagccgagatcacgccactg

SEQ ID NO: 3482017 - DNA, 16 bp, Homo sapiens
gagcctaccccctgaa

SEQ ID NO: 3482018 - DNA, 13 bp, Homo sapiens
gagcctcagcatc

SEQ ID NO: 3482019 - DNA, 20 bp, Homo sapiens
gagcctcagcatcctggcac

SEQ ID NO: 3482020 - DNA, 16 bp, Homo sapiens
gagcctcttggggaag

SEQ ID NO: 3482021 - DNA, 10 bp, Homo sapiens
gagcctgagg

SEQ ID NO: 3482022 - DNA, 12 bp, Homo sapiens
gagcctgcagtt

SEQ ID NO: 3482023 - DNA, 12 bp, Homo sapiens
gagcctgctgga

SEQ ID NO: 3482024 - DNA, 21 bp, Homo sapiens
gagcctgggaggtcaaggctg

SEQ ID NO: 3482025 - DNA, 12 bp, Homo sapiens
gagcctggtgcc

SEQ ID NO: 3482026 - DNA, 19 bp, Homo sapiens
gagcctgtctttcagcatt

SEQ ID NO: 3482027 - DNA, 18 bp, Homo sapiens
gagcctttggttctggcc

SEQ ID NO: 3482028 - DNA, 23 bp, Homo sapiens
gagcgcctccatccaaggccagg

SEQ ID NO: 3482029 - DNA, 20 bp, Homo sapiens
gagcgcctgcccctcccaga

SEQ ID NO: 3482030 - DNA, 17 bp, Homo sapiens
gagcgcgcccctagccg

SEQ ID NO: 3482031 - DNA, 15 bp, Homo sapiens
gagcgctcctgccgc

SEQ ID NO: 3482032 - DNA, 21 bp, Homo sapiens
gagcgctcctgccgcagagct

SEQ ID NO: 3482033 - DNA, 14 bp, Homo sapiens
gagcggaaagcagc

SEQ ID NO: 3482034 - DNA, 13 bp, Homo sapiens
gagcggtggggga

SEQ ID NO: 3482035 - DNA, 22 bp, Homo sapiens
gagctaaactccttcctggcct

SEQ ID NO: 3482036 - DNA, 13 bp, Homo sapiens
gagctacaaatgc

SEQ ID NO: 3482037 - DNA, 11 bp, Homo sapiens
gagctactgcc

SEQ ID NO: 3482038 - DNA, 15 bp, Homo sapiens
gagctagcagcaggg

SEQ ID NO: 3482039 - DNA, 17 bp, Homo sapiens
gagctagcagcagggag

SEQ ID NO: 3482040 - DNA, 13 bp, Homo sapiens
gagctagccagag

SEQ ID NO: 3482041 - DNA, 15 bp, Homo sapiens
gagctagccagagga

SEQ ID NO: 3482042 - DNA, 13 bp, Homo sapiens
gagctaggagaag

SEQ ID NO: 3482043 - DNA, 19 bp, Homo sapiens
gagctaggagaagggctga

SEQ ID NO: 3482044 - DNA, 17 bp, Homo sapiens
gagctcacccatgtgca

SEQ ID NO: 3482045 - DNA, 20 bp, Homo sapiens
gagctcagacattttctttt

SEQ ID NO: 3482046 - DNA, 20 bp, Homo sapiens
gagctcagagagggcaggca

SEQ ID NO: 3482047 - DNA, 13 bp, Homo sapiens
gagctccactctg

SEQ ID NO: 3482048 - DNA, 19 bp, Homo sapiens
gagctctcctgtgcattgt

SEQ ID NO: 3482049 - DNA, 20 bp, Homo sapiens
gagctctggtgataaggaca

SEQ ID NO: 3482050 - DNA, 18 bp, Homo sapiens
gagctcttgacagaaagc

SEQ ID NO: 3482051 - DNA, 20 bp, Homo sapiens
gagctcttgacagaaagcag

SEQ ID NO: 3482052 - DNA, 21 bp, Homo sapiens
gagctcttgacagaaagcagt

SEQ ID NO: 3482053 - DNA, 21 bp, Homo sapiens
gagctgcctgttcagctccag

SEQ ID NO: 3482054 - DNA, 22 bp, Homo sapiens
gagctgcctgttcagctccagc

SEQ ID NO: 3482055 - DNA, 15 bp, Homo sapiens
gagctgccttggctc

SEQ ID NO: 3482056 - DNA, 21 bp, Homo sapiens
gagctgccttggctcagacat

SEQ ID NO: 3482057 - DNA, 18 bp, Homo sapiens
gagctgcttcactaggga

SEQ ID NO: 3482058 - DNA, 12 bp, Homo sapiens
gagctggagcct

SEQ ID NO: 3482059 - DNA, 15 bp, Homo sapiens
gagctggagcctggt

SEQ ID NO: 3482060 - DNA, 19 bp, Homo sapiens
gagctggggccaccctggc

SEQ ID NO: 3482061 - DNA, 20 bp, Homo sapiens
gagctggggccaccctggcc

SEQ ID NO: 3482062 - DNA, 17 bp, Homo sapiens
gagctgtcaccaaggaa

SEQ ID NO: 3482063 - DNA, 17 bp, Homo sapiens
gagctgtttactaggga

SEQ ID NO: 3482064 - DNA, 13 bp, Homo sapiens
gagcttccctgac

SEQ ID NO: 3482065 - DNA, 19 bp, Homo sapiens
gagcttcctgtcctcccag

SEQ ID NO: 3482066 - DNA, 16 bp, Homo sapiens
gagcttctctgtgaac

SEQ ID NO: 3482067 - DNA, 22 bp, Homo sapiens
gagcttcttccaggtgcccagc

SEQ ID NO: 3482068 - DNA, 12 bp, Homo sapiens
gagcttggggca

SEQ ID NO: 3482069 - DNA, 13 bp, Homo sapiens
gagctttgtttca

SEQ ID NO: 3482070 - DNA, 22 bp, Homo sapiens
gaggaaaaaaatcgtccaggga

SEQ ID NO: 3482071 - DNA, 18 bp, Homo sapiens
gaggaaacaacagcttta

SEQ ID NO: 3482072 - DNA, 14 bp, Homo sapiens
gaggaaactcagag

SEQ ID NO: 3482073 - DNA, 13 bp, Homo sapiens
gaggaaaggccag

SEQ ID NO: 3482074 - DNA, 12 bp, Homo sapiens
gaggaaagtcat

SEQ ID NO: 3482075 - DNA, 21 bp, Homo sapiens
gaggaaataaagttaagtttg

SEQ ID NO: 3482076 - DNA, 23 bp, Homo sapiens
gaggaagaacggggctcttctca

SEQ ID NO: 3482077 - DNA, 20 bp, Homo sapiens
gaggaagcgtgaaggccgag

SEQ ID NO: 3482078 - DNA, 13 bp, Homo sapiens
gaggaagttcaga

SEQ ID NO: 3482079 - DNA, 20 bp, Homo sapiens
gaggaatctgtgggtctggg

SEQ ID NO: 3482080 - DNA, 21 bp, Homo sapiens
gaggaatctgtgggtctggga

SEQ ID NO: 3482081 - DNA, 14 bp, Homo sapiens
gaggaatgtatatg

SEQ ID NO: 3482082 - DNA, 12 bp, Homo sapiens
gaggacagtggg

SEQ ID NO: 3482083 - DNA, 21 bp, Homo sapiens
gaggaccacaggtgtgagcca

SEQ ID NO: 3482084 - DNA, 22 bp, Homo sapiens
gaggacgagcgattgaggtgta

SEQ ID NO: 3482085 - DNA, 22 bp, Homo sapiens
gaggacttcggggtagaggctg

SEQ ID NO: 3482086 - DNA, 23 bp, Homo sapiens
gaggacttcggggtagaggctgg

SEQ ID NO: 3482087 - DNA, 20 bp, Homo sapiens
gaggacttttctttgtggct

SEQ ID NO: 3482088 - DNA, 23 bp, Homo sapiens
gaggacttttctttgtggcttcc

SEQ ID NO: 3482089 - DNA, 14 bp, Homo sapiens
gaggagagagcctt

SEQ ID NO: 3482090 - DNA, 15 bp, Homo sapiens
gaggagcagtgcagg

SEQ ID NO: 3482091 - DNA, 17 bp, Homo sapiens
gaggaggggccgctgcc

SEQ ID NO: 3482092 - DNA, 20 bp, Homo sapiens
gaggagtaaccgctccaggt

SEQ ID NO: 3482093 - DNA, 17 bp, Homo sapiens
gaggatccctctctgga

SEQ ID NO: 3482094 - DNA, 22 bp, Homo sapiens
gaggatctcttgagcctgggag

SEQ ID NO: 3482095 - DNA, 15 bp, Homo sapiens
gaggatgcattcgag

SEQ ID NO: 3482096 - DNA, 16 bp, Homo sapiens
gaggatgtaaggcctt

SEQ ID NO: 3482097 - DNA, 21 bp, Homo sapiens
gaggatgtaaggccttagcca

SEQ ID NO: 3482098 - DNA, 20 bp, Homo sapiens
gaggatgtcactcagatgga

SEQ ID NO: 3482099 - DNA, 17 bp, Homo sapiens
gaggatgttctgggaca

SEQ ID NO: 3482100 - DNA, 20 bp, Homo sapiens
gaggatgttctgggacacag

SEQ ID NO: 3482101 - DNA, 20 bp, Homo sapiens
gaggattgcttgagctcagg

SEQ ID NO: 3482102 - DNA, 16 bp, Homo sapiens
gaggcaaatggcactg

SEQ ID NO: 3482103 - DNA, 13 bp, Homo sapiens
gaggcaagagaat

SEQ ID NO: 3482104 - DNA, 21 bp, Homo sapiens
gaggcaatcctaccttgcttt

SEQ ID NO: 3482105 - DNA, 15 bp, Homo sapiens
gaggcactgaagccc

SEQ ID NO: 3482106 - DNA, 20 bp, Homo sapiens
gaggcagcagtgtgaggcca

SEQ ID NO: 3482107 - DNA, 21 bp, Homo sapiens
gaggcagcagtgtgaggccag

SEQ ID NO: 3482108 - DNA, 19 bp, Homo sapiens
gaggcaggtggatcacctg

SEQ ID NO: 3482109 - DNA, 22 bp, Homo sapiens
gaggcatcatggaaagactggg

SEQ ID NO: 3482110 - DNA, 13 bp, Homo sapiens
gaggcatccagca

SEQ ID NO: 3482111 - DNA, 17 bp, Homo sapiens
gaggccaaaggctggtg

SEQ ID NO: 3482112 - DNA, 17 bp, Homo sapiens
gaggccaaggtgggagg

SEQ ID NO: 3482113 - DNA, 18 bp, Homo sapiens
gaggccacactcagcaca

SEQ ID NO: 3482114 - DNA, 21 bp, Homo sapiens
gaggccacactcagcacaagg

SEQ ID NO: 3482115 - DNA, 18 bp, Homo sapiens
gaggccagctatctgcct

SEQ ID NO: 3482116 - DNA, 15 bp, Homo sapiens
gaggccagtgagcca

SEQ ID NO: 3482117 - DNA, 13 bp, Homo sapiens
gaggcccaggctg

SEQ ID NO: 3482118 - DNA, 17 bp, Homo sapiens
gaggcccaggctgggaa

SEQ ID NO: 3482119 - DNA, 23 bp, Homo sapiens
gaggcccaggctgggaactcatc

SEQ ID NO: 3482120 - DNA, 20 bp, Homo sapiens
gaggcccagttcaccctgat

SEQ ID NO: 3482121 - DNA, 14 bp, Homo sapiens
gaggccccactggg

SEQ ID NO: 3482122 - DNA, 13 bp, Homo sapiens
gaggccccagcct

SEQ ID NO: 3482123 - DNA, 19 bp, Homo sapiens
gaggccccagcctccctga

SEQ ID NO: 3482124 - DNA, 16 bp, Homo sapiens
gaggcccccagcccag

SEQ ID NO: 3482125 - DNA, 19 bp, Homo sapiens
gaggccccttctaggtggc

SEQ ID NO: 3482126 - DNA, 19 bp, Homo sapiens
gaggccctctggagtggcc

SEQ ID NO: 3482127 - DNA, 17 bp, Homo sapiens
gaggccctttgctgtcc

SEQ ID NO: 3482128 - DNA, 14 bp, Homo sapiens
gaggcctcaggtgc

SEQ ID NO: 3482129 - DNA, 20 bp, Homo sapiens
gaggcctcaggtgctgtcca

SEQ ID NO: 3482130 - DNA, 21 bp, Homo sapiens
gaggcctcttttcctgaagaa

SEQ ID NO: 3482131 - DNA, 9 bp, Homo sapiens
gaggcctga

SEQ ID NO: 3482132 - DNA, 23 bp, Homo sapiens
gaggcctgaagccagctgcccta

SEQ ID NO: 3482133 - DNA, 21 bp, Homo sapiens
gaggcctgcctccagggctgg

SEQ ID NO: 3482134 - DNA, 14 bp, Homo sapiens
gaggcctgggccgc

SEQ ID NO: 3482135 - DNA, 15 bp, Homo sapiens
gaggcctgtctgtga

SEQ ID NO: 3482136 - DNA, 21 bp, Homo sapiens
gaggccttatgagggtcctct

SEQ ID NO: 3482137 - DNA, 14 bp, Homo sapiens
gaggccttctctga

SEQ ID NO: 3482138 - DNA, 19 bp, Homo sapiens
gaggccttctctgaaggac

SEQ ID NO: 3482139 - DNA, 14 bp, Homo sapiens
gaggcggagcccag

SEQ ID NO: 3482140 - DNA, 14 bp, Homo sapiens
gaggctgcactgca

SEQ ID NO: 3482141 - DNA, 14 bp, Homo sapiens
gaggctgcacttgt

SEQ ID NO: 3482142 - DNA, 15 bp, Homo sapiens
gaggctgcctcccaa

SEQ ID NO: 3482143 - DNA, 14 bp, Homo sapiens
gaggctttccatgg

SEQ ID NO: 3482144 - DNA, 16 bp, Homo sapiens
gaggctttggatttga

SEQ ID NO: 3482145 - DNA, 13 bp, Homo sapiens
gagggacctctcc

SEQ ID NO: 3482146 - DNA, 16 bp, Homo sapiens
gcaaaagatgcttctc

SEQ ID NO: 3482147 - DNA, 17 bp, Homo sapiens
gcaaaagatgcttctca

SEQ ID NO: 3482148 - DNA, 20 bp, Homo sapiens
gcaaaaggttcactaaagca

SEQ ID NO: 3482149 - DNA, 18 bp, Homo sapiens
gcaaaagttctgacttga

SEQ ID NO: 3482150 - DNA, 19 bp, Homo sapiens
gcaaaagttctgacttgac

SEQ ID NO: 3482151 - DNA, 19 bp, Homo sapiens
gcaaaatcaagcaagcctc

SEQ ID NO: 3482152 - DNA, 23 bp, Homo sapiens
gcaaaatcattttatatgtcaaa

SEQ ID NO: 3482153 - DNA, 21 bp, Homo sapiens
gcaaaattgtttttggttgga

SEQ ID NO: 3482154 - DNA, 12 bp, Homo sapiens
gcaaacacttaa

SEQ ID NO: 3482155 - DNA, 18 bp, Homo sapiens
gcaaaccacactggactc

SEQ ID NO: 3482156 - DNA, 20 bp, Homo sapiens
gcaaaccacactggactccg

SEQ ID NO: 3482157 - DNA, 18 bp, Homo sapiens
gcaaacgctgcctgcccg

SEQ ID NO: 3482158 - DNA, 17 bp, Homo sapiens
gcaaactatttgcgact

SEQ ID NO: 3482159 - DNA, 21 bp, Homo sapiens
gcaaagatctgtcctcagcct

SEQ ID NO: 3482160 - DNA, 14 bp, Homo sapiens
gcaaagccaaggca

SEQ ID NO: 3482161 - DNA, 20 bp, Homo sapiens
gcaaagggagcactgggttg

SEQ ID NO: 3482162 - DNA, 22 bp, Homo sapiens
gcaaagggcatgggtcgggaga

SEQ ID NO: 3482163 - DNA, 11 bp, Homo sapiens
gcaaagtactg

SEQ ID NO: 3482164 - DNA, 20 bp, Homo sapiens
gcaaagtattgtaaattata

SEQ ID NO: 3482165 - DNA, 21 bp, Homo sapiens
gcaaagtattgtaaattatat

SEQ ID NO: 3482166 - DNA, 16 bp, Homo sapiens
gcaaagtcatgcaaag

SEQ ID NO: 3482167 - DNA, 21 bp, Homo sapiens
gcaaagtcatgcaaaggctgg

SEQ ID NO: 3482168 - DNA, 23 bp, Homo sapiens
gcaaagtcatgcaaaggctggga

SEQ ID NO: 3482169 - DNA, 12 bp, Homo sapiens
gcaaagtgtttt

SEQ ID NO: 3482170 - DNA, 23 bp, Homo sapiens
gcaaatcctatgtgattttaact

SEQ ID NO: 3482171 - DNA, 18 bp, Homo sapiens
gcaacagatctggaacct

SEQ ID NO: 3482172 - DNA, 18 bp, Homo sapiens
gcaacagcctttgaatgt

SEQ ID NO: 3482173 - DNA, 19 bp, Homo sapiens
gcaacaggaatctcagaga

SEQ ID NO: 3482174 - DNA, 20 bp, Homo sapiens
gcaacaggaatctcagagac

SEQ ID NO: 3482175 - DNA, 16 bp, Homo sapiens
gcaacaggctgggctt

SEQ ID NO: 3482176 - DNA, 19 bp, Homo sapiens
gcaacaggctgggcttcag

SEQ ID NO: 3482177 - DNA, 14 bp, Homo sapiens
gcaacattccaaga

SEQ ID NO: 3482178 - DNA, 19 bp, Homo sapiens
gcaaccccaggctgaagca

SEQ ID NO: 3482179 - DNA, 15 bp, Homo sapiens
gcaacccccagcctg

SEQ ID NO: 3482180 - DNA, 14 bp, Homo sapiens
gcaacctacccagc

SEQ ID NO: 3482181 - DNA, 18 bp, Homo sapiens
gcaacctccgcctcttgg

SEQ ID NO: 3482182 - DNA, 22 bp, Homo sapiens
gcaaccttgcatccatctgggc

SEQ ID NO: 3482183 - DNA, 20 bp, Homo sapiens
gcaactgctcagctctggtc

SEQ ID NO: 3482184 - DNA, 16 bp, Homo sapiens
gcaagaactcatcact

SEQ ID NO: 3482185 - DNA, 20 bp, Homo sapiens
gcaagaactcatcactgtgg

SEQ ID NO: 3482186 - DNA, 17 bp, Homo sapiens
gcaagaattgaagcagg

SEQ ID NO: 3482187 - DNA, 14 bp, Homo sapiens
gcaagacgccctct

SEQ ID NO: 3482188 - DNA, 15 bp, Homo sapiens
gcaagagaacatttt

SEQ ID NO: 3482189 - DNA, 19 bp, Homo sapiens
gcaagagaacattttactg

SEQ ID NO: 3482190 - DNA, 22 bp, Homo sapiens
gcaagagatattttgggcatgt

SEQ ID NO: 3482191 - DNA, 14 bp, Homo sapiens
gcaagattgcttaa

SEQ ID NO: 3482192 - DNA, 20 bp, Homo sapiens
gcaagcaatcctaggtaggg

SEQ ID NO: 3482193 - DNA, 14 bp, Homo sapiens
gcaagcacatctgc

SEQ ID NO: 3482194 - DNA, 20 bp, Homo sapiens
gcaagcacctcctgcctcga

SEQ ID NO: 3482195 - DNA, 16 bp, Homo sapiens
gcaagcccctctttct

SEQ ID NO: 3482196 - DNA, 21 bp, Homo sapiens
gcaaggacacagatgaaacac

SEQ ID NO: 3482197 - DNA, 12 bp, Homo sapiens
gcaaggctgtgc

SEQ ID NO: 3482198 - DNA, 18 bp, Homo sapiens
gcaaggctgtgctccctg

SEQ ID NO: 3482199 - DNA, 21 bp, Homo sapiens
gcaagtgaaggtttacaattt

SEQ ID NO: 3482200 - DNA, 19 bp, Homo sapiens
gcaagtgattgggacagag

SEQ ID NO: 3482201 - DNA, 13 bp, Homo sapiens
gcaagtgctcagg

SEQ ID NO: 3482202 - DNA, 14 bp, Homo sapiens
gcaataatgcagta

SEQ ID NO: 3482203 - DNA, 19 bp, Homo sapiens
gcaataatgcagtatggta

SEQ ID NO: 3482204 - DNA, 19 bp, Homo sapiens
gcaatagaagtgctcccct

SEQ ID NO: 3482205 - DNA, 15 bp, Homo sapiens
gcaatcacagatgag

SEQ ID NO: 3482206 - DNA, 21 bp, Homo sapiens
gcaatctccccttgatttaaa

SEQ ID NO: 3482207 - DNA, 16 bp, Homo sapiens
gcaatgatgaatgaga

SEQ ID NO: 3482208 - DNA, 17 bp, Homo sapiens
gcaatgatgaatgagaa

SEQ ID NO: 3482209 - DNA, 12 bp, Homo sapiens
gcaatggcagcc

SEQ ID NO: 3482210 - DNA, 14 bp, Homo sapiens
gcaatggcagcctt

SEQ ID NO: 3482211 - DNA, 14 bp, Homo sapiens
gcaatgtgataaaa

SEQ ID NO: 3482212 - DNA, 15 bp, Homo sapiens
gcaattccgcattta

SEQ ID NO: 3482213 - DNA, 16 bp, Homo sapiens
gcaatttatacaatat

SEQ ID NO: 3482214 - DNA, 23 bp, Homo sapiens
gcacaaaacccagacctgttagc

SEQ ID NO: 3482215 - DNA, 18 bp, Homo sapiens
gcacaaactcaccatctg

SEQ ID NO: 3482216 - DNA, 20 bp, Homo sapiens
gcacaagatgccccagggat

SEQ ID NO: 3482217 - DNA, 22 bp, Homo sapiens
gcacaagatgccccagggatgg

SEQ ID NO: 3482218 - DNA, 22 bp, Homo sapiens
gcacaagctgcaccctcaggca

SEQ ID NO: 3482219 - DNA, 21 bp, Homo sapiens
gcacaatgcataatgtcttta

SEQ ID NO: 3482220 - DNA, 18 bp, Homo sapiens
gcacacaccagagcccac

SEQ ID NO: 3482221 - DNA, 19 bp, Homo sapiens
gcacacaccagagcccacc

SEQ ID NO: 3482222 - DNA, 20 bp, Homo sapiens
gcacacaccagagcccacct

SEQ ID NO: 3482223 - DNA, 13 bp, Homo sapiens
gcacacagggcag

SEQ ID NO: 3482224 - DNA, 20 bp, Homo sapiens
gcacactcatcccctcactt

SEQ ID NO: 3482225 - DNA, 14 bp, Homo sapiens
gcacacttggccca

SEQ ID NO: 3482226 - DNA, 17 bp, Homo sapiens
gcacagaagtcctgtat

SEQ ID NO: 3482227 - DNA, 17 bp, Homo sapiens
gcacagatgctccaggg

SEQ ID NO: 3482228 - DNA, 14 bp, Homo sapiens
gcacagatttgcat

SEQ ID NO: 3482229 - DNA, 14 bp, Homo sapiens
gcacagctgggata

SEQ ID NO: 3482230 - DNA, 23 bp, Homo sapiens
gcacagctgtagtggggttctag

SEQ ID NO: 3482231 - DNA, 14 bp, Homo sapiens
gcacagcttgacct

SEQ ID NO: 3482232 - DNA, 20 bp, Homo sapiens
gcacagcttgacctgaggct

SEQ ID NO: 3482233 - DNA, 19 bp, Homo sapiens
gcacaggacacctggccgc

SEQ ID NO: 3482234 - DNA, 22 bp, Homo sapiens
gcacaggacatgcggtagccag

SEQ ID NO: 3482235 - DNA, 21 bp, Homo sapiens
gcacaggtgggcttcccagtg

SEQ ID NO: 3482236 - DNA, 16 bp, Homo sapiens
gcacagtgaagtgctg

SEQ ID NO: 3482237 - DNA, 22 bp, Homo sapiens
gcacatattagtgcagccaagt

SEQ ID NO: 3482238 - DNA, 16 bp, Homo sapiens
gcacatctctgcttga

SEQ ID NO: 3482239 - DNA, 18 bp, Homo sapiens
gcacatctgtgtcttgtt

SEQ ID NO: 3482240 - DNA, 13 bp, Homo sapiens
gcacatgactcgg

SEQ ID NO: 3482241 - DNA, 17 bp, Homo sapiens
gcacatgcacctaccca

SEQ ID NO: 3482242 - DNA, 15 bp, Homo sapiens
gcacatgtcttaatg

SEQ ID NO: 3482243 - DNA, 16 bp, Homo sapiens
gcacatgttggaggag

SEQ ID NO: 3482244 - DNA, 19 bp, Homo sapiens
gcacatgttggaggagaga

SEQ ID NO: 3482245 - DNA, 17 bp, Homo sapiens
gcacatttaagagacag

SEQ ID NO: 3482246 - DNA, 14 bp, Homo sapiens
gcaccaccaagcca

SEQ ID NO: 3482247 - DNA, 20 bp, Homo sapiens
gcaccactgcactccagcct

SEQ ID NO: 3482248 - DNA, 21 bp, Homo sapiens
gcaccactgcactccagcctg

SEQ ID NO: 3482249 - DNA, 15 bp, Homo sapiens
gcaccagacacccag

SEQ ID NO: 3482250 - DNA, 16 bp, Homo sapiens
gcaccagacacccagg

SEQ ID NO: 3482251 - DNA, 14 bp, Homo sapiens
gcaccagcagcctg

SEQ ID NO: 3482252 - DNA, 18 bp, Homo sapiens
gcaccaggggtttctcgc

SEQ ID NO: 3482253 - DNA, 23 bp, Homo sapiens
gcaccagggttgaccccagagga

SEQ ID NO: 3482254 - DNA, 19 bp, Homo sapiens
gcaccagttttatccataa

SEQ ID NO: 3482255 - DNA, 21 bp, Homo sapiens
gcaccagttttatccataatg

SEQ ID NO: 3482256 - DNA, 23 bp, Homo sapiens
gcaccattctgactcggtttctc

SEQ ID NO: 3482257 - DNA, 13 bp, Homo sapiens
gcacccaccctgg

SEQ ID NO: 3482258 - DNA, 13 bp, Homo sapiens
gcacccccctggg

SEQ ID NO: 3482259 - DNA, 22 bp, Homo sapiens
gcacccctccccattcacagag

SEQ ID NO: 3482260 - DNA, 15 bp, Homo sapiens
gcaccctcaggcagg

SEQ ID NO: 3482261 - DNA, 16 bp, Homo sapiens
gcaccctcaggcaggt

SEQ ID NO: 3482262 - DNA, 19 bp, Homo sapiens
gcaccctcaggcaggtggg

SEQ ID NO: 3482263 - DNA, 13 bp, Homo sapiens
gcaccctgcagag

SEQ ID NO: 3482264 - DNA, 20 bp, Homo sapiens
gcaccctgcagagcacacag

SEQ ID NO: 3482265 - DNA, 21 bp, Homo sapiens
gcaccctgcagagcacacagg

SEQ ID NO: 3482266 - DNA, 15 bp, Homo sapiens
gcacctaatccaggc

SEQ ID NO: 3482267 - DNA, 18 bp, Homo sapiens
gcacctaatccaggcaga

SEQ ID NO: 3482268 - DNA, 22 bp, Homo sapiens
gcacctaatccaggcagatcca

SEQ ID NO: 3482269 - DNA, 18 bp, Homo sapiens
gcacctccacatcctcca

SEQ ID NO: 3482270 - DNA, 20 bp, Homo sapiens
gcacctctcttgaaccccaa

SEQ ID NO: 3482271 - DNA, 21 bp, Homo sapiens
gcacctctcttgaaccccaaa

SEQ ID NO: 3482272 - DNA, 12 bp, Homo sapiens
gcacgcagtggc

SEQ ID NO: 3482273 - DNA, 12 bp, Homo sapiens
gcacggctgctg

SEQ ID NO: 3482274 - DNA, 14 bp, Homo sapiens
gcacgtgtgtgcac

SEQ ID NO: 3482275 - DNA, 17 bp, Homo sapiens
gcactaaggtgtgctct

SEQ ID NO: 3482276 - DNA, 18 bp, Homo sapiens
gcactaaggtgtgctctg

SEQ ID NO: 3482277 - DNA, 12 bp, Homo sapiens
gcactacattca

SEQ ID NO: 3482278 - DNA, 16 bp, Homo sapiens
gccatctctggatgcc

SEQ ID NO: 3482279 - DNA, 19 bp, Homo sapiens
gccatgatgcctctgtctt

SEQ ID NO: 3482280 - DNA, 21 bp, Homo sapiens
gccatgatggcaacagatctg

SEQ ID NO: 3482281 - DNA, 22 bp, Homo sapiens
gccatgcaccaggactggctgt

SEQ ID NO: 3482282 - DNA, 21 bp, Homo sapiens
gccatgcctcagccctgaccc

SEQ ID NO: 3482283 - DNA, 13 bp, Homo sapiens
gccatgctgaggc

SEQ ID NO: 3482284 - DNA, 17 bp, Homo sapiens
gccatgctgaggcctgg

SEQ ID NO: 3482285 - DNA, 18 bp, Homo sapiens
gccatgctgaggcctggg

SEQ ID NO: 3482286 - DNA, 20 bp, Homo sapiens
gccatgctgaggcctgggcc

SEQ ID NO: 3482287 - DNA, 17 bp, Homo sapiens
gccatggaactgtttcc

SEQ ID NO: 3482288 - DNA, 22 bp, Homo sapiens
gccatggaagaggctacagggc

SEQ ID NO: 3482289 - DNA, 15 bp, Homo sapiens
gccatggagagctgg

SEQ ID NO: 3482290 - DNA, 22 bp, Homo sapiens
gccatggagagctggagcctgg

SEQ ID NO: 3482291 - DNA, 12 bp, Homo sapiens
gccatggcctct

SEQ ID NO: 3482292 - DNA, 15 bp, Homo sapiens
gccatgggcctcctg

SEQ ID NO: 3482293 - DNA, 16 bp, Homo sapiens
gccatgggcctcctgt

SEQ ID NO: 3482294 - DNA, 15 bp, Homo sapiens
gccatgtactagttt

SEQ ID NO: 3482295 - DNA, 14 bp, Homo sapiens
gccatgtgccaggt

SEQ ID NO: 3482296 - DNA, 23 bp, Homo sapiens
gccatgttaatgtaatctgatgg

SEQ ID NO: 3482297 - DNA, 16 bp, Homo sapiens
gccatgttggccaggc

SEQ ID NO: 3482298 - DNA, 17 bp, Homo sapiens
gccatgttggccaggct

SEQ ID NO: 3482299 - DNA, 22 bp, Homo sapiens
gccatgttggccaggctggtct

SEQ ID NO: 3482300 - DNA, 14 bp, Homo sapiens
gccattattctatg

SEQ ID NO: 3482301 - DNA, 17 bp, Homo sapiens
gccattctccacagcaa

SEQ ID NO: 3482302 - DNA, 16 bp, Homo sapiens
gccattgcactccagc

SEQ ID NO: 3482303 - DNA, 19 bp, Homo sapiens
gccattgtgaaccaatgca

SEQ ID NO: 3482304 - DNA, 15 bp, Homo sapiens
gcccaaaatttattt

SEQ ID NO: 3482305 - DNA, 16 bp, Homo sapiens
gcccaacccttccctc

SEQ ID NO: 3482306 - DNA, 15 bp, Homo sapiens
gcccaactgtgtagc

SEQ ID NO: 3482307 - DNA, 19 bp, Homo sapiens
gcccaagggatctggtcct

SEQ ID NO: 3482308 - DNA, 23 bp, Homo sapiens
gcccacaaaggcaaagggtccag

SEQ ID NO: 3482309 - DNA, 22 bp, Homo sapiens
gcccacaatccctttctaagga

SEQ ID NO: 3482310 - DNA, 18 bp, Homo sapiens
gcccacaggatcagtctg

SEQ ID NO: 3482311 - DNA, 22 bp, Homo sapiens
gcccacctgtcaaacaaagcca

SEQ ID NO: 3482312 - DNA, 17 bp, Homo sapiens
gcccaccttggctcaag

SEQ ID NO: 3482313 - DNA, 17 bp, Homo sapiens
gcccacgctggagtgca

SEQ ID NO: 3482314 - DNA, 17 bp, Homo sapiens
gcccactctgctcgcct

SEQ ID NO: 3482315 - DNA, 17 bp, Homo sapiens
gcccactgtcctgggcc

SEQ ID NO: 3482316 - DNA, 19 bp, Homo sapiens
gcccagagacccaagctgc

SEQ ID NO: 3482317 - DNA, 15 bp, Homo sapiens
gcccagagagggtgg

SEQ ID NO: 3482318 - DNA, 13 bp, Homo sapiens
gcccagagcccag

SEQ ID NO: 3482319 - DNA, 17 bp, Homo sapiens
gcccagagcccagctcc

SEQ ID NO: 3482320 - DNA, 18 bp, Homo sapiens
gcccagagcccagctcca

SEQ ID NO: 3482321 - DNA, 16 bp, Homo sapiens
gcccagaggagggcag

SEQ ID NO: 3482322 - DNA, 23 bp, Homo sapiens
gcccagaggagggcagcagaagg

SEQ ID NO: 3482323 - DNA, 17 bp, Homo sapiens
gcccagccaaaccctgt

SEQ ID NO: 3482324 - DNA, 21 bp, Homo sapiens
gcccagccaaaccctgtctga

SEQ ID NO: 3482325 - DNA, 15 bp, Homo sapiens
gcccagccaggcccc

SEQ ID NO: 3482326 - DNA, 17 bp, Homo sapiens
gcccagccaggccccag

SEQ ID NO: 3482327 - DNA, 20 bp, Homo sapiens
gcccagcccctactgctgtg

SEQ ID NO: 3482328 - DNA, 20 bp, Homo sapiens
gcccagctatacctgtgcct

SEQ ID NO: 3482329 - DNA, 12 bp, Homo sapiens
gcccagctccaa

SEQ ID NO: 3482330 - DNA, 16 bp, Homo sapiens
gcccaggcaggtcttg

SEQ ID NO: 3482331 - DNA, 12 bp, Homo sapiens
gcccaggcccct

SEQ ID NO: 3482332 - DNA, 13 bp, Homo sapiens
gcccaggcccctg

SEQ ID NO: 3482333 - DNA, 17 bp, Homo sapiens
gcccaggcccctgccac

SEQ ID NO: 3482334 - DNA, 20 bp, Homo sapiens
gcccaggcccctgccaccct

SEQ ID NO: 3482335 - DNA, 11 bp, Homo sapiens
gcccaggctgg

SEQ ID NO: 3482336 - DNA, 19 bp, Homo sapiens
gcccaggctggagtgcagt

SEQ ID NO: 3482337 - DNA, 15 bp, Homo sapiens
gcccaggctggcgtg

SEQ ID NO: 3482338 - DNA, 19 bp, Homo sapiens
gcccaggctggcgtgcagt

SEQ ID NO: 3482339 - DNA, 24 bp, Homo sapiens
gcccaggctggtcttgaagtcctg

SEQ ID NO: 3482340 - DNA, 17 bp, Homo sapiens
gcccagggagcggaaag

SEQ ID NO: 3482341 - DNA, 15 bp, Homo sapiens
gcccagggcccagag

SEQ ID NO: 3482342 - DNA, 18 bp, Homo sapiens
gcccagggcccagagccc

SEQ ID NO: 3482343 - DNA, 19 bp, Homo sapiens
gcccagggcccagagccca

SEQ ID NO: 3482344 - DNA, 14 bp, Homo sapiens
gcccagggctcctg

SEQ ID NO: 3482345 - DNA, 16 bp, Homo sapiens
gcccagggctcctgca

SEQ ID NO: 3482346 - DNA, 14 bp, Homo sapiens
gcccaggtttctgg

SEQ ID NO: 3482347 - DNA, 15 bp, Homo sapiens
gcccagtagaccttg

SEQ ID NO: 3482348 - DNA, 14 bp, Homo sapiens
gcccagtccttcca

SEQ ID NO: 3482349 - DNA, 19 bp, Homo sapiens
gcccagtccttccacctcg

SEQ ID NO: 3482350 - DNA, 16 bp, Homo sapiens
gcccagtcgaccccaa

SEQ ID NO: 3482351 - DNA, 20 bp, Homo sapiens
gcccagtctggaatgcagtg

SEQ ID NO: 3482352 - DNA, 19 bp, Homo sapiens
gcccagttcaccctgattt

SEQ ID NO: 3482353 - DNA, 21 bp, Homo sapiens
gcccagttgggtggatgcctg

SEQ ID NO: 3482354 - DNA, 21 bp, Homo sapiens
gcccatggacaggctggctcc

SEQ ID NO: 3482355 - DNA, 23 bp, Homo sapiens
gcccatggacaggctggctccag

SEQ ID NO: 3482356 - DNA, 22 bp, Homo sapiens
gcccatggccctcccagtacct

SEQ ID NO: 3482357 - DNA, 22 bp, Homo sapiens
gcccatgttaagtcctccctga

SEQ ID NO: 3482358 - DNA, 23 bp, Homo sapiens
gcccatgttaagtcctccctgac

SEQ ID NO: 3482359 - DNA, 11 bp, Homo sapiens
gcccatttcat

SEQ ID NO: 3482360 - DNA, 22 bp, Homo sapiens
gcccatttcgtgagccccatct

SEQ ID NO: 3482361 - DNA, 17 bp, Homo sapiens
gccccaaacaaatatgc

SEQ ID NO: 3482362 - DNA, 12 bp, Homo sapiens
gccccaattcaa

SEQ ID NO: 3482363 - DNA, 13 bp, Homo sapiens
gccccactgggga

SEQ ID NO: 3482364 - DNA, 15 bp, Homo sapiens
gccccactggggaaa

SEQ ID NO: 3482365 - DNA, 18 bp, Homo sapiens
gccccagcctccctgaag

SEQ ID NO: 3482366 - DNA, 14 bp, Homo sapiens
gccccagcctgcta

SEQ ID NO: 3482367 - DNA, 15 bp, Homo sapiens
gccccagcctgctag

SEQ ID NO: 3482368 - DNA, 15 bp, Homo sapiens
gccccaggaaaggcc

SEQ ID NO: 3482369 - DNA, 11 bp, Homo sapiens
gccccaggacc

SEQ ID NO: 3482370 - DNA, 14 bp, Homo sapiens
gccccaggaccagc

SEQ ID NO: 3482371 - DNA, 17 bp, Homo sapiens
gccccaggaccagctca

SEQ ID NO: 3482372 - DNA, 22 bp, Homo sapiens
gccccaggaccagctcaggaca

SEQ ID NO: 3482373 - DNA, 24 bp, Homo sapiens
gccccaggaccagctcaggacaga

SEQ ID NO: 3482374 - DNA, 21 bp, Homo sapiens
gccccaggacctggctgccat

SEQ ID NO: 3482375 - DNA, 23 bp, Homo sapiens
gccccaggcttgtcactagcagc

SEQ ID NO: 3482376 - DNA, 12 bp, Homo sapiens
gccccagtgccc

SEQ ID NO: 3482377 - DNA, 14 bp, Homo sapiens
gccccagtgcccac

SEQ ID NO: 3482378 - DNA, 16 bp, Homo sapiens
gccccagtgcccacag

SEQ ID NO: 3482379 - DNA, 21 bp, Homo sapiens
gccccagtgcccacaggatca

SEQ ID NO: 3482380 - DNA, 16 bp, Homo sapiens
gccccatcctccagca

SEQ ID NO: 3482381 - DNA, 12 bp, Homo sapiens
gccccatctccc

SEQ ID NO: 3482382 - DNA, 17 bp, Homo sapiens
gccccatctcccctcag

SEQ ID NO: 3482383 - DNA, 18 bp, Homo sapiens
gccccatctcccctcagc

SEQ ID NO: 3482384 - DNA, 21 bp, Homo sapiens
gccccatctcccctcagctcg

SEQ ID NO: 3482385 - DNA, 16 bp, Homo sapiens
gccccatcttcaccca

SEQ ID NO: 3482386 - DNA, 18 bp, Homo sapiens
gccccattctcactgcta

SEQ ID NO: 3482387 - DNA, 14 bp, Homo sapiens
gccccattctgcct

SEQ ID NO: 3482388 - DNA, 15 bp, Homo sapiens
gccccattctgcctg

SEQ ID NO: 3482389 - DNA, 14 bp, Homo sapiens
gcccccaagcctgc

SEQ ID NO: 3482390 - DNA, 22 bp, Homo sapiens
gcccccaccgtgggcagggagc

SEQ ID NO: 3482391 - DNA, 12 bp, Homo sapiens
gcccccactgac

SEQ ID NO: 3482392 - DNA, 16 bp, Homo sapiens
gcccccacttgcctct

SEQ ID NO: 3482393 - DNA, 21 bp, Homo sapiens
gcccccagcccagggctcctg

SEQ ID NO: 3482394 - DNA, 22 bp, Homo sapiens
gcccccagctaagaacctggaa

SEQ ID NO: 3482395 - DNA, 16 bp, Homo sapiens
gcccccaggactgggc

SEQ ID NO: 3482396 - DNA, 19 bp, Homo sapiens
gccccccacccctggaaga

SEQ ID NO: 3482397 - DNA, 14 bp, Homo sapiens
gccccccgcagcac

SEQ ID NO: 3482398 - DNA, 20 bp, Homo sapiens
gcccccctttggtttggcct

SEQ ID NO: 3482399 - DNA, 16 bp, Homo sapiens
gccccctccgccctgc

SEQ ID NO: 3482400 - DNA, 22 bp, Homo sapiens
gccccctccgccctgccactca

SEQ ID NO: 3482401 - DNA, 11 bp, Homo sapiens
gccccctgccc

SEQ ID NO: 3482402 - DNA, 13 bp, Homo sapiens
gccccctggcctc

SEQ ID NO: 3482403 - DNA, 14 bp, Homo sapiens
gccccctggcctct

SEQ ID NO: 3482404 - DNA, 16 bp, Homo sapiens
gccccctggcctctgt

SEQ ID NO: 3482405 - DNA, 19 bp, Homo sapiens
gccccctggcctctgtgcc

SEQ ID NO: 3482406 - DNA, 18 bp, Homo sapiens
gccccgaggccttctctg

SEQ ID NO: 3482407 - DNA, 13 bp, Homo sapiens
gccccgccgcctg

SEQ ID NO: 3482408 - DNA, 18 bp, Homo sapiens
gccccgcctgcctgccac

SEQ ID NO: 3482409 - DNA, 21 bp, Homo sapiens
gccccgggtccccagctcccc

SEQ ID NO: 3482410 - DNA, 16 bp, Homo sapiens
gctaatttaaagagac

SEQ ID NO: 3482411 - DNA, 12 bp, Homo sapiens
gctaatttgcat

SEQ ID NO: 3482412 - DNA, 16 bp, Homo sapiens
gctaatttttcatttt

SEQ ID NO: 3482413 - DNA, 15 bp, Homo sapiens
gctaatttttgtaat

SEQ ID NO: 3482414 - DNA, 22 bp, Homo sapiens
gctacaaaataaagctgttctc

SEQ ID NO: 3482415 - DNA, 20 bp, Homo sapiens
gctacaaatactcttaggaa

SEQ ID NO: 3482416 - DNA, 14 bp, Homo sapiens
gctacacagggatg

SEQ ID NO: 3482417 - DNA, 13 bp, Homo sapiens
gctacacctttct

SEQ ID NO: 3482418 - DNA, 20 bp, Homo sapiens
gctacacctttctcctttgt

SEQ ID NO: 3482419 - DNA, 12 bp, Homo sapiens
gctaccctgagc

SEQ ID NO: 3482420 - DNA, 16 bp, Homo sapiens
gctaccctgagctgag

SEQ ID NO: 3482421 - DNA, 20 bp, Homo sapiens
gctaccctgagctgaggcag

SEQ ID NO: 3482422 - DNA, 13 bp, Homo sapiens
gctacctccctcc

SEQ ID NO: 3482423 - DNA, 14 bp, Homo sapiens
gctacctctctgtc

SEQ ID NO: 3482424 - DNA, 22 bp, Homo sapiens
gctacctctctgtcccttgctg

SEQ ID NO: 3482425 - DNA, 13 bp, Homo sapiens
gctacctgagcca

SEQ ID NO: 3482426 - DNA, 23 bp, Homo sapiens
gctaccttctctacccatctccc

SEQ ID NO: 3482427 - DNA, 14 bp, Homo sapiens
gctactagctcttt

SEQ ID NO: 3482428 - DNA, 20 bp, Homo sapiens
gctactctgatccctctggg

SEQ ID NO: 3482429 - DNA, 18 bp, Homo sapiens
gctactgccgtcagtgct

SEQ ID NO: 3482430 - DNA, 23 bp, Homo sapiens
gctactggcaaaaggatctttgt

SEQ ID NO: 3482431 - DNA, 22 bp, Homo sapiens
gctactgtaattttatatgaag

SEQ ID NO: 3482432 - DNA, 19 bp, Homo sapiens
gctactgtcctacccaccc

SEQ ID NO: 3482433 - DNA, 21 bp, Homo sapiens
gctactgtgtgtgtgaatgaa

SEQ ID NO: 3482434 - DNA, 22 bp, Homo sapiens
gctagcagcagggagggcttct

SEQ ID NO: 3482435 - DNA, 14 bp, Homo sapiens
gctagctagctcaa

SEQ ID NO: 3482436 - DNA, 17 bp, Homo sapiens
gctagctagctcaacta

SEQ ID NO: 3482437 - DNA, 12 bp, Homo sapiens
gctagctcaact

SEQ ID NO: 3482438 - DNA, 22 bp, Homo sapiens
gctaggacccctccatgtgggc

SEQ ID NO: 3482439 - DNA, 14 bp, Homo sapiens
gctagtaatgcttt

SEQ ID NO: 3482440 - DNA, 16 bp, Homo sapiens
gctagtcaagctcctc

SEQ ID NO: 3482441 - DNA, 21 bp, Homo sapiens
gctagtcaagctcctcctccc

SEQ ID NO: 3482442 - DNA, 14 bp, Homo sapiens
gctagttgggcttc

SEQ ID NO: 3482443 - DNA, 21 bp, Homo sapiens
gctagttgggcttcctcatag

SEQ ID NO: 3482444 - DNA, 17 bp, Homo sapiens
gctagttggttgaattt

SEQ ID NO: 3482445 - DNA, 13 bp, Homo sapiens
gctatagtatttg

SEQ ID NO: 3482446 - DNA, 15 bp, Homo sapiens
gctatcctggctctt

SEQ ID NO: 3482447 - DNA, 12 bp, Homo sapiens
gctatctgcctg

SEQ ID NO: 3482448 - DNA, 16 bp, Homo sapiens
gctatctgcctgacag

SEQ ID NO: 3482449 - DNA, 19 bp, Homo sapiens
gctatctgcctgacaggct

SEQ ID NO: 3482450 - DNA, 20 bp, Homo sapiens
gctatgacatggaggcactg

SEQ ID NO: 3482451 - DNA, 18 bp, Homo sapiens
gctatggtgctctgtcta

SEQ ID NO: 3482452 - DNA, 15 bp, Homo sapiens
gctattgacaataaa

SEQ ID NO: 3482453 - DNA, 16 bp, Homo sapiens
gctattgcactccagt

SEQ ID NO: 3482454 - DNA, 19 bp, Homo sapiens
gctattggaggatcagttt

SEQ ID NO: 3482455 - DNA, 22 bp, Homo sapiens
gctattggcctcccaaaagact

SEQ ID NO: 3482456 - DNA, 22 bp, Homo sapiens
gctcacactgagaatgtaagaa

SEQ ID NO: 3482457 - DNA, 16 bp, Homo sapiens
gctcacccccttctcc

SEQ ID NO: 3482458 - DNA, 13 bp, Homo sapiens
gctcactcacccc

SEQ ID NO: 3482459 - DNA, 22 bp, Homo sapiens
gctcactgaactccttccccac

SEQ ID NO: 3482460 - DNA, 17 bp, Homo sapiens
gctcactgcagcctcaa

SEQ ID NO: 3482461 - DNA, 17 bp, Homo sapiens
gctcagaacttgctgct

SEQ ID NO: 3482462 - DNA, 19 bp, Homo sapiens
gctcagacattttcttttt

SEQ ID NO: 3482463 - DNA, 21 bp, Homo sapiens
gctcagaggcgcactgtgacc

SEQ ID NO: 3482464 - DNA, 18 bp, Homo sapiens
gctcagatggcctgagcc

SEQ ID NO: 3482465 - DNA, 20 bp, Homo sapiens
gctcagcaaaagatgcttct

SEQ ID NO: 3482466 - DNA, 12 bp, Homo sapiens
gctcagccagca

SEQ ID NO: 3482467 - DNA, 15 bp, Homo sapiens
gctcagcggggacag

SEQ ID NO: 3482468 - DNA, 18 bp, Homo sapiens
gctcagcggggacagctc

SEQ ID NO: 3482469 - DNA, 22 bp, Homo sapiens
gctcagcggggacagctccttc

SEQ ID NO: 3482470 - DNA, 17 bp, Homo sapiens
gctcaggacagatgcca

SEQ ID NO: 3482471 - DNA, 19 bp, Homo sapiens
gctcaggactcagaagcct

SEQ ID NO: 3482472 - DNA, 14 bp, Homo sapiens
gctcaggatctctt

SEQ ID NO: 3482473 - DNA, 19 bp, Homo sapiens
gctcaggcgatccacctgt

SEQ ID NO: 3482474 - DNA, 22 bp, Homo sapiens
gctcaggcgatccacctgtctc

SEQ ID NO: 3482475 - DNA, 24 bp, Homo sapiens
gctcaggcgatccacctgtctcag

SEQ ID NO: 3482476 - DNA, 20 bp, Homo sapiens
gctcagggaaatggccttcc

SEQ ID NO: 3482477 - DNA, 19 bp, Homo sapiens
gctcagggccatgctgagg

SEQ ID NO: 3482478 - DNA, 14 bp, Homo sapiens
gctcaggtgtccct

SEQ ID NO: 3482479 - DNA, 18 bp, Homo sapiens
gctcaggtgtccctgcac

SEQ ID NO: 3482480 - DNA, 19 bp, Homo sapiens
gctcaggtgtccctgcact

SEQ ID NO: 3482481 - DNA, 16 bp, Homo sapiens
gctcagttctgcctta

SEQ ID NO: 3482482 - DNA, 19 bp, Homo sapiens
gctcatcattctctgtctc

SEQ ID NO: 3482483 - DNA, 22 bp, Homo sapiens
gctcatctctgtcccacttggc

SEQ ID NO: 3482484 - DNA, 15 bp, Homo sapiens
gctcatctgctggtc

SEQ ID NO: 3482485 - DNA, 21 bp, Homo sapiens
gctcatctgctggtccgtggg

SEQ ID NO: 3482486 - DNA, 23 bp, Homo sapiens
gctcatctgctggtccgtgggac

SEQ ID NO: 3482487 - DNA, 17 bp, Homo sapiens
gctcatggccctgtagt

SEQ ID NO: 3482488 - DNA, 16 bp, Homo sapiens
gctcattctgcacctt

SEQ ID NO: 3482489 - DNA, 18 bp, Homo sapiens
gctccaacctgcaaagat

SEQ ID NO: 3482490 - DNA, 16 bp, Homo sapiens
gctccaagccccatct

SEQ ID NO: 3482491 - DNA, 20 bp, Homo sapiens
gctccaaggggaatcagaac

SEQ ID NO: 3482492 - DNA, 16 bp, Homo sapiens
gctccactctgcttct

SEQ ID NO: 3482493 - DNA, 20 bp, Homo sapiens
gctccactctgcttctctga

SEQ ID NO: 3482494 - DNA, 21 bp, Homo sapiens
gctccactctgcttctctgac

SEQ ID NO: 3482495 - DNA, 23 bp, Homo sapiens
gctccactctgcttctctgactt

SEQ ID NO: 3482496 - DNA, 13 bp, Homo sapiens
gctccagacctga

SEQ ID NO: 3482497 - DNA, 20 bp, Homo sapiens
gctccagacctgatcctgga

SEQ ID NO: 3482498 - DNA, 21 bp, Homo sapiens
gctccagacctgatcctggag

SEQ ID NO: 3482499 - DNA, 12 bp, Homo sapiens
gctccagagggc

SEQ ID NO: 3482500 - DNA, 18 bp, Homo sapiens
gctccagatgcagggcag

SEQ ID NO: 3482501 - DNA, 19 bp, Homo sapiens
gctccagatgcagggcagt

SEQ ID NO: 3482502 - DNA, 13 bp, Homo sapiens
gctccagctcacc

SEQ ID NO: 3482503 - DNA, 20 bp, Homo sapiens
gctccagctcaccagcccca

SEQ ID NO: 3482504 - DNA, 21 bp, Homo sapiens
gctccagctcaccagccccag

SEQ ID NO: 3482505 - DNA, 23 bp, Homo sapiens
gctccagggatgattcaagccat

SEQ ID NO: 3482506 - DNA, 20 bp, Homo sapiens
gctccatttttagtgaaata

SEQ ID NO: 3482507 - DNA, 11 bp, Homo sapiens
gctcccaaggg

SEQ ID NO: 3482508 - DNA, 14 bp, Homo sapiens
gctcccagcctcag

SEQ ID NO: 3482509 - DNA, 22 bp, Homo sapiens
gctcccaggtgcagccagaggc

SEQ ID NO: 3482510 - DNA, 12 bp, Homo sapiens
gctccccaggac

SEQ ID NO: 3482511 - DNA, 13 bp, Homo sapiens
gctccccaggact

SEQ ID NO: 3482512 - DNA, 15 bp, Homo sapiens
gctcccccaggcctg

SEQ ID NO: 3482513 - DNA, 12 bp, Homo sapiens
gctcccctccaa

SEQ ID NO: 3482514 - DNA, 15 bp, Homo sapiens
gctcccgtggcctgt

SEQ ID NO: 3482515 - DNA, 18 bp, Homo sapiens
gctccctcccaggactct

SEQ ID NO: 3482516 - DNA, 18 bp, Homo sapiens
gctccctgactgggagtt

SEQ ID NO: 3482517 - DNA, 20 bp, Homo sapiens
gctccgaaattccaaggccc

SEQ ID NO: 3482518 - DNA, 22 bp, Homo sapiens
gctccgctttctacccagcgag

SEQ ID NO: 3482519 - DNA, 23 bp, Homo sapiens
gctccgctttctacccagcgagc

SEQ ID NO: 3482520 - DNA, 24 bp, Homo sapiens
gctccgctttctacccagcgagcc

SEQ ID NO: 3482521 - DNA, 13 bp, Homo sapiens
gctcctagaggga

SEQ ID NO: 3482522 - DNA, 14 bp, Homo sapiens
gctcctagagggag

SEQ ID NO: 3482523 - DNA, 19 bp, Homo sapiens
gctcctagagggaggggcc

SEQ ID NO: 3482524 - DNA, 20 bp, Homo sapiens
gctcctccagggtgtgtgct

SEQ ID NO: 3482525 - DNA, 16 bp, Homo sapiens
gctcctctctttgtgg

SEQ ID NO: 3482526 - DNA, 20 bp, Homo sapiens
gctcctgcacttacttgctt

SEQ ID NO: 3482527 - DNA, 22 bp, Homo sapiens
gctcctgccgcagagctggccg

SEQ ID NO: 3482528 - DNA, 14 bp, Homo sapiens
gctcctggcccact

SEQ ID NO: 3482529 - DNA, 19 bp, Homo sapiens
gctcctggcccactgcatc

SEQ ID NO: 3482530 - DNA, 12 bp, Homo sapiens
gctcctgtgtct

SEQ ID NO: 3482531 - DNA, 13 bp, Homo sapiens
gctccttgggagg

SEQ ID NO: 3482532 - DNA, 14 bp, Homo sapiens
gctccttgggaggc

SEQ ID NO: 3482533 - DNA, 21 bp, Homo sapiens
gctccttgggaggccccactg

SEQ ID NO: 3482534 - DNA, 14 bp, Homo sapiens
gctccttgttccta

SEQ ID NO: 3482535 - DNA, 17 bp, Homo sapiens
gctcgagcagtcctgcc

SEQ ID NO: 3482536 - DNA, 21 bp, Homo sapiens
gctcgagcagtcctgcctcag

SEQ ID NO: 3482537 - DNA, 20 bp, Homo sapiens
gctcgagtcacattctgctt

SEQ ID NO: 3482538 - DNA, 14 bp, Homo sapiens
gctcgattttgtat

SEQ ID NO: 3482539 - DNA, 12 bp, Homo sapiens
gctcgccaaggc

SEQ ID NO: 3482540 - DNA, 14 bp, Homo sapiens
gctcgccaaggcct

SEQ ID NO: 3482541 - DNA, 13 bp, Homo sapiens
gctcgctgttgct

SEQ ID NO: 3482542 - DNA, 13 bp, Homo sapiens
ggaagtcaaagca

SEQ ID NO: 3482543 - DNA, 16 bp, Homo sapiens
ggaagtccaatgtggc

SEQ ID NO: 3482544 - DNA, 20 bp, Homo sapiens
ggaagtgaagactggaagct

SEQ ID NO: 3482545 - DNA, 17 bp, Homo sapiens
ggaagtgttccctgaga

SEQ ID NO: 3482546 - DNA, 18 bp, Homo sapiens
ggaagtgttccctgagaa

SEQ ID NO: 3482547 - DNA, 14 bp, Homo sapiens
ggaagttttcaatg

SEQ ID NO: 3482548 - DNA, 22 bp, Homo sapiens
ggaataatgggcttagagcagt

SEQ ID NO: 3482549 - DNA, 14 bp, Homo sapiens
ggaatatcaatata

SEQ ID NO: 3482550 - DNA, 14 bp, Homo sapiens
ggaatatttgaatc

SEQ ID NO: 3482551 - DNA, 15 bp, Homo sapiens
ggaatatttgaatct

SEQ ID NO: 3482552 - DNA, 20 bp, Homo sapiens
ggaatatttgaatcttgtct

SEQ ID NO: 3482553 - DNA, 18 bp, Homo sapiens
ggaatcacatcttttaag

SEQ ID NO: 3482554 - DNA, 15 bp, Homo sapiens
ggaatcatggcctct

SEQ ID NO: 3482555 - DNA, 24 bp, Homo sapiens
ggaatcatttctatttctcctcca

SEQ ID NO: 3482556 - DNA, 14 bp, Homo sapiens
ggaatccactccca

SEQ ID NO: 3482557 - DNA, 22 bp, Homo sapiens
ggaatctgaggcatcctctgac

SEQ ID NO: 3482558 - DNA, 20 bp, Homo sapiens
ggaatgagaagtagccacag

SEQ ID NO: 3482559 - DNA, 18 bp, Homo sapiens
ggaatgatatgcatttga

SEQ ID NO: 3482560 - DNA, 12 bp, Homo sapiens
ggaatgcagtgg

SEQ ID NO: 3482561 - DNA, 18 bp, Homo sapiens
ggaatgcctgagtgcctg

SEQ ID NO: 3482562 - DNA, 23 bp, Homo sapiens
ggaatgcctgagtgcctggccaa

SEQ ID NO: 3482563 - DNA, 15 bp, Homo sapiens
ggaatgttggataag

SEQ ID NO: 3482564 - DNA, 19 bp, Homo sapiens
ggaattacatgtaaaacat

SEQ ID NO: 3482565 - DNA, 16 bp, Homo sapiens
ggaatttcccaggacc

SEQ ID NO: 3482566 - DNA, 17 bp, Homo sapiens
ggaatttcccaggaccc

SEQ ID NO: 3482567 - DNA, 18 bp, Homo sapiens
ggaatttttaaaataaac

SEQ ID NO: 3482568 - DNA, 19 bp, Homo sapiens
ggaatttttaaaataaact

SEQ ID NO: 3482569 - DNA, 17 bp, Homo sapiens
ggaatttttgcttgact

SEQ ID NO: 3482570 - DNA, 22 bp, Homo sapiens
ggacaaagaattccaaagcaaa

SEQ ID NO: 3482571 - DNA, 15 bp, Homo sapiens
ggacaacgaggaagc

SEQ ID NO: 3482572 - DNA, 16 bp, Homo sapiens
ggacaacgaggaagcc

SEQ ID NO: 3482573 - DNA, 19 bp, Homo sapiens
ggacacacatggtgagcct

SEQ ID NO: 3482574 - DNA, 21 bp, Homo sapiens
ggacacacatggtgagcctag

SEQ ID NO: 3482575 - DNA, 12 bp, Homo sapiens
ggacacagctct

SEQ ID NO: 3482576 - DNA, 14 bp, Homo sapiens
ggacacagctcttc

SEQ ID NO: 3482577 - DNA, 15 bp, Homo sapiens
ggacaccccctcgct

SEQ ID NO: 3482578 - DNA, 16 bp, Homo sapiens
ggacacttaatactac

SEQ ID NO: 3482579 - DNA, 23 bp, Homo sapiens
ggacagactcacaacctgaacct

SEQ ID NO: 3482580 - DNA, 14 bp, Homo sapiens
ggacagaggcccca

SEQ ID NO: 3482581 - DNA, 15 bp, Homo sapiens
ggacagccacggcca

SEQ ID NO: 3482582 - DNA, 21 bp, Homo sapiens
ggacagccacggccaggccag

SEQ ID NO: 3482583 - DNA, 20 bp, Homo sapiens
ggacagctccttctgtccta

SEQ ID NO: 3482584 - DNA, 15 bp, Homo sapiens
ggacaggctggctcc

SEQ ID NO: 3482585 - DNA, 20 bp, Homo sapiens
ggacagtaataagaatggaa

SEQ ID NO: 3482586 - DNA, 14 bp, Homo sapiens
ggacagtgctgcag

SEQ ID NO: 3482587 - DNA, 16 bp, Homo sapiens
ggacagtgctgcagct

SEQ ID NO: 3482588 - DNA, 18 bp, Homo sapiens
ggacatagcgaatacaaa

SEQ ID NO: 3482589 - DNA, 18 bp, Homo sapiens
ggacatcaggagactggg

SEQ ID NO: 3482590 - DNA, 13 bp, Homo sapiens
ggacatcctcctc

SEQ ID NO: 3482591 - DNA, 16 bp, Homo sapiens
ggacatgcggtagcca

SEQ ID NO: 3482592 - DNA, 18 bp, Homo sapiens
ggacatggcccctgtgag

SEQ ID NO: 3482593 - DNA, 16 bp, Homo sapiens
ggaccaaccctgggga

SEQ ID NO: 3482594 - DNA, 20 bp, Homo sapiens
ggaccaaccctggggaagga

SEQ ID NO: 3482595 - DNA, 15 bp, Homo sapiens
ggaccagccagcagc

SEQ ID NO: 3482596 - DNA, 19 bp, Homo sapiens
ggaccagctcaggacagat

SEQ ID NO: 3482597 - DNA, 19 bp, Homo sapiens
ggaccagtcaacctgggca

SEQ ID NO: 3482598 - DNA, 17 bp, Homo sapiens
ggaccatcatcctactg

SEQ ID NO: 3482599 - DNA, 22 bp, Homo sapiens
ggacccccgccccctgccctcc

SEQ ID NO: 3482600 - DNA, 23 bp, Homo sapiens
ggacccccgccccctgccctccc

SEQ ID NO: 3482601 - DNA, 13 bp, Homo sapiens
ggacccctgccct

SEQ ID NO: 3482602 - DNA, 21 bp, Homo sapiens
ggaccccttaatcttgctttc

SEQ ID NO: 3482603 - DNA, 17 bp, Homo sapiens
ggacctaaatggcctca

SEQ ID NO: 3482604 - DNA, 14 bp, Homo sapiens
ggacctaggctcct

SEQ ID NO: 3482605 - DNA, 14 bp, Homo sapiens
ggacctgcctgtag

SEQ ID NO: 3482606 - DNA, 16 bp, Homo sapiens
ggaccttttgggggag

SEQ ID NO: 3482607 - DNA, 23 bp, Homo sapiens
ggacgcagcaggaggccaggccg

SEQ ID NO: 3482608 - DNA, 13 bp, Homo sapiens
ggacgcaggcccc

SEQ ID NO: 3482609 - DNA, 19 bp, Homo sapiens
ggacgcaggcccctctcct

SEQ ID NO: 3482610 - DNA, 15 bp, Homo sapiens
ggacgccacccagca

SEQ ID NO: 3482611 - DNA, 14 bp, Homo sapiens
ggacgcctgggggt

SEQ ID NO: 3482612 - DNA, 19 bp, Homo sapiens
ggacgcctgggggtgccag

SEQ ID NO: 3482613 - DNA, 15 bp, Homo sapiens
ggacggtgctccagg

SEQ ID NO: 3482614 - DNA, 18 bp, Homo sapiens
ggacgtggctcagccagc

SEQ ID NO: 3482615 - DNA, 19 bp, Homo sapiens
ggacgtggctcagccagca

SEQ ID NO: 3482616 - DNA, 13 bp, Homo sapiens
ggacgtgggctgg

SEQ ID NO: 3482617 - DNA, 12 bp, Homo sapiens
ggactaaaagat

SEQ ID NO: 3482618 - DNA, 14 bp, Homo sapiens
ggactaaaagatat

SEQ ID NO: 3482619 - DNA, 14 bp, Homo sapiens
ggactacaggtgtg

SEQ ID NO: 3482620 - DNA, 23 bp, Homo sapiens
ggactatatttgggcctgctcca

SEQ ID NO: 3482621 - DNA, 14 bp, Homo sapiens
ggactattataatt

SEQ ID NO: 3482622 - DNA, 18 bp, Homo sapiens
ggactcagaagcctctgg

SEQ ID NO: 3482623 - DNA, 17 bp, Homo sapiens
ggactcagccttcagac

SEQ ID NO: 3482624 - DNA, 21 bp, Homo sapiens
ggactcagccttcagacagag

SEQ ID NO: 3482625 - DNA, 13 bp, Homo sapiens
ggactcagctccc

SEQ ID NO: 3482626 - DNA, 14 bp, Homo sapiens
ggactcatgaggag

SEQ ID NO: 3482627 - DNA, 14 bp, Homo sapiens
ggactccaggccca

SEQ ID NO: 3482628 - DNA, 15 bp, Homo sapiens
ggactccaggcccaa

SEQ ID NO: 3482629 - DNA, 23 bp, Homo sapiens
ggactccaggcccaaggctcccg

SEQ ID NO: 3482630 - DNA, 11 bp, Homo sapiens
ggactccatct

SEQ ID NO: 3482631 - DNA, 16 bp, Homo sapiens
ggactccggccctcct

SEQ ID NO: 3482632 - DNA, 20 bp, Homo sapiens
ggactctcagtctctgagca

SEQ ID NO: 3482633 - DNA, 22 bp, Homo sapiens
ggactgcacagcgtcctgtcca

SEQ ID NO: 3482634 - DNA, 21 bp, Homo sapiens
ggactggtgccctcctcactc

SEQ ID NO: 3482635 - DNA, 18 bp, Homo sapiens
ggactgtagggagggcgg

SEQ ID NO: 3482636 - DNA, 11 bp, Homo sapiens
ggacttcctgt

SEQ ID NO: 3482637 - DNA, 19 bp, Homo sapiens
ggacttcctgtccagctcc

SEQ ID NO: 3482638 - DNA, 21 bp, Homo sapiens
ggacttcctgtccagctccaa

SEQ ID NO: 3482639 - DNA, 13 bp, Homo sapiens
ggacttgaagttg

SEQ ID NO: 3482640 - DNA, 22 bp, Homo sapiens
ggagaaatttgataatgacact

SEQ ID NO: 3482641 - DNA, 21 bp, Homo sapiens
ggagaactcctagggtggctg

SEQ ID NO: 3482642 - DNA, 17 bp, Homo sapiens
ggagaagcggctggcag

SEQ ID NO: 3482643 - DNA, 22 bp, Homo sapiens
ggagaatttaggtttttattag

SEQ ID NO: 3482644 - DNA, 21 bp, Homo sapiens
ggagacaatgtctgcagccct

SEQ ID NO: 3482645 - DNA, 18 bp, Homo sapiens
ggagacagcatcagggtt

SEQ ID NO: 3482646 - DNA, 11 bp, Homo sapiens
ggagacagggt

SEQ ID NO: 3482647 - DNA, 13 bp, Homo sapiens
ggagactcctagg

SEQ ID NO: 3482648 - DNA, 18 bp, Homo sapiens
ggagactcctaggcagga

SEQ ID NO: 3482649 - DNA, 21 bp, Homo sapiens
ggagactcctaggcaggacat

SEQ ID NO: 3482650 - DNA, 13 bp, Homo sapiens
ggagactgggctg

SEQ ID NO: 3482651 - DNA, 22 bp, Homo sapiens
ggagacttagggcaccaggggt

SEQ ID NO: 3482652 - DNA, 16 bp, Homo sapiens
ggagagaaaatatatg

SEQ ID NO: 3482653 - DNA, 16 bp, Homo sapiens
ggagagagacagagag

SEQ ID NO: 3482654 - DNA, 20 bp, Homo sapiens
ggagagcgcctgcccctccc

SEQ ID NO: 3482655 - DNA, 17 bp, Homo sapiens
ggagagctagcagcagg

SEQ ID NO: 3482656 - DNA, 11 bp, Homo sapiens
ggagaggagac

SEQ ID NO: 3482657 - DNA, 18 bp, Homo sapiens
ggagagtttcctgaaaca

SEQ ID NO: 3482658 - DNA, 13 bp, Homo sapiens
ggagatcctcctg

SEQ ID NO: 3482659 - DNA, 20 bp, Homo sapiens
ggagatggaagttgcagtga

SEQ ID NO: 3482660 - DNA, 14 bp, Homo sapiens
ggagcaaaggctga

SEQ ID NO: 3482661 - DNA, 14 bp, Homo sapiens
ggagcagtgcaggc

SEQ ID NO: 3482662 - DNA, 18 bp, Homo sapiens
ggagcagtgcaggcacag

SEQ ID NO: 3482663 - DNA, 15 bp, Homo sapiens
ggagcatcaagccac

SEQ ID NO: 3482664 - DNA, 21 bp, Homo sapiens
ggagcatttttttattcagca

SEQ ID NO: 3482665 - DNA, 20 bp, Homo sapiens
ggagccaacagaagcttcca

SEQ ID NO: 3482666 - DNA, 16 bp, Homo sapiens
ggagccactcctctga

SEQ ID NO: 3482667 - DNA, 19 bp, Homo sapiens
ggagccactcctctgactc

SEQ ID NO: 3482668 - DNA, 12 bp, Homo sapiens
ggagccactgcc

SEQ ID NO: 3482669 - DNA, 15 bp, Homo sapiens
ggagccactgccact

SEQ ID NO: 3482670 - DNA, 14 bp, Homo sapiens
ggagccatttgaga

SEQ ID NO: 3482671 - DNA, 20 bp, Homo sapiens
ggagcccactgtcctgggcc

SEQ ID NO: 3482672 - DNA, 16 bp, Homo sapiens
ggagccccatctgtct

SEQ ID NO: 3482673 - DNA, 17 bp, Homo sapiens
ggagccccattcctggg

SEQ ID NO: 3482674 - DNA, 23 bp, Homo sapiens
ggagcccgtgccctaccacacat

SEQ ID NO: 3482675 - DNA, 22 bp, Homo sapiens
ggctcgattttgtatctgcagg

SEQ ID NO: 3482676 - DNA, 15 bp, Homo sapiens
ggctcgccaaggcct

SEQ ID NO: 3482677 - DNA, 15 bp, Homo sapiens
ggctctatttcttct

SEQ ID NO: 3482678 - DNA, 13 bp, Homo sapiens
ggctctgaccagt

SEQ ID NO: 3482679 - DNA, 15 bp, Homo sapiens
ggctctgagcgcctc

SEQ ID NO: 3482680 - DNA, 17 bp, Homo sapiens
ggctctggccaagggcc

SEQ ID NO: 3482681 - DNA, 23 bp, Homo sapiens
ggctctgggatagctgacccagc

SEQ ID NO: 3482682 - DNA, 19 bp, Homo sapiens
ggctctgtgggtgatgggg

SEQ ID NO: 3482683 - DNA, 22 bp, Homo sapiens
ggctcttctcatttcacccctc

SEQ ID NO: 3482684 - DNA, 16 bp, Homo sapiens
ggctcttctccccaga

SEQ ID NO: 3482685 - DNA, 17 bp, Homo sapiens
ggctcttctttcccaaa

SEQ ID NO: 3482686 - DNA, 19 bp, Homo sapiens
ggctgaaattctcctggag

SEQ ID NO: 3482687 - DNA, 21 bp, Homo sapiens
ggctgaaattctcctggaggt

SEQ ID NO: 3482688 - DNA, 21 bp, Homo sapiens
ggctgaaccctcagccttgac

SEQ ID NO: 3482689 - DNA, 22 bp, Homo sapiens
ggctgaaccctcagccttgact

SEQ ID NO: 3482690 - DNA, 13 bp, Homo sapiens
ggctgaccacagc

SEQ ID NO: 3482691 - DNA, 15 bp, Homo sapiens
ggctgaccacagcac

SEQ ID NO: 3482692 - DNA, 15 bp, Homo sapiens
ggctgaccatgctca

SEQ ID NO: 3482693 - DNA, 13 bp, Homo sapiens
ggctgagctgggg

SEQ ID NO: 3482694 - DNA, 17 bp, Homo sapiens
ggctgaggaaaggccag

SEQ ID NO: 3482695 - DNA, 17 bp, Homo sapiens
ggctgaggctggcacag

SEQ ID NO: 3482696 - DNA, 18 bp, Homo sapiens
ggctgaggctggcacagg

SEQ ID NO: 3482697 - DNA, 12 bp, Homo sapiens
ggctgagggcct

SEQ ID NO: 3482698 - DNA, 13 bp, Homo sapiens
ggctgagggcctg

SEQ ID NO: 3482699 - DNA, 14 bp, Homo sapiens
ggctgagggcctgc

SEQ ID NO: 3482700 - DNA, 16 bp, Homo sapiens
ggctgagggcctgctg

SEQ ID NO: 3482701 - DNA, 18 bp, Homo sapiens
ggctgagggcctgctgga

SEQ ID NO: 3482702 - DNA, 13 bp, Homo sapiens
ggctgaggtggga

SEQ ID NO: 3482703 - DNA, 15 bp, Homo sapiens
ggctgaggtgggagg

SEQ ID NO: 3482704 - DNA, 24 bp, Homo sapiens
ggctgatgtcaatttctgtgttgc

SEQ ID NO: 3482705 - DNA, 18 bp, Homo sapiens
ggctgcaaagggtatcag

SEQ ID NO: 3482706 - DNA, 22 bp, Homo sapiens
ggctgcaaagggtatcaggtgc

SEQ ID NO: 3482707 - DNA, 24 bp, Homo sapiens
ggctgcaaagggtatcaggtgctg

SEQ ID NO: 3482708 - DNA, 16 bp, Homo sapiens
ggctgcagaggccaga

SEQ ID NO: 3482709 - DNA, 18 bp, Homo sapiens
ggctgcagaggccagagg

SEQ ID NO: 3482710 - DNA, 19 bp, Homo sapiens
ggctgcagaggccagaggc

SEQ ID NO: 3482711 - DNA, 20 bp, Homo sapiens
ggctgcagagtctgccccac

SEQ ID NO: 3482712 - DNA, 19 bp, Homo sapiens
ggctgccccgggtccccag

SEQ ID NO: 3482713 - DNA, 23 bp, Homo sapiens
ggctgccccgggtccccagctcc

SEQ ID NO: 3482714 - DNA, 13 bp, Homo sapiens
ggctgcctcccaa

SEQ ID NO: 3482715 - DNA, 22 bp, Homo sapiens
ggctgcggaatgaaccacatct

SEQ ID NO: 3482716 - DNA, 21 bp, Homo sapiens
ggctgcggcgtacaggctggc

SEQ ID NO: 3482717 - DNA, 22 bp, Homo sapiens
ggctgcggcgtacaggctggcg

SEQ ID NO: 3482718 - DNA, 12 bp, Homo sapiens
ggctgctgccca

SEQ ID NO: 3482719 - DNA, 14 bp, Homo sapiens
ggctgcttagaatc

SEQ ID NO: 3482720 - DNA, 13 bp, Homo sapiens
ggctgcttcctcc

SEQ ID NO: 3482721 - DNA, 23 bp, Homo sapiens
ggctggaacagattcacactgtc

SEQ ID NO: 3482722 - DNA, 19 bp, Homo sapiens
ggctggaagatcctgcggg

SEQ ID NO: 3482723 - DNA, 14 bp, Homo sapiens
ggctggaggcccag

SEQ ID NO: 3482724 - DNA, 19 bp, Homo sapiens
ggctggaggcccaggctgg

SEQ ID NO: 3482725 - DNA, 20 bp, Homo sapiens
ggctggagtacagtggtgcc

SEQ ID NO: 3482726 - DNA, 19 bp, Homo sapiens
ggctggagtggagtggcgt

SEQ ID NO: 3482727 - DNA, 23 bp, Homo sapiens
ggctggcctcacccacccctgca

SEQ ID NO: 3482728 - DNA, 24 bp, Homo sapiens
ggctggctccagatgcagggcagt

SEQ ID NO: 3482729 - DNA, 10 bp, Homo sapiens
ggctggctgg

SEQ ID NO: 3482730 - DNA, 15 bp, Homo sapiens
ggctggctggcctca

SEQ ID NO: 3482731 - DNA, 19 bp, Homo sapiens
ggctgggacgtggctcagc

SEQ ID NO: 3482732 - DNA, 12 bp, Homo sapiens
ggctgggcttca

SEQ ID NO: 3482733 - DNA, 21 bp, Homo sapiens
ggctgggcttcagtggcagct

SEQ ID NO: 3482734 - DNA, 16 bp, Homo sapiens
ggctgggggaagaagc

SEQ ID NO: 3482735 - DNA, 19 bp, Homo sapiens
ggctgggggagagccgtgg

SEQ ID NO: 3482736 - DNA, 14 bp, Homo sapiens
ggctgggggcctca

SEQ ID NO: 3482737 - DNA, 16 bp, Homo sapiens
ggctgggggcctcagt

SEQ ID NO: 3482738 - DNA, 14 bp, Homo sapiens
ggctgggtggcccc

SEQ ID NO: 3482739 - DNA, 14 bp, Homo sapiens
ggctgggttggagg

SEQ ID NO: 3482740 - DNA, 14 bp, Homo sapiens
ggctggtggcaagt

SEQ ID NO: 3482741 - DNA, 22 bp, Homo sapiens
ggctggttcggatttggggtgg

SEQ ID NO: 3482742 - DNA, 16 bp, Homo sapiens
ggctgtaaaatgcatg

SEQ ID NO: 3482743 - DNA, 18 bp, Homo sapiens
ggctgtatcccatgagcc

SEQ ID NO: 3482744 - DNA, 19 bp, Homo sapiens
ggctgtatcccatgagcct

SEQ ID NO: 3482745 - DNA, 17 bp, Homo sapiens
ggctgtgactcttctct

SEQ ID NO: 3482746 - DNA, 17 bp, Homo sapiens
ggctgtgcttgaaggcc

SEQ ID NO: 3482747 - DNA, 20 bp, Homo sapiens
ggctgtgcttgaaggccctg

SEQ ID NO: 3482748 - DNA, 21 bp, Homo sapiens
ggctgtgcttgaaggccctgc

SEQ ID NO: 3482749 - DNA, 23 bp, Homo sapiens
ggctgtgcttgaaggccctgctg

SEQ ID NO: 3482750 - DNA, 21 bp, Homo sapiens
ggctgtggagacaatgtctgc

SEQ ID NO: 3482751 - DNA, 23 bp, Homo sapiens
ggctgtggagacaatgtctgcag

SEQ ID NO: 3482752 - DNA, 14 bp, Homo sapiens
ggctgttggctggg

SEQ ID NO: 3482753 - DNA, 20 bp, Homo sapiens
ggctgttggctgggggcctc

SEQ ID NO: 3482754 - DNA, 14 bp, Homo sapiens
ggcttaatcatttt

SEQ ID NO: 3482755 - DNA, 13 bp, Homo sapiens
ggcttacacccac

SEQ ID NO: 3482756 - DNA, 19 bp, Homo sapiens
ggcttcagtggcagctgct

SEQ ID NO: 3482757 - DNA, 12 bp, Homo sapiens
ggcttcatctct

SEQ ID NO: 3482758 - DNA, 13 bp, Homo sapiens
ggcttctgtgggg

SEQ ID NO: 3482759 - DNA, 23 bp, Homo sapiens
ggcttgccccactctgcctgcct

SEQ ID NO: 3482760 - DNA, 15 bp, Homo sapiens
ggcttgcctgcaggc

SEQ ID NO: 3482761 - DNA, 18 bp, Homo sapiens
ggcttgcttatgtgtagg

SEQ ID NO: 3482762 - DNA, 16 bp, Homo sapiens
ggcttggcctatctcc

SEQ ID NO: 3482763 - DNA, 22 bp, Homo sapiens
ggcttggggctcacacacctgt

SEQ ID NO: 3482764 - DNA, 14 bp, Homo sapiens
ggcttgttttccaa

SEQ ID NO: 3482765 - DNA, 21 bp, Homo sapiens
ggctttcgtccacagcttcct

SEQ ID NO: 3482766 - DNA, 13 bp, Homo sapiens
ggctttggcttct

SEQ ID NO: 3482767 - DNA, 18 bp, Homo sapiens
ggcttttactgaagcctt

SEQ ID NO: 3482768 - DNA, 14 bp, Homo sapiens
ggcttttctcagct

SEQ ID NO: 3482769 - DNA, 12 bp, Homo sapiens
gggaaaggggac

SEQ ID NO: 3482770 - DNA, 13 bp, Homo sapiens
gggaaaggggaca

SEQ ID NO: 3482771 - DNA, 14 bp, Homo sapiens
gggaacagactgga

SEQ ID NO: 3482772 - DNA, 22 bp, Homo sapiens
gggaacagactggaagcacagc

SEQ ID NO: 3482773 - DNA, 15 bp, Homo sapiens
gggaacatgaagcca

SEQ ID NO: 3482774 - DNA, 16 bp, Homo sapiens
gggaacctccccagcc

SEQ ID NO: 3482775 - DNA, 20 bp, Homo sapiens
gggaacctccccagcctgcg

SEQ ID NO: 3482776 - DNA, 15 bp, Homo sapiens
gggaacctgtgtccg

SEQ ID NO: 3482777 - DNA, 22 bp, Homo sapiens
gggaactcacctggggctgctg

SEQ ID NO: 3482778 - DNA, 23 bp, Homo sapiens
gggaactcacctggggctgctgg

SEQ ID NO: 3482779 - DNA, 18 bp, Homo sapiens
gggaagaagctctctcct

SEQ ID NO: 3482780 - DNA, 14 bp, Homo sapiens
gggaagagggggcg

SEQ ID NO: 3482781 - DNA, 12 bp, Homo sapiens
gggaagccttta

SEQ ID NO: 3482782 - DNA, 17 bp, Homo sapiens
gggaaggaggctggctt

SEQ ID NO: 3482783 - DNA, 14 bp, Homo sapiens
gggaaggggcggtg

SEQ ID NO: 3482784 - DNA, 23 bp, Homo sapiens
gggaatagtctagatggctcctc

SEQ ID NO: 3482785 - DNA, 12 bp, Homo sapiens
gggaatcacatc

SEQ ID NO: 3482786 - DNA, 15 bp, Homo sapiens
gggaatgatatgcat

SEQ ID NO: 3482787 - DNA, 11 bp, Homo sapiens
gggaatgtttg

SEQ ID NO: 3482788 - DNA, 18 bp, Homo sapiens
gggacaagtggactcagg

SEQ ID NO: 3482789 - DNA, 17 bp, Homo sapiens
gggacagaggccccagc

SEQ ID NO: 3482790 - DNA, 15 bp, Homo sapiens
gggacagctccttct

SEQ ID NO: 3482791 - DNA, 17 bp, Homo sapiens
gggacaggagaagagag

SEQ ID NO: 3482792 - DNA, 22 bp, Homo sapiens
gggacaggctcttctttcccaa

SEQ ID NO: 3482793 - DNA, 15 bp, Homo sapiens
gggacattgggaagg

SEQ ID NO: 3482794 - DNA, 18 bp, Homo sapiens
gggacccccgccccctgc

SEQ ID NO: 3482795 - DNA, 12 bp, Homo sapiens
gggacgcaggcc

SEQ ID NO: 3482796 - DNA, 22 bp, Homo sapiens
gggacgcctgggggtgccagga

SEQ ID NO: 3482797 - DNA, 19 bp, Homo sapiens
gggacgtggctcagccagc

SEQ ID NO: 3482798 - DNA, 16 bp, Homo sapiens
gggactcaatgcactg

SEQ ID NO: 3482799 - DNA, 19 bp, Homo sapiens
gggactcaatgcactgaca

SEQ ID NO: 3482800 - DNA, 20 bp, Homo sapiens
gggactgggagccgcagcag

SEQ ID NO: 3482801 - DNA, 17 bp, Homo sapiens
gggacttggaagctccg

SEQ ID NO: 3482802 - DNA, 13 bp, Homo sapiens
gggagaaaattca

SEQ ID NO: 3482803 - DNA, 12 bp, Homo sapiens
gggagacagcat

SEQ ID NO: 3482804 - DNA, 16 bp, Homo sapiens
gggagactgggctgag

SEQ ID NO: 3482805 - DNA, 19 bp, Homo sapiens
gggagactgggctgaggga

SEQ ID NO: 3482806 - DNA, 20 bp, Homo sapiens
gggagactgggctgagggag

SEQ ID NO: 3482807 - DNA, 11 bp, Homo sapiens
ggtttctcaga

SEQ ID NO: 3482808 - DNA, 21 bp, Homo sapiens
ggtttctcgcataggaccttt

SEQ ID NO: 3482809 - DNA, 15 bp, Homo sapiens
ggtttctggtctcta

SEQ ID NO: 3482810 - DNA, 15 bp, Homo sapiens
ggtttgaagcctgga

SEQ ID NO: 3482811 - DNA, 17 bp, Homo sapiens
ggtttgaagcctggaac

SEQ ID NO: 3482812 - DNA, 13 bp, Homo sapiens
ggtttgaagctgc

SEQ ID NO: 3482813 - DNA, 23 bp, Homo sapiens
ggtttgcgggggtctgagtctat

SEQ ID NO: 3482814 - DNA, 21 bp, Homo sapiens
ggtttggctgtgtctaaactg

SEQ ID NO: 3482815 - DNA, 17 bp, Homo sapiens
ggttttaggatacttaa

SEQ ID NO: 3482816 - DNA, 19 bp, Homo sapiens
ggttttgtattctctgagc

SEQ ID NO: 3482817 - DNA, 14 bp, Homo sapiens
ggttttgttcccct

SEQ ID NO: 3482818 - DNA, 19 bp, Homo sapiens
ggttttgttcccctcctcc

SEQ ID NO: 3482819 - DNA, 16 bp, Homo sapiens
ggtttttaaaacccag

SEQ ID NO: 3482820 - DNA, 18 bp, Homo sapiens
ggtttttaaattttgtaa

SEQ ID NO: 3482821 - DNA, 19 bp, Homo sapiens
ggtttttaaattttgtaat

SEQ ID NO: 3482822 - DNA, 18 bp, Homo sapiens
ggtttttagagaatgtgt

SEQ ID NO: 3482823 - DNA, 22 bp, Homo sapiens
ggtttttagagaatgtgtttca

SEQ ID NO: 3482824 - DNA, 15 bp, Homo sapiens
ggtttttcatctttt

SEQ ID NO: 3482825 - DNA, 16 bp, Homo sapiens
ggtttttcatctttta

SEQ ID NO: 3482826 - DNA, 20 bp, Homo sapiens
gtaaaaggccaaacctctgt

SEQ ID NO: 3482827 - DNA, 18 bp, Homo sapiens
gtaaaattgccatattgc

SEQ ID NO: 3482828 - DNA, 21 bp, Homo sapiens
gtaaaattgccatattgcaca

SEQ ID NO: 3482829 - DNA, 24 bp, Homo sapiens
gtaaactgtgcaccaagcaggaaa

SEQ ID NO: 3482830 - DNA, 14 bp, Homo sapiens
gtaaataatctgtg

SEQ ID NO: 3482831 - DNA, 20 bp, Homo sapiens
gtaaatatataaatatatat

SEQ ID NO: 3482832 - DNA, 15 bp, Homo sapiens
gtaaatatgaatctg

SEQ ID NO: 3482833 - DNA, 22 bp, Homo sapiens
gtaaatgttatcttatactgta

SEQ ID NO: 3482834 - DNA, 19 bp, Homo sapiens
gtaaattatatttgtgcta

SEQ ID NO: 3482835 - DNA, 20 bp, Homo sapiens
gtaaattatatttgtgctat

SEQ ID NO: 3482836 - DNA, 22 bp, Homo sapiens
gtaaattattaatttatgcaga

SEQ ID NO: 3482837 - DNA, 17 bp, Homo sapiens
gtaacactttacaatgt

SEQ ID NO: 3482838 - DNA, 12 bp, Homo sapiens
gtaacatgatgt

SEQ ID NO: 3482839 - DNA, 23 bp, Homo sapiens
gtaacatgtgttaagtattttca

SEQ ID NO: 3482840 - DNA, 21 bp, Homo sapiens
gtaaccaatcctactaataaa

SEQ ID NO: 3482841 - DNA, 23 bp, Homo sapiens
gtaaccaatcctactaataaacc

SEQ ID NO: 3482842 - DNA, 20 bp, Homo sapiens
gtaacctcttcagaggccct

SEQ ID NO: 3482843 - DNA, 19 bp, Homo sapiens
gtaactatttcttcagagt

SEQ ID NO: 3482844 - DNA, 20 bp, Homo sapiens
gtaactcatgatgagaaatg

SEQ ID NO: 3482845 - DNA, 18 bp, Homo sapiens
gtaactgcattgagaact

SEQ ID NO: 3482846 - DNA, 23 bp, Homo sapiens
gtaagaaaatattttgtctaaaa

SEQ ID NO: 3482847 - DNA, 20 bp, Homo sapiens
gtaagaaacacactgaggca

SEQ ID NO: 3482848 - DNA, 16 bp, Homo sapiens
gtaagaaatttctagt

SEQ ID NO: 3482849 - DNA, 17 bp, Homo sapiens
gtaagaattcagaagac

SEQ ID NO: 3482850 - DNA, 14 bp, Homo sapiens
gtaagacctctgag

SEQ ID NO: 3482851 - DNA, 13 bp, Homo sapiens
gtaagaggctgga

SEQ ID NO: 3482852 - DNA, 14 bp, Homo sapiens
gtaagatgtctgtt

SEQ ID NO: 3482853 - DNA, 15 bp, Homo sapiens
gtaagcatctacttc

SEQ ID NO: 3482854 - DNA, 20 bp, Homo sapiens
gtaataggcgtaactaattt

SEQ ID NO: 3482855 - DNA, 14 bp, Homo sapiens
gtaatcccagctac

SEQ ID NO: 3482856 - DNA, 16 bp, Homo sapiens
gtaatcccagctactt

SEQ ID NO: 3482857 - DNA, 23 bp, Homo sapiens
gtaatcctagcactttgggaggc

SEQ ID NO: 3482858 - DNA, 14 bp, Homo sapiens
gtaatggagcatca

SEQ ID NO: 3482859 - DNA, 15 bp, Homo sapiens
gtaattgtaattttg

SEQ ID NO: 3482860 - DNA, 18 bp, Homo sapiens
gtaattgtactaaagcca

SEQ ID NO: 3482861 - DNA, 14 bp, Homo sapiens
gtaattgttccttt

SEQ ID NO: 3482862 - DNA, 13 bp, Homo sapiens
gtaatttgtaaag

SEQ ID NO: 3482863 - DNA, 14 bp, Homo sapiens
gtaatttgtaaagt

SEQ ID NO: 3482864 - DNA, 18 bp, Homo sapiens
gtaattttatatgaagat

SEQ ID NO: 3482865 - DNA, 18 bp, Homo sapiens
gtacaaaaataaatttat

SEQ ID NO: 3482866 - DNA, 23 bp, Homo sapiens
gtacaaatataagaataaaatgt

SEQ ID NO: 3482867 - DNA, 21 bp, Homo sapiens
gtacacaactagttttgttta

SEQ ID NO: 3482868 - DNA, 21 bp, Homo sapiens
gtacacagagaaggctatgta

SEQ ID NO: 3482869 - DNA, 14 bp, Homo sapiens
gtacagcccagagg

SEQ ID NO: 3482870 - DNA, 19 bp, Homo sapiens
gtacataaataagaaaaac

SEQ ID NO: 3482871 - DNA, 18 bp, Homo sapiens
gtacatctattttggatt

SEQ ID NO: 3482872 - DNA, 19 bp, Homo sapiens
gtacatgaaatttttgtaa

SEQ ID NO: 3482873 - DNA, 11 bp, Homo sapiens
gtacatgagaa

SEQ ID NO: 3482874 - DNA, 16 bp, Homo sapiens
gtacatttttcaactt

SEQ ID NO: 3482875 - DNA, 19 bp, Homo sapiens
gtacatttttcaactttga

SEQ ID NO: 3482876 - DNA, 16 bp, Homo sapiens
gtaccagtgaattttt

SEQ ID NO: 3482877 - DNA, 19 bp, Homo sapiens
gtaccatttatacaaatta

SEQ ID NO: 3482878 - DNA, 15 bp, Homo sapiens
gtacccactgctctg

SEQ ID NO: 3482879 - DNA, 23 bp, Homo sapiens
gtacctatggctgcctgcatcta

SEQ ID NO: 3482880 - DNA, 15 bp, Homo sapiens
gtacctcagcattta

SEQ ID NO: 3482881 - DNA, 11 bp, Homo sapiens
gtaccttgctt

SEQ ID NO: 3482882 - DNA, 23 bp, Homo sapiens
gtaccttgcttcttactgataat

SEQ ID NO: 3482883 - DNA, 17 bp, Homo sapiens
gtacgtctgacaggcaa

SEQ ID NO: 3482884 - DNA, 12 bp, Homo sapiens
gtacgtgaccct

SEQ ID NO: 3482885 - DNA, 14 bp, Homo sapiens
gtactagtgttctg

SEQ ID NO: 3482886 - DNA, 22 bp, Homo sapiens
gtactctacaattcctctgata

SEQ ID NO: 3482887 - DNA, 16 bp, Homo sapiens
gtactggcatggtacg

SEQ ID NO: 3482888 - DNA, 19 bp, Homo sapiens
gtactggctgatggagtaa

SEQ ID NO: 3482889 - DNA, 16 bp, Homo sapiens
gtactgtaagaataat

SEQ ID NO: 3482890 - DNA, 17 bp, Homo sapiens
gtactgtgggcaattta

SEQ ID NO: 3482891 - DNA, 15 bp, Homo sapiens
gtactgtttaatgtt

SEQ ID NO: 3482892 - DNA, 22 bp, Homo sapiens
gtacttcccgggccagggctgc

SEQ ID NO: 3482893 - DNA, 18 bp, Homo sapiens
gtacttctccaccctgct

SEQ ID NO: 3482894 - DNA, 21 bp, Homo sapiens
gtacttctccaccctgctctc

SEQ ID NO: 3482895 - DNA, 19 bp, Homo sapiens
gtacttgtcatatgtagcc

SEQ ID NO: 3482896 - DNA, 21 bp, Homo sapiens
gtacttgtggacacagctctt

SEQ ID NO: 3482897 - DNA, 16 bp, Homo sapiens
gtacttttcattctct

SEQ ID NO: 3482898 - DNA, 17 bp, Homo sapiens
gtacttttcattctctt

SEQ ID NO: 3482899 - DNA, 20 bp, Homo sapiens
gtacttttcattctctttta

SEQ ID NO: 3482900 - DNA, 16 bp, Homo sapiens
gtagaaataatatgca

SEQ ID NO: 3482901 - DNA, 18 bp, Homo sapiens
gtagaaatggttgtatta

SEQ ID NO: 3482902 - DNA, 20 bp, Homo sapiens
gtagaaatggttgtattaga

SEQ ID NO: 3482903 - DNA, 19 bp, Homo sapiens
gtagaaggttgacacagtt

SEQ ID NO: 3482904 - DNA, 19 bp, Homo sapiens
gtagaataacctttcagaa

SEQ ID NO: 3482905 - DNA, 14 bp, Homo sapiens
gtagaattgcattg

SEQ ID NO: 3482906 - DNA, 15 bp, Homo sapiens
gtagaattgcattga

SEQ ID NO: 3482907 - DNA, 20 bp, Homo sapiens
gtagaccttgttacttctga

SEQ ID NO: 3482908 - DNA, 11 bp, Homo sapiens
gtagagccagg

SEQ ID NO: 3482909 - DNA, 14 bp, Homo sapiens
gtagaggctgggag

SEQ ID NO: 3482910 - DNA, 15 bp, Homo sapiens
gtagaggctgggagg

SEQ ID NO: 3482911 - DNA, 13 bp, Homo sapiens
gtagagtgggagc

SEQ ID NO: 3482912 - DNA, 17 bp, Homo sapiens
gtagatgggagggaggc

SEQ ID NO: 3482913 - DNA, 14 bp, Homo sapiens
gtagattaaaaatt

SEQ ID NO: 3482914 - DNA, 13 bp, Homo sapiens
gtagcaggccatg

SEQ ID NO: 3482915 - DNA, 19 bp, Homo sapiens
gtagcagggtcgggaaagg

SEQ ID NO: 3482916 - DNA, 15 bp, Homo sapiens
gtagccacaccagga

SEQ ID NO: 3482917 - DNA, 21 bp, Homo sapiens
gtagccagcacacagggcagt

SEQ ID NO: 3482918 - DNA, 20 bp, Homo sapiens
gtagcccactctgctcgcct

SEQ ID NO: 3482919 - DNA, 17 bp, Homo sapiens
gtagccccctggcctct

SEQ ID NO: 3482920 - DNA, 19 bp, Homo sapiens
gtagccccctggcctctgt

SEQ ID NO: 3482921 - DNA, 15 bp, Homo sapiens
gtagctagaggaacc

SEQ ID NO: 3482922 - DNA, 12 bp, Homo sapiens
gtagctgcccct

SEQ ID NO: 3482923 - DNA, 15 bp, Homo sapiens
gtagctgcccctggc

SEQ ID NO: 3482924 - DNA, 10 bp, Homo sapiens
gtagctgcta

SEQ ID NO: 3482925 - DNA, 17 bp, Homo sapiens
gtagctgctaccttctt

SEQ ID NO: 3482926 - DNA, 18 bp, Homo sapiens
gtagctgggactacaggc

SEQ ID NO: 3482927 - DNA, 14 bp, Homo sapiens
gtaggaaaaaaata

SEQ ID NO: 3482928 - DNA, 14 bp, Homo sapiens
gtaggaaagggcaa

SEQ ID NO: 3482929 - DNA, 22 bp, Homo sapiens
gtaggagctgccttggctcaga

SEQ ID NO: 3482930 - DNA, 15 bp, Homo sapiens
gtaggatctaaggct

SEQ ID NO: 3482931 - DNA, 12 bp, Homo sapiens
gtaggcagacac

SEQ ID NO: 3482932 - DNA, 22 bp, Homo sapiens
gtaggcagacacagggacttga

SEQ ID NO: 3482933 - DNA, 23 bp, Homo sapiens
gtaggcagacacagggacttgaa

SEQ ID NO: 3482934 - DNA, 23 bp, Homo sapiens
gtagggtttaatccccagtaaaa

SEQ ID NO: 3482935 - DNA, 20 bp, Homo sapiens
gtaggtactttttgtgaaga

SEQ ID NO: 3482936 - DNA, 21 bp, Homo sapiens
gtagtcagaattagctgcttc

SEQ ID NO: 3482937 - DNA, 22 bp, Homo sapiens
gtagtccgtgctgacagctgct

SEQ ID NO: 3482938 - DNA, 12 bp, Homo sapiens
gtagtcttgatg

SEQ ID NO: 3482939 - DNA, 22 bp, Homo sapiens
gtctcactgttgcccaggctgg

SEQ ID NO: 3482940 - DNA, 23 bp, Homo sapiens
gtctcactgttgcccaggctggc

SEQ ID NO: 3482941 - DNA, 20 bp, Homo sapiens
gtctcattccgttgtctgtg

SEQ ID NO: 3482942 - DNA, 17 bp, Homo sapiens
gtctccaaccccccagc

SEQ ID NO: 3482943 - DNA, 15 bp, Homo sapiens
gtctccaccaggaac

SEQ ID NO: 3482944 - DNA, 22 bp, Homo sapiens
gtctccagccccttctcagaat

SEQ ID NO: 3482945 - DNA, 15 bp, Homo sapiens
gtctccaggggctgc

SEQ ID NO: 3482946 - DNA, 16 bp, Homo sapiens
gtctccaggggctgct

SEQ ID NO: 3482947 - DNA, 19 bp, Homo sapiens
gtctccaggggctgcttcc

SEQ ID NO: 3482948 - DNA, 21 bp, Homo sapiens
gtctccaggggctgcttcctc

SEQ ID NO: 3482949 - DNA, 16 bp, Homo sapiens
gtctcctttaagagct

SEQ ID NO: 3482950 - DNA, 17 bp, Homo sapiens
gtctcgctttgttgccc

SEQ ID NO: 3482951 - DNA, 22 bp, Homo sapiens
gtctctacttttccctgtactt

SEQ ID NO: 3482952 - DNA, 21 bp, Homo sapiens
gtctctagaagtgccatctca

SEQ ID NO: 3482953 - DNA, 14 bp, Homo sapiens
gtctctaggctggg

SEQ ID NO: 3482954 - DNA, 17 bp, Homo sapiens
gtctctaggctggggaa

SEQ ID NO: 3482955 - DNA, 12 bp, Homo sapiens
gtctctctccat

SEQ ID NO: 3482956 - DNA, 12 bp, Homo sapiens
gtctctgcaaac

SEQ ID NO: 3482957 - DNA, 15 bp, Homo sapiens
gtctctgccttgcct

SEQ ID NO: 3482958 - DNA, 16 bp, Homo sapiens
gtctctgccttgcctt

SEQ ID NO: 3482959 - DNA, 15 bp, Homo sapiens
gtctctgtgagactc

SEQ ID NO: 3482960 - DNA, 16 bp, Homo sapiens
gtctcttgtattaaac

SEQ ID NO: 3482961 - DNA, 19 bp, Homo sapiens
gtctctttaatgtcacagg

SEQ ID NO: 3482962 - DNA, 16 bp, Homo sapiens
gtctgaactttgggaa

SEQ ID NO: 3482963 - DNA, 20 bp, Homo sapiens
gtctgacaggcaatgctggc

SEQ ID NO: 3482964 - DNA, 21 bp, Homo sapiens
gtctgacaggcaatgctggct

SEQ ID NO: 3482965 - DNA, 18 bp, Homo sapiens
gtctgaggaatccagacc

SEQ ID NO: 3482966 - DNA, 14 bp, Homo sapiens
gtctgagtctatgt

SEQ ID NO: 3482967 - DNA, 17 bp, Homo sapiens
gtctgattcccaagctc

SEQ ID NO: 3482968 - DNA, 19 bp, Homo sapiens
gtctgattcccaagctctg

SEQ ID NO: 3482969 - DNA, 20 bp, Homo sapiens
gtctgattcccaagctctgc

SEQ ID NO: 3482970 - DNA, 19 bp, Homo sapiens
gtctgcaggtgagcagaca

SEQ ID NO: 3482971 - DNA, 20 bp, Homo sapiens
gtctgcatttcggtggctag

SEQ ID NO: 3482972 - DNA, 12 bp, Homo sapiens
gtctgccagggc

SEQ ID NO: 3482973 - DNA, 17 bp, Homo sapiens
gtctgcctccagccaaa

SEQ ID NO: 3482974 - DNA, 11 bp, Homo sapiens
gtctgcctctt

SEQ ID NO: 3482975 - DNA, 16 bp, Homo sapiens
gtctggaatgcagtgg

SEQ ID NO: 3482976 - DNA, 18 bp, Homo sapiens
gtctggaatgcagtggta

SEQ ID NO: 3482977 - DNA, 12 bp, Homo sapiens
gtctggcagcct

SEQ ID NO: 3482978 - DNA, 20 bp, Homo sapiens
gtctggccctagactcgggg

SEQ ID NO: 3482979 - DNA, 20 bp, Homo sapiens
gtctgggaggaatggacaga

SEQ ID NO: 3482980 - DNA, 20 bp, Homo sapiens
gtctggtcagagccacaggg

SEQ ID NO: 3482981 - DNA, 14 bp, Homo sapiens
gtctggtctatgtt

SEQ ID NO: 3482982 - DNA, 15 bp, Homo sapiens
gtctgtaaaatcttt

SEQ ID NO: 3482983 - DNA, 20 bp, Homo sapiens
gtctgtgacctgcatctaag

SEQ ID NO: 3482984 - DNA, 14 bp, Homo sapiens
gtctgttggcaggc

SEQ ID NO: 3482985 - DNA, 19 bp, Homo sapiens
gtctgttggcaggctggcc

SEQ ID NO: 3482986 - DNA, 23 bp, Homo sapiens
gtctgtttctggaaatgttcttt

SEQ ID NO: 3482987 - DNA, 21 bp, Homo sapiens
gtctgtttgctgatggtctgg

SEQ ID NO: 3482988 - DNA, 13 bp, Homo sapiens
gtctgtttggact

SEQ ID NO: 3482989 - DNA, 21 bp, Homo sapiens
gtcttaaaaagtggaaaaata

SEQ ID NO: 3482990 - DNA, 18 bp, Homo sapiens
gtcttaatgaagtttgaa

SEQ ID NO: 3482991 - DNA, 19 bp, Homo sapiens
gtcttaatgaagtttgaat

SEQ ID NO: 3482992 - DNA, 22 bp, Homo sapiens
gtcttaatgaagtttgaatgtt

SEQ ID NO: 3482993 - DNA, 19 bp, Homo sapiens
gtcttatatattgtagata

SEQ ID NO: 3482994 - DNA, 21 bp, Homo sapiens
gtcttcaaggcttcagtctca

SEQ ID NO: 3482995 - DNA, 16 bp, Homo sapiens
gtcttcagtaagccgt

SEQ ID NO: 3482996 - DNA, 16 bp, Homo sapiens
gtcttccacaaagaaa

SEQ ID NO: 3482997 - DNA, 15 bp, Homo sapiens
gtcttccatttgcaa

SEQ ID NO: 3482998 - DNA, 10 bp, Homo sapiens
gtcttcctct

SEQ ID NO: 3482999 - DNA, 13 bp, Homo sapiens
gtcttcctctgca

SEQ ID NO: 3483000 - DNA, 14 bp, Homo sapiens
gtcttcctctgcaa

SEQ ID NO: 3483001 - DNA, 15 bp, Homo sapiens
gtcttcctctgcaag

SEQ ID NO: 3483002 - DNA, 18 bp, Homo sapiens
gtcttcctgaaatgcagt

SEQ ID NO: 3483003 - DNA, 17 bp, Homo sapiens
gtcttctccaccacgct

SEQ ID NO: 3483004 - DNA, 20 bp, Homo sapiens
gtcttctccaccacgctggg

SEQ ID NO: 3483005 - DNA, 16 bp, Homo sapiens
gtcttgaactcctggc

SEQ ID NO: 3483006 - DNA, 17 bp, Homo sapiens
gtcttgaactcctggcc

SEQ ID NO: 3483007 - DNA, 20 bp, Homo sapiens
gtcttgaactcctggcctca

SEQ ID NO: 3483008 - DNA, 21 bp, Homo sapiens
gtcttgaactcctggcctcaa

SEQ ID NO: 3483009 - DNA, 16 bp, Homo sapiens
gtcttgaagtcctggc

SEQ ID NO: 3483010 - DNA, 13 bp, Homo sapiens
gtcttgagaaaaa

SEQ ID NO: 3483011 - DNA, 18 bp, Homo sapiens
gtcttgatgaccaaagtc

SEQ ID NO: 3483012 - DNA, 19 bp, Homo sapiens
gtcttgcaatggcagcctt

SEQ ID NO: 3483013 - DNA, 14 bp, Homo sapiens
gtcttgccagccag

SEQ ID NO: 3483014 - DNA, 15 bp, Homo sapiens
gtcttgccagccaga

SEQ ID NO: 3483015 - DNA, 19 bp, Homo sapiens
gtcttgccagccagaagcc

SEQ ID NO: 3483016 - DNA, 21 bp, Homo sapiens
gtcttgctatattgcccaggc

SEQ ID NO: 3483017 - DNA, 15 bp, Homo sapiens
gtcttgctgttgaca

SEQ ID NO: 3483018 - DNA, 19 bp, Homo sapiens
gtcttgctgttgacatatt

SEQ ID NO: 3483019 - DNA, 22 bp, Homo sapiens
gtcttggcagcacctgtctcct

SEQ ID NO: 3483020 - DNA, 16 bp, Homo sapiens
gtcttgggcagagctg

SEQ ID NO: 3483021 - DNA, 19 bp, Homo sapiens
gtcttgggcagagctggct

SEQ ID NO: 3483022 - DNA, 23 bp, Homo sapiens
gtcttgtggatggaaatgtagtg

SEQ ID NO: 3483023 - DNA, 21 bp, Homo sapiens
gtcttgttctgtcactcaggc

SEQ ID NO: 3483024 - DNA, 23 bp, Homo sapiens
gtcttgttctgtcactcaggctg

SEQ ID NO: 3483025 - DNA, 20 bp, Homo sapiens
gtcttgttgcggatggatgg

SEQ ID NO: 3483026 - DNA, 14 bp, Homo sapiens
gtctttaactgtca

SEQ ID NO: 3483027 - DNA, 21 bp, Homo sapiens
gtctttaggtctttgtaagaa

SEQ ID NO: 3483028 - DNA, 16 bp, Homo sapiens
gtctttcacatttaaa

SEQ ID NO: 3483029 - DNA, 20 bp, Homo sapiens
gtctttcagatgatttgaaa

SEQ ID NO: 3483030 - DNA, 19 bp, Homo sapiens
gtctttcccatggggaggg

SEQ ID NO: 3483031 - DNA, 20 bp, Homo sapiens
gtctttcccatggggaggga

SEQ ID NO: 3483032 - DNA, 21 bp, Homo sapiens
gtctttcggaatttttaaaat

SEQ ID NO: 3483033 - DNA, 12 bp, Homo sapiens
gtcttttgcttt

SEQ ID NO: 3483034 - DNA, 15 bp, Homo sapiens
gtcttttgttcgcat

SEQ ID NO: 3483035 - DNA, 16 bp, Homo sapiens
gtctttttagatgccc

SEQ ID NO: 3483036 - DNA, 13 bp, Homo sapiens
gtctttttgtttg

SEQ ID NO: 3483037 - DNA, 14 bp, Homo sapiens
gtgaaaagctccat

SEQ ID NO: 3483038 - DNA, 19 bp, Homo sapiens
gtgaaaagtccttgattgt

SEQ ID NO: 3483039 - DNA, 21 bp, Homo sapiens
gtgaaccaccacacccagccc

SEQ ID NO: 3483040 - DNA, 13 bp, Homo sapiens
gtgaactgaaatt

SEQ ID NO: 3483041 - DNA, 23 bp, Homo sapiens
gtgaagagaaaaaggctgaaaag

SEQ ID NO: 3483042 - DNA, 15 bp, Homo sapiens
gtgaagctctcaccc

SEQ ID NO: 3483043 - DNA, 12 bp, Homo sapiens
gtgaaggctggc

SEQ ID NO: 3483044 - DNA, 13 bp, Homo sapiens
gtgaatgaacact

SEQ ID NO: 3483045 - DNA, 19 bp, Homo sapiens
gtgaatgccagtgtgctga

SEQ ID NO: 3483046 - DNA, 22 bp, Homo sapiens
gtgaattttcaaggccttcagt

SEQ ID NO: 3483047 - DNA, 14 bp, Homo sapiens
gtgaatttttctct

SEQ ID NO: 3483048 - DNA, 16 bp, Homo sapiens
gtgaatttttctctaa

SEQ ID NO: 3483049 - DNA, 14 bp, Homo sapiens
gtgaatttttgcaa

SEQ ID NO: 3483050 - DNA, 16 bp, Homo sapiens
gtgaatttttgcaata

SEQ ID NO: 3483051 - DNA, 23 bp, Homo sapiens
gtgaatttttgcaataatgcagt

SEQ ID NO: 3483052 - DNA, 16 bp, Homo sapiens
gtgacaattctgtttt

SEQ ID NO: 3483053 - DNA, 18 bp, Homo sapiens
gtgacacaaacacacaca

SEQ ID NO: 3483054 - DNA, 12 bp, Homo sapiens
gtgacagagacc

SEQ ID NO: 3483055 - DNA, 13 bp, Homo sapiens
gtgacagaggcag

SEQ ID NO: 3483056 - DNA, 23 bp, Homo sapiens
gtgacagggaaacctttttttga

SEQ ID NO: 3483057 - DNA, 21 bp, Homo sapiens
gtgacatttatttttctcatg

SEQ ID NO: 3483058 - DNA, 18 bp, Homo sapiens
gtgaccatgttttgttta

SEQ ID NO: 3483059 - DNA, 12 bp, Homo sapiens
gtgacctctgcc

SEQ ID NO: 3483060 - DNA, 16 bp, Homo sapiens
gtgacctgaggaagcg

SEQ ID NO: 3483061 - DNA, 13 bp, Homo sapiens
gtgacctgtttat

SEQ ID NO: 3483062 - DNA, 17 bp, Homo sapiens
gtgactaatggcatgag

SEQ ID NO: 3483063 - DNA, 14 bp, Homo sapiens
gtgactctccaggg

SEQ ID NO: 3483064 - DNA, 14 bp, Homo sapiens
gtgactctgaagct

SEQ ID NO: 3483065 - DNA, 16 bp, Homo sapiens
gtgactctgtccagct

SEQ ID NO: 3483066 - DNA, 20 bp, Homo sapiens
gtgagactcgagaactttca

SEQ ID NO: 3483067 - DNA, 21 bp, Homo sapiens
gtgagcaagaagtcaaagtaa

SEQ ID NO: 3483068 - DNA, 14 bp, Homo sapiens
gtgagccactgcac

SEQ ID NO: 3483069 - DNA, 12 bp, Homo sapiens
gtgagccccatc

SEQ ID NO: 3483070 - DNA, 19 bp, Homo sapiens
gtgagccgagatcacgcca

SEQ ID NO: 3483071 - DNA, 18 bp, Homo sapiens
gttgcactaactgctggt

SEQ ID NO: 3483072 - DNA, 14 bp, Homo sapiens
gttgcagacaggaa

SEQ ID NO: 3483073 - DNA, 20 bp, Homo sapiens
gttgcagacaggaatcttaa

SEQ ID NO: 3483074 - DNA, 17 bp, Homo sapiens
gttgcaggttcatggat

SEQ ID NO: 3483075 - DNA, 15 bp, Homo sapiens
gttgccaatatgcca

SEQ ID NO: 3483076 - DNA, 15 bp, Homo sapiens
gttgccacaggacac

SEQ ID NO: 3483077 - DNA, 16 bp, Homo sapiens
gttgccacaggacaca

SEQ ID NO: 3483078 - DNA, 17 bp, Homo sapiens
gttgccattattctatg

SEQ ID NO: 3483079 - DNA, 23 bp, Homo sapiens
gttgccattattctatgtagtgg

SEQ ID NO: 3483080 - DNA, 17 bp, Homo sapiens
gttgcccaggcaggtct

SEQ ID NO: 3483081 - DNA, 14 bp, Homo sapiens
gttgcccaggctgg

SEQ ID NO: 3483082 - DNA, 20 bp, Homo sapiens
gttgcggatggatggaaggt

SEQ ID NO: 3483083 - DNA, 17 bp, Homo sapiens
gttgctaagccccagca

SEQ ID NO: 3483084 - DNA, 22 bp, Homo sapiens
gttgctaagccccagcaagcaa

SEQ ID NO: 3483085 - DNA, 23 bp, Homo sapiens
gttgctctatgctttccaaacct

SEQ ID NO: 3483086 - DNA, 18 bp, Homo sapiens
gttgctggatcaggaagc

SEQ ID NO: 3483087 - DNA, 23 bp, Homo sapiens
gttgctgttattatatttgacat

SEQ ID NO: 3483088 - DNA, 19 bp, Homo sapiens
gttgctgttttcctccctt

SEQ ID NO: 3483089 - DNA, 14 bp, Homo sapiens
gttgctttcactct

SEQ ID NO: 3483090 - DNA, 14 bp, Homo sapiens
gttgctttgttgca

SEQ ID NO: 3483091 - DNA, 17 bp, Homo sapiens
gttggaggagagagcct

SEQ ID NO: 3483092 - DNA, 19 bp, Homo sapiens
gttggatccgtttgaccaa

SEQ ID NO: 3483093 - DNA, 20 bp, Homo sapiens
gttggatccgtttgaccaat

SEQ ID NO: 3483094 - DNA, 23 bp, Homo sapiens
gttggatggatgggtggatggcc

SEQ ID NO: 3483095 - DNA, 18 bp, Homo sapiens
gttggcaaaaaggcagga

SEQ ID NO: 3483096 - DNA, 20 bp, Homo sapiens
gttggcagaaatacagtctt

SEQ ID NO: 3483097 - DNA, 13 bp, Homo sapiens
gttggcaggctgg

SEQ ID NO: 3483098 - DNA, 15 bp, Homo sapiens
gttggcaggctggcc

SEQ ID NO: 3483099 - DNA, 17 bp, Homo sapiens
gttggcaggctggccag

SEQ ID NO: 3483100 - DNA, 13 bp, Homo sapiens
gttggccaggctg

SEQ ID NO: 3483101 - DNA, 13 bp, Homo sapiens
gttggcctgcact

SEQ ID NO: 3483102 - DNA, 12 bp, Homo sapiens
gttggctggcct

SEQ ID NO: 3483103 - DNA, 16 bp, Homo sapiens
gttggggtctggcagc

SEQ ID NO: 3483104 - DNA, 21 bp, Homo sapiens
gttggggtgggtataaaagat

SEQ ID NO: 3483105 - DNA, 23 bp, Homo sapiens
gttggggtgggtataaaagatgg

SEQ ID NO: 3483106 - DNA, 17 bp, Homo sapiens
gttggtagcaattggca

SEQ ID NO: 3483107 - DNA, 23 bp, Homo sapiens
gttggtctctgcatttttctgca

SEQ ID NO: 3483108 - DNA, 22 bp, Homo sapiens
gttggtgaattttcaaggcctt

SEQ ID NO: 3483109 - DNA, 18 bp, Homo sapiens
gttggttttgacttcaga

SEQ ID NO: 3483110 - DNA, 20 bp, Homo sapiens
gttgtaacaaatacagatga

SEQ ID NO: 3483111 - DNA, 16 bp, Homo sapiens
gttgtacatgaaattt

SEQ ID NO: 3483112 - DNA, 14 bp, Homo sapiens
gttgtattagatgt

SEQ ID NO: 3483113 - DNA, 21 bp, Homo sapiens
gttgtcactgcttttggcctg

SEQ ID NO: 3483114 - DNA, 17 bp, Homo sapiens
gttgtccttaaatttgt

SEQ ID NO: 3483115 - DNA, 12 bp, Homo sapiens
gttgtgtatggg

SEQ ID NO: 3483116 - DNA, 16 bp, Homo sapiens
gtttaaaaatacacat

SEQ ID NO: 3483117 - DNA, 23 bp, Homo sapiens
gtttaagaaaaaataacacacat

SEQ ID NO: 3483118 - DNA, 19 bp, Homo sapiens
gtttaatgcaagagaacat

SEQ ID NO: 3483119 - DNA, 15 bp, Homo sapiens
gtttaattctgtctt

SEQ ID NO: 3483120 - DNA, 18 bp, Homo sapiens
gtttacaagccccccctt

SEQ ID NO: 3483121 - DNA, 22 bp, Homo sapiens
gtttacaagcccccccttccac

SEQ ID NO: 3483122 - DNA, 18 bp, Homo sapiens
gtttacaatttacaaagt

SEQ ID NO: 3483123 - DNA, 19 bp, Homo sapiens
gtttacaatttacaaagtg

SEQ ID NO: 3483124 - DNA, 23 bp, Homo sapiens
gtttacaatttacaaagtgtgta

SEQ ID NO: 3483125 - DNA, 21 bp, Homo sapiens
gtttacatttgatgcatgtct

SEQ ID NO: 3483126 - DNA, 20 bp, Homo sapiens
gtttagaaaagtattcgtta

SEQ ID NO: 3483127 - DNA, 21 bp, Homo sapiens
gtttagccatcttacttggct

SEQ ID NO: 3483128 - DNA, 13 bp, Homo sapiens
gtttataaatctt

SEQ ID NO: 3483129 - DNA, 15 bp, Homo sapiens
gtttatcagcaaaaa

SEQ ID NO: 3483130 - DNA, 18 bp, Homo sapiens
gtttatgagatgctggtt

SEQ ID NO: 3483131 - DNA, 21 bp, Homo sapiens
gtttatttccactattttcaa

SEQ ID NO: 3483132 - DNA, 13 bp, Homo sapiens
gtttattttaaga

SEQ ID NO: 3483133 - DNA, 16 bp, Homo sapiens
gtttcaattgcatctc

SEQ ID NO: 3483134 - DNA, 22 bp, Homo sapiens
gtttcaattgcatctcccagat

SEQ ID NO: 3483135 - DNA, 15 bp, Homo sapiens
gtttcagagatggac

SEQ ID NO: 3483136 - DNA, 21 bp, Homo sapiens
gtttccaattatttgacttta

SEQ ID NO: 3483137 - DNA, 14 bp, Homo sapiens
gtttcctgcaggcc

SEQ ID NO: 3483138 - DNA, 17 bp, Homo sapiens
gtttcctggcactggac

SEQ ID NO: 3483139 - DNA, 15 bp, Homo sapiens
gtttcgtggggaggt

SEQ ID NO: 3483140 - DNA, 23 bp, Homo sapiens
gtttcgtggggaggtctaatcta

SEQ ID NO: 3483141 - DNA, 16 bp, Homo sapiens
gtttctcagaatccaa

SEQ ID NO: 3483142 - DNA, 18 bp, Homo sapiens
gtttctggaaatgttctt

SEQ ID NO: 3483143 - DNA, 16 bp, Homo sapiens
gtttctgtcctgctgg

SEQ ID NO: 3483144 - DNA, 21 bp, Homo sapiens
gtttcttattcccccctaagc

SEQ ID NO: 3483145 - DNA, 21 bp, Homo sapiens
gtttcttttgtatgtaaatgt

SEQ ID NO: 3483146 - DNA, 16 bp, Homo sapiens
gtttgaaattctgaat

SEQ ID NO: 3483147 - DNA, 17 bp, Homo sapiens
gtttgaaattctgaatt

SEQ ID NO: 3483148 - DNA, 21 bp, Homo sapiens
gtttgaaattctgaatttgca

SEQ ID NO: 3483149 - DNA, 23 bp, Homo sapiens
gtttgaaattctgaatttgcaaa

SEQ ID NO: 3483150 - DNA, 19 bp, Homo sapiens
gtttgaagctgctgtctct

SEQ ID NO: 3483151 - DNA, 16 bp, Homo sapiens
gtttgaatgttaaata

SEQ ID NO: 3483152 - DNA, 18 bp, Homo sapiens
gtttgactagatgatgga

SEQ ID NO: 3483153 - DNA, 20 bp, Homo sapiens
gtttgagaagaaaacatcta

SEQ ID NO: 3483154 - DNA, 13 bp, Homo sapiens
gtttgattgttta

SEQ ID NO: 3483155 - DNA, 13 bp, Homo sapiens
gtttgcctctgcc

SEQ ID NO: 3483156 - DNA, 16 bp, Homo sapiens
gtttgcctctgcctct

SEQ ID NO: 3483157 - DNA, 15 bp, Homo sapiens
gtttgccttccagaa

SEQ ID NO: 3483158 - DNA, 17 bp, Homo sapiens
gtttgctcacctggggt

SEQ ID NO: 3483159 - DNA, 12 bp, Homo sapiens
gtttgctgctat

SEQ ID NO: 3483160 - DNA, 17 bp, Homo sapiens
gtttggaagatcctgtg

SEQ ID NO: 3483161 - DNA, 14 bp, Homo sapiens
gtttggcaaggaaa

SEQ ID NO: 3483162 - DNA, 11 bp, Homo sapiens
gtttggcctcc

SEQ ID NO: 3483163 - DNA, 17 bp, Homo sapiens
gtttggctgtgtctaaa

SEQ ID NO: 3483164 - DNA, 23 bp, Homo sapiens
gtttggctgtgtctaaactgcat

SEQ ID NO: 3483165 - DNA, 18 bp, Homo sapiens
gtttggctttcagggagg

SEQ ID NO: 3483166 - DNA, 15 bp, Homo sapiens
gtttggttttacatt

SEQ ID NO: 3483167 - DNA, 21 bp, Homo sapiens
gtttggttttacattttagtt

SEQ ID NO: 3483168 - DNA, 14 bp, Homo sapiens
gtttgtaacttttt

SEQ ID NO: 3483169 - DNA, 15 bp, Homo sapiens
gtttgtctgtcttca

SEQ ID NO: 3483170 - DNA, 23 bp, Homo sapiens
gtttgtggggtgacgggactcag

SEQ ID NO: 3483171 - DNA, 20 bp, Homo sapiens
gtttgtgtgttgtctcttga

SEQ ID NO: 3483172 - DNA, 15 bp, Homo sapiens
gttttaaatgtacag

SEQ ID NO: 3483173 - DNA, 22 bp, Homo sapiens
gttttaaatgtacagacatatt

SEQ ID NO: 3483174 - DNA, 18 bp, Homo sapiens
gttttactgcagctttgt

SEQ ID NO: 3483175 - DNA, 16 bp, Homo sapiens
gttttataaaatcaag

SEQ ID NO: 3483176 - DNA, 19 bp, Homo sapiens
gttttatatttttatagac

SEQ ID NO: 3483177 - DNA, 21 bp, Homo sapiens
gttttatgagaaagccttctt

SEQ ID NO: 3483178 - DNA, 22 bp, Homo sapiens
gttttatgagatggatcacata

SEQ ID NO: 3483179 - DNA, 17 bp, Homo sapiens
gttttattcttggtttt

SEQ ID NO: 3483180 - DNA, 13 bp, Homo sapiens
gttttcaagtcaa

SEQ ID NO: 3483181 - DNA, 17 bp, Homo sapiens
gttttcaagtcaaatta

SEQ ID NO: 3483182 - DNA, 16 bp, Homo sapiens
gttttcatttggttca

SEQ ID NO: 3483183 - DNA, 15 bp, Homo sapiens
gttttcctcccttct

SEQ ID NO: 3483184 - DNA, 18 bp, Homo sapiens
gttttcttgttgctttgt

SEQ ID NO: 3483185 - DNA, 19 bp, Homo sapiens
gttttgaagctactgtgtg

SEQ ID NO: 3483186 - DNA, 16 bp, Homo sapiens
gttttggactccatct

SEQ ID NO: 3483187 - DNA, 19 bp, Homo sapiens
gttttggattctttaaata

SEQ ID NO: 3483188 - DNA, 22 bp, Homo sapiens
gttttggctgaaattctcctgg

SEQ ID NO: 3483189 - DNA, 17 bp, Homo sapiens
gttttgtaccagtgaat

SEQ ID NO: 3483190 - DNA, 12 bp, Homo sapiens
gttttgtagcag

SEQ ID NO: 3483191 - DNA, 12 bp, Homo sapiens
gttttgtattct

SEQ ID NO: 3483192 - DNA, 17 bp, Homo sapiens
gttttgtgtaacatatt

SEQ ID NO: 3483193 - DNA, 14 bp, Homo sapiens
gttttgttcccctc

SEQ ID NO: 3483194 - DNA, 17 bp, Homo sapiens
gttttgttcccctcctc

SEQ ID NO: 3483195 - DNA, 22 bp, Homo sapiens
gttttgttcccctcctccactc

SEQ ID NO: 3483196 - DNA, 20 bp, Homo sapiens
gttttgttttttgtttctaa

SEQ ID NO: 3483197 - DNA, 19 bp, Homo sapiens
gtttttaaattttgtaatg

SEQ ID NO: 3483198 - DNA, 20 bp, Homo sapiens
gtttttaaattttgtaatga

SEQ ID NO: 3483199 - DNA, 14 bp, Homo sapiens
gtttttaagctgtt

SEQ ID NO: 3483200 - DNA, 15 bp, Homo sapiens
gtttttaagctgttt

SEQ ID NO: 3483201 - DNA, 14 bp, Homo sapiens
gtttttattagtac

SEQ ID NO: 3483202 - DNA, 14 bp, Homo sapiens
gtttttcatctttt

SEQ ID NO: 3483203 - DNA, 17 bp, Homo sapiens
tacaactagatcaagga

SEQ ID NO: 3483204 - DNA, 17 bp, Homo sapiens
tacaactcattccagat

SEQ ID NO: 3483205 - DNA, 23 bp, Homo sapiens
tacaactgcctcgaaacacagaa

SEQ ID NO: 3483206 - DNA, 19 bp, Homo sapiens
tacaagcccccccttccac

SEQ ID NO: 3483207 - DNA, 20 bp, Homo sapiens
tacaagcgtgagccactgca

SEQ ID NO: 3483208 - DNA, 21 bp, Homo sapiens
tacaagcgtgagccactgcac

SEQ ID NO: 3483209 - DNA, 17 bp, Homo sapiens
tacaaggaaggtggtgg

SEQ ID NO: 3483210 - DNA, 21 bp, Homo sapiens
tacaataaaactttgctgcca

SEQ ID NO: 3483211 - DNA, 11 bp, Homo sapiens
tacaatcatgt

SEQ ID NO: 3483212 - DNA, 14 bp, Homo sapiens
tacaatcatgttct

SEQ ID NO: 3483213 - DNA, 16 bp, Homo sapiens
tacaatcatgttctgg

SEQ ID NO: 3483214 - DNA, 14 bp, Homo sapiens
tacaatgtgaactt

SEQ ID NO: 3483215 - DNA, 16 bp, Homo sapiens
tacaatgtgaacttta

SEQ ID NO: 3483216 - DNA, 22 bp, Homo sapiens
tacaatgtgaactttattaaat

SEQ ID NO: 3483217 - DNA, 16 bp, Homo sapiens
tacaatgttcatccca

SEQ ID NO: 3483218 - DNA, 12 bp, Homo sapiens
tacaatgtttta

SEQ ID NO: 3483219 - DNA, 22 bp, Homo sapiens
tacaattaaaaaaaaagatctg

SEQ ID NO: 3483220 - DNA, 19 bp, Homo sapiens
tacaattatatcagtcctc

SEQ ID NO: 3483221 - DNA, 22 bp, Homo sapiens
tacaattatttttacagttctc

SEQ ID NO: 3483222 - DNA, 18 bp, Homo sapiens
tacaattcctctgataat

SEQ ID NO: 3483223 - DNA, 13 bp, Homo sapiens
tacaattgaaatg

SEQ ID NO: 3483224 - DNA, 14 bp, Homo sapiens
tacaattgaaatga

SEQ ID NO: 3483225 - DNA, 15 bp, Homo sapiens
tacaatttacaaagt

SEQ ID NO: 3483226 - DNA, 22 bp, Homo sapiens
tacaatttacaaagtgtgtatt

SEQ ID NO: 3483227 - DNA, 18 bp, Homo sapiens
tacaattttatctgtttc

SEQ ID NO: 3483228 - DNA, 21 bp, Homo sapiens
tacacaatggtttttaaattt

SEQ ID NO: 3483229 - DNA, 21 bp, Homo sapiens
tacacacacacgcgtgcacac

SEQ ID NO: 3483230 - DNA, 23 bp, Homo sapiens
tacacacggctcccccaggcctg

SEQ ID NO: 3483231 - DNA, 20 bp, Homo sapiens
tacacactgtcatgcttcat

SEQ ID NO: 3483232 - DNA, 20 bp, Homo sapiens
tacacagaaatgctgctggc

SEQ ID NO: 3483233 - DNA, 21 bp, Homo sapiens
tacacagagaaggctatgtaa

SEQ ID NO: 3483234 - DNA, 18 bp, Homo sapiens
tacacagagcaggactgc

SEQ ID NO: 3483235 - DNA, 18 bp, Homo sapiens
tacacagtaagtcattta

SEQ ID NO: 3483236 - DNA, 19 bp, Homo sapiens
tacacagtaagtcatttaa

SEQ ID NO: 3483237 - DNA, 20 bp, Homo sapiens
tacaccaattaatgtagctg

SEQ ID NO: 3483238 - DNA, 20 bp, Homo sapiens
tacaccagcattccttttga

SEQ ID NO: 3483239 - DNA, 19 bp, Homo sapiens
tacaccttgcttttttact

SEQ ID NO: 3483240 - DNA, 22 bp, Homo sapiens
tacactttatggtaagtagcag

SEQ ID NO: 3483241 - DNA, 19 bp, Homo sapiens
tacagaactctttcaaaac

SEQ ID NO: 3483242 - DNA, 19 bp, Homo sapiens
tacagaatatgaatgagaa

SEQ ID NO: 3483243 - DNA, 15 bp, Homo sapiens
tacagacatatttaa

SEQ ID NO: 3483244 - DNA, 15 bp, Homo sapiens
tacagagcttccctg

SEQ ID NO: 3483245 - DNA, 16 bp, Homo sapiens
tacagagcttccctga

SEQ ID NO: 3483246 - DNA, 18 bp, Homo sapiens
tacagaggccatgggcct

SEQ ID NO: 3483247 - DNA, 13 bp, Homo sapiens
tacagatttaata

SEQ ID NO: 3483248 - DNA, 16 bp, Homo sapiens
tacagattttgatagc

SEQ ID NO: 3483249 - DNA, 13 bp, Homo sapiens
tacagcaacagga

SEQ ID NO: 3483250 - DNA, 21 bp, Homo sapiens
tacagcaacaggaatctcaga

SEQ ID NO: 3483251 - DNA, 23 bp, Homo sapiens
tacagctttctgaccttcagctc

SEQ ID NO: 3483252 - DNA, 17 bp, Homo sapiens
tacaggaaaaatgaaaa

SEQ ID NO: 3483253 - DNA, 15 bp, Homo sapiens
tacaggagtgagcac

SEQ ID NO: 3483254 - DNA, 16 bp, Homo sapiens
tacaggcacccaccat

SEQ ID NO: 3483255 - DNA, 15 bp, Homo sapiens
tacaggcagcacaga

SEQ ID NO: 3483256 - DNA, 20 bp, Homo sapiens
tacagggaatgcctgagtgc

SEQ ID NO: 3483257 - DNA, 21 bp, Homo sapiens
tacagtagattttccaaatgt

SEQ ID NO: 3483258 - DNA, 13 bp, Homo sapiens
tacagtaggagcc

SEQ ID NO: 3483259 - DNA, 16 bp, Homo sapiens
tacagtatgcttgctc

SEQ ID NO: 3483260 - DNA, 17 bp, Homo sapiens
tacagttgaaataactg

SEQ ID NO: 3483261 - DNA, 16 bp, Homo sapiens
tacataaacttttgca

SEQ ID NO: 3483262 - DNA, 19 bp, Homo sapiens
tacataatgggccactgaa

SEQ ID NO: 3483263 - DNA, 23 bp, Homo sapiens
tacataatgggccactgaaatct

SEQ ID NO: 3483264 - DNA, 16 bp, Homo sapiens
tacatatctttattaa

SEQ ID NO: 3483265 - DNA, 22 bp, Homo sapiens
tacatatctttattaatcacta

SEQ ID NO: 3483266 - DNA, 15 bp, Homo sapiens
tacatatgtaaaata

SEQ ID NO: 3483267 - DNA, 19 bp, Homo sapiens
tacatccaaagcagacagc

SEQ ID NO: 3483268 - DNA, 23 bp, Homo sapiens
tacatccaaagcagacagctcca

SEQ ID NO: 3483269 - DNA, 18 bp, Homo sapiens
tacatctggaatctgagg

SEQ ID NO: 3483270 - DNA, 14 bp, Homo sapiens
tacatctttcacat

SEQ ID NO: 3483271 - DNA, 15 bp, Homo sapiens
tacatctttcacatt

SEQ ID NO: 3483272 - DNA, 20 bp, Homo sapiens
tacatctttcacattggcta

SEQ ID NO: 3483273 - DNA, 18 bp, Homo sapiens
tacatgaaatttttgtaa

SEQ ID NO: 3483274 - DNA, 19 bp, Homo sapiens
tacatgaaatttttgtaaa

SEQ ID NO: 3483275 - DNA, 19 bp, Homo sapiens
tacatgtaaaacattatct

SEQ ID NO: 3483276 - DNA, 14 bp, Homo sapiens
tacatgtaatttga

SEQ ID NO: 3483277 - DNA, 21 bp, Homo sapiens
tacatgtataaagtgattgac

SEQ ID NO: 3483278 - DNA, 15 bp, Homo sapiens
tacattcatttagct

SEQ ID NO: 3483279 - DNA, 15 bp, Homo sapiens
tacattgttcaatta

SEQ ID NO: 3483280 - DNA, 13 bp, Homo sapiens
tacattgttgagc

SEQ ID NO: 3483281 - DNA, 19 bp, Homo sapiens
tacattgtttgtctgtctt

SEQ ID NO: 3483282 - DNA, 19 bp, Homo sapiens
tacatttgatgcatgtctt

SEQ ID NO: 3483283 - DNA, 20 bp, Homo sapiens
tacatttttcaactttgaat

SEQ ID NO: 3483284 - DNA, 15 bp, Homo sapiens
taccaaaaattttgt

SEQ ID NO: 3483285 - DNA, 13 bp, Homo sapiens
taccaatgaaaaa

SEQ ID NO: 3483286 - DNA, 10 bp, Homo sapiens
taccacctcc

SEQ ID NO: 3483287 - DNA, 13 bp, Homo sapiens
taccactcctgcc

SEQ ID NO: 3483288 - DNA, 12 bp, Homo sapiens
taccagatgcag

SEQ ID NO: 3483289 - DNA, 20 bp, Homo sapiens
taccagcgaggaggctccag

SEQ ID NO: 3483290 - DNA, 21 bp, Homo sapiens
taccagtgaatttttgcaata

SEQ ID NO: 3483291 - DNA, 20 bp, Homo sapiens
taccatctgtcttgccagcc

SEQ ID NO: 3483292 - DNA, 23 bp, Homo sapiens
taccatctgtcttgccagccaga

SEQ ID NO: 3483293 - DNA, 20 bp, Homo sapiens
taccatgtaaataatctgtg

SEQ ID NO: 3483294 - DNA, 23 bp, Homo sapiens
taccattttggggtacccactgc

SEQ ID NO: 3483295 - DNA, 17 bp, Homo sapiens
tacccaaaacaagcctg

SEQ ID NO: 3483296 - DNA, 20 bp, Homo sapiens
tacccaaacccatggctcta

SEQ ID NO: 3483297 - DNA, 22 bp, Homo sapiens
tacccaaaggatactgtaacac

SEQ ID NO: 3483298 - DNA, 13 bp, Homo sapiens
tacccactgccat

SEQ ID NO: 3483299 - DNA, 16 bp, Homo sapiens
tacccatacaccccct

SEQ ID NO: 3483300 - DNA, 17 bp, Homo sapiens
tacccatccccgcagtg

SEQ ID NO: 3483301 - DNA, 16 bp, Homo sapiens
taccccagttttttga

SEQ ID NO: 3483302 - DNA, 13 bp, Homo sapiens
taccccatccctg

SEQ ID NO: 3483303 - DNA, 17 bp, Homo sapiens
taccccgcagacacctt

SEQ ID NO: 3483304 - DNA, 19 bp, Homo sapiens
taccctctttgctgcagag

SEQ ID NO: 3483305 - DNA, 16 bp, Homo sapiens
taccctgagctgaggc

SEQ ID NO: 3483306 - DNA, 19 bp, Homo sapiens
taccctgaggtcactgcta

SEQ ID NO: 3483307 - DNA, 23 bp, Homo sapiens
taccctgcgcccagtccttccac

SEQ ID NO: 3483308 - DNA, 22 bp, Homo sapiens
taccctgtgttagtaaaggggc

SEQ ID NO: 3483309 - DNA, 14 bp, Homo sapiens
taccgacccagggt

SEQ ID NO: 3483310 - DNA, 13 bp, Homo sapiens
taccgagagccaa

SEQ ID NO: 3483311 - DNA, 15 bp, Homo sapiens
taccgcgttgtaaaa

SEQ ID NO: 3483312 - DNA, 19 bp, Homo sapiens
tacctaaaaggaaatctca

SEQ ID NO: 3483313 - DNA, 22 bp, Homo sapiens
tacctaaaaggaaatctcaccc

SEQ ID NO: 3483314 - DNA, 12 bp, Homo sapiens
tacctatatgca

SEQ ID NO: 3483315 - DNA, 17 bp, Homo sapiens
tacctcaacctatggta

SEQ ID NO: 3483316 - DNA, 14 bp, Homo sapiens
tacctcccacactc

SEQ ID NO: 3483317 - DNA, 20 bp, Homo sapiens
tacctcccacactcccaagg

SEQ ID NO: 3483318 - DNA, 11 bp, Homo sapiens
tacctccctcc

SEQ ID NO: 3483319 - DNA, 15 bp, Homo sapiens
tacctcccttgcctt

SEQ ID NO: 3483320 - DNA, 15 bp, Homo sapiens
tacctcctctcagtg

SEQ ID NO: 3483321 - DNA, 13 bp, Homo sapiens
tacctcctgagaa

SEQ ID NO: 3483322 - DNA, 14 bp, Homo sapiens
tacctcctgtctct

SEQ ID NO: 3483323 - DNA, 15 bp, Homo sapiens
tacctcctgtctctg

SEQ ID NO: 3483324 - DNA, 21 bp, Homo sapiens
tacctcctgtctttacaaata

SEQ ID NO: 3483325 - DNA, 18 bp, Homo sapiens
tacctcggtgccttcctc

SEQ ID NO: 3483326 - DNA, 15 bp, Homo sapiens
tacctctctgtccct

SEQ ID NO: 3483327 - DNA, 20 bp, Homo sapiens
tacctgaaaacactgtgcac

SEQ ID NO: 3483328 - DNA, 17 bp, Homo sapiens
tacctgacactcccttg

SEQ ID NO: 3483329 - DNA, 20 bp, Homo sapiens
tacctgacactcccttgggc

SEQ ID NO: 3483330 - DNA, 11 bp, Homo sapiens
tacctgctgct

SEQ ID NO: 3483331 - DNA, 19 bp, Homo sapiens
tacctgctgcttctccaaa

SEQ ID NO: 3483332 - DNA, 14 bp, Homo sapiens
tacctgttgagcat

SEQ ID NO: 3483333 - DNA, 22 bp, Homo sapiens
taccttctccctcatttcagga

SEQ ID NO: 3483334 - DNA, 22 bp, Homo sapiens
taccttgaaaataagaatagaa

SEQ ID NO: 3483335 - DNA, 21 bp, Homo sapiens
tatggacggtgctccaggcag

SEQ ID NO: 3483336 - DNA, 17 bp, Homo sapiens
tatggactatctgtctg

SEQ ID NO: 3483337 - DNA, 18 bp, Homo sapiens
tatggactatctgtctgg

SEQ ID NO: 3483338 - DNA, 21 bp, Homo sapiens
tatggactatctgtctggtgg

SEQ ID NO: 3483339 - DNA, 20 bp, Homo sapiens
tatggcagagttgtaaatat

SEQ ID NO: 3483340 - DNA, 18 bp, Homo sapiens
tatggcagtccagccagc

SEQ ID NO: 3483341 - DNA, 23 bp, Homo sapiens
tatggcctaaatttattaaataa

SEQ ID NO: 3483342 - DNA, 16 bp, Homo sapiens
tatgggactcaatgca

SEQ ID NO: 3483343 - DNA, 12 bp, Homo sapiens
tatgggctgggg

SEQ ID NO: 3483344 - DNA, 21 bp, Homo sapiens
tatgggctgggggctatgtat

SEQ ID NO: 3483345 - DNA, 15 bp, Homo sapiens
tatgggtagcactac

SEQ ID NO: 3483346 - DNA, 22 bp, Homo sapiens
tatgggtttagttactttagat

SEQ ID NO: 3483347 - DNA, 21 bp, Homo sapiens
tatggtacatttttcaacttt

SEQ ID NO: 3483348 - DNA, 16 bp, Homo sapiens
tatggtaccagatgca

SEQ ID NO: 3483349 - DNA, 14 bp, Homo sapiens
tatggtatttgagt

SEQ ID NO: 3483350 - DNA, 19 bp, Homo sapiens
tatgtaaaataaaattatg

SEQ ID NO: 3483351 - DNA, 13 bp, Homo sapiens
tatgtaaatgtgc

SEQ ID NO: 3483352 - DNA, 18 bp, Homo sapiens
tatgtaacatgatgttaa

SEQ ID NO: 3483353 - DNA, 24 bp, Homo sapiens
tatgtaactgcattgagaactgca

SEQ ID NO: 3483354 - DNA, 15 bp, Homo sapiens
tatgtacaaaacttt

SEQ ID NO: 3483355 - DNA, 15 bp, Homo sapiens
tatgtacatgagaag

SEQ ID NO: 3483356 - DNA, 15 bp, Homo sapiens
tatgtagcaaaatac

SEQ ID NO: 3483357 - DNA, 18 bp, Homo sapiens
tatgtaggaaaaaaatag

SEQ ID NO: 3483358 - DNA, 17 bp, Homo sapiens
tatgtagtaattgacat

SEQ ID NO: 3483359 - DNA, 20 bp, Homo sapiens
tatgtatatatatgtatgta

SEQ ID NO: 3483360 - DNA, 10 bp, Homo sapiens
tatgtatttt

SEQ ID NO: 3483361 - DNA, 22 bp, Homo sapiens
tatgtcgtagaattccttcgaa

SEQ ID NO: 3483362 - DNA, 23 bp, Homo sapiens
tatgtctagagcctcttggggaa

SEQ ID NO: 3483363 - DNA, 17 bp, Homo sapiens
tatgtgaaaggaacatt

SEQ ID NO: 3483364 - DNA, 20 bp, Homo sapiens
tatgtgaaaggaacattttt

SEQ ID NO: 3483365 - DNA, 18 bp, Homo sapiens
tatgtgtaggtgaacagt

SEQ ID NO: 3483366 - DNA, 21 bp, Homo sapiens
tatgttatagaacttcatgga

SEQ ID NO: 3483367 - DNA, 13 bp, Homo sapiens
tatgttctgtctt

SEQ ID NO: 3483368 - DNA, 16 bp, Homo sapiens
tatgttctgtcttccc

SEQ ID NO: 3483369 - DNA, 12 bp, Homo sapiens
tatgttgaatac

SEQ ID NO: 3483370 - DNA, 18 bp, Homo sapiens
tatgttgatccatccagc

SEQ ID NO: 3483371 - DNA, 19 bp, Homo sapiens
tatgttgcccaggcaggtc

SEQ ID NO: 3483372 - DNA, 21 bp, Homo sapiens
tatgttgctataataaagaag

SEQ ID NO: 3483373 - DNA, 15 bp, Homo sapiens
tatgttttttttctg

SEQ ID NO: 3483374 - DNA, 20 bp, Homo sapiens
tattaaaaaggtttacagaa

SEQ ID NO: 3483375 - DNA, 13 bp, Homo sapiens
tattaaaaatata

SEQ ID NO: 3483376 - DNA, 22 bp, Homo sapiens
tattaaaaatataaaactgcgt

SEQ ID NO: 3483377 - DNA, 15 bp, Homo sapiens
tattaaaatattttg

SEQ ID NO: 3483378 - DNA, 14 bp, Homo sapiens
tattaaaattctga

SEQ ID NO: 3483379 - DNA, 18 bp, Homo sapiens
tattaaatacaaaacttc

SEQ ID NO: 3483380 - DNA, 19 bp, Homo sapiens
tattaaattaaattttgtg

SEQ ID NO: 3483381 - DNA, 20 bp, Homo sapiens
tattaaggatgtagcttttc

SEQ ID NO: 3483382 - DNA, 14 bp, Homo sapiens
tattaattgctttg

SEQ ID NO: 3483383 - DNA, 16 bp, Homo sapiens
tattaccatgtaaata

SEQ ID NO: 3483384 - DNA, 19 bp, Homo sapiens
tattaccatgtaaataatc

SEQ ID NO: 3483385 - DNA, 23 bp, Homo sapiens
tattaccatgtaaataatctgtg

SEQ ID NO: 3483386 - DNA, 22 bp, Homo sapiens
tattaccccctccttcagacac

SEQ ID NO: 3483387 - DNA, 13 bp, Homo sapiens
tattacctctgat

SEQ ID NO: 3483388 - DNA, 19 bp, Homo sapiens
tattacctctgatacctca

SEQ ID NO: 3483389 - DNA, 12 bp, Homo sapiens
tattagagaaga

SEQ ID NO: 3483390 - DNA, 18 bp, Homo sapiens
tattagagtgtctttcca

SEQ ID NO: 3483391 - DNA, 12 bp, Homo sapiens
tattagatgttc

SEQ ID NO: 3483392 - DNA, 20 bp, Homo sapiens
tattagccagtaccagcttt

SEQ ID NO: 3483393 - DNA, 22 bp, Homo sapiens
tattagcccttctccatggccc

SEQ ID NO: 3483394 - DNA, 16 bp, Homo sapiens
tattagggagaaaatt

SEQ ID NO: 3483395 - DNA, 21 bp, Homo sapiens
tattagggagaaaattcaatt

SEQ ID NO: 3483396 - DNA, 17 bp, Homo sapiens
tattagttgccaatatg

SEQ ID NO: 3483397 - DNA, 18 bp, Homo sapiens
tattagttgccaatatgc

SEQ ID NO: 3483398 - DNA, 19 bp, Homo sapiens
tattagttgccaatatgcc

SEQ ID NO: 3483399 - DNA, 20 bp, Homo sapiens
tattataacaagtgtgtctt

SEQ ID NO: 3483400 - DNA, 12 bp, Homo sapiens
tattataattta

SEQ ID NO: 3483401 - DNA, 15 bp, Homo sapiens
tattataatttaatg

SEQ ID NO: 3483402 - DNA, 21 bp, Homo sapiens
tattatatttgacatgggtat

SEQ ID NO: 3483403 - DNA, 16 bp, Homo sapiens
tattatcatgcaaatg

SEQ ID NO: 3483404 - DNA, 14 bp, Homo sapiens
tattatccttctac

SEQ ID NO: 3483405 - DNA, 15 bp, Homo sapiens
tattatgagatgctg

SEQ ID NO: 3483406 - DNA, 13 bp, Homo sapiens
tattatgtataaa

SEQ ID NO: 3483407 - DNA, 15 bp, Homo sapiens
tattatgtataaaat

SEQ ID NO: 3483408 - DNA, 21 bp, Homo sapiens
tattatgtataaaatgtaaca

SEQ ID NO: 3483409 - DNA, 12 bp, Homo sapiens
tattattattta

SEQ ID NO: 3483410 - DNA, 14 bp, Homo sapiens
tattattctcattt

SEQ ID NO: 3483411 - DNA, 15 bp, Homo sapiens
tattattctcattta

SEQ ID NO: 3483412 - DNA, 16 bp, Homo sapiens
tattattttcacctgt

SEQ ID NO: 3483413 - DNA, 12 bp, Homo sapiens
tattattttcca

SEQ ID NO: 3483414 - DNA, 15 bp, Homo sapiens
tattcaataaagtat

SEQ ID NO: 3483415 - DNA, 16 bp, Homo sapiens
tattcaattcctctgg

SEQ ID NO: 3483416 - DNA, 18 bp, Homo sapiens
tattcagaatctttgtta

SEQ ID NO: 3483417 - DNA, 15 bp, Homo sapiens
tattcagacaaaatg

SEQ ID NO: 3483418 - DNA, 15 bp, Homo sapiens
tattcatatattgca

SEQ ID NO: 3483419 - DNA, 16 bp, Homo sapiens
tattcatatattgcat

SEQ ID NO: 3483420 - DNA, 20 bp, Homo sapiens
tattcatgaagcggtcacag

SEQ ID NO: 3483421 - DNA, 23 bp, Homo sapiens
tattcattatttgtcaaattgtc

SEQ ID NO: 3483422 - DNA, 21 bp, Homo sapiens
tattccaaaaaggttgctgtt

SEQ ID NO: 3483423 - DNA, 15 bp, Homo sapiens
tattccaaaataaaa

SEQ ID NO: 3483424 - DNA, 16 bp, Homo sapiens
tattcccccctaagct

SEQ ID NO: 3483425 - DNA, 11 bp, Homo sapiens
tattcctgcct

SEQ ID NO: 3483426 - DNA, 13 bp, Homo sapiens
tattcgttacatc

SEQ ID NO: 3483427 - DNA, 14 bp, Homo sapiens
tattctcatttagt

SEQ ID NO: 3483428 - DNA, 15 bp, Homo sapiens
tattctcatttagtg

SEQ ID NO: 3483429 - DNA, 18 bp, Homo sapiens
tattctctccaaaaatgc

SEQ ID NO: 3483430 - DNA, 12 bp, Homo sapiens
tattctctgagc

SEQ ID NO: 3483431 - DNA, 22 bp, Homo sapiens
tattctgctctattatataaac

SEQ ID NO: 3483432 - DNA, 14 bp, Homo sapiens
tattctttactatt

SEQ ID NO: 3483433 - DNA, 22 bp, Homo sapiens
tattctttcgaaagaagaaaat

SEQ ID NO: 3483434 - DNA, 20 bp, Homo sapiens
tattgaatataatatatttg

SEQ ID NO: 3483435 - DNA, 22 bp, Homo sapiens
tattgaatataatatatttgtg

SEQ ID NO: 3483436 - DNA, 20 bp, Homo sapiens
tattgaatcagtttccaatt

SEQ ID NO: 3483437 - DNA, 17 bp, Homo sapiens
tattgaatctatttaag

SEQ ID NO: 3483438 - DNA, 13 bp, Homo sapiens
tattgaatttttc

SEQ ID NO: 3483439 - DNA, 15 bp, Homo sapiens
tattgaatttttcct

SEQ ID NO: 3483440 - DNA, 18 bp, Homo sapiens
tattgaatttttcctatg

SEQ ID NO: 3483441 - DNA, 13 bp, Homo sapiens
tattgacaataaa

SEQ ID NO: 3483442 - DNA, 21 bp, Homo sapiens
tattgacaataaaatattatt

SEQ ID NO: 3483443 - DNA, 16 bp, Homo sapiens
tattgacacagaaaat

SEQ ID NO: 3483444 - DNA, 18 bp, Homo sapiens
tattgacacagaaaatgt

SEQ ID NO: 3483445 - DNA, 22 bp, Homo sapiens
tattgactctgggtccttcctg

SEQ ID NO: 3483446 - DNA, 15 bp, Homo sapiens
tattgagaaagagca

SEQ ID NO: 3483447 - DNA, 16 bp, Homo sapiens
tattgcacatgtctta

SEQ ID NO: 3483448 - DNA, 17 bp, Homo sapiens
tattgcacatgtcttaa

SEQ ID NO: 3483449 - DNA, 20 bp, Homo sapiens
tattgcacatgtcttaatga

SEQ ID NO: 3483450 - DNA, 22 bp, Homo sapiens
tattgcacatgtcttaatgaag

SEQ ID NO: 3483451 - DNA, 20 bp, Homo sapiens
tattgcagacctgtcaccct

SEQ ID NO: 3483452 - DNA, 17 bp, Homo sapiens
tattgcatctgtataag

SEQ ID NO: 3483453 - DNA, 13 bp, Homo sapiens
tattgcccacgct

SEQ ID NO: 3483454 - DNA, 15 bp, Homo sapiens
tattgcccacgctgg

SEQ ID NO: 3483455 - DNA, 20 bp, Homo sapiens
tattgcccaggctggtcttg

SEQ ID NO: 3483456 - DNA, 15 bp, Homo sapiens
tattgcctctacttt

SEQ ID NO: 3483457 - DNA, 19 bp, Homo sapiens
tattgccttctcaccagct

SEQ ID NO: 3483458 - DNA, 21 bp, Homo sapiens
tattgccttctcaccagctgc

SEQ ID NO: 3483459 - DNA, 22 bp, Homo sapiens
tattgccttctcaccagctgca

SEQ ID NO: 3483460 - DNA, 16 bp, Homo sapiens
tattgctgagagaaat

SEQ ID NO: 3483461 - DNA, 12 bp, Homo sapiens
tattgctggggt

SEQ ID NO: 3483462 - DNA, 22 bp, Homo sapiens
tattggcactgctaaaatagaa

SEQ ID NO: 3483463 - DNA, 19 bp, Homo sapiens
tattggcctcccaaaagac

SEQ ID NO: 3483464 - DNA, 21 bp, Homo sapiens
tattggcctcccaaaagactc

SEQ ID NO: 3483465 - DNA, 13 bp, Homo sapiens
tattggtggaatc

SEQ ID NO: 3483466 - DNA, 15 bp, Homo sapiens
tattgtaaaaaattc

SEQ ID NO: 3483467 - DNA, 19 bp, Homo sapiens
tcactcccacctgcatctg

SEQ ID NO: 3483468 - DNA, 20 bp, Homo sapiens
tcactctgagtgttttatga

SEQ ID NO: 3483469 - DNA, 21 bp, Homo sapiens
tcactgagttttccatggcag

SEQ ID NO: 3483470 - DNA, 15 bp, Homo sapiens
tcactgcagcctcaa

SEQ ID NO: 3483471 - DNA, 17 bp, Homo sapiens
tcactgctagagacgct

SEQ ID NO: 3483472 - DNA, 19 bp, Homo sapiens
tcactgcttttggcctgga

SEQ ID NO: 3483473 - DNA, 23 bp, Homo sapiens
tcactgcttttggcctggagttt

SEQ ID NO: 3483474 - DNA, 22 bp, Homo sapiens
tcactggcgacacgtagcagct

SEQ ID NO: 3483475 - DNA, 16 bp, Homo sapiens
tcactgtcctccaagc

SEQ ID NO: 3483476 - DNA, 16 bp, Homo sapiens
tcactgtctttcctag

SEQ ID NO: 3483477 - DNA, 17 bp, Homo sapiens
tcactgtctttcctaga

SEQ ID NO: 3483478 - DNA, 16 bp, Homo sapiens
tcactgtgagctccca

SEQ ID NO: 3483479 - DNA, 15 bp, Homo sapiens
tcactgtggctgtct

SEQ ID NO: 3483480 - DNA, 18 bp, Homo sapiens
tcactgtggctgtctgga

SEQ ID NO: 3483481 - DNA, 18 bp, Homo sapiens
tcactgtgggaaggccag

SEQ ID NO: 3483482 - DNA, 14 bp, Homo sapiens
tcactgtgttactg

SEQ ID NO: 3483483 - DNA, 18 bp, Homo sapiens
tcactgtgttactgcttt

SEQ ID NO: 3483484 - DNA, 19 bp, Homo sapiens
tcactgtgttactgctttg

SEQ ID NO: 3483485 - DNA, 16 bp, Homo sapiens
tcactgttgcccaggc

SEQ ID NO: 3483486 - DNA, 17 bp, Homo sapiens
tcactgttgcccaggct

SEQ ID NO: 3483487 - DNA, 13 bp, Homo sapiens
tcacttagccatg

SEQ ID NO: 3483488 - DNA, 22 bp, Homo sapiens
tcacttatgaatgatttgcata

SEQ ID NO: 3483489 - DNA, 14 bp, Homo sapiens
tcacttccttgccc

SEQ ID NO: 3483490 - DNA, 13 bp, Homo sapiens
tcactttcatttt

SEQ ID NO: 3483491 - DNA, 14 bp, Homo sapiens
tcactttcattttt

SEQ ID NO: 3483492 - DNA, 18 bp, Homo sapiens
tcacttttgacaaaggca

SEQ ID NO: 3483493 - DNA, 17 bp, Homo sapiens
tcagaaaaatggagcaa

SEQ ID NO: 3483494 - DNA, 22 bp, Homo sapiens
tcagaaacatcagttactctga

SEQ ID NO: 3483495 - DNA, 14 bp, Homo sapiens
tcagaaatttaatt

SEQ ID NO: 3483496 - DNA, 16 bp, Homo sapiens
tcagaacccttggctt

SEQ ID NO: 3483497 - DNA, 24 bp, Homo sapiens
tcagaacccttggcttgcccacgt

SEQ ID NO: 3483498 - DNA, 15 bp, Homo sapiens
tcagaactgtgccac

SEQ ID NO: 3483499 - DNA, 17 bp, Homo sapiens
tcagaacttgctgctgt

SEQ ID NO: 3483500 - DNA, 13 bp, Homo sapiens
tcagaagacactg

SEQ ID NO: 3483501 - DNA, 22 bp, Homo sapiens
tcagaatagccacatttggaat

SEQ ID NO: 3483502 - DNA, 23 bp, Homo sapiens
tcagaatagccacatttggaata

SEQ ID NO: 3483503 - DNA, 19 bp, Homo sapiens
tcagaatcacttctgagaa

SEQ ID NO: 3483504 - DNA, 12 bp, Homo sapiens
tcagaatccaaa

SEQ ID NO: 3483505 - DNA, 15 bp, Homo sapiens
tcagaatccaaagat

SEQ ID NO: 3483506 - DNA, 19 bp, Homo sapiens
tcagaatctacccaaagga

SEQ ID NO: 3483507 - DNA, 16 bp, Homo sapiens
tcagaatctttgttaa

SEQ ID NO: 3483508 - DNA, 17 bp, Homo sapiens
tcagacaccctcaacct

SEQ ID NO: 3483509 - DNA, 23 bp, Homo sapiens
tcagacaccctcaacctcttctg

SEQ ID NO: 3483510 - DNA, 13 bp, Homo sapiens
tcagaccagagaa

SEQ ID NO: 3483511 - DNA, 17 bp, Homo sapiens
tcagacgcctgaggaac

SEQ ID NO: 3483512 - DNA, 21 bp, Homo sapiens
tcagactttggaaaatgcatt

SEQ ID NO: 3483513 - DNA, 16 bp, Homo sapiens
tcagagaccaggccct

SEQ ID NO: 3483514 - DNA, 16 bp, Homo sapiens
tcagagatgcaccacc

SEQ ID NO: 3483515 - DNA, 21 bp, Homo sapiens
tcagagatgcaccaccaagcc

SEQ ID NO: 3483516 - DNA, 15 bp, Homo sapiens
tcagagatggacaga

SEQ ID NO: 3483517 - DNA, 18 bp, Homo sapiens
tcagagctaaactccttc

SEQ ID NO: 3483518 - DNA, 22 bp, Homo sapiens
tcagaggccctcgctgccagct

SEQ ID NO: 3483519 - DNA, 16 bp, Homo sapiens
tcagaggcgcactgtg

SEQ ID NO: 3483520 - DNA, 15 bp, Homo sapiens
tcagagtatggagct

SEQ ID NO: 3483521 - DNA, 23 bp, Homo sapiens
tcagagtgacacccaagagggct

SEQ ID NO: 3483522 - DNA, 22 bp, Homo sapiens
tcagataaggtaaaatgccatg

SEQ ID NO: 3483523 - DNA, 23 bp, Homo sapiens
tcagataattagatgattatata

SEQ ID NO: 3483524 - DNA, 21 bp, Homo sapiens
tcagatcatttcaaaactcat

SEQ ID NO: 3483525 - DNA, 20 bp, Homo sapiens
tcagatcttaatataaattc

SEQ ID NO: 3483526 - DNA, 20 bp, Homo sapiens
tcagatggaaccgcaggaag

SEQ ID NO: 3483527 - DNA, 22 bp, Homo sapiens
tcagatggaaccgcaggaagct

SEQ ID NO: 3483528 - DNA, 16 bp, Homo sapiens
tcagatgtaatgtttt

SEQ ID NO: 3483529 - DNA, 16 bp, Homo sapiens
tcagattgcatgtgac

SEQ ID NO: 3483530 - DNA, 22 bp, Homo sapiens
tcagattgcatgtgactctgaa

SEQ ID NO: 3483531 - DNA, 13 bp, Homo sapiens
tcagcaaaaagca

SEQ ID NO: 3483532 - DNA, 15 bp, Homo sapiens
tcagcaaaaagcaaa

SEQ ID NO: 3483533 - DNA, 13 bp, Homo sapiens
tcagcaccccagt

SEQ ID NO: 3483534 - DNA, 13 bp, Homo sapiens
tcagcagactgat

SEQ ID NO: 3483535 - DNA, 17 bp, Homo sapiens
tcagcatcctggcaccc

SEQ ID NO: 3483536 - DNA, 18 bp, Homo sapiens
tcagcatcctggcacccg

SEQ ID NO: 3483537 - DNA, 17 bp, Homo sapiens
tcagcatttgatctgtt

SEQ ID NO: 3483538 - DNA, 13 bp, Homo sapiens
tcagccaattatg

SEQ ID NO: 3483539 - DNA, 15 bp, Homo sapiens
tcagccaattatgtt

SEQ ID NO: 3483540 - DNA, 23 bp, Homo sapiens
tcagccagcacttgtccagctga

SEQ ID NO: 3483541 - DNA, 14 bp, Homo sapiens
tcagccatgtacag

SEQ ID NO: 3483542 - DNA, 16 bp, Homo sapiens
tcagcccaagatgctt

SEQ ID NO: 3483543 - DNA, 16 bp, Homo sapiens
tcagccccgacttcct

SEQ ID NO: 3483544 - DNA, 19 bp, Homo sapiens
tcagcctagtggcttgtcc

SEQ ID NO: 3483545 - DNA, 20 bp, Homo sapiens
tcagcctagtggcttgtcct

SEQ ID NO: 3483546 - DNA, 21 bp, Homo sapiens
tcagcctcccaaccccagggc

SEQ ID NO: 3483547 - DNA, 22 bp, Homo sapiens
tcagcctcccaaccccagggcc

SEQ ID NO: 3483548 - DNA, 22 bp, Homo sapiens
tcagcctcccgaatagctggga

SEQ ID NO: 3483549 - DNA, 16 bp, Homo sapiens
tcagcctgctccagct

SEQ ID NO: 3483550 - DNA, 15 bp, Homo sapiens
tcagcctggccagac

SEQ ID NO: 3483551 - DNA, 17 bp, Homo sapiens
tcagccttgaaaaacaa

SEQ ID NO: 3483552 - DNA, 18 bp, Homo sapiens
tcagccttgaaaaacaag

SEQ ID NO: 3483553 - DNA, 14 bp, Homo sapiens
tcagcggctccagc

SEQ ID NO: 3483554 - DNA, 17 bp, Homo sapiens
tcagcggggacagctcc

SEQ ID NO: 3483555 - DNA, 19 bp, Homo sapiens
tcagcggggacagctcctt

SEQ ID NO: 3483556 - DNA, 21 bp, Homo sapiens
tcagcggggacagctccttct

SEQ ID NO: 3483557 - DNA, 23 bp, Homo sapiens
tcagcggggacagctccttctgt

SEQ ID NO: 3483558 - DNA, 14 bp, Homo sapiens
tcagctagtggctc

SEQ ID NO: 3483559 - DNA, 19 bp, Homo sapiens
tcagctatttactgccaaa

SEQ ID NO: 3483560 - DNA, 14 bp, Homo sapiens
tcagctcactgttc

SEQ ID NO: 3483561 - DNA, 12 bp, Homo sapiens
tcagctccagct

SEQ ID NO: 3483562 - DNA, 15 bp, Homo sapiens
tcagctccagctcac

SEQ ID NO: 3483563 - DNA, 18 bp, Homo sapiens
tcagctccagctcaccag

SEQ ID NO: 3483564 - DNA, 21 bp, Homo sapiens
tcagctccagctcaccagccc

SEQ ID NO: 3483565 - DNA, 14 bp, Homo sapiens
tcagctccttcctg

SEQ ID NO: 3483566 - DNA, 14 bp, Homo sapiens
tcagctctctgccc

SEQ ID NO: 3483567 - DNA, 19 bp, Homo sapiens
tcagctctgggccattctc

SEQ ID NO: 3483568 - DNA, 13 bp, Homo sapiens
tcagcttatctct

SEQ ID NO: 3483569 - DNA, 19 bp, Homo sapiens
tcagcttatctcttttata

SEQ ID NO: 3483570 - DNA, 20 bp, Homo sapiens
tcagcttgtaaatagctcag

SEQ ID NO: 3483571 - DNA, 21 bp, Homo sapiens
tcagcttgtaaatagctcagg

SEQ ID NO: 3483572 - DNA, 22 bp, Homo sapiens
tcagcttgtaaatagctcaggt

SEQ ID NO: 3483573 - DNA, 19 bp, Homo sapiens
tcaggaacctcgagtactg

SEQ ID NO: 3483574 - DNA, 15 bp, Homo sapiens
tcaggacagatgcca

SEQ ID NO: 3483575 - DNA, 15 bp, Homo sapiens
tcaggacccagagga

SEQ ID NO: 3483576 - DNA, 19 bp, Homo sapiens
tcaggacccagaggaaggg

SEQ ID NO: 3483577 - DNA, 12 bp, Homo sapiens
tcaggagaaaaa

SEQ ID NO: 3483578 - DNA, 23 bp, Homo sapiens
tcaggaggaaggcttacacccac

SEQ ID NO: 3483579 - DNA, 12 bp, Homo sapiens
tcaggagttcct

SEQ ID NO: 3483580 - DNA, 19 bp, Homo sapiens
tcaggcaattctcctgcct

SEQ ID NO: 3483581 - DNA, 18 bp, Homo sapiens
tcaggcaccagtccctgt

SEQ ID NO: 3483582 - DNA, 17 bp, Homo sapiens
tcaggcaggtgggatgg

SEQ ID NO: 3483583 - DNA, 18 bp, Homo sapiens
tcaggcaggtgggatgga

SEQ ID NO: 3483584 - DNA, 21 bp, Homo sapiens
tcaggccatattatcaatgtt

SEQ ID NO: 3483585 - DNA, 21 bp, Homo sapiens
tcaggcgatccacctgtctca

SEQ ID NO: 3483586 - DNA, 22 bp, Homo sapiens
tcaggctactataggtccagaa

SEQ ID NO: 3483587 - DNA, 15 bp, Homo sapiens
tcaggctcgccaagg

SEQ ID NO: 3483588 - DNA, 19 bp, Homo sapiens
tcaggctcgccaaggccta

SEQ ID NO: 3483589 - DNA, 20 bp, Homo sapiens
tcaggctcgccaaggcctag

SEQ ID NO: 3483590 - DNA, 23 bp, Homo sapiens
tcagggaaaagcagctctcccct

SEQ ID NO: 3483591 - DNA, 12 bp, Homo sapiens
tcagggagacaa

SEQ ID NO: 3483592 - DNA, 15 bp, Homo sapiens
tcagggaggccctgt

SEQ ID NO: 3483593 - DNA, 13 bp, Homo sapiens
tcagggccatgct

SEQ ID NO: 3483594 - DNA, 14 bp, Homo sapiens
tcagggccatgctg

SEQ ID NO: 3483595 - DNA, 21 bp, Homo sapiens
tcagggccatgctgaggcctg

SEQ ID NO: 3483596 - DNA, 23 bp, Homo sapiens
tcagggccatgctgaggcctggg

SEQ ID NO: 3483597 - DNA, 15 bp, Homo sapiens
tcagggcctggttga

SEQ ID NO: 3483598 - DNA, 23 bp, Homo sapiens
tcagggctaaacgggcattgcct

SEQ ID NO: 3483599 - DNA, 14 bp, Homo sapiens
tcctaagcctaaaa

SEQ ID NO: 3483600 - DNA, 16 bp, Homo sapiens
tcctaagcctgtggct

SEQ ID NO: 3483601 - DNA, 14 bp, Homo sapiens
tcctacctattatc

SEQ ID NO: 3483602 - DNA, 22 bp, Homo sapiens
tcctacctattatccttctact

SEQ ID NO: 3483603 - DNA, 14 bp, Homo sapiens
tcctaccttgcttt

SEQ ID NO: 3483604 - DNA, 14 bp, Homo sapiens
tcctactaataaac

SEQ ID NO: 3483605 - DNA, 13 bp, Homo sapiens
tcctactctgtgt

SEQ ID NO: 3483606 - DNA, 18 bp, Homo sapiens
tcctacttataaagtaga

SEQ ID NO: 3483607 - DNA, 17 bp, Homo sapiens
tcctactttagccactg

SEQ ID NO: 3483608 - DNA, 16 bp, Homo sapiens
tcctagaaattcccca

SEQ ID NO: 3483609 - DNA, 22 bp, Homo sapiens
tcctagaaattccccaccctga

SEQ ID NO: 3483610 - DNA, 17 bp, Homo sapiens
tcctagagggaggggcc

SEQ ID NO: 3483611 - DNA, 20 bp, Homo sapiens
tcctagcactttgggaggcc

SEQ ID NO: 3483612 - DNA, 19 bp, Homo sapiens
tcctagggaagggtggtgg

SEQ ID NO: 3483613 - DNA, 22 bp, Homo sapiens
tcctagtgctttccttttttaa

SEQ ID NO: 3483614 - DNA, 18 bp, Homo sapiens
tcctagttctgtagaaat

SEQ ID NO: 3483615 - DNA, 21 bp, Homo sapiens
tcctataaggaagatttggaa

SEQ ID NO: 3483616 - DNA, 18 bp, Homo sapiens
tcctatatagtttattga

SEQ ID NO: 3483617 - DNA, 14 bp, Homo sapiens
tcctatatatttct

SEQ ID NO: 3483618 - DNA, 15 bp, Homo sapiens
tcctatatatttcta

SEQ ID NO: 3483619 - DNA, 19 bp, Homo sapiens
tcctatcacctatttccat

SEQ ID NO: 3483620 - DNA, 15 bp, Homo sapiens
tcctatgaatgcttt

SEQ ID NO: 3483621 - DNA, 17 bp, Homo sapiens
tcctatgaatgctttgc

SEQ ID NO: 3483622 - DNA, 18 bp, Homo sapiens
tcctatgaatgctttgca

SEQ ID NO: 3483623 - DNA, 13 bp, Homo sapiens
tcctatgctttga

SEQ ID NO: 3483624 - DNA, 21 bp, Homo sapiens
tcctattctttcgaaagaaga

SEQ ID NO: 3483625 - DNA, 15 bp, Homo sapiens
tcctcaaacactgca

SEQ ID NO: 3483626 - DNA, 23 bp, Homo sapiens
tcctcaagaaataaaaggaagcc

SEQ ID NO: 3483627 - DNA, 15 bp, Homo sapiens
tcctcacacttactg

SEQ ID NO: 3483628 - DNA, 15 bp, Homo sapiens
tcctcacacttttgg

SEQ ID NO: 3483629 - DNA, 20 bp, Homo sapiens
tcctcagccttgccagagat

SEQ ID NO: 3483630 - DNA, 15 bp, Homo sapiens
tcctcaggcacacag

SEQ ID NO: 3483631 - DNA, 22 bp, Homo sapiens
tcctcaggcacacagctactct

SEQ ID NO: 3483632 - DNA, 13 bp, Homo sapiens
tcctcaggtggcc

SEQ ID NO: 3483633 - DNA, 18 bp, Homo sapiens
tcctcagtatgtgggggc

SEQ ID NO: 3483634 - DNA, 22 bp, Homo sapiens
tcctcagtatgtgggggcttca

SEQ ID NO: 3483635 - DNA, 23 bp, Homo sapiens
tcctcatctctaacagctcagga

SEQ ID NO: 3483636 - DNA, 16 bp, Homo sapiens
tcctcatctctcttgg

SEQ ID NO: 3483637 - DNA, 17 bp, Homo sapiens
tcctcattaaattacct

SEQ ID NO: 3483638 - DNA, 16 bp, Homo sapiens
tcctcatttctccaga

SEQ ID NO: 3483639 - DNA, 19 bp, Homo sapiens
tcctccacgttctgctcat

SEQ ID NO: 3483640 - DNA, 23 bp, Homo sapiens
tcctccacgttctgctcatcatt

SEQ ID NO: 3483641 - DNA, 16 bp, Homo sapiens
tcctccactctccccc

SEQ ID NO: 3483642 - DNA, 23 bp, Homo sapiens
tcctccactctcccccaccccct

SEQ ID NO: 3483643 - DNA, 13 bp, Homo sapiens
tcctccaggagct

SEQ ID NO: 3483644 - DNA, 17 bp, Homo sapiens
tcctccaggagcttctt

SEQ ID NO: 3483645 - DNA, 19 bp, Homo sapiens
tcctccaggagcttcttgt

SEQ ID NO: 3483646 - DNA, 17 bp, Homo sapiens
tcctccagggtgatttt

SEQ ID NO: 3483647 - DNA, 12 bp, Homo sapiens
tcctccatggga

SEQ ID NO: 3483648 - DNA, 20 bp, Homo sapiens
tcctcccaatttcagactcc

SEQ ID NO: 3483649 - DNA, 20 bp, Homo sapiens
tcctcccacccggctgcaga

SEQ ID NO: 3483650 - DNA, 21 bp, Homo sapiens
tcctcccacccggctgcagag

SEQ ID NO: 3483651 - DNA, 13 bp, Homo sapiens
tcctcccacctca

SEQ ID NO: 3483652 - DNA, 20 bp, Homo sapiens
tcctcccacctcagcctccc

SEQ ID NO: 3483653 - DNA, 20 bp, Homo sapiens
tcctcccccctcctctgaaa

SEQ ID NO: 3483654 - DNA, 17 bp, Homo sapiens
tcctccctgacttttct

SEQ ID NO: 3483655 - DNA, 14 bp, Homo sapiens
tcctccctgcatct

SEQ ID NO: 3483656 - DNA, 13 bp, Homo sapiens
tcctcccttctgc

SEQ ID NO: 3483657 - DNA, 18 bp, Homo sapiens
tcctcccttctgctactg

SEQ ID NO: 3483658 - DNA, 14 bp, Homo sapiens
tcctccgaggccag

SEQ ID NO: 3483659 - DNA, 14 bp, Homo sapiens
tcctccgtggcaca

SEQ ID NO: 3483660 - DNA, 15 bp, Homo sapiens
tcctccgtggcacat

SEQ ID NO: 3483661 - DNA, 20 bp, Homo sapiens
tcctcctcccacccggctgc

SEQ ID NO: 3483662 - DNA, 13 bp, Homo sapiens
tcctcctccctgc

SEQ ID NO: 3483663 - DNA, 17 bp, Homo sapiens
tcctcctccctgcatct

SEQ ID NO: 3483664 - DNA, 18 bp, Homo sapiens
tcctcctccctgcatctg

SEQ ID NO: 3483665 - DNA, 20 bp, Homo sapiens
tcctcctgcagaccacgccc

SEQ ID NO: 3483666 - DNA, 11 bp, Homo sapiens
tcctcctggaa

SEQ ID NO: 3483667 - DNA, 14 bp, Homo sapiens
tcctcctgggccct

SEQ ID NO: 3483668 - DNA, 15 bp, Homo sapiens
tcctccttccatgga

SEQ ID NO: 3483669 - DNA, 13 bp, Homo sapiens
tcctcgcaagctg

SEQ ID NO: 3483670 - DNA, 15 bp, Homo sapiens
tcctcgcaagctggg

SEQ ID NO: 3483671 - DNA, 19 bp, Homo sapiens
tcctctactaacaatcagc

SEQ ID NO: 3483672 - DNA, 22 bp, Homo sapiens
tcctctagaaataggttaaact

SEQ ID NO: 3483673 - DNA, 14 bp, Homo sapiens
tcctctcagtgttt

SEQ ID NO: 3483674 - DNA, 14 bp, Homo sapiens
tcctctccatttta

SEQ ID NO: 3483675 - DNA, 20 bp, Homo sapiens
tcctctcccattgtccctct

SEQ ID NO: 3483676 - DNA, 22 bp, Homo sapiens
tcctctcccattgtccctctgc

SEQ ID NO: 3483677 - DNA, 23 bp, Homo sapiens
tcctctcccattgtccctctgcc

SEQ ID NO: 3483678 - DNA, 15 bp, Homo sapiens
tcctctccccagcaa

SEQ ID NO: 3483679 - DNA, 15 bp, Homo sapiens
tcctctccccagccc

SEQ ID NO: 3483680 - DNA, 18 bp, Homo sapiens
tcctctccccagcccaga

SEQ ID NO: 3483681 - DNA, 19 bp, Homo sapiens
tcctctccccagcccagag

SEQ ID NO: 3483682 - DNA, 14 bp, Homo sapiens
tcctctctatattt

SEQ ID NO: 3483683 - DNA, 20 bp, Homo sapiens
tcctctgaaacagctgcctt

SEQ ID NO: 3483684 - DNA, 17 bp, Homo sapiens
tcctctgactcagggct

SEQ ID NO: 3483685 - DNA, 23 bp, Homo sapiens
tcctctgactccactcaaagagg

SEQ ID NO: 3483686 - DNA, 15 bp, Homo sapiens
tcctctgcaagtgct

SEQ ID NO: 3483687 - DNA, 16 bp, Homo sapiens
tcctctgcaagtgctc

SEQ ID NO: 3483688 - DNA, 20 bp, Homo sapiens
tcctctgcaagtgctcaggg

SEQ ID NO: 3483689 - DNA, 21 bp, Homo sapiens
tcctctgcaagtgctcaggga

SEQ ID NO: 3483690 - DNA, 21 bp, Homo sapiens
tcctctgtcagtcacagccac

SEQ ID NO: 3483691 - DNA, 12 bp, Homo sapiens
tcctctgtgaag

SEQ ID NO: 3483692 - DNA, 14 bp, Homo sapiens
tcctcttccctctc

SEQ ID NO: 3483693 - DNA, 18 bp, Homo sapiens
tcctcttccctctctgca

SEQ ID NO: 3483694 - DNA, 18 bp, Homo sapiens
tcctcttgtaaataaagc

SEQ ID NO: 3483695 - DNA, 20 bp, Homo sapiens
tcctcttgtaaataaagccc

SEQ ID NO: 3483696 - DNA, 20 bp, Homo sapiens
tcctctttagagttagactg

SEQ ID NO: 3483697 - DNA, 21 bp, Homo sapiens
tcctctttagagttagactgt

SEQ ID NO: 3483698 - DNA, 20 bp, Homo sapiens
tcctctttgctttgctttct

SEQ ID NO: 3483699 - DNA, 17 bp, Homo sapiens
tcctgaaacaacttgga

SEQ ID NO: 3483700 - DNA, 14 bp, Homo sapiens
tcctgaaactatat

SEQ ID NO: 3483701 - DNA, 23 bp, Homo sapiens
tcctgaaactatattttgtcata

SEQ ID NO: 3483702 - DNA, 15 bp, Homo sapiens
tcctgaaagcggctg

SEQ ID NO: 3483703 - DNA, 18 bp, Homo sapiens
tcctgaaagcggctgcct

SEQ ID NO: 3483704 - DNA, 20 bp, Homo sapiens
tcctgaaagcggctgcctcc

SEQ ID NO: 3483705 - DNA, 14 bp, Homo sapiens
tcctgaagaaccag

SEQ ID NO: 3483706 - DNA, 16 bp, Homo sapiens
tcctgaagaaccagtc

SEQ ID NO: 3483707 - DNA, 16 bp, Homo sapiens
tcctgacccattgctg

SEQ ID NO: 3483708 - DNA, 20 bp, Homo sapiens
tcctgactctcacctgtact

SEQ ID NO: 3483709 - DNA, 13 bp, Homo sapiens
tcctgagaagcat

SEQ ID NO: 3483710 - DNA, 17 bp, Homo sapiens
tcctgagcataactcca

SEQ ID NO: 3483711 - DNA, 17 bp, Homo sapiens
tcctgaggctttggatt

SEQ ID NO: 3483712 - DNA, 21 bp, Homo sapiens
tcctgatggcaggatggcctg

SEQ ID NO: 3483713 - DNA, 20 bp, Homo sapiens
tcctgcaggccaggccagct

SEQ ID NO: 3483714 - DNA, 13 bp, Homo sapiens
tcctgccaggcat

SEQ ID NO: 3483715 - DNA, 13 bp, Homo sapiens
tcctgccgcagag

SEQ ID NO: 3483716 - DNA, 23 bp, Homo sapiens
tcctgccggagaggaagagacac

SEQ ID NO: 3483717 - DNA, 13 bp, Homo sapiens
tcctgcctcagcc

SEQ ID NO: 3483718 - DNA, 17 bp, Homo sapiens
tcctgcctcagcctccc

SEQ ID NO: 3483719 - DNA, 21 bp, Homo sapiens
tcctgcctcgaactggctgca

SEQ ID NO: 3483720 - DNA, 13 bp, Homo sapiens
tcctgcctgtggc

SEQ ID NO: 3483721 - DNA, 19 bp, Homo sapiens
tcctgccttcctcctgggc

SEQ ID NO: 3483722 - DNA, 23 bp, Homo sapiens
tcctgccttcctcctgggccctc

SEQ ID NO: 3483723 - DNA, 21 bp, Homo sapiens
tcctgcggcaggactgcagag

SEQ ID NO: 3483724 - DNA, 22 bp, Homo sapiens
tcctgcggcaggactgcagagc

SEQ ID NO: 3483725 - DNA, 23 bp, Homo sapiens
tcctgcttgatgggattctggac

SEQ ID NO: 3483726 - DNA, 22 bp, Homo sapiens
tcctggaaattgacgaggggtg

SEQ ID NO: 3483727 - DNA, 16 bp, Homo sapiens
tcctggagctctgtgg

SEQ ID NO: 3483728 - DNA, 13 bp, Homo sapiens
tcctggaggccca

SEQ ID NO: 3483729 - DNA, 14 bp, Homo sapiens
tcctggaggcccag

SEQ ID NO: 3483730 - DNA, 18 bp, Homo sapiens
tcctggatgggcctttga

SEQ ID NO: 3483731 - DNA, 15 bp, Homo sapiens
tcgggcaccagccag

SEQ ID NO: 3483732 - DNA, 19 bp, Homo sapiens
tcgggctggagcctccgac

SEQ ID NO: 3483733 - DNA, 16 bp, Homo sapiens
tcggggtagaggctgg

SEQ ID NO: 3483734 - DNA, 21 bp, Homo sapiens
tcggtacccggggcccagggc

SEQ ID NO: 3483735 - DNA, 22 bp, Homo sapiens
tcggtggagactatcagcccaa

SEQ ID NO: 3483736 - DNA, 14 bp, Homo sapiens
tcgtctactgcaag

SEQ ID NO: 3483737 - DNA, 21 bp, Homo sapiens
tcgtctccagccccttctcag

SEQ ID NO: 3483738 - DNA, 15 bp, Homo sapiens
tcgtcttgttgttat

SEQ ID NO: 3483739 - DNA, 13 bp, Homo sapiens
tcgtgatggggca

SEQ ID NO: 3483740 - DNA, 12 bp, Homo sapiens
tcgtgcctgtgt

SEQ ID NO: 3483741 - DNA, 15 bp, Homo sapiens
tcgtggggtgtgctg

SEQ ID NO: 3483742 - DNA, 17 bp, Homo sapiens
tcgttaaaaagttgttt

SEQ ID NO: 3483743 - DNA, 14 bp, Homo sapiens
tcgttctttttaag

SEQ ID NO: 3483744 - DNA, 15 bp, Homo sapiens
tcgtttactatgcct

SEQ ID NO: 3483745 - DNA, 18 bp, Homo sapiens
tcgtttttatattaatgt

SEQ ID NO: 3483746 - DNA, 11 bp, Homo sapiens
tctaaaagaaa

SEQ ID NO: 3483747 - DNA, 21 bp, Homo sapiens
tctaaaatgcctcagtgtatt

SEQ ID NO: 3483748 - DNA, 22 bp, Homo sapiens
tctaaaatgcctcagtgtattt

SEQ ID NO: 3483749 - DNA, 20 bp, Homo sapiens
tctaaaccccagattcttca

SEQ ID NO: 3483750 - DNA, 20 bp, Homo sapiens
tctaaagagtttattttaag

SEQ ID NO: 3483751 - DNA, 24 bp, Homo sapiens
tctaaagatagagtcattgctgta

SEQ ID NO: 3483752 - DNA, 14 bp, Homo sapiens
tctaaagttatatt

SEQ ID NO: 3483753 - DNA, 17 bp, Homo sapiens
tctaaagttatatttca

SEQ ID NO: 3483754 - DNA, 11 bp, Homo sapiens
tctaaagttgt

SEQ ID NO: 3483755 - DNA, 12 bp, Homo sapiens
tctaaagttgta

SEQ ID NO: 3483756 - DNA, 17 bp, Homo sapiens
tctaaatattcagaatc

SEQ ID NO: 3483757 - DNA, 20 bp, Homo sapiens
tctaacctcatcttcttcac

SEQ ID NO: 3483758 - DNA, 15 bp, Homo sapiens
tctaactcagaaaca

SEQ ID NO: 3483759 - DNA, 20 bp, Homo sapiens
tctaaggaaatggagaagct

SEQ ID NO: 3483760 - DNA, 23 bp, Homo sapiens
tctaaggaaatggagaagctctg

SEQ ID NO: 3483761 - DNA, 16 bp, Homo sapiens
tctaaggctgtttgct

SEQ ID NO: 3483762 - DNA, 20 bp, Homo sapiens
tctaagtacctttcctacat

SEQ ID NO: 3483763 - DNA, 13 bp, Homo sapiens
tctaagtctttcc

SEQ ID NO: 3483764 - DNA, 14 bp, Homo sapiens
tctaagtctttcca

SEQ ID NO: 3483765 - DNA, 19 bp, Homo sapiens
tctaagttcacagtgtttc

SEQ ID NO: 3483766 - DNA, 11 bp, Homo sapiens
tctaataaact

SEQ ID NO: 3483767 - DNA, 19 bp, Homo sapiens
tctaatagaactcagtttt

SEQ ID NO: 3483768 - DNA, 20 bp, Homo sapiens
tctaatgggtatttaaacaa

SEQ ID NO: 3483769 - DNA, 16 bp, Homo sapiens
tctaatttttaagcaa

SEQ ID NO: 3483770 - DNA, 20 bp, Homo sapiens
tctacaatgtgaactttatt

SEQ ID NO: 3483771 - DNA, 14 bp, Homo sapiens
tctacacagagcag

SEQ ID NO: 3483772 - DNA, 19 bp, Homo sapiens
tctacagccttgtccccct

SEQ ID NO: 3483773 - DNA, 21 bp, Homo sapiens
tctacccaaaggatactgtaa

SEQ ID NO: 3483774 - DNA, 19 bp, Homo sapiens
tctacccagcgagccctgg

SEQ ID NO: 3483775 - DNA, 14 bp, Homo sapiens
tctacccatctccc

SEQ ID NO: 3483776 - DNA, 19 bp, Homo sapiens
tctacccatctcccccatc

SEQ ID NO: 3483777 - DNA, 21 bp, Homo sapiens
tctaccctcttagaaaaacca

SEQ ID NO: 3483778 - DNA, 14 bp, Homo sapiens
tctacctatatgca

SEQ ID NO: 3483779 - DNA, 21 bp, Homo sapiens
tctactaagtgatgctgtgat

SEQ ID NO: 3483780 - DNA, 22 bp, Homo sapiens
tctactaagtgatgctgtgata

SEQ ID NO: 3483781 - DNA, 18 bp, Homo sapiens
tctactctagggaaaaac

SEQ ID NO: 3483782 - DNA, 12 bp, Homo sapiens
tctactgttgca

SEQ ID NO: 3483783 - DNA, 22 bp, Homo sapiens
tctacttgccagaaccaaatta

SEQ ID NO: 3483784 - DNA, 17 bp, Homo sapiens
tctactttgattctgat

SEQ ID NO: 3483785 - DNA, 21 bp, Homo sapiens
tctactttttgaacttttcat

SEQ ID NO: 3483786 - DNA, 15 bp, Homo sapiens
tctagagcactgcca

SEQ ID NO: 3483787 - DNA, 12 bp, Homo sapiens
tctagagccttc

SEQ ID NO: 3483788 - DNA, 17 bp, Homo sapiens
tctagagcttagcatat

SEQ ID NO: 3483789 - DNA, 17 bp, Homo sapiens
tctagatacctaaaaca

SEQ ID NO: 3483790 - DNA, 18 bp, Homo sapiens
tctagatacctaaaacat

SEQ ID NO: 3483791 - DNA, 23 bp, Homo sapiens
tctagatgaagttttacattgtt

SEQ ID NO: 3483792 - DNA, 16 bp, Homo sapiens
tctagcaaatgttatg

SEQ ID NO: 3483793 - DNA, 16 bp, Homo sapiens
tctagccaaatggttt

SEQ ID NO: 3483794 - DNA, 15 bp, Homo sapiens
tctaggaagacattt

SEQ ID NO: 3483795 - DNA, 12 bp, Homo sapiens
tctagggaaaaa

SEQ ID NO: 3483796 - DNA, 13 bp, Homo sapiens
tctagggaaatga

SEQ ID NO: 3483797 - DNA, 18 bp, Homo sapiens
tctaggtggcaaggctgt

SEQ ID NO: 3483798 - DNA, 18 bp, Homo sapiens
tctagtagctgaaatgca

SEQ ID NO: 3483799 - DNA, 14 bp, Homo sapiens
tctagtgccttcta

SEQ ID NO: 3483800 - DNA, 15 bp, Homo sapiens
tctataaaaaatatg

SEQ ID NO: 3483801 - DNA, 14 bp, Homo sapiens
tctatcagagaaaa

SEQ ID NO: 3483802 - DNA, 13 bp, Homo sapiens
tctatcatttaat

SEQ ID NO: 3483803 - DNA, 17 bp, Homo sapiens
tctatcatttaataata

SEQ ID NO: 3483804 - DNA, 18 bp, Homo sapiens
tctatcatttaataatat

SEQ ID NO: 3483805 - DNA, 15 bp, Homo sapiens
tctatccttccagaa

SEQ ID NO: 3483806 - DNA, 17 bp, Homo sapiens
tctatgctttccaaacc

SEQ ID NO: 3483807 - DNA, 21 bp, Homo sapiens
tctatggcagtccagccagct

SEQ ID NO: 3483808 - DNA, 23 bp, Homo sapiens
tctatggcagtccagccagctcc

SEQ ID NO: 3483809 - DNA, 13 bp, Homo sapiens
tctatgggactca

SEQ ID NO: 3483810 - DNA, 19 bp, Homo sapiens
tctatgggactcaatgcac

SEQ ID NO: 3483811 - DNA, 15 bp, Homo sapiens
tctatgtaggaaaaa

SEQ ID NO: 3483812 - DNA, 21 bp, Homo sapiens
tctatgttcaaagactgtgaa

SEQ ID NO: 3483813 - DNA, 13 bp, Homo sapiens
tctattccattcc

SEQ ID NO: 3483814 - DNA, 14 bp, Homo sapiens
tctatttctcctcc

SEQ ID NO: 3483815 - DNA, 20 bp, Homo sapiens
tctatttctcctccatggga

SEQ ID NO: 3483816 - DNA, 19 bp, Homo sapiens
tctatttcttcttcacatc

SEQ ID NO: 3483817 - DNA, 19 bp, Homo sapiens
tctcaaaagaacttacccc

SEQ ID NO: 3483818 - DNA, 16 bp, Homo sapiens
tctcaaacctccaaat

SEQ ID NO: 3483819 - DNA, 21 bp, Homo sapiens
tctcaaactcttgacctcagg

SEQ ID NO: 3483820 - DNA, 22 bp, Homo sapiens
tctcaaactcttgacctcaggt

SEQ ID NO: 3483821 - DNA, 13 bp, Homo sapiens
tctcaaagctggg

SEQ ID NO: 3483822 - DNA, 23 bp, Homo sapiens
tctcaaccacctaggcaatgaag

SEQ ID NO: 3483823 - DNA, 16 bp, Homo sapiens
tctcaaccttggcctt

SEQ ID NO: 3483824 - DNA, 17 bp, Homo sapiens
tctcaatgaagccagct

SEQ ID NO: 3483825 - DNA, 22 bp, Homo sapiens
tctcaatggaaacatcactggg

SEQ ID NO: 3483826 - DNA, 16 bp, Homo sapiens
tctcaccagctgcaaa

SEQ ID NO: 3483827 - DNA, 18 bp, Homo sapiens
tctcaccagctgcaaagt

SEQ ID NO: 3483828 - DNA, 15 bp, Homo sapiens
tctcacccataataa

SEQ ID NO: 3483829 - DNA, 15 bp, Homo sapiens
tctcaccccatccca

SEQ ID NO: 3483830 - DNA, 19 bp, Homo sapiens
tctcaccccatcccacacc

SEQ ID NO: 3483831 - DNA, 16 bp, Homo sapiens
tctcaccttccaaatc

SEQ ID NO: 3483832 - DNA, 19 bp, Homo sapiens
tctcactatgttgcccagg

SEQ ID NO: 3483833 - DNA, 22 bp, Homo sapiens
tctcactatgttgcccaggcag

SEQ ID NO: 3483834 - DNA, 21 bp, Homo sapiens
tctcactctcgtcgcccaggc

SEQ ID NO: 3483835 - DNA, 23 bp, Homo sapiens
tctcactctgcccccccccccca

SEQ ID NO: 3483836 - DNA, 17 bp, Homo sapiens
tctcactctgtcgccca

SEQ ID NO: 3483837 - DNA, 22 bp, Homo sapiens
tctcactctgtcgcccagtctg

SEQ ID NO: 3483838 - DNA, 15 bp, Homo sapiens
tctcactgttgccca

SEQ ID NO: 3483839 - DNA, 15 bp, Homo sapiens
tctcactgtttgttt

SEQ ID NO: 3483840 - DNA, 13 bp, Homo sapiens
tctcacttgtgcc

SEQ ID NO: 3483841 - DNA, 19 bp, Homo sapiens
tctcacttttggaaggtga

SEQ ID NO: 3483842 - DNA, 20 bp, Homo sapiens
tctcagaatctacccaaagg

SEQ ID NO: 3483843 - DNA, 14 bp, Homo sapiens
tctcagagacaggt

SEQ ID NO: 3483844 - DNA, 12 bp, Homo sapiens
tctcagcctccc

SEQ ID NO: 3483845 - DNA, 14 bp, Homo sapiens
tctcagcctcccaa

SEQ ID NO: 3483846 - DNA, 16 bp, Homo sapiens
tctcaggagtctctgg

SEQ ID NO: 3483847 - DNA, 17 bp, Homo sapiens
tctcaggccagagccaa

SEQ ID NO: 3483848 - DNA, 16 bp, Homo sapiens
tctcagggtctctgct

SEQ ID NO: 3483849 - DNA, 22 bp, Homo sapiens
tctcaggtagaaggttgacaca

SEQ ID NO: 3483850 - DNA, 17 bp, Homo sapiens
tctcagtctctgagcag

SEQ ID NO: 3483851 - DNA, 18 bp, Homo sapiens
tctcagtctctgagcagt

SEQ ID NO: 3483852 - DNA, 12 bp, Homo sapiens
tctcagtgtttt

SEQ ID NO: 3483853 - DNA, 21 bp, Homo sapiens
tctcagttgcagccctgctgc

SEQ ID NO: 3483854 - DNA, 14 bp, Homo sapiens
tctcatcctccagt

SEQ ID NO: 3483855 - DNA, 20 bp, Homo sapiens
tctcatctagtacctttgga

SEQ ID NO: 3483856 - DNA, 13 bp, Homo sapiens
tctcatctgaggc

SEQ ID NO: 3483857 - DNA, 12 bp, Homo sapiens
tctcatctttct

SEQ ID NO: 3483858 - DNA, 20 bp, Homo sapiens
tctcatgaggggagaggaga

SEQ ID NO: 3483859 - DNA, 22 bp, Homo sapiens
tctcatgaggggagaggagacg

SEQ ID NO: 3483860 - DNA, 18 bp, Homo sapiens
tctcatggaaactggcca

SEQ ID NO: 3483861 - DNA, 20 bp, Homo sapiens
tctcattccgttgtctgtgg

SEQ ID NO: 3483862 - DNA, 21 bp, Homo sapiens
tctcattccgttgtctgtgga

SEQ ID NO: 3483863 - DNA, 21 bp, Homo sapiens
tctccaaaaatctgcctgggt

SEQ ID NO: 3483864 - DNA, 23 bp, Homo sapiens
tcttctgtgattcggtggagact

SEQ ID NO: 3483865 - DNA, 19 bp, Homo sapiens
tcttcttattacccaaacc

SEQ ID NO: 3483866 - DNA, 16 bp, Homo sapiens
tcttctttttcaggct

SEQ ID NO: 3483867 - DNA, 17 bp, Homo sapiens
tcttgaaaaacttacaa

SEQ ID NO: 3483868 - DNA, 14 bp, Homo sapiens
tcttgaaagctgtg

SEQ ID NO: 3483869 - DNA, 20 bp, Homo sapiens
tcttgaaattaagaaggcaa

SEQ ID NO: 3483870 - DNA, 22 bp, Homo sapiens
tcttgaaccccaaatgctctct

SEQ ID NO: 3483871 - DNA, 12 bp, Homo sapiens
tcttgaactcct

SEQ ID NO: 3483872 - DNA, 16 bp, Homo sapiens
tcttgaactcctggcc

SEQ ID NO: 3483873 - DNA, 21 bp, Homo sapiens
tcttgaagagaaaaaagtcac

SEQ ID NO: 3483874 - DNA, 13 bp, Homo sapiens
tcttgaaggtgct

SEQ ID NO: 3483875 - DNA, 13 bp, Homo sapiens
tcttgaagtcctg

SEQ ID NO: 3483876 - DNA, 20 bp, Homo sapiens
tcttgaatttttttctgcac

SEQ ID NO: 3483877 - DNA, 21 bp, Homo sapiens
tcttgaatttttttctgcaca

SEQ ID NO: 3483878 - DNA, 21 bp, Homo sapiens
tcttgaccaagcaggaagctc

SEQ ID NO: 3483879 - DNA, 21 bp, Homo sapiens
tcttgagccagccaggccctg

SEQ ID NO: 3483880 - DNA, 16 bp, Homo sapiens
tcttgagcctgggagg

SEQ ID NO: 3483881 - DNA, 19 bp, Homo sapiens
tcttgagtcatggatttct

SEQ ID NO: 3483882 - DNA, 20 bp, Homo sapiens
tcttgagtttgtcgctcatg

SEQ ID NO: 3483883 - DNA, 21 bp, Homo sapiens
tcttgatgcatgcactgttcc

SEQ ID NO: 3483884 - DNA, 18 bp, Homo sapiens
tcttgcaatggcagcctt

SEQ ID NO: 3483885 - DNA, 14 bp, Homo sapiens
tcttgccagccaga

SEQ ID NO: 3483886 - DNA, 19 bp, Homo sapiens
tcttgccagccagaagcct

SEQ ID NO: 3483887 - DNA, 19 bp, Homo sapiens
tcttgctatattgcccagg

SEQ ID NO: 3483888 - DNA, 11 bp, Homo sapiens
tcttgctctgc

SEQ ID NO: 3483889 - DNA, 14 bp, Homo sapiens
tcttgctgttgaca

SEQ ID NO: 3483890 - DNA, 18 bp, Homo sapiens
tcttgctgttgacatatt

SEQ ID NO: 3483891 - DNA, 18 bp, Homo sapiens
tcttgcttccctaatcta

SEQ ID NO: 3483892 - DNA, 22 bp, Homo sapiens
tcttgcttccctaatctatggt

SEQ ID NO: 3483893 - DNA, 23 bp, Homo sapiens
tcttgcttccctaatctatggtc

SEQ ID NO: 3483894 - DNA, 14 bp, Homo sapiens
tcttgctttcttta

SEQ ID NO: 3483895 - DNA, 22 bp, Homo sapiens
tcttggcacatttaagagacag

SEQ ID NO: 3483896 - DNA, 15 bp, Homo sapiens
tcttggcttaatcat

SEQ ID NO: 3483897 - DNA, 19 bp, Homo sapiens
tcttggcttaatcattttc

SEQ ID NO: 3483898 - DNA, 20 bp, Homo sapiens
tcttggcttaatcattttca

SEQ ID NO: 3483899 - DNA, 13 bp, Homo sapiens
tcttgggaactga

SEQ ID NO: 3483900 - DNA, 22 bp, Homo sapiens
tcttgggccaagccagctgcct

SEQ ID NO: 3483901 - DNA, 18 bp, Homo sapiens
tcttgtaaataaagccct

SEQ ID NO: 3483902 - DNA, 17 bp, Homo sapiens
tcttgtaaggctttgat

SEQ ID NO: 3483903 - DNA, 19 bp, Homo sapiens
tcttgtattaaactcttca

SEQ ID NO: 3483904 - DNA, 14 bp, Homo sapiens
tcttgtattcatga

SEQ ID NO: 3483905 - DNA, 14 bp, Homo sapiens
tcttgtctcaatgc

SEQ ID NO: 3483906 - DNA, 15 bp, Homo sapiens
tcttgtctcaatgct

SEQ ID NO: 3483907 - DNA, 13 bp, Homo sapiens
tcttgtctctggg

SEQ ID NO: 3483908 - DNA, 13 bp, Homo sapiens
tcttgtgaggaaa

SEQ ID NO: 3483909 - DNA, 17 bp, Homo sapiens
tcttgttattgaagtgt

SEQ ID NO: 3483910 - DNA, 15 bp, Homo sapiens
tcttgttccaaggcc

SEQ ID NO: 3483911 - DNA, 20 bp, Homo sapiens
tcttgttctgagattcaata

SEQ ID NO: 3483912 - DNA, 13 bp, Homo sapiens
tcttgttctgtca

SEQ ID NO: 3483913 - DNA, 19 bp, Homo sapiens
tcttgttgctttgttgcac

SEQ ID NO: 3483914 - DNA, 20 bp, Homo sapiens
tcttgtttatacctttgcct

SEQ ID NO: 3483915 - DNA, 15 bp, Homo sapiens
tcttgtttccttgtt

SEQ ID NO: 3483916 - DNA, 13 bp, Homo sapiens
tcttgtttttcca

SEQ ID NO: 3483917 - DNA, 21 bp, Homo sapiens
tcttgtttttccactactgct

SEQ ID NO: 3483918 - DNA, 16 bp, Homo sapiens
tctttaaaagagagag

SEQ ID NO: 3483919 - DNA, 17 bp, Homo sapiens
tctttaaaagagagaga

SEQ ID NO: 3483920 - DNA, 16 bp, Homo sapiens
tctttaaatatatatt

SEQ ID NO: 3483921 - DNA, 21 bp, Homo sapiens
tctttactattaaaatatttt

SEQ ID NO: 3483922 - DNA, 16 bp, Homo sapiens
tctttagagttagact

SEQ ID NO: 3483923 - DNA, 22 bp, Homo sapiens
tctttagatggtggcacattcc

SEQ ID NO: 3483924 - DNA, 15 bp, Homo sapiens
tctttagccagaatc

SEQ ID NO: 3483925 - DNA, 16 bp, Homo sapiens
tctttaggtctttgta

SEQ ID NO: 3483926 - DNA, 15 bp, Homo sapiens
tctttatgcttgcaa

SEQ ID NO: 3483927 - DNA, 14 bp, Homo sapiens
tctttattgagaaa

SEQ ID NO: 3483928 - DNA, 19 bp, Homo sapiens
tctttattgagaaagagca

SEQ ID NO: 3483929 - DNA, 15 bp, Homo sapiens
tctttattttactag

SEQ ID NO: 3483930 - DNA, 11 bp, Homo sapiens
tctttcaaaac

SEQ ID NO: 3483931 - DNA, 20 bp, Homo sapiens
tctttcaaaaccttttgaaa

SEQ ID NO: 3483932 - DNA, 23 bp, Homo sapiens
tctttcaaaaccttttgaaatta

SEQ ID NO: 3483933 - DNA, 22 bp, Homo sapiens
tctttcaaaggtagccatcatg

SEQ ID NO: 3483934 - DNA, 20 bp, Homo sapiens
tctttcaagcagtcgtgcct

SEQ ID NO: 3483935 - DNA, 21 bp, Homo sapiens
tctttcaagcagtcgtgcctg

SEQ ID NO: 3483936 - DNA, 14 bp, Homo sapiens
tctttcaattctgt

SEQ ID NO: 3483937 - DNA, 21 bp, Homo sapiens
tctttcagacttgccatgtga

SEQ ID NO: 3483938 - DNA, 23 bp, Homo sapiens
tctttcagacttgccatgtgact

SEQ ID NO: 3483939 - DNA, 23 bp, Homo sapiens
tctttcatccactagtgcaaatc

SEQ ID NO: 3483940 - DNA, 19 bp, Homo sapiens
tctttccacggagccactc

SEQ ID NO: 3483941 - DNA, 23 bp, Homo sapiens
tctttccacggagccactcctct

SEQ ID NO: 3483942 - DNA, 17 bp, Homo sapiens
tctttcctaagacctgg

SEQ ID NO: 3483943 - DNA, 23 bp, Homo sapiens
tctttcctaaggctgcaaggttt

SEQ ID NO: 3483944 - DNA, 24 bp, Homo sapiens
tctttcctatttcagtgttacctg

SEQ ID NO: 3483945 - DNA, 14 bp, Homo sapiens
tctttcctcctttc

SEQ ID NO: 3483946 - DNA, 22 bp, Homo sapiens
tctttctgagtgccttctgtgg

SEQ ID NO: 3483947 - DNA, 17 bp, Homo sapiens
tctttctggtgttttat

SEQ ID NO: 3483948 - DNA, 14 bp, Homo sapiens
tctttctgtccctt

SEQ ID NO: 3483949 - DNA, 13 bp, Homo sapiens
tctttcttagaaa

SEQ ID NO: 3483950 - DNA, 15 bp, Homo sapiens
tctttctttcttaga

SEQ ID NO: 3483951 - DNA, 15 bp, Homo sapiens
tctttgcaaagtatt

SEQ ID NO: 3483952 - DNA, 13 bp, Homo sapiens
tctttgcagacag

SEQ ID NO: 3483953 - DNA, 17 bp, Homo sapiens
tctttgcagacaggcaa

SEQ ID NO: 3483954 - DNA, 12 bp, Homo sapiens
tctttgccaagt

SEQ ID NO: 3483955 - DNA, 14 bp, Homo sapiens
tctttgctgtaaga

SEQ ID NO: 3483956 - DNA, 11 bp, Homo sapiens
tctttgctttg

SEQ ID NO: 3483957 - DNA, 18 bp, Homo sapiens
tctttgctttgctttctg

SEQ ID NO: 3483958 - DNA, 20 bp, Homo sapiens
tctttggccccttgctggag

SEQ ID NO: 3483959 - DNA, 16 bp, Homo sapiens
tctttgggaatatttg

SEQ ID NO: 3483960 - DNA, 14 bp, Homo sapiens
tctttgggaatgtt

SEQ ID NO: 3483961 - DNA, 20 bp, Homo sapiens
tctttgggccagacatgcca

SEQ ID NO: 3483962 - DNA, 12 bp, Homo sapiens
tctttgtaagaa

SEQ ID NO: 3483963 - DNA, 20 bp, Homo sapiens
tctttgtaagaactaaagaa

SEQ ID NO: 3483964 - DNA, 22 bp, Homo sapiens
tctttgtaagaactaaagaaga

SEQ ID NO: 3483965 - DNA, 15 bp, Homo sapiens
tctttgtctaaaaca

SEQ ID NO: 3483966 - DNA, 19 bp, Homo sapiens
tctttgtctaaaacaataa

SEQ ID NO: 3483967 - DNA, 14 bp, Homo sapiens
tctttgttcaagat

SEQ ID NO: 3483968 - DNA, 23 bp, Homo sapiens
tctttgttcatagcccagtagac

SEQ ID NO: 3483969 - DNA, 12 bp, Homo sapiens
tcttttacaact

SEQ ID NO: 3483970 - DNA, 14 bp, Homo sapiens
tcttttacattctg

SEQ ID NO: 3483971 - DNA, 13 bp, Homo sapiens
tcttttacctgct

SEQ ID NO: 3483972 - DNA, 20 bp, Homo sapiens
tcttttacctgctgcttctc

SEQ ID NO: 3483973 - DNA, 13 bp, Homo sapiens
tcttttatatttg

SEQ ID NO: 3483974 - DNA, 16 bp, Homo sapiens
tcttttattttggaac

SEQ ID NO: 3483975 - DNA, 18 bp, Homo sapiens
tcttttattttggaacta

SEQ ID NO: 3483976 - DNA, 14 bp, Homo sapiens
tcttttcacagcaa

SEQ ID NO: 3483977 - DNA, 18 bp, Homo sapiens
tcttttcccctttcctgt

SEQ ID NO: 3483978 - DNA, 16 bp, Homo sapiens
tcttttcttgcctctg

SEQ ID NO: 3483979 - DNA, 18 bp, Homo sapiens
tcttttgaattgttacat

SEQ ID NO: 3483980 - DNA, 20 bp, Homo sapiens
tcttttgtatgtaaatgtgc

SEQ ID NO: 3483981 - DNA, 15 bp, Homo sapiens
tctttttaataaaaa

SEQ ID NO: 3483982 - DNA, 14 bp, Homo sapiens
tctttttattgaat

SEQ ID NO: 3483983 - DNA, 15 bp, Homo sapiens
tctttttattgaatc

SEQ ID NO: 3483984 - DNA, 17 bp, Homo sapiens
tctttttttaactggtg

SEQ ID NO: 3483985 - DNA, 17 bp, Homo sapiens
tctttttttattaaaca

SEQ ID NO: 3483986 - DNA, 16 bp, Homo sapiens
tgaaaacactgtgcac

SEQ ID NO: 3483987 - DNA, 20 bp, Homo sapiens
tgaaaacggagctgaacaat

SEQ ID NO: 3483988 - DNA, 22 bp, Homo sapiens
tgaaaagaaggaatataccttt

SEQ ID NO: 3483989 - DNA, 21 bp, Homo sapiens
tgaaaagagaatgatgctcaa

SEQ ID NO: 3483990 - DNA, 19 bp, Homo sapiens
tgaaaagctccatcaatga

SEQ ID NO: 3483991 - DNA, 20 bp, Homo sapiens
tgaaaagctccatttttagt

SEQ ID NO: 3483992 - DNA, 19 bp, Homo sapiens
tgaaaatcgtgacaacact

SEQ ID NO: 3483993 - DNA, 13 bp, Homo sapiens
tgaaaatgtcttg

SEQ ID NO: 3483994 - DNA, 14 bp, Homo sapiens
tgaaaattcagtgg

SEQ ID NO: 3483995 - DNA, 13 bp, Homo sapiens
tgaaacacaaaca

SEQ ID NO: 3483996 - DNA, 21 bp, Homo sapiens
tgagtgccttctgtggggact

SEQ ID NO: 3483997 - DNA, 17 bp, Homo sapiens
tgagtgccttttgcaga

SEQ ID NO: 3483998 - DNA, 19 bp, Homo sapiens
tgagtgccttttgcagaag

SEQ ID NO: 3483999 - DNA, 21 bp, Homo sapiens
tgagtggcaggggacaggagt

SEQ ID NO: 3484000 - DNA, 21 bp, Homo sapiens
tgagtgggggatcacagcctc

SEQ ID NO: 3484001 - DNA, 14 bp, Homo sapiens
tgagtgtttctatg

SEQ ID NO: 3484002 - DNA, 18 bp, Homo sapiens
tgagttaggaatgagaag

SEQ ID NO: 3484003 - DNA, 16 bp, Homo sapiens
tgagttatctaagaat

SEQ ID NO: 3484004 - DNA, 21 bp, Homo sapiens
tgagttattgagattgtcctc

SEQ ID NO: 3484005 - DNA, 15 bp, Homo sapiens
tgagttcaggtagct

SEQ ID NO: 3484006 - DNA, 16 bp, Homo sapiens
tgagttcaggtagctg

SEQ ID NO: 3484007 - DNA, 17 bp, Homo sapiens
tgagttcataccctgtt

SEQ ID NO: 3484008 - DNA, 16 bp, Homo sapiens
tgagttgattcagctc

SEQ ID NO: 3484009 - DNA, 21 bp, Homo sapiens
tgagttggggtctggcagcct

SEQ ID NO: 3484010 - DNA, 12 bp, Homo sapiens
tgagtttaaaaa

SEQ ID NO: 3484011 - DNA, 16 bp, Homo sapiens
tgagtttaaaaatcaa

SEQ ID NO: 3484012 - DNA, 20 bp, Homo sapiens
tgagtttaaaaatcaacttt

SEQ ID NO: 3484013 - DNA, 14 bp, Homo sapiens
tgagtttaaagcaa

SEQ ID NO: 3484014 - DNA, 20 bp, Homo sapiens
tgagtttgtcgctcatgtgt

SEQ ID NO: 3484015 - DNA, 16 bp, Homo sapiens
tgataaaaccatgtag

SEQ ID NO: 3484016 - DNA, 18 bp, Homo sapiens
tgataactagatggtgct

SEQ ID NO: 3484017 - DNA, 22 bp, Homo sapiens
tgataactagatggtgctgaga

SEQ ID NO: 3484018 - DNA, 19 bp, Homo sapiens
tgataagttcctttccttt

SEQ ID NO: 3484019 - DNA, 13 bp, Homo sapiens
tgataataaagga

SEQ ID NO: 3484020 - DNA, 16 bp, Homo sapiens
tgataatgacactgtt

SEQ ID NO: 3484021 - DNA, 16 bp, Homo sapiens
tgatacatccaaagca

SEQ ID NO: 3484022 - DNA, 13 bp, Homo sapiens
tgatacatttctg

SEQ ID NO: 3484023 - DNA, 19 bp, Homo sapiens
tgatagacacatatgaggg

SEQ ID NO: 3484024 - DNA, 21 bp, Homo sapiens
tgatagacacatatgaggggg

SEQ ID NO: 3484025 - DNA, 22 bp, Homo sapiens
tgatagacacatatgaggggga

SEQ ID NO: 3484026 - DNA, 23 bp, Homo sapiens
tgatagcaagtgaatttttctct

SEQ ID NO: 3484027 - DNA, 15 bp, Homo sapiens
tgatagcactttcta

SEQ ID NO: 3484028 - DNA, 21 bp, Homo sapiens
tgatagcactttctacaatgt

SEQ ID NO: 3484029 - DNA, 19 bp, Homo sapiens
tgatatatttaaaaatatt

SEQ ID NO: 3484030 - DNA, 21 bp, Homo sapiens
tgatatcatgcccctgtactc

SEQ ID NO: 3484031 - DNA, 22 bp, Homo sapiens
tgatatcattgttggtgttaat

SEQ ID NO: 3484032 - DNA, 19 bp, Homo sapiens
tgatatccattctttctga

SEQ ID NO: 3484033 - DNA, 17 bp, Homo sapiens
tgatatgttttatttca

SEQ ID NO: 3484034 - DNA, 14 bp, Homo sapiens
tgatcaacatcttt

SEQ ID NO: 3484035 - DNA, 12 bp, Homo sapiens
tgatcaaggcct

SEQ ID NO: 3484036 - DNA, 13 bp, Homo sapiens
tgatcaaggcctt

SEQ ID NO: 3484037 - DNA, 15 bp, Homo sapiens
tgatcacggctcact

SEQ ID NO: 3484038 - DNA, 20 bp, Homo sapiens
tgatcacggctcactgcagc

SEQ ID NO: 3484039 - DNA, 22 bp, Homo sapiens
tgatcacggctcactgcagcct

SEQ ID NO: 3484040 - DNA, 15 bp, Homo sapiens
tgatcagatctgaca

SEQ ID NO: 3484041 - DNA, 11 bp, Homo sapiens
tgatcagtgtt

SEQ ID NO: 3484042 - DNA, 16 bp, Homo sapiens
tgatcatcgccagagg

SEQ ID NO: 3484043 - DNA, 14 bp, Homo sapiens
tgatcatgtacttt

SEQ ID NO: 3484044 - DNA, 15 bp, Homo sapiens
tgatcatgtactttt

SEQ ID NO: 3484045 - DNA, 17 bp, Homo sapiens
tgatcatgtacttttta

SEQ ID NO: 3484046 - DNA, 21 bp, Homo sapiens
tgatccaagctggtcccactc

SEQ ID NO: 3484047 - DNA, 13 bp, Homo sapiens
tgatccatccagc

SEQ ID NO: 3484048 - DNA, 20 bp, Homo sapiens
tgatccctctgggggctctg

SEQ ID NO: 3484049 - DNA, 18 bp, Homo sapiens
tgatcctcccacctcagc

SEQ ID NO: 3484050 - DNA, 16 bp, Homo sapiens
tgatcctggaggccca

SEQ ID NO: 3484051 - DNA, 17 bp, Homo sapiens
tgatctgcaggggtctg

SEQ ID NO: 3484052 - DNA, 18 bp, Homo sapiens
tgatctgcaggggtctgg

SEQ ID NO: 3484053 - DNA, 15 bp, Homo sapiens
tgatctgtatataca

SEQ ID NO: 3484054 - DNA, 22 bp, Homo sapiens
tgatctgtatatacaataacat

SEQ ID NO: 3484055 - DNA, 21 bp, Homo sapiens
tgatcttggcttactgcagcc

SEQ ID NO: 3484056 - DNA, 14 bp, Homo sapiens
tgatgactgccttg

SEQ ID NO: 3484057 - DNA, 19 bp, Homo sapiens
tgatgatctttgcagacag

SEQ ID NO: 3484058 - DNA, 23 bp, Homo sapiens
tgatgatctttgcagacaggcaa

SEQ ID NO: 3484059 - DNA, 23 bp, Homo sapiens
tgatgcatgcactgttccccctg

SEQ ID NO: 3484060 - DNA, 20 bp, Homo sapiens
tgatgctacaggatttgaaa

SEQ ID NO: 3484061 - DNA, 18 bp, Homo sapiens
tgatgctgccggcacagc

SEQ ID NO: 3484062 - DNA, 15 bp, Homo sapiens
tgatgctggatgctc

SEQ ID NO: 3484063 - DNA, 20 bp, Homo sapiens
tgatgctggatgctccttcc

SEQ ID NO: 3484064 - DNA, 16 bp, Homo sapiens
tgatggagattaagat

SEQ ID NO: 3484065 - DNA, 17 bp, Homo sapiens
tgatggatttaacagca

SEQ ID NO: 3484066 - DNA, 24 bp, Homo sapiens
tgatgggattctggacaggatgtg

SEQ ID NO: 3484067 - DNA, 24 bp, Homo sapiens
tgatggggcaagggcacaagtcct

SEQ ID NO: 3484068 - DNA, 14 bp, Homo sapiens
tgatgtacacattt

SEQ ID NO: 3484069 - DNA, 18 bp, Homo sapiens
tgatgtaccatgaaacaa

SEQ ID NO: 3484070 - DNA, 20 bp, Homo sapiens
tgatgtaccatgaaacaaag

SEQ ID NO: 3484071 - DNA, 17 bp, Homo sapiens
tgatgtcaatttctgtg

SEQ ID NO: 3484072 - DNA, 16 bp, Homo sapiens
tgatgttggctgggaa

SEQ ID NO: 3484073 - DNA, 19 bp, Homo sapiens
tgatgtttgcccaaaattt

SEQ ID NO: 3484074 - DNA, 12 bp, Homo sapiens
tgattaaagtgc

SEQ ID NO: 3484075 - DNA, 13 bp, Homo sapiens
tgattaacatttg

SEQ ID NO: 3484076 - DNA, 15 bp, Homo sapiens
tgattaggtatgttt

SEQ ID NO: 3484077 - DNA, 16 bp, Homo sapiens
tgattaggtatgtttg

SEQ ID NO: 3484078 - DNA, 16 bp, Homo sapiens
tgattatttattattt

SEQ ID NO: 3484079 - DNA, 14 bp, Homo sapiens
tgattcaaaatatt

SEQ ID NO: 3484080 - DNA, 17 bp, Homo sapiens
tgattcaaaatatttaa

SEQ ID NO: 3484081 - DNA, 14 bp, Homo sapiens
tgattcaactaaaa

SEQ ID NO: 3484082 - DNA, 12 bp, Homo sapiens
tgattcaagcca

SEQ ID NO: 3484083 - DNA, 14 bp, Homo sapiens
tgattcagctctgc

SEQ ID NO: 3484084 - DNA, 21 bp, Homo sapiens
tgattcaggtgcagaggaagt

SEQ ID NO: 3484085 - DNA, 18 bp, Homo sapiens
tgattcatagtaacttct

SEQ ID NO: 3484086 - DNA, 19 bp, Homo sapiens
tgattcatagtaacttctt

SEQ ID NO: 3484087 - DNA, 19 bp, Homo sapiens
tgattcccaagctctgctc

SEQ ID NO: 3484088 - DNA, 21 bp, Homo sapiens
tgattctatttatatgtacat

SEQ ID NO: 3484089 - DNA, 22 bp, Homo sapiens
tgattctatttatatgtacatg

SEQ ID NO: 3484090 - DNA, 19 bp, Homo sapiens
tgattctcagggtctctgc

SEQ ID NO: 3484091 - DNA, 19 bp, Homo sapiens
tgattctcctgcctcagcc

SEQ ID NO: 3484092 - DNA, 21 bp, Homo sapiens
tgattctcctgcctcagcctc

SEQ ID NO: 3484093 - DNA, 13 bp, Homo sapiens
tgattctccttca

SEQ ID NO: 3484094 - DNA, 19 bp, Homo sapiens
tgattctccttcagccctc

SEQ ID NO: 3484095 - DNA, 23 bp, Homo sapiens
tgattctccttcagccctcaccc

SEQ ID NO: 3484096 - DNA, 21 bp, Homo sapiens
tgattctgataatgctcactt

SEQ ID NO: 3484097 - DNA, 12 bp, Homo sapiens
tgattgacagct

SEQ ID NO: 3484098 - DNA, 19 bp, Homo sapiens
tgattgacagctttgctgc

SEQ ID NO: 3484099 - DNA, 17 bp, Homo sapiens
tgattgcacgtgcctgt

SEQ ID NO: 3484100 - DNA, 18 bp, Homo sapiens
tgattgccaagctcagga

SEQ ID NO: 3484101 - DNA, 19 bp, Homo sapiens
tgattggaatagcttctgg

SEQ ID NO: 3484102 - DNA, 18 bp, Homo sapiens
tgattgtggaatggagat

SEQ ID NO: 3484103 - DNA, 18 bp, Homo sapiens
tgattgttcgggtgtgca

SEQ ID NO: 3484104 - DNA, 19 bp, Homo sapiens
tgattgttcgggtgtgcaa

SEQ ID NO: 3484105 - DNA, 11 bp, Homo sapiens
tgattgtttac

SEQ ID NO: 3484106 - DNA, 13 bp, Homo sapiens
tgattgtttacag

SEQ ID NO: 3484107 - DNA, 21 bp, Homo sapiens
tgatttaggagaagccaggaa

SEQ ID NO: 3484108 - DNA, 15 bp, Homo sapiens
tgatttccttgaatg

SEQ ID NO: 3484109 - DNA, 16 bp, Homo sapiens
tgatttccttgaatgt

SEQ ID NO: 3484110 - DNA, 12 bp, Homo sapiens
tgatttgcattg

SEQ ID NO: 3484111 - DNA, 13 bp, Homo sapiens
tgatttgcattga

SEQ ID NO: 3484112 - DNA, 14 bp, Homo sapiens
tgatttgcattgaa

SEQ ID NO: 3484113 - DNA, 15 bp, Homo sapiens
tgattttaactctgt

SEQ ID NO: 3484114 - DNA, 17 bp, Homo sapiens
tgattttaactctgtct

SEQ ID NO: 3484115 - DNA, 23 bp, Homo sapiens
tgcaaaaatatttataaaacttc

SEQ ID NO: 3484116 - DNA, 20 bp, Homo sapiens
tgcaaaagttctgacttgac

SEQ ID NO: 3484117 - DNA, 18 bp, Homo sapiens
tgcaaaatgaggaatgta

SEQ ID NO: 3484118 - DNA, 14 bp, Homo sapiens
tgcaaacgctgcct

SEQ ID NO: 3484119 - DNA, 15 bp, Homo sapiens
tgcaaacgctgcctg

SEQ ID NO: 3484120 - DNA, 21 bp, Homo sapiens
tgcaaacgctgcctgccggta

SEQ ID NO: 3484121 - DNA, 16 bp, Homo sapiens
tgcaaactgtgcttct

SEQ ID NO: 3484122 - DNA, 19 bp, Homo sapiens
tgcaaactgtgcttctcta

SEQ ID NO: 3484123 - DNA, 15 bp, Homo sapiens
tgcaaagaggcaaga

SEQ ID NO: 3484124 - DNA, 12 bp, Homo sapiens
tgcaaagatctg

SEQ ID NO: 3484125 - DNA, 14 bp, Homo sapiens
tgcaaagccaaggc

SEQ ID NO: 3484126 - DNA, 13 bp, Homo sapiens
tgcaaaggctggg

SEQ ID NO: 3484127 - DNA, 16 bp, Homo sapiens
tgcaaagtattgtaaa

SEQ ID NO: 3484128 - DNA, 14 bp, Homo sapiens
tgctgtctctagaa

SEQ ID NO: 3484129 - DNA, 15 bp, Homo sapiens
tgctgtctctctggg

SEQ ID NO: 3484130 - DNA, 18 bp, Homo sapiens
tgctgtctctctgggctg

SEQ ID NO: 3484131 - DNA, 13 bp, Homo sapiens
tgctgtctgcagc

SEQ ID NO: 3484132 - DNA, 21 bp, Homo sapiens
tgctgtgaaccctggggcctg

SEQ ID NO: 3484133 - DNA, 15 bp, Homo sapiens
tgctgtgctgtgcta

SEQ ID NO: 3484134 - DNA, 22 bp, Homo sapiens
tgctgttctagcacttcatctg

SEQ ID NO: 3484135 - DNA, 15 bp, Homo sapiens
tgctgttgacatatt

SEQ ID NO: 3484136 - DNA, 17 bp, Homo sapiens
tgctgttggtcctctct

SEQ ID NO: 3484137 - DNA, 23 bp, Homo sapiens
tgctgttgtccaactatttattg

SEQ ID NO: 3484138 - DNA, 19 bp, Homo sapiens
tgctgttttcctcccttct

SEQ ID NO: 3484139 - DNA, 16 bp, Homo sapiens
tgcttaaagttgtaac

SEQ ID NO: 3484140 - DNA, 14 bp, Homo sapiens
tgcttacatctgga

SEQ ID NO: 3484141 - DNA, 22 bp, Homo sapiens
tgcttacatctggaatctgagg

SEQ ID NO: 3484142 - DNA, 14 bp, Homo sapiens
tgcttagaaaagaa

SEQ ID NO: 3484143 - DNA, 20 bp, Homo sapiens
tgcttagtccaattccttgc

SEQ ID NO: 3484144 - DNA, 17 bp, Homo sapiens
tgcttataggtggcctc

SEQ ID NO: 3484145 - DNA, 21 bp, Homo sapiens
tgcttatggtaccagatgcag

SEQ ID NO: 3484146 - DNA, 18 bp, Homo sapiens
tgcttcattctttgcagg

SEQ ID NO: 3484147 - DNA, 16 bp, Homo sapiens
tgcttcatttttgtaa

SEQ ID NO: 3484148 - DNA, 17 bp, Homo sapiens
tgcttcatttttgtaat

SEQ ID NO: 3484149 - DNA, 12 bp, Homo sapiens
tgcttcctcctg

SEQ ID NO: 3484150 - DNA, 14 bp, Homo sapiens
tgcttcctcctgga

SEQ ID NO: 3484151 - DNA, 15 bp, Homo sapiens
tgcttcgggcccttc

SEQ ID NO: 3484152 - DNA, 18 bp, Homo sapiens
tgcttcgggcccttccca

SEQ ID NO: 3484153 - DNA, 17 bp, Homo sapiens
tgcttctctgacttctg

SEQ ID NO: 3484154 - DNA, 16 bp, Homo sapiens
tgcttgaaggccctgc

SEQ ID NO: 3484155 - DNA, 15 bp, Homo sapiens
tgcttgacaacatct

SEQ ID NO: 3484156 - DNA, 21 bp, Homo sapiens
tgcttgaggcaactcatctta

SEQ ID NO: 3484157 - DNA, 13 bp, Homo sapiens
tgcttgatacagg

SEQ ID NO: 3484158 - DNA, 22 bp, Homo sapiens
tgcttgatgggattctggacag

SEQ ID NO: 3484159 - DNA, 18 bp, Homo sapiens
tgcttgctcatatgcatg

SEQ ID NO: 3484160 - DNA, 16 bp, Homo sapiens
tgcttgggtctctctc

SEQ ID NO: 3484161 - DNA, 20 bp, Homo sapiens
tgcttgggtctctctccatt

SEQ ID NO: 3484162 - DNA, 16 bp, Homo sapiens
tgcttggtctgtttga

SEQ ID NO: 3484163 - DNA, 15 bp, Homo sapiens
tgcttgtataggttt

SEQ ID NO: 3484164 - DNA, 16 bp, Homo sapiens
tgcttgttccctctcc

SEQ ID NO: 3484165 - DNA, 15 bp, Homo sapiens
tgctttatgctgaaa

SEQ ID NO: 3484166 - DNA, 15 bp, Homo sapiens
tgctttattccagaa

SEQ ID NO: 3484167 - DNA, 17 bp, Homo sapiens
tgctttattccagaatg

SEQ ID NO: 3484168 - DNA, 12 bp, Homo sapiens
tgctttcactct

SEQ ID NO: 3484169 - DNA, 19 bp, Homo sapiens
tgctttcatcttggtcaca

SEQ ID NO: 3484170 - DNA, 14 bp, Homo sapiens
tgctttctgctcag

SEQ ID NO: 3484171 - DNA, 15 bp, Homo sapiens
tgctttctgctcagc

SEQ ID NO: 3484172 - DNA, 18 bp, Homo sapiens
tgctttcttgtctttaga

SEQ ID NO: 3484173 - DNA, 16 bp, Homo sapiens
tgctttgaaacagaaa

SEQ ID NO: 3484174 - DNA, 12 bp, Homo sapiens
tgctttgcattt

SEQ ID NO: 3484175 - DNA, 14 bp, Homo sapiens
tgctttgcccagca

SEQ ID NO: 3484176 - DNA, 18 bp, Homo sapiens
tgctttggacctaaatgg

SEQ ID NO: 3484177 - DNA, 13 bp, Homo sapiens
tgctttgttgcac

SEQ ID NO: 3484178 - DNA, 19 bp, Homo sapiens
tgcttttggcaaaactcta

SEQ ID NO: 3484179 - DNA, 20 bp, Homo sapiens
tgctttttgcgtacacagag

SEQ ID NO: 3484180 - DNA, 16 bp, Homo sapiens
tggaaaaataaacact

SEQ ID NO: 3484181 - DNA, 17 bp, Homo sapiens
tggaaaacaaggaagtc

SEQ ID NO: 3484182 - DNA, 13 bp, Homo sapiens
tggaaagactggg

SEQ ID NO: 3484183 - DNA, 13 bp, Homo sapiens
tggaaatgttctt

SEQ ID NO: 3484184 - DNA, 17 bp, Homo sapiens
tggaaatgttctttaga

SEQ ID NO: 3484185 - DNA, 15 bp, Homo sapiens
tggaacacggccaca

SEQ ID NO: 3484186 - DNA, 17 bp, Homo sapiens
tggaacacggccacatc

SEQ ID NO: 3484187 - DNA, 22 bp, Homo sapiens
tggaacactagacaagccagaa

SEQ ID NO: 3484188 - DNA, 23 bp, Homo sapiens
tggaacagattcacactgtctgg

SEQ ID NO: 3484189 - DNA, 21 bp, Homo sapiens
tggaacatcatcaaggcactg

SEQ ID NO: 3484190 - DNA, 14 bp, Homo sapiens
tggaacccagactc

SEQ ID NO: 3484191 - DNA, 16 bp, Homo sapiens
tggaactatgaagact

SEQ ID NO: 3484192 - DNA, 15 bp, Homo sapiens
tggaactgtttcctt

SEQ ID NO: 3484193 - DNA, 16 bp, Homo sapiens
tggaacttacattgtt

SEQ ID NO: 3484194 - DNA, 15 bp, Homo sapiens
tggaagacacattga

SEQ ID NO: 3484195 - DNA, 21 bp, Homo sapiens
tggaagatcctgcgggtgggg

SEQ ID NO: 3484196 - DNA, 14 bp, Homo sapiens
tggaagattttcat

SEQ ID NO: 3484197 - DNA, 16 bp, Homo sapiens
tggaagcacagcttca

SEQ ID NO: 3484198 - DNA, 18 bp, Homo sapiens
tggaagctaatttgcatt

SEQ ID NO: 3484199 - DNA, 16 bp, Homo sapiens
tggaagcttgttgaaa

SEQ ID NO: 3484200 - DNA, 22 bp, Homo sapiens
tggaagcttgttgaaaacccag

SEQ ID NO: 3484201 - DNA, 16 bp, Homo sapiens
tggaaggaccctgtgc

SEQ ID NO: 3484202 - DNA, 21 bp, Homo sapiens
tggaagggggctcttttactg

SEQ ID NO: 3484203 - DNA, 22 bp, Homo sapiens
tggaataatcctaaacatatga

SEQ ID NO: 3484204 - DNA, 13 bp, Homo sapiens
tggaatacttttt

SEQ ID NO: 3484205 - DNA, 21 bp, Homo sapiens
tggaatcaggaatattttcca

SEQ ID NO: 3484206 - DNA, 14 bp, Homo sapiens
tggaatctgaggca

SEQ ID NO: 3484207 - DNA, 16 bp, Homo sapiens
tggaatctgaggcatc

SEQ ID NO: 3484208 - DNA, 23 bp, Homo sapiens
tggaatctgaggcatcctctgac

SEQ ID NO: 3484209 - DNA, 17 bp, Homo sapiens
tggaattgatttgcatt

SEQ ID NO: 3484210 - DNA, 22 bp, Homo sapiens
tggaattgatttgcattgaaca

SEQ ID NO: 3484211 - DNA, 15 bp, Homo sapiens
tggaatttgttcaag

SEQ ID NO: 3484212 - DNA, 20 bp, Homo sapiens
tggacaaagaattccaaagc

SEQ ID NO: 3484213 - DNA, 23 bp, Homo sapiens
tggacaaagaattccaaagcaaa

SEQ ID NO: 3484214 - DNA, 21 bp, Homo sapiens
tggacacagctcttctccagg

SEQ ID NO: 3484215 - DNA, 14 bp, Homo sapiens
tggacacttttcac

SEQ ID NO: 3484216 - DNA, 16 bp, Homo sapiens
tggacagacagaggat

SEQ ID NO: 3484217 - DNA, 22 bp, Homo sapiens
tggacagacagaggatgagctc

SEQ ID NO: 3484218 - DNA, 18 bp, Homo sapiens
tggacaggcatgttctct

SEQ ID NO: 3484219 - DNA, 22 bp, Homo sapiens
tggacaggcatgttctctgagg

SEQ ID NO: 3484220 - DNA, 23 bp, Homo sapiens
tggacaggcatgttctctgagga

SEQ ID NO: 3484221 - DNA, 15 bp, Homo sapiens
tggacatcagtgttt

SEQ ID NO: 3484222 - DNA, 14 bp, Homo sapiens
tggacatcctcctc

SEQ ID NO: 3484223 - DNA, 17 bp, Homo sapiens
tggacatgcctgtcctg

SEQ ID NO: 3484224 - DNA, 21 bp, Homo sapiens
tggacatgcctgtcctgaaag

SEQ ID NO: 3484225 - DNA, 22 bp, Homo sapiens
tggacatgcctgtcctgaaagc

SEQ ID NO: 3484226 - DNA, 13 bp, Homo sapiens
tggaccagtggtc

SEQ ID NO: 3484227 - DNA, 16 bp, Homo sapiens
tggacccagggaacag

SEQ ID NO: 3484228 - DNA, 23 bp, Homo sapiens
tggaccctgtggatgataaaaca

SEQ ID NO: 3484229 - DNA, 18 bp, Homo sapiens
tggaccgtcccctgccca

SEQ ID NO: 3484230 - DNA, 17 bp, Homo sapiens
tggaccttaggccttcc

SEQ ID NO: 3484231 - DNA, 19 bp, Homo sapiens
tggaccttaggccttcctc

SEQ ID NO: 3484232 - DNA, 20 bp, Homo sapiens
tggaccttgaactgggtact

SEQ ID NO: 3484233 - DNA, 15 bp, Homo sapiens
tggacggctgggcac

SEQ ID NO: 3484234 - DNA, 17 bp, Homo sapiens
tggacggtgctccaggc

SEQ ID NO: 3484235 - DNA, 20 bp, Homo sapiens
tggacggtgctccaggcagg

SEQ ID NO: 3484236 - DNA, 13 bp, Homo sapiens
tggactaaaagat

SEQ ID NO: 3484237 - DNA, 21 bp, Homo sapiens
tggactagagggacctctccc

SEQ ID NO: 3484238 - DNA, 23 bp, Homo sapiens
tggactatctgtctggtggcccc

SEQ ID NO: 3484239 - DNA, 18 bp, Homo sapiens
tggactattataatttaa

SEQ ID NO: 3484240 - DNA, 23 bp, Homo sapiens
tggactccagcctgcctggcagg

SEQ ID NO: 3484241 - DNA, 18 bp, Homo sapiens
tggactcctgccaccagc

SEQ ID NO: 3484242 - DNA, 15 bp, Homo sapiens
tggactctcagtctc

SEQ ID NO: 3484243 - DNA, 22 bp, Homo sapiens
tggactctcagtctctgagcag

SEQ ID NO: 3484244 - DNA, 15 bp, Homo sapiens
tggactgaggcctga

SEQ ID NO: 3484245 - DNA, 14 bp, Homo sapiens
tggactgcagaagc

SEQ ID NO: 3484246 - DNA, 14 bp, Homo sapiens
tggactggttttca

SEQ ID NO: 3484247 - DNA, 15 bp, Homo sapiens
tggacttgtcctcag

SEQ ID NO: 3484248 - DNA, 20 bp, Homo sapiens
tggacttgtcctcagcagct

SEQ ID NO: 3484249 - DNA, 21 bp, Homo sapiens
tggagaagccacaggcctgag

SEQ ID NO: 3484250 - DNA, 19 bp, Homo sapiens
tggagacaatgtctgcagc

SEQ ID NO: 3484251 - DNA, 22 bp, Homo sapiens
tggagacaatgtctgcagccct

SEQ ID NO: 3484252 - DNA, 24 bp, Homo sapiens
tggagacaatgtctgcagccctga

SEQ ID NO: 3484253 - DNA, 22 bp, Homo sapiens
tggagactcctaggcaggacat

SEQ ID NO: 3484254 - DNA, 15 bp, Homo sapiens
tggagagctggagcc

SEQ ID NO: 3484255 - DNA, 20 bp, Homo sapiens
tggagagctggagcctggtg

SEQ ID NO: 3484256 - DNA, 14 bp, Homo sapiens
tggagatcctcctg

SEQ ID NO: 3484257 - DNA, 14 bp, Homo sapiens
tggagattaagatg

SEQ ID NO: 3484258 - DNA, 18 bp, Homo sapiens
tggagattaagatgcctt

SEQ ID NO: 3484259 - DNA, 17 bp, Homo sapiens
tggagcaaagtggtagg

SEQ ID NO: 3484260 - DNA, 16 bp, Homo sapiens
tggtgctacgcctgca

SEQ ID NO: 3484261 - DNA, 15 bp, Homo sapiens
tggtgctgagaagct

SEQ ID NO: 3484262 - DNA, 19 bp, Homo sapiens
tggtggaggattgctgcca

SEQ ID NO: 3484263 - DNA, 15 bp, Homo sapiens
tggtggcacattcct

SEQ ID NO: 3484264 - DNA, 12 bp, Homo sapiens
tggtggcagtgg

SEQ ID NO: 3484265 - DNA, 13 bp, Homo sapiens
tggtggcagtggg

SEQ ID NO: 3484266 - DNA, 13 bp, Homo sapiens
tggtggctgggtt

SEQ ID NO: 3484267 - DNA, 16 bp, Homo sapiens
tggtgggtccatgggc

SEQ ID NO: 3484268 - DNA, 17 bp, Homo sapiens
tggtgggtccatgggca

SEQ ID NO: 3484269 - DNA, 14 bp, Homo sapiens
tggtggttgctgtt

SEQ ID NO: 3484270 - DNA, 16 bp, Homo sapiens
tggtggtttgattgtt

SEQ ID NO: 3484271 - DNA, 19 bp, Homo sapiens
tggtgtctggattcccagg

SEQ ID NO: 3484272 - DNA, 16 bp, Homo sapiens
tggtgtgatcgtctga

SEQ ID NO: 3484273 - DNA, 19 bp, Homo sapiens
tggtgtgtccccctctgtc

SEQ ID NO: 3484274 - DNA, 17 bp, Homo sapiens
tggtgttttatttccta

SEQ ID NO: 3484275 - DNA, 17 bp, Homo sapiens
tggttaaaaaaaagaat

SEQ ID NO: 3484276 - DNA, 22 bp, Homo sapiens
tggttaggatggcaggacgtgg

SEQ ID NO: 3484277 - DNA, 15 bp, Homo sapiens
tggttctaatagaac

SEQ ID NO: 3484278 - DNA, 13 bp, Homo sapiens
tggttctcatctt

SEQ ID NO: 3484279 - DNA, 15 bp, Homo sapiens
tggttctcatctttc

SEQ ID NO: 3484280 - DNA, 16 bp, Homo sapiens
tggttggctggccttc

SEQ ID NO: 3484281 - DNA, 18 bp, Homo sapiens
tggttgtgtatgggtagc

SEQ ID NO: 3484282 - DNA, 18 bp, Homo sapiens
tggtttatcagcaaaaaa

SEQ ID NO: 3484283 - DNA, 21 bp, Homo sapiens
tggtttctcagaatccaaaga

SEQ ID NO: 3484284 - DNA, 16 bp, Homo sapiens
tggtttgattgtttac

SEQ ID NO: 3484285 - DNA, 16 bp, Homo sapiens
tggtttgccttccaga

SEQ ID NO: 3484286 - DNA, 17 bp, Homo sapiens
tggtttgccttccagaa

SEQ ID NO: 3484287 - DNA, 20 bp, Homo sapiens
tggtttggccatctctggat

SEQ ID NO: 3484288 - DNA, 13 bp, Homo sapiens
tggtttggcctcc

SEQ ID NO: 3484289 - DNA, 19 bp, Homo sapiens
tggttttaggatacttaac

SEQ ID NO: 3484290 - DNA, 21 bp, Homo sapiens
tggttttaggatacttaacaa

SEQ ID NO: 3484291 - DNA, 16 bp, Homo sapiens
tggttttgttcccctc

SEQ ID NO: 3484292 - DNA, 23 bp, Homo sapiens
tggtttttaaaaaatgttttctg

SEQ ID NO: 3484293 - DNA, 21 bp, Homo sapiens
tggtttttaaattttgtaatg

SEQ ID NO: 3484294 - DNA, 13 bp, Homo sapiens
tgtaaaaaattca

SEQ ID NO: 3484295 - DNA, 16 bp, Homo sapiens
tgtaaaaaattcacat

SEQ ID NO: 3484296 - DNA, 14 bp, Homo sapiens
tgtaaaacaaaatt

SEQ ID NO: 3484297 - DNA, 22 bp, Homo sapiens
tgtaaaaggccaaacctctgtt

SEQ ID NO: 3484298 - DNA, 23 bp, Homo sapiens
tgtaaaaggccaaacctctgttc

SEQ ID NO: 3484299 - DNA, 14 bp, Homo sapiens
tgtaaaataaaatt

SEQ ID NO: 3484300 - DNA, 11 bp, Homo sapiens
tgtaaaatata

SEQ ID NO: 3484301 - DNA, 19 bp, Homo sapiens
tgtaaaatatagctgtaca

SEQ ID NO: 3484302 - DNA, 13 bp, Homo sapiens
tgtaaaatctttc

SEQ ID NO: 3484303 - DNA, 18 bp, Homo sapiens
tgtaaacagcctcttttt

SEQ ID NO: 3484304 - DNA, 19 bp, Homo sapiens
tgtaaacataccaacatgt

SEQ ID NO: 3484305 - DNA, 14 bp, Homo sapiens
tgtaaataaaaaga

SEQ ID NO: 3484306 - DNA, 14 bp, Homo sapiens
tgtaaataatctgt

SEQ ID NO: 3484307 - DNA, 12 bp, Homo sapiens
tgtaaatatata

SEQ ID NO: 3484308 - DNA, 14 bp, Homo sapiens
tgtaaatatataaa

SEQ ID NO: 3484309 - DNA, 17 bp, Homo sapiens
tgtaaatatataaatat

SEQ ID NO: 3484310 - DNA, 18 bp, Homo sapiens
tgtaaatatataaatata

SEQ ID NO: 3484311 - DNA, 19 bp, Homo sapiens
tgtaaatatataaatatat

SEQ ID NO: 3484312 - DNA, 15 bp, Homo sapiens
tgtaaattatatttg

SEQ ID NO: 3484313 - DNA, 22 bp, Homo sapiens
tgtaaattatatttgtgctata

SEQ ID NO: 3484314 - DNA, 14 bp, Homo sapiens
tgtaacaagccacc

SEQ ID NO: 3484315 - DNA, 16 bp, Homo sapiens
tgtaacactttacaat

SEQ ID NO: 3484316 - DNA, 17 bp, Homo sapiens
tgtaacatgatgttaac

SEQ ID NO: 3484317 - DNA, 16 bp, Homo sapiens
tgtaaccaatcctact

SEQ ID NO: 3484318 - DNA, 19 bp, Homo sapiens
tgtaacctcttcagaggcc

SEQ ID NO: 3484319 - DNA, 14 bp, Homo sapiens
tgtaaccttgggtg

SEQ ID NO: 3484320 - DNA, 15 bp, Homo sapiens
tgtaactatttcttc

SEQ ID NO: 3484321 - DNA, 21 bp, Homo sapiens
tgtaactggcagttttccatt

SEQ ID NO: 3484322 - DNA, 16 bp, Homo sapiens
tgtaactttttacatt

SEQ ID NO: 3484323 - DNA, 22 bp, Homo sapiens
tgtaactttttacattacagaa

SEQ ID NO: 3484324 - DNA, 17 bp, Homo sapiens
tgtaagaaacacactga

SEQ ID NO: 3484325 - DNA, 15 bp, Homo sapiens
tgtaagaactaaaga

SEQ ID NO: 3484326 - DNA, 12 bp, Homo sapiens
tgtaagaataat

SEQ ID NO: 3484327 - DNA, 18 bp, Homo sapiens
tgtaagaattcagaagac

SEQ ID NO: 3484328 - DNA, 11 bp, Homo sapiens
tgtaagacatt

SEQ ID NO: 3484329 - DNA, 20 bp, Homo sapiens
tgtaagcatactttgtaaat

SEQ ID NO: 3484330 - DNA, 22 bp, Homo sapiens
tgtaagcatactttgtaaatag

SEQ ID NO: 3484331 - DNA, 13 bp, Homo sapiens
tgtaataaacttt

SEQ ID NO: 3484332 - DNA, 17 bp, Homo sapiens
tgtaataaactttaata

SEQ ID NO: 3484333 - DNA, 12 bp, Homo sapiens
tgtaataacatt

SEQ ID NO: 3484334 - DNA, 13 bp, Homo sapiens
tgtaataacattt

SEQ ID NO: 3484335 - DNA, 16 bp, Homo sapiens
tgtaataacatttaat

SEQ ID NO: 3484336 - DNA, 15 bp, Homo sapiens
tgtaatcttgaattg

SEQ ID NO: 3484337 - DNA, 20 bp, Homo sapiens
tgtaatgtgaatctatgctg

SEQ ID NO: 3484338 - DNA, 15 bp, Homo sapiens
tgtaattgttccttt

SEQ ID NO: 3484339 - DNA, 19 bp, Homo sapiens
tgtaatttagtctaacaca

SEQ ID NO: 3484340 - DNA, 19 bp, Homo sapiens
tgtaatttgatgaggtatt

SEQ ID NO: 3484341 - DNA, 17 bp, Homo sapiens
tgtaattttacttttta

SEQ ID NO: 3484342 - DNA, 16 bp, Homo sapiens
tgtaattttatatgaa

SEQ ID NO: 3484343 - DNA, 23 bp, Homo sapiens
tgtaattttgttctagttttcag

SEQ ID NO: 3484344 - DNA, 22 bp, Homo sapiens
tgtacaaaggggaaagaacata

SEQ ID NO: 3484345 - DNA, 14 bp, Homo sapiens
tgtacagacatatt

SEQ ID NO: 3484346 - DNA, 17 bp, Homo sapiens
tgtacagtagattttcc

SEQ ID NO: 3484347 - DNA, 13 bp, Homo sapiens
tgtacatatgtaa

SEQ ID NO: 3484348 - DNA, 15 bp, Homo sapiens
tgtacatatgtaaaa

SEQ ID NO: 3484349 - DNA, 16 bp, Homo sapiens
tgtacatatgtaaaat

SEQ ID NO: 3484350 - DNA, 20 bp, Homo sapiens
tgtacatctattttggattg

SEQ ID NO: 3484351 - DNA, 23 bp, Homo sapiens
tgtacatctattttggattgtat

SEQ ID NO: 3484352 - DNA, 18 bp, Homo sapiens
tgtacatttccaaattca

SEQ ID NO: 3484353 - DNA, 16 bp, Homo sapiens
tgtaccagtgaatttt

SEQ ID NO: 3484354 - DNA, 19 bp, Homo sapiens
tgtaccagtgaatttttgc

SEQ ID NO: 3484355 - DNA, 21 bp, Homo sapiens
tgtaccagtgaatttttgcaa

SEQ ID NO: 3484356 - DNA, 22 bp, Homo sapiens
tgtacccttaagtcaccctagc

SEQ ID NO: 3484357 - DNA, 20 bp, Homo sapiens
tgtaccgatgcagctctctt

SEQ ID NO: 3484358 - DNA, 20 bp, Homo sapiens
tgtacctcctctcagtgttt

SEQ ID NO: 3484359 - DNA, 19 bp, Homo sapiens
tgtactgtttaatgttctg

SEQ ID NO: 3484360 - DNA, 13 bp, Homo sapiens
tgtactgtttgct

SEQ ID NO: 3484361 - DNA, 12 bp, Homo sapiens
tgtacttagaaa

SEQ ID NO: 3484362 - DNA, 14 bp, Homo sapiens
tgtacttgtttgca

SEQ ID NO: 3484363 - DNA, 18 bp, Homo sapiens
tgtactttgcttgctcat

SEQ ID NO: 3484364 - DNA, 16 bp, Homo sapiens
tgtacttttaaggcag

SEQ ID NO: 3484365 - DNA, 18 bp, Homo sapiens
tgtacttttcattctctt

SEQ ID NO: 3484366 - DNA, 15 bp, Homo sapiens
tgtactttttagtaa

SEQ ID NO: 3484367 - DNA, 18 bp, Homo sapiens
tgtagaatagcctgtggc

SEQ ID NO: 3484368 - DNA, 18 bp, Homo sapiens
tgtagagccagggtctca

SEQ ID NO: 3484369 - DNA, 14 bp, Homo sapiens
tgtagcaaccattt

SEQ ID NO: 3484370 - DNA, 15 bp, Homo sapiens
tgtagcacttactgg

SEQ ID NO: 3484371 - DNA, 13 bp, Homo sapiens
tgtagccacacca

SEQ ID NO: 3484372 - DNA, 17 bp, Homo sapiens
tgtagccacaccaggat

SEQ ID NO: 3484373 - DNA, 16 bp, Homo sapiens
tgtagccccctggcct

SEQ ID NO: 3484374 - DNA, 19 bp, Homo sapiens
tgtagccccctggcctctg

SEQ ID NO: 3484375 - DNA, 20 bp, Homo sapiens
tgtagccccctggcctctgt

SEQ ID NO: 3484376 - DNA, 15 bp, Homo sapiens
tgtagcctcagatga

SEQ ID NO: 3484377 - DNA, 18 bp, Homo sapiens
tgtaggagaaactcccat

SEQ ID NO: 3484378 - DNA, 15 bp, Homo sapiens
tgtaggagctgcctt

SEQ ID NO: 3484379 - DNA, 13 bp, Homo sapiens
tgtaggcagacac

SEQ ID NO: 3484380 - DNA, 16 bp, Homo sapiens
tgtaggcagacacagg

SEQ ID NO: 3484381 - DNA, 13 bp, Homo sapiens
tgtagggagggcg

SEQ ID NO: 3484382 - DNA, 16 bp, Homo sapiens
tgtaggtaaattctta

SEQ ID NO: 3484383 - DNA, 14 bp, Homo sapiens
tgtaggtgaacagt

SEQ ID NO: 3484384 - DNA, 14 bp, Homo sapiens
tgtagtaagagctt

SEQ ID NO: 3484385 - DNA, 15 bp, Homo sapiens
tgtagtaattgacat

SEQ ID NO: 3484386 - DNA, 21 bp, Homo sapiens
tgtagtcctcataaaaagcaa

SEQ ID NO: 3484387 - DNA, 17 bp, Homo sapiens
tgtagttaaggagccta

SEQ ID NO: 3484388 - DNA, 18 bp, Homo sapiens
tgtagttaggcctggctc

SEQ ID NO: 3484389 - DNA, 16 bp, Homo sapiens
tgtagttgacaattct

SEQ ID NO: 3484390 - DNA, 16 bp, Homo sapiens
tgtataaaatcagcca

SEQ ID NO: 3484391 - DNA, 19 bp, Homo sapiens
tgtataagtggaggcactt

SEQ ID NO: 3484392 - DNA, 23 bp, Homo sapiens
tgtataagttatttttgtacatg

SEQ ID NO: 3484393 - DNA, 20 bp, Homo sapiens
tgtataatttttttcttgta

SEQ ID NO: 3484394 - DNA, 16 bp, Homo sapiens
tgtttggtattgtatt

SEQ ID NO: 3484395 - DNA, 18 bp, Homo sapiens
tgtttgtaactttttaca

SEQ ID NO: 3484396 - DNA, 15 bp, Homo sapiens
tgtttgtattgtaaa

SEQ ID NO: 3484397 - DNA, 19 bp, Homo sapiens
tgtttgtattgtaaaaaat

SEQ ID NO: 3484398 - DNA, 22 bp, Homo sapiens
tgttttaaagaatatgactttt

SEQ ID NO: 3484399 - DNA, 13 bp, Homo sapiens
tgttttacaatgt

SEQ ID NO: 3484400 - DNA, 14 bp, Homo sapiens
tgttttatgagaaa

SEQ ID NO: 3484401 - DNA, 14 bp, Homo sapiens
tgttttcctccctt

SEQ ID NO: 3484402 - DNA, 23 bp, Homo sapiens
tgttttcctcccttctgctactg

SEQ ID NO: 3484403 - DNA, 14 bp, Homo sapiens
tgttttctttgagg

SEQ ID NO: 3484404 - DNA, 19 bp, Homo sapiens
tgttttggactccatctct

SEQ ID NO: 3484405 - DNA, 16 bp, Homo sapiens
tgttttggattcttta

SEQ ID NO: 3484406 - DNA, 18 bp, Homo sapiens
tgttttggctgaaattct

SEQ ID NO: 3484407 - DNA, 23 bp, Homo sapiens
tgttttggctgaaattctcctgg

SEQ ID NO: 3484408 - DNA, 20 bp, Homo sapiens
tgttttgtaccagtgaattt

SEQ ID NO: 3484409 - DNA, 12 bp, Homo sapiens
tgttttgtagca

SEQ ID NO: 3484410 - DNA, 19 bp, Homo sapiens
tgttttgtagcaaccattt

SEQ ID NO: 3484411 - DNA, 22 bp, Homo sapiens
tgtttttaagctgtttccatag

SEQ ID NO: 3484412 - DNA, 19 bp, Homo sapiens
tgtttttaatgctatttga

SEQ ID NO: 3484413 - DNA, 11 bp, Homo sapiens
tgtttttctct

SEQ ID NO: 3484414 - DNA, 13 bp, Homo sapiens
tgtttttgccact

SEQ ID NO: 3484415 - DNA, 13 bp, Homo sapiens
tgtttttgtctta

SEQ ID NO: 3484416 - DNA, 13 bp, Homo sapiens
ttaaaaaaaaaga

SEQ ID NO: 3484417 - DNA, 14 bp, Homo sapiens
ttaaaaaaaacaaa

SEQ ID NO: 3484418 - DNA, 22 bp, Homo sapiens
ttaaaaaaaacaaaaagaacaa

SEQ ID NO: 3484419 - DNA, 13 bp, Homo sapiens
ttaaaaaaaatcc

SEQ ID NO: 3484420 - DNA, 12 bp, Homo sapiens
ttaaaaaaagaa

SEQ ID NO: 3484421 - DNA, 18 bp, Homo sapiens
ttaaaaaaagaagagaaa

SEQ ID NO: 3484422 - DNA, 16 bp, Homo sapiens
ttaaaaaaatggcagt

SEQ ID NO: 3484423 - DNA, 18 bp, Homo sapiens
ttaaaaaagcaaggcaca

SEQ ID NO: 3484424 - DNA, 16 bp, Homo sapiens
ttaaaaaatattttct

SEQ ID NO: 3484425 - DNA, 20 bp, Homo sapiens
ttaaaaaatattttctctgt

SEQ ID NO: 3484426 - DNA, 18 bp, Homo sapiens
ttaaaaaatgttttctgg

SEQ ID NO: 3484427 - DNA, 15 bp, Homo sapiens
ttaaaaatacacatg

SEQ ID NO: 3484428 - DNA, 12 bp, Homo sapiens
ttaaaaatcaac

SEQ ID NO: 3484429 - DNA, 23 bp, Homo sapiens
ttaaaaatcaactttttattgcc

SEQ ID NO: 3484430 - DNA, 17 bp, Homo sapiens
ttaaaacaacactcaca

SEQ ID NO: 3484431 - DNA, 22 bp, Homo sapiens
ttaaaagatgcttttaacagag

SEQ ID NO: 3484432 - DNA, 19 bp, Homo sapiens
ttaaaataaactgtaaact

SEQ ID NO: 3484433 - DNA, 20 bp, Homo sapiens
ttaaaataaactgtaaacta

SEQ ID NO: 3484434 - DNA, 22 bp, Homo sapiens
ttaaaataaactgtaaactaat

SEQ ID NO: 3484435 - DNA, 15 bp, Homo sapiens
ttaaaataactagtg

SEQ ID NO: 3484436 - DNA, 12 bp, Homo sapiens
ttaaaatcctca

SEQ ID NO: 3484437 - DNA, 14 bp, Homo sapiens
ttaaacacccctca

SEQ ID NO: 3484438 - DNA, 22 bp, Homo sapiens
ttaaacctgtttttttttcatt

SEQ ID NO: 3484439 - DNA, 13 bp, Homo sapiens
ttaaataaattgt

SEQ ID NO: 3484440 - DNA, 18 bp, Homo sapiens
ttaaataaattgtatatt

SEQ ID NO: 3484441 - DNA, 20 bp, Homo sapiens
ttaaataaattgtatattca

SEQ ID NO: 3484442 - DNA, 15 bp, Homo sapiens
ttaaataatttccta

SEQ ID NO: 3484443 - DNA, 15 bp, Homo sapiens
ttaaatacaaaactt

SEQ ID NO: 3484444 - DNA, 13 bp, Homo sapiens
ttaaatattttct

SEQ ID NO: 3484445 - DNA, 19 bp, Homo sapiens
ttaaatgtacagacatatt

SEQ ID NO: 3484446 - DNA, 14 bp, Homo sapiens
ttaaattttgtaat

SEQ ID NO: 3484447 - DNA, 16 bp, Homo sapiens
ttaaattttgtgtctc

SEQ ID NO: 3484448 - DNA, 19 bp, Homo sapiens
ttaacaaaaagtgcttcat

SEQ ID NO: 3484449 - DNA, 13 bp, Homo sapiens
ttaacaaatacat

SEQ ID NO: 3484450 - DNA, 14 bp, Homo sapiens
ttaacaaatacatt

SEQ ID NO: 3484451 - DNA, 21 bp, Homo sapiens
ttaacaactgtagcaagaact

SEQ ID NO: 3484452 - DNA, 14 bp, Homo sapiens
ttaacagaaaaaca

SEQ ID NO: 3484453 - DNA, 20 bp, Homo sapiens
ttaacagcatgacaaaaatt

SEQ ID NO: 3484454 - DNA, 23 bp, Homo sapiens
ttaacagcatgacaaaaattatt

SEQ ID NO: 3484455 - DNA, 13 bp, Homo sapiens
ttaacagggaggg

SEQ ID NO: 3484456 - DNA, 13 bp, Homo sapiens
ttaacatgatgta

SEQ ID NO: 3484457 - DNA, 22 bp, Homo sapiens
ttaacatttgtgtaatatgaaa

SEQ ID NO: 3484458 - DNA, 14 bp, Homo sapiens
ttaaccaaaggtga

SEQ ID NO: 3484459 - DNA, 19 bp, Homo sapiens
ttaaccagatggttgtgta

SEQ ID NO: 3484460 - DNA, 21 bp, Homo sapiens
ttaacccttcatcttcctgtg

SEQ ID NO: 3484461 - DNA, 18 bp, Homo sapiens
ttaactactatattgatt

SEQ ID NO: 3484462 - DNA, 12 bp, Homo sapiens
ttaactagaatt

SEQ ID NO: 3484463 - DNA, 14 bp, Homo sapiens
ttaactagaattta

SEQ ID NO: 3484464 - DNA, 15 bp, Homo sapiens
ttaactagaatttat

SEQ ID NO: 3484465 - DNA, 21 bp, Homo sapiens
ttaactccctttttacacttt

SEQ ID NO: 3484466 - DNA, 22 bp, Homo sapiens
ttaactccctttttacacttta

SEQ ID NO: 3484467 - DNA, 12 bp, Homo sapiens
ttaactctgtct

SEQ ID NO: 3484468 - DNA, 17 bp, Homo sapiens
ttaactgccaatcctta

SEQ ID NO: 3484469 - DNA, 22 bp, Homo sapiens
ttaactggaaggctgctttctc

SEQ ID NO: 3484470 - DNA, 22 bp, Homo sapiens
ttaagaaaatcatattgcttct

SEQ ID NO: 3484471 - DNA, 12 bp, Homo sapiens
ttaagaaggcaa

SEQ ID NO: 3484472 - DNA, 16 bp, Homo sapiens
ttaagaatttcacaag

SEQ ID NO: 3484473 - DNA, 16 bp, Homo sapiens
ttaagacgtgtttgtg

SEQ ID NO: 3484474 - DNA, 16 bp, Homo sapiens
ttaagatgccttgaat

SEQ ID NO: 3484475 - DNA, 21 bp, Homo sapiens
ttaagatgccttgaattgtct

SEQ ID NO: 3484476 - DNA, 19 bp, Homo sapiens
ttaagatggtaagacctct

SEQ ID NO: 3484477 - DNA, 20 bp, Homo sapiens
ttaagatggtaagacctctg

SEQ ID NO: 3484478 - DNA, 19 bp, Homo sapiens
ttaagcaaaagaaaaagat

SEQ ID NO: 3484479 - DNA, 14 bp, Homo sapiens
ttaagcaacatctt

SEQ ID NO: 3484480 - DNA, 21 bp, Homo sapiens
ttaagccacttaaaatgttca

SEQ ID NO: 3484481 - DNA, 14 bp, Homo sapiens
ttaagctgtttcca

SEQ ID NO: 3484482 - DNA, 17 bp, Homo sapiens
ttaaggacactggggtc

SEQ ID NO: 3484483 - DNA, 11 bp, Homo sapiens
ttaaggcctga

SEQ ID NO: 3484484 - DNA, 15 bp, Homo sapiens
ttaaggcctgaatca

SEQ ID NO: 3484485 - DNA, 16 bp, Homo sapiens
ttaaggctaaaaagta

SEQ ID NO: 3484486 - DNA, 15 bp, Homo sapiens
ttaaggggaagataa

SEQ ID NO: 3484487 - DNA, 20 bp, Homo sapiens
ttaaggtgaggcctgtctgt

SEQ ID NO: 3484488 - DNA, 21 bp, Homo sapiens
ttaaggtgaggcctgtctgtg

SEQ ID NO: 3484489 - DNA, 18 bp, Homo sapiens
ttaaggtgatatatttaa

SEQ ID NO: 3484490 - DNA, 14 bp, Homo sapiens
ttaaggtgtagcca

SEQ ID NO: 3484491 - DNA, 15 bp, Homo sapiens
ttaagtattgcatct

SEQ ID NO: 3484492 - DNA, 20 bp, Homo sapiens
ttaagtattgcatctgtata

SEQ ID NO: 3484493 - DNA, 21 bp, Homo sapiens
ttaagtattgcatctgtataa

SEQ ID NO: 3484494 - DNA, 14 bp, Homo sapiens
ttaataaagatgat

SEQ ID NO: 3484495 - DNA, 18 bp, Homo sapiens
ttaataaagatgattgaa

SEQ ID NO: 3484496 - DNA, 17 bp, Homo sapiens
ttaatactaccttgaaa

SEQ ID NO: 3484497 - DNA, 17 bp, Homo sapiens
ttaatagggaatatatc

SEQ ID NO: 3484498 - DNA, 17 bp, Homo sapiens
ttaatagtaatttgtaa

SEQ ID NO: 3484499 - DNA, 15 bp, Homo sapiens
ttaatatgaaaactt

SEQ ID NO: 3484500 - DNA, 18 bp, Homo sapiens
ttaatatgctgcaacaaa

SEQ ID NO: 3484501 - DNA, 22 bp, Homo sapiens
ttaatattaaaaagtctgtatg

SEQ ID NO: 3484502 - DNA, 19 bp, Homo sapiens
ttaatatttaacctctttt

SEQ ID NO: 3484503 - DNA, 12 bp, Homo sapiens
ttaatatttgct

SEQ ID NO: 3484504 - DNA, 20 bp, Homo sapiens
ttaatatttgctgacagctg

SEQ ID NO: 3484505 - DNA, 16 bp, Homo sapiens
ttaatattttgttctt

SEQ ID NO: 3484506 - DNA, 19 bp, Homo sapiens
ttaatattttgttcttatt

SEQ ID NO: 3484507 - DNA, 18 bp, Homo sapiens
ttaatccccagtaaaatt

SEQ ID NO: 3484508 - DNA, 15 bp, Homo sapiens
ttaatcttgctttct

SEQ ID NO: 3484509 - DNA, 14 bp, Homo sapiens
ttaatgaaaaggaa

SEQ ID NO: 3484510 - DNA, 23 bp, Homo sapiens
ttaatgaagaaagtggaaaacaa

SEQ ID NO: 3484511 - DNA, 17 bp, Homo sapiens
ttaatgaagtttgaatg

SEQ ID NO: 3484512 - DNA, 14 bp, Homo sapiens
ttaatgacacttgt

SEQ ID NO: 3484513 - DNA, 16 bp, Homo sapiens
ttaatgctatttgaac

SEQ ID NO: 3484514 - DNA, 10 bp, Homo sapiens
ttaatgtttt

SEQ ID NO: 3484515 - DNA, 18 bp, Homo sapiens
ttaatgttttaaatgtac

SEQ ID NO: 3484516 - DNA, 14 bp, Homo sapiens
ttaattagtgctaa

SEQ ID NO: 3484517 - DNA, 14 bp, Homo sapiens
ttaattcatgtttc

SEQ ID NO: 3484518 - DNA, 15 bp, Homo sapiens
ttaattgaaagtata

SEQ ID NO: 3484519 - DNA, 18 bp, Homo sapiens
ttaatttagatattttcc

SEQ ID NO: 3484520 - DNA, 21 bp, Homo sapiens
ttaatttagatattttccata

SEQ ID NO: 3484521 - DNA, 16 bp, Homo sapiens
ttaatttaggacacat

SEQ ID NO: 3484522 - DNA, 14 bp, Homo sapiens
ttaatttatgcaga

SEQ ID NO: 3484523 - DNA, 18 bp, Homo sapiens
ttaattttttggtacaaa

SEQ ID NO: 3484524 - DNA, 17 bp, Homo sapiens
ttaatttttttaaccaa

SEQ ID NO: 3484525 - DNA, 18 bp, Homo sapiens
ttaatttttttaaccaaa

SEQ ID NO: 3484526 - DNA, 22 bp, Homo sapiens
ttaatttttttaaccaaaggtg

SEQ ID NO: 3484527 - DNA, 19 bp, Homo sapiens
ttcccaggaccctgaaggg

SEQ ID NO: 3484528 - DNA, 12 bp, Homo sapiens
ttcccaggtgct

SEQ ID NO: 3484529 - DNA, 19 bp, Homo sapiens
ttcccagtggctgctgccc

SEQ ID NO: 3484530 - DNA, 21 bp, Homo sapiens
ttcccagtggctgctgcccag

SEQ ID NO: 3484531 - DNA, 19 bp, Homo sapiens
ttcccatgacccaggctgg

SEQ ID NO: 3484532 - DNA, 20 bp, Homo sapiens
ttcccatgacccaggctggg

SEQ ID NO: 3484533 - DNA, 15 bp, Homo sapiens
ttcccatggggaggg

SEQ ID NO: 3484534 - DNA, 17 bp, Homo sapiens
ttcccatgtagccccct

SEQ ID NO: 3484535 - DNA, 11 bp, Homo sapiens
ttccccacaga

SEQ ID NO: 3484536 - DNA, 22 bp, Homo sapiens
ttccccacttctgtgccacccc

SEQ ID NO: 3484537 - DNA, 19 bp, Homo sapiens
ttccccatctcaggccaga

SEQ ID NO: 3484538 - DNA, 18 bp, Homo sapiens
ttccccatcttctaaacc

SEQ ID NO: 3484539 - DNA, 15 bp, Homo sapiens
ttcccccactgatca

SEQ ID NO: 3484540 - DNA, 19 bp, Homo sapiens
ttcccctaacctcattccc

SEQ ID NO: 3484541 - DNA, 22 bp, Homo sapiens
ttcccctcagaaaaaaattcat

SEQ ID NO: 3484542 - DNA, 11 bp, Homo sapiens
ttcccctctcc

SEQ ID NO: 3484543 - DNA, 12 bp, Homo sapiens
ttcccctgcctc

SEQ ID NO: 3484544 - DNA, 13 bp, Homo sapiens
ttcccctgcctcc

SEQ ID NO: 3484545 - DNA, 16 bp, Homo sapiens
ttcccctggggaccca

SEQ ID NO: 3484546 - DNA, 21 bp, Homo sapiens
ttcccctggggacccacgtgg

SEQ ID NO: 3484547 - DNA, 15 bp, Homo sapiens
ttcccctgtgtcatc

SEQ ID NO: 3484548 - DNA, 14 bp, Homo sapiens
ttccccttccactg

SEQ ID NO: 3484549 - DNA, 15 bp, Homo sapiens
ttccccttccactga

SEQ ID NO: 3484550 - DNA, 19 bp, Homo sapiens
ttcccctttcctgtcccac

SEQ ID NO: 3484551 - DNA, 16 bp, Homo sapiens
ttccccttttgccaat

SEQ ID NO: 3484552 - DNA, 23 bp, Homo sapiens
ttcccgaaccccaaggagggaga

SEQ ID NO: 3484553 - DNA, 13 bp, Homo sapiens
ttcccgccggagg

SEQ ID NO: 3484554 - DNA, 14 bp, Homo sapiens
ttccctaacactta

SEQ ID NO: 3484555 - DNA, 16 bp, Homo sapiens
ttccctaatctatggt

SEQ ID NO: 3484556 - DNA, 22 bp, Homo sapiens
ttccctagaaacttccaaatcc

SEQ ID NO: 3484557 - DNA, 14 bp, Homo sapiens
ttccctctccctgt

SEQ ID NO: 3484558 - DNA, 19 bp, Homo sapiens
ttccctgcgcctgtgatgc

SEQ ID NO: 3484559 - DNA, 16 bp, Homo sapiens
ttcccttgtaaacaga

SEQ ID NO: 3484560 - DNA, 17 bp, Homo sapiens
ttccctttggagatgct

SEQ ID NO: 3484561 - DNA, 21 bp, Homo sapiens
ttcccttttaaacacattttg

SEQ ID NO: 3484562 - DNA, 17 bp, Homo sapiens
ttcccttttacatactg

SEQ ID NO: 3484563 - DNA, 19 bp, Homo sapiens
ttccgcttggagcagaggg

SEQ ID NO: 3484564 - DNA, 19 bp, Homo sapiens
ttccgtcaacgttgtactg

SEQ ID NO: 3484565 - DNA, 17 bp, Homo sapiens
ttccgtgaaaacggagc

SEQ ID NO: 3484566 - DNA, 14 bp, Homo sapiens
ttccgttgtctgtg

SEQ ID NO: 3484567 - DNA, 18 bp, Homo sapiens
ttcctaaatattatgaga

SEQ ID NO: 3484568 - DNA, 16 bp, Homo sapiens
ttcctaatatcaaatg

SEQ ID NO: 3484569 - DNA, 16 bp, Homo sapiens
ttcctaccctgcctcc

SEQ ID NO: 3484570 - DNA, 19 bp, Homo sapiens
ttcctagatggcagtcact

SEQ ID NO: 3484571 - DNA, 21 bp, Homo sapiens
ttcctaggaaaaaaggaataa

SEQ ID NO: 3484572 - DNA, 16 bp, Homo sapiens
ttcctagttctgtaga

SEQ ID NO: 3484573 - DNA, 19 bp, Homo sapiens
ttcctatacgcagcgtgct

SEQ ID NO: 3484574 - DNA, 19 bp, Homo sapiens
ttcctatatagtttattga

SEQ ID NO: 3484575 - DNA, 14 bp, Homo sapiens
ttcctatgacacag

SEQ ID NO: 3484576 - DNA, 17 bp, Homo sapiens
ttcctatttttaaataa

SEQ ID NO: 3484577 - DNA, 14 bp, Homo sapiens
ttcctcattaaatt

SEQ ID NO: 3484578 - DNA, 13 bp, Homo sapiens
ttcctcattagca

SEQ ID NO: 3484579 - DNA, 14 bp, Homo sapiens
ttcctcccttctgc

SEQ ID NO: 3484580 - DNA, 16 bp, Homo sapiens
ttcctcccttctgcta

SEQ ID NO: 3484581 - DNA, 20 bp, Homo sapiens
ttcctcctcaggcacacagc

SEQ ID NO: 3484582 - DNA, 20 bp, Homo sapiens
ttcctcctctgacttgggga

SEQ ID NO: 3484583 - DNA, 14 bp, Homo sapiens
ttcctcctgggccc

SEQ ID NO: 3484584 - DNA, 21 bp, Homo sapiens
ttcctcctgggccctctctgc

SEQ ID NO: 3484585 - DNA, 23 bp, Homo sapiens
ttcctcctgggccctctctgctc

SEQ ID NO: 3484586 - DNA, 15 bp, Homo sapiens
ttcctccttccatgg

SEQ ID NO: 3484587 - DNA, 15 bp, Homo sapiens
ttcctctccttcctt

SEQ ID NO: 3484588 - DNA, 19 bp, Homo sapiens
ttcctcttccgggcagaaa

SEQ ID NO: 3484589 - DNA, 15 bp, Homo sapiens
ttcctctttgctttg

SEQ ID NO: 3484590 - DNA, 22 bp, Homo sapiens
ttcctctttgctttgctttctg

SEQ ID NO: 3484591 - DNA, 18 bp, Homo sapiens
ttcctgaaacaacttgga

SEQ ID NO: 3484592 - DNA, 17 bp, Homo sapiens
ttcctgaaactatattt

SEQ ID NO: 3484593 - DNA, 16 bp, Homo sapiens
ttcctgactctcacct

SEQ ID NO: 3484594 - DNA, 18 bp, Homo sapiens
ttcctgactctcacctgt

SEQ ID NO: 3484595 - DNA, 21 bp, Homo sapiens
ttcctgatggcaggatggcct

SEQ ID NO: 3484596 - DNA, 17 bp, Homo sapiens
ttcctgccactgtgtaa

SEQ ID NO: 3484597 - DNA, 17 bp, Homo sapiens
ttcctgccaggcatggt

SEQ ID NO: 3484598 - DNA, 18 bp, Homo sapiens
ttcctgctgaacgtttcc

SEQ ID NO: 3484599 - DNA, 22 bp, Homo sapiens
ttcctgctgaacgtttccccga

SEQ ID NO: 3484600 - DNA, 15 bp, Homo sapiens
ttcctggatgtctga

SEQ ID NO: 3484601 - DNA, 21 bp, Homo sapiens
ttcctggcactggaccccagc

SEQ ID NO: 3484602 - DNA, 21 bp, Homo sapiens
ttcctgggaaatattccctag

SEQ ID NO: 3484603 - DNA, 14 bp, Homo sapiens
ttcctgtcctccca

SEQ ID NO: 3484604 - DNA, 21 bp, Homo sapiens
ttcctgtgatacatttctgaa

SEQ ID NO: 3484605 - DNA, 22 bp, Homo sapiens
ttcctgtgatacatttctgaat

SEQ ID NO: 3484606 - DNA, 11 bp, Homo sapiens
ttcctgtgtca

SEQ ID NO: 3484607 - DNA, 18 bp, Homo sapiens
ttcctgtgtcaatccaga

SEQ ID NO: 3484608 - DNA, 14 bp, Homo sapiens
ttcctgttcagtaa

SEQ ID NO: 3484609 - DNA, 16 bp, Homo sapiens
ttccttacctttaccc

SEQ ID NO: 3484610 - DNA, 14 bp, Homo sapiens
ttccttccagccca

SEQ ID NO: 3484611 - DNA, 18 bp, Homo sapiens
ttccttcgaaaggccttc

SEQ ID NO: 3484612 - DNA, 14 bp, Homo sapiens
ttccttctcatctg

SEQ ID NO: 3484613 - DNA, 13 bp, Homo sapiens
ttccttctcccat

SEQ ID NO: 3484614 - DNA, 22 bp, Homo sapiens
ttccttgagacacggagcccag

SEQ ID NO: 3484615 - DNA, 19 bp, Homo sapiens
ttccttgcctgcacaaact

SEQ ID NO: 3484616 - DNA, 18 bp, Homo sapiens
ttccttggggcaggcagt

SEQ ID NO: 3484617 - DNA, 21 bp, Homo sapiens
ttccttgttacccatgaaaaa

SEQ ID NO: 3484618 - DNA, 15 bp, Homo sapiens
ttcctttaaaaaact

SEQ ID NO: 3484619 - DNA, 16 bp, Homo sapiens
ttcctttatgttctca

SEQ ID NO: 3484620 - DNA, 14 bp, Homo sapiens
ttcctttccttttc

SEQ ID NO: 3484621 - DNA, 23 bp, Homo sapiens
ttccttttgaacgccccccccca

SEQ ID NO: 3484622 - DNA, 15 bp, Homo sapiens
ttccttttttcccat

SEQ ID NO: 3484623 - DNA, 22 bp, Homo sapiens
ttccttttttcccataagacaa

SEQ ID NO: 3484624 - DNA, 16 bp, Homo sapiens
ttcgagaccagcctgg

SEQ ID NO: 3484625 - DNA, 19 bp, Homo sapiens
ttcgagaccagcctggcca

SEQ ID NO: 3484626 - DNA, 20 bp, Homo sapiens
ttcgatggtacgtgaccctc

SEQ ID NO: 3484627 - DNA, 20 bp, Homo sapiens
ttcgcagagcttttcagatt

SEQ ID NO: 3484628 - DNA, 17 bp, Homo sapiens
ttcgcagctgaagtgga

SEQ ID NO: 3484629 - DNA, 17 bp, Homo sapiens
ttcgcatggtcacacac

SEQ ID NO: 3484630 - DNA, 15 bp, Homo sapiens
ttcgcctggagccct

SEQ ID NO: 3484631 - DNA, 16 bp, Homo sapiens
ttcgcctttcctctct

SEQ ID NO: 3484632 - DNA, 13 bp, Homo sapiens
ttcgctcctgtgt

SEQ ID NO: 3484633 - DNA, 12 bp, Homo sapiens
ttcgctgcaacc

SEQ ID NO: 3484634 - DNA, 15 bp, Homo sapiens
ttcgctgtcccccaa

SEQ ID NO: 3484635 - DNA, 19 bp, Homo sapiens
ttcggaactgtcctttcct

SEQ ID NO: 3484636 - DNA, 20 bp, Homo sapiens
ttcggcagatactgtctctt

SEQ ID NO: 3484637 - DNA, 14 bp, Homo sapiens
ttcgggctggccat

SEQ ID NO: 3484638 - DNA, 21 bp, Homo sapiens
ttcggggtagaggctgggagg

SEQ ID NO: 3484639 - DNA, 21 bp, Homo sapiens
ttcgggtgtgcaatgtctgag

SEQ ID NO: 3484640 - DNA, 18 bp, Homo sapiens
ttcggtgagctacaaatg

SEQ ID NO: 3484641 - DNA, 17 bp, Homo sapiens
ttcgtgaagtatactgt

SEQ ID NO: 3484642 - DNA, 15 bp, Homo sapiens
ttcgtgagccccatc

SEQ ID NO: 3484643 - DNA, 22 bp, Homo sapiens
ttctaaaagtttgaggaatatt

SEQ ID NO: 3484644 - DNA, 20 bp, Homo sapiens
ttctaaaggtgttgtccctt

SEQ ID NO: 3484645 - DNA, 12 bp, Homo sapiens
ttctaagtcttt

SEQ ID NO: 3484646 - DNA, 16 bp, Homo sapiens
ttctacaatgtgaact

SEQ ID NO: 3484647 - DNA, 12 bp, Homo sapiens
ttctacccagcg

SEQ ID NO: 3484648 - DNA, 15 bp, Homo sapiens
ttctagaggctcatg

SEQ ID NO: 3484649 - DNA, 18 bp, Homo sapiens
ttctaggcaaaattgtga

SEQ ID NO: 3484650 - DNA, 19 bp, Homo sapiens
ttctaggcaaaattgtgaa

SEQ ID NO: 3484651 - DNA, 19 bp, Homo sapiens
ttctaggcatctctgtact

SEQ ID NO: 3484652 - DNA, 13 bp, Homo sapiens
ttctaggcctggg

SEQ ID NO: 3484653 - DNA, 23 bp, Homo sapiens
ttctaggtggcaaggctgtgctc

SEQ ID NO: 3484654 - DNA, 14 bp, Homo sapiens
ttctagttttcagt

SEQ ID NO: 3484655 - DNA, 16 bp, Homo sapiens
ttctatagttattaag

SEQ ID NO: 3484656 - DNA, 18 bp, Homo sapiens
ttctattgactttcttaa

SEQ ID NO: 3484657 - DNA, 17 bp, Homo sapiens
ttctatttctcctccat

SEQ ID NO: 3484658 - DNA, 23 bp, Homo sapiens
ttctcaagctggtggcctctgca

SEQ ID NO: 3484659 - DNA, 19 bp, Homo sapiens
ttctcaccagctgcaaagt

SEQ ID NO: 3484660 - DNA, 18 bp, Homo sapiens
ttgtaaaacaaaatttga

SEQ ID NO: 3484661 - DNA, 13 bp, Homo sapiens
ttgtaaaatatag

SEQ ID NO: 3484662 - DNA, 18 bp, Homo sapiens
ttgtaaaatatagctgta

SEQ ID NO: 3484663 - DNA, 12 bp, Homo sapiens
ttgtaaatatat

SEQ ID NO: 3484664 - DNA, 18 bp, Homo sapiens
ttgtaaatatataaatat

SEQ ID NO: 3484665 - DNA, 12 bp, Homo sapiens
ttgtaaattata

SEQ ID NO: 3484666 - DNA, 17 bp, Homo sapiens
ttgtaaattatatttgt

SEQ ID NO: 3484667 - DNA, 20 bp, Homo sapiens
ttgtaactttttacattaca

SEQ ID NO: 3484668 - DNA, 22 bp, Homo sapiens
ttgtaataacatttaatttaga

SEQ ID NO: 3484669 - DNA, 19 bp, Homo sapiens
ttgtacaatcatgttctgg

SEQ ID NO: 3484670 - DNA, 15 bp, Homo sapiens
ttgtacagcccagag

SEQ ID NO: 3484671 - DNA, 16 bp, Homo sapiens
ttgtacagtttaaaat

SEQ ID NO: 3484672 - DNA, 22 bp, Homo sapiens
ttgtacatgaaatttttgtaaa

SEQ ID NO: 3484673 - DNA, 15 bp, Homo sapiens
ttgtaccaactttta

SEQ ID NO: 3484674 - DNA, 12 bp, Homo sapiens
ttgtaccagtga

SEQ ID NO: 3484675 - DNA, 22 bp, Homo sapiens
ttgtaccagtgaatttttgcaa

SEQ ID NO: 3484676 - DNA, 23 bp, Homo sapiens
ttgtaccttttttgttttttcaa

SEQ ID NO: 3484677 - DNA, 23 bp, Homo sapiens
ttgtagagaacacgcgtatttac

SEQ ID NO: 3484678 - DNA, 16 bp, Homo sapiens
ttgtagggttacagag

SEQ ID NO: 3484679 - DNA, 19 bp, Homo sapiens
ttgtagtaagaaacatcca

SEQ ID NO: 3484680 - DNA, 21 bp, Homo sapiens
ttgtatcgatgttatgtaaaa

SEQ ID NO: 3484681 - DNA, 13 bp, Homo sapiens
ttgtattaaactc

SEQ ID NO: 3484682 - DNA, 16 bp, Homo sapiens
ttgtattaaactcttc

SEQ ID NO: 3484683 - DNA, 14 bp, Homo sapiens
ttgtattaaagaca

SEQ ID NO: 3484684 - DNA, 14 bp, Homo sapiens
ttgtattacaaatc

SEQ ID NO: 3484685 - DNA, 14 bp, Homo sapiens
ttgtattacagatg

SEQ ID NO: 3484686 - DNA, 15 bp, Homo sapiens
ttgtattagatgttc

SEQ ID NO: 3484687 - DNA, 17 bp, Homo sapiens
ttgtattagatgttctc

SEQ ID NO: 3484688 - DNA, 17 bp, Homo sapiens
ttgtattatttttgtag

SEQ ID NO: 3484689 - DNA, 15 bp, Homo sapiens
ttgtattctctgagc

SEQ ID NO: 3484690 - DNA, 22 bp, Homo sapiens
ttgtattctctgagctgtgcag

SEQ ID NO: 3484691 - DNA, 13 bp, Homo sapiens
ttgtattgtaaaa

SEQ ID NO: 3484692 - DNA, 19 bp, Homo sapiens
ttgtattgtaaaaaattca

SEQ ID NO: 3484693 - DNA, 23 bp, Homo sapiens
ttgtattgttaatgcatcatcat

SEQ ID NO: 3484694 - DNA, 15 bp, Homo sapiens
ttgtattgtttcaat

SEQ ID NO: 3484695 - DNA, 13 bp, Homo sapiens
ttgtattgttttc

SEQ ID NO: 3484696 - DNA, 14 bp, Homo sapiens
ttgtattgttttct

SEQ ID NO: 3484697 - DNA, 15 bp, Homo sapiens
ttgtatttattcaat

SEQ ID NO: 3484698 - DNA, 21 bp, Homo sapiens
ttgtatttttttgcaagtgaa

SEQ ID NO: 3484699 - DNA, 13 bp, Homo sapiens
ttgtcaaagagag

SEQ ID NO: 3484700 - DNA, 18 bp, Homo sapiens
ttgtcactagcagctgca

SEQ ID NO: 3484701 - DNA, 20 bp, Homo sapiens
ttgtcactagcagctgcagt

SEQ ID NO: 3484702 - DNA, 15 bp, Homo sapiens
ttgtcattagcctga

SEQ ID NO: 3484703 - DNA, 19 bp, Homo sapiens
ttgtcattagcctgagtag

SEQ ID NO: 3484704 - DNA, 20 bp, Homo sapiens
ttgtcattagcctgagtaga

SEQ ID NO: 3484705 - DNA, 19 bp, Homo sapiens
ttgtccagctgagcgccag

SEQ ID NO: 3484706 - DNA, 16 bp, Homo sapiens
ttgtccctctgcccca

SEQ ID NO: 3484707 - DNA, 17 bp, Homo sapiens
ttgtccctctgccccat

SEQ ID NO: 3484708 - DNA, 17 bp, Homo sapiens
ttgtctaaaacaataaa

SEQ ID NO: 3484709 - DNA, 18 bp, Homo sapiens
ttgtctaaaacaataaaa

SEQ ID NO: 3484710 - DNA, 20 bp, Homo sapiens
ttgtctagggtgttctgtac

SEQ ID NO: 3484711 - DNA, 20 bp, Homo sapiens
ttgtctatgggactcaatgc

SEQ ID NO: 3484712 - DNA, 17 bp, Homo sapiens
ttgtctcaatgctcata

SEQ ID NO: 3484713 - DNA, 13 bp, Homo sapiens
ttgtctttttaga

SEQ ID NO: 3484714 - DNA, 19 bp, Homo sapiens
ttgtctttttagatgccca

SEQ ID NO: 3484715 - DNA, 17 bp, Homo sapiens
ttgtgaaccaatgcaag

SEQ ID NO: 3484716 - DNA, 12 bp, Homo sapiens
ttgtgaatgttc

SEQ ID NO: 3484717 - DNA, 16 bp, Homo sapiens
ttgtgacattccttct

SEQ ID NO: 3484718 - DNA, 15 bp, Homo sapiens
ttgtgatagcacttt

SEQ ID NO: 3484719 - DNA, 21 bp, Homo sapiens
ttgtgatagcactttctacaa

SEQ ID NO: 3484720 - DNA, 19 bp, Homo sapiens
ttgtgatgtatattccttt

SEQ ID NO: 3484721 - DNA, 18 bp, Homo sapiens
ttgtgctagaaattttca

SEQ ID NO: 3484722 - DNA, 19 bp, Homo sapiens
ttgtgctatagtatttgat

SEQ ID NO: 3484723 - DNA, 18 bp, Homo sapiens
ttgtggactaaaagatat

SEQ ID NO: 3484724 - DNA, 19 bp, Homo sapiens
ttgtggccaaggagctgct

SEQ ID NO: 3484725 - DNA, 19 bp, Homo sapiens
ttgtgggtttttcatcttt

SEQ ID NO: 3484726 - DNA, 15 bp, Homo sapiens
ttgtgtaatatgaaa

SEQ ID NO: 3484727 - DNA, 22 bp, Homo sapiens
ttgtgtatgggtagcactacta

SEQ ID NO: 3484728 - DNA, 13 bp, Homo sapiens
ttgtgtatttaac

SEQ ID NO: 3484729 - DNA, 14 bp, Homo sapiens
ttgtgtatttaaca

SEQ ID NO: 3484730 - DNA, 19 bp, Homo sapiens
ttgtgtatttacgctttga

SEQ ID NO: 3484731 - DNA, 20 bp, Homo sapiens
ttgtgtatttacgctttgat

SEQ ID NO: 3484732 - DNA, 13 bp, Homo sapiens
ttgtgtgttgtct

SEQ ID NO: 3484733 - DNA, 15 bp, Homo sapiens
ttgtgtgttgtctct

SEQ ID NO: 3484734 - DNA, 17 bp, Homo sapiens
ttgtgtgttgtctcttg

SEQ ID NO: 3484735 - DNA, 19 bp, Homo sapiens
ttgtgttcttcttcatatt

SEQ ID NO: 3484736 - DNA, 13 bp, Homo sapiens
ttgttaaaaataa

SEQ ID NO: 3484737 - DNA, 16 bp, Homo sapiens
ttgttatcagtcaata

SEQ ID NO: 3484738 - DNA, 14 bp, Homo sapiens
ttgttatggcttaa

SEQ ID NO: 3484739 - DNA, 15 bp, Homo sapiens
ttgttattttgcaac

SEQ ID NO: 3484740 - DNA, 22 bp, Homo sapiens
ttgttattttgcaacctcgctg

SEQ ID NO: 3484741 - DNA, 22 bp, Homo sapiens
ttgttccacttgtttgcactgt

SEQ ID NO: 3484742 - DNA, 14 bp, Homo sapiens
ttgttcccctcctc

SEQ ID NO: 3484743 - DNA, 16 bp, Homo sapiens
ttgttctagttttcag

SEQ ID NO: 3484744 - DNA, 15 bp, Homo sapiens
ttgttctttgttctt

SEQ ID NO: 3484745 - DNA, 13 bp, Homo sapiens
ttgttctttttat

SEQ ID NO: 3484746 - DNA, 17 bp, Homo sapiens
ttgttgaacaggtgttt

SEQ ID NO: 3484747 - DNA, 22 bp, Homo sapiens
ttgttgagcatgacagcctgca

SEQ ID NO: 3484748 - DNA, 20 bp, Homo sapiens
ttgttggagtgtttctaata

SEQ ID NO: 3484749 - DNA, 18 bp, Homo sapiens
ttgttggtgaattttcaa

SEQ ID NO: 3484750 - DNA, 15 bp, Homo sapiens
ttgttgtgtgtgcag

SEQ ID NO: 3484751 - DNA, 16 bp, Homo sapiens
ttgtttcaattgcatc

SEQ ID NO: 3484752 - DNA, 14 bp, Homo sapiens
ttgtttctgtgggc

SEQ ID NO: 3484753 - DNA, 12 bp, Homo sapiens
ttgtttgcactg

SEQ ID NO: 3484754 - DNA, 16 bp, Homo sapiens
ttgtttggcaaggaaa

SEQ ID NO: 3484755 - DNA, 15 bp, Homo sapiens
ttgtttggtattgta

SEQ ID NO: 3484756 - DNA, 14 bp, Homo sapiens
ttgtttgtattgta

SEQ ID NO: 3484757 - DNA, 14 bp, Homo sapiens
ttgtttgttttgga

SEQ ID NO: 3484758 - DNA, 18 bp, Homo sapiens
ttgttttaaaattaaagc

SEQ ID NO: 3484759 - DNA, 22 bp, Homo sapiens
ttgttttggctgaaattctcct

SEQ ID NO: 3484760 - DNA, 19 bp, Homo sapiens
ttgtttttcattcagtctt

SEQ ID NO: 3484761 - DNA, 17 bp, Homo sapiens
ttgttttttcaaaatag

SEQ ID NO: 3484762 - DNA, 21 bp, Homo sapiens
tttaaaaatacacatggaaaa

SEQ ID NO: 3484763 - DNA, 23 bp, Homo sapiens
tttaaaaatcaactttttattgc

SEQ ID NO: 3484764 - DNA, 12 bp, Homo sapiens
tttaaaaatgca

SEQ ID NO: 3484765 - DNA, 12 bp, Homo sapiens
tttaaaaatgtc

SEQ ID NO: 3484766 - DNA, 17 bp, Homo sapiens
tttaaaaatgtcttgct

SEQ ID NO: 3484767 - DNA, 16 bp, Homo sapiens
tttaaaagacaagact

SEQ ID NO: 3484768 - DNA, 21 bp, Homo sapiens
tttaaaagagagagagagaaa

SEQ ID NO: 3484769 - DNA, 18 bp, Homo sapiens
tttaaaagagtagaataa

SEQ ID NO: 3484770 - DNA, 13 bp, Homo sapiens
tttaaaagatgct

SEQ ID NO: 3484771 - DNA, 18 bp, Homo sapiens
tttaaaagcagagcattt

SEQ ID NO: 3484772 - DNA, 14 bp, Homo sapiens
tttaaaataaactg

SEQ ID NO: 3484773 - DNA, 20 bp, Homo sapiens
tttaaaatgtaaagccatgc

SEQ ID NO: 3484774 - DNA, 13 bp, Homo sapiens
tttaaacacacag

SEQ ID NO: 3484775 - DNA, 21 bp, Homo sapiens
tttaaactacatcttgaaaat

SEQ ID NO: 3484776 - DNA, 18 bp, Homo sapiens
tttaaatatatgctaagt

SEQ ID NO: 3484777 - DNA, 14 bp, Homo sapiens
tttaaatattttct

SEQ ID NO: 3484778 - DNA, 11 bp, Homo sapiens
tttaaatgtac

SEQ ID NO: 3484779 - DNA, 13 bp, Homo sapiens
tttaaattacaat

SEQ ID NO: 3484780 - DNA, 17 bp, Homo sapiens
tttaacagcatgacaaa

SEQ ID NO: 3484781 - DNA, 17 bp, Homo sapiens
tttaacagctgaattat

SEQ ID NO: 3484782 - DNA, 20 bp, Homo sapiens
tttaacagctgaattatcta

SEQ ID NO: 3484783 - DNA, 22 bp, Homo sapiens
tttaactccctttttacacttt

SEQ ID NO: 3484784 - DNA, 17 bp, Homo sapiens
tttaactggaaggctgc

SEQ ID NO: 3484785 - DNA, 13 bp, Homo sapiens
tttaactggtgaa

SEQ ID NO: 3484786 - DNA, 17 bp, Homo sapiens
tttaactggtgaagaga

SEQ ID NO: 3484787 - DNA, 23 bp, Homo sapiens
tttaactggtgcactttgtaaat

SEQ ID NO: 3484788 - DNA, 13 bp, Homo sapiens
tttaacttctgcc

SEQ ID NO: 3484789 - DNA, 18 bp, Homo sapiens
tttaagaaaaaataacac

SEQ ID NO: 3484790 - DNA, 15 bp, Homo sapiens
tttaagataaattat

SEQ ID NO: 3484791 - DNA, 18 bp, Homo sapiens
tttaagcctgcattctta

SEQ ID NO: 3484792 - DNA, 11 bp, Homo sapiens
tttaaggaaaa

SEQ ID NO: 3484793 - DNA, 22 bp, Homo sapiens
ttttccatggcaggaaggcttg

SEQ ID NO: 3484794 - DNA, 18 bp, Homo sapiens
ttttcccagctacacctt

SEQ ID NO: 3484795 - DNA, 15 bp, Homo sapiens
ttttcccataagaca

SEQ ID NO: 3484796 - DNA, 14 bp, Homo sapiens
ttttccctttgcct

SEQ ID NO: 3484797 - DNA, 20 bp, Homo sapiens
ttttcctatgctattgacaa

SEQ ID NO: 3484798 - DNA, 17 bp, Homo sapiens
ttttcctccctgcttaa

SEQ ID NO: 3484799 - DNA, 18 bp, Homo sapiens
ttttcctccctgcttaaa

SEQ ID NO: 3484800 - DNA, 20 bp, Homo sapiens
ttttcctcccttctgctact

SEQ ID NO: 3484801 - DNA, 12 bp, Homo sapiens
ttttccttaaaa

SEQ ID NO: 3484802 - DNA, 21 bp, Homo sapiens
ttttctaatgaggagagaaaa

SEQ ID NO: 3484803 - DNA, 19 bp, Homo sapiens
ttttctagatacaataaat

SEQ ID NO: 3484804 - DNA, 16 bp, Homo sapiens
ttttctataatttaaa

SEQ ID NO: 3484805 - DNA, 16 bp, Homo sapiens
ttttctctcctgtcct

SEQ ID NO: 3484806 - DNA, 21 bp, Homo sapiens
ttttctcttagaacattgtat

SEQ ID NO: 3484807 - DNA, 19 bp, Homo sapiens
ttttctcttttcacagcaa

SEQ ID NO: 3484808 - DNA, 21 bp, Homo sapiens
ttttctgcacagcttttccaa

SEQ ID NO: 3484809 - DNA, 23 bp, Homo sapiens
ttttctgcacagcttttccaaaa

SEQ ID NO: 3484810 - DNA, 10 bp, Homo sapiens
ttttctgggg

SEQ ID NO: 3484811 - DNA, 16 bp, Homo sapiens
ttttctttaatgcttt

SEQ ID NO: 3484812 - DNA, 15 bp, Homo sapiens
ttttcttttccatta

SEQ ID NO: 3484813 - DNA, 18 bp, Homo sapiens
ttttctttttttaactgg

SEQ ID NO: 3484814 - DNA, 17 bp, Homo sapiens
ttttgaacttttcattc

SEQ ID NO: 3484815 - DNA, 13 bp, Homo sapiens
ttttgaaggcaaa

SEQ ID NO: 3484816 - DNA, 22 bp, Homo sapiens
ttttgaagtgtaggcagacaca

SEQ ID NO: 3484817 - DNA, 15 bp, Homo sapiens
ttttgaattgttaca

SEQ ID NO: 3484818 - DNA, 19 bp, Homo sapiens
ttttgacacttccattgtt

SEQ ID NO: 3484819 - DNA, 21 bp, Homo sapiens
ttttgaccttcatttcatgta

SEQ ID NO: 3484820 - DNA, 18 bp, Homo sapiens
ttttgacttaatgtgatt

SEQ ID NO: 3484821 - DNA, 15 bp, Homo sapiens
ttttgagacagtctt

SEQ ID NO: 3484822 - DNA, 14 bp, Homo sapiens
ttttgagcatgggt

SEQ ID NO: 3484823 - DNA, 18 bp, Homo sapiens
ttttgagtggatgatgtt

SEQ ID NO: 3484824 - DNA, 15 bp, Homo sapiens
ttttgatagcaaagc

SEQ ID NO: 3484825 - DNA, 17 bp, Homo sapiens
ttttgatccaagctggt

SEQ ID NO: 3484826 - DNA, 13 bp, Homo sapiens
ttttgcagaagag

SEQ ID NO: 3484827 - DNA, 21 bp, Homo sapiens
ttttgcagcccagacaaatgt

SEQ ID NO: 3484828 - DNA, 12 bp, Homo sapiens
ttttgcagcttt

SEQ ID NO: 3484829 - DNA, 16 bp, Homo sapiens
ttttggatgcagtgct

SEQ ID NO: 3484830 - DNA, 22 bp, Homo sapiens
ttttggctgaaattctcctgga

SEQ ID NO: 3484831 - DNA, 18 bp, Homo sapiens
ttttggcttgcttatgtg

SEQ ID NO: 3484832 - DNA, 15 bp, Homo sapiens
ttttggtctgtgtga

SEQ ID NO: 3484833 - DNA, 16 bp, Homo sapiens
ttttggttttgttccc

SEQ ID NO: 3484834 - DNA, 21 bp, Homo sapiens
ttttgtaaagatgccgggttt

SEQ ID NO: 3484835 - DNA, 21 bp, Homo sapiens
ttttgtaaatcacatccttat

SEQ ID NO: 3484836 - DNA, 17 bp, Homo sapiens
ttttgtacataaataag

SEQ ID NO: 3484837 - DNA, 11 bp, Homo sapiens
ttttgtacatg

SEQ ID NO: 3484838 - DNA, 11 bp, Homo sapiens
ttttgtaccaa

SEQ ID NO: 3484839 - DNA, 17 bp, Homo sapiens
ttttgtattctctgagc

SEQ ID NO: 3484840 - DNA, 20 bp, Homo sapiens
ttttgtgtcctccaggagct

SEQ ID NO: 3484841 - DNA, 18 bp, Homo sapiens
ttttgttatcagtcaata

SEQ ID NO: 3484842 - DNA, 15 bp, Homo sapiens
ttttgttccacttgt

SEQ ID NO: 3484843 - DNA, 15 bp, Homo sapiens
ttttgttcccctcct

SEQ ID NO: 3484844 - DNA, 21 bp, Homo sapiens
ttttgtttgtattgtaaaaaa

SEQ ID NO: 3484845 - DNA, 17 bp, Homo sapiens
ttttgtttttcattcag

SEQ ID NO: 3484846 - DNA, 19 bp, Homo sapiens
ttttgttttttcaaaatag

SEQ ID NO: 3484847 - DNA, 21 bp, Homo sapiens
tttttaaaaaaataaaacagt

SEQ ID NO: 3484848 - DNA, 12 bp, Homo sapiens
tttttaaaaaat

SEQ ID NO: 3484849 - DNA, 18 bp, Homo sapiens
tttttaaaaactaaaaaa

SEQ ID NO: 3484850 - DNA, 20 bp, Homo sapiens
tttttaaaaatgcaaatcct

SEQ ID NO: 3484851 - DNA, 20 bp, Homo sapiens
tttttaaaataaactgtaaa

SEQ ID NO: 3484852 - DNA, 16 bp, Homo sapiens
tttttaaatattttct

SEQ ID NO: 3484853 - DNA, 16 bp, Homo sapiens
tttttaaattttgtaa

SEQ ID NO: 3484854 - DNA, 19 bp, Homo sapiens
tttttaaattttgtaatga

SEQ ID NO: 3484855 - DNA, 12 bp, Homo sapiens
tttttaaccaaa

SEQ ID NO: 3484856 - DNA, 13 bp, Homo sapiens
tttttaaggacac

SEQ ID NO: 3484857 - DNA, 19 bp, Homo sapiens
tttttacactttatggtaa

SEQ ID NO: 3484858 - DNA, 16 bp, Homo sapiens
tttttacatggagaaa

SEQ ID NO: 3484859 - DNA, 22 bp, Homo sapiens
tttttagacagagtctcactgt

SEQ ID NO: 3484860 - DNA, 18 bp, Homo sapiens
tttttataaaatggctgt

SEQ ID NO: 3484861 - DNA, 12 bp, Homo sapiens
tttttatgatat

SEQ ID NO: 3484862 - DNA, 13 bp, Homo sapiens
tttttatttaaat

SEQ ID NO: 3484863 - DNA, 12 bp, Homo sapiens
tttttatttctg

SEQ ID NO: 3484864 - DNA, 15 bp, Homo sapiens
tttttcaaaatagaa

SEQ ID NO: 3484865 - DNA, 19 bp, Homo sapiens
tttttcacggaagttttca

SEQ ID NO: 3484866 - DNA, 22 bp, Homo sapiens
tttttcacggaagttttcaatg

SEQ ID NO: 3484867 - DNA, 12 bp, Homo sapiens
tttttcatcccc

SEQ ID NO: 3484868 - DNA, 20 bp, Homo sapiens
tttttcatcttttattttgg

SEQ ID NO: 3484869 - DNA, 19 bp, Homo sapiens
tttttcattgccaaaaact

SEQ ID NO: 3484870 - DNA, 19 bp, Homo sapiens
tttttcccagctacacctt

SEQ ID NO: 3484871 - DNA, 15 bp, Homo sapiens
tttttccttaatcca

SEQ ID NO: 3484872 - DNA, 16 bp, Homo sapiens
tttttctgcacagctt

SEQ ID NO: 3484873 - DNA, 14 bp, Homo sapiens
tttttctgcctcct

SEQ ID NO: 3484874 - DNA, 15 bp, Homo sapiens
tttttgaagctgtat

SEQ ID NO: 3484875 - DNA, 14 bp, Homo sapiens
tttttgaagtgtag

SEQ ID NO: 3484876 - DNA, 11 bp, Homo sapiens
tttttgcaata

SEQ ID NO: 3484877 - DNA, 21 bp, Homo sapiens
tttttgccactgatttagcca

SEQ ID NO: 3484878 - DNA, 22 bp, Homo sapiens
tttttgccactgatttagccat

SEQ ID NO: 3484879 - DNA, 12 bp, Homo sapiens
tttttggtacaa

SEQ ID NO: 3484880 - DNA, 19 bp, Homo sapiens
tttttgtagagccagggtc

SEQ ID NO: 3484881 - DNA, 12 bp, Homo sapiens
tttttgtatgtt

SEQ ID NO: 3484882 - DNA, 17 bp, Homo sapiens
tttttgtcaacattgtg

SEQ ID NO: 3484883 - DNA, 15 bp, Homo sapiens
ttttttaactggtga

SEQ ID NO: 3484884 - DNA, 18 bp, Homo sapiens
ttttttcaaaatagaaaa

SEQ ID NO: 3484885 - DNA, 20 bp, Homo sapiens
ttttttcatgttttaacaaa

SEQ ID NO: 3484886 - DNA, 22 bp, Homo sapiens
ttttttccatctttacaaaact

SEQ ID NO: 3484887 - DNA, 15 bp, Homo sapiens
ttttttcccataaga

SEQ ID NO: 3484888 - DNA, 14 bp, Homo sapiens
ttttttccttaaaa

SEQ ID NO: 3484889 - DNA, 12 bp, Homo sapiens
ttttttctgggt

SEQ ID NO: 3484890 - DNA, 12 bp, Homo sapiens
tttttttctggg

SEQ ID NO: 3484891 - DNA, 12 bp, Homo sapiens
tttttttcttta

SEQ ID NO: 3484892 - DNA, 13 bp, Homo sapiens
tttttttgttctt

SEQ ID NO: 3484893 - DNA, 19 bp, Homo sapiens
cctggcacccggcccctgc

SEQ ID NO: 3484894 - DNA, 16 bp, Homo sapiens
cctggcactggacccc

SEQ ID NO: 3484895 - DNA, 20 bp, Homo sapiens
cctggcactggaccccagca

SEQ ID NO: 3484896 - DNA, 14 bp, Homo sapiens
cctggcagctctgg

SEQ ID NO: 3484897 - DNA, 23 bp, Homo sapiens
cctggcagggtcatcctgtgctc

SEQ ID NO: 3484898 - DNA, 21 bp, Homo sapiens
cctggcatcgcaccattctga

SEQ ID NO: 3484899 - DNA, 15 bp, Homo sapiens
cctggccagacacag

SEQ ID NO: 3484900 - DNA, 19 bp, Homo sapiens
cctggccagacacaggccc

SEQ ID NO: 3484901 - DNA, 23 bp, Homo sapiens
cctggccagatgcaccagccctt

SEQ ID NO: 3484902 - DNA, 20 bp, Homo sapiens
cctggccagggcctggaaga

SEQ ID NO: 3484903 - DNA, 13 bp, Homo sapiens
cctggcccactgc

SEQ ID NO: 3484904 - DNA, 12 bp, Homo sapiens
cctggccccagg

SEQ ID NO: 3484905 - DNA, 18 bp, Homo sapiens
cctggccccatggtcagc

SEQ ID NO: 3484906 - DNA, 22 bp, Homo sapiens
cctggccccgcctgcctgccac

SEQ ID NO: 3484907 - DNA, 23 bp, Homo sapiens
cctggccctgttctcctccccaa

SEQ ID NO: 3484908 - DNA, 20 bp, Homo sapiens
cctggcctcccctgccacca

SEQ ID NO: 3484909 - DNA, 11 bp, Homo sapiens
cctggcctcct

SEQ ID NO: 3484910 - DNA, 13 bp, Homo sapiens
cctggcctctgtg

SEQ ID NO: 3484911 - DNA, 13 bp, Homo sapiens
cctggcctgagag

SEQ ID NO: 3484912 - DNA, 14 bp, Homo sapiens
cctggctccttcac

SEQ ID NO: 3484913 - DNA, 14 bp, Homo sapiens
cctggcttcaggca

SEQ ID NO: 3484914 - DNA, 13 bp, Homo sapiens
cctggcttctgtg

SEQ ID NO: 3484915 - DNA, 21 bp, Homo sapiens
cctgggacatcaggagactgg

SEQ ID NO: 3484916 - DNA, 18 bp, Homo sapiens
cctgggacttccatgcct

SEQ ID NO: 3484917 - DNA, 11 bp, Homo sapiens
cctgggccctc

SEQ ID NO: 3484918 - DNA, 15 bp, Homo sapiens
cctgggccctctctg

SEQ ID NO: 3484919 - DNA, 18 bp, Homo sapiens
cctgggccctgggctgga

SEQ ID NO: 3484920 - DNA, 19 bp, Homo sapiens
cctgggccctgggctggaa

SEQ ID NO: 3484921 - DNA, 16 bp, Homo sapiens
cctgggccgctgccac

SEQ ID NO: 3484922 - DNA, 17 bp, Homo sapiens
cctgggccgctgccacg

SEQ ID NO: 3484923 - DNA, 20 bp, Homo sapiens
cctgggccgtatctccggct

SEQ ID NO: 3484924 - DNA, 14 bp, Homo sapiens
cctgggctgggtgg

SEQ ID NO: 3484925 - DNA, 17 bp, Homo sapiens
cctggggaaggagccag

SEQ ID NO: 3484926 - DNA, 17 bp, Homo sapiens
cctggggacccacgtgg

SEQ ID NO: 3484927 - DNA, 16 bp, Homo sapiens
cctggggcctgactgc

SEQ ID NO: 3484928 - DNA, 14 bp, Homo sapiens
cctggggctgctgg

SEQ ID NO: 3484929 - DNA, 15 bp, Homo sapiens
cctggggctggcttt

SEQ ID NO: 3484930 - DNA, 19 bp, Homo sapiens
cctgggggacccctggctc

SEQ ID NO: 3484931 - DNA, 20 bp, Homo sapiens
cctgggggacccctggctct

SEQ ID NO: 3484932 - DNA, 13 bp, Homo sapiens
cctgggggctctc

SEQ ID NO: 3484933 - DNA, 15 bp, Homo sapiens
cctgggggtgccagg

SEQ ID NO: 3484934 - DNA, 14 bp, Homo sapiens
cctgggtggtctgc

SEQ ID NO: 3484935 - DNA, 19 bp, Homo sapiens
cctgggtggtctgcaggca

SEQ ID NO: 3484936 - DNA, 20 bp, Homo sapiens
cctgggtggtctgcaggcag

SEQ ID NO: 3484937 - DNA, 22 bp, Homo sapiens
cctgggtggtctgcaggcaggg

SEQ ID NO: 3484938 - DNA, 16 bp, Homo sapiens
cctgggttgcagacag

SEQ ID NO: 3484939 - DNA, 14 bp, Homo sapiens
cctgggttgctgct

SEQ ID NO: 3484940 - DNA, 22 bp, Homo sapiens
cctgggttttgtattctctgag

SEQ ID NO: 3484941 - DNA, 13 bp, Homo sapiens
cctggtattttca

SEQ ID NO: 3484942 - DNA, 23 bp, Homo sapiens
cctggtcctggcctccttccccg

SEQ ID NO: 3484943 - DNA, 22 bp, Homo sapiens
cctggtgccccccacccctgga

SEQ ID NO: 3484944 - DNA, 12 bp, Homo sapiens
cctggtgctgct

SEQ ID NO: 3484945 - DNA, 17 bp, Homo sapiens
cctggtggcagctgcgg

SEQ ID NO: 3484946 - DNA, 14 bp, Homo sapiens
cctggtggcagtgg

SEQ ID NO: 3484947 - DNA, 19 bp, Homo sapiens
cctggtggcagtgggagct

SEQ ID NO: 3484948 - DNA, 13 bp, Homo sapiens
cctggttctcatc

SEQ ID NO: 3484949 - DNA, 16 bp, Homo sapiens
cctggttctcatcttt

SEQ ID NO: 3484950 - DNA, 14 bp, Homo sapiens
cctggttgaagaag

SEQ ID NO: 3484951 - DNA, 21 bp, Homo sapiens
cctgtaacctcttcagaggcc

SEQ ID NO: 3484952 - DNA, 14 bp, Homo sapiens
cctgtaatcccagc

SEQ ID NO: 3484953 - DNA, 18 bp, Homo sapiens
cctgtaatcccagcactt

SEQ ID NO: 3484954 - DNA, 21 bp, Homo sapiens
cctgtagaatagcctgtggcc

SEQ ID NO: 3484955 - DNA, 17 bp, Homo sapiens
cctgtagcacttactgg

SEQ ID NO: 3484956 - DNA, 16 bp, Homo sapiens
cctgtagcccactctg

SEQ ID NO: 3484957 - DNA, 19 bp, Homo sapiens
cctgtagcccactctgctc

SEQ ID NO: 3484958 - DNA, 24 bp, Homo sapiens
cctgtagcccactctgctcgcctt

SEQ ID NO: 3484959 - DNA, 20 bp, Homo sapiens
cctgtaggcagaggctgccg

SEQ ID NO: 3484960 - DNA, 21 bp, Homo sapiens
cctgtagttaggcctggctca

SEQ ID NO: 3484961 - DNA, 20 bp, Homo sapiens
cctgtagttgacaattctgc

SEQ ID NO: 3484962 - DNA, 23 bp, Homo sapiens
cctgtagttgacaattctgcatg

SEQ ID NO: 3484963 - DNA, 24 bp, Homo sapiens
cctgtagttgacaattctgcatgt

SEQ ID NO: 3484964 - DNA, 16 bp, Homo sapiens
cctgtatatagcccag

SEQ ID NO: 3484965 - DNA, 21 bp, Homo sapiens
cctgtatatagcccagccagg

SEQ ID NO: 3484966 - DNA, 23 bp, Homo sapiens
cctgtatatagcccagccaggcc

SEQ ID NO: 3484967 - DNA, 14 bp, Homo sapiens
cctgtatgtctgtc

SEQ ID NO: 3484968 - DNA, 16 bp, Homo sapiens
cctgtatgtctgtcat

SEQ ID NO: 3484969 - DNA, 19 bp, Homo sapiens
cctgtcaaacaaagccaga

SEQ ID NO: 3484970 - DNA, 16 bp, Homo sapiens
cctgtcattgtattca

SEQ ID NO: 3484971 - DNA, 16 bp, Homo sapiens
cctgtcattttgcact

SEQ ID NO: 3484972 - DNA, 19 bp, Homo sapiens
cctgtcattttgcactgta

SEQ ID NO: 3484973 - DNA, 22 bp, Homo sapiens
cctgtccacacccagctcagca

SEQ ID NO: 3484974 - DNA, 14 bp, Homo sapiens
cctgtccagctcca

SEQ ID NO: 3484975 - DNA, 15 bp, Homo sapiens
cctgtccagctccaa

SEQ ID NO: 3484976 - DNA, 23 bp, Homo sapiens
cctgtccctgcgcctttcctttt

SEQ ID NO: 3484977 - DNA, 22 bp, Homo sapiens
cctgtcctcccagctcctcact

SEQ ID NO: 3484978 - DNA, 18 bp, Homo sapiens
cctgtcctgccatgcaag

SEQ ID NO: 3484979 - DNA, 22 bp, Homo sapiens
cctgtcgggctttgtgtgaagg

SEQ ID NO: 3484980 - DNA, 17 bp, Homo sapiens
cctgtctagagagggag

SEQ ID NO: 3484981 - DNA, 13 bp, Homo sapiens
cctgtctcagcct

SEQ ID NO: 3484982 - DNA, 15 bp, Homo sapiens
cctgtctcagcctcc

SEQ ID NO: 3484983 - DNA, 16 bp, Homo sapiens
cctgtctcagcctccc

SEQ ID NO: 3484984 - DNA, 20 bp, Homo sapiens
cctgtctcggggcttgcccc

SEQ ID NO: 3484985 - DNA, 20 bp, Homo sapiens
cctgtctgccccagcccaga

SEQ ID NO: 3484986 - DNA, 17 bp, Homo sapiens
cctgtcttcctctgcaa

SEQ ID NO: 3484987 - DNA, 22 bp, Homo sapiens
cctgtcttcctctgcaagtgct

SEQ ID NO: 3484988 - DNA, 21 bp, Homo sapiens
cctgtctttcctaagacctgg

SEQ ID NO: 3484989 - DNA, 19 bp, Homo sapiens
cctgtgaaatagttcaaag

SEQ ID NO: 3484990 - DNA, 18 bp, Homo sapiens
cctgtgaagtaaggatgt

SEQ ID NO: 3484991 - DNA, 21 bp, Homo sapiens
cctgtgaatgccactgccttc

SEQ ID NO: 3484992 - DNA, 20 bp, Homo sapiens
cctgtgagcccagctgggtc

SEQ ID NO: 3484993 - DNA, 16 bp, Homo sapiens
cctgtgatgctgggca

SEQ ID NO: 3484994 - DNA, 17 bp, Homo sapiens
cctgtgcaaaaaaatta

SEQ ID NO: 3484995 - DNA, 22 bp, Homo sapiens
cctgtggccccaccctgggccc

SEQ ID NO: 3484996 - DNA, 13 bp, Homo sapiens
cctgtggccctgt

SEQ ID NO: 3484997 - DNA, 13 bp, Homo sapiens
cctgtggctgtgg

SEQ ID NO: 3484998 - DNA, 13 bp, Homo sapiens
cctgtgggcctgg

SEQ ID NO: 3484999 - DNA, 23 bp, Homo sapiens
cctgtggggtcaacccttctgga

SEQ ID NO: 3485000 - DNA, 15 bp, Homo sapiens
cctgtgtcaatccag

SEQ ID NO: 3485001 - DNA, 21 bp, Homo sapiens
cctgtgtcaatccagatggtg

SEQ ID NO: 3485002 - DNA, 13 bp, Homo sapiens
cctgtgtcctgaa

SEQ ID NO: 3485003 - DNA, 21 bp, Homo sapiens
cctgtgtcttgcaatggcagc

SEQ ID NO: 3485004 - DNA, 12 bp, Homo sapiens
cctgtgtggcca

SEQ ID NO: 3485005 - DNA, 20 bp, Homo sapiens
cctgtgtggccacttctgtc

SEQ ID NO: 3485006 - DNA, 21 bp, Homo sapiens
cctgtgtgtccaaaactgcct

SEQ ID NO: 3485007 - DNA, 20 bp, Homo sapiens
cctgtgtgtgcgcctacagg

SEQ ID NO: 3485008 - DNA, 21 bp, Homo sapiens
cctgtgtgtgcgcctacagga

SEQ ID NO: 3485009 - DNA, 20 bp, Homo sapiens
cctgttaacgtcatctcagg

SEQ ID NO: 3485010 - DNA, 23 bp, Homo sapiens
cctgttagacgtcctccgtccat

SEQ ID NO: 3485011 - DNA, 15 bp, Homo sapiens
cctgttcagctccag

SEQ ID NO: 3485012 - DNA, 19 bp, Homo sapiens
cctgttcagctccagctca

SEQ ID NO: 3485013 - DNA, 13 bp, Homo sapiens
cctgttccccaga

SEQ ID NO: 3485014 - DNA, 15 bp, Homo sapiens
cctgttccccagaga

SEQ ID NO: 3485015 - DNA, 16 bp, Homo sapiens
cctgttccccagagaa

SEQ ID NO: 3485016 - DNA, 13 bp, Homo sapiens
cctgttctgaact

SEQ ID NO: 3485017 - DNA, 21 bp, Homo sapiens
cctgttgaagattatttcatt

SEQ ID NO: 3485018 - DNA, 19 bp, Homo sapiens
cctgttgacacaggtcttt

SEQ ID NO: 3485019 - DNA, 17 bp, Homo sapiens
cctgttgagcatcacag

SEQ ID NO: 3485020 - DNA, 22 bp, Homo sapiens
cctgttgctaagccccagcaag

SEQ ID NO: 3485021 - DNA, 23 bp, Homo sapiens
gcctctacctgacactcccttgg

SEQ ID NO: 3485022 - DNA, 18 bp, Homo sapiens
gcctctccccaggtccag

SEQ ID NO: 3485023 - DNA, 22 bp, Homo sapiens
gcctctccccaggtccagctct

SEQ ID NO: 3485024 - DNA, 24 bp, Homo sapiens
gcctctccctgcactccctcctgg

SEQ ID NO: 3485025 - DNA, 20 bp, Homo sapiens
gcctctgacacacagctctg

SEQ ID NO: 3485026 - DNA, 21 bp, Homo sapiens
gcctctgacacacagctctgt

SEQ ID NO: 3485027 - DNA, 20 bp, Homo sapiens
gcctctgcaactgctcagct

SEQ ID NO: 3485028 - DNA, 12 bp, Homo sapiens
gcctctgcctct

SEQ ID NO: 3485029 - DNA, 12 bp, Homo sapiens
gcctctgggtca

SEQ ID NO: 3485030 - DNA, 15 bp, Homo sapiens
gcctctgtccccttc

SEQ ID NO: 3485031 - DNA, 18 bp, Homo sapiens
gcctctgtcttctggact

SEQ ID NO: 3485032 - DNA, 19 bp, Homo sapiens
gcctctgtcttctggactg

SEQ ID NO: 3485033 - DNA, 15 bp, Homo sapiens
gcctcttctgggagg

SEQ ID NO: 3485034 - DNA, 16 bp, Homo sapiens
gcctctttcatccact

SEQ ID NO: 3485035 - DNA, 23 bp, Homo sapiens
gcctctttcatccactagtgcaa

SEQ ID NO: 3485036 - DNA, 18 bp, Homo sapiens
gctcaagtcctcttttct

SEQ ID NO: 3485037 - DNA, 21 bp, Homo sapiens
gctcaagtgttcacaacctgg

SEQ ID NO: 3485038 - DNA, 15 bp, Homo sapiens
gctcaataggaccag

SEQ ID NO: 3485039 - DNA, 16 bp, Homo sapiens
gctcaatcaagaaaat

SEQ ID NO: 3485040 - DNA, 14 bp, Homo sapiens
gctcacactgagaa

SEQ ID NO: 3485041 - DNA, 13 bp, Homo sapiens
gctcaccagcccc

SEQ ID NO: 3485042 - DNA, 18 bp, Homo sapiens
gctcaccagccccagtgc

SEQ ID NO: 3485043 - DNA, 23 bp, Homo sapiens
gctcaccagccccagtgcccaca

SEQ ID NO: 3485044 - DNA, 18 bp, Homo sapiens
gctcacccccttctccat

SEQ ID NO: 3485045 - DNA, 20 bp, Homo sapiens
gctcacgcctgtaatcccag

SEQ ID NO: 3485046 - DNA, 21 bp, Homo sapiens
gctcacgcctgtaatcccagc

SEQ ID NO: 3485047 - DNA, 11 bp, Homo sapiens
gctcactgcag

SEQ ID NO: 3485048 - DNA, 16 bp, Homo sapiens
gctcagaacttgctgc

SEQ ID NO: 3485049 - DNA, 19 bp, Homo sapiens
gctcagaacttgctgctgt

SEQ ID NO: 3485050 - DNA, 18 bp, Homo sapiens
gctcagagagggcaggca

SEQ ID NO: 3485051 - DNA, 17 bp, Homo sapiens
gctcagcaaaagatgct

SEQ ID NO: 3485052 - DNA, 14 bp, Homo sapiens
gctcagccagcact

SEQ ID NO: 3485053 - DNA, 16 bp, Homo sapiens
gctcagcggggacagc

SEQ ID NO: 3485054 - DNA, 19 bp, Homo sapiens
gctcagcggggacagctcc

SEQ ID NO: 3485055 - DNA, 20 bp, Homo sapiens
gctcagcggggacagctcct

SEQ ID NO: 3485056 - DNA, 21 bp, Homo sapiens
gctcagcggggacagctcctt

SEQ ID NO: 3485057 - DNA, 20 bp, Homo sapiens
gctcagctctggtccaggcc

SEQ ID NO: 3485058 - DNA, 17 bp, Homo sapiens
gctcaggactcagaagc

SEQ ID NO: 3485059 - DNA, 13 bp, Homo sapiens
gctcaggagtttg

SEQ ID NO: 3485060 - DNA, 15 bp, Homo sapiens
gctcagggaaaagca

SEQ ID NO: 3485061 - DNA, 12 bp, Homo sapiens
gctcagggaaat

SEQ ID NO: 3485062 - DNA, 21 bp, Homo sapiens
gctcagggaaatggccttccc

SEQ ID NO: 3485063 - DNA, 20 bp, Homo sapiens
gctcagggccatgctgaggc

SEQ ID NO: 3485064 - DNA, 23 bp, Homo sapiens
gctcagggccatgctgaggcctg

SEQ ID NO: 3485065 - DNA, 19 bp, Homo sapiens
gctcaggtccctggggcta

SEQ ID NO: 3485066 - DNA, 18 bp, Homo sapiens
gctcagtgcaacctctgc

SEQ ID NO: 3485067 - DNA, 21 bp, Homo sapiens
gctcagtgcaacctctgcttc

SEQ ID NO: 3485068 - DNA, 16 bp, Homo sapiens
gctcagttcagaatca

SEQ ID NO: 3485069 - DNA, 23 bp, Homo sapiens
gctcagttttacgcaacactaaa

SEQ ID NO: 3485070 - DNA, 19 bp, Homo sapiens
gctcatatgctgacagctc

SEQ ID NO: 3485071 - DNA, 16 bp, Homo sapiens
gctcatcattctctgt

SEQ ID NO: 3485072 - DNA, 20 bp, Homo sapiens
gctcatcattctctgtctca

SEQ ID NO: 3485073 - DNA, 13 bp, Homo sapiens
gctcatctgctgg

SEQ ID NO: 3485074 - DNA, 14 bp, Homo sapiens
gctcatctgctggt

SEQ ID NO: 3485075 - DNA, 20 bp, Homo sapiens
gctcattctgcaccttgcca

SEQ ID NO: 3485076 - DNA, 19 bp, Homo sapiens
gctccaagccccatcttct

SEQ ID NO: 3485077 - DNA, 21 bp, Homo sapiens
gctccaaggggaatcagaact

SEQ ID NO: 3485078 - DNA, 19 bp, Homo sapiens
gctccaccaagaaagcagg

SEQ ID NO: 3485079 - DNA, 16 bp, Homo sapiens
gctccaccctggccga

SEQ ID NO: 3485080 - DNA, 15 bp, Homo sapiens
gctccactctgcttc

SEQ ID NO: 3485081 - DNA, 17 bp, Homo sapiens
gctccactctgcttctc

SEQ ID NO: 3485082 - DNA, 19 bp, Homo sapiens
gctccactctgcttctctg

SEQ ID NO: 3485083 - DNA, 12 bp, Homo sapiens
gctccagacctg

SEQ ID NO: 3485084 - DNA, 21 bp, Homo sapiens
gctccagagggcactctgctt

SEQ ID NO: 3485085 - DNA, 12 bp, Homo sapiens
gctccagctgcc

SEQ ID NO: 3485086 - DNA, 11 bp, Homo sapiens
gctccagctgt

SEQ ID NO: 3485087 - DNA, 20 bp, Homo sapiens
gctccagctgttcagctggt

SEQ ID NO: 3485088 - DNA, 21 bp, Homo sapiens
gctccagctgttcagctggtt

SEQ ID NO: 3485089 - DNA, 13 bp, Homo sapiens
gctccaggcaggc

SEQ ID NO: 3485090 - DNA, 21 bp, Homo sapiens
gctccaggcaggctaaggcgt

SEQ ID NO: 3485091 - DNA, 14 bp, Homo sapiens
gctccatcaatgag

SEQ ID NO: 3485092 - DNA, 22 bp, Homo sapiens
gctccattttcttattgcgctg

SEQ ID NO: 3485093 - DNA, 14 bp, Homo sapiens
gctcccaggtgcag

SEQ ID NO: 3485094 - DNA, 21 bp, Homo sapiens
gctccccaggactcaccctca

SEQ ID NO: 3485095 - DNA, 14 bp, Homo sapiens
gctcccccaggcct

SEQ ID NO: 3485096 - DNA, 20 bp, Homo sapiens
gctcccccaggcctgagctg

SEQ ID NO: 3485097 - DNA, 15 bp, Homo sapiens
gctccctaccacctc

SEQ ID NO: 3485098 - DNA, 21 bp, Homo sapiens
gctccctcccaggactctgac

SEQ ID NO: 3485099 - DNA, 18 bp, Homo sapiens
gctccctggcttctgtgg

SEQ ID NO: 3485100 - DNA, 21 bp, Homo sapiens
gctccgctttctacccagcga

SEQ ID NO: 3485101 - DNA, 16 bp, Homo sapiens
gctcctcagcggctcc

SEQ ID NO: 3485102 - DNA, 18 bp, Homo sapiens
gctcctccctctgaccca

SEQ ID NO: 3485103 - DNA, 14 bp, Homo sapiens
gctcctcctccctg

SEQ ID NO: 3485104 - DNA, 15 bp, Homo sapiens
gctcctcctccctgc

SEQ ID NO: 3485105 - DNA, 15 bp, Homo sapiens
gctcctctccccagc

SEQ ID NO: 3485106 - DNA, 16 bp, Homo sapiens
gctcctctccccagca

SEQ ID NO: 3485107 - DNA, 19 bp, Homo sapiens
gctcctctccccagcaagt

SEQ ID NO: 3485108 - DNA, 16 bp, Homo sapiens
gctcctctccccagcc

SEQ ID NO: 3485109 - DNA, 19 bp, Homo sapiens
gctcctctccccagcccag

SEQ ID NO: 3485110 - DNA, 20 bp, Homo sapiens
gctcctctccccagcccaga

SEQ ID NO: 3485111 - DNA, 21 bp, Homo sapiens
gctcctctccccagcccagag

SEQ ID NO: 3485112 - DNA, 22 bp, Homo sapiens
gctcctctccccagcccagaga

SEQ ID NO: 3485113 - DNA, 15 bp, Homo sapiens
gctcctctctttgtg

SEQ ID NO: 3485114 - DNA, 17 bp, Homo sapiens
gctcctgccgcagagct

SEQ ID NO: 3485115 - DNA, 15 bp, Homo sapiens
gctcctggcccactg

SEQ ID NO: 3485116 - DNA, 18 bp, Homo sapiens
gctcctggcccactgcat

SEQ ID NO: 3485117 - DNA, 13 bp, Homo sapiens
gctcctgtggccc

SEQ ID NO: 3485118 - DNA, 15 bp, Homo sapiens
gctcctgtggcccca

SEQ ID NO: 3485119 - DNA, 14 bp, Homo sapiens
gctccttcctggag

SEQ ID NO: 3485120 - DNA, 13 bp, Homo sapiens
gctccttctgtcc

SEQ ID NO: 3485121 - DNA, 21 bp, Homo sapiens
gctccttctgtcctactctgt

SEQ ID NO: 3485122 - DNA, 17 bp, Homo sapiens
gctccttgggccctttg

SEQ ID NO: 3485123 - DNA, 19 bp, Homo sapiens
gctccttgggccctttgag

SEQ ID NO: 3485124 - DNA, 19 bp, Homo sapiens
gctcctttgtgtgtgtgtc

SEQ ID NO: 3485125 - DNA, 20 bp, Homo sapiens
gctcctttgtgtgtgtgtca

SEQ ID NO: 3485126 - DNA, 22 bp, Homo sapiens
gctcctttgtgtgtgtgtcagc

SEQ ID NO: 3485127 - DNA, 19 bp, Homo sapiens
gctcgagtcacattctgct

SEQ ID NO: 3485128 - DNA, 15 bp, Homo sapiens
gctcggaggaagccc

SEQ ID NO: 3485129 - DNA, 16 bp, Homo sapiens
gctcggctcagctcgg

SEQ ID NO: 3485130 - DNA, 24 bp, Homo sapiens
gctcggtacccggggcccagggca

SEQ ID NO: 3485131 - DNA, 14 bp, Homo sapiens
gctctacccagggc

SEQ ID NO: 3485132 - DNA, 19 bp, Homo sapiens
gctctacccagggcctgca

SEQ ID NO: 3485133 - DNA, 14 bp, Homo sapiens
gctctaggctgccc

SEQ ID NO: 3485134 - DNA, 12 bp, Homo sapiens
gctctagtgcct

SEQ ID NO: 3485135 - DNA, 21 bp, Homo sapiens
gctctattatataaactttat

SEQ ID NO: 3485136 - DNA, 19 bp, Homo sapiens
gctctcacccataataaag

SEQ ID NO: 3485137 - DNA, 17 bp, Homo sapiens
gctctcatctgaggcat

SEQ ID NO: 3485138 - DNA, 22 bp, Homo sapiens
gctctcatctgaggcatccagc

SEQ ID NO: 3485139 - DNA, 19 bp, Homo sapiens
gctctccattcaatttcag

SEQ ID NO: 3485140 - DNA, 16 bp, Homo sapiens
gctctctcttcttatt

SEQ ID NO: 3485141 - DNA, 16 bp, Homo sapiens
gctctgaaaccagtgt

SEQ ID NO: 3485142 - DNA, 19 bp, Homo sapiens
gctctgaagcaaggcggtg

SEQ ID NO: 3485143 - DNA, 21 bp, Homo sapiens
gctctgaccgaaacagcgctg

SEQ ID NO: 3485144 - DNA, 14 bp, Homo sapiens
gctctgagcgcctc

SEQ ID NO: 3485145 - DNA, 23 bp, Homo sapiens
gctctgatcatccactgtgccat

SEQ ID NO: 3485146 - DNA, 13 bp, Homo sapiens
gctctgatccctc

SEQ ID NO: 3485147 - DNA, 23 bp, Homo sapiens
gctctgatccctctacagagctt

SEQ ID NO: 3485148 - DNA, 17 bp, Homo sapiens
gctctgcgtgtcacctg

SEQ ID NO: 3485149 - DNA, 19 bp, Homo sapiens
gctctgctcctctccccag

SEQ ID NO: 3485150 - DNA, 14 bp, Homo sapiens
gctctgcttgacaa

SEQ ID NO: 3485151 - DNA, 21 bp, Homo sapiens
gctctgcttgacaacatctga

SEQ ID NO: 3485152 - DNA, 20 bp, Homo sapiens
gctctggacagccccaccct

SEQ ID NO: 3485153 - DNA, 16 bp, Homo sapiens
gctctggacaggcatg

SEQ ID NO: 3485154 - DNA, 16 bp, Homo sapiens
gctctggaggggaggg

SEQ ID NO: 3485155 - DNA, 21 bp, Homo sapiens
gctctggccaagggccagaca

SEQ ID NO: 3485156 - DNA, 15 bp, Homo sapiens
gctctggccccaggc

SEQ ID NO: 3485157 - DNA, 19 bp, Homo sapiens
gctctggccccaggcttgt

SEQ ID NO: 3485158 - DNA, 11 bp, Homo sapiens
gctctggctct

SEQ ID NO: 3485159 - DNA, 21 bp, Homo sapiens
gctctgggatagctgacccag

SEQ ID NO: 3485160 - DNA, 23 bp, Homo sapiens
gctctgtatcaggacccagagga

SEQ ID NO: 3485161 - DNA, 15 bp, Homo sapiens
gctctgtcctgggag

SEQ ID NO: 3485162 - DNA, 16 bp, Homo sapiens
gctctgtcctgggagt

SEQ ID NO: 3485163 - DNA, 15 bp, Homo sapiens
gctctgtgggtctct

SEQ ID NO: 3485164 - DNA, 16 bp, Homo sapiens
gctctgtgggtgatgg

SEQ ID NO: 3485165 - DNA, 12 bp, Homo sapiens
gctcttcacagt

SEQ ID NO: 3485166 - DNA, 22 bp, Homo sapiens
aatgtcacgttttgttttgtgc

SEQ ID NO: 3485167 - DNA, 23 bp, Homo sapiens
aatgtcacgttttgttttgtgcc

SEQ ID NO: 3485168 - DNA, 19 bp, Homo sapiens
aatgtcatatactgccatg

SEQ ID NO: 3485169 - DNA, 14 bp, Homo sapiens
aatgtctattaagg

SEQ ID NO: 3485170 - DNA, 19 bp, Homo sapiens
aatgtcttgctgttgacat

SEQ ID NO: 3485171 - DNA, 11 bp, Homo sapiens
aatgtcttgtg

SEQ ID NO: 3485172 - DNA, 20 bp, Homo sapiens
aatgtcttttttcaaacttt

SEQ ID NO: 3485173 - DNA, 17 bp, Homo sapiens
aatgtggcctaaaaatg

SEQ ID NO: 3485174 - DNA, 20 bp, Homo sapiens
aatgtggcctaaaaatgcaa

SEQ ID NO: 3485175 - DNA, 21 bp, Homo sapiens
aatgtggcttgagaaatatgg

SEQ ID NO: 3485176 - DNA, 14 bp, Homo sapiens
aatgtgggcagaga

SEQ ID NO: 3485177 - DNA, 16 bp, Homo sapiens
aatgtgtggcctgcac

SEQ ID NO: 3485178 - DNA, 13 bp, Homo sapiens
aatgtgtttcaaa

SEQ ID NO: 3485179 - DNA, 13 bp, Homo sapiens
aatgttaaataaa

SEQ ID NO: 3485180 - DNA, 18 bp, Homo sapiens
aatgttaaataaattgta

SEQ ID NO: 3485181 - DNA, 23 bp, Homo sapiens
aatgttaaataaattgtatattc

SEQ ID NO: 3485182 - DNA, 20 bp, Homo sapiens
aatgttaattttttggtaca

SEQ ID NO: 3485183 - DNA, 13 bp, Homo sapiens
aatgttactgcct

SEQ ID NO: 3485184 - DNA, 22 bp, Homo sapiens
aatgttatcttatactgtacaa

SEQ ID NO: 3485185 - DNA, 21 bp, Homo sapiens
aatgttcatcccatgatgtag

SEQ ID NO: 3485186 - DNA, 12 bp, Homo sapiens
aatgttccagac

SEQ ID NO: 3485187 - DNA, 12 bp, Homo sapiens
aatgttctgtga

SEQ ID NO: 3485188 - DNA, 16 bp, Homo sapiens
aatgttgaaaagtcaa

SEQ ID NO: 3485189 - DNA, 19 bp, Homo sapiens
aatgttgattacagtgcag

SEQ ID NO: 3485190 - DNA, 13 bp, Homo sapiens
aatgttgctggat

SEQ ID NO: 3485191 - DNA, 17 bp, Homo sapiens
aatgttgtatttaattt

SEQ ID NO: 3485192 - DNA, 14 bp, Homo sapiens
aatgtttaatgctg

SEQ ID NO: 3485193 - DNA, 14 bp, Homo sapiens
aatgttttaaatgt

SEQ ID NO: 3485194 - DNA, 15 bp, Homo sapiens
aatgttttaaattct

SEQ ID NO: 3485195 - DNA, 17 bp, Homo sapiens
aatgttttctttgcaaa

SEQ ID NO: 3485196 - DNA, 13 bp, Homo sapiens
aattaaaatggat

SEQ ID NO: 3485197 - DNA, 15 bp, Homo sapiens
aattaataatcttat

SEQ ID NO: 3485198 - DNA, 12 bp, Homo sapiens
aattacaataca

SEQ ID NO: 3485199 - DNA, 14 bp, Homo sapiens
aattacaatacaaa

SEQ ID NO: 3485200 - DNA, 15 bp, Homo sapiens
aattacaattttatc

SEQ ID NO: 3485201 - DNA, 19 bp, Homo sapiens
aattacaattttatctgtt

SEQ ID NO: 3485202 - DNA, 23 bp, Homo sapiens
aattacacagtaagtcatttaac

SEQ ID NO: 3485203 - DNA, 17 bp, Homo sapiens
aattacatgtaaaacat

SEQ ID NO: 3485204 - DNA, 15 bp, Homo sapiens
aattagaatagtgtt

SEQ ID NO: 3485205 - DNA, 15 bp, Homo sapiens
aattagctgcttcta

SEQ ID NO: 3485206 - DNA, 22 bp, Homo sapiens
aattagctttttcatcccctta

SEQ ID NO: 3485207 - DNA, 20 bp, Homo sapiens
aattagtaaaaaatcaatta

SEQ ID NO: 3485208 - DNA, 18 bp, Homo sapiens
aattagtgctaagtgtga

SEQ ID NO: 3485209 - DNA, 20 bp, Homo sapiens
aattagtgctaagtgtgaac

SEQ ID NO: 3485210 - DNA, 21 bp, Homo sapiens
aattataggaatatcaatata

SEQ ID NO: 3485211 - DNA, 22 bp, Homo sapiens
aattatatcagtcctctttcaa

SEQ ID NO: 3485212 - DNA, 22 bp, Homo sapiens
aattatatttgtgctatagtat

SEQ ID NO: 3485213 - DNA, 23 bp, Homo sapiens
aattatatttgtgctatagtatt

SEQ ID NO: 3485214 - DNA, 16 bp, Homo sapiens
aattatctatacatat

SEQ ID NO: 3485215 - DNA, 13 bp, Homo sapiens
aattatgttaaac

SEQ ID NO: 3485216 - DNA, 15 bp, Homo sapiens
aattatgttaaacta

SEQ ID NO: 3485217 - DNA, 21 bp, Homo sapiens
aattatttttttttttgttct

SEQ ID NO: 3485218 - DNA, 22 bp, Homo sapiens
aattatttttttttttgttctt

SEQ ID NO: 3485219 - DNA, 14 bp, Homo sapiens
aattcaattgtaaa

SEQ ID NO: 3485220 - DNA, 17 bp, Homo sapiens
aattcaattgtaaattg

SEQ ID NO: 3485221 - DNA, 13 bp, Homo sapiens
aattcacaaactt

SEQ ID NO: 3485222 - DNA, 19 bp, Homo sapiens
aattcacaaacttttatac

SEQ ID NO: 3485223 - DNA, 21 bp, Homo sapiens
aattcacatctaacctcatct

SEQ ID NO: 3485224 - DNA, 22 bp, Homo sapiens
aattcacatctaacctcatctt

SEQ ID NO: 3485225 - DNA, 19 bp, Homo sapiens
aattcacgccccccttaag

SEQ ID NO: 3485226 - DNA, 12 bp, Homo sapiens
aattcactctga

SEQ ID NO: 3485227 - DNA, 21 bp, Homo sapiens
aattcactttcatttttgata

SEQ ID NO: 3485228 - DNA, 12 bp, Homo sapiens
aattcatttcta

SEQ ID NO: 3485229 - DNA, 13 bp, Homo sapiens
aattcatttctaa

SEQ ID NO: 3485230 - DNA, 13 bp, Homo sapiens
aattccaaagcaa

SEQ ID NO: 3485231 - DNA, 14 bp, Homo sapiens
aattccactgtcaa

SEQ ID NO: 3485232 - DNA, 22 bp, Homo sapiens
aattccactgtcaagaaagagc

SEQ ID NO: 3485233 - DNA, 14 bp, Homo sapiens
aattccccaccctg

SEQ ID NO: 3485234 - DNA, 12 bp, Homo sapiens
aattcctataag

SEQ ID NO: 3485235 - DNA, 17 bp, Homo sapiens
aattcctctttgctttg

SEQ ID NO: 3485236 - DNA, 23 bp, Homo sapiens
aattccttcgaaaggccttcaga

SEQ ID NO: 3485237 - DNA, 16 bp, Homo sapiens
aattctcctgcctttg

SEQ ID NO: 3485238 - DNA, 13 bp, Homo sapiens
aattctcctggag

SEQ ID NO: 3485239 - DNA, 17 bp, Homo sapiens
aattctgaatttgcaaa

SEQ ID NO: 3485240 - DNA, 18 bp, Homo sapiens
aattctgaatttgcaaag

SEQ ID NO: 3485241 - DNA, 19 bp, Homo sapiens
aattctgaatttgcaaagt

SEQ ID NO: 3485242 - DNA, 20 bp, Homo sapiens
aattctgaatttgcaaagta

SEQ ID NO: 3485243 - DNA, 22 bp, Homo sapiens
aattctgtcttgttcattttga

SEQ ID NO: 3485244 - DNA, 16 bp, Homo sapiens
aattctgtttcttgag

SEQ ID NO: 3485245 - DNA, 19 bp, Homo sapiens
aattctgtttttaatgcta

SEQ ID NO: 3485246 - DNA, 21 bp, Homo sapiens
aattctgtttttaatgctatt

SEQ ID NO: 3485247 - DNA, 13 bp, Homo sapiens
aattcttacatgt

SEQ ID NO: 3485248 - DNA, 21 bp, Homo sapiens
aattgaatcagtataaacaaa

SEQ ID NO: 3485249 - DNA, 15 bp, Homo sapiens
aattgacaacccaaa

SEQ ID NO: 3485250 - DNA, 17 bp, Homo sapiens
aattgagttttcagtgg

SEQ ID NO: 3485251 - DNA, 22 bp, Homo sapiens
aattgatttgcattgaacacaa

SEQ ID NO: 3485252 - DNA, 20 bp, Homo sapiens
aattgcacagaagtcctgta

SEQ ID NO: 3485253 - DNA, 14 bp, Homo sapiens
aattgcagaactaa

SEQ ID NO: 3485254 - DNA, 13 bp, Homo sapiens
aattgcagactgt

SEQ ID NO: 3485255 - DNA, 12 bp, Homo sapiens
aattgccatatt

SEQ ID NO: 3485256 - DNA, 23 bp, Homo sapiens
aattgccatattgcacatgtctt

SEQ ID NO: 3485257 - DNA, 16 bp, Homo sapiens
aattgctaatgttgct

SEQ ID NO: 3485258 - DNA, 18 bp, Homo sapiens
aattgctttcctgcctcc

SEQ ID NO: 3485259 - DNA, 16 bp, Homo sapiens
aattgtactaaagcca

SEQ ID NO: 3485260 - DNA, 17 bp, Homo sapiens
aattgtactaaagccaa

SEQ ID NO: 3485261 - DNA, 16 bp, Homo sapiens
aattgtatattcactt

SEQ ID NO: 3485262 - DNA, 20 bp, Homo sapiens
aattgttgaacaggtgtttt

SEQ ID NO: 3485263 - DNA, 22 bp, Homo sapiens
aattgttgaacaggtgtttttc

SEQ ID NO: 3485264 - DNA, 20 bp, Homo sapiens
aattgtttcaaaataaaaac

SEQ ID NO: 3485265 - DNA, 22 bp, Homo sapiens
aattgtttggggatgagaaagg

SEQ ID NO: 3485266 - DNA, 16 bp, Homo sapiens
aattgtttgtctttaa

SEQ ID NO: 3485267 - DNA, 20 bp, Homo sapiens
aatttaaaagcagagcattt

SEQ ID NO: 3485268 - DNA, 18 bp, Homo sapiens
aatttaattcatgtttct

SEQ ID NO: 3485269 - DNA, 14 bp, Homo sapiens
aatttacaaagtgt

SEQ ID NO: 3485270 - DNA, 17 bp, Homo sapiens
aatttacaaagtgtgta

SEQ ID NO: 3485271 - DNA, 18 bp, Homo sapiens
aatttacaaagtgtgtat

SEQ ID NO: 3485272 - DNA, 15 bp, Homo sapiens
aatttagaaaaagaa

SEQ ID NO: 3485273 - DNA, 16 bp, Homo sapiens
aatttagaaaaagaac

SEQ ID NO: 3485274 - DNA, 21 bp, Homo sapiens
aatttagaaaaagaacatgca

SEQ ID NO: 3485275 - DNA, 13 bp, Homo sapiens
aatttagaaacta

SEQ ID NO: 3485276 - DNA, 22 bp, Homo sapiens
aatttagaaactaattgacttt

SEQ ID NO: 3485277 - DNA, 19 bp, Homo sapiens
aatttagatattttccata

SEQ ID NO: 3485278 - DNA, 23 bp, Homo sapiens
aatttagatattttccatatatt

SEQ ID NO: 3485279 - DNA, 15 bp, Homo sapiens
aatttagattgtaaa

SEQ ID NO: 3485280 - DNA, 20 bp, Homo sapiens
aatttagtaaatgttatctt

SEQ ID NO: 3485281 - DNA, 16 bp, Homo sapiens
aatttagtctaacaca

SEQ ID NO: 3485282 - DNA, 21 bp, Homo sapiens
aatttagtctaacacagttga

SEQ ID NO: 3485283 - DNA, 15 bp, Homo sapiens
aatttatacaatatc

SEQ ID NO: 3485284 - DNA, 15 bp, Homo sapiens
aatttatagtaatga

SEQ ID NO: 3485285 - DNA, 12 bp, Homo sapiens
aatttattcaat

SEQ ID NO: 3485286 - DNA, 21 bp, Homo sapiens
aatttattcaattcctctggg

SEQ ID NO: 3485287 - DNA, 18 bp, Homo sapiens
aatttattgcacattgtt

SEQ ID NO: 3485288 - DNA, 16 bp, Homo sapiens
aatttatttcctagtt

SEQ ID NO: 3485289 - DNA, 22 bp, Homo sapiens
aatttattttataagaaaaact

SEQ ID NO: 3485290 - DNA, 23 bp, Homo sapiens
aatttattttataagaaaaactt

SEQ ID NO: 3485291 - DNA, 14 bp, Homo sapiens
aatttcacattaat

SEQ ID NO: 3485292 - DNA, 22 bp, Homo sapiens
aatttcaggttttgtaaagatg

SEQ ID NO: 3485293 - DNA, 15 bp, Homo sapiens
aatttcccaggaccc

SEQ ID NO: 3485294 - DNA, 16 bp, Homo sapiens
aatttcccaggaccct

SEQ ID NO: 3485295 - DNA, 17 bp, Homo sapiens
aatttcccaggaccctg

SEQ ID NO: 3485296 - DNA, 17 bp, Homo sapiens
aatttctactttgaagt

SEQ ID NO: 3485297 - DNA, 13 bp, Homo sapiens
aatttctattaaa

SEQ ID NO: 3485298 - DNA, 14 bp, Homo sapiens
aatttgattgattt

SEQ ID NO: 3485299 - DNA, 14 bp, Homo sapiens
aatttgcaaagtac

SEQ ID NO: 3485300 - DNA, 16 bp, Homo sapiens
aatttgcaaagtactg

SEQ ID NO: 3485301 - DNA, 17 bp, Homo sapiens
aatttgcaaagtactgt

SEQ ID NO: 3485302 - DNA, 19 bp, Homo sapiens
aatttgcaaagtactgtaa

SEQ ID NO: 3485303 - DNA, 15 bp, Homo sapiens
aatacttttccttac

SEQ ID NO: 3485304 - DNA, 20 bp, Homo sapiens
aatacttttccttaccttta

SEQ ID NO: 3485305 - DNA, 16 bp, Homo sapiens
aatactttttctaatg

SEQ ID NO: 3485306 - DNA, 14 bp, Homo sapiens
aatagaaaagttat

SEQ ID NO: 3485307 - DNA, 14 bp, Homo sapiens
aatagagcctgagg

SEQ ID NO: 3485308 - DNA, 18 bp, Homo sapiens
aatagagtatatgcactt

SEQ ID NO: 3485309 - DNA, 20 bp, Homo sapiens
aatagataagagtagaaact

SEQ ID NO: 3485310 - DNA, 16 bp, Homo sapiens
aatagattaggtttgc

SEQ ID NO: 3485311 - DNA, 12 bp, Homo sapiens
aatagcatctgt

SEQ ID NO: 3485312 - DNA, 19 bp, Homo sapiens
aatagcatctgtacaaagg

SEQ ID NO: 3485313 - DNA, 22 bp, Homo sapiens
aatagccacatttggaatactt

SEQ ID NO: 3485314 - DNA, 23 bp, Homo sapiens
aatagccacatttggaatacttt

SEQ ID NO: 3485315 - DNA, 21 bp, Homo sapiens
aatagctgcccatttcgtgag

SEQ ID NO: 3485316 - DNA, 14 bp, Homo sapiens
aataggttcttctt

SEQ ID NO: 3485317 - DNA, 15 bp, Homo sapiens
aatagtaatttgtaa

SEQ ID NO: 3485318 - DNA, 20 bp, Homo sapiens
aatagtctagatggctcctc

SEQ ID NO: 3485319 - DNA, 21 bp, Homo sapiens
aatagtctagatggctcctct

SEQ ID NO: 3485320 - DNA, 21 bp, Homo sapiens
aatagttaagacatgatttcc

SEQ ID NO: 3485321 - DNA, 23 bp, Homo sapiens
aatagttaagacatgatttcctt

SEQ ID NO: 3485322 - DNA, 22 bp, Homo sapiens
aatagttcaaagccaagtttat

SEQ ID NO: 3485323 - DNA, 13 bp, Homo sapiens
aatagttggctag

SEQ ID NO: 3485324 - DNA, 11 bp, Homo sapiens
aatataaaact

SEQ ID NO: 3485325 - DNA, 14 bp, Homo sapiens
aatataaaactgcg

SEQ ID NO: 3485326 - DNA, 19 bp, Homo sapiens
aatataaatgttaagaaaa

SEQ ID NO: 3485327 - DNA, 14 bp, Homo sapiens
aatataatactgta

SEQ ID NO: 3485328 - DNA, 15 bp, Homo sapiens
aatatacttgtggac

SEQ ID NO: 3485329 - DNA, 16 bp, Homo sapiens
aatatacttgtggact

SEQ ID NO: 3485330 - DNA, 19 bp, Homo sapiens
aatatagcatctttcatat

SEQ ID NO: 3485331 - DNA, 16 bp, Homo sapiens
aatatagctgtacaaa

SEQ ID NO: 3485332 - DNA, 18 bp, Homo sapiens
aatatagctgtacaaata

SEQ ID NO: 3485333 - DNA, 14 bp, Homo sapiens
aatatataaatata

SEQ ID NO: 3485334 - DNA, 15 bp, Homo sapiens
aatatatataaacct

SEQ ID NO: 3485335 - DNA, 18 bp, Homo sapiens
aatatatatatatataaa

SEQ ID NO: 3485336 - DNA, 19 bp, Homo sapiens
aatatatatatatataaaa

SEQ ID NO: 3485337 - DNA, 16 bp, Homo sapiens
aatatatatatgtata

SEQ ID NO: 3485338 - DNA, 14 bp, Homo sapiens
aatatatattattc

SEQ ID NO: 3485339 - DNA, 19 bp, Homo sapiens
aatatatattattctcatt

SEQ ID NO: 3485340 - DNA, 22 bp, Homo sapiens
aatatatattattctcatttag

SEQ ID NO: 3485341 - DNA, 14 bp, Homo sapiens
aatatatctctatt

SEQ ID NO: 3485342 - DNA, 20 bp, Homo sapiens
aatatatggcagagttgtaa

SEQ ID NO: 3485343 - DNA, 22 bp, Homo sapiens
aatatatggcagagttgtaaat

SEQ ID NO: 3485344 - DNA, 23 bp, Homo sapiens
aatatatggcagagttgtaaata

SEQ ID NO: 3485345 - DNA, 14 bp, Homo sapiens
aatatatgtatttt

SEQ ID NO: 3485346 - DNA, 24 bp, Homo sapiens
aatatatttgtgtatttaacaggg

SEQ ID NO: 3485347 - DNA, 20 bp, Homo sapiens
aatatcaaatgcagtatatt

SEQ ID NO: 3485348 - DNA, 22 bp, Homo sapiens
aatatcaaatgcagtatatttc

SEQ ID NO: 3485349 - DNA, 14 bp, Homo sapiens
aatatctaaagtta

SEQ ID NO: 3485350 - DNA, 16 bp, Homo sapiens
aatatctaaagttata

SEQ ID NO: 3485351 - DNA, 21 bp, Homo sapiens
aatatgaatgagaatgtgcca

SEQ ID NO: 3485352 - DNA, 19 bp, Homo sapiens
aatatgactttttataaaa

SEQ ID NO: 3485353 - DNA, 16 bp, Homo sapiens
aatatgagaatcagat

SEQ ID NO: 3485354 - DNA, 15 bp, Homo sapiens
aatatgccagcttgg

SEQ ID NO: 3485355 - DNA, 14 bp, Homo sapiens
aatatggaacttac

SEQ ID NO: 3485356 - DNA, 17 bp, Homo sapiens
aatatggaacttacatt

SEQ ID NO: 3485357 - DNA, 20 bp, Homo sapiens
aatatggaacttacattgtt

SEQ ID NO: 3485358 - DNA, 24 bp, Homo sapiens
aatatggaacttacattgttcaat

SEQ ID NO: 3485359 - DNA, 15 bp, Homo sapiens
aatatggttacattt

SEQ ID NO: 3485360 - DNA, 15 bp, Homo sapiens
aatatgtaccaagaa

SEQ ID NO: 3485361 - DNA, 19 bp, Homo sapiens
aatatgtaccaagaatctt

SEQ ID NO: 3485362 - DNA, 17 bp, Homo sapiens
aatatgtcgtagaattc

SEQ ID NO: 3485363 - DNA, 11 bp, Homo sapiens
aatatgtctgc

SEQ ID NO: 3485364 - DNA, 21 bp, Homo sapiens
aatattaaatctgctggagtt

SEQ ID NO: 3485365 - DNA, 15 bp, Homo sapiens
aatattagctttact

SEQ ID NO: 3485366 - DNA, 22 bp, Homo sapiens
aatattatgagatgctggcttg

SEQ ID NO: 3485367 - DNA, 14 bp, Homo sapiens
aatattattgaact

SEQ ID NO: 3485368 - DNA, 21 bp, Homo sapiens
aatattcagaatctttgttaa

SEQ ID NO: 3485369 - DNA, 21 bp, Homo sapiens
aatattcagacaaaatggata

SEQ ID NO: 3485370 - DNA, 13 bp, Homo sapiens
aatattgaatttt

SEQ ID NO: 3485371 - DNA, 20 bp, Homo sapiens
aatattgacaagtgtctttt

SEQ ID NO: 3485372 - DNA, 13 bp, Homo sapiens
aatattgttctct

SEQ ID NO: 3485373 - DNA, 17 bp, Homo sapiens
aatatttaaaaatgtct

SEQ ID NO: 3485374 - DNA, 13 bp, Homo sapiens
aatatttataaaa

SEQ ID NO: 3485375 - DNA, 19 bp, Homo sapiens
aatatttataaaacttctc

SEQ ID NO: 3485376 - DNA, 14 bp, Homo sapiens
aatatttattacct

SEQ ID NO: 3485377 - DNA, 17 bp, Homo sapiens
aatatttattacctctg

SEQ ID NO: 3485378 - DNA, 12 bp, Homo sapiens
aatatttattat

SEQ ID NO: 3485379 - DNA, 19 bp, Homo sapiens
aatatttattattttcacc

SEQ ID NO: 3485380 - DNA, 18 bp, Homo sapiens
aatatttctattgaattc

SEQ ID NO: 3485381 - DNA, 11 bp, Homo sapiens
aatatttgaat

SEQ ID NO: 3485382 - DNA, 13 bp, Homo sapiens
aatatttgaatct

SEQ ID NO: 3485383 - DNA, 10 bp, Homo sapiens
aatattttat

SEQ ID NO: 3485384 - DNA, 17 bp, Homo sapiens
aatattttatctttcct

SEQ ID NO: 3485385 - DNA, 21 bp, Homo sapiens
aatattttcaactatgtaggt

SEQ ID NO: 3485386 - DNA, 14 bp, Homo sapiens
aatattttcctgcc

SEQ ID NO: 3485387 - DNA, 19 bp, Homo sapiens
aatattttctttaatgctt

SEQ ID NO: 3485388 - DNA, 13 bp, Homo sapiens
aatattttgtcta

SEQ ID NO: 3485389 - DNA, 16 bp, Homo sapiens
aatattttgtctaaaa

SEQ ID NO: 3485390 - DNA, 21 bp, Homo sapiens
aatattttgtctaaaatgcct

SEQ ID NO: 3485391 - DNA, 14 bp, Homo sapiens
aatattttttctgt

SEQ ID NO: 3485392 - DNA, 20 bp, Homo sapiens
aatcaaaaccagtgaacttt

SEQ ID NO: 3485393 - DNA, 17 bp, Homo sapiens
aatcaacaccttaatat

SEQ ID NO: 3485394 - DNA, 16 bp, Homo sapiens
aatcaacactaccagc

SEQ ID NO: 3485395 - DNA, 13 bp, Homo sapiens
aatcaacttgctt

SEQ ID NO: 3485396 - DNA, 15 bp, Homo sapiens
aatcaacttgcttat

SEQ ID NO: 3485397 - DNA, 17 bp, Homo sapiens
aatcaacttgcttatca

SEQ ID NO: 3485398 - DNA, 18 bp, Homo sapiens
aatcaacttgcttatcaa

SEQ ID NO: 3485399 - DNA, 23 bp, Homo sapiens
aatcaactttttattgccttctc

SEQ ID NO: 3485400 - DNA, 16 bp, Homo sapiens
aatcaagcaagcctct

SEQ ID NO: 3485401 - DNA, 21 bp, Homo sapiens
aatcaagtctgtttactgcaa

SEQ ID NO: 3485402 - DNA, 19 bp, Homo sapiens
aatcaataaaaaacaaata

SEQ ID NO: 3485403 - DNA, 20 bp, Homo sapiens
aatcaataaaaaacaaatat

SEQ ID NO: 3485404 - DNA, 11 bp, Homo sapiens
aatcagaactc

SEQ ID NO: 3485405 - DNA, 23 bp, Homo sapiens
aatcagaactcaaatggggccag

SEQ ID NO: 3485406 - DNA, 18 bp, Homo sapiens
aatcagagaccaggccct

SEQ ID NO: 3485407 - DNA, 14 bp, Homo sapiens
aatcagcaagaaga

SEQ ID NO: 3485408 - DNA, 14 bp, Homo sapiens
aatcagccaattat

SEQ ID NO: 3485409 - DNA, 19 bp, Homo sapiens
aatcagccaattatgttaa

SEQ ID NO: 3485410 - DNA, 18 bp, Homo sapiens
aatcagcctgctccagct

SEQ ID NO: 3485411 - DNA, 20 bp, Homo sapiens
aatcaggaatattttccaaa

SEQ ID NO: 3485412 - DNA, 14 bp, Homo sapiens
aatcatcaagaagg

SEQ ID NO: 3485413 - DNA, 24 bp, Homo sapiens
aatcatcggagtcagccaggagct

SEQ ID NO: 3485414 - DNA, 22 bp, Homo sapiens
aatcatgttgatcatgtacttt

SEQ ID NO: 3485415 - DNA, 23 bp, Homo sapiens
aatcatgttgatcatgtactttt

SEQ ID NO: 3485416 - DNA, 12 bp, Homo sapiens
aatcatttctat

SEQ ID NO: 3485417 - DNA, 19 bp, Homo sapiens
aatcattttatatgtcaaa

SEQ ID NO: 3485418 - DNA, 23 bp, Homo sapiens
aatcattttatatgtcaaagcag

SEQ ID NO: 3485419 - DNA, 21 bp, Homo sapiens
aatccaaacttggatttttga

SEQ ID NO: 3485420 - DNA, 11 bp, Homo sapiens
aatccaaagaa

SEQ ID NO: 3485421 - DNA, 13 bp, Homo sapiens
aatccaaatggcg

SEQ ID NO: 3485422 - DNA, 15 bp, Homo sapiens
aatccactcccaggc

SEQ ID NO: 3485423 - DNA, 17 bp, Homo sapiens
aatccactcccaggcag

SEQ ID NO: 3485424 - DNA, 21 bp, Homo sapiens
aatccagatggtgggatgtgg

SEQ ID NO: 3485425 - DNA, 17 bp, Homo sapiens
aatccagtgtgcacccc

SEQ ID NO: 3485426 - DNA, 19 bp, Homo sapiens
aatccagtgtgcacccctc

SEQ ID NO: 3485427 - DNA, 16 bp, Homo sapiens
aatcccaaatttgatt

SEQ ID NO: 3485428 - DNA, 18 bp, Homo sapiens
aatcccaaatttgattga

SEQ ID NO: 3485429 - DNA, 21 bp, Homo sapiens
aatcccaaatttgattgattt

SEQ ID NO: 3485430 - DNA, 14 bp, Homo sapiens
aatcccactgtatg

SEQ ID NO: 3485431 - DNA, 14 bp, Homo sapiens
aatcccagctactc

SEQ ID NO: 3485432 - DNA, 15 bp, Homo sapiens
aatccccagtaaaat

SEQ ID NO: 3485433 - DNA, 21 bp, Homo sapiens
aatccccagtaaaattgccat

SEQ ID NO: 3485434 - DNA, 15 bp, Homo sapiens
aatccctctccaact

SEQ ID NO: 3485435 - DNA, 13 bp, Homo sapiens
aatccgaacctcc

SEQ ID NO: 3485436 - DNA, 20 bp, Homo sapiens
aatccgaacctcctctgtga

SEQ ID NO: 3485437 - DNA, 17 bp, Homo sapiens
aatcctacctgttttgt

SEQ ID NO: 3485438 - DNA, 17 bp, Homo sapiens
aatcctactaataaacc

SEQ ID NO: 3485439 - DNA, 14 bp, Homo sapiens
aatcctatgtgatt

SEQ ID NO: 3485440 - DNA, 21 bp, Homo sapiens
aatcctatgtgattttaactc

SEQ ID NO: 3485441 - DNA, 20 bp, Homo sapiens
aatccttagatctggcatgt

SEQ ID NO: 3485442 - DNA, 12 bp, Homo sapiens
aatccttttgta

SEQ ID NO: 3485443 - DNA, 13 bp, Homo sapiens
aatcgatggggga

SEQ ID NO: 3485444 - DNA, 22 bp, Homo sapiens
aatcggatctggggctctggga

SEQ ID NO: 3485445 - DNA, 16 bp, Homo sapiens
aatctacccaaaggat

SEQ ID NO: 3485446 - DNA, 15 bp, Homo sapiens
aatctactaattcca

SEQ ID NO: 3485447 - DNA, 17 bp, Homo sapiens
aatctactaattccaca

SEQ ID NO: 3485448 - DNA, 14 bp, Homo sapiens
aatctagaggaaaa

SEQ ID NO: 3485449 - DNA, 21 bp, Homo sapiens
aatctatgctggtgaaaacaa

SEQ ID NO: 3485450 - DNA, 12 bp, Homo sapiens
aatctatttaag

SEQ ID NO: 3485451 - DNA, 16 bp, Homo sapiens
aatctcaatcctgcag

SEQ ID NO: 3485452 - DNA, 13 bp, Homo sapiens
aatctcagagaca

SEQ ID NO: 3485453 - DNA, 21 bp, Homo sapiens
aatctcagttgattttctgga

SEQ ID NO: 3485454 - DNA, 22 bp, Homo sapiens
aatctcagttgattttctggat

SEQ ID NO: 3485455 - DNA, 14 bp, Homo sapiens
aatctcattactgc

SEQ ID NO: 3485456 - DNA, 21 bp, Homo sapiens
aatctcattactgcttcattt

SEQ ID NO: 3485457 - DNA, 22 bp, Homo sapiens
aatctctcaaacggcaacattc

SEQ ID NO: 3485458 - DNA, 14 bp, Homo sapiens
aatctgacccagtg

SEQ ID NO: 3485459 - DNA, 15 bp, Homo sapiens
aatctgacccagtgc

SEQ ID NO: 3485460 - DNA, 17 bp, Homo sapiens
aatctgacccagtgccc

SEQ ID NO: 3485461 - DNA, 18 bp, Homo sapiens
aatctgagaaactctaca

SEQ ID NO: 3485462 - DNA, 15 bp, Homo sapiens
aatctgaggcatcct

SEQ ID NO: 3485463 - DNA, 16 bp, Homo sapiens
aatctgagggagctga

SEQ ID NO: 3485464 - DNA, 14 bp, Homo sapiens
aatctgcagaagga

SEQ ID NO: 3485465 - DNA, 23 bp, Homo sapiens
aatctgcagaaggaaaaatgtgt

SEQ ID NO: 3485466 - DNA, 19 bp, Homo sapiens
aatctgtcaagagtagtta

SEQ ID NO: 3485467 - DNA, 22 bp, Homo sapiens
aatctgtcactacaatttaaac

SEQ ID NO: 3485468 - DNA, 23 bp, Homo sapiens
aatctgttatgtactagtgttct

SEQ ID NO: 3485469 - DNA, 19 bp, Homo sapiens
aatcttaaggtgtagccac

SEQ ID NO: 3485470 - DNA, 14 bp, Homo sapiens
aatcttactctaga

SEQ ID NO: 3485471 - DNA, 15 bp, Homo sapiens
aatcttatcatggtc

SEQ ID NO: 3485472 - DNA, 14 bp, Homo sapiens
aatcttctttttca

SEQ ID NO: 3485473 - DNA, 19 bp, Homo sapiens
aatcttctttttcaggctc

SEQ ID NO: 3485474 - DNA, 13 bp, Homo sapiens
aatcttgctttct

SEQ ID NO: 3485475 - DNA, 17 bp, Homo sapiens
aatcttgtctcaatgct

SEQ ID NO: 3485476 - DNA, 14 bp, Homo sapiens
aatctttattgaga

SEQ ID NO: 3485477 - DNA, 13 bp, Homo sapiens
aatctttccaaat

SEQ ID NO: 3485478 - DNA, 17 bp, Homo sapiens
aatctttctttcttaga

SEQ ID NO: 3485479 - DNA, 21 bp, Homo sapiens
aatctttctttcttagaaatt

SEQ ID NO: 3485480 - DNA, 22 bp, Homo sapiens
aatctttctttcttagaaattt

SEQ ID NO: 3485481 - DNA, 13 bp, Homo sapiens
aatctttgttaag

SEQ ID NO: 3485482 - DNA, 18 bp, Homo sapiens
aatgaaatatgtgaagcc

SEQ ID NO: 3485483 - DNA, 20 bp, Homo sapiens
aatgaaatatgtgaagccca

SEQ ID NO: 3485484 - DNA, 18 bp, Homo sapiens
aatgaaatattgctgtat

SEQ ID NO: 3485485 - DNA, 14 bp, Homo sapiens
aatgaaatgtatgt

SEQ ID NO: 3485486 - DNA, 17 bp, Homo sapiens
aatgaaatgtatgtgct

SEQ ID NO: 3485487 - DNA, 16 bp, Homo sapiens
aatgaaccacatcttg

SEQ ID NO: 3485488 - DNA, 23 bp, Homo sapiens
aatgaaccacatcttgctctgct

SEQ ID NO: 3485489 - DNA, 19 bp, Homo sapiens
aatgaacccctggctcctt

SEQ ID NO: 3485490 - DNA, 11 bp, Homo sapiens
aatgaagaaag

SEQ ID NO: 3485491 - DNA, 13 bp, Homo sapiens
aatgaagccagct

SEQ ID NO: 3485492 - DNA, 14 bp, Homo sapiens
aatgaagttggggt

SEQ ID NO: 3485493 - DNA, 14 bp, Homo sapiens
aatgaagtttgaat

SEQ ID NO: 3485494 - DNA, 15 bp, Homo sapiens
aatgaagtttgaatg

SEQ ID NO: 3485495 - DNA, 18 bp, Homo sapiens
aatgaagtttgaatgtta

SEQ ID NO: 3485496 - DNA, 21 bp, Homo sapiens
aatgaagtttgaatgttaaat

SEQ ID NO: 3485497 - DNA, 20 bp, Homo sapiens
aatgaatactttataaagga

SEQ ID NO: 3485498 - DNA, 13 bp, Homo sapiens
aatgaatgtcttt

SEQ ID NO: 3485499 - DNA, 17 bp, Homo sapiens
aatgaattcctagaatt

SEQ ID NO: 3485500 - DNA, 16 bp, Homo sapiens
aatgacactgtttcct

SEQ ID NO: 3485501 - DNA, 17 bp, Homo sapiens
aatgacactgtttcctg

SEQ ID NO: 3485502 - DNA, 17 bp, Homo sapiens
aatgacacttgtcccca

SEQ ID NO: 3485503 - DNA, 21 bp, Homo sapiens
aatgacatacgcttttaatga

SEQ ID NO: 3485504 - DNA, 21 bp, Homo sapiens
aatgagaatgtgccatgtata

SEQ ID NO: 3485505 - DNA, 18 bp, Homo sapiens
aatgagagcgacacagac

SEQ ID NO: 3485506 - DNA, 15 bp, Homo sapiens
aatgagcctggcaag

SEQ ID NO: 3485507 - DNA, 21 bp, Homo sapiens
aatgagctggtttgtcaaaca

SEQ ID NO: 3485508 - DNA, 18 bp, Homo sapiens
aatgaggtcagagcctgc

SEQ ID NO: 3485509 - DNA, 13 bp, Homo sapiens
aatgatatgcatt

SEQ ID NO: 3485510 - DNA, 19 bp, Homo sapiens
aatgatgacaaaaaatgtt

SEQ ID NO: 3485511 - DNA, 21 bp, Homo sapiens
aatgatggcagtggtttgaaa

SEQ ID NO: 3485512 - DNA, 13 bp, Homo sapiens
aatgattcagtgt

SEQ ID NO: 3485513 - DNA, 12 bp, Homo sapiens
aatgatttgtgt

SEQ ID NO: 3485514 - DNA, 20 bp, Homo sapiens
aatgatttgtgtttctttat

SEQ ID NO: 3485515 - DNA, 17 bp, Homo sapiens
aatgcaaagaatcccta

SEQ ID NO: 3485516 - DNA, 20 bp, Homo sapiens
aatgcaactacccaaaacaa

SEQ ID NO: 3485517 - DNA, 21 bp, Homo sapiens
aatgcaagagaacattttact

SEQ ID NO: 3485518 - DNA, 16 bp, Homo sapiens
aatgcaatagaagtgc

SEQ ID NO: 3485519 - DNA, 24 bp, Homo sapiens
aatgcaatctccccttgatttaaa

SEQ ID NO: 3485520 - DNA, 21 bp, Homo sapiens
aatgcaatgtaagcatacttt

SEQ ID NO: 3485521 - DNA, 14 bp, Homo sapiens
aatgcagaggtctc

SEQ ID NO: 3485522 - DNA, 20 bp, Homo sapiens
aatgcagcagggatgccctg

SEQ ID NO: 3485523 - DNA, 14 bp, Homo sapiens
aatgcagtatggta

SEQ ID NO: 3485524 - DNA, 23 bp, Homo sapiens
aatgcagtatggtacatttttca

SEQ ID NO: 3485525 - DNA, 20 bp, Homo sapiens
aatgcagtctgtccaggctc

SEQ ID NO: 3485526 - DNA, 17 bp, Homo sapiens
aatgcataatgtcttta

SEQ ID NO: 3485527 - DNA, 19 bp, Homo sapiens
aatgcataatgtctttaaa

SEQ ID NO: 3485528 - DNA, 19 bp, Homo sapiens
aatgcatctagattatgga

SEQ ID NO: 3485529 - DNA, 12 bp, Homo sapiens
aatgcattgtat

SEQ ID NO: 3485530 - DNA, 18 bp, Homo sapiens
aatgcattgtatcgatgt

SEQ ID NO: 3485531 - DNA, 10 bp, Homo sapiens
aatgcattta

SEQ ID NO: 3485532 - DNA, 19 bp, Homo sapiens
aatgcatttatagatcatt

SEQ ID NO: 3485533 - DNA, 21 bp, Homo sapiens
aatgcattttgtttggtattg

SEQ ID NO: 3485534 - DNA, 21 bp, Homo sapiens
aatgccatcctcaaacactgc

SEQ ID NO: 3485535 - DNA, 16 bp, Homo sapiens
aatgcccttaaatcat

SEQ ID NO: 3485536 - DNA, 23 bp, Homo sapiens
aatgcctcagtgtatttgtattt

SEQ ID NO: 3485537 - DNA, 22 bp, Homo sapiens
aatgcctgactagggagccatg

SEQ ID NO: 3485538 - DNA, 19 bp, Homo sapiens
aatgcctgagtgcctggcc

SEQ ID NO: 3485539 - DNA, 15 bp, Homo sapiens
aatgctgaggttatg

SEQ ID NO: 3485540 - DNA, 17 bp, Homo sapiens
aatgctgctggccaaat

SEQ ID NO: 3485541 - DNA, 22 bp, Homo sapiens
aatgctggctgttggctggggg

SEQ ID NO: 3485542 - DNA, 13 bp, Homo sapiens
aatgctgtacatc

SEQ ID NO: 3485543 - DNA, 15 bp, Homo sapiens
aatgctgtacatcta

SEQ ID NO: 3485544 - DNA, 12 bp, Homo sapiens
aatgcttaagag

SEQ ID NO: 3485545 - DNA, 14 bp, Homo sapiens
aatggaaccaggct

SEQ ID NO: 3485546 - DNA, 17 bp, Homo sapiens
aatggaaccaggcttgg

SEQ ID NO: 3485547 - DNA, 14 bp, Homo sapiens
aatggagaagctct

SEQ ID NO: 3485548 - DNA, 17 bp, Homo sapiens
aatggatacataaagac

SEQ ID NO: 3485549 - DNA, 22 bp, Homo sapiens
aatggatatttgtactgtttaa

SEQ ID NO: 3485550 - DNA, 17 bp, Homo sapiens
aatggatgccttgaata

SEQ ID NO: 3485551 - DNA, 17 bp, Homo sapiens
aatggcactgagaaaca

SEQ ID NO: 3485552 - DNA, 12 bp, Homo sapiens
aatggcagcctt

SEQ ID NO: 3485553 - DNA, 20 bp, Homo sapiens
aatggccttcccgccggagg

SEQ ID NO: 3485554 - DNA, 22 bp, Homo sapiens
aatggccttcccgccggaggcc

SEQ ID NO: 3485555 - DNA, 20 bp, Homo sapiens
aatggcgtctggaagtccaa

SEQ ID NO: 3485556 - DNA, 13 bp, Homo sapiens
aatgggaatcatg

SEQ ID NO: 3485557 - DNA, 19 bp, Homo sapiens
aatgggaatcatggcctct

SEQ ID NO: 3485558 - DNA, 13 bp, Homo sapiens
aatgggacactaa

SEQ ID NO: 3485559 - DNA, 16 bp, Homo sapiens
aatgggatcatgaaag

SEQ ID NO: 3485560 - DNA, 15 bp, Homo sapiens
aatgggcaattccag

SEQ ID NO: 3485561 - DNA, 20 bp, Homo sapiens
aatgggccactgaaatctgt

SEQ ID NO: 3485562 - DNA, 13 bp, Homo sapiens
aatggggccagat

SEQ ID NO: 3485563 - DNA, 16 bp, Homo sapiens
aatggtataaatttca

SEQ ID NO: 3485564 - DNA, 22 bp, Homo sapiens
aatggtatttgaattaaatgtt

SEQ ID NO: 3485565 - DNA, 17 bp, Homo sapiens
aatggttgactgggttt

SEQ ID NO: 3485566 - DNA, 13 bp, Homo sapiens
aatggttgtatta

SEQ ID NO: 3485567 - DNA, 24 bp, Homo sapiens
aatggttgtattagatgttctcta

SEQ ID NO: 3485568 - DNA, 16 bp, Homo sapiens
aatggtttttaaattt

SEQ ID NO: 3485569 - DNA, 14 bp, Homo sapiens
aatgtaaagccatg

SEQ ID NO: 3485570 - DNA, 21 bp, Homo sapiens
aatgtaaaggagtcaaaacta

SEQ ID NO: 3485571 - DNA, 16 bp, Homo sapiens
aatgtaagcatacttt

SEQ ID NO: 3485572 - DNA, 19 bp, Homo sapiens
aatgtacttgtttctctgt

SEQ ID NO: 3485573 - DNA, 19 bp, Homo sapiens
aatgtagaatattcagaca

SEQ ID NO: 3485574 - DNA, 20 bp, Homo sapiens
aatgtagaatattcagacaa

SEQ ID NO: 3485575 - DNA, 18 bp, Homo sapiens
aatgtatcttattcacat

SEQ ID NO: 3485576 - DNA, 16 bp, Homo sapiens
aatgtcacaggcaggt

SEQ ID NO: 3485577 - DNA, 14 bp, Homo sapiens
aaggtcaaatttat

SEQ ID NO: 3485578 - DNA, 20 bp, Homo sapiens
aaggtcctctgtcagtcaca

SEQ ID NO: 3485579 - DNA, 15 bp, Homo sapiens
aaggtgaaggaatat

SEQ ID NO: 3485580 - DNA, 16 bp, Homo sapiens
aaggtgaaggaatata

SEQ ID NO: 3485581 - DNA, 18 bp, Homo sapiens
aaggtgccatggaagagg

SEQ ID NO: 3485582 - DNA, 13 bp, Homo sapiens
aaggtgcctgcca

SEQ ID NO: 3485583 - DNA, 22 bp, Homo sapiens
aaggtgcctgccatagccagga

SEQ ID NO: 3485584 - DNA, 23 bp, Homo sapiens
aaggtgcctgccatagccaggag

SEQ ID NO: 3485585 - DNA, 15 bp, Homo sapiens
aaggtgctaaatctg

SEQ ID NO: 3485586 - DNA, 19 bp, Homo sapiens
aaggtgctaaatctgcgat

SEQ ID NO: 3485587 - DNA, 20 bp, Homo sapiens
aaggtggactggaaggggcc

SEQ ID NO: 3485588 - DNA, 20 bp, Homo sapiens
aaggtggtgggggtgcagat

SEQ ID NO: 3485589 - DNA, 20 bp, Homo sapiens
aaggtgtagccacaccagga

SEQ ID NO: 3485590 - DNA, 22 bp, Homo sapiens
aaggttccaatcagatctttat

SEQ ID NO: 3485591 - DNA, 17 bp, Homo sapiens
aaggttggagcccaggg

SEQ ID NO: 3485592 - DNA, 15 bp, Homo sapiens
aaggtttaggctggt

SEQ ID NO: 3485593 - DNA, 13 bp, Homo sapiens
aagtaaaagaaac

SEQ ID NO: 3485594 - DNA, 15 bp, Homo sapiens
aagtaagaggctgga

SEQ ID NO: 3485595 - DNA, 17 bp, Homo sapiens
aagtacctttcctacat

SEQ ID NO: 3485596 - DNA, 19 bp, Homo sapiens
aagtacttctccaccctgc

SEQ ID NO: 3485597 - DNA, 11 bp, Homo sapiens
aagtacttctt

SEQ ID NO: 3485598 - DNA, 19 bp, Homo sapiens
aagtagacagttttgagaa

SEQ ID NO: 3485599 - DNA, 16 bp, Homo sapiens
aagtagaccaaatctt

SEQ ID NO: 3485600 - DNA, 14 bp, Homo sapiens
aagtagcctctcct

SEQ ID NO: 3485601 - DNA, 13 bp, Homo sapiens
aagtaggaagtaa

SEQ ID NO: 3485602 - DNA, 14 bp, Homo sapiens
aagtagtcctgtga

SEQ ID NO: 3485603 - DNA, 20 bp, Homo sapiens
aagtataatttgctggaaca

SEQ ID NO: 3485604 - DNA, 12 bp, Homo sapiens
aagtatactgta

SEQ ID NO: 3485605 - DNA, 23 bp, Homo sapiens
aagtatcctgacaagttcctagg

SEQ ID NO: 3485606 - DNA, 21 bp, Homo sapiens
aagtattctgtactcttagat

SEQ ID NO: 3485607 - DNA, 12 bp, Homo sapiens
aagtattgtaaa

SEQ ID NO: 3485608 - DNA, 13 bp, Homo sapiens
aagtattgtaaat

SEQ ID NO: 3485609 - DNA, 21 bp, Homo sapiens
aagtattgtaaattatatttg

SEQ ID NO: 3485610 - DNA, 13 bp, Homo sapiens
aagtattgtttcc

SEQ ID NO: 3485611 - DNA, 15 bp, Homo sapiens
aagtattgtttcctg

SEQ ID NO: 3485612 - DNA, 17 bp, Homo sapiens
aagtatttaattagtgc

SEQ ID NO: 3485613 - DNA, 21 bp, Homo sapiens
aagtatttaattagtgctaag

SEQ ID NO: 3485614 - DNA, 13 bp, Homo sapiens
aagtatttgggaa

SEQ ID NO: 3485615 - DNA, 14 bp, Homo sapiens
aagtcaaagtaaaa

SEQ ID NO: 3485616 - DNA, 17 bp, Homo sapiens
aagtcaccattctgcat

SEQ ID NO: 3485617 - DNA, 21 bp, Homo sapiens
aagtcagtgcccaactgttat

SEQ ID NO: 3485618 - DNA, 17 bp, Homo sapiens
aagtcatgcaaaggctg

SEQ ID NO: 3485619 - DNA, 14 bp, Homo sapiens
aagtcatggcccaa

SEQ ID NO: 3485620 - DNA, 18 bp, Homo sapiens
aagtccaattttaattta

SEQ ID NO: 3485621 - DNA, 17 bp, Homo sapiens
aagtcccccagcagaac

SEQ ID NO: 3485622 - DNA, 14 bp, Homo sapiens
aagtcctccctgac

SEQ ID NO: 3485623 - DNA, 12 bp, Homo sapiens
aagtcctggctt

SEQ ID NO: 3485624 - DNA, 19 bp, Homo sapiens
aagtcctgtatgtctgtca

SEQ ID NO: 3485625 - DNA, 16 bp, Homo sapiens
aagtcctttgtgaata

SEQ ID NO: 3485626 - DNA, 16 bp, Homo sapiens
aagtccttttgtaaag

SEQ ID NO: 3485627 - DNA, 21 bp, Homo sapiens
aagtctctcattctaggcctc

SEQ ID NO: 3485628 - DNA, 16 bp, Homo sapiens
aagtctctgctggccc

SEQ ID NO: 3485629 - DNA, 16 bp, Homo sapiens
aagtctgtatggcatg

SEQ ID NO: 3485630 - DNA, 13 bp, Homo sapiens
aagtctgtttact

SEQ ID NO: 3485631 - DNA, 17 bp, Homo sapiens
aagtcttatcaagcagc

SEQ ID NO: 3485632 - DNA, 16 bp, Homo sapiens
aagtcttgagaaaaag

SEQ ID NO: 3485633 - DNA, 13 bp, Homo sapiens
aagtctttcagat

SEQ ID NO: 3485634 - DNA, 17 bp, Homo sapiens
aagtgaaggtttacaat

SEQ ID NO: 3485635 - DNA, 19 bp, Homo sapiens
aagtgactgttcaagagca

SEQ ID NO: 3485636 - DNA, 15 bp, Homo sapiens
aagtgagacagtcca

SEQ ID NO: 3485637 - DNA, 20 bp, Homo sapiens
aagtgagacagtccagcctg

SEQ ID NO: 3485638 - DNA, 22 bp, Homo sapiens
aagtgagacagtccagcctgga

SEQ ID NO: 3485639 - DNA, 18 bp, Homo sapiens
aagtgagtgtttctatga

SEQ ID NO: 3485640 - DNA, 16 bp, Homo sapiens
aagtgatgctgtgata

SEQ ID NO: 3485641 - DNA, 17 bp, Homo sapiens
aagtgattctcctgcct

SEQ ID NO: 3485642 - DNA, 22 bp, Homo sapiens
aagtgcaataaatctgacccag

SEQ ID NO: 3485643 - DNA, 14 bp, Homo sapiens
aagtgccatctcaa

SEQ ID NO: 3485644 - DNA, 22 bp, Homo sapiens
aagtgctggcaaccactaagaa

SEQ ID NO: 3485645 - DNA, 12 bp, Homo sapiens
aagtgctgggat

SEQ ID NO: 3485646 - DNA, 19 bp, Homo sapiens
aagtgcttcattctttgca

SEQ ID NO: 3485647 - DNA, 19 bp, Homo sapiens
aagtggaaaaatagcctgc

SEQ ID NO: 3485648 - DNA, 22 bp, Homo sapiens
aagtggaccttaggccttcctc

SEQ ID NO: 3485649 - DNA, 17 bp, Homo sapiens
aagtggactcagggcag

SEQ ID NO: 3485650 - DNA, 13 bp, Homo sapiens
aagtggcctcttt

SEQ ID NO: 3485651 - DNA, 17 bp, Homo sapiens
aagtggcctctttgtct

SEQ ID NO: 3485652 - DNA, 15 bp, Homo sapiens
aagtggtagtaattt

SEQ ID NO: 3485653 - DNA, 19 bp, Homo sapiens
aagtggtagtaatttcctt

SEQ ID NO: 3485654 - DNA, 22 bp, Homo sapiens
aagtggtcctagaggccctttg

SEQ ID NO: 3485655 - DNA, 11 bp, Homo sapiens
aagtgtaactg

SEQ ID NO: 3485656 - DNA, 22 bp, Homo sapiens
aagtgtatttttcaataaagca

SEQ ID NO: 3485657 - DNA, 16 bp, Homo sapiens
aagtgtgtattaaaaa

SEQ ID NO: 3485658 - DNA, 18 bp, Homo sapiens
aagtgttgaagggaggtg

SEQ ID NO: 3485659 - DNA, 12 bp, Homo sapiens
aagttaatagat

SEQ ID NO: 3485660 - DNA, 15 bp, Homo sapiens
aagttacaatgtttt

SEQ ID NO: 3485661 - DNA, 18 bp, Homo sapiens
aagttactaggtaacttc

SEQ ID NO: 3485662 - DNA, 19 bp, Homo sapiens
aagttactaggtaacttca

SEQ ID NO: 3485663 - DNA, 17 bp, Homo sapiens
aagttagcctttgaatg

SEQ ID NO: 3485664 - DNA, 14 bp, Homo sapiens
aagttatatttcag

SEQ ID NO: 3485665 - DNA, 20 bp, Homo sapiens
aagttattagtggtttatca

SEQ ID NO: 3485666 - DNA, 17 bp, Homo sapiens
aagttatttttgtacat

SEQ ID NO: 3485667 - DNA, 18 bp, Homo sapiens
aagttatttttgtacatg

SEQ ID NO: 3485668 - DNA, 16 bp, Homo sapiens
aagttcagaaatttaa

SEQ ID NO: 3485669 - DNA, 22 bp, Homo sapiens
aagttgagggaaagagcttata

SEQ ID NO: 3485670 - DNA, 20 bp, Homo sapiens
aagttgatatagaacagtgc

SEQ ID NO: 3485671 - DNA, 21 bp, Homo sapiens
aagttgatatagaacagtgct

SEQ ID NO: 3485672 - DNA, 16 bp, Homo sapiens
aagttgcagtgagctg

SEQ ID NO: 3485673 - DNA, 16 bp, Homo sapiens
aagttgccattattct

SEQ ID NO: 3485674 - DNA, 22 bp, Homo sapiens
aagttgccattattctatgtag

SEQ ID NO: 3485675 - DNA, 11 bp, Homo sapiens
aagttgtaaca

SEQ ID NO: 3485676 - DNA, 12 bp, Homo sapiens
aagttgtacatg

SEQ ID NO: 3485677 - DNA, 22 bp, Homo sapiens
aagttgtagtgaagctctcacc

SEQ ID NO: 3485678 - DNA, 18 bp, Homo sapiens
aagtttactccttctgtt

SEQ ID NO: 3485679 - DNA, 21 bp, Homo sapiens
aagtttactccttctgttttg

SEQ ID NO: 3485680 - DNA, 21 bp, Homo sapiens
aagtttccttccagcccagaa

SEQ ID NO: 3485681 - DNA, 20 bp, Homo sapiens
aagtttccttggctggtgca

SEQ ID NO: 3485682 - DNA, 15 bp, Homo sapiens
aagtttgaatgttaa

SEQ ID NO: 3485683 - DNA, 16 bp, Homo sapiens
aagtttgaatgttaaa

SEQ ID NO: 3485684 - DNA, 18 bp, Homo sapiens
aagtttgaatgttaaata

SEQ ID NO: 3485685 - DNA, 22 bp, Homo sapiens
aagtttgaatgttaaataaatt

SEQ ID NO: 3485686 - DNA, 19 bp, Homo sapiens
aagtttgcactatctttca

SEQ ID NO: 3485687 - DNA, 21 bp, Homo sapiens
aagtttgcactatctttcagc

SEQ ID NO: 3485688 - DNA, 21 bp, Homo sapiens
aagttttcccttgaggaaaca

SEQ ID NO: 3485689 - DNA, 11 bp, Homo sapiens
aataaaaaggc

SEQ ID NO: 3485690 - DNA, 16 bp, Homo sapiens
aataaaaataaatttg

SEQ ID NO: 3485691 - DNA, 16 bp, Homo sapiens
aataaaacagtatctc

SEQ ID NO: 3485692 - DNA, 20 bp, Homo sapiens
aataaaatcatgtagtttgt

SEQ ID NO: 3485693 - DNA, 13 bp, Homo sapiens
aataaagaatact

SEQ ID NO: 3485694 - DNA, 16 bp, Homo sapiens
aataaagatgattgaa

SEQ ID NO: 3485695 - DNA, 22 bp, Homo sapiens
aataaagctgttctcattcctg

SEQ ID NO: 3485696 - DNA, 18 bp, Homo sapiens
aataaaggatgtgattgt

SEQ ID NO: 3485697 - DNA, 14 bp, Homo sapiens
aataaagtatttaa

SEQ ID NO: 3485698 - DNA, 19 bp, Homo sapiens
aataaagtttgcttagaaa

SEQ ID NO: 3485699 - DNA, 11 bp, Homo sapiens
aataaatatat

SEQ ID NO: 3485700 - DNA, 17 bp, Homo sapiens
aataaatctgacccagt

SEQ ID NO: 3485701 - DNA, 19 bp, Homo sapiens
aataaattgctaatgttgc

SEQ ID NO: 3485702 - DNA, 12 bp, Homo sapiens
aataaattgtat

SEQ ID NO: 3485703 - DNA, 15 bp, Homo sapiens
aataaattgtatatt

SEQ ID NO: 3485704 - DNA, 17 bp, Homo sapiens
aataaattgtatattca

SEQ ID NO: 3485705 - DNA, 15 bp, Homo sapiens
aataacaataaaaga

SEQ ID NO: 3485706 - DNA, 20 bp, Homo sapiens
aataacacacatataaacat

SEQ ID NO: 3485707 - DNA, 11 bp, Homo sapiens
aataacattta

SEQ ID NO: 3485708 - DNA, 23 bp, Homo sapiens
aataacatttaatttagatattt

SEQ ID NO: 3485709 - DNA, 13 bp, Homo sapiens
aataagaatagaa

SEQ ID NO: 3485710 - DNA, 15 bp, Homo sapiens
aataatatgcattgt

SEQ ID NO: 3485711 - DNA, 17 bp, Homo sapiens
aataatatgcattgtca

SEQ ID NO: 3485712 - DNA, 18 bp, Homo sapiens
aataatcccattctttat

SEQ ID NO: 3485713 - DNA, 19 bp, Homo sapiens
aataatcttattagggaga

SEQ ID NO: 3485714 - DNA, 15 bp, Homo sapiens
aataatgcagtatgg

SEQ ID NO: 3485715 - DNA, 23 bp, Homo sapiens
aataatgcagtatggtacatttt

SEQ ID NO: 3485716 - DNA, 14 bp, Homo sapiens
aataatgtaattta

SEQ ID NO: 3485717 - DNA, 21 bp, Homo sapiens
aataattgcagaactaaactc

SEQ ID NO: 3485718 - DNA, 14 bp, Homo sapiens
aatacaaaaatttg

SEQ ID NO: 3485719 - DNA, 12 bp, Homo sapiens
aatacaaaactt

SEQ ID NO: 3485720 - DNA, 17 bp, Homo sapiens
aatacaaaggttccatt

SEQ ID NO: 3485721 - DNA, 13 bp, Homo sapiens
aatacagctttct

SEQ ID NO: 3485722 - DNA, 14 bp, Homo sapiens
aatacagctttctg

SEQ ID NO: 3485723 - DNA, 19 bp, Homo sapiens
aatacagctttctgacctt

SEQ ID NO: 3485724 - DNA, 17 bp, Homo sapiens
aatacagttctgtcata

SEQ ID NO: 3485725 - DNA, 15 bp, Homo sapiens
aatacattctgcttt

SEQ ID NO: 3485726 - DNA, 15 bp, Homo sapiens
aatacctcatgcttc

SEQ ID NO: 3485727 - DNA, 21 bp, Homo sapiens
aatactatatttatactgtat

SEQ ID NO: 3485728 - DNA, 12 bp, Homo sapiens
aatactccaaag

SEQ ID NO: 3485729 - DNA, 13 bp, Homo sapiens
aatactctgccct

SEQ ID NO: 3485730 - DNA, 18 bp, Homo sapiens
aatactgctgagatacat

SEQ ID NO: 3485731 - DNA, 16 bp, Homo sapiens
aatacttacattctct

SEQ ID NO: 3485732 - DNA, 18 bp, Homo sapiens
aatacttgaacttgcctc

SEQ ID NO: 3485733 - DNA, 19 bp, Homo sapiens
aatacttgaacttgcctct

SEQ ID NO: 3485734 - DNA, 17 bp, Homo sapiens
aatacttgactcagtga

SEQ ID NO: 3485735 - DNA, 13 bp, Homo sapiens
aaaaaaaaagttc

SEQ ID NO: 3485736 - DNA, 11 bp, Homo sapiens
aaaaaaaccaa

SEQ ID NO: 3485737 - DNA, 16 bp, Homo sapiens
aaagatctgttttgaa

SEQ ID NO: 3485738 - DNA, 21 bp, Homo sapiens
aaagatctgttttgaaggcaa

SEQ ID NO: 3485739 - DNA, 14 bp, Homo sapiens
aaagatgcttctca

SEQ ID NO: 3485740 - DNA, 19 bp, Homo sapiens
aaagatgcttctcactgcc

SEQ ID NO: 3485741 - DNA, 17 bp, Homo sapiens
aaagatggggtctgtaa

SEQ ID NO: 3485742 - DNA, 22 bp, Homo sapiens
aaagatggggtctgtaaaatct

SEQ ID NO: 3485743 - DNA, 23 bp, Homo sapiens
aaagatggggtctgtaaaatctt

SEQ ID NO: 3485744 - DNA, 14 bp, Homo sapiens
aaagatttcttgag

SEQ ID NO: 3485745 - DNA, 13 bp, Homo sapiens
aaagcaaatgata

SEQ ID NO: 3485746 - DNA, 14 bp, Homo sapiens
aaagcaaggaaact

SEQ ID NO: 3485747 - DNA, 12 bp, Homo sapiens
aaagcagccacg

SEQ ID NO: 3485748 - DNA, 15 bp, Homo sapiens
aaagcagccacgagg

SEQ ID NO: 3485749 - DNA, 18 bp, Homo sapiens
aaagcagctcaaaggcac

SEQ ID NO: 3485750 - DNA, 19 bp, Homo sapiens
aaagcagctcaaaggcaca

SEQ ID NO: 3485751 - DNA, 18 bp, Homo sapiens
aaagcagctctcccctca

SEQ ID NO: 3485752 - DNA, 14 bp, Homo sapiens
aaagcagttctgat

SEQ ID NO: 3485753 - DNA, 15 bp, Homo sapiens
aaagcagttctgatg

SEQ ID NO: 3485754 - DNA, 22 bp, Homo sapiens
aaaattcaagcatttaggaatg

SEQ ID NO: 3485755 - DNA, 16 bp, Homo sapiens
aaaattcagcaaacca

SEQ ID NO: 3485756 - DNA, 14 bp, Homo sapiens
aaaattcatttcta

SEQ ID NO: 3485757 - DNA, 15 bp, Homo sapiens
aaaattctaaatgta

SEQ ID NO: 3485758 - DNA, 17 bp, Homo sapiens
aaaattgctgcaccaat

SEQ ID NO: 3485759 - DNA, 13 bp, Homo sapiens
aaaattttattcc

SEQ ID NO: 3485760 - DNA, 16 bp, Homo sapiens
aaaattttgtgacatt

SEQ ID NO: 3485761 - DNA, 19 bp, Homo sapiens
aaaattttgtgacattcct

SEQ ID NO: 3485762 - DNA, 17 bp, Homo sapiens
aaaattttttttcatgt

SEQ ID NO: 3485763 - DNA, 9 bp, Homo sapiens
aaacaaaaa

SEQ ID NO: 3485764 - DNA, 11 bp, Homo sapiens
aaacaaaaaga

SEQ ID NO: 3485765 - DNA, 12 bp, Homo sapiens
aaacaaaaccag

SEQ ID NO: 3485766 - DNA, 12 bp, Homo sapiens
aaacaaagccag

SEQ ID NO: 3485767 - DNA, 13 bp, Homo sapiens
aaacaaagccaga

SEQ ID NO: 3485768 - DNA, 12 bp, Homo sapiens
aaacaaatatgc

SEQ ID NO: 3485769 - DNA, 17 bp, Homo sapiens
aaacaaatatgcaaaag

SEQ ID NO: 3485770 - DNA, 21 bp, Homo sapiens
aaacaacattttgagaacaaa

SEQ ID NO: 3485771 - DNA, 22 bp, Homo sapiens
aaacaacattttgagaacaaag

SEQ ID NO: 3485772 - DNA, 17 bp, Homo sapiens
aaacaactctttgagaa

SEQ ID NO: 3485773 - DNA, 15 bp, Homo sapiens
aaacaataaatgtgc

SEQ ID NO: 3485774 - DNA, 18 bp, Homo sapiens
aaacaatctggaagaaaa

SEQ ID NO: 3485775 - DNA, 12 bp, Homo sapiens
aaacaatttttt

SEQ ID NO: 3485776 - DNA, 19 bp, Homo sapiens
aaacacaaacgggctcagc

SEQ ID NO: 3485777 - DNA, 21 bp, Homo sapiens
aaacacacagatacacacaca

SEQ ID NO: 3485778 - DNA, 16 bp, Homo sapiens
aaacacactgaggcag

SEQ ID NO: 3485779 - DNA, 17 bp, Homo sapiens
aaacacactgaggcagg

SEQ ID NO: 3485780 - DNA, 15 bp, Homo sapiens
ataatatattttcaa

SEQ ID NO: 3485781 - DNA, 14 bp, Homo sapiens
ataatatctaaagt

SEQ ID NO: 3485782 - DNA, 18 bp, Homo sapiens
ataatatctaaagttata

SEQ ID NO: 3485783 - DNA, 12 bp, Homo sapiens
ataatatgagaa

SEQ ID NO: 3485784 - DNA, 16 bp, Homo sapiens
ataatatgatgcaaac

SEQ ID NO: 3485785 - DNA, 12 bp, Homo sapiens
ataatatgcaca

SEQ ID NO: 3485786 - DNA, 20 bp, Homo sapiens
ataatatgcacacagtgctt

SEQ ID NO: 3485787 - DNA, 19 bp, Homo sapiens
ataatctgtgagtgaaagt

SEQ ID NO: 3485788 - DNA, 20 bp, Homo sapiens
ataatctgtgagtgaaagtt

SEQ ID NO: 3485789 - DNA, 21 bp, Homo sapiens
ataatgatggatttaacagca

SEQ ID NO: 3485790 - DNA, 23 bp, Homo sapiens
ataatgatggatttaacagcatg

SEQ ID NO: 3485791 - DNA, 14 bp, Homo sapiens
ataatgcaaagaat

SEQ ID NO: 3485792 - DNA, 17 bp, Homo sapiens
ataatgctaatttaaag

SEQ ID NO: 3485793 - DNA, 17 bp, Homo sapiens
ataatgggccactgaaa

SEQ ID NO: 3485794 - DNA, 22 bp, Homo sapiens
ataatgggccactgaaatctgt

SEQ ID NO: 3485795 - DNA, 14 bp, Homo sapiens
ataatggttgactg

SEQ ID NO: 3485796 - DNA, 21 bp, Homo sapiens
ataattagatgattatatatt

SEQ ID NO: 3485797 - DNA, 19 bp, Homo sapiens
ataattgagttttcagtgg

SEQ ID NO: 3485798 - DNA, 22 bp, Homo sapiens
ataatttgtacatatgtaaaat

SEQ ID NO: 3485799 - DNA, 13 bp, Homo sapiens
ataattttgctgg

SEQ ID NO: 3485800 - DNA, 22 bp, Homo sapiens
ataattttgctggaattcctaa

SEQ ID NO: 3485801 - DNA, 14 bp, Homo sapiens
atacaaattagaaa

SEQ ID NO: 3485802 - DNA, 18 bp, Homo sapiens
atacaagatattatgtat

SEQ ID NO: 3485803 - DNA, 22 bp, Homo sapiens
atacaagccattctaaggaaat

SEQ ID NO: 3485804 - DNA, 13 bp, Homo sapiens
atacacatggaaa

SEQ ID NO: 3485805 - DNA, 17 bp, Homo sapiens
atacacatggaaaaaaa

SEQ ID NO: 3485806 - DNA, 18 bp, Homo sapiens
atacaccagcattccttt

SEQ ID NO: 3485807 - DNA, 14 bp, Homo sapiens
atacactaaaaatc

SEQ ID NO: 3485808 - DNA, 14 bp, Homo sapiens
atacagaactcttt

SEQ ID NO: 3485809 - DNA, 18 bp, Homo sapiens
atacagaactctttcaaa

SEQ ID NO: 3485810 - DNA, 20 bp, Homo sapiens
atacagaactctttcaaaac

SEQ ID NO: 3485811 - DNA, 16 bp, Homo sapiens
atacagaggcaactgc

SEQ ID NO: 3485812 - DNA, 17 bp, Homo sapiens
atacagaggcaactgca

SEQ ID NO: 3485813 - DNA, 22 bp, Homo sapiens
atacagattttgatagcaaagc

SEQ ID NO: 3485814 - DNA, 20 bp, Homo sapiens
atacaggaaaagctgctgac

SEQ ID NO: 3485815 - DNA, 15 bp, Homo sapiens
atacagtacaggcag

SEQ ID NO: 3485816 - DNA, 15 bp, Homo sapiens
atacagtcaacaagc

SEQ ID NO: 3485817 - DNA, 21 bp, Homo sapiens
atacagtttatttttaaagat

SEQ ID NO: 3485818 - DNA, 12 bp, Homo sapiens
atacataatggg

SEQ ID NO: 3485819 - DNA, 22 bp, Homo sapiens
atacataatgggccactgaaat

SEQ ID NO: 3485820 - DNA, 17 bp, Homo sapiens
atacatacagaattact

SEQ ID NO: 3485821 - DNA, 15 bp, Homo sapiens
atacctcaacctatg

SEQ ID NO: 3485822 - DNA, 19 bp, Homo sapiens
atacctcctccctaatgct

SEQ ID NO: 3485823 - DNA, 21 bp, Homo sapiens
atacctcctccctaatgctca

SEQ ID NO: 3485824 - DNA, 17 bp, Homo sapiens
ataccttctggctgtgc

SEQ ID NO: 3485825 - DNA, 15 bp, Homo sapiens
atacctttgccttgg

SEQ ID NO: 3485826 - DNA, 16 bp, Homo sapiens
atacgagagcagaggt

SEQ ID NO: 3485827 - DNA, 20 bp, Homo sapiens
atacgagagcagaggtctcc

SEQ ID NO: 3485828 - DNA, 21 bp, Homo sapiens
atacgctggcaacacagaggc

SEQ ID NO: 3485829 - DNA, 22 bp, Homo sapiens
atacgcttttaatgaaaaggaa

SEQ ID NO: 3485830 - DNA, 15 bp, Homo sapiens
atactaccttgaaaa

SEQ ID NO: 3485831 - DNA, 17 bp, Homo sapiens
atactaccttgaaaata

SEQ ID NO: 3485832 - DNA, 21 bp, Homo sapiens
atactagggagccatttgaga

SEQ ID NO: 3485833 - DNA, 22 bp, Homo sapiens
atactattaaaaaggtttacag

SEQ ID NO: 3485834 - DNA, 19 bp, Homo sapiens
atactcttaggaagagaaa

SEQ ID NO: 3485835 - DNA, 19 bp, Homo sapiens
atactgcgactttctgcct

SEQ ID NO: 3485836 - DNA, 16 bp, Homo sapiens
atactgctactgtaat

SEQ ID NO: 3485837 - DNA, 12 bp, Homo sapiens
atactgctgaga

SEQ ID NO: 3485838 - DNA, 21 bp, Homo sapiens
atactgctgagatacatacag

SEQ ID NO: 3485839 - DNA, 13 bp, Homo sapiens
atactgcttgtca

SEQ ID NO: 3485840 - DNA, 14 bp, Homo sapiens
atacttaacaaata

SEQ ID NO: 3485841 - DNA, 17 bp, Homo sapiens
atacttaacaaatacat

SEQ ID NO: 3485842 - DNA, 22 bp, Homo sapiens
atacttacattctctaataaga

SEQ ID NO: 3485843 - DNA, 24 bp, Homo sapiens
atacttactgaactgtgtgtaatt

SEQ ID NO: 3485844 - DNA, 21 bp, Homo sapiens
atacttccttatgcttctttc

SEQ ID NO: 3485845 - DNA, 12 bp, Homo sapiens
atacttgaactt

SEQ ID NO: 3485846 - DNA, 13 bp, Homo sapiens
atacttgaacttg

SEQ ID NO: 3485847 - DNA, 16 bp, Homo sapiens
atacttgaagggccag

SEQ ID NO: 3485848 - DNA, 21 bp, Homo sapiens
atacttgtggactaaaagata

SEQ ID NO: 3485849 - DNA, 12 bp, Homo sapiens
atactttacatg

SEQ ID NO: 3485850 - DNA, 13 bp, Homo sapiens
atactttttacaa

SEQ ID NO: 3485851 - DNA, 13 bp, Homo sapiens
atactttttctaa

SEQ ID NO: 3485852 - DNA, 21 bp, Homo sapiens
atacttttttttctttaaaaa

SEQ ID NO: 3485853 - DNA, 18 bp, Homo sapiens
atagaaaagcacttgaag

SEQ ID NO: 3485854 - DNA, 12 bp, Homo sapiens
atagaaatgcca

SEQ ID NO: 3485855 - DNA, 12 bp, Homo sapiens
atagaaatggaa

SEQ ID NO: 3485856 - DNA, 17 bp, Homo sapiens
atagaacagagaaagag

SEQ ID NO: 3485857 - DNA, 16 bp, Homo sapiens
atagaacttcatggat

SEQ ID NO: 3485858 - DNA, 19 bp, Homo sapiens
atagaaggatgtacatttc

SEQ ID NO: 3485859 - DNA, 15 bp, Homo sapiens
atagaatatagcatc

SEQ ID NO: 3485860 - DNA, 18 bp, Homo sapiens
atagaatatagcatcttt

SEQ ID NO: 3485861 - DNA, 19 bp, Homo sapiens
atagaatatagcatctttc

SEQ ID NO: 3485862 - DNA, 22 bp, Homo sapiens
atagaatatttattacctctga

SEQ ID NO: 3485863 - DNA, 13 bp, Homo sapiens
atagaattagctt

SEQ ID NO: 3485864 - DNA, 22 bp, Homo sapiens
atagaattatttcacaaataat

SEQ ID NO: 3485865 - DNA, 15 bp, Homo sapiens
atagagcctgaggga

SEQ ID NO: 3485866 - DNA, 17 bp, Homo sapiens
atagaggagaggaaaag

SEQ ID NO: 3485867 - DNA, 18 bp, Homo sapiens
atagataggtcagtgcaa

SEQ ID NO: 3485868 - DNA, 15 bp, Homo sapiens
atagatcatttctag

SEQ ID NO: 3485869 - DNA, 13 bp, Homo sapiens
atagatgtttcct

SEQ ID NO: 3485870 - DNA, 16 bp, Homo sapiens
atagcaacactctata

SEQ ID NO: 3485871 - DNA, 19 bp, Homo sapiens
atagcaagtgaatttttct

SEQ ID NO: 3485872 - DNA, 19 bp, Homo sapiens
atagcatgacatttctttg

SEQ ID NO: 3485873 - DNA, 19 bp, Homo sapiens
atagccgatatcagaattt

SEQ ID NO: 3485874 - DNA, 15 bp, Homo sapiens
atagcctaggtgaca

SEQ ID NO: 3485875 - DNA, 17 bp, Homo sapiens
atagcctaggtgacaga

SEQ ID NO: 3485876 - DNA, 14 bp, Homo sapiens
atagctaactgtaa

SEQ ID NO: 3485877 - DNA, 18 bp, Homo sapiens
atagctactaattttaaa

SEQ ID NO: 3485878 - DNA, 20 bp, Homo sapiens
atagctcaggtgtccctgca

SEQ ID NO: 3485879 - DNA, 21 bp, Homo sapiens
atagctcaggtgtccctgcac

SEQ ID NO: 3485880 - DNA, 20 bp, Homo sapiens
atagctccccgcttctgcct

SEQ ID NO: 3485881 - DNA, 14 bp, Homo sapiens
atagctccttttga

SEQ ID NO: 3485882 - DNA, 19 bp, Homo sapiens
atagctgcccatttcgtga

SEQ ID NO: 3485883 - DNA, 12 bp, Homo sapiens
atagctgctgcc

SEQ ID NO: 3485884 - DNA, 15 bp, Homo sapiens
atagctgtacaaata

SEQ ID NO: 3485885 - DNA, 17 bp, Homo sapiens
atagctgtacaaatata

SEQ ID NO: 3485886 - DNA, 20 bp, Homo sapiens
ataggacctttccaccacag

SEQ ID NO: 3485887 - DNA, 13 bp, Homo sapiens
ataggcaggaagc

SEQ ID NO: 3485888 - DNA, 21 bp, Homo sapiens
ataggtccagaagtccttatg

SEQ ID NO: 3485889 - DNA, 22 bp, Homo sapiens
ataggtgtccagcattgctgga

SEQ ID NO: 3485890 - DNA, 22 bp, Homo sapiens
ataggttaataaagatgattga

SEQ ID NO: 3485891 - DNA, 16 bp, Homo sapiens
ataggttgagcaattt

SEQ ID NO: 3485892 - DNA, 15 bp, Homo sapiens
agttggttggataag

SEQ ID NO: 3485893 - DNA, 11 bp, Homo sapiens
agttgtacatg

SEQ ID NO: 3485894 - DNA, 13 bp, Homo sapiens
agttgtacatgaa

SEQ ID NO: 3485895 - DNA, 22 bp, Homo sapiens
agttgtagcaaagatttcaaaa

SEQ ID NO: 3485896 - DNA, 11 bp, Homo sapiens
agttgtagtga

SEQ ID NO: 3485897 - DNA, 19 bp, Homo sapiens
agttgtcaagtctctgctg

SEQ ID NO: 3485898 - DNA, 12 bp, Homo sapiens
agtttaaaaaaa

SEQ ID NO: 3485899 - DNA, 15 bp, Homo sapiens
agtttaaaaaaattg

SEQ ID NO: 3485900 - DNA, 20 bp, Homo sapiens
agtttaaaaatcaacttttt

SEQ ID NO: 3485901 - DNA, 18 bp, Homo sapiens
agtttaaaacagaagcct

SEQ ID NO: 3485902 - DNA, 20 bp, Homo sapiens
agtttaaattgtaataggcg

SEQ ID NO: 3485903 - DNA, 21 bp, Homo sapiens
agtttaatgcaagagaacatt

SEQ ID NO: 3485904 - DNA, 16 bp, Homo sapiens
agtttcagagatggac

SEQ ID NO: 3485905 - DNA, 18 bp, Homo sapiens
agtttcagagatggacag

SEQ ID NO: 3485906 - DNA, 21 bp, Homo sapiens
agtttcagagatggacagaga

SEQ ID NO: 3485907 - DNA, 22 bp, Homo sapiens
agtttcagttgtccttaaattt

SEQ ID NO: 3485908 - DNA, 18 bp, Homo sapiens
agtttccttccctaccca

SEQ ID NO: 3485909 - DNA, 15 bp, Homo sapiens
agtttccttggctgg

SEQ ID NO: 3485910 - DNA, 17 bp, Homo sapiens
agtttccttggctggtg

SEQ ID NO: 3485911 - DNA, 18 bp, Homo sapiens
agtttccttggctggtgc

SEQ ID NO: 3485912 - DNA, 17 bp, Homo sapiens
agtttgaaattctgaat

SEQ ID NO: 3485913 - DNA, 22 bp, Homo sapiens
agtttgaaattctgaatttgca

SEQ ID NO: 3485914 - DNA, 12 bp, Homo sapiens
agtttgaatgtt

SEQ ID NO: 3485915 - DNA, 12 bp, Homo sapiens
agtttgagacca

SEQ ID NO: 3485916 - DNA, 22 bp, Homo sapiens
agtttgagaccagcctggccaa

SEQ ID NO: 3485917 - DNA, 18 bp, Homo sapiens
agtttgagatcagcctgg

SEQ ID NO: 3485918 - DNA, 17 bp, Homo sapiens
agtttgattattcagtg

SEQ ID NO: 3485919 - DNA, 18 bp, Homo sapiens
agtttgattattcagtgt

SEQ ID NO: 3485920 - DNA, 22 bp, Homo sapiens
agtttgccggatacaaactggt

SEQ ID NO: 3485921 - DNA, 13 bp, Homo sapiens
agtttgcttagaa

SEQ ID NO: 3485922 - DNA, 14 bp, Homo sapiens
agtttgcttagaaa

SEQ ID NO: 3485923 - DNA, 15 bp, Homo sapiens
agtttgggcttcagc

SEQ ID NO: 3485924 - DNA, 20 bp, Homo sapiens
agtttgtggcatcttgccaa

SEQ ID NO: 3485925 - DNA, 14 bp, Homo sapiens
agtttgtgtgttgt

SEQ ID NO: 3485926 - DNA, 18 bp, Homo sapiens
agttttaactagaattta

SEQ ID NO: 3485927 - DNA, 15 bp, Homo sapiens
agttttatccataat

SEQ ID NO: 3485928 - DNA, 15 bp, Homo sapiens
agttttcaaatttgt

SEQ ID NO: 3485929 - DNA, 22 bp, Homo sapiens
agttttcaagtcaaattaataa

SEQ ID NO: 3485930 - DNA, 22 bp, Homo sapiens
agttttcactcttattgcccac

SEQ ID NO: 3485931 - DNA, 12 bp, Homo sapiens
agttttcagtgg

SEQ ID NO: 3485932 - DNA, 15 bp, Homo sapiens
agttttcagtttgta

SEQ ID NO: 3485933 - DNA, 16 bp, Homo sapiens
agttttcctatgcttt

SEQ ID NO: 3485934 - DNA, 18 bp, Homo sapiens
agttttcctatgctttga

SEQ ID NO: 3485935 - DNA, 12 bp, Homo sapiens
agttttccttct

SEQ ID NO: 3485936 - DNA, 14 bp, Homo sapiens
agttttccttctca

SEQ ID NO: 3485937 - DNA, 12 bp, Homo sapiens
agttttcttgtt

SEQ ID NO: 3485938 - DNA, 15 bp, Homo sapiens
agttttcttgttgct

SEQ ID NO: 3485939 - DNA, 18 bp, Homo sapiens
agttttctttcctccttt

SEQ ID NO: 3485940 - DNA, 19 bp, Homo sapiens
agttttctttcctcctttc

SEQ ID NO: 3485941 - DNA, 19 bp, Homo sapiens
agttttggatgcagtgctc

SEQ ID NO: 3485942 - DNA, 17 bp, Homo sapiens
agtttttttccttaaaa

SEQ ID NO: 3485943 - DNA, 20 bp, Homo sapiens
ataaaaaatatgtatttacc

SEQ ID NO: 3485944 - DNA, 13 bp, Homo sapiens
ataaaaagcaaaa

SEQ ID NO: 3485945 - DNA, 11 bp, Homo sapiens
ataaaaaggca

SEQ ID NO: 3485946 - DNA, 13 bp, Homo sapiens
ataaaacaaaggg

SEQ ID NO: 3485947 - DNA, 20 bp, Homo sapiens
ataaaacagcattagatagt

SEQ ID NO: 3485948 - DNA, 15 bp, Homo sapiens
ataaaactggctttg

SEQ ID NO: 3485949 - DNA, 15 bp, Homo sapiens
ataaaaggaagccaa

SEQ ID NO: 3485950 - DNA, 19 bp, Homo sapiens
ataaaagttttacaaaggg

SEQ ID NO: 3485951 - DNA, 13 bp, Homo sapiens
ataaaataaatat

SEQ ID NO: 3485952 - DNA, 16 bp, Homo sapiens
ataaaatcaagtttta

SEQ ID NO: 3485953 - DNA, 16 bp, Homo sapiens
ataaaatcagccaatt

SEQ ID NO: 3485954 - DNA, 18 bp, Homo sapiens
ataaaatcagccaattat

SEQ ID NO: 3485955 - DNA, 18 bp, Homo sapiens
ataaaatgtaacactgat

SEQ ID NO: 3485956 - DNA, 20 bp, Homo sapiens
ataaaatgtcttcaaggctt

SEQ ID NO: 3485957 - DNA, 19 bp, Homo sapiens
ataaaatgttgaaaagtca

SEQ ID NO: 3485958 - DNA, 15 bp, Homo sapiens
ataaacaaagttact

SEQ ID NO: 3485959 - DNA, 13 bp, Homo sapiens
ataaacaatgaaa

SEQ ID NO: 3485960 - DNA, 18 bp, Homo sapiens
ataaacctaaaaaagata

SEQ ID NO: 3485961 - DNA, 22 bp, Homo sapiens
ataaacctaaaaaagatatatt

SEQ ID NO: 3485962 - DNA, 18 bp, Homo sapiens
ataaacgatgttgtgatg

SEQ ID NO: 3485963 - DNA, 20 bp, Homo sapiens
ataaactttaatataaagta

SEQ ID NO: 3485964 - DNA, 22 bp, Homo sapiens
ataaactttaatataaagtagt

SEQ ID NO: 3485965 - DNA, 12 bp, Homo sapiens
ataaagaatact

SEQ ID NO: 3485966 - DNA, 20 bp, Homo sapiens
ataaagaatacttgaacttg

SEQ ID NO: 3485967 - DNA, 18 bp, Homo sapiens
ataaagacaatcactgcc

SEQ ID NO: 3485968 - DNA, 20 bp, Homo sapiens
ataaagacaatcactgccaa

SEQ ID NO: 3485969 - DNA, 21 bp, Homo sapiens
ataaagagagaaaaacaaatt

SEQ ID NO: 3485970 - DNA, 19 bp, Homo sapiens
ataaagaggcgttgctttc

SEQ ID NO: 3485971 - DNA, 16 bp, Homo sapiens
ataaagatgattgaat

SEQ ID NO: 3485972 - DNA, 19 bp, Homo sapiens
ataaagcacagatttgcat

SEQ ID NO: 3485973 - DNA, 14 bp, Homo sapiens
ataaagcatttata

SEQ ID NO: 3485974 - DNA, 14 bp, Homo sapiens
ataaagccctggga

SEQ ID NO: 3485975 - DNA, 20 bp, Homo sapiens
ataaagccctgggatcactg

SEQ ID NO: 3485976 - DNA, 21 bp, Homo sapiens
ataaagctgttctcattcctg

SEQ ID NO: 3485977 - DNA, 18 bp, Homo sapiens
ataaaggattaatgtcaa

SEQ ID NO: 3485978 - DNA, 12 bp, Homo sapiens
ataaagtattta

SEQ ID NO: 3485979 - DNA, 15 bp, Homo sapiens
ataaagtatttaatt

SEQ ID NO: 3485980 - DNA, 15 bp, Homo sapiens
ataaagttctgtact

SEQ ID NO: 3485981 - DNA, 19 bp, Homo sapiens
ataaagtttgcttagaaaa

SEQ ID NO: 3485982 - DNA, 19 bp, Homo sapiens
ataaagtttttttccttaa

SEQ ID NO: 3485983 - DNA, 22 bp, Homo sapiens
ataaagtttttttccttaaaaa

SEQ ID NO: 3485984 - DNA, 12 bp, Homo sapiens
ataaataaatgt

SEQ ID NO: 3485985 - DNA, 12 bp, Homo sapiens
ataaatatatat

SEQ ID NO: 3485986 - DNA, 16 bp, Homo sapiens
ataaatatatataaac

SEQ ID NO: 3485987 - DNA, 22 bp, Homo sapiens
ataaatatatataaacctaaaa

SEQ ID NO: 3485988 - DNA, 23 bp, Homo sapiens
ataaatatatatatatataaaat

SEQ ID NO: 3485989 - DNA, 19 bp, Homo sapiens
ataaatctgacccagtgcc

SEQ ID NO: 3485990 - DNA, 15 bp, Homo sapiens
ataaatgtatcttat

SEQ ID NO: 3485991 - DNA, 15 bp, Homo sapiens
ataaatgttaagaaa

SEQ ID NO: 3485992 - DNA, 20 bp, Homo sapiens
ataaattcctctttgctttg

SEQ ID NO: 3485993 - DNA, 21 bp, Homo sapiens
ataaattcctctttgctttgc

SEQ ID NO: 3485994 - DNA, 16 bp, Homo sapiens
ataaattgtatattca

SEQ ID NO: 3485995 - DNA, 17 bp, Homo sapiens
ataaattgtatattcac

SEQ ID NO: 3485996 - DNA, 13 bp, Homo sapiens
ataacacacagct

SEQ ID NO: 3485997 - DNA, 23 bp, Homo sapiens
ataacacacagctaacacacagc

SEQ ID NO: 3485998 - DNA, 11 bp, Homo sapiens
ataacacacat

SEQ ID NO: 3485999 - DNA, 14 bp, Homo sapiens
ataacacctgccac

SEQ ID NO: 3486000 - DNA, 22 bp, Homo sapiens
ataacgataaaagacagtgaaa

SEQ ID NO: 3486001 - DNA, 20 bp, Homo sapiens
ataactagatggtgctgaga

SEQ ID NO: 3486002 - DNA, 16 bp, Homo sapiens
ataactagtgttgctt

SEQ ID NO: 3486003 - DNA, 16 bp, Homo sapiens
ataacttcaagcaaac

SEQ ID NO: 3486004 - DNA, 12 bp, Homo sapiens
ataacttcctgt

SEQ ID NO: 3486005 - DNA, 12 bp, Homo sapiens
ataactttttaa

SEQ ID NO: 3486006 - DNA, 17 bp, Homo sapiens
ataagaaaaaccaaaat

SEQ ID NO: 3486007 - DNA, 14 bp, Homo sapiens
ataagaaaaacttt

SEQ ID NO: 3486008 - DNA, 21 bp, Homo sapiens
ataagaataaaatgttgaaaa

SEQ ID NO: 3486009 - DNA, 21 bp, Homo sapiens
ataagacaatgacatacgctt

SEQ ID NO: 3486010 - DNA, 23 bp, Homo sapiens
ataagcaaagggagcactgggtt

SEQ ID NO: 3486011 - DNA, 23 bp, Homo sapiens
ataagtaaagtgattaaagtgct

SEQ ID NO: 3486012 - DNA, 20 bp, Homo sapiens
ataagtaagaaatttctagt

SEQ ID NO: 3486013 - DNA, 18 bp, Homo sapiens
agtgctcgctgttgctga

SEQ ID NO: 3486014 - DNA, 20 bp, Homo sapiens
agtgctcgctgttgctgaat

SEQ ID NO: 3486015 - DNA, 22 bp, Homo sapiens
agtgctcgctgttgctgaatag

SEQ ID NO: 3486016 - DNA, 23 bp, Homo sapiens
agtgctcgctgttgctgaatagg

SEQ ID NO: 3486017 - DNA, 18 bp, Homo sapiens
agtgctctaggctgcccc

SEQ ID NO: 3486018 - DNA, 19 bp, Homo sapiens
agtgctctaggctgccccg

SEQ ID NO: 3486019 - DNA, 17 bp, Homo sapiens
agtgctgcagctccctg

SEQ ID NO: 3486020 - DNA, 22 bp, Homo sapiens
agtgctgcagctccctggcttc

SEQ ID NO: 3486021 - DNA, 21 bp, Homo sapiens
agtgctgggattacaggtgtg

SEQ ID NO: 3486022 - DNA, 14 bp, Homo sapiens
agtgctgtataaaa

SEQ ID NO: 3486023 - DNA, 15 bp, Homo sapiens
agtgctgtataaaat

SEQ ID NO: 3486024 - DNA, 17 bp, Homo sapiens
agtgctgtataaaatca

SEQ ID NO: 3486025 - DNA, 22 bp, Homo sapiens
agtgctgtataaaatcagccaa

SEQ ID NO: 3486026 - DNA, 22 bp, Homo sapiens
agtggaaagacagcttctcatc

SEQ ID NO: 3486027 - DNA, 19 bp, Homo sapiens
agtggaccttaggccttcc

SEQ ID NO: 3486028 - DNA, 14 bp, Homo sapiens
agtggaggcacttt

SEQ ID NO: 3486029 - DNA, 17 bp, Homo sapiens
agtggaggcactttagg

SEQ ID NO: 3486030 - DNA, 19 bp, Homo sapiens
agtggaggtgggctgggcc

SEQ ID NO: 3486031 - DNA, 20 bp, Homo sapiens
agtggatgatgtttcgtgaa

SEQ ID NO: 3486032 - DNA, 14 bp, Homo sapiens
agtggattgcattt

SEQ ID NO: 3486033 - DNA, 13 bp, Homo sapiens
agtggcagctgct

SEQ ID NO: 3486034 - DNA, 18 bp, Homo sapiens
agtggcaggggacaggag

SEQ ID NO: 3486035 - DNA, 15 bp, Homo sapiens
agtggcctctttgtc

SEQ ID NO: 3486036 - DNA, 21 bp, Homo sapiens
agtggcctctttgtctaaaac

SEQ ID NO: 3486037 - DNA, 12 bp, Homo sapiens
agtggctgctgc

SEQ ID NO: 3486038 - DNA, 13 bp, Homo sapiens
agtggctgctgcc

SEQ ID NO: 3486039 - DNA, 17 bp, Homo sapiens
agtggctgctgcccagg

SEQ ID NO: 3486040 - DNA, 19 bp, Homo sapiens
agtggcttcattagagcag

SEQ ID NO: 3486041 - DNA, 20 bp, Homo sapiens
agtggcttcattagagcagg

SEQ ID NO: 3486042 - DNA, 21 bp, Homo sapiens
agtggcttcattagagcaggc

SEQ ID NO: 3486043 - DNA, 22 bp, Homo sapiens
agtggcttcattagagcaggcg

SEQ ID NO: 3486044 - DNA, 15 bp, Homo sapiens
agtgggagctgcctg

SEQ ID NO: 3486045 - DNA, 17 bp, Homo sapiens
agtgggaggcaaatggg

SEQ ID NO: 3486046 - DNA, 16 bp, Homo sapiens
agtgggcttgattctg

SEQ ID NO: 3486047 - DNA, 13 bp, Homo sapiens
agtggggctctct

SEQ ID NO: 3486048 - DNA, 19 bp, Homo sapiens
agtgggtaaaattagatgc

SEQ ID NO: 3486049 - DNA, 18 bp, Homo sapiens
agtgggtgaataatacag

SEQ ID NO: 3486050 - DNA, 22 bp, Homo sapiens
agtgggtgcatatgtacagaag

SEQ ID NO: 3486051 - DNA, 17 bp, Homo sapiens
agtggtcctagaggccc

SEQ ID NO: 3486052 - DNA, 20 bp, Homo sapiens
agtggtggtaaccctggtgg

SEQ ID NO: 3486053 - DNA, 18 bp, Homo sapiens
agtggttttaggatactt

SEQ ID NO: 3486054 - DNA, 14 bp, Homo sapiens
agtgtaacactgca

SEQ ID NO: 3486055 - DNA, 20 bp, Homo sapiens
agtgtacccacgctgggtat

SEQ ID NO: 3486056 - DNA, 23 bp, Homo sapiens
agtgtacccacgctgggtattac

SEQ ID NO: 3486057 - DNA, 14 bp, Homo sapiens
agtgtacctcctct

SEQ ID NO: 3486058 - DNA, 22 bp, Homo sapiens
agtgtacctcctctcagtgttt

SEQ ID NO: 3486059 - DNA, 13 bp, Homo sapiens
agtgtaggcagac

SEQ ID NO: 3486060 - DNA, 18 bp, Homo sapiens
agtgtaggcagacacagg

SEQ ID NO: 3486061 - DNA, 14 bp, Homo sapiens
agtgtcaggaggaa

SEQ ID NO: 3486062 - DNA, 17 bp, Homo sapiens
agtgtccaaagcagggt

SEQ ID NO: 3486063 - DNA, 14 bp, Homo sapiens
agtgtctgtgtgtg

SEQ ID NO: 3486064 - DNA, 15 bp, Homo sapiens
agtgtctttcggaat

SEQ ID NO: 3486065 - DNA, 15 bp, Homo sapiens
agtgtcttttgacat

SEQ ID NO: 3486066 - DNA, 14 bp, Homo sapiens
agtgtgaactggac

SEQ ID NO: 3486067 - DNA, 23 bp, Homo sapiens
agtgtgaactggaccctgttgct

SEQ ID NO: 3486068 - DNA, 20 bp, Homo sapiens
agtgtgaagcttccttggct

SEQ ID NO: 3486069 - DNA, 23 bp, Homo sapiens
agtgtgacaaggattgctactgt

SEQ ID NO: 3486070 - DNA, 15 bp, Homo sapiens
agtgtgaggccaggg

SEQ ID NO: 3486071 - DNA, 17 bp, Homo sapiens
agtgtgcactaaggggc

SEQ ID NO: 3486072 - DNA, 22 bp, Homo sapiens
agtgtgcactaaggggcccggc

SEQ ID NO: 3486073 - DNA, 21 bp, Homo sapiens
agtgtgcctgaagtcccagat

SEQ ID NO: 3486074 - DNA, 12 bp, Homo sapiens
agtgtgctttat

SEQ ID NO: 3486075 - DNA, 21 bp, Homo sapiens
agtgtgctttatgctgaaaca

SEQ ID NO: 3486076 - DNA, 15 bp, Homo sapiens
agtgtgggacaggct

SEQ ID NO: 3486077 - DNA, 16 bp, Homo sapiens
agtgtgggacaggctc

SEQ ID NO: 3486078 - DNA, 22 bp, Homo sapiens
agtgtgtattaaaaaaaacaaa

SEQ ID NO: 3486079 - DNA, 17 bp, Homo sapiens
agtgttacctgtgtgct

SEQ ID NO: 3486080 - DNA, 13 bp, Homo sapiens
agtgttatgtatt

SEQ ID NO: 3486081 - DNA, 21 bp, Homo sapiens
agtgttccccttccactgagg

SEQ ID NO: 3486082 - DNA, 18 bp, Homo sapiens
agtgttccctgagaaacc

SEQ ID NO: 3486083 - DNA, 17 bp, Homo sapiens
agtgttctgagctgtat

SEQ ID NO: 3486084 - DNA, 12 bp, Homo sapiens
agtgttgaaggg

SEQ ID NO: 3486085 - DNA, 19 bp, Homo sapiens
agtgttgaagggaggtggc

SEQ ID NO: 3486086 - DNA, 18 bp, Homo sapiens
agtgttttatgagaaagc

SEQ ID NO: 3486087 - DNA, 17 bp, Homo sapiens
agtgttttctttgagga

SEQ ID NO: 3486088 - DNA, 23 bp, Homo sapiens
agtgttttgtaccagtgaatttt

SEQ ID NO: 3486089 - DNA, 21 bp, Homo sapiens
agttaaatagagtatatgcac

SEQ ID NO: 3486090 - DNA, 23 bp, Homo sapiens
agttaaatagagtatatgcactt

SEQ ID NO: 3486091 - DNA, 16 bp, Homo sapiens
agttaagacctggcag

SEQ ID NO: 3486092 - DNA, 19 bp, Homo sapiens
agttaaggtgggcccggcc

SEQ ID NO: 3486093 - DNA, 15 bp, Homo sapiens
agttaatattgtgaa

SEQ ID NO: 3486094 - DNA, 20 bp, Homo sapiens
agttaatgcttaagagggaa

SEQ ID NO: 3486095 - DNA, 22 bp, Homo sapiens
agttacataattcactctgagt

SEQ ID NO: 3486096 - DNA, 19 bp, Homo sapiens
agttactaggtaacttcat

SEQ ID NO: 3486097 - DNA, 15 bp, Homo sapiens
agttactctgaaggg

SEQ ID NO: 3486098 - DNA, 12 bp, Homo sapiens
agttagagctga

SEQ ID NO: 3486099 - DNA, 17 bp, Homo sapiens
agttagccaaacaacaa

SEQ ID NO: 3486100 - DNA, 23 bp, Homo sapiens
agttagccaaacaacaacaaaaa

SEQ ID NO: 3486101 - DNA, 23 bp, Homo sapiens
agttatatttcagatgtaatgtt

SEQ ID NO: 3486102 - DNA, 21 bp, Homo sapiens
agttatcaaaaagtattatca

SEQ ID NO: 3486103 - DNA, 17 bp, Homo sapiens
agttatctaaaagaaat

SEQ ID NO: 3486104 - DNA, 19 bp, Homo sapiens
agttattaagttctttaaa

SEQ ID NO: 3486105 - DNA, 22 bp, Homo sapiens
agttattaatttttaaggatgt

SEQ ID NO: 3486106 - DNA, 20 bp, Homo sapiens
agttattacatgtaatttga

SEQ ID NO: 3486107 - DNA, 19 bp, Homo sapiens
agttattggtggaatcttt

SEQ ID NO: 3486108 - DNA, 16 bp, Homo sapiens
agttatttttgtacat

SEQ ID NO: 3486109 - DNA, 13 bp, Homo sapiens
agttcaaaattct

SEQ ID NO: 3486110 - DNA, 23 bp, Homo sapiens
agttcaaagaagtcatggcccaa

SEQ ID NO: 3486111 - DNA, 13 bp, Homo sapiens
agttcaatcctac

SEQ ID NO: 3486112 - DNA, 17 bp, Homo sapiens
agttcacagtgtttctt

SEQ ID NO: 3486113 - DNA, 22 bp, Homo sapiens
agttcagatcttaatataaatt

SEQ ID NO: 3486114 - DNA, 21 bp, Homo sapiens
agttcaggtagctgcccctgg

SEQ ID NO: 3486115 - DNA, 14 bp, Homo sapiens
agttccccatgcag

SEQ ID NO: 3486116 - DNA, 19 bp, Homo sapiens
agttctaggaaattcttga

SEQ ID NO: 3486117 - DNA, 15 bp, Homo sapiens
agttctgctgaatgc

SEQ ID NO: 3486118 - DNA, 23 bp, Homo sapiens
agttctggatggtgtgccttcca

SEQ ID NO: 3486119 - DNA, 12 bp, Homo sapiens
agttctgggtgc

SEQ ID NO: 3486120 - DNA, 17 bp, Homo sapiens
agttctgggtgctccct

SEQ ID NO: 3486121 - DNA, 19 bp, Homo sapiens
agttctgggtgctccctac

SEQ ID NO: 3486122 - DNA, 16 bp, Homo sapiens
agttctgtagaaatgg

SEQ ID NO: 3486123 - DNA, 17 bp, Homo sapiens
agttctgtagaaatggt

SEQ ID NO: 3486124 - DNA, 19 bp, Homo sapiens
agttctttccataataaaa

SEQ ID NO: 3486125 - DNA, 15 bp, Homo sapiens
agttctttgggccag

SEQ ID NO: 3486126 - DNA, 16 bp, Homo sapiens
agttctttgggccaga

SEQ ID NO: 3486127 - DNA, 17 bp, Homo sapiens
agttgacacctgagaaa

SEQ ID NO: 3486128 - DNA, 18 bp, Homo sapiens
agttgagaaggtgcctgc

SEQ ID NO: 3486129 - DNA, 15 bp, Homo sapiens
agttgatatagaaca

SEQ ID NO: 3486130 - DNA, 17 bp, Homo sapiens
agttgatatagaacagt

SEQ ID NO: 3486131 - DNA, 13 bp, Homo sapiens
agttgatctggaa

SEQ ID NO: 3486132 - DNA, 15 bp, Homo sapiens
agttgatctggaacc

SEQ ID NO: 3486133 - DNA, 15 bp, Homo sapiens
agttgatgttgcatt

SEQ ID NO: 3486134 - DNA, 21 bp, Homo sapiens
agttgattttacaattgaaat

SEQ ID NO: 3486135 - DNA, 20 bp, Homo sapiens
agttgcacggctgctgaggc

SEQ ID NO: 3486136 - DNA, 21 bp, Homo sapiens
agttgcatggcatcacctcca

SEQ ID NO: 3486137 - DNA, 14 bp, Homo sapiens
agttgccaatatgc

SEQ ID NO: 3486138 - DNA, 22 bp, Homo sapiens
agttgccaatatgccagcttgg

SEQ ID NO: 3486139 - DNA, 18 bp, Homo sapiens
agttgccattattctatg

SEQ ID NO: 3486140 - DNA, 22 bp, Homo sapiens
agtcaaattaataatcttatta

SEQ ID NO: 3486141 - DNA, 15 bp, Homo sapiens
agtcaagaagaaaaa

SEQ ID NO: 3486142 - DNA, 15 bp, Homo sapiens
agtcaagctcctcct

SEQ ID NO: 3486143 - DNA, 17 bp, Homo sapiens
agtcaagctcctcctcc

SEQ ID NO: 3486144 - DNA, 16 bp, Homo sapiens
agtcaagtgaaaaagg

SEQ ID NO: 3486145 - DNA, 24 bp, Homo sapiens
agtcaatcaagtctgtttactgca

SEQ ID NO: 3486146 - DNA, 22 bp, Homo sapiens
agtcacacagtattacttctgc

SEQ ID NO: 3486147 - DNA, 19 bp, Homo sapiens
agtcacacgggggcagctg

SEQ ID NO: 3486148 - DNA, 13 bp, Homo sapiens
agtcacagccacc

SEQ ID NO: 3486149 - DNA, 15 bp, Homo sapiens
agtcacattctgctt

SEQ ID NO: 3486150 - DNA, 13 bp, Homo sapiens
agtcaccaagccc

SEQ ID NO: 3486151 - DNA, 18 bp, Homo sapiens
agtcaccattctgcattt

SEQ ID NO: 3486152 - DNA, 19 bp, Homo sapiens
agtcaccattctgcattta

SEQ ID NO: 3486153 - DNA, 23 bp, Homo sapiens
agtcaccattctgcatttagctg

SEQ ID NO: 3486154 - DNA, 21 bp, Homo sapiens
agtcacgtggaggagcagtgc

SEQ ID NO: 3486155 - DNA, 24 bp, Homo sapiens
agtcactgtgagctcccaggtgca

SEQ ID NO: 3486156 - DNA, 13 bp, Homo sapiens
agtcagctctctg

SEQ ID NO: 3486157 - DNA, 20 bp, Homo sapiens
agtcagctcttcatctgccc

SEQ ID NO: 3486158 - DNA, 22 bp, Homo sapiens
agtcagctcttcatctgcccaa

SEQ ID NO: 3486159 - DNA, 12 bp, Homo sapiens
agtcagtgctgg

SEQ ID NO: 3486160 - DNA, 14 bp, Homo sapiens
agtcataccaatga

SEQ ID NO: 3486161 - DNA, 14 bp, Homo sapiens
agtcatctcaacca

SEQ ID NO: 3486162 - DNA, 19 bp, Homo sapiens
agtcatggcccaaatccag

SEQ ID NO: 3486163 - DNA, 17 bp, Homo sapiens
agtcattcgttctgtgg

SEQ ID NO: 3486164 - DNA, 18 bp, Homo sapiens
agtcattggctttatcct

SEQ ID NO: 3486165 - DNA, 21 bp, Homo sapiens
agtcattggctttatcctctt

SEQ ID NO: 3486166 - DNA, 15 bp, Homo sapiens
agtccaaatctccaa

SEQ ID NO: 3486167 - DNA, 23 bp, Homo sapiens
agtccaagcaacagcctttgaat

SEQ ID NO: 3486168 - DNA, 21 bp, Homo sapiens
agtccaaggaaaccacagctg

SEQ ID NO: 3486169 - DNA, 17 bp, Homo sapiens
agtccaattttaattta

SEQ ID NO: 3486170 - DNA, 21 bp, Homo sapiens
agtccaattttaatttagtaa

SEQ ID NO: 3486171 - DNA, 14 bp, Homo sapiens
agtccacaaaataa

SEQ ID NO: 3486172 - DNA, 14 bp, Homo sapiens
agtccactttgttt

SEQ ID NO: 3486173 - DNA, 16 bp, Homo sapiens
agtccccagaagcaga

SEQ ID NO: 3486174 - DNA, 18 bp, Homo sapiens
agtcccccagcagaacca

SEQ ID NO: 3486175 - DNA, 23 bp, Homo sapiens
agtcccccagcagaaccagcctc

SEQ ID NO: 3486176 - DNA, 18 bp, Homo sapiens
agtccctgtcacctcttc

SEQ ID NO: 3486177 - DNA, 22 bp, Homo sapiens
agtccgtgctgacagctgctcc

SEQ ID NO: 3486178 - DNA, 15 bp, Homo sapiens
agtccgtgggctggc

SEQ ID NO: 3486179 - DNA, 23 bp, Homo sapiens
agtcctaggcccctgccctgtag

SEQ ID NO: 3486180 - DNA, 14 bp, Homo sapiens
agtcctcttttctg

SEQ ID NO: 3486181 - DNA, 19 bp, Homo sapiens
agtcctcttttctgagagg

SEQ ID NO: 3486182 - DNA, 22 bp, Homo sapiens
agtcctcttttctgagaggact

SEQ ID NO: 3486183 - DNA, 13 bp, Homo sapiens
agtcctgaagcag

SEQ ID NO: 3486184 - DNA, 21 bp, Homo sapiens
agtcctgctacctcccttgcc

SEQ ID NO: 3486185 - DNA, 24 bp, Homo sapiens
agtcctgctacctcccttgccttt

SEQ ID NO: 3486186 - DNA, 17 bp, Homo sapiens
agtcctggatgttgtgt

SEQ ID NO: 3486187 - DNA, 15 bp, Homo sapiens
agtcctggcttcagg

SEQ ID NO: 3486188 - DNA, 17 bp, Homo sapiens
agtcctgtatgtctgtc

SEQ ID NO: 3486189 - DNA, 19 bp, Homo sapiens
agtcctgtatgtctgtcat

SEQ ID NO: 3486190 - DNA, 20 bp, Homo sapiens
agtcctgtatgtctgtcatt

SEQ ID NO: 3486191 - DNA, 23 bp, Homo sapiens
agtcctgtatgtctgtcattgta

SEQ ID NO: 3486192 - DNA, 13 bp, Homo sapiens
agtcctgtgaatg

SEQ ID NO: 3486193 - DNA, 18 bp, Homo sapiens
agtcctgtgaatgccact

SEQ ID NO: 3486194 - DNA, 11 bp, Homo sapiens
agtccttccac

SEQ ID NO: 3486195 - DNA, 13 bp, Homo sapiens
agtcctttgtgaa

SEQ ID NO: 3486196 - DNA, 15 bp, Homo sapiens
agtcctttgtgaata

SEQ ID NO: 3486197 - DNA, 12 bp, Homo sapiens
agtccttttgta

SEQ ID NO: 3486198 - DNA, 16 bp, Homo sapiens
agtcctttttttccat

SEQ ID NO: 3486199 - DNA, 19 bp, Homo sapiens
agtcgatagagctgtatta

SEQ ID NO: 3486200 - DNA, 18 bp, Homo sapiens
agtcgtgagctcttgtga

SEQ ID NO: 3486201 - DNA, 15 bp, Homo sapiens
agtcgtgcctgtgtc

SEQ ID NO: 3486202 - DNA, 20 bp, Homo sapiens
agtctaacacagttgaccct

SEQ ID NO: 3486203 - DNA, 12 bp, Homo sapiens
agtctagtgtag

SEQ ID NO: 3486204 - DNA, 11 bp, Homo sapiens
agtctatggcc

SEQ ID NO: 3486205 - DNA, 16 bp, Homo sapiens
agtctatgttcaaaga

SEQ ID NO: 3486206 - DNA, 23 bp, Homo sapiens
agtctcactctcgtcgcccaggc

SEQ ID NO: 3486207 - DNA, 19 bp, Homo sapiens
agtctcactgttgcccagg

SEQ ID NO: 3486208 - DNA, 20 bp, Homo sapiens
agtctcactgttgcccaggc

SEQ ID NO: 3486209 - DNA, 22 bp, Homo sapiens
agtctctttattttactagaaa

SEQ ID NO: 3486210 - DNA, 16 bp, Homo sapiens
agtctgattcccaagc

SEQ ID NO: 3486211 - DNA, 22 bp, Homo sapiens
agtctgattcccaagctctgct

SEQ ID NO: 3486212 - DNA, 13 bp, Homo sapiens
agtctgcaaaatg

SEQ ID NO: 3486213 - DNA, 17 bp, Homo sapiens
agtctggaatgcagtgg

SEQ ID NO: 3486214 - DNA, 13 bp, Homo sapiens
agtctggccctag

SEQ ID NO: 3486215 - DNA, 14 bp, Homo sapiens
agtctgtggatcag

SEQ ID NO: 3486216 - DNA, 15 bp, Homo sapiens
agtcttatcaagcag

SEQ ID NO: 3486217 - DNA, 16 bp, Homo sapiens
agtcttgcagcaggat

SEQ ID NO: 3486218 - DNA, 18 bp, Homo sapiens
agtctttcacatttaaat

SEQ ID NO: 3486219 - DNA, 13 bp, Homo sapiens
agtctttcagatg

SEQ ID NO: 3486220 - DNA, 17 bp, Homo sapiens
agtctttgccagtcatt

SEQ ID NO: 3486221 - DNA, 19 bp, Homo sapiens
agtcttttgcttttggcaa

SEQ ID NO: 3486222 - DNA, 20 bp, Homo sapiens
agtcttttgcttttggcaaa

SEQ ID NO: 3486223 - DNA, 16 bp, Homo sapiens
agtgaacttgggccac

SEQ ID NO: 3486224 - DNA, 17 bp, Homo sapiens
agtgaagaatccttttg

SEQ ID NO: 3486225 - DNA, 15 bp, Homo sapiens
agtgaagacagaagt

SEQ ID NO: 3486226 - DNA, 16 bp, Homo sapiens
agtgaagctctcaccc

SEQ ID NO: 3486227 - DNA, 15 bp, Homo sapiens
agtgaaggtttacaa

SEQ ID NO: 3486228 - DNA, 15 bp, Homo sapiens
agtgaatttttctct

SEQ ID NO: 3486229 - DNA, 23 bp, Homo sapiens
agtgaatttttctctaactcaga

SEQ ID NO: 3486230 - DNA, 22 bp, Homo sapiens
agtgaatttttgcaataatgca

SEQ ID NO: 3486231 - DNA, 23 bp, Homo sapiens
agtgaatttttgcaataatgcag

SEQ ID NO: 3486232 - DNA, 13 bp, Homo sapiens
agtgacagagacc

SEQ ID NO: 3486233 - DNA, 19 bp, Homo sapiens
agtgacagtggattgcatt

SEQ ID NO: 3486234 - DNA, 18 bp, Homo sapiens
agtgacctgaggaagcgt

SEQ ID NO: 3486235 - DNA, 16 bp, Homo sapiens
agtgactaatggcatg

SEQ ID NO: 3486236 - DNA, 19 bp, Homo sapiens
agtgactgttcaagagcac

SEQ ID NO: 3486237 - DNA, 17 bp, Homo sapiens
agtgagaataggcagcc

SEQ ID NO: 3486238 - DNA, 14 bp, Homo sapiens
agtgaggagaatga

SEQ ID NO: 3486239 - DNA, 19 bp, Homo sapiens
agtgagggagggctgtcat

SEQ ID NO: 3486240 - DNA, 14 bp, Homo sapiens
agtgagtgtttcta

SEQ ID NO: 3486241 - DNA, 19 bp, Homo sapiens
agtgataatttctggaatt

SEQ ID NO: 3486242 - DNA, 15 bp, Homo sapiens
agtgatagtcttttg

SEQ ID NO: 3486243 - DNA, 17 bp, Homo sapiens
agtgatagtcttttgct

SEQ ID NO: 3486244 - DNA, 21 bp, Homo sapiens
agtgatagtcttttgcttttg

SEQ ID NO: 3486245 - DNA, 17 bp, Homo sapiens
agtgatatggagcaaga

SEQ ID NO: 3486246 - DNA, 24 bp, Homo sapiens
agtgatcctcccacctcagcctcc

SEQ ID NO: 3486247 - DNA, 13 bp, Homo sapiens
agtgatgtgctga

SEQ ID NO: 3486248 - DNA, 19 bp, Homo sapiens
agtgattctcctgcctcag

SEQ ID NO: 3486249 - DNA, 16 bp, Homo sapiens
agtgcaacctctgctt

SEQ ID NO: 3486250 - DNA, 16 bp, Homo sapiens
agtgcaactgttttga

SEQ ID NO: 3486251 - DNA, 22 bp, Homo sapiens
agtgcaataaatctgacccagt

SEQ ID NO: 3486252 - DNA, 18 bp, Homo sapiens
agtgcacggggcacagcg

SEQ ID NO: 3486253 - DNA, 21 bp, Homo sapiens
agtgcagccaagtagcctctc

SEQ ID NO: 3486254 - DNA, 22 bp, Homo sapiens
agtgcagtcctgatcagagccg

SEQ ID NO: 3486255 - DNA, 23 bp, Homo sapiens
agtgcagtcctgatcagagccgt

SEQ ID NO: 3486256 - DNA, 17 bp, Homo sapiens
agtgcagtgagccgaga

SEQ ID NO: 3486257 - DNA, 16 bp, Homo sapiens
agtgcatatttatcca

SEQ ID NO: 3486258 - DNA, 13 bp, Homo sapiens
agtgcatctactt

SEQ ID NO: 3486259 - DNA, 21 bp, Homo sapiens
agtgcattgtttctgtgggcg

SEQ ID NO: 3486260 - DNA, 21 bp, Homo sapiens
agtgcatttgtgctagaaatt

SEQ ID NO: 3486261 - DNA, 15 bp, Homo sapiens
agtgccatgtaaatc

SEQ ID NO: 3486262 - DNA, 15 bp, Homo sapiens
agtgcccaactgtta

SEQ ID NO: 3486263 - DNA, 14 bp, Homo sapiens
agtgcccacaggat

SEQ ID NO: 3486264 - DNA, 14 bp, Homo sapiens
agtgcccccactga

SEQ ID NO: 3486265 - DNA, 22 bp, Homo sapiens
agtgcctacatcccgggcctca

SEQ ID NO: 3486266 - DNA, 15 bp, Homo sapiens
agtgccttctgtggg

SEQ ID NO: 3486267 - DNA, 19 bp, Homo sapiens
agtgccttttgcagaagag

SEQ ID NO: 3486268 - DNA, 14 bp, Homo sapiens
agtgctaagtgtga

SEQ ID NO: 3486269 - DNA, 15 bp, Homo sapiens
agtgctaagtgtgaa

SEQ ID NO: 3486270 - DNA, 15 bp, Homo sapiens
agtgctcagggaaat

SEQ ID NO: 3486271 - DNA, 23 bp, Homo sapiens
agtgctcagggaaatggccttcc

SEQ ID NO: 3486272 - DNA, 18 bp, Homo sapiens
agtgctcccctctgaaag

SEQ ID NO: 3486273 - DNA, 14 bp, Homo sapiens
agtgctccctcaca

SEQ ID NO: 3486274 - DNA, 20 bp, Homo sapiens
agtgctcgagtcacattctg

SEQ ID NO: 3486275 - DNA, 23 bp, Homo sapiens
agtgctcgagtcacattctgctt

SEQ ID NO: 3486276 - DNA, 14 bp, Homo sapiens
aggccagtgagcca

SEQ ID NO: 3486277 - DNA, 22 bp, Homo sapiens
aggccatctgggctcctccagg

SEQ ID NO: 3486278 - DNA, 18 bp, Homo sapiens
aggccatgggcctcctgt

SEQ ID NO: 3486279 - DNA, 17 bp, Homo sapiens
aggccattgtgaaccaa

SEQ ID NO: 3486280 - DNA, 15 bp, Homo sapiens
aggcccaggctggga

SEQ ID NO: 3486281 - DNA, 17 bp, Homo sapiens
aggcccaggctgggaac

SEQ ID NO: 3486282 - DNA, 13 bp, Homo sapiens
aggccccactggg

SEQ ID NO: 3486283 - DNA, 12 bp, Homo sapiens
aggccccaggaa

SEQ ID NO: 3486284 - DNA, 13 bp, Homo sapiens
aggccccaggaag

SEQ ID NO: 3486285 - DNA, 13 bp, Homo sapiens
aggcccccaagcc

SEQ ID NO: 3486286 - DNA, 18 bp, Homo sapiens
aggcccccacttgcctct

SEQ ID NO: 3486287 - DNA, 20 bp, Homo sapiens
aggcccccacttgcctcttc

SEQ ID NO: 3486288 - DNA, 19 bp, Homo sapiens
aggcccccagcccagggct

SEQ ID NO: 3486289 - DNA, 17 bp, Homo sapiens
aggccccccgcagcacc

SEQ ID NO: 3486290 - DNA, 21 bp, Homo sapiens
aggcccctatgtagtccgtgc

SEQ ID NO: 3486291 - DNA, 21 bp, Homo sapiens
aggcccctggaggctgcctcc

SEQ ID NO: 3486292 - DNA, 13 bp, Homo sapiens
aggcccggcctat

SEQ ID NO: 3486293 - DNA, 13 bp, Homo sapiens
aggcccggctcca

SEQ ID NO: 3486294 - DNA, 20 bp, Homo sapiens
aggcccggctccaggctcct

SEQ ID NO: 3486295 - DNA, 21 bp, Homo sapiens
aggcccggctccaggctcctt

SEQ ID NO: 3486296 - DNA, 20 bp, Homo sapiens
aggccctccctgttccccag

SEQ ID NO: 3486297 - DNA, 22 bp, Homo sapiens
aggccctccctgttccccagag

SEQ ID NO: 3486298 - DNA, 23 bp, Homo sapiens
aggccctccctgttccccagaga

SEQ ID NO: 3486299 - DNA, 22 bp, Homo sapiens
aggccctcgctgccagctctgt

SEQ ID NO: 3486300 - DNA, 14 bp, Homo sapiens
aggccctggcctcc

SEQ ID NO: 3486301 - DNA, 23 bp, Homo sapiens
aggccctggcctcccctgccacc

SEQ ID NO: 3486302 - DNA, 14 bp, Homo sapiens
aggccctttgctgt

SEQ ID NO: 3486303 - DNA, 16 bp, Homo sapiens
aggccctttgctgtcc

SEQ ID NO: 3486304 - DNA, 20 bp, Homo sapiens
aggtctcataggttgagcaa

SEQ ID NO: 3486305 - DNA, 20 bp, Homo sapiens
aggtcttcatcgaatctact

SEQ ID NO: 3486306 - DNA, 17 bp, Homo sapiens
aggtcttgaactcctgg

SEQ ID NO: 3486307 - DNA, 23 bp, Homo sapiens
aggtcttgaactcctggcctcaa

SEQ ID NO: 3486308 - DNA, 11 bp, Homo sapiens
aggtctttcct

SEQ ID NO: 3486309 - DNA, 15 bp, Homo sapiens
aggtgaaatgaagca

SEQ ID NO: 3486310 - DNA, 15 bp, Homo sapiens
aggtgaacagtcacg

SEQ ID NO: 3486311 - DNA, 17 bp, Homo sapiens
aggtgaaggaatatatg

SEQ ID NO: 3486312 - DNA, 15 bp, Homo sapiens
aggtgacagagtgag

SEQ ID NO: 3486313 - DNA, 22 bp, Homo sapiens
aggtgacagagtgagactctgt

SEQ ID NO: 3486314 - DNA, 15 bp, Homo sapiens
aggtgagaaaaaaac

SEQ ID NO: 3486315 - DNA, 14 bp, Homo sapiens
aggtgagcagacag

SEQ ID NO: 3486316 - DNA, 13 bp, Homo sapiens
aggtgaggcctgt

SEQ ID NO: 3486317 - DNA, 17 bp, Homo sapiens
aggtgaggcctgtctgt

SEQ ID NO: 3486318 - DNA, 19 bp, Homo sapiens
aggtgatatccattctttc

SEQ ID NO: 3486319 - DNA, 14 bp, Homo sapiens
aggtgatccaccca

SEQ ID NO: 3486320 - DNA, 21 bp, Homo sapiens
aggtgatccacccacctcagc

SEQ ID NO: 3486321 - DNA, 23 bp, Homo sapiens
aggtgatccacccacctcagcct

SEQ ID NO: 3486322 - DNA, 16 bp, Homo sapiens
aggtgccatggaagag

SEQ ID NO: 3486323 - DNA, 20 bp, Homo sapiens
aggtgcccttggaggccagc

SEQ ID NO: 3486324 - DNA, 21 bp, Homo sapiens
aggtgcccttggaggccagcc

SEQ ID NO: 3486325 - DNA, 13 bp, Homo sapiens
aggtgcctgccat

SEQ ID NO: 3486326 - DNA, 21 bp, Homo sapiens
aggtgcctgccatagccagga

SEQ ID NO: 3486327 - DNA, 11 bp, Homo sapiens
aggtgccttct

SEQ ID NO: 3486328 - DNA, 23 bp, Homo sapiens
aggtgccttcttcagggcctggt

SEQ ID NO: 3486329 - DNA, 16 bp, Homo sapiens
aggtgcggccaccacc

SEQ ID NO: 3486330 - DNA, 16 bp, Homo sapiens
aggtgctgacggccag

SEQ ID NO: 3486331 - DNA, 16 bp, Homo sapiens
aggtgctgccatccag

SEQ ID NO: 3486332 - DNA, 16 bp, Homo sapiens
aggtgctggagcactg

SEQ ID NO: 3486333 - DNA, 15 bp, Homo sapiens
aggtggcaaggctgt

SEQ ID NO: 3486334 - DNA, 12 bp, Homo sapiens
aggtggccatgc

SEQ ID NO: 3486335 - DNA, 19 bp, Homo sapiens
aggtggccatgcctcagcc

SEQ ID NO: 3486336 - DNA, 23 bp, Homo sapiens
aggtggcctctccttgtggcctg

SEQ ID NO: 3486337 - DNA, 12 bp, Homo sapiens
aggtgggcccgg

SEQ ID NO: 3486338 - DNA, 14 bp, Homo sapiens
aggtgggctgggcc

SEQ ID NO: 3486339 - DNA, 21 bp, Homo sapiens
aggtgggcttcccagtggctg

SEQ ID NO: 3486340 - DNA, 13 bp, Homo sapiens
aggtggggcagct

SEQ ID NO: 3486341 - DNA, 16 bp, Homo sapiens
aggtggggcagcttga

SEQ ID NO: 3486342 - DNA, 23 bp, Homo sapiens
aggtgggttttcatcaagactgg

SEQ ID NO: 3486343 - DNA, 16 bp, Homo sapiens
aggtgtcaacttttga

SEQ ID NO: 3486344 - DNA, 16 bp, Homo sapiens
aggtgtccctgcactt

SEQ ID NO: 3486345 - DNA, 17 bp, Homo sapiens
aggtgtgaggaggaggc

SEQ ID NO: 3486346 - DNA, 15 bp, Homo sapiens
aggttaaaaaaatgg

SEQ ID NO: 3486347 - DNA, 21 bp, Homo sapiens
aggttaaaaaaatggcagtga

SEQ ID NO: 3486348 - DNA, 23 bp, Homo sapiens
aggttaaaaaaatggcagtgatg

SEQ ID NO: 3486349 - DNA, 13 bp, Homo sapiens
aggttcagccaag

SEQ ID NO: 3486350 - DNA, 13 bp, Homo sapiens
aggttcagcttgt

SEQ ID NO: 3486351 - DNA, 16 bp, Homo sapiens
aggttcccaagctcag

SEQ ID NO: 3486352 - DNA, 21 bp, Homo sapiens
aggttccgcttggagcagagg

SEQ ID NO: 3486353 - DNA, 16 bp, Homo sapiens
aggttctgggttttct

SEQ ID NO: 3486354 - DNA, 18 bp, Homo sapiens
aggttctgggttttctga

SEQ ID NO: 3486355 - DNA, 20 bp, Homo sapiens
aggttggcaaaaaggcagga

SEQ ID NO: 3486356 - DNA, 12 bp, Homo sapiens
aggttgtgaatg

SEQ ID NO: 3486357 - DNA, 16 bp, Homo sapiens
aggttgttcctaaaat

SEQ ID NO: 3486358 - DNA, 23 bp, Homo sapiens
aggtttacaatttacaaagtgtg

SEQ ID NO: 3486359 - DNA, 23 bp, Homo sapiens
aggtttctggtctctaggctggg

SEQ ID NO: 3486360 - DNA, 15 bp, Homo sapiens
aggttttgtaaagat

SEQ ID NO: 3486361 - DNA, 23 bp, Homo sapiens
aggtttttaaacactaaaatata

SEQ ID NO: 3486362 - DNA, 13 bp, Homo sapiens
aggtttttattag

SEQ ID NO: 3486363 - DNA, 21 bp, Homo sapiens
aggtttttttgtatagtaaag

SEQ ID NO: 3486364 - DNA, 22 bp, Homo sapiens
aggtttttttgtcaacattgtg

SEQ ID NO: 3486365 - DNA, 20 bp, Homo sapiens
agtaaaagaaaccacttctg

SEQ ID NO: 3486366 - DNA, 21 bp, Homo sapiens
agtaaaattgccatattgcac

SEQ ID NO: 3486367 - DNA, 23 bp, Homo sapiens
agtaaaattgccatattgcacat

SEQ ID NO: 3486368 - DNA, 15 bp, Homo sapiens
agtaaatcttttaca

SEQ ID NO: 3486369 - DNA, 23 bp, Homo sapiens
agtaaatgttatcttatactgta

SEQ ID NO: 3486370 - DNA, 20 bp, Homo sapiens
agtaacccccactggactga

SEQ ID NO: 3486371 - DNA, 22 bp, Homo sapiens
agtaactcataatctataaaca

SEQ ID NO: 3486372 - DNA, 14 bp, Homo sapiens
agtaactgacaact

SEQ ID NO: 3486373 - DNA, 23 bp, Homo sapiens
agtaagaaaatattttgtctaaa

SEQ ID NO: 3486374 - DNA, 14 bp, Homo sapiens
agtaagaggctgga

SEQ ID NO: 3486375 - DNA, 20 bp, Homo sapiens
agtaagccgtgattttcatt

SEQ ID NO: 3486376 - DNA, 21 bp, Homo sapiens
agtaagcctcatcatcagagc

SEQ ID NO: 3486377 - DNA, 21 bp, Homo sapiens
agtaatgagtttaaaaatcaa

SEQ ID NO: 3486378 - DNA, 20 bp, Homo sapiens
agtaatgttaaacaccattt

SEQ ID NO: 3486379 - DNA, 12 bp, Homo sapiens
agtaatttccta

SEQ ID NO: 3486380 - DNA, 12 bp, Homo sapiens
agtaatttcctt

SEQ ID NO: 3486381 - DNA, 21 bp, Homo sapiens
agtaatttctttttttccttt

SEQ ID NO: 3486382 - DNA, 17 bp, Homo sapiens
agtaccaccaaaaaagc

SEQ ID NO: 3486383 - DNA, 19 bp, Homo sapiens
agtaccatagtaccattta

SEQ ID NO: 3486384 - DNA, 21 bp, Homo sapiens
agtaccatagtaccatttata

SEQ ID NO: 3486385 - DNA, 23 bp, Homo sapiens
agtaccatagtaccatttataca

SEQ ID NO: 3486386 - DNA, 16 bp, Homo sapiens
agtacctcagcattta

SEQ ID NO: 3486387 - DNA, 12 bp, Homo sapiens
agtacctcctgt

SEQ ID NO: 3486388 - DNA, 17 bp, Homo sapiens
agtactctacaattcct

SEQ ID NO: 3486389 - DNA, 15 bp, Homo sapiens
agtactggcatggta

SEQ ID NO: 3486390 - DNA, 19 bp, Homo sapiens
agtacttctccaccctgct

SEQ ID NO: 3486391 - DNA, 14 bp, Homo sapiens
agtacttgtcatat

SEQ ID NO: 3486392 - DNA, 16 bp, Homo sapiens
agtagaaaggccttta

SEQ ID NO: 3486393 - DNA, 21 bp, Homo sapiens
agtagaatctcagttgatttt

SEQ ID NO: 3486394 - DNA, 15 bp, Homo sapiens
agtagaattgcattg

SEQ ID NO: 3486395 - DNA, 20 bp, Homo sapiens
agtagaccaaatcttgttat

SEQ ID NO: 3486396 - DNA, 12 bp, Homo sapiens
agtagagacagg

SEQ ID NO: 3486397 - DNA, 12 bp, Homo sapiens
agtagagctggg

SEQ ID NO: 3486398 - DNA, 19 bp, Homo sapiens
agtagattaaaaattatag

SEQ ID NO: 3486399 - DNA, 23 bp, Homo sapiens
agtagcagggggggaaatgcatt

SEQ ID NO: 3486400 - DNA, 14 bp, Homo sapiens
agtagctagtttgc

SEQ ID NO: 3486401 - DNA, 15 bp, Homo sapiens
agtagctctcctgac

SEQ ID NO: 3486402 - DNA, 22 bp, Homo sapiens
agtagctgctaccttctttggc

SEQ ID NO: 3486403 - DNA, 19 bp, Homo sapiens
agtagctgggactacaggc

SEQ ID NO: 3486404 - DNA, 17 bp, Homo sapiens
agtagtttgagaccagc

SEQ ID NO: 3486405 - DNA, 22 bp, Homo sapiens
agtatcactgtctttcctagat

SEQ ID NO: 3486406 - DNA, 16 bp, Homo sapiens
agtatgcttgctctaa

SEQ ID NO: 3486407 - DNA, 15 bp, Homo sapiens
agtatggatgggtgg

SEQ ID NO: 3486408 - DNA, 13 bp, Homo sapiens
agtatggtacatt

SEQ ID NO: 3486409 - DNA, 19 bp, Homo sapiens
agtatggtacatttttcaa

SEQ ID NO: 3486410 - DNA, 22 bp, Homo sapiens
agtatggtacatttttcaactt

SEQ ID NO: 3486411 - DNA, 17 bp, Homo sapiens
agtatgtgggggcttca

SEQ ID NO: 3486412 - DNA, 22 bp, Homo sapiens
agtatgtgggggcttcatctct

SEQ ID NO: 3486413 - DNA, 15 bp, Homo sapiens
agtattattttccaa

SEQ ID NO: 3486414 - DNA, 12 bp, Homo sapiens
agtattgtaaat

SEQ ID NO: 3486415 - DNA, 14 bp, Homo sapiens
agtattgtaaatta

SEQ ID NO: 3486416 - DNA, 18 bp, Homo sapiens
agtattgtaaattatatt

SEQ ID NO: 3486417 - DNA, 22 bp, Homo sapiens
agtattgtaaattatatttgtg

SEQ ID NO: 3486418 - DNA, 19 bp, Homo sapiens
agtatttaattagtgctaa

SEQ ID NO: 3486419 - DNA, 23 bp, Homo sapiens
agtatttgattcaaaatatttaa

SEQ ID NO: 3486420 - DNA, 17 bp, Homo sapiens
agtatttgggaagtgaa

SEQ ID NO: 3486421 - DNA, 21 bp, Homo sapiens
agtatttgggaagtgaagact

SEQ ID NO: 3486422 - DNA, 20 bp, Homo sapiens
agtattttagtgaacttgaa

SEQ ID NO: 3486423 - DNA, 15 bp, Homo sapiens
agtattttgtgtcct

SEQ ID NO: 3486424 - DNA, 17 bp, Homo sapiens
agtcaaaactacaaatc

SEQ ID NO: 3486425 - DNA, 12 bp, Homo sapiens
agtcaaagtaaa

SEQ ID NO: 3486426 - DNA, 21 bp, Homo sapiens
agtcaaagtaaaacttgctgc

SEQ ID NO: 3486427 - DNA, 15 bp, Homo sapiens
agtcaaattaataat

SEQ ID NO: 3486428 - DNA, 19 bp, Homo sapiens
aggagagagccttgggagc

SEQ ID NO: 3486429 - DNA, 21 bp, Homo sapiens
aggagagagccttgggagcca

SEQ ID NO: 3486430 - DNA, 18 bp, Homo sapiens
aggagagatagcctgtgg

SEQ ID NO: 3486431 - DNA, 19 bp, Homo sapiens
aggagagatagcctgtggc

SEQ ID NO: 3486432 - DNA, 20 bp, Homo sapiens
aggagaggcaacatccaaaa

SEQ ID NO: 3486433 - DNA, 21 bp, Homo sapiens
aggagaggcaacatccaaaat

SEQ ID NO: 3486434 - DNA, 14 bp, Homo sapiens
aggagaggggcaca

SEQ ID NO: 3486435 - DNA, 16 bp, Homo sapiens
aggagaggggcacagg

SEQ ID NO: 3486436 - DNA, 18 bp, Homo sapiens
aggagaggggcacagggt

SEQ ID NO: 3486437 - DNA, 18 bp, Homo sapiens
aggagatgctccttgggc

SEQ ID NO: 3486438 - DNA, 20 bp, Homo sapiens
aggagatggaagttgcagtg

SEQ ID NO: 3486439 - DNA, 15 bp, Homo sapiens
aggagcaaaggctga

SEQ ID NO: 3486440 - DNA, 19 bp, Homo sapiens
aggagcagcctcagaacaa

SEQ ID NO: 3486441 - DNA, 16 bp, Homo sapiens
aggagcagtgcaggca

SEQ ID NO: 3486442 - DNA, 19 bp, Homo sapiens
aggagcagtgcaggcacag

SEQ ID NO: 3486443 - DNA, 17 bp, Homo sapiens
aggagcccagaaaacct

SEQ ID NO: 3486444 - DNA, 16 bp, Homo sapiens
aggagccccattcctg

SEQ ID NO: 3486445 - DNA, 18 bp, Homo sapiens
aggagcccctggacatgc

SEQ ID NO: 3486446 - DNA, 23 bp, Homo sapiens
aggagcccttatctgtgctcagg

SEQ ID NO: 3486447 - DNA, 14 bp, Homo sapiens
aggagcgcatctca

SEQ ID NO: 3486448 - DNA, 22 bp, Homo sapiens
aggagctgccttggctcagaca

SEQ ID NO: 3486449 - DNA, 19 bp, Homo sapiens
aggagctgctatagcctgg

SEQ ID NO: 3486450 - DNA, 18 bp, Homo sapiens
aggagctgggatcctaag

SEQ ID NO: 3486451 - DNA, 11 bp, Homo sapiens
aggagcttcct

SEQ ID NO: 3486452 - DNA, 20 bp, Homo sapiens
aggaggaaacgggttaaaaa

SEQ ID NO: 3486453 - DNA, 18 bp, Homo sapiens
aggaggatgtaaggcctt

SEQ ID NO: 3486454 - DNA, 21 bp, Homo sapiens
aggaggcaaatggcactgcag

SEQ ID NO: 3486455 - DNA, 21 bp, Homo sapiens
aggaggccctggtcctggcct

SEQ ID NO: 3486456 - DNA, 21 bp, Homo sapiens
aggaggcgtctcgggagagga

SEQ ID NO: 3486457 - DNA, 17 bp, Homo sapiens
aggaggggaaaaaaatg

SEQ ID NO: 3486458 - DNA, 23 bp, Homo sapiens
aggaggggcccccctgccctgtg

SEQ ID NO: 3486459 - DNA, 18 bp, Homo sapiens
aggagtacaggtgaagca

SEQ ID NO: 3486460 - DNA, 12 bp, Homo sapiens
aggagtgagcac

SEQ ID NO: 3486461 - DNA, 18 bp, Homo sapiens
aggagtgtgtgatttttt

SEQ ID NO: 3486462 - DNA, 14 bp, Homo sapiens
aggataaattgcca

SEQ ID NO: 3486463 - DNA, 15 bp, Homo sapiens
aggataaattgccat

SEQ ID NO: 3486464 - DNA, 18 bp, Homo sapiens
agataagtgtatttttca

SEQ ID NO: 3486465 - DNA, 17 bp, Homo sapiens
agataatatgagaatca

SEQ ID NO: 3486466 - DNA, 19 bp, Homo sapiens
agatacaaatggtggagga

SEQ ID NO: 3486467 - DNA, 18 bp, Homo sapiens
agatacagaactctttca

SEQ ID NO: 3486468 - DNA, 16 bp, Homo sapiens
agatacatacagaatt

SEQ ID NO: 3486469 - DNA, 19 bp, Homo sapiens
agatactgctactgtaatt

SEQ ID NO: 3486470 - DNA, 23 bp, Homo sapiens
agatactgctactgtaattttat

SEQ ID NO: 3486471 - DNA, 22 bp, Homo sapiens
agatacttggggggctgaggtg

SEQ ID NO: 3486472 - DNA, 20 bp, Homo sapiens
agatagataggtcagtgcaa

SEQ ID NO: 3486473 - DNA, 22 bp, Homo sapiens
agatagggaaaaggggctcctt

SEQ ID NO: 3486474 - DNA, 14 bp, Homo sapiens
agatagtcatgctg

SEQ ID NO: 3486475 - DNA, 16 bp, Homo sapiens
agatagtcatgctgct

SEQ ID NO: 3486476 - DNA, 13 bp, Homo sapiens
agatataagtgct

SEQ ID NO: 3486477 - DNA, 16 bp, Homo sapiens
agatataagtgctgta

SEQ ID NO: 3486478 - DNA, 17 bp, Homo sapiens
agatatattaaaaatat

SEQ ID NO: 3486479 - DNA, 21 bp, Homo sapiens
agatatattaaaaatataaaa

SEQ ID NO: 3486480 - DNA, 20 bp, Homo sapiens
agatatattaagtgactgtt

SEQ ID NO: 3486481 - DNA, 18 bp, Homo sapiens
agatatcttcagtttaat

SEQ ID NO: 3486482 - DNA, 23 bp, Homo sapiens
agatatcttcagtttaatgcaag

SEQ ID NO: 3486483 - DNA, 13 bp, Homo sapiens
agatattatgtat

SEQ ID NO: 3486484 - DNA, 20 bp, Homo sapiens
agatattatgtataaaatgt

SEQ ID NO: 3486485 - DNA, 14 bp, Homo sapiens
agatattggacaaa

SEQ ID NO: 3486486 - DNA, 13 bp, Homo sapiens
agatattttccat

SEQ ID NO: 3486487 - DNA, 16 bp, Homo sapiens
agatcaaggagcccag

SEQ ID NO: 3486488 - DNA, 18 bp, Homo sapiens
agatcacgccactgcact

SEQ ID NO: 3486489 - DNA, 21 bp, Homo sapiens
agatcagaaaaatggagcaaa

SEQ ID NO: 3486490 - DNA, 15 bp, Homo sapiens
agatcagtgtaccat

SEQ ID NO: 3486491 - DNA, 18 bp, Homo sapiens
agatcagtgtaccatttg

SEQ ID NO: 3486492 - DNA, 14 bp, Homo sapiens
agatcatttctagg

SEQ ID NO: 3486493 - DNA, 13 bp, Homo sapiens
agatccagcctgg

SEQ ID NO: 3486494 - DNA, 13 bp, Homo sapiens
agatccaggacta

SEQ ID NO: 3486495 - DNA, 19 bp, Homo sapiens
agatccagggacagaggcc

SEQ ID NO: 3486496 - DNA, 22 bp, Homo sapiens
agatccagggacagaggcccca

SEQ ID NO: 3486497 - DNA, 16 bp, Homo sapiens
agatcccaggcccctg

SEQ ID NO: 3486498 - DNA, 12 bp, Homo sapiens
agatcctcctgc

SEQ ID NO: 3486499 - DNA, 17 bp, Homo sapiens
agatcctctctggggct

SEQ ID NO: 3486500 - DNA, 12 bp, Homo sapiens
agatcctcttct

SEQ ID NO: 3486501 - DNA, 15 bp, Homo sapiens
agatcctgtgaggag

SEQ ID NO: 3486502 - DNA, 14 bp, Homo sapiens
agatcgcatttcct

SEQ ID NO: 3486503 - DNA, 16 bp, Homo sapiens
agatcgcatttcctaa

SEQ ID NO: 3486504 - DNA, 17 bp, Homo sapiens
agatctctgcagggccg

SEQ ID NO: 3486505 - DNA, 21 bp, Homo sapiens
agatctgacatgattccttcc

SEQ ID NO: 3486506 - DNA, 15 bp, Homo sapiens
agatctggaacctca

SEQ ID NO: 3486507 - DNA, 20 bp, Homo sapiens
agatctggaacctcagcctg

SEQ ID NO: 3486508 - DNA, 19 bp, Homo sapiens
agatctgtcctcagccttg

SEQ ID NO: 3486509 - DNA, 14 bp, Homo sapiens
agatcttgcctcca

SEQ ID NO: 3486510 - DNA, 23 bp, Homo sapiens
agatctttattatggaaaacatt

SEQ ID NO: 3486511 - DNA, 19 bp, Homo sapiens
agatgaagttttacattgt

SEQ ID NO: 3486512 - DNA, 14 bp, Homo sapiens
agatgacagctctt

SEQ ID NO: 3486513 - DNA, 21 bp, Homo sapiens
agatgacagctcttctaagga

SEQ ID NO: 3486514 - DNA, 21 bp, Homo sapiens
agctaccattttacatttcta

SEQ ID NO: 3486515 - DNA, 23 bp, Homo sapiens
agctacctcaaccaatgccaaaa

SEQ ID NO: 3486516 - DNA, 16 bp, Homo sapiens
agctactctgatccct

SEQ ID NO: 3486517 - DNA, 19 bp, Homo sapiens
agctagccagaggactgtg

SEQ ID NO: 3486518 - DNA, 15 bp, Homo sapiens
agctagctcaactag

SEQ ID NO: 3486519 - DNA, 22 bp, Homo sapiens
agctaggagaagggctgaaccc

SEQ ID NO: 3486520 - DNA, 21 bp, Homo sapiens
agctaggcctggccagatgca

SEQ ID NO: 3486521 - DNA, 12 bp, Homo sapiens
agctagtttgct

SEQ ID NO: 3486522 - DNA, 17 bp, Homo sapiens
agctagtttgctttttg

SEQ ID NO: 3486523 - DNA, 16 bp, Homo sapiens
agctatacctgtgcct

SEQ ID NO: 3486524 - DNA, 16 bp, Homo sapiens
agctatcctggctctt

SEQ ID NO: 3486525 - DNA, 14 bp, Homo sapiens
agctatctgcctga

SEQ ID NO: 3486526 - DNA, 15 bp, Homo sapiens
agctatctgcctgac

SEQ ID NO: 3486527 - DNA, 16 bp, Homo sapiens
agctatctgcctgaca

SEQ ID NO: 3486528 - DNA, 22 bp, Homo sapiens
agctatgttatattgaaaaaat

SEQ ID NO: 3486529 - DNA, 21 bp, Homo sapiens
agctattggcctcccaaaaga

SEQ ID NO: 3486530 - DNA, 22 bp, Homo sapiens
agctattggcctcccaaaagac

SEQ ID NO: 3486531 - DNA, 23 bp, Homo sapiens
agctattggcctcccaaaagact

SEQ ID NO: 3486532 - DNA, 22 bp, Homo sapiens
agctcaaagcgtggacaggtgt

SEQ ID NO: 3486533 - DNA, 15 bp, Homo sapiens
agctcaaaggcacag

SEQ ID NO: 3486534 - DNA, 19 bp, Homo sapiens
agctcaagatgacagctct

SEQ ID NO: 3486535 - DNA, 19 bp, Homo sapiens
agctcaaggaaaggcctga

SEQ ID NO: 3486536 - DNA, 14 bp, Homo sapiens
agctcaccagcccc

SEQ ID NO: 3486537 - DNA, 15 bp, Homo sapiens
agctcaccagcccca

SEQ ID NO: 3486538 - DNA, 16 bp, Homo sapiens
agctcaccagccccag

SEQ ID NO: 3486539 - DNA, 16 bp, Homo sapiens
agctcagcatttccac

SEQ ID NO: 3486540 - DNA, 18 bp, Homo sapiens
agctcaggaccaggcaat

SEQ ID NO: 3486541 - DNA, 18 bp, Homo sapiens
agctcatctatttggaac

SEQ ID NO: 3486542 - DNA, 14 bp, Homo sapiens
agctcatctctgtc

SEQ ID NO: 3486543 - DNA, 18 bp, Homo sapiens
agctccaacctgcaaaga

SEQ ID NO: 3486544 - DNA, 14 bp, Homo sapiens
agctccactctgct

SEQ ID NO: 3486545 - DNA, 13 bp, Homo sapiens
agctccagctcac

SEQ ID NO: 3486546 - DNA, 18 bp, Homo sapiens
agctccagctcaccagcc

SEQ ID NO: 3486547 - DNA, 17 bp, Homo sapiens
agctccatactctgtcc

SEQ ID NO: 3486548 - DNA, 22 bp, Homo sapiens
agctccatcaatgaggtatctt

SEQ ID NO: 3486549 - DNA, 23 bp, Homo sapiens
agctcccaagggatggtgccctg

SEQ ID NO: 3486550 - DNA, 15 bp, Homo sapiens
agctccccaggactc

SEQ ID NO: 3486551 - DNA, 20 bp, Homo sapiens
agctccccaggactcaccct

SEQ ID NO: 3486552 - DNA, 23 bp, Homo sapiens
agctccccctcccccactgccat

SEQ ID NO: 3486553 - DNA, 20 bp, Homo sapiens
agctccccgcttctgcctgc

SEQ ID NO: 3486554 - DNA, 16 bp, Homo sapiens
agctccctggcttctg

SEQ ID NO: 3486555 - DNA, 18 bp, Homo sapiens
agctccctggcttctgtg

SEQ ID NO: 3486556 - DNA, 15 bp, Homo sapiens
agctccgcaggactt

SEQ ID NO: 3486557 - DNA, 23 bp, Homo sapiens
agctccgcaggacttccccggag

SEQ ID NO: 3486558 - DNA, 21 bp, Homo sapiens
agctccgctttctacccagcg

SEQ ID NO: 3486559 - DNA, 16 bp, Homo sapiens
agctcctcactcacct

SEQ ID NO: 3486560 - DNA, 12 bp, Homo sapiens
agctcctcagcg

SEQ ID NO: 3486561 - DNA, 16 bp, Homo sapiens
agctcctcagcggctc

SEQ ID NO: 3486562 - DNA, 23 bp, Homo sapiens
agctcctctccccagcccagaga

SEQ ID NO: 3486563 - DNA, 12 bp, Homo sapiens
agctccttctgt

SEQ ID NO: 3486564 - DNA, 16 bp, Homo sapiens
agctccttctgtccta

SEQ ID NO: 3486565 - DNA, 23 bp, Homo sapiens
agctccttctgtcctactctgtg

SEQ ID NO: 3486566 - DNA, 20 bp, Homo sapiens
agctccttgggaggccccac

SEQ ID NO: 3486567 - DNA, 22 bp, Homo sapiens
agctccttgggaggccccactg

SEQ ID NO: 3486568 - DNA, 14 bp, Homo sapiens
agctcggctcagct

SEQ ID NO: 3486569 - DNA, 15 bp, Homo sapiens
agctcggtacccggg

SEQ ID NO: 3486570 - DNA, 19 bp, Homo sapiens
agctctacccagggcctgc

SEQ ID NO: 3486571 - DNA, 22 bp, Homo sapiens
agctctatgtttacaaatggac

SEQ ID NO: 3486572 - DNA, 17 bp, Homo sapiens
agctctcagttgcagcc

SEQ ID NO: 3486573 - DNA, 17 bp, Homo sapiens
agctctcctgactttta

SEQ ID NO: 3486574 - DNA, 22 bp, Homo sapiens
agctctcggaactgcatgctgc

SEQ ID NO: 3486575 - DNA, 17 bp, Homo sapiens
agctctctgccctgtgt

SEQ ID NO: 3486576 - DNA, 19 bp, Homo sapiens
agctctctgccctgtgtac

SEQ ID NO: 3486577 - DNA, 18 bp, Homo sapiens
agctctgaaaccagtgtt

SEQ ID NO: 3486578 - DNA, 12 bp, Homo sapiens
agctctgctcct

SEQ ID NO: 3486579 - DNA, 17 bp, Homo sapiens
agctctggaggggaggg

SEQ ID NO: 3486580 - DNA, 15 bp, Homo sapiens
agctctggccccagg

SEQ ID NO: 3486581 - DNA, 18 bp, Homo sapiens
agctctggccccaggctt

SEQ ID NO: 3486582 - DNA, 22 bp, Homo sapiens
agctctggccccaggcttgtca

SEQ ID NO: 3486583 - DNA, 22 bp, Homo sapiens
agctctgtatcaggacccagag

SEQ ID NO: 3486584 - DNA, 20 bp, Homo sapiens
agctctgtgggtctctggaa

SEQ ID NO: 3486585 - DNA, 14 bp, Homo sapiens
agctcttcatctgc

SEQ ID NO: 3486586 - DNA, 15 bp, Homo sapiens
agctcttctaaggaa

SEQ ID NO: 3486587 - DNA, 17 bp, Homo sapiens
agctcttctccaggctg

SEQ ID NO: 3486588 - DNA, 16 bp, Homo sapiens
agctcttcttcccagc

SEQ ID NO: 3486589 - DNA, 20 bp, Homo sapiens
agctcttgacagaaagcagt

SEQ ID NO: 3486590 - DNA, 23 bp, Homo sapiens
agctcttgacagaaagcagttct

SEQ ID NO: 3486591 - DNA, 16 bp, Homo sapiens
agctcttggctccact

SEQ ID NO: 3486592 - DNA, 16 bp, Homo sapiens
agctcttgtgaggaaa

SEQ ID NO: 3486593 - DNA, 17 bp, Homo sapiens
agctcttgtgaggaaag

SEQ ID NO: 3486594 - DNA, 21 bp, Homo sapiens
agctcttgtgaggaaagtcat

SEQ ID NO: 3486595 - DNA, 12 bp, Homo sapiens
agctctttcctc

SEQ ID NO: 3486596 - DNA, 15 bp, Homo sapiens
agctctttcctcctt

SEQ ID NO: 3486597 - DNA, 17 bp, Homo sapiens
agctctttcctccttcc

SEQ ID NO: 3486598 - DNA, 23 bp, Homo sapiens
agctctttgagataatacattcc

SEQ ID NO: 3486599 - DNA, 18 bp, Homo sapiens
agctgaaatatgctggct

SEQ ID NO: 3486600 - DNA, 23 bp, Homo sapiens
agctgaacaataggctgttccca

SEQ ID NO: 3486601 - DNA, 19 bp, Homo sapiens
agctgaagagttgccccgt

SEQ ID NO: 3486602 - DNA, 20 bp, Homo sapiens
agctgaagagttgccccgtc

SEQ ID NO: 3486603 - DNA, 15 bp, Homo sapiens
agctgaatacattct

SEQ ID NO: 3486604 - DNA, 23 bp, Homo sapiens
agctgacccagccccttgagaaa

SEQ ID NO: 3486605 - DNA, 21 bp, Homo sapiens
agctgacctttaactgagggc

SEQ ID NO: 3486606 - DNA, 19 bp, Homo sapiens
agctgacgaacttccatgg

SEQ ID NO: 3486607 - DNA, 15 bp, Homo sapiens
agctgagcgccagga

SEQ ID NO: 3486608 - DNA, 15 bp, Homo sapiens
agctgaggcagcagt

SEQ ID NO: 3486609 - DNA, 13 bp, Homo sapiens
agctgcaaaggac

SEQ ID NO: 3486610 - DNA, 16 bp, Homo sapiens
agctgcaaaggacaga

SEQ ID NO: 3486611 - DNA, 13 bp, Homo sapiens
agctgcaaagtgt

SEQ ID NO: 3486612 - DNA, 15 bp, Homo sapiens
agctgcaaagtgttt

SEQ ID NO: 3486613 - DNA, 19 bp, Homo sapiens
agctgcaaagtgttttgta

SEQ ID NO: 3486614 - DNA, 22 bp, Homo sapiens
agctgcccatttcgtgagcccc

SEQ ID NO: 3486615 - DNA, 14 bp, Homo sapiens
agctgcccctctct

SEQ ID NO: 3486616 - DNA, 18 bp, Homo sapiens
agctgcccctctctgggc

SEQ ID NO: 3486617 - DNA, 18 bp, Homo sapiens
agctgccctatgggcctg

SEQ ID NO: 3486618 - DNA, 14 bp, Homo sapiens
agctgcctgttcag

SEQ ID NO: 3486619 - DNA, 20 bp, Homo sapiens
agctgcctgttcagctccag

SEQ ID NO: 3486620 - DNA, 22 bp, Homo sapiens
agctgccttagcttcaggaacc

SEQ ID NO: 3486621 - DNA, 17 bp, Homo sapiens
agctgccttggctcaga

SEQ ID NO: 3486622 - DNA, 20 bp, Homo sapiens
agctgccttggctcagacat

SEQ ID NO: 3486623 - DNA, 17 bp, Homo sapiens
agctgcggtccacccag

SEQ ID NO: 3486624 - DNA, 18 bp, Homo sapiens
agctgcggtccacccagg

SEQ ID NO: 3486625 - DNA, 23 bp, Homo sapiens
agctgcggtccacccaggagccc

SEQ ID NO: 3486626 - DNA, 15 bp, Homo sapiens
agctgctaccttctt

SEQ ID NO: 3486627 - DNA, 15 bp, Homo sapiens
agctgctagctattg

SEQ ID NO: 3486628 - DNA, 16 bp, Homo sapiens
agctgctcagggaaaa

SEQ ID NO: 3486629 - DNA, 16 bp, Homo sapiens
agctgctctgagccac

SEQ ID NO: 3486630 - DNA, 14 bp, Homo sapiens
agctgctggagact

SEQ ID NO: 3486631 - DNA, 17 bp, Homo sapiens
agctgcttcactaggga

SEQ ID NO: 3486632 - DNA, 24 bp, Homo sapiens
agctgcttttgtctatgggactca

SEQ ID NO: 3486633 - DNA, 14 bp, Homo sapiens
agctggagcctggt

SEQ ID NO: 3486634 - DNA, 19 bp, Homo sapiens
agctggagcctggtgccct

SEQ ID NO: 3486635 - DNA, 19 bp, Homo sapiens
agctggccaaagagccttt

SEQ ID NO: 3486636 - DNA, 13 bp, Homo sapiens
agctggccccgcc

SEQ ID NO: 3486637 - DNA, 14 bp, Homo sapiens
agctggccccgccg

SEQ ID NO: 3486638 - DNA, 14 bp, Homo sapiens
agctggctggggtg

SEQ ID NO: 3486639 - DNA, 15 bp, Homo sapiens
agctggctggggtgg

SEQ ID NO: 3486640 - DNA, 21 bp, Homo sapiens
agctggctggggtggcctgtg

SEQ ID NO: 3486641 - DNA, 19 bp, Homo sapiens
agctgggactacaggcacc

SEQ ID NO: 3486642 - DNA, 17 bp, Homo sapiens
agctgggactacaggtg

SEQ ID NO: 3486643 - DNA, 14 bp, Homo sapiens
agctgggcaggttg

SEQ ID NO: 3486644 - DNA, 18 bp, Homo sapiens
agctgggctagaggctga

SEQ ID NO: 3486645 - DNA, 15 bp, Homo sapiens
agctggggatccctc

SEQ ID NO: 3486646 - DNA, 17 bp, Homo sapiens
agctgggggtgggccag

SEQ ID NO: 3486647 - DNA, 19 bp, Homo sapiens
agctgggggtgggccaggc

SEQ ID NO: 3486648 - DNA, 14 bp, Homo sapiens
agctgggtcaggca

SEQ ID NO: 3486649 - DNA, 17 bp, Homo sapiens
agctgggtgtcaagagg

SEQ ID NO: 3486650 - DNA, 23 bp, Homo sapiens
agagacagttgggtgagaacaac

SEQ ID NO: 3486651 - DNA, 19 bp, Homo sapiens
agagaccaggcaaagcaag

SEQ ID NO: 3486652 - DNA, 15 bp, Homo sapiens
agagacccagatctc

SEQ ID NO: 3486653 - DNA, 17 bp, Homo sapiens
agagacccagatctcat

SEQ ID NO: 3486654 - DNA, 15 bp, Homo sapiens
agagacctcctgcct

SEQ ID NO: 3486655 - DNA, 23 bp, Homo sapiens
agagagaatgagagcgacacaga

SEQ ID NO: 3486656 - DNA, 15 bp, Homo sapiens
agagagagagagaaa

SEQ ID NO: 3486657 - DNA, 15 bp, Homo sapiens
agagagaggcaatgg

SEQ ID NO: 3486658 - DNA, 15 bp, Homo sapiens
agagagcaaggaagc

SEQ ID NO: 3486659 - DNA, 17 bp, Homo sapiens
agagagggaggcaagcc

SEQ ID NO: 3486660 - DNA, 15 bp, Homo sapiens
agagagggcaggcat

SEQ ID NO: 3486661 - DNA, 21 bp, Homo sapiens
agagagggtggtgacctctgc

SEQ ID NO: 3486662 - DNA, 18 bp, Homo sapiens
agagatattttgggcatg

SEQ ID NO: 3486663 - DNA, 20 bp, Homo sapiens
agagatattttgggcatgtg

SEQ ID NO: 3486664 - DNA, 22 bp, Homo sapiens
agagatcaaccccttcgctcct

SEQ ID NO: 3486665 - DNA, 12 bp, Homo sapiens
agagatggacag

SEQ ID NO: 3486666 - DNA, 22 bp, Homo sapiens
agagattggaatgggcagctca

SEQ ID NO: 3486667 - DNA, 14 bp, Homo sapiens
agagcaagactctg

SEQ ID NO: 3486668 - DNA, 13 bp, Homo sapiens
agagcaaggaagc

SEQ ID NO: 3486669 - DNA, 20 bp, Homo sapiens
agagcacacttggcccaagt

SEQ ID NO: 3486670 - DNA, 18 bp, Homo sapiens
agagcactgccaccagta

SEQ ID NO: 3486671 - DNA, 21 bp, Homo sapiens
agagcacttaagagaatattt

SEQ ID NO: 3486672 - DNA, 20 bp, Homo sapiens
agagcagaacagatctttta

SEQ ID NO: 3486673 - DNA, 21 bp, Homo sapiens
agagcaggactccaggcccaa

SEQ ID NO: 3486674 - DNA, 22 bp, Homo sapiens
agagcaggactccaggcccaag

SEQ ID NO: 3486675 - DNA, 17 bp, Homo sapiens
agagcagggggacctag

SEQ ID NO: 3486676 - DNA, 22 bp, Homo sapiens
agagcagtttctgtcctgctgg

SEQ ID NO: 3486677 - DNA, 10 bp, Homo sapiens
agagccaaac

SEQ ID NO: 3486678 - DNA, 20 bp, Homo sapiens
agagccaaacagagcccagg

SEQ ID NO: 3486679 - DNA, 16 bp, Homo sapiens
agagccaagttccaaa

SEQ ID NO: 3486680 - DNA, 19 bp, Homo sapiens
agagccacagggtctgcct

SEQ ID NO: 3486681 - DNA, 20 bp, Homo sapiens
agagccacagggtctgcctc

SEQ ID NO: 3486682 - DNA, 15 bp, Homo sapiens
agagccaccaagagg

SEQ ID NO: 3486683 - DNA, 11 bp, Homo sapiens
agagccagccg

SEQ ID NO: 3486684 - DNA, 18 bp, Homo sapiens
agagccatgtagaagctg

SEQ ID NO: 3486685 - DNA, 13 bp, Homo sapiens
agagcccagctcc

SEQ ID NO: 3486686 - DNA, 21 bp, Homo sapiens
agagccgtggtccctgaggat

SEQ ID NO: 3486687 - DNA, 20 bp, Homo sapiens
agagcctgtctttcagcatt

SEQ ID NO: 3486688 - DNA, 21 bp, Homo sapiens
agagcctgtctttcagcattc

SEQ ID NO: 3486689 - DNA, 14 bp, Homo sapiens
agagccttcagcct

SEQ ID NO: 3486690 - DNA, 11 bp, Homo sapiens
agagccttgcg

SEQ ID NO: 3486691 - DNA, 16 bp, Homo sapiens
agagccttgggagcca

SEQ ID NO: 3486692 - DNA, 22 bp, Homo sapiens
agaaatggttgtattagatgtt

SEQ ID NO: 3486693 - DNA, 21 bp, Homo sapiens
agaaatttaattcatgtttct

SEQ ID NO: 3486694 - DNA, 20 bp, Homo sapiens
agaacaaaaaaatctgcaga

SEQ ID NO: 3486695 - DNA, 23 bp, Homo sapiens
agaacaaaaaaatctgcagaagg

SEQ ID NO: 3486696 - DNA, 16 bp, Homo sapiens
agaacaaagtgagaca

SEQ ID NO: 3486697 - DNA, 17 bp, Homo sapiens
agaacaaccaaaatctt

SEQ ID NO: 3486698 - DNA, 17 bp, Homo sapiens
agaacaatattgacttt

SEQ ID NO: 3486699 - DNA, 21 bp, Homo sapiens
agaacaatattgactttgtct

SEQ ID NO: 3486700 - DNA, 15 bp, Homo sapiens
agaacaccctctaaa

SEQ ID NO: 3486701 - DNA, 14 bp, Homo sapiens
agaacagtatgaat

SEQ ID NO: 3486702 - DNA, 17 bp, Homo sapiens
agaacagtatgaatttg

SEQ ID NO: 3486703 - DNA, 20 bp, Homo sapiens
agaacataaaggtaaaacaa

SEQ ID NO: 3486704 - DNA, 16 bp, Homo sapiens
agaacatccctgccag

SEQ ID NO: 3486705 - DNA, 17 bp, Homo sapiens
agaacatgcagtttgaa

SEQ ID NO: 3486706 - DNA, 18 bp, Homo sapiens
agaacatgcagtttgaaa

SEQ ID NO: 3486707 - DNA, 20 bp, Homo sapiens
agaacatgcagtttgaaatt

SEQ ID NO: 3486708 - DNA, 23 bp, Homo sapiens
agaacatgcagtttgaaattctg

SEQ ID NO: 3486709 - DNA, 16 bp, Homo sapiens
agaacattttaattca

SEQ ID NO: 3486710 - DNA, 12 bp, Homo sapiens
agaacattttac

SEQ ID NO: 3486711 - DNA, 15 bp, Homo sapiens
agaacattttactgt

SEQ ID NO: 3486712 - DNA, 23 bp, Homo sapiens
agaacattttactgttgtacaat

SEQ ID NO: 3486713 - DNA, 16 bp, Homo sapiens
agaaccagtcccccca

SEQ ID NO: 3486714 - DNA, 22 bp, Homo sapiens
agaaccatccctattttgtatt

SEQ ID NO: 3486715 - DNA, 18 bp, Homo sapiens
agaacctcacgcacctcc

SEQ ID NO: 3486716 - DNA, 22 bp, Homo sapiens
actggccagggccacgctccag

SEQ ID NO: 3486717 - DNA, 13 bp, Homo sapiens
actggctttggct

SEQ ID NO: 3486718 - DNA, 17 bp, Homo sapiens
actgggcctgtagctca

SEQ ID NO: 3486719 - DNA, 16 bp, Homo sapiens
actgggctcccgggcc

SEQ ID NO: 3486720 - DNA, 14 bp, Homo sapiens
actgggctctggct

SEQ ID NO: 3486721 - DNA, 14 bp, Homo sapiens
actgggctgaggga

SEQ ID NO: 3486722 - DNA, 17 bp, Homo sapiens
actgggctgagggagcc

SEQ ID NO: 3486723 - DNA, 21 bp, Homo sapiens
actggggcctacagctttgat

SEQ ID NO: 3486724 - DNA, 13 bp, Homo sapiens
actggggcctcca

SEQ ID NO: 3486725 - DNA, 13 bp, Homo sapiens
actggggtctgtt

SEQ ID NO: 3486726 - DNA, 15 bp, Homo sapiens
actgggtacttgtgg

SEQ ID NO: 3486727 - DNA, 17 bp, Homo sapiens
actgggtacttgtggac

SEQ ID NO: 3486728 - DNA, 19 bp, Homo sapiens
actgggtacttgtggacac

SEQ ID NO: 3486729 - DNA, 20 bp, Homo sapiens
actgggtacttgtggacaca

SEQ ID NO: 3486730 - DNA, 22 bp, Homo sapiens
actgggtggtggcctggtccct

SEQ ID NO: 3486731 - DNA, 18 bp, Homo sapiens
actgggtttgtttttcaa

SEQ ID NO: 3486732 - DNA, 14 bp, Homo sapiens
actggtattttatc

SEQ ID NO: 3486733 - DNA, 16 bp, Homo sapiens
actggtgcactttgta

SEQ ID NO: 3486734 - DNA, 22 bp, Homo sapiens
actggtgttatcaccgtgggct

SEQ ID NO: 3486735 - DNA, 15 bp, Homo sapiens
actggtttctcagaa

SEQ ID NO: 3486736 - DNA, 23 bp, Homo sapiens
actgtaaaggcaagccagcatgt

SEQ ID NO: 3486737 - DNA, 11 bp, Homo sapiens
actgtaaatca

SEQ ID NO: 3486738 - DNA, 12 bp, Homo sapiens
actgtaaatcat

SEQ ID NO: 3486739 - DNA, 13 bp, Homo sapiens
actgtaacacttt

SEQ ID NO: 3486740 - DNA, 15 bp, Homo sapiens
actgtaagaataatt

SEQ ID NO: 3486741 - DNA, 19 bp, Homo sapiens
actgtaagaataatttata

SEQ ID NO: 3486742 - DNA, 20 bp, Homo sapiens
actgtaagacgtatgtaaca

SEQ ID NO: 3486743 - DNA, 13 bp, Homo sapiens
actgtaatgtgaa

SEQ ID NO: 3486744 - DNA, 15 bp, Homo sapiens
actgtaatgtgaatc

SEQ ID NO: 3486745 - DNA, 17 bp, Homo sapiens
actgtacaataaaaaca

SEQ ID NO: 3486746 - DNA, 12 bp, Homo sapiens
actgtacagggg

SEQ ID NO: 3486747 - DNA, 21 bp, Homo sapiens
actgtattttgtattgtttca

SEQ ID NO: 3486748 - DNA, 20 bp, Homo sapiens
actgtatttttacctttttc

SEQ ID NO: 3486749 - DNA, 24 bp, Homo sapiens
actgtcactcattgctgagcctct

SEQ ID NO: 3486750 - DNA, 15 bp, Homo sapiens
actgtcatgcttcat

SEQ ID NO: 3486751 - DNA, 24 bp, Homo sapiens
actgtcatgcttcatcattccctc

SEQ ID NO: 3486752 - DNA, 21 bp, Homo sapiens
actgtcctttccttggcttta

SEQ ID NO: 3486753 - DNA, 22 bp, Homo sapiens
actgtctccatggccctgcaaa

SEQ ID NO: 3486754 - DNA, 23 bp, Homo sapiens
actgtctgtgtttttttggcagt

SEQ ID NO: 3486755 - DNA, 19 bp, Homo sapiens
actgtctttaaaagagaga

SEQ ID NO: 3486756 - DNA, 23 bp, Homo sapiens
actgtgatgaagccgaccttaga

SEQ ID NO: 3486757 - DNA, 16 bp, Homo sapiens
actgtgccatgtgcca

SEQ ID NO: 3486758 - DNA, 18 bp, Homo sapiens
actgtgccatgtgccagg

SEQ ID NO: 3486759 - DNA, 14 bp, Homo sapiens
actgtgctcagggc

SEQ ID NO: 3486760 - DNA, 14 bp, Homo sapiens
actgtggctgtctg

SEQ ID NO: 3486761 - DNA, 17 bp, Homo sapiens
actgtgggcaatttaga

SEQ ID NO: 3486762 - DNA, 19 bp, Homo sapiens
actgtgggcaatttagaaa

SEQ ID NO: 3486763 - DNA, 18 bp, Homo sapiens
actgtgtgctgactgaac

SEQ ID NO: 3486764 - DNA, 16 bp, Homo sapiens
actgtgtgtgtgaatg

SEQ ID NO: 3486765 - DNA, 22 bp, Homo sapiens
actgtgtgtgtgaatgaacact

SEQ ID NO: 3486766 - DNA, 14 bp, Homo sapiens
actgtgttactgct

SEQ ID NO: 3486767 - DNA, 21 bp, Homo sapiens
actgtgttactgctttgcaaa

SEQ ID NO: 3486768 - DNA, 23 bp, Homo sapiens
actgtgttactgctttgcaaaga

SEQ ID NO: 3486769 - DNA, 15 bp, Homo sapiens
actgtgtttcaagtt

SEQ ID NO: 3486770 - DNA, 13 bp, Homo sapiens
actgttcaagagc

SEQ ID NO: 3486771 - DNA, 18 bp, Homo sapiens
actgttccccctgtgcag

SEQ ID NO: 3486772 - DNA, 17 bp, Homo sapiens
actgttgcccaggctgg

SEQ ID NO: 3486773 - DNA, 21 bp, Homo sapiens
actgttgtacaatcatgttct

SEQ ID NO: 3486774 - DNA, 20 bp, Homo sapiens
actgtttattgaaagaatta

SEQ ID NO: 3486775 - DNA, 13 bp, Homo sapiens
actgtttccttca

SEQ ID NO: 3486776 - DNA, 20 bp, Homo sapiens
actgttttctttatgtcttt

SEQ ID NO: 3486777 - DNA, 23 bp, Homo sapiens
actgttttttgttttttgtttga

SEQ ID NO: 3486778 - DNA, 14 bp, Homo sapiens
acttaaaagagctc

SEQ ID NO: 3486779 - DNA, 20 bp, Homo sapiens
acttaaaagagctcagacat

SEQ ID NO: 3486780 - DNA, 18 bp, Homo sapiens
acttaacaaatacattca

SEQ ID NO: 3486781 - DNA, 16 bp, Homo sapiens
acttaactgtttcaaa

SEQ ID NO: 3486782 - DNA, 18 bp, Homo sapiens
acttaagagaatatttta

SEQ ID NO: 3486783 - DNA, 19 bp, Homo sapiens
acttaagcaaaagaaaaag

SEQ ID NO: 3486784 - DNA, 20 bp, Homo sapiens
acttaagcaaaagaaaaaga

SEQ ID NO: 3486785 - DNA, 15 bp, Homo sapiens
acttaatagaaacat

SEQ ID NO: 3486786 - DNA, 23 bp, Homo sapiens
acttagggcaccaggggtttctc

SEQ ID NO: 3486787 - DNA, 18 bp, Homo sapiens
acttagtgacaaaataga

SEQ ID NO: 3486788 - DNA, 17 bp, Homo sapiens
acttatagttaatattt

SEQ ID NO: 3486789 - DNA, 22 bp, Homo sapiens
acttatattaatagtaatttgt

SEQ ID NO: 3486790 - DNA, 16 bp, Homo sapiens
acttatccctgcccat

SEQ ID NO: 3486791 - DNA, 17 bp, Homo sapiens
acttatgatttcatgtg

SEQ ID NO: 3486792 - DNA, 15 bp, Homo sapiens
acttatttaaactct

SEQ ID NO: 3486793 - DNA, 13 bp, Homo sapiens
acttatttaatgc

SEQ ID NO: 3486794 - DNA, 16 bp, Homo sapiens
acttcagctgactttt

SEQ ID NO: 3486795 - DNA, 17 bp, Homo sapiens
acttcaggccaacaagg

SEQ ID NO: 3486796 - DNA, 17 bp, Homo sapiens
acttcagtatgttgtca

SEQ ID NO: 3486797 - DNA, 23 bp, Homo sapiens
acttcagtatgttgtcaaagaga

SEQ ID NO: 3486798 - DNA, 14 bp, Homo sapiens
acttcatattgctg

SEQ ID NO: 3486799 - DNA, 22 bp, Homo sapiens
acttcatattgctgagagaaat

SEQ ID NO: 3486800 - DNA, 15 bp, Homo sapiens
acttcatcaaacatg

SEQ ID NO: 3486801 - DNA, 17 bp, Homo sapiens
acttcattttcagagtg

SEQ ID NO: 3486802 - DNA, 19 bp, Homo sapiens
acttccaaatcccctaagc

SEQ ID NO: 3486803 - DNA, 20 bp, Homo sapiens
acttccaggtgttactgtaa

SEQ ID NO: 3486804 - DNA, 21 bp, Homo sapiens
acttccaggtgttactgtaat

SEQ ID NO: 3486805 - DNA, 18 bp, Homo sapiens
acttccatggccctcatt

SEQ ID NO: 3486806 - DNA, 18 bp, Homo sapiens
acttcccgggccagggct

SEQ ID NO: 3486807 - DNA, 11 bp, Homo sapiens
acttccctgct

SEQ ID NO: 3486808 - DNA, 20 bp, Homo sapiens
acttcctaaatattatgaga

SEQ ID NO: 3486809 - DNA, 19 bp, Homo sapiens
acttcctgactctcacctg

SEQ ID NO: 3486810 - DNA, 23 bp, Homo sapiens
acttcctgtccagctccaacctg

SEQ ID NO: 3486811 - DNA, 22 bp, Homo sapiens
acttccttgagacacggagccc

SEQ ID NO: 3486812 - DNA, 22 bp, Homo sapiens
acttcggcagatactgtctctt

SEQ ID NO: 3486813 - DNA, 15 bp, Homo sapiens
acttcggccagagct

SEQ ID NO: 3486814 - DNA, 17 bp, Homo sapiens
acttcgggaggtcgagg

SEQ ID NO: 3486815 - DNA, 22 bp, Homo sapiens
acttcgggaggtcgaggcagga

SEQ ID NO: 3486816 - DNA, 14 bp, Homo sapiens
acttcgggctggcc

SEQ ID NO: 3486817 - DNA, 16 bp, Homo sapiens
acttctccaccctgct

SEQ ID NO: 3486818 - DNA, 21 bp, Homo sapiens
acttctctataaaaaatatgt

SEQ ID NO: 3486819 - DNA, 14 bp, Homo sapiens
acttctcttccttg

SEQ ID NO: 3486820 - DNA, 17 bp, Homo sapiens
acttctgggtggggcag

SEQ ID NO: 3486821 - DNA, 15 bp, Homo sapiens
acttctggtcaatca

SEQ ID NO: 3486822 - DNA, 16 bp, Homo sapiens
acttcttatggaattg

SEQ ID NO: 3486823 - DNA, 17 bp, Homo sapiens
acttcttatggaattga

SEQ ID NO: 3486824 - DNA, 20 bp, Homo sapiens
acttcttcacctcttccact

SEQ ID NO: 3486825 - DNA, 16 bp, Homo sapiens
acttcttcagagctga

SEQ ID NO: 3486826 - DNA, 13 bp, Homo sapiens
acttcttgaaggt

SEQ ID NO: 3486827 - DNA, 16 bp, Homo sapiens
acttcttgaaggtgct

SEQ ID NO: 3486828 - DNA, 18 bp, Homo sapiens
acttcttgccctggggat

SEQ ID NO: 3486829 - DNA, 20 bp, Homo sapiens
acttgaaatatcctgcttga

SEQ ID NO: 3486830 - DNA, 17 bp, Homo sapiens
acttgaacccgggaggc

SEQ ID NO: 3486831 - DNA, 18 bp, Homo sapiens
acttgaagggccagagcc

SEQ ID NO: 3486832 - DNA, 19 bp, Homo sapiens
acttgaagggccagagcca

SEQ ID NO: 3486833 - DNA, 12 bp, Homo sapiens
acttgaagttgt

SEQ ID NO: 3486834 - DNA, 13 bp, Homo sapiens
acttgaagttgtt

SEQ ID NO: 3486835 - DNA, 19 bp, Homo sapiens
acttgacccccttgagggt

SEQ ID NO: 3486836 - DNA, 21 bp, Homo sapiens
acttgcacagggattctcaca

SEQ ID NO: 3486837 - DNA, 19 bp, Homo sapiens
acttgcagactctacagag

SEQ ID NO: 3486838 - DNA, 15 bp, Homo sapiens
acttgcagtgtcttt

SEQ ID NO: 3486839 - DNA, 17 bp, Homo sapiens
acttgcatgaatgattt

SEQ ID NO: 3486840 - DNA, 11 bp, Homo sapiens
acttgcatttc

SEQ ID NO: 3486841 - DNA, 22 bp, Homo sapiens
acttgccgcgtcgccctcccag

SEQ ID NO: 3486842 - DNA, 12 bp, Homo sapiens
acttgcctcttc

SEQ ID NO: 3486843 - DNA, 13 bp, Homo sapiens
acttgcctcttcc

SEQ ID NO: 3486844 - DNA, 20 bp, Homo sapiens
acttgcctcttttacctgct

SEQ ID NO: 3486845 - DNA, 19 bp, Homo sapiens
acttgcttatcaacttcct

SEQ ID NO: 3486846 - DNA, 18 bp, Homo sapiens
acttggcatcagctggcg

SEQ ID NO: 3486847 - DNA, 14 bp, Homo sapiens
acttgggccactgt

SEQ ID NO: 3486848 - DNA, 16 bp, Homo sapiens
acttggtaattgtact

SEQ ID NO: 3486849 - DNA, 16 bp, Homo sapiens
acttggtttttaaaaa

SEQ ID NO: 3486850 - DNA, 18 bp, Homo sapiens
acttgtattaaagacaga

SEQ ID NO: 3486851 - DNA, 20 bp, Homo sapiens
acttgtcaagcctgtgcaaa

SEQ ID NO: 3486852 - DNA, 19 bp, Homo sapiens
aaatcaccacaaactgtaa

SEQ ID NO: 3486853 - DNA, 18 bp, Homo sapiens
aaatcagccaattatgtt

SEQ ID NO: 3486854 - DNA, 19 bp, Homo sapiens
aaatcagccgtgtaaccat

SEQ ID NO: 3486855 - DNA, 22 bp, Homo sapiens
aaatcataggaaagtatttttt

SEQ ID NO: 3486856 - DNA, 23 bp, Homo sapiens
aaatcatgccattgcactccagc

SEQ ID NO: 3486857 - DNA, 11 bp, Homo sapiens
aaatccaaaga

SEQ ID NO: 3486858 - DNA, 15 bp, Homo sapiens
aaatcccatttaaaa

SEQ ID NO: 3486859 - DNA, 21 bp, Homo sapiens
aaatcctatgtgattttaact

SEQ ID NO: 3486860 - DNA, 12 bp, Homo sapiens
catttcctgtgt

SEQ ID NO: 3486861 - DNA, 13 bp, Homo sapiens
catttctaggcaa

SEQ ID NO: 3486862 - DNA, 20 bp, Homo sapiens
catttctaggcaaaattgtg

SEQ ID NO: 3486863 - DNA, 14 bp, Homo sapiens
catttctatttatt

SEQ ID NO: 3486864 - DNA, 18 bp, Homo sapiens
catttctccagattatct

SEQ ID NO: 3486865 - DNA, 21 bp, Homo sapiens
catttctgtattttttgtttg

SEQ ID NO: 3486866 - DNA, 10 bp, Homo sapiens
catttgaatg

SEQ ID NO: 3486867 - DNA, 12 bp, Homo sapiens
catttgaatgca

SEQ ID NO: 3486868 - DNA, 13 bp, Homo sapiens
catttgaatgcat

SEQ ID NO: 3486869 - DNA, 14 bp, Homo sapiens
catttgagcagggc

SEQ ID NO: 3486870 - DNA, 16 bp, Homo sapiens
catttgagcagggctc

SEQ ID NO: 3486871 - DNA, 17 bp, Homo sapiens
catttgagcagggctca

SEQ ID NO: 3486872 - DNA, 14 bp, Homo sapiens
catttgagtctctt

SEQ ID NO: 3486873 - DNA, 19 bp, Homo sapiens
catttgatgcatgtctttt

SEQ ID NO: 3486874 - DNA, 20 bp, Homo sapiens
catttgatgcatgtctttta

SEQ ID NO: 3486875 - DNA, 14 bp, Homo sapiens
catttgattaacat

SEQ ID NO: 3486876 - DNA, 22 bp, Homo sapiens
catttgcagggtcctcttctgg

SEQ ID NO: 3486877 - DNA, 17 bp, Homo sapiens
catttggaatacttttt

SEQ ID NO: 3486878 - DNA, 15 bp, Homo sapiens
catttggaggcaatc

SEQ ID NO: 3486879 - DNA, 23 bp, Homo sapiens
catttggagtgttccccttccac

SEQ ID NO: 3486880 - DNA, 14 bp, Homo sapiens
catttggattgggg

SEQ ID NO: 3486881 - DNA, 23 bp, Homo sapiens
catttggattggggtccctctaa

SEQ ID NO: 3486882 - DNA, 20 bp, Homo sapiens
catttggcaatgccatcatc

SEQ ID NO: 3486883 - DNA, 21 bp, Homo sapiens
catttggcaggggtggctgcc

SEQ ID NO: 3486884 - DNA, 21 bp, Homo sapiens
catttggttcattaattctat

SEQ ID NO: 3486885 - DNA, 16 bp, Homo sapiens
catttggttggcacta

SEQ ID NO: 3486886 - DNA, 17 bp, Homo sapiens
catttgtcacacacttt

SEQ ID NO: 3486887 - DNA, 18 bp, Homo sapiens
catttgtctctacttttc

SEQ ID NO: 3486888 - DNA, 20 bp, Homo sapiens
catttgtgctagaaattttc

SEQ ID NO: 3486889 - DNA, 13 bp, Homo sapiens
catttgttaaaat

SEQ ID NO: 3486890 - DNA, 14 bp, Homo sapiens
cattttaattcatc

SEQ ID NO: 3486891 - DNA, 12 bp, Homo sapiens
cattttactgtt

SEQ ID NO: 3486892 - DNA, 17 bp, Homo sapiens
cattttactgttgtaca

SEQ ID NO: 3486893 - DNA, 21 bp, Homo sapiens
cattttagcccagtgttttct

SEQ ID NO: 3486894 - DNA, 14 bp, Homo sapiens
cattttatatgtca

SEQ ID NO: 3486895 - DNA, 12 bp, Homo sapiens
cattttcagagt

SEQ ID NO: 3486896 - DNA, 14 bp, Homo sapiens
cattttcattccta

SEQ ID NO: 3486897 - DNA, 12 bp, Homo sapiens
cattttctagat

SEQ ID NO: 3486898 - DNA, 16 bp, Homo sapiens
cattttcttgaatttt

SEQ ID NO: 3486899 - DNA, 22 bp, Homo sapiens
cattttctttttttaactggtg

SEQ ID NO: 3486900 - DNA, 17 bp, Homo sapiens
cattttgcactgtaaat

SEQ ID NO: 3486901 - DNA, 24 bp, Homo sapiens
cattttgctaaatgtgaatgatga

SEQ ID NO: 3486902 - DNA, 20 bp, Homo sapiens
cattttggagagtttcctga

SEQ ID NO: 3486903 - DNA, 16 bp, Homo sapiens
cattttggttcttctc

SEQ ID NO: 3486904 - DNA, 19 bp, Homo sapiens
cattttgtttggtattgta

SEQ ID NO: 3486905 - DNA, 17 bp, Homo sapiens
catttttaaatgtgttt

SEQ ID NO: 3486906 - DNA, 18 bp, Homo sapiens
catttttaaatgtgtttt

SEQ ID NO: 3486907 - DNA, 17 bp, Homo sapiens
catttttagtagagaca

SEQ ID NO: 3486908 - DNA, 20 bp, Homo sapiens
catttttagtagagacaggg

SEQ ID NO: 3486909 - DNA, 14 bp, Homo sapiens
catttttcaacttt

SEQ ID NO: 3486910 - DNA, 17 bp, Homo sapiens
catttttcaactttgaa

SEQ ID NO: 3486911 - DNA, 20 bp, Homo sapiens
catttttcaactttgaataa

SEQ ID NO: 3486912 - DNA, 21 bp, Homo sapiens
catttttcaactttgaataaa

SEQ ID NO: 3486913 - DNA, 12 bp, Homo sapiens
catttttctgca

SEQ ID NO: 3486914 - DNA, 15 bp, Homo sapiens
catttttgtaataac

SEQ ID NO: 3486915 - DNA, 20 bp, Homo sapiens
catttttgtaataacattta

SEQ ID NO: 3486916 - DNA, 20 bp, Homo sapiens
cattttttttttctttttgg

SEQ ID NO: 3486917 - DNA, 20 bp, Homo sapiens
ccaaaaaagctgtattttga

SEQ ID NO: 3486918 - DNA, 22 bp, Homo sapiens
ccaaaaaggttgctgtttcaca

SEQ ID NO: 3486919 - DNA, 17 bp, Homo sapiens
ccaaaaatctgcctggg

SEQ ID NO: 3486920 - DNA, 22 bp, Homo sapiens
ccaaaagaagcccccagctaag

SEQ ID NO: 3486921 - DNA, 18 bp, Homo sapiens
ccaaaagttcaacaacac

SEQ ID NO: 3486922 - DNA, 19 bp, Homo sapiens
ccaaaatactccaaagatg

SEQ ID NO: 3486923 - DNA, 20 bp, Homo sapiens
ccaaaatactccaaagatga

SEQ ID NO: 3486924 - DNA, 22 bp, Homo sapiens
ccaaaatgctctagtgccttct

SEQ ID NO: 3486925 - DNA, 21 bp, Homo sapiens
ccaaaatttattttataagaa

SEQ ID NO: 3486926 - DNA, 17 bp, Homo sapiens
ccaaacaaaaagcagga

SEQ ID NO: 3486927 - DNA, 23 bp, Homo sapiens
ccaaacagacaggtggaaaaact

SEQ ID NO: 3486928 - DNA, 13 bp, Homo sapiens
ccaaacagtgaca

SEQ ID NO: 3486929 - DNA, 17 bp, Homo sapiens
ccaaacatatgcacatt

SEQ ID NO: 3486930 - DNA, 21 bp, Homo sapiens
ccaaacgccctttcctcctca

SEQ ID NO: 3486931 - DNA, 22 bp, Homo sapiens
ccaaacgccctttcctcctcag

SEQ ID NO: 3486932 - DNA, 20 bp, Homo sapiens
ccaaacgctgagccacctgc

SEQ ID NO: 3486933 - DNA, 22 bp, Homo sapiens
ccaaagaaaaagggctgccggg

SEQ ID NO: 3486934 - DNA, 22 bp, Homo sapiens
ccaaagagtagaattgcattga

SEQ ID NO: 3486935 - DNA, 14 bp, Homo sapiens
ccaaagcagacagc

SEQ ID NO: 3486936 - DNA, 16 bp, Homo sapiens
ccaaagctaggcctgg

SEQ ID NO: 3486937 - DNA, 16 bp, Homo sapiens
ccaaaggaacactgac

SEQ ID NO: 3486938 - DNA, 19 bp, Homo sapiens
ccaaaggccatggagagct

SEQ ID NO: 3486939 - DNA, 21 bp, Homo sapiens
ccaaaggctggtggcaagtgc

SEQ ID NO: 3486940 - DNA, 17 bp, Homo sapiens
ccaaagtaaaagaaacc

SEQ ID NO: 3486941 - DNA, 16 bp, Homo sapiens
ccaaatcatagtggct

SEQ ID NO: 3486942 - DNA, 23 bp, Homo sapiens
ccaaatccgaacctcctctgtga

SEQ ID NO: 3486943 - DNA, 16 bp, Homo sapiens
ccaaatgctctctctt

SEQ ID NO: 3486944 - DNA, 22 bp, Homo sapiens
ccaacaatcctagtgctttcct

SEQ ID NO: 3486945 - DNA, 16 bp, Homo sapiens
ccaacaccaagcacag

SEQ ID NO: 3486946 - DNA, 19 bp, Homo sapiens
ccaacaccaagcacagcag

SEQ ID NO: 3486947 - DNA, 15 bp, Homo sapiens
ccaacaggagctggg

SEQ ID NO: 3486948 - DNA, 15 bp, Homo sapiens
ccaacatgtggctcc

SEQ ID NO: 3486949 - DNA, 18 bp, Homo sapiens
ccaaccctggggaaggag

SEQ ID NO: 3486950 - DNA, 21 bp, Homo sapiens
ccaacgtgcaaagccaaggca

SEQ ID NO: 3486951 - DNA, 15 bp, Homo sapiens
ccaactagcccctgg

SEQ ID NO: 3486952 - DNA, 15 bp, Homo sapiens
ccaactgtgtagcat

SEQ ID NO: 3486953 - DNA, 14 bp, Homo sapiens
ccaagaaacgtctt

SEQ ID NO: 3486954 - DNA, 15 bp, Homo sapiens
ccaagaaagatgtat

SEQ ID NO: 3486955 - DNA, 11 bp, Homo sapiens
ccaagaatctt

SEQ ID NO: 3486956 - DNA, 19 bp, Homo sapiens
ccaagaggaagttcagatc

SEQ ID NO: 3486957 - DNA, 11 bp, Homo sapiens
ccaagatgcct

SEQ ID NO: 3486958 - DNA, 13 bp, Homo sapiens
ccaagatgcctga

SEQ ID NO: 3486959 - DNA, 22 bp, Homo sapiens
ccaagcaacagcctttgaatgt

SEQ ID NO: 3486960 - DNA, 21 bp, Homo sapiens
ccaagcactgtgctcagggct

SEQ ID NO: 3486961 - DNA, 23 bp, Homo sapiens
ccaagcatcttgggggggtggcc

SEQ ID NO: 3486962 - DNA, 18 bp, Homo sapiens
ccaagccaagggaacctg

SEQ ID NO: 3486963 - DNA, 22 bp, Homo sapiens
ccaagccaagggaacctgtgtc

SEQ ID NO: 3486964 - DNA, 12 bp, Homo sapiens
ccaagccactga

SEQ ID NO: 3486965 - DNA, 13 bp, Homo sapiens
ccaagccagctgc

SEQ ID NO: 3486966 - DNA, 14 bp, Homo sapiens
ccaagccagctgcc

SEQ ID NO: 3486967 - DNA, 17 bp, Homo sapiens
ccaagccagctgcctag

SEQ ID NO: 3486968 - DNA, 15 bp, Homo sapiens
ccaagctccttggga

SEQ ID NO: 3486969 - DNA, 13 bp, Homo sapiens
ccaagctctgctc

SEQ ID NO: 3486970 - DNA, 17 bp, Homo sapiens
ccaagctctgctcctct

SEQ ID NO: 3486971 - DNA, 18 bp, Homo sapiens
ccaagctctgctcctctc

SEQ ID NO: 3486972 - DNA, 14 bp, Homo sapiens
ccaagctggctggg

SEQ ID NO: 3486973 - DNA, 20 bp, Homo sapiens
ccaagctggtcccactcagt

SEQ ID NO: 3486974 - DNA, 15 bp, Homo sapiens
ccaagcttcaaccct

SEQ ID NO: 3486975 - DNA, 19 bp, Homo sapiens
ccaaggaaaccacagctgc

SEQ ID NO: 3486976 - DNA, 17 bp, Homo sapiens
ccaaggaaacgctacct

SEQ ID NO: 3486977 - DNA, 22 bp, Homo sapiens
ccaaggaaacgctacctctctg

SEQ ID NO: 3486978 - DNA, 22 bp, Homo sapiens
ccaaggactgagcaccctctgg

SEQ ID NO: 3486979 - DNA, 14 bp, Homo sapiens
ccaaggagacacaa

SEQ ID NO: 3486980 - DNA, 18 bp, Homo sapiens
ccaaggcagcgaccccag

SEQ ID NO: 3486981 - DNA, 22 bp, Homo sapiens
ccaaggctcttctccttggagg

SEQ ID NO: 3486982 - DNA, 16 bp, Homo sapiens
ccaagggaacctgtgt

SEQ ID NO: 3486983 - DNA, 18 bp, Homo sapiens
ccaagggacaggagaaga

SEQ ID NO: 3486984 - DNA, 20 bp, Homo sapiens
ccaagggacaggagaagaga

SEQ ID NO: 3486985 - DNA, 20 bp, Homo sapiens
ccaagggatgaaagagaagg

SEQ ID NO: 3486986 - DNA, 17 bp, Homo sapiens
ccaagggccagacagac

SEQ ID NO: 3486987 - DNA, 22 bp, Homo sapiens
ccaaggggaatgtttgcctctg

SEQ ID NO: 3486988 - DNA, 16 bp, Homo sapiens
ccaaggggcttcaggt

SEQ ID NO: 3486989 - DNA, 13 bp, Homo sapiens
ccaaggtgggagg

SEQ ID NO: 3486990 - DNA, 15 bp, Homo sapiens
ccaagtaagaggctg

SEQ ID NO: 3486991 - DNA, 14 bp, Homo sapiens
ccaagtagctgcta

SEQ ID NO: 3486992 - DNA, 20 bp, Homo sapiens
ccaagtagctgggattacag

SEQ ID NO: 3486993 - DNA, 20 bp, Homo sapiens
ccaagtcaagtgaaaaagga

SEQ ID NO: 3486994 - DNA, 14 bp, Homo sapiens
ccaagtggcagagc

SEQ ID NO: 3486995 - DNA, 17 bp, Homo sapiens
ccaagtggcagagcttg

SEQ ID NO: 3486996 - DNA, 17 bp, Homo sapiens
catattctttcaattct

SEQ ID NO: 3486997 - DNA, 17 bp, Homo sapiens
catattgcacatgtctt

SEQ ID NO: 3486998 - DNA, 19 bp, Homo sapiens
catattgcacatgtcttaa

SEQ ID NO: 3486999 - DNA, 20 bp, Homo sapiens
catattgcacatgtcttaat

SEQ ID NO: 3487000 - DNA, 14 bp, Homo sapiens
catatttaactggt

SEQ ID NO: 3487001 - DNA, 13 bp, Homo sapiens
catatttaatgtt

SEQ ID NO: 3487002 - DNA, 18 bp, Homo sapiens
catatttaatgttttaaa

SEQ ID NO: 3487003 - DNA, 13 bp, Homo sapiens
catcaaaatgctt

SEQ ID NO: 3487004 - DNA, 23 bp, Homo sapiens
catcaaagaggctgaggctggca

SEQ ID NO: 3487005 - DNA, 13 bp, Homo sapiens
catcaacaaaaat

SEQ ID NO: 3487006 - DNA, 13 bp, Homo sapiens
catcaagactgga

SEQ ID NO: 3487007 - DNA, 15 bp, Homo sapiens
catcaagactggaag

SEQ ID NO: 3487008 - DNA, 16 bp, Homo sapiens
catcaagactggaagg

SEQ ID NO: 3487009 - DNA, 19 bp, Homo sapiens
catcacactgggtggtggc

SEQ ID NO: 3487010 - DNA, 20 bp, Homo sapiens
catcacagatcgcatttcct

SEQ ID NO: 3487011 - DNA, 22 bp, Homo sapiens
catcaccttaggcagggaagtg

SEQ ID NO: 3487012 - DNA, 16 bp, Homo sapiens
catcactgagttttcc

SEQ ID NO: 3487013 - DNA, 12 bp, Homo sapiens
catcactgtggc

SEQ ID NO: 3487014 - DNA, 13 bp, Homo sapiens
catcactgtggct

SEQ ID NO: 3487015 - DNA, 15 bp, Homo sapiens
catcagcaccccagt

SEQ ID NO: 3487016 - DNA, 23 bp, Homo sapiens
catcagcttaggggctgctgacc

SEQ ID NO: 3487017 - DNA, 21 bp, Homo sapiens
catcaggagactgggctctgg

SEQ ID NO: 3487018 - DNA, 15 bp, Homo sapiens
catcagtgctccctc

SEQ ID NO: 3487019 - DNA, 24 bp, Homo sapiens
catcagtgctccctcacatgtcag

SEQ ID NO: 3487020 - DNA, 15 bp, Homo sapiens
catcagttagagctg

SEQ ID NO: 3487021 - DNA, 18 bp, Homo sapiens
catcagttagagctgaca

SEQ ID NO: 3487022 - DNA, 13 bp, Homo sapiens
catcatcaaggca

SEQ ID NO: 3487023 - DNA, 19 bp, Homo sapiens
catcatcaaggcactgcct

SEQ ID NO: 3487024 - DNA, 20 bp, Homo sapiens
catcatcaaggcactgcctg

SEQ ID NO: 3487025 - DNA, 21 bp, Homo sapiens
catcatctcctgccttcctcc

SEQ ID NO: 3487026 - DNA, 22 bp, Homo sapiens
catcatgctggaacctgcaaaa

SEQ ID NO: 3487027 - DNA, 14 bp, Homo sapiens
catcatgtctggct

SEQ ID NO: 3487028 - DNA, 14 bp, Homo sapiens
catcattccctctc

SEQ ID NO: 3487029 - DNA, 21 bp, Homo sapiens
catcattgctgtctgcagcct

SEQ ID NO: 3487030 - DNA, 23 bp, Homo sapiens
catccaaaatagttaagacatga

SEQ ID NO: 3487031 - DNA, 16 bp, Homo sapiens
catccaaccttcccaa

SEQ ID NO: 3487032 - DNA, 21 bp, Homo sapiens
catccaaggccaggttctccg

SEQ ID NO: 3487033 - DNA, 17 bp, Homo sapiens
catccacatgggagccg

SEQ ID NO: 3487034 - DNA, 14 bp, Homo sapiens
catccactagtgca

SEQ ID NO: 3487035 - DNA, 20 bp, Homo sapiens
catccactagtgcaaatcat

SEQ ID NO: 3487036 - DNA, 17 bp, Homo sapiens
catccactgtgccatgt

SEQ ID NO: 3487037 - DNA, 23 bp, Homo sapiens
catccactgtgccatgtgccagg

SEQ ID NO: 3487038 - DNA, 14 bp, Homo sapiens
catccagcttgcca

SEQ ID NO: 3487039 - DNA, 13 bp, Homo sapiens
catccatcatcat

SEQ ID NO: 3487040 - DNA, 14 bp, Homo sapiens
catccattgtctct

SEQ ID NO: 3487041 - DNA, 15 bp, Homo sapiens
catcccacaagtggt

SEQ ID NO: 3487042 - DNA, 14 bp, Homo sapiens
catccccaggtctc

SEQ ID NO: 3487043 - DNA, 22 bp, Homo sapiens
catccccaggtctctccactgc

SEQ ID NO: 3487044 - DNA, 14 bp, Homo sapiens
catcccccactgcc

SEQ ID NO: 3487045 - DNA, 17 bp, Homo sapiens
catcccccactgccaca

SEQ ID NO: 3487046 - DNA, 19 bp, Homo sapiens
catcccccactgccacacc

SEQ ID NO: 3487047 - DNA, 14 bp, Homo sapiens
catcccctgtagag

SEQ ID NO: 3487048 - DNA, 23 bp, Homo sapiens
catcccgggcctcagtgccccat

SEQ ID NO: 3487049 - DNA, 19 bp, Homo sapiens
catcccttgaccaggcctg

SEQ ID NO: 3487050 - DNA, 13 bp, Homo sapiens
catccctttttga

SEQ ID NO: 3487051 - DNA, 17 bp, Homo sapiens
catccctttttgaagtg

SEQ ID NO: 3487052 - DNA, 13 bp, Homo sapiens
catcctcatctct

SEQ ID NO: 3487053 - DNA, 20 bp, Homo sapiens
catcctccacgttctgctca

SEQ ID NO: 3487054 - DNA, 21 bp, Homo sapiens
catcctccacgttctgctcat

SEQ ID NO: 3487055 - DNA, 14 bp, Homo sapiens
catcctccagcagg

SEQ ID NO: 3487056 - DNA, 16 bp, Homo sapiens
catcctccagcaggga

SEQ ID NO: 3487057 - DNA, 20 bp, Homo sapiens
catcctcctcccacccggct

SEQ ID NO: 3487058 - DNA, 12 bp, Homo sapiens
catcctctgact

SEQ ID NO: 3487059 - DNA, 16 bp, Homo sapiens
catcctctgactccac

SEQ ID NO: 3487060 - DNA, 12 bp, Homo sapiens
catcctgcaggc

SEQ ID NO: 3487061 - DNA, 12 bp, Homo sapiens
catcctggctgc

SEQ ID NO: 3487062 - DNA, 15 bp, Homo sapiens
catcctggctgcggc

SEQ ID NO: 3487063 - DNA, 21 bp, Homo sapiens
catcctgtgtttctagggaaa

SEQ ID NO: 3487064 - DNA, 19 bp, Homo sapiens
catccttatccttcatctt

SEQ ID NO: 3487065 - DNA, 15 bp, Homo sapiens
catccttccctgtct

SEQ ID NO: 3487066 - DNA, 21 bp, Homo sapiens
catccttccctgtctgccagg

SEQ ID NO: 3487067 - DNA, 18 bp, Homo sapiens
catccttcctcacaccag

SEQ ID NO: 3487068 - DNA, 19 bp, Homo sapiens
catcggacaagacccccag

SEQ ID NO: 3487069 - DNA, 17 bp, Homo sapiens
catcggcctagggcccc

SEQ ID NO: 3487070 - DNA, 22 bp, Homo sapiens
catcgttttcttcactgtcctc

SEQ ID NO: 3487071 - DNA, 15 bp, Homo sapiens
catctaacctcatct

SEQ ID NO: 3487072 - DNA, 21 bp, Homo sapiens
catctatggcagtccagccag

SEQ ID NO: 3487073 - DNA, 22 bp, Homo sapiens
catctatggcagtccagccagc

SEQ ID NO: 3487074 - DNA, 20 bp, Homo sapiens
catctattctctccaaaaat

SEQ ID NO: 3487075 - DNA, 14 bp, Homo sapiens
catctatttggaac

SEQ ID NO: 3487076 - DNA, 16 bp, Homo sapiens
catctattttggattg

SEQ ID NO: 3487077 - DNA, 17 bp, Homo sapiens
catctcaatggaaacat

SEQ ID NO: 3487078 - DNA, 16 bp, Homo sapiens
catctcaattgtgctt

SEQ ID NO: 3487079 - DNA, 20 bp, Homo sapiens
catctcaggacacttccgta

SEQ ID NO: 3487080 - DNA, 18 bp, Homo sapiens
catctcaggccagagcca

SEQ ID NO: 3487081 - DNA, 18 bp, Homo sapiens
catctcatgaggggagag

SEQ ID NO: 3487082 - DNA, 20 bp, Homo sapiens
catctcattacccttttctg

SEQ ID NO: 3487083 - DNA, 17 bp, Homo sapiens
catctcccagataatgt

SEQ ID NO: 3487084 - DNA, 14 bp, Homo sapiens
catctcccctcagc

SEQ ID NO: 3487085 - DNA, 15 bp, Homo sapiens
catctcccctcagct

SEQ ID NO: 3487086 - DNA, 16 bp, Homo sapiens
catctccggggctttg

SEQ ID NO: 3487087 - DNA, 17 bp, Homo sapiens
catctcgctccctccca

SEQ ID NO: 3487088 - DNA, 21 bp, Homo sapiens
catctcgctccctcccaggac

SEQ ID NO: 3487089 - DNA, 19 bp, Homo sapiens
catctctaacagctcagga

SEQ ID NO: 3487090 - DNA, 22 bp, Homo sapiens
catctctaacagctcaggatct

SEQ ID NO: 3487091 - DNA, 20 bp, Homo sapiens
catctctccctcccctgcca

SEQ ID NO: 3487092 - DNA, 23 bp, Homo sapiens
catctctcttgggccaagccagc

SEQ ID NO: 3487093 - DNA, 20 bp, Homo sapiens
catctctgcttgagtcaggt

SEQ ID NO: 3487094 - DNA, 14 bp, Homo sapiens
catctctggatgcc

SEQ ID NO: 3487095 - DNA, 13 bp, Homo sapiens
catctctgtccca

SEQ ID NO: 3487096 - DNA, 23 bp, Homo sapiens
catctcttagctcccctccaacc

SEQ ID NO: 3487097 - DNA, 15 bp, Homo sapiens
catctctttagagaa

SEQ ID NO: 3487098 - DNA, 21 bp, Homo sapiens
catctgaaggggcaaattctt

SEQ ID NO: 3487099 - DNA, 17 bp, Homo sapiens
catctgaccagcagcgc

SEQ ID NO: 3487100 - DNA, 21 bp, Homo sapiens
catctgaccagcagcgccttt

SEQ ID NO: 3487101 - DNA, 20 bp, Homo sapiens
catctgagaaacctgttgaa

SEQ ID NO: 3487102 - DNA, 16 bp, Homo sapiens
catctgaggcatccag

SEQ ID NO: 3487103 - DNA, 17 bp, Homo sapiens
catctgaggcatccagc

SEQ ID NO: 3487104 - DNA, 18 bp, Homo sapiens
catctgcacccccctggg

SEQ ID NO: 3487105 - DNA, 17 bp, Homo sapiens
catctgcatgtctactc

SEQ ID NO: 3487106 - DNA, 16 bp, Homo sapiens
catctgcattgcccag

SEQ ID NO: 3487107 - DNA, 14 bp, Homo sapiens
catctgctctcctt

SEQ ID NO: 3487108 - DNA, 15 bp, Homo sapiens
catctgctctccttc

SEQ ID NO: 3487109 - DNA, 18 bp, Homo sapiens
catctgctctccttcctg

SEQ ID NO: 3487110 - DNA, 23 bp, Homo sapiens
catctggccgttgatgttggctg

SEQ ID NO: 3487111 - DNA, 11 bp, Homo sapiens
catctgggctc

SEQ ID NO: 3487112 - DNA, 17 bp, Homo sapiens
catctgggctcctccag

SEQ ID NO: 3487113 - DNA, 22 bp, Homo sapiens
catctggttgaactctggtggc

SEQ ID NO: 3487114 - DNA, 14 bp, Homo sapiens
catctgtagtcagc

SEQ ID NO: 3487115 - DNA, 22 bp, Homo sapiens
catctgtataagtaagaaaata

SEQ ID NO: 3487116 - DNA, 16 bp, Homo sapiens
catctgtccctccggg

SEQ ID NO: 3487117 - DNA, 17 bp, Homo sapiens
catctgtccctccggga

SEQ ID NO: 3487118 - DNA, 18 bp, Homo sapiens
catctgtccctccgggac

SEQ ID NO: 3487119 - DNA, 14 bp, Homo sapiens
catctgtctaaaga

SEQ ID NO: 3487120 - DNA, 18 bp, Homo sapiens
catctgtctaaagataga

SEQ ID NO: 3487121 - DNA, 17 bp, Homo sapiens
catctgtcttgccagcc

SEQ ID NO: 3487122 - DNA, 11 bp, Homo sapiens
catctgtgcat

SEQ ID NO: 3487123 - DNA, 17 bp, Homo sapiens
catctgtggagatgccc

SEQ ID NO: 3487124 - DNA, 15 bp, Homo sapiens
catctgttagggcct

SEQ ID NO: 3487125 - DNA, 14 bp, Homo sapiens
catcttactgaagg

SEQ ID NO: 3487126 - DNA, 15 bp, Homo sapiens
catcttactgaaggt

SEQ ID NO: 3487127 - DNA, 12 bp, Homo sapiens
catcttcctgtg

SEQ ID NO: 3487128 - DNA, 14 bp, Homo sapiens
catcttcgggacca

SEQ ID NO: 3487129 - DNA, 18 bp, Homo sapiens
catcttcgggaccaggat

SEQ ID NO: 3487130 - DNA, 14 bp, Homo sapiens
catcttcttcacca

SEQ ID NO: 3487131 - DNA, 19 bp, Homo sapiens
catcttcttcaccatttgg

SEQ ID NO: 3487132 - DNA, 15 bp, Homo sapiens
catcttgaccaagca

SEQ ID NO: 3487133 - DNA, 16 bp, Homo sapiens
caggccccaggaagcc

SEQ ID NO: 3487134 - DNA, 17 bp, Homo sapiens
caggccccaggaagccg

SEQ ID NO: 3487135 - DNA, 21 bp, Homo sapiens
caggccccccgcagcaccctg

SEQ ID NO: 3487136 - DNA, 22 bp, Homo sapiens
caggccccccgcagcaccctgc

SEQ ID NO: 3487137 - DNA, 21 bp, Homo sapiens
caggccccgtgaggcaatggg

SEQ ID NO: 3487138 - DNA, 12 bp, Homo sapiens
caggcccctctc

SEQ ID NO: 3487139 - DNA, 13 bp, Homo sapiens
caggcccctctcc

SEQ ID NO: 3487140 - DNA, 18 bp, Homo sapiens
caggcccctctcctccgt

SEQ ID NO: 3487141 - DNA, 13 bp, Homo sapiens
caggcccctgcca

SEQ ID NO: 3487142 - DNA, 15 bp, Homo sapiens
caggcccctgccacc

SEQ ID NO: 3487143 - DNA, 19 bp, Homo sapiens
caggcccctgccaccctgg

SEQ ID NO: 3487144 - DNA, 16 bp, Homo sapiens
caggcccctggaggct

SEQ ID NO: 3487145 - DNA, 20 bp, Homo sapiens
caggcccctggaggctgcct

SEQ ID NO: 3487146 - DNA, 16 bp, Homo sapiens
caggcccggcagggcg

SEQ ID NO: 3487147 - DNA, 13 bp, Homo sapiens
caggcccggctcc

SEQ ID NO: 3487148 - DNA, 18 bp, Homo sapiens
caggcccggctccaggct

SEQ ID NO: 3487149 - DNA, 21 bp, Homo sapiens
caggcccggctccaggctcct

SEQ ID NO: 3487150 - DNA, 20 bp, Homo sapiens
caggccctgccagagcaggg

SEQ ID NO: 3487151 - DNA, 23 bp, Homo sapiens
caggccctgccagtggggaagga

SEQ ID NO: 3487152 - DNA, 15 bp, Homo sapiens
caggccctggcctcc

SEQ ID NO: 3487153 - DNA, 23 bp, Homo sapiens
caggccggcagccccagcctgct

SEQ ID NO: 3487154 - DNA, 19 bp, Homo sapiens
caggcctaggtgcagctcc

SEQ ID NO: 3487155 - DNA, 12 bp, Homo sapiens
caggcctcttgg

SEQ ID NO: 3487156 - DNA, 18 bp, Homo sapiens
caggcctcttggcagtca

SEQ ID NO: 3487157 - DNA, 18 bp, Homo sapiens
caggcctgagatttcatc

SEQ ID NO: 3487158 - DNA, 13 bp, Homo sapiens
caggcctgagctg

SEQ ID NO: 3487159 - DNA, 12 bp, Homo sapiens
caggcctgggcc

SEQ ID NO: 3487160 - DNA, 17 bp, Homo sapiens
caggccttatctccaag

SEQ ID NO: 3487161 - DNA, 18 bp, Homo sapiens
caggcgggcccagaccgg

SEQ ID NO: 3487162 - DNA, 15 bp, Homo sapiens
caggcggtgggcacc

SEQ ID NO: 3487163 - DNA, 17 bp, Homo sapiens
caggcggtgggcaccca

SEQ ID NO: 3487164 - DNA, 21 bp, Homo sapiens
caggcggtgggcacccaccct

SEQ ID NO: 3487165 - DNA, 19 bp, Homo sapiens
caggcgttcagctcactgt

SEQ ID NO: 3487166 - DNA, 22 bp, Homo sapiens
caggcgttcagctcactgttct

SEQ ID NO: 3487167 - DNA, 23 bp, Homo sapiens
caggctaaacatccaatattttc

SEQ ID NO: 3487168 - DNA, 19 bp, Homo sapiens
caggctaaggcgtggagct

SEQ ID NO: 3487169 - DNA, 14 bp, Homo sapiens
caggctcccaggga

SEQ ID NO: 3487170 - DNA, 23 bp, Homo sapiens
caggctcccagggacacctggga

SEQ ID NO: 3487171 - DNA, 14 bp, Homo sapiens
caggctcctttagc

SEQ ID NO: 3487172 - DNA, 21 bp, Homo sapiens
caggctcctttagcgcccagt

SEQ ID NO: 3487173 - DNA, 15 bp, Homo sapiens
caggctcgccaaggc

SEQ ID NO: 3487174 - DNA, 13 bp, Homo sapiens
caggctctcaaca

SEQ ID NO: 3487175 - DNA, 12 bp, Homo sapiens
caggctcttctt

SEQ ID NO: 3487176 - DNA, 18 bp, Homo sapiens
caggctcttctttcccaa

SEQ ID NO: 3487177 - DNA, 19 bp, Homo sapiens
caggctcttctttcccaaa

SEQ ID NO: 3487178 - DNA, 18 bp, Homo sapiens
caggctgaagcaggttcc

SEQ ID NO: 3487179 - DNA, 18 bp, Homo sapiens
caggctggcgtgcagtgg

SEQ ID NO: 3487180 - DNA, 18 bp, Homo sapiens
caggctggctccagatgc

SEQ ID NO: 3487181 - DNA, 18 bp, Homo sapiens
caggctgggcaaggaggc

SEQ ID NO: 3487182 - DNA, 16 bp, Homo sapiens
caggctgggcttcagt

SEQ ID NO: 3487183 - DNA, 17 bp, Homo sapiens
caggctgggcttcagtg

SEQ ID NO: 3487184 - DNA, 20 bp, Homo sapiens
caggctggtcttgaagtcct

SEQ ID NO: 3487185 - DNA, 20 bp, Homo sapiens
caggctgtatcccatgagcc

SEQ ID NO: 3487186 - DNA, 14 bp, Homo sapiens
caggctgtgactct

SEQ ID NO: 3487187 - DNA, 20 bp, Homo sapiens
caggctgtgactcttctctc

SEQ ID NO: 3487188 - DNA, 22 bp, Homo sapiens
caggctgtgactcttctctcaa

SEQ ID NO: 3487189 - DNA, 16 bp, Homo sapiens
caggcttgcctgcagg

SEQ ID NO: 3487190 - DNA, 17 bp, Homo sapiens
caggcttgcctgcaggc

SEQ ID NO: 3487191 - DNA, 18 bp, Homo sapiens
caggcttgcctgcaggca

SEQ ID NO: 3487192 - DNA, 23 bp, Homo sapiens
caggcttgtcactagcagctgca

SEQ ID NO: 3487193 - DNA, 19 bp, Homo sapiens
cagggaaaagcagctctcc

SEQ ID NO: 3487194 - DNA, 20 bp, Homo sapiens
cagggaaaagcagctctccc

SEQ ID NO: 3487195 - DNA, 21 bp, Homo sapiens
cagccacggccaggccagagg

SEQ ID NO: 3487196 - DNA, 22 bp, Homo sapiens
cagccacggccaggccagaggg

SEQ ID NO: 3487197 - DNA, 19 bp, Homo sapiens
cagccactaagaacccctc

SEQ ID NO: 3487198 - DNA, 17 bp, Homo sapiens
cagccagaagcctctgc

SEQ ID NO: 3487199 - DNA, 13 bp, Homo sapiens
cagccagcagcag

SEQ ID NO: 3487200 - DNA, 17 bp, Homo sapiens
cagccagcagcagccca

SEQ ID NO: 3487201 - DNA, 18 bp, Homo sapiens
cagccaggagctgtcacc

SEQ ID NO: 3487202 - DNA, 12 bp, Homo sapiens
cagccagggctg

SEQ ID NO: 3487203 - DNA, 13 bp, Homo sapiens
cagccagggctgc

SEQ ID NO: 3487204 - DNA, 16 bp, Homo sapiens
cagccagtgacctgag

SEQ ID NO: 3487205 - DNA, 19 bp, Homo sapiens
cagccatctcatgagggga

SEQ ID NO: 3487206 - DNA, 14 bp, Homo sapiens
cagccatgtacaga

SEQ ID NO: 3487207 - DNA, 19 bp, Homo sapiens
cagccatgtacagacagag

SEQ ID NO: 3487208 - DNA, 23 bp, Homo sapiens
cagccattacccagctaaataat

SEQ ID NO: 3487209 - DNA, 17 bp, Homo sapiens
cagccattgcacccagc

SEQ ID NO: 3487210 - DNA, 15 bp, Homo sapiens
cagcccacttctgcc

SEQ ID NO: 3487211 - DNA, 16 bp, Homo sapiens
cagcccagggctcctg

SEQ ID NO: 3487212 - DNA, 19 bp, Homo sapiens
cagcccagggctcctgcac

SEQ ID NO: 3487213 - DNA, 15 bp, Homo sapiens
cagccccagtgccca

SEQ ID NO: 3487214 - DNA, 17 bp, Homo sapiens
cagccccatctgtgcat

SEQ ID NO: 3487215 - DNA, 16 bp, Homo sapiens
cagccccgacttcctg

SEQ ID NO: 3487216 - DNA, 14 bp, Homo sapiens
cagcccctactgct

SEQ ID NO: 3487217 - DNA, 15 bp, Homo sapiens
cagcccctactgctg

SEQ ID NO: 3487218 - DNA, 22 bp, Homo sapiens
cagcccctctggtcgctcctgc

SEQ ID NO: 3487219 - DNA, 21 bp, Homo sapiens
cagcccctggccccaggacct

SEQ ID NO: 3487220 - DNA, 17 bp, Homo sapiens
cagccccttgagaaacc

SEQ ID NO: 3487221 - DNA, 18 bp, Homo sapiens
cagccctagggtggagag

SEQ ID NO: 3487222 - DNA, 13 bp, Homo sapiens
cagccctcatccc

SEQ ID NO: 3487223 - DNA, 17 bp, Homo sapiens
cagccctcatcccgagc

SEQ ID NO: 3487224 - DNA, 18 bp, Homo sapiens
cagccctgagaaagccct

SEQ ID NO: 3487225 - DNA, 19 bp, Homo sapiens
cagccctgagaaagccctg

SEQ ID NO: 3487226 - DNA, 15 bp, Homo sapiens
cagcccttagcaggg

SEQ ID NO: 3487227 - DNA, 21 bp, Homo sapiens
cagcccttagcagggaaacag

SEQ ID NO: 3487228 - DNA, 18 bp, Homo sapiens
cagccgattcacctgagc

SEQ ID NO: 3487229 - DNA, 19 bp, Homo sapiens
cagccgattcacctgagca

SEQ ID NO: 3487230 - DNA, 23 bp, Homo sapiens
cagccgccatgctcctggcccac

SEQ ID NO: 3487231 - DNA, 19 bp, Homo sapiens
cagccgctgagcgaggaga

SEQ ID NO: 3487232 - DNA, 14 bp, Homo sapiens
cagccgtgagcatg

SEQ ID NO: 3487233 - DNA, 17 bp, Homo sapiens
cagcctaagaagctctg

SEQ ID NO: 3487234 - DNA, 22 bp, Homo sapiens
cagcctcaaaaacgccctcaag

SEQ ID NO: 3487235 - DNA, 21 bp, Homo sapiens
cagcctcaacctcctgggcta

SEQ ID NO: 3487236 - DNA, 20 bp, Homo sapiens
cagcctcagcgcggccctcc

SEQ ID NO: 3487237 - DNA, 14 bp, Homo sapiens
cagcctcccaaccc

SEQ ID NO: 3487238 - DNA, 18 bp, Homo sapiens
cagcctcccaaccccagg

SEQ ID NO: 3487239 - DNA, 20 bp, Homo sapiens
cagcctcccaaccccagggc

SEQ ID NO: 3487240 - DNA, 19 bp, Homo sapiens
cagcctcccacccccatct

SEQ ID NO: 3487241 - DNA, 20 bp, Homo sapiens
cagcctcccatccagggccc

SEQ ID NO: 3487242 - DNA, 17 bp, Homo sapiens
cagcctcccctgccagg

SEQ ID NO: 3487243 - DNA, 20 bp, Homo sapiens
cagcctcccgagtagctggg

SEQ ID NO: 3487244 - DNA, 21 bp, Homo sapiens
cagcctcccgagtagctggga

SEQ ID NO: 3487245 - DNA, 22 bp, Homo sapiens
cagcctcccgagtagctgggac

SEQ ID NO: 3487246 - DNA, 18 bp, Homo sapiens
cagcctccctgaagcctt

SEQ ID NO: 3487247 - DNA, 17 bp, Homo sapiens
cagcctctgaaaaccaa

SEQ ID NO: 3487248 - DNA, 17 bp, Homo sapiens
cagcctgaacagaagct

SEQ ID NO: 3487249 - DNA, 18 bp, Homo sapiens
cagcctgaacagaagctc

SEQ ID NO: 3487250 - DNA, 20 bp, Homo sapiens
cagcctgagcaactcttgat

SEQ ID NO: 3487251 - DNA, 21 bp, Homo sapiens
cagcctgagcaactcttgatt

SEQ ID NO: 3487252 - DNA, 19 bp, Homo sapiens
cagcctgcctggcaggctg

SEQ ID NO: 3487253 - DNA, 15 bp, Homo sapiens
cagcctgcgcctgct

SEQ ID NO: 3487254 - DNA, 17 bp, Homo sapiens
cagcctgcgcctgctgc

SEQ ID NO: 3487255 - DNA, 17 bp, Homo sapiens
cagcctgcgggaagctg

SEQ ID NO: 3487256 - DNA, 18 bp, Homo sapiens
cagcctgcgggaagctga

SEQ ID NO: 3487257 - DNA, 16 bp, Homo sapiens
cagcctgctagctagc

SEQ ID NO: 3487258 - DNA, 23 bp, Homo sapiens
cagcctgctagctagctcaacta

SEQ ID NO: 3487259 - DNA, 19 bp, Homo sapiens
cagcctgctccagctgttc

SEQ ID NO: 3487260 - DNA, 16 bp, Homo sapiens
cagcctggagatgaaa

SEQ ID NO: 3487261 - DNA, 17 bp, Homo sapiens
cagcctggggctggcct

SEQ ID NO: 3487262 - DNA, 20 bp, Homo sapiens
cagcctggtcaacatggtga

SEQ ID NO: 3487263 - DNA, 18 bp, Homo sapiens
cagccttgaactctgggc

SEQ ID NO: 3487264 - DNA, 18 bp, Homo sapiens
cagccttgactatgtcta

SEQ ID NO: 3487265 - DNA, 20 bp, Homo sapiens
cagccttgactatgtctaga

SEQ ID NO: 3487266 - DNA, 14 bp, Homo sapiens
cagccttgccagag

SEQ ID NO: 3487267 - DNA, 20 bp, Homo sapiens
cagcctttctggcaggtcct

SEQ ID NO: 3487268 - DNA, 16 bp, Homo sapiens
cagcctttgaatgtaa

SEQ ID NO: 3487269 - DNA, 23 bp, Homo sapiens
cagcctttgatcaggtggggagt

SEQ ID NO: 3487270 - DNA, 15 bp, Homo sapiens
cagcctttgcccaaa

SEQ ID NO: 3487271 - DNA, 24 bp, Homo sapiens
cagcctttgcccaaaactgtcatc

SEQ ID NO: 3487272 - DNA, 13 bp, Homo sapiens
cagcgagccctgg

SEQ ID NO: 3487273 - DNA, 19 bp, Homo sapiens
cagagcttggactggatgc

SEQ ID NO: 3487274 - DNA, 14 bp, Homo sapiens
cagagcttttcaga

SEQ ID NO: 3487275 - DNA, 13 bp, Homo sapiens
cagaggaaggaga

SEQ ID NO: 3487276 - DNA, 18 bp, Homo sapiens
cagaggaaggggccagag

SEQ ID NO: 3487277 - DNA, 22 bp, Homo sapiens
cagaggaggatgtaaggcctta

SEQ ID NO: 3487278 - DNA, 18 bp, Homo sapiens
cagaggagggcagcagaa

SEQ ID NO: 3487279 - DNA, 14 bp, Homo sapiens
cagaggaggggccg

SEQ ID NO: 3487280 - DNA, 19 bp, Homo sapiens
cagaggaggggccgctgcc

SEQ ID NO: 3487281 - DNA, 21 bp, Homo sapiens
cagaggagtacaggtgaagca

SEQ ID NO: 3487282 - DNA, 13 bp, Homo sapiens
cagaggcagcccc

SEQ ID NO: 3487283 - DNA, 14 bp, Homo sapiens
cagaggcagcccca

SEQ ID NO: 3487284 - DNA, 21 bp, Homo sapiens
cagaggcagcccgcacacctg

SEQ ID NO: 3487285 - DNA, 17 bp, Homo sapiens
cagaggccaacactgtg

SEQ ID NO: 3487286 - DNA, 18 bp, Homo sapiens
cagaggccaacactgtgg

SEQ ID NO: 3487287 - DNA, 19 bp, Homo sapiens
cagaggccatgggcctcct

SEQ ID NO: 3487288 - DNA, 17 bp, Homo sapiens
cagaggcccccagccca

SEQ ID NO: 3487289 - DNA, 12 bp, Homo sapiens
cagaggctgcag

SEQ ID NO: 3487290 - DNA, 14 bp, Homo sapiens
cagaggctgcagga

SEQ ID NO: 3487291 - DNA, 17 bp, Homo sapiens
cagaggctgcaggactt

SEQ ID NO: 3487292 - DNA, 14 bp, Homo sapiens
cagaggctgggttc

SEQ ID NO: 3487293 - DNA, 19 bp, Homo sapiens
cagagggaagaaaagagct

SEQ ID NO: 3487294 - DNA, 14 bp, Homo sapiens
cagagggagtgaca

SEQ ID NO: 3487295 - DNA, 16 bp, Homo sapiens
cagagggagtgacaga

SEQ ID NO: 3487296 - DNA, 22 bp, Homo sapiens
cagagggagtgacagaggcagc

SEQ ID NO: 3487297 - DNA, 10 bp, Homo sapiens
cagagggctg

SEQ ID NO: 3487298 - DNA, 14 bp, Homo sapiens
cagagggctggagg

SEQ ID NO: 3487299 - DNA, 21 bp, Homo sapiens
cagagggctggaggcccaggc

SEQ ID NO: 3487300 - DNA, 13 bp, Homo sapiens
cagaggtctccca

SEQ ID NO: 3487301 - DNA, 18 bp, Homo sapiens
cagaggttatctgtccca

SEQ ID NO: 3487302 - DNA, 19 bp, Homo sapiens
cagaggttatctgtcccag

SEQ ID NO: 3487303 - DNA, 20 bp, Homo sapiens
cagagtatggagctcagaga

SEQ ID NO: 3487304 - DNA, 13 bp, Homo sapiens
cagagtcctggag

SEQ ID NO: 3487305 - DNA, 19 bp, Homo sapiens
cagagtctcactgttgccc

SEQ ID NO: 3487306 - DNA, 22 bp, Homo sapiens
cagagtctcactgttgcccagg

SEQ ID NO: 3487307 - DNA, 14 bp, Homo sapiens
cagagtgagaccca

SEQ ID NO: 3487308 - DNA, 15 bp, Homo sapiens
cagagtgagacccag

SEQ ID NO: 3487309 - DNA, 16 bp, Homo sapiens
cagagtgagactctgt

SEQ ID NO: 3487310 - DNA, 12 bp, Homo sapiens
cagagtggaggc

SEQ ID NO: 3487311 - DNA, 23 bp, Homo sapiens
cagagtgtggccttcggacaact

SEQ ID NO: 3487312 - DNA, 16 bp, Homo sapiens
cagagttccccatgca

SEQ ID NO: 3487313 - DNA, 14 bp, Homo sapiens
cagataactgagga

SEQ ID NO: 3487314 - DNA, 20 bp, Homo sapiens
cagataactgaggaggggag

SEQ ID NO: 3487315 - DNA, 16 bp, Homo sapiens
cagataatgtgaaaat

SEQ ID NO: 3487316 - DNA, 23 bp, Homo sapiens
cagatacaggaaaagctgctgac

SEQ ID NO: 3487317 - DNA, 17 bp, Homo sapiens
cagatcatgttttggtg

SEQ ID NO: 3487318 - DNA, 19 bp, Homo sapiens
cagatcatgttttggtgaa

SEQ ID NO: 3487319 - DNA, 14 bp, Homo sapiens
cagatccagcctgg

SEQ ID NO: 3487320 - DNA, 20 bp, Homo sapiens
cagatcccaggcccctggag

SEQ ID NO: 3487321 - DNA, 22 bp, Homo sapiens
cagatcccaggcccctggaggc

SEQ ID NO: 3487322 - DNA, 14 bp, Homo sapiens
cagatcctctctgg

SEQ ID NO: 3487323 - DNA, 16 bp, Homo sapiens
cagatcgcatttccta

SEQ ID NO: 3487324 - DNA, 18 bp, Homo sapiens
cagatcgcatttcctaag

SEQ ID NO: 3487325 - DNA, 24 bp, Homo sapiens
cagatctgacatgattccttcctg

SEQ ID NO: 3487326 - DNA, 14 bp, Homo sapiens
cagatctggaacct

SEQ ID NO: 3487327 - DNA, 20 bp, Homo sapiens
cagatctggaacctcagcct

SEQ ID NO: 3487328 - DNA, 23 bp, Homo sapiens
cagatctggggcagcaccctata

SEQ ID NO: 3487329 - DNA, 15 bp, Homo sapiens
cagatcttaatataa

SEQ ID NO: 3487330 - DNA, 14 bp, Homo sapiens
cagatcttggactc

SEQ ID NO: 3487331 - DNA, 20 bp, Homo sapiens
cagatcttggactcatgagg

SEQ ID NO: 3487332 - DNA, 22 bp, Homo sapiens
cagatcttggactcatgaggag

SEQ ID NO: 3487333 - DNA, 19 bp, Homo sapiens
cagatgaatgtatttattt

SEQ ID NO: 3487334 - DNA, 17 bp, Homo sapiens
cagatgcaaagaggcaa

SEQ ID NO: 3487335 - DNA, 18 bp, Homo sapiens
cagatgcaaagaggcaag

SEQ ID NO: 3487336 - DNA, 13 bp, Homo sapiens
cagatgcagggca

SEQ ID NO: 3487337 - DNA, 12 bp, Homo sapiens
cagatgcccgag

SEQ ID NO: 3487338 - DNA, 22 bp, Homo sapiens
cagatggaaccgcaggaagctg

SEQ ID NO: 3487339 - DNA, 23 bp, Homo sapiens
cagatgggcatatgtgtcagtgg

SEQ ID NO: 3487340 - DNA, 22 bp, Homo sapiens
cagatggtttccacatttagat

SEQ ID NO: 3487341 - DNA, 16 bp, Homo sapiens
cagatgtaatgttttc

SEQ ID NO: 3487342 - DNA, 18 bp, Homo sapiens
cagatgtggggctgagct

SEQ ID NO: 3487343 - DNA, 19 bp, Homo sapiens
cagatgtggggctgagctg

SEQ ID NO: 3487344 - DNA, 23 bp, Homo sapiens
cagatgtggggctgagctgggga

SEQ ID NO: 3487345 - DNA, 23 bp, Homo sapiens
cagatgtttccagacttccttga

SEQ ID NO: 3487346 - DNA, 14 bp, Homo sapiens
cagattcccactgc

SEQ ID NO: 3487347 - DNA, 13 bp, Homo sapiens
cagattgaactta

SEQ ID NO: 3487348 - DNA, 19 bp, Homo sapiens
cagattgcaacaggctggg

SEQ ID NO: 3487349 - DNA, 17 bp, Homo sapiens
cagattggctcacactg

SEQ ID NO: 3487350 - DNA, 15 bp, Homo sapiens
cagattgtcttaatt

SEQ ID NO: 3487351 - DNA, 14 bp, Homo sapiens
cagatttgtctttt

SEQ ID NO: 3487352 - DNA, 23 bp, Homo sapiens
cagattttaattttgaataaata

SEQ ID NO: 3487353 - DNA, 20 bp, Homo sapiens
cagattttgatagcaaagcg

SEQ ID NO: 3487354 - DNA, 23 bp, Homo sapiens
cagattttgctgtatatttgtga

SEQ ID NO: 3487355 - DNA, 15 bp, Homo sapiens
cagcaaaaagcaaaa

SEQ ID NO: 3487356 - DNA, 13 bp, Homo sapiens
cagcaaattttca

SEQ ID NO: 3487357 - DNA, 19 bp, Homo sapiens
cagcaacaggaatctcaga

SEQ ID NO: 3487358 - DNA, 21 bp, Homo sapiens
cagcaacaggaatctcagaga

SEQ ID NO: 3487359 - DNA, 22 bp, Homo sapiens
cagcaacattttcttgaatttt

SEQ ID NO: 3487360 - DNA, 12 bp, Homo sapiens
cagcaaccccag

SEQ ID NO: 3487361 - DNA, 20 bp, Homo sapiens
cagaaataatctgacactac

SEQ ID NO: 3487362 - DNA, 15 bp, Homo sapiens
cagaaatacagattt

SEQ ID NO: 3487363 - DNA, 15 bp, Homo sapiens
cagaaatgctgctgg

SEQ ID NO: 3487364 - DNA, 17 bp, Homo sapiens
cagaaatgctgctggcc

SEQ ID NO: 3487365 - DNA, 19 bp, Homo sapiens
cagaaatgctgctggccaa

SEQ ID NO: 3487366 - DNA, 22 bp, Homo sapiens
cagaaatttaattcatgtttct

SEQ ID NO: 3487367 - DNA, 18 bp, Homo sapiens
cagaacacactccatcag

SEQ ID NO: 3487368 - DNA, 18 bp, Homo sapiens
cagaacagtatgaatttg

SEQ ID NO: 3487369 - DNA, 13 bp, Homo sapiens
cagaaccagcctc

SEQ ID NO: 3487370 - DNA, 15 bp, Homo sapiens
cagaaccagcctcaa

SEQ ID NO: 3487371 - DNA, 18 bp, Homo sapiens
cagaaccctgccatggaa

SEQ ID NO: 3487372 - DNA, 18 bp, Homo sapiens
cagaaccttgttatttct

SEQ ID NO: 3487373 - DNA, 21 bp, Homo sapiens
cagaacgaaccttggcctggg

SEQ ID NO: 3487374 - DNA, 17 bp, Homo sapiens
cagaactaaactcattt

SEQ ID NO: 3487375 - DNA, 16 bp, Homo sapiens
cagaactctttcaaaa

SEQ ID NO: 3487376 - DNA, 17 bp, Homo sapiens
cagaacttgctgctgtc

SEQ ID NO: 3487377 - DNA, 18 bp, Homo sapiens
cagaacttgctgctgtct

SEQ ID NO: 3487378 - DNA, 19 bp, Homo sapiens
cagaagattaagacagaga

SEQ ID NO: 3487379 - DNA, 13 bp, Homo sapiens
cagaagcagagag

SEQ ID NO: 3487380 - DNA, 19 bp, Homo sapiens
cagaagggggtggtgtctc

SEQ ID NO: 3487381 - DNA, 12 bp, Homo sapiens
cagaagtcctgt

SEQ ID NO: 3487382 - DNA, 19 bp, Homo sapiens
cagaagtcctgtatgtctg

SEQ ID NO: 3487383 - DNA, 20 bp, Homo sapiens
cagaagtcctgtatgtctgt

SEQ ID NO: 3487384 - DNA, 22 bp, Homo sapiens
cagaagtcctgtatgtctgtca

SEQ ID NO: 3487385 - DNA, 20 bp, Homo sapiens
cagaagtttgagatcagcct

SEQ ID NO: 3487386 - DNA, 23 bp, Homo sapiens
cagaagtttgagatcagcctggg

SEQ ID NO: 3487387 - DNA, 22 bp, Homo sapiens
cagaagtttgcactatctttca

SEQ ID NO: 3487388 - DNA, 19 bp, Homo sapiens
cagaatagatagcactgaa

SEQ ID NO: 3487389 - DNA, 21 bp, Homo sapiens
cagaatagccacatttggaat

SEQ ID NO: 3487390 - DNA, 15 bp, Homo sapiens
cagaatccaaagatc

SEQ ID NO: 3487391 - DNA, 18 bp, Homo sapiens
cagaatgctgcaggactt

SEQ ID NO: 3487392 - DNA, 16 bp, Homo sapiens
cagaatgctgtacatc

SEQ ID NO: 3487393 - DNA, 22 bp, Homo sapiens
cagacaatatgtgagtgccttt

SEQ ID NO: 3487394 - DNA, 12 bp, Homo sapiens
cagacacacaca

SEQ ID NO: 3487395 - DNA, 15 bp, Homo sapiens
cagacacaggcccgg

SEQ ID NO: 3487396 - DNA, 18 bp, Homo sapiens
cagacacaggcccggctc

SEQ ID NO: 3487397 - DNA, 23 bp, Homo sapiens
cagacacaggcccggctccaggc

SEQ ID NO: 3487398 - DNA, 15 bp, Homo sapiens
cagacacaggccctc

SEQ ID NO: 3487399 - DNA, 22 bp, Homo sapiens
cagacacagggacttgaagttg

SEQ ID NO: 3487400 - DNA, 13 bp, Homo sapiens
cagacacatgcta

SEQ ID NO: 3487401 - DNA, 12 bp, Homo sapiens
cagacacccagg

SEQ ID NO: 3487402 - DNA, 13 bp, Homo sapiens
cagacacccagga

SEQ ID NO: 3487403 - DNA, 21 bp, Homo sapiens
cagacaccctcaacctcttct

SEQ ID NO: 3487404 - DNA, 14 bp, Homo sapiens
cagacaccttggac

SEQ ID NO: 3487405 - DNA, 22 bp, Homo sapiens
cagacacggatctgagaatctt

SEQ ID NO: 3487406 - DNA, 18 bp, Homo sapiens
cagacacttcatggacca

SEQ ID NO: 3487407 - DNA, 17 bp, Homo sapiens
cagacagaaagagacac

SEQ ID NO: 3487408 - DNA, 16 bp, Homo sapiens
cagacagaccttcaca

SEQ ID NO: 3487409 - DNA, 17 bp, Homo sapiens
cagacagaccttcacag

SEQ ID NO: 3487410 - DNA, 20 bp, Homo sapiens
cagacagaccttcacagatg

SEQ ID NO: 3487411 - DNA, 21 bp, Homo sapiens
cagacagagaatatgtctgct

SEQ ID NO: 3487412 - DNA, 14 bp, Homo sapiens
cagacagaggatga

SEQ ID NO: 3487413 - DNA, 21 bp, Homo sapiens
cagacagctccaccctggccg

SEQ ID NO: 3487414 - DNA, 11 bp, Homo sapiens
cagacaggcaa

SEQ ID NO: 3487415 - DNA, 18 bp, Homo sapiens
cagacaggcaagcacctc

SEQ ID NO: 3487416 - DNA, 20 bp, Homo sapiens
cagacaggcaagcacctcct

SEQ ID NO: 3487417 - DNA, 21 bp, Homo sapiens
cagacaggcaagcacctcctg

SEQ ID NO: 3487418 - DNA, 18 bp, Homo sapiens
cagacaggtggaaaaact

SEQ ID NO: 3487419 - DNA, 15 bp, Homo sapiens
cagacatatttaact

SEQ ID NO: 3487420 - DNA, 17 bp, Homo sapiens
cagacatatttaactgg

SEQ ID NO: 3487421 - DNA, 12 bp, Homo sapiens
cagacatgtttt

SEQ ID NO: 3487422 - DNA, 16 bp, Homo sapiens
cagacattctgccagg

SEQ ID NO: 3487423 - DNA, 21 bp, Homo sapiens
cagacattctgccaggccccc

SEQ ID NO: 3487424 - DNA, 20 bp, Homo sapiens
cagaccacaaaacttttcta

SEQ ID NO: 3487425 - DNA, 13 bp, Homo sapiens
cagaccagctctt

SEQ ID NO: 3487426 - DNA, 14 bp, Homo sapiens
cagaccctctgccg

SEQ ID NO: 3487427 - DNA, 12 bp, Homo sapiens
cagaccctgaag

SEQ ID NO: 3487428 - DNA, 13 bp, Homo sapiens
cagacctctggat

SEQ ID NO: 3487429 - DNA, 14 bp, Homo sapiens
cagacctgatcctg

SEQ ID NO: 3487430 - DNA, 22 bp, Homo sapiens
cagacctgatcctggaggccca

SEQ ID NO: 3487431 - DNA, 20 bp, Homo sapiens
cagacctgtcaccctgcagg

SEQ ID NO: 3487432 - DNA, 19 bp, Homo sapiens
cagacctgttagcagacag

SEQ ID NO: 3487433 - DNA, 16 bp, Homo sapiens
cagaccttcacagatg

SEQ ID NO: 3487434 - DNA, 18 bp, Homo sapiens
cagaccttcacagatgcc

SEQ ID NO: 3487435 - DNA, 21 bp, Homo sapiens
cagaccttctaggacgccacc

SEQ ID NO: 3487436 - DNA, 22 bp, Homo sapiens
cagactcaaatgctcagaccag

SEQ ID NO: 3487437 - DNA, 23 bp, Homo sapiens
cagactcaaatgctcagaccagc

SEQ ID NO: 3487438 - DNA, 20 bp, Homo sapiens
cagactcacaacctgaacct

SEQ ID NO: 3487439 - DNA, 14 bp, Homo sapiens
cagactcagacatt

SEQ ID NO: 3487440 - DNA, 18 bp, Homo sapiens
cagactcccattcctgaa

SEQ ID NO: 3487441 - DNA, 22 bp, Homo sapiens
cagactcgattcatattgaata

SEQ ID NO: 3487442 - DNA, 17 bp, Homo sapiens
cagactctacagaggcc

SEQ ID NO: 3487443 - DNA, 18 bp, Homo sapiens
cagactctacagaggcca

SEQ ID NO: 3487444 - DNA, 21 bp, Homo sapiens
cagactctacagaggccatgg

SEQ ID NO: 3487445 - DNA, 19 bp, Homo sapiens
cagactctttatgcttgca

SEQ ID NO: 3487446 - DNA, 18 bp, Homo sapiens
cagactggaagcacagct

SEQ ID NO: 3487447 - DNA, 21 bp, Homo sapiens
cagactggaagcacagcttca

SEQ ID NO: 3487448 - DNA, 23 bp, Homo sapiens
cagactggttgagttcaggtagc

SEQ ID NO: 3487449 - DNA, 12 bp, Homo sapiens
cagactgtgtaa

SEQ ID NO: 3487450 - DNA, 21 bp, Homo sapiens
cagactgtgtaaaaagagagc

SEQ ID NO: 3487451 - DNA, 14 bp, Homo sapiens
cagacttcccagct

SEQ ID NO: 3487452 - DNA, 16 bp, Homo sapiens
cagagaaacagacaga

SEQ ID NO: 3487453 - DNA, 20 bp, Homo sapiens
cagagaaacttaagcaaagg

SEQ ID NO: 3487454 - DNA, 13 bp, Homo sapiens
cagagaaagagga

SEQ ID NO: 3487455 - DNA, 21 bp, Homo sapiens
cagagaagctataaattcctc

SEQ ID NO: 3487456 - DNA, 20 bp, Homo sapiens
cagagaatatgtctgctcct

SEQ ID NO: 3487457 - DNA, 15 bp, Homo sapiens
cagagacaggtggcc

SEQ ID NO: 3487458 - DNA, 16 bp, Homo sapiens
cagagacatacttgaa

SEQ ID NO: 3487459 - DNA, 20 bp, Homo sapiens
cagagacatacttgaagggc

SEQ ID NO: 3487460 - DNA, 18 bp, Homo sapiens
cagagacctcctgcctcc

SEQ ID NO: 3487461 - DNA, 16 bp, Homo sapiens
cagagagaatgagagc

SEQ ID NO: 3487462 - DNA, 13 bp, Homo sapiens
cagagagagagaa

SEQ ID NO: 3487463 - DNA, 22 bp, Homo sapiens
cagagagagagaatggatcctc

SEQ ID NO: 3487464 - DNA, 14 bp, Homo sapiens
cagagagggcaggc

SEQ ID NO: 3487465 - DNA, 21 bp, Homo sapiens
cagagagggcaggcatgaagt

SEQ ID NO: 3487466 - DNA, 17 bp, Homo sapiens
cagagagggtggtgacc

SEQ ID NO: 3487467 - DNA, 23 bp, Homo sapiens
cagagatccaaaagaagccccca

SEQ ID NO: 3487468 - DNA, 21 bp, Homo sapiens
cagagatgcaccaccaagcca

SEQ ID NO: 3487469 - DNA, 13 bp, Homo sapiens
cagagatggacag

SEQ ID NO: 3487470 - DNA, 19 bp, Homo sapiens
cagagatggacagagaact

SEQ ID NO: 3487471 - DNA, 22 bp, Homo sapiens
cagagattggaatgggcagctc

SEQ ID NO: 3487472 - DNA, 23 bp, Homo sapiens
cagagattggaatgggcagctca

SEQ ID NO: 3487473 - DNA, 14 bp, Homo sapiens
cagagcaagtgaga

SEQ ID NO: 3487474 - DNA, 20 bp, Homo sapiens
cagagcaagtgagaccctgt

SEQ ID NO: 3487475 - DNA, 13 bp, Homo sapiens
cagagcagatggc

SEQ ID NO: 3487476 - DNA, 14 bp, Homo sapiens
cagagcaggactgc

SEQ ID NO: 3487477 - DNA, 21 bp, Homo sapiens
cagagcagggggacctaggct

SEQ ID NO: 3487478 - DNA, 20 bp, Homo sapiens
cagagcattttttatgatat

SEQ ID NO: 3487479 - DNA, 14 bp, Homo sapiens
cagagccacagggt

SEQ ID NO: 3487480 - DNA, 17 bp, Homo sapiens
cagagccacagggtctg

SEQ ID NO: 3487481 - DNA, 21 bp, Homo sapiens
cagagccacagggtctgcctc

SEQ ID NO: 3487482 - DNA, 23 bp, Homo sapiens
cagagccacagggtctgcctcca

SEQ ID NO: 3487483 - DNA, 17 bp, Homo sapiens
cagagcccaccttggct

SEQ ID NO: 3487484 - DNA, 19 bp, Homo sapiens
cagagcccaccttggctca

SEQ ID NO: 3487485 - DNA, 20 bp, Homo sapiens
cagagcccaccttggctcaa

SEQ ID NO: 3487486 - DNA, 11 bp, Homo sapiens
cagagcccagc

SEQ ID NO: 3487487 - DNA, 13 bp, Homo sapiens
cagagcccagctc

SEQ ID NO: 3487488 - DNA, 14 bp, Homo sapiens
cagagcccagctcc

SEQ ID NO: 3487489 - DNA, 15 bp, Homo sapiens
cagagcccagggaga

SEQ ID NO: 3487490 - DNA, 14 bp, Homo sapiens
cagagcctcgctct

SEQ ID NO: 3487491 - DNA, 12 bp, Homo sapiens
cagagcctgcag

SEQ ID NO: 3487492 - DNA, 19 bp, Homo sapiens
cagagctaaactccttcct

SEQ ID NO: 3487493 - DNA, 22 bp, Homo sapiens
cagagctggccaggccactggg

SEQ ID NO: 3487494 - DNA, 13 bp, Homo sapiens
cagagcttccctg

SEQ ID NO: 3487495 - DNA, 14 bp, Homo sapiens
cagagcttccctga

SEQ ID NO: 3487496 - DNA, 15 bp, Homo sapiens
cagagcttggactgg

SEQ ID NO: 3487497 - DNA, 21 bp, Homo sapiens
cacaagtcctggatgttgtgt

SEQ ID NO: 3487498 - DNA, 14 bp, Homo sapiens
cacaagtggtggta

SEQ ID NO: 3487499 - DNA, 20 bp, Homo sapiens
cacaagtggtggtaaccctg

SEQ ID NO: 3487500 - DNA, 21 bp, Homo sapiens
cacaagtggtggtaaccctgg

SEQ ID NO: 3487501 - DNA, 14 bp, Homo sapiens
cacaagttgtgttt

SEQ ID NO: 3487502 - DNA, 17 bp, Homo sapiens
cacaatggtttttaaat

SEQ ID NO: 3487503 - DNA, 23 bp, Homo sapiens
cacaattccatttccagttcatc

SEQ ID NO: 3487504 - DNA, 14 bp, Homo sapiens
cacacacaaacctt

SEQ ID NO: 3487505 - DNA, 9 bp, Homo sapiens
cacacacac

SEQ ID NO: 3487506 - DNA, 12 bp, Homo sapiens
cacacacacaca

SEQ ID NO: 3487507 - DNA, 16 bp, Homo sapiens
cacacacacacacaca

SEQ ID NO: 3487508 - DNA, 16 bp, Homo sapiens
cacacaccagagccca

SEQ ID NO: 3487509 - DNA, 14 bp, Homo sapiens
cacacacccctcaa

SEQ ID NO: 3487510 - DNA, 13 bp, Homo sapiens
cacacacctgtag

SEQ ID NO: 3487511 - DNA, 17 bp, Homo sapiens
cacacacgcgtgcacac

SEQ ID NO: 3487512 - DNA, 14 bp, Homo sapiens
cacacactgatgct

SEQ ID NO: 3487513 - DNA, 14 bp, Homo sapiens
cacacactttggct

SEQ ID NO: 3487514 - DNA, 12 bp, Homo sapiens
cacacagggcag

SEQ ID NO: 3487515 - DNA, 23 bp, Homo sapiens
cacacatataaacatcacacaca

SEQ ID NO: 3487516 - DNA, 19 bp, Homo sapiens
cacacatcctgctgggccc

SEQ ID NO: 3487517 - DNA, 16 bp, Homo sapiens
cacacatctgtggaga

SEQ ID NO: 3487518 - DNA, 18 bp, Homo sapiens
cacaccaagcagcaacag

SEQ ID NO: 3487519 - DNA, 12 bp, Homo sapiens
cacaccagagcc

SEQ ID NO: 3487520 - DNA, 15 bp, Homo sapiens
cacaccagagcccac

SEQ ID NO: 3487521 - DNA, 21 bp, Homo sapiens
cacaccagagcccaccttggc

SEQ ID NO: 3487522 - DNA, 22 bp, Homo sapiens
cacaccaggcttgcctgcaggc

SEQ ID NO: 3487523 - DNA, 16 bp, Homo sapiens
cacacccactcagctc

SEQ ID NO: 3487524 - DNA, 20 bp, Homo sapiens
cacacccagcccacttctgc

SEQ ID NO: 3487525 - DNA, 15 bp, Homo sapiens
cacacctagccagct

SEQ ID NO: 3487526 - DNA, 15 bp, Homo sapiens
cacacctgccctaaa

SEQ ID NO: 3487527 - DNA, 16 bp, Homo sapiens
cacacctgtagcactt

SEQ ID NO: 3487528 - DNA, 23 bp, Homo sapiens
cacaccttttattgacacagaaa

SEQ ID NO: 3487529 - DNA, 20 bp, Homo sapiens
cacacgcctcccactggggt

SEQ ID NO: 3487530 - DNA, 15 bp, Homo sapiens
cacacggctccccca

SEQ ID NO: 3487531 - DNA, 19 bp, Homo sapiens
cacacggctcccccaggcc

SEQ ID NO: 3487532 - DNA, 20 bp, Homo sapiens
cacacggtttgaagcctgga

SEQ ID NO: 3487533 - DNA, 14 bp, Homo sapiens
cacactccatcagc

SEQ ID NO: 3487534 - DNA, 17 bp, Homo sapiens
cacactccatcagctta

SEQ ID NO: 3487535 - DNA, 17 bp, Homo sapiens
cacactgaggcagggaa

SEQ ID NO: 3487536 - DNA, 18 bp, Homo sapiens
cacactgatgcttagatg

SEQ ID NO: 3487537 - DNA, 22 bp, Homo sapiens
cacacttactgtaagacattag

SEQ ID NO: 3487538 - DNA, 21 bp, Homo sapiens
cacacttggcccaagtggcag

SEQ ID NO: 3487539 - DNA, 12 bp, Homo sapiens
cacagaaacctt

SEQ ID NO: 3487540 - DNA, 20 bp, Homo sapiens
cacagaaatgctgctggcca

SEQ ID NO: 3487541 - DNA, 22 bp, Homo sapiens
cacagaaatgctgctggccaaa

SEQ ID NO: 3487542 - DNA, 21 bp, Homo sapiens
cacagaactgcttactagccc

SEQ ID NO: 3487543 - DNA, 12 bp, Homo sapiens
cacagaagtcct

SEQ ID NO: 3487544 - DNA, 18 bp, Homo sapiens
cacagacattctgccagg

SEQ ID NO: 3487545 - DNA, 14 bp, Homo sapiens
cacagagacccccg

SEQ ID NO: 3487546 - DNA, 17 bp, Homo sapiens
cacagatgaaacacaaa

SEQ ID NO: 3487547 - DNA, 16 bp, Homo sapiens
cacagatgctccaggg

SEQ ID NO: 3487548 - DNA, 19 bp, Homo sapiens
cacagatgttcccccatct

SEQ ID NO: 3487549 - DNA, 15 bp, Homo sapiens
cacagcacagccaac

SEQ ID NO: 3487550 - DNA, 17 bp, Homo sapiens
cacagccagcacctggc

SEQ ID NO: 3487551 - DNA, 20 bp, Homo sapiens
cacagccagcacctggcatc

SEQ ID NO: 3487552 - DNA, 19 bp, Homo sapiens
cacagcgtcctgtccacac

SEQ ID NO: 3487553 - DNA, 20 bp, Homo sapiens
cacagctaacacacagctcc

SEQ ID NO: 3487554 - DNA, 11 bp, Homo sapiens
cacagctctgt

SEQ ID NO: 3487555 - DNA, 14 bp, Homo sapiens
cacagctctgtcct

SEQ ID NO: 3487556 - DNA, 15 bp, Homo sapiens
cacagctctgtcctg

SEQ ID NO: 3487557 - DNA, 19 bp, Homo sapiens
cacagctctgtcctgggag

SEQ ID NO: 3487558 - DNA, 10 bp, Homo sapiens
cacagctctt

SEQ ID NO: 3487559 - DNA, 18 bp, Homo sapiens
cacagctcttctccaggc

SEQ ID NO: 3487560 - DNA, 19 bp, Homo sapiens
cacagctcttctccaggct

SEQ ID NO: 3487561 - DNA, 14 bp, Homo sapiens
cacagctgctggag

SEQ ID NO: 3487562 - DNA, 15 bp, Homo sapiens
cacagctgctggaga

SEQ ID NO: 3487563 - DNA, 13 bp, Homo sapiens
cacagctgggata

SEQ ID NO: 3487564 - DNA, 14 bp, Homo sapiens
cacagcttcccctc

SEQ ID NO: 3487565 - DNA, 22 bp, Homo sapiens
cacagcttcctgtccccatctg

SEQ ID NO: 3487566 - DNA, 19 bp, Homo sapiens
cacagcttgacctgaggct

SEQ ID NO: 3487567 - DNA, 16 bp, Homo sapiens
cacagcttttccaaaa

SEQ ID NO: 3487568 - DNA, 20 bp, Homo sapiens
cacaggacatgcggtagcca

SEQ ID NO: 3487569 - DNA, 15 bp, Homo sapiens
cacaggacatttctc

SEQ ID NO: 3487570 - DNA, 17 bp, Homo sapiens
cacaggatcagtctgat

SEQ ID NO: 3487571 - DNA, 11 bp, Homo sapiens
cacaggcaggt

SEQ ID NO: 3487572 - DNA, 15 bp, Homo sapiens
cacaggcaggtccag

SEQ ID NO: 3487573 - DNA, 17 bp, Homo sapiens
cacaggccccccgcagc

SEQ ID NO: 3487574 - DNA, 21 bp, Homo sapiens
cacaggccccccgcagcaccc

SEQ ID NO: 3487575 - DNA, 23 bp, Homo sapiens
cacaggccccccgcagcaccctg

SEQ ID NO: 3487576 - DNA, 14 bp, Homo sapiens
cacaggcccggctc

SEQ ID NO: 3487577 - DNA, 16 bp, Homo sapiens
cacaggcccggctcca

SEQ ID NO: 3487578 - DNA, 18 bp, Homo sapiens
cacaggcccggctccagg

SEQ ID NO: 3487579 - DNA, 19 bp, Homo sapiens
cacaggcccggctccaggc

SEQ ID NO: 3487580 - DNA, 19 bp, Homo sapiens
cacaggcctgagatttcat

SEQ ID NO: 3487581 - DNA, 14 bp, Homo sapiens
cacagggacttgaa

SEQ ID NO: 3487582 - DNA, 15 bp, Homo sapiens
cacaggtctttccta

SEQ ID NO: 3487583 - DNA, 19 bp, Homo sapiens
cacaggttcatgccaccat

SEQ ID NO: 3487584 - DNA, 18 bp, Homo sapiens
cacagtaaacgtgtttgt

SEQ ID NO: 3487585 - DNA, 22 bp, Homo sapiens
cacagtgctttccgtggcactg

SEQ ID NO: 3487586 - DNA, 20 bp, Homo sapiens
cacagtgggatgaaccagcc

SEQ ID NO: 3487587 - DNA, 18 bp, Homo sapiens
cacagttctttgggccag

SEQ ID NO: 3487588 - DNA, 19 bp, Homo sapiens
cacagttctttgggccaga

SEQ ID NO: 3487589 - DNA, 23 bp, Homo sapiens
cacagttgaagggaggggctgtg

SEQ ID NO: 3487590 - DNA, 13 bp, Homo sapiens
cacataataaacg

SEQ ID NO: 3487591 - DNA, 16 bp, Homo sapiens
cacatagtttttcagt

SEQ ID NO: 3487592 - DNA, 21 bp, Homo sapiens
cacatataaacatcacacaca

SEQ ID NO: 3487593 - DNA, 19 bp, Homo sapiens
cacatccatcagcacccca

SEQ ID NO: 3487594 - DNA, 17 bp, Homo sapiens
cacatcctgtgtttcta

SEQ ID NO: 3487595 - DNA, 13 bp, Homo sapiens
cacatcgttttgg

SEQ ID NO: 3487596 - DNA, 21 bp, Homo sapiens
cacatctgcattttcacccca

SEQ ID NO: 3487597 - DNA, 15 bp, Homo sapiens
cacatctgtggagat

SEQ ID NO: 3487598 - DNA, 12 bp, Homo sapiens
cacatctgtgtc

SEQ ID NO: 3487599 - DNA, 16 bp, Homo sapiens
cacatctgtgtcttgt

SEQ ID NO: 3487600 - DNA, 17 bp, Homo sapiens
cacatctgtgtcttgtt

SEQ ID NO: 3487601 - DNA, 23 bp, Homo sapiens
cacatctgtgtcttgtttggaat

SEQ ID NO: 3487602 - DNA, 14 bp, Homo sapiens
cacatcttgctctg

SEQ ID NO: 3487603 - DNA, 18 bp, Homo sapiens
cacatcttgctctgctga

SEQ ID NO: 3487604 - DNA, 21 bp, Homo sapiens
cacatgaaacctacacactgt

SEQ ID NO: 3487605 - DNA, 14 bp, Homo sapiens
cacatggaaaaaaa

SEQ ID NO: 3487606 - DNA, 15 bp, Homo sapiens
cacatgtcttaatga

SEQ ID NO: 3487607 - DNA, 18 bp, Homo sapiens
cacatgtcttaatgaagt

SEQ ID NO: 3487608 - DNA, 23 bp, Homo sapiens
cacatgtcttaatgaagtttgaa

SEQ ID NO: 3487609 - DNA, 23 bp, Homo sapiens
cacatgttggaggagagagcctt

SEQ ID NO: 3487610 - DNA, 18 bp, Homo sapiens
cacattaatatttgctga

SEQ ID NO: 3487611 - DNA, 21 bp, Homo sapiens
cacattagaagacaattgaca

SEQ ID NO: 3487612 - DNA, 11 bp, Homo sapiens
cacattcccct

SEQ ID NO: 3487613 - DNA, 15 bp, Homo sapiens
cacattcccctgggg

SEQ ID NO: 3487614 - DNA, 17 bp, Homo sapiens
cacattcccctggggac

SEQ ID NO: 3487615 - DNA, 14 bp, Homo sapiens
cacattcctttggg

SEQ ID NO: 3487616 - DNA, 18 bp, Homo sapiens
cacattgtttgctgctat

SEQ ID NO: 3487617 - DNA, 19 bp, Homo sapiens
cacattgtttgctgctatt

SEQ ID NO: 3487618 - DNA, 19 bp, Homo sapiens
cacattttggttcttctca

SEQ ID NO: 3487619 - DNA, 20 bp, Homo sapiens
caaggtcacctgggctgtga

SEQ ID NO: 3487620 - DNA, 21 bp, Homo sapiens
caaggtgaaatgaagcaacag

SEQ ID NO: 3487621 - DNA, 12 bp, Homo sapiens
caaggtgggagg

SEQ ID NO: 3487622 - DNA, 20 bp, Homo sapiens
caaggtggtgcttctgccat

SEQ ID NO: 3487623 - DNA, 22 bp, Homo sapiens
caaggtttaggctggtggccca

SEQ ID NO: 3487624 - DNA, 23 bp, Homo sapiens
caaggtttaggctggtggcccag

SEQ ID NO: 3487625 - DNA, 16 bp, Homo sapiens
caagtaagaggctgga

SEQ ID NO: 3487626 - DNA, 18 bp, Homo sapiens
caagtatactagggagcc

SEQ ID NO: 3487627 - DNA, 16 bp, Homo sapiens
caagtatgctgtggag

SEQ ID NO: 3487628 - DNA, 20 bp, Homo sapiens
caagtcaccaaaagacactg

SEQ ID NO: 3487629 - DNA, 13 bp, Homo sapiens
caagtcatgtgca

SEQ ID NO: 3487630 - DNA, 19 bp, Homo sapiens
caagtcctggatgttgtgt

SEQ ID NO: 3487631 - DNA, 17 bp, Homo sapiens
caagtcctttgtgaata

SEQ ID NO: 3487632 - DNA, 20 bp, Homo sapiens
caagtctgtttactgcaagg

SEQ ID NO: 3487633 - DNA, 21 bp, Homo sapiens
caagtctttaggtctttgtaa

SEQ ID NO: 3487634 - DNA, 14 bp, Homo sapiens
caagtgaaggttta

SEQ ID NO: 3487635 - DNA, 21 bp, Homo sapiens
caagtgaaggtttacaattta

SEQ ID NO: 3487636 - DNA, 20 bp, Homo sapiens
caagtgattctcctgcctca

SEQ ID NO: 3487637 - DNA, 18 bp, Homo sapiens
caagtgattgggacagag

SEQ ID NO: 3487638 - DNA, 14 bp, Homo sapiens
caagtgcacggggc

SEQ ID NO: 3487639 - DNA, 16 bp, Homo sapiens
caagtgccgcaaattg

SEQ ID NO: 3487640 - DNA, 16 bp, Homo sapiens
caagtgcctgctttta

SEQ ID NO: 3487641 - DNA, 13 bp, Homo sapiens
caagtgctcaggg

SEQ ID NO: 3487642 - DNA, 22 bp, Homo sapiens
caagtggtgggaatcagatctg

SEQ ID NO: 3487643 - DNA, 22 bp, Homo sapiens
caagtggtggtaaccctggtgg

SEQ ID NO: 3487644 - DNA, 22 bp, Homo sapiens
caagtgtgtgccaccatgcctc

SEQ ID NO: 3487645 - DNA, 21 bp, Homo sapiens
caagttttcttccatgatttt

SEQ ID NO: 3487646 - DNA, 20 bp, Homo sapiens
caataaaaacattgcctttg

SEQ ID NO: 3487647 - DNA, 21 bp, Homo sapiens
caataaaatattattgaacta

SEQ ID NO: 3487648 - DNA, 20 bp, Homo sapiens
caataaaatttttttaaagt

SEQ ID NO: 3487649 - DNA, 18 bp, Homo sapiens
caataaaattttttttca

SEQ ID NO: 3487650 - DNA, 15 bp, Homo sapiens
caataaagcatttat

SEQ ID NO: 3487651 - DNA, 17 bp, Homo sapiens
caataaagtatttaatt

SEQ ID NO: 3487652 - DNA, 18 bp, Homo sapiens
caataaatctgacccagt

SEQ ID NO: 3487653 - DNA, 13 bp, Homo sapiens
caataaattgcta

SEQ ID NO: 3487654 - DNA, 21 bp, Homo sapiens
caataataagtgatgtgctga

SEQ ID NO: 3487655 - DNA, 11 bp, Homo sapiens
caataatgcag

SEQ ID NO: 3487656 - DNA, 13 bp, Homo sapiens
caataatgcagta

SEQ ID NO: 3487657 - DNA, 17 bp, Homo sapiens
caataatgcagtatggt

SEQ ID NO: 3487658 - DNA, 20 bp, Homo sapiens
caataatgcagtatggtaca

SEQ ID NO: 3487659 - DNA, 18 bp, Homo sapiens
caataatgtaatttagtc

SEQ ID NO: 3487660 - DNA, 21 bp, Homo sapiens
caataatgtaatttagtctaa

SEQ ID NO: 3487661 - DNA, 14 bp, Homo sapiens
caataatttcaggt

SEQ ID NO: 3487662 - DNA, 22 bp, Homo sapiens
caataatttcaggttttgtaaa

SEQ ID NO: 3487663 - DNA, 18 bp, Homo sapiens
caatacaaaggttccatt

SEQ ID NO: 3487664 - DNA, 14 bp, Homo sapiens
caatacctcttgga

SEQ ID NO: 3487665 - DNA, 23 bp, Homo sapiens
caatagccgatatcagaatttgt

SEQ ID NO: 3487666 - DNA, 18 bp, Homo sapiens
caatagtaattctcaggc

SEQ ID NO: 3487667 - DNA, 22 bp, Homo sapiens
caatagttcaaggaacttgaaa

SEQ ID NO: 3487668 - DNA, 15 bp, Homo sapiens
caatataatgttttt

SEQ ID NO: 3487669 - DNA, 15 bp, Homo sapiens
caatatcactcttga

SEQ ID NO: 3487670 - DNA, 15 bp, Homo sapiens
caatatcctttgcct

SEQ ID NO: 3487671 - DNA, 20 bp, Homo sapiens
caatatcctttgcctcaagg

SEQ ID NO: 3487672 - DNA, 16 bp, Homo sapiens
caatatgtgagtgcct

SEQ ID NO: 3487673 - DNA, 12 bp, Homo sapiens
caatatgtgcca

SEQ ID NO: 3487674 - DNA, 14 bp, Homo sapiens
caatattaaatctg

SEQ ID NO: 3487675 - DNA, 15 bp, Homo sapiens
caatattaaatctgc

SEQ ID NO: 3487676 - DNA, 13 bp, Homo sapiens
caatattataatt

SEQ ID NO: 3487677 - DNA, 14 bp, Homo sapiens
caatattataattt

SEQ ID NO: 3487678 - DNA, 14 bp, Homo sapiens
caatattgactttg

SEQ ID NO: 3487679 - DNA, 20 bp, Homo sapiens
caatattttctttaatgctt

SEQ ID NO: 3487680 - DNA, 12 bp, Homo sapiens
caatcactgcca

SEQ ID NO: 3487681 - DNA, 20 bp, Homo sapiens
caatcagagaccaggccctg

SEQ ID NO: 3487682 - DNA, 14 bp, Homo sapiens
caatcatgttctgg

SEQ ID NO: 3487683 - DNA, 20 bp, Homo sapiens
caatccctttattaccccct

SEQ ID NO: 3487684 - DNA, 20 bp, Homo sapiens
caatcctactaataaaccag

SEQ ID NO: 3487685 - DNA, 23 bp, Homo sapiens
caatcggtgtgtagtgatgtttc

SEQ ID NO: 3487686 - DNA, 16 bp, Homo sapiens
caatctggaagaaaaa

SEQ ID NO: 3487687 - DNA, 18 bp, Homo sapiens
caatcttctttttcaggc

SEQ ID NO: 3487688 - DNA, 19 bp, Homo sapiens
caatgaaatatgtgaagcc

SEQ ID NO: 3487689 - DNA, 21 bp, Homo sapiens
caatgaaatatgtgaagccca

SEQ ID NO: 3487690 - DNA, 21 bp, Homo sapiens
caatgaagccagctcacagtg

SEQ ID NO: 3487691 - DNA, 13 bp, Homo sapiens
caatgatttgtca

SEQ ID NO: 3487692 - DNA, 18 bp, Homo sapiens
caatgcaagacgccctct

SEQ ID NO: 3487693 - DNA, 14 bp, Homo sapiens
caatgcactgacat

SEQ ID NO: 3487694 - DNA, 12 bp, Homo sapiens
caatgcactgag

SEQ ID NO: 3487695 - DNA, 18 bp, Homo sapiens
caatgcataatgtcttta

SEQ ID NO: 3487696 - DNA, 13 bp, Homo sapiens
caatgccatcatc

SEQ ID NO: 3487697 - DNA, 14 bp, Homo sapiens
caatgccatcatct

SEQ ID NO: 3487698 - DNA, 18 bp, Homo sapiens
caatgccatcctcaaaca

SEQ ID NO: 3487699 - DNA, 21 bp, Homo sapiens
caatgctgatttggtgaccaa

SEQ ID NO: 3487700 - DNA, 12 bp, Homo sapiens
caatgctggctg

SEQ ID NO: 3487701 - DNA, 23 bp, Homo sapiens
caatgctggctgttggctggggg

SEQ ID NO: 3487702 - DNA, 11 bp, Homo sapiens
caatggcagcc

SEQ ID NO: 3487703 - DNA, 13 bp, Homo sapiens
caatggcagcctt

SEQ ID NO: 3487704 - DNA, 14 bp, Homo sapiens
caatggcagccttg

SEQ ID NO: 3487705 - DNA, 15 bp, Homo sapiens
caatggcagccttgg

SEQ ID NO: 3487706 - DNA, 16 bp, Homo sapiens
caatggcagccttggc

SEQ ID NO: 3487707 - DNA, 23 bp, Homo sapiens
caatgggagctgaggccacactc

SEQ ID NO: 3487708 - DNA, 16 bp, Homo sapiens
caatggtttttaaatt

SEQ ID NO: 3487709 - DNA, 23 bp, Homo sapiens
caatggtttttaaattttgtaat

SEQ ID NO: 3487710 - DNA, 17 bp, Homo sapiens
caatgtaagcatacttt

SEQ ID NO: 3487711 - DNA, 20 bp, Homo sapiens
caatgtctgagtgaacctgt

SEQ ID NO: 3487712 - DNA, 19 bp, Homo sapiens
caatgtctgcagccctgag

SEQ ID NO: 3487713 - DNA, 14 bp, Homo sapiens
caatgtgaacttta

SEQ ID NO: 3487714 - DNA, 15 bp, Homo sapiens
caatgtgaactttat

SEQ ID NO: 3487715 - DNA, 23 bp, Homo sapiens
caatgtggcaaggaaaaacaggt

SEQ ID NO: 3487716 - DNA, 19 bp, Homo sapiens
caatgtgtggctgaagact

SEQ ID NO: 3487717 - DNA, 23 bp, Homo sapiens
caattatatcagtcctctttcaa

SEQ ID NO: 3487718 - DNA, 13 bp, Homo sapiens
caattatgttaaa

SEQ ID NO: 3487719 - DNA, 19 bp, Homo sapiens
caattcacgccccccttaa

SEQ ID NO: 3487720 - DNA, 13 bp, Homo sapiens
caattcagacagg

SEQ ID NO: 3487721 - DNA, 15 bp, Homo sapiens
caattcagacaggca

SEQ ID NO: 3487722 - DNA, 15 bp, Homo sapiens
caattccatttccag

SEQ ID NO: 3487723 - DNA, 16 bp, Homo sapiens
caattcctggccctgt

SEQ ID NO: 3487724 - DNA, 21 bp, Homo sapiens
caattctcctgcctttgcctc

SEQ ID NO: 3487725 - DNA, 12 bp, Homo sapiens
caattctgcatg

SEQ ID NO: 3487726 - DNA, 19 bp, Homo sapiens
caattctgtaggttaaaaa

SEQ ID NO: 3487727 - DNA, 20 bp, Homo sapiens
caattgaaggatcatctgaa

SEQ ID NO: 3487728 - DNA, 22 bp, Homo sapiens
caattgacaacagttacataat

SEQ ID NO: 3487729 - DNA, 16 bp, Homo sapiens
caattgtgctttgtat

SEQ ID NO: 3487730 - DNA, 20 bp, Homo sapiens
caattgtttgttctgttttc

SEQ ID NO: 3487731 - DNA, 13 bp, Homo sapiens
caatttacaaagt

SEQ ID NO: 3487732 - DNA, 21 bp, Homo sapiens
caatttacaaagtgtgtatta

SEQ ID NO: 3487733 - DNA, 14 bp, Homo sapiens
caatttcagactcc

SEQ ID NO: 3487734 - DNA, 15 bp, Homo sapiens
caatttctgtgttgc

SEQ ID NO: 3487735 - DNA, 13 bp, Homo sapiens
caatttgcaccag

SEQ ID NO: 3487736 - DNA, 18 bp, Homo sapiens
caattttaatttagtaaa

SEQ ID NO: 3487737 - DNA, 17 bp, Homo sapiens
cacaaaacctgtcctat

SEQ ID NO: 3487738 - DNA, 16 bp, Homo sapiens
cacaaaagtttctctt

SEQ ID NO: 3487739 - DNA, 16 bp, Homo sapiens
cacaaaattgggaaag

SEQ ID NO: 3487740 - DNA, 17 bp, Homo sapiens
cacaaacctgcctgggt

SEQ ID NO: 3487741 - DNA, 14 bp, Homo sapiens
cacaaactgtaaat

SEQ ID NO: 3487742 - DNA, 15 bp, Homo sapiens
cacaaactgtaaata

SEQ ID NO: 3487743 - DNA, 17 bp, Homo sapiens
cacaaactgtaatacaa

SEQ ID NO: 3487744 - DNA, 17 bp, Homo sapiens
cacaaagaccaaaatga

SEQ ID NO: 3487745 - DNA, 20 bp, Homo sapiens
cacaaagaccaaaatgaaag

SEQ ID NO: 3487746 - DNA, 18 bp, Homo sapiens
cacaaagctcaagatgac

SEQ ID NO: 3487747 - DNA, 21 bp, Homo sapiens
cacaaagctcaagatgacagc

SEQ ID NO: 3487748 - DNA, 20 bp, Homo sapiens
cacaaaggcaaagggtccag

SEQ ID NO: 3487749 - DNA, 19 bp, Homo sapiens
caaccttggccttctcccc

SEQ ID NO: 3487750 - DNA, 16 bp, Homo sapiens
caacctttattctttt

SEQ ID NO: 3487751 - DNA, 13 bp, Homo sapiens
caacgaggaagcc

SEQ ID NO: 3487752 - DNA, 15 bp, Homo sapiens
caacgaggaagccct

SEQ ID NO: 3487753 - DNA, 21 bp, Homo sapiens
caacggagagcgcctgcccct

SEQ ID NO: 3487754 - DNA, 18 bp, Homo sapiens
caacggccctgcagccag

SEQ ID NO: 3487755 - DNA, 14 bp, Homo sapiens
caacgtgcaaagcc

SEQ ID NO: 3487756 - DNA, 19 bp, Homo sapiens
attttgataccagaaggga

SEQ ID NO: 3487757 - DNA, 19 bp, Homo sapiens
attttgatccaagctggtc

SEQ ID NO: 3487758 - DNA, 19 bp, Homo sapiens
attttgctatcaacaataa

SEQ ID NO: 3487759 - DNA, 19 bp, Homo sapiens
attttgctggaattcctaa

SEQ ID NO: 3487760 - DNA, 14 bp, Homo sapiens
attttgctgtatat

SEQ ID NO: 3487761 - DNA, 22 bp, Homo sapiens
attttggagagtttcctgaaac

SEQ ID NO: 3487762 - DNA, 18 bp, Homo sapiens
attttggggattttcaaa

SEQ ID NO: 3487763 - DNA, 22 bp, Homo sapiens
attttggggtacccactgctct

SEQ ID NO: 3487764 - DNA, 23 bp, Homo sapiens
attttggggtacccactgctctg

SEQ ID NO: 3487765 - DNA, 21 bp, Homo sapiens
attttggtgagaaatgggact

SEQ ID NO: 3487766 - DNA, 16 bp, Homo sapiens
attttggttcttctca

SEQ ID NO: 3487767 - DNA, 16 bp, Homo sapiens
attttggttttgttcc

SEQ ID NO: 3487768 - DNA, 21 bp, Homo sapiens
attttggttttgttcccctcc

SEQ ID NO: 3487769 - DNA, 22 bp, Homo sapiens
attttggttttgttcccctcct

SEQ ID NO: 3487770 - DNA, 21 bp, Homo sapiens
attttgtatctgcaggcagac

SEQ ID NO: 3487771 - DNA, 23 bp, Homo sapiens
attttgtatctgcaggcagacac

SEQ ID NO: 3487772 - DNA, 17 bp, Homo sapiens
attttgtgacattcctt

SEQ ID NO: 3487773 - DNA, 18 bp, Homo sapiens
attttgttctagttttca

SEQ ID NO: 3487774 - DNA, 14 bp, Homo sapiens
attttgttctctgg

SEQ ID NO: 3487775 - DNA, 16 bp, Homo sapiens
attttgttctctggga

SEQ ID NO: 3487776 - DNA, 18 bp, Homo sapiens
attttgttctctgggaga

SEQ ID NO: 3487777 - DNA, 14 bp, Homo sapiens
attttgtttggtat

SEQ ID NO: 3487778 - DNA, 17 bp, Homo sapiens
attttgtttggtattgt

SEQ ID NO: 3487779 - DNA, 22 bp, Homo sapiens
attttgtttttgtcttaaaaag

SEQ ID NO: 3487780 - DNA, 19 bp, Homo sapiens
atttttaaaaaatattttc

SEQ ID NO: 3487781 - DNA, 16 bp, Homo sapiens
atttttaaaataaact

SEQ ID NO: 3487782 - DNA, 19 bp, Homo sapiens
atttttaaaataaactgta

SEQ ID NO: 3487783 - DNA, 22 bp, Homo sapiens
atttttaaaataaactgtaaac

SEQ ID NO: 3487784 - DNA, 13 bp, Homo sapiens
atttttaaatgtg

SEQ ID NO: 3487785 - DNA, 14 bp, Homo sapiens
atttttagacagag

SEQ ID NO: 3487786 - DNA, 21 bp, Homo sapiens
atttttagatagttagaacct

SEQ ID NO: 3487787 - DNA, 21 bp, Homo sapiens
atttttatataatatctaaag

SEQ ID NO: 3487788 - DNA, 13 bp, Homo sapiens
atttttcaacttt

SEQ ID NO: 3487789 - DNA, 18 bp, Homo sapiens
atttttcaactttgaata

SEQ ID NO: 3487790 - DNA, 17 bp, Homo sapiens
atttttcaataaagcat

SEQ ID NO: 3487791 - DNA, 19 bp, Homo sapiens
atttttctctcctgtcctc

SEQ ID NO: 3487792 - DNA, 13 bp, Homo sapiens
atttttctgcaga

SEQ ID NO: 3487793 - DNA, 16 bp, Homo sapiens
atttttgcttgacttc

SEQ ID NO: 3487794 - DNA, 12 bp, Homo sapiens
atttttgtaata

SEQ ID NO: 3487795 - DNA, 13 bp, Homo sapiens
atttttgtacatg

SEQ ID NO: 3487796 - DNA, 19 bp, Homo sapiens
atttttgtagagccagggt

SEQ ID NO: 3487797 - DNA, 22 bp, Homo sapiens
atttttgtgattttgtgattga

SEQ ID NO: 3487798 - DNA, 12 bp, Homo sapiens
atttttgttaat

SEQ ID NO: 3487799 - DNA, 15 bp, Homo sapiens
attttttaaaaacta

SEQ ID NO: 3487800 - DNA, 15 bp, Homo sapiens
attttttatgatatc

SEQ ID NO: 3487801 - DNA, 20 bp, Homo sapiens
attttttcagacttgtcaag

SEQ ID NO: 3487802 - DNA, 13 bp, Homo sapiens
attttttctgtac

SEQ ID NO: 3487803 - DNA, 13 bp, Homo sapiens
attttttgacact

SEQ ID NO: 3487804 - DNA, 21 bp, Homo sapiens
attttttgacacttccattgt

SEQ ID NO: 3487805 - DNA, 17 bp, Homo sapiens
attttttggtacaaaaa

SEQ ID NO: 3487806 - DNA, 16 bp, Homo sapiens
atttttttattcagca

SEQ ID NO: 3487807 - DNA, 16 bp, Homo sapiens
atttttttctgcacag

SEQ ID NO: 3487808 - DNA, 17 bp, Homo sapiens
atttttttctgcacagc

SEQ ID NO: 3487809 - DNA, 19 bp, Homo sapiens
atttttttctgcacagctt

SEQ ID NO: 3487810 - DNA, 16 bp, Homo sapiens
atttttttgagacaga

SEQ ID NO: 3487811 - DNA, 17 bp, Homo sapiens
atttttttgcaagtgaa

SEQ ID NO: 3487812 - DNA, 20 bp, Homo sapiens
atttttttgcaagtgaaggt

SEQ ID NO: 3487813 - DNA, 20 bp, Homo sapiens
attttttttaatgcttaaga

SEQ ID NO: 3487814 - DNA, 20 bp, Homo sapiens
attttttttcatgttttaac

SEQ ID NO: 3487815 - DNA, 19 bp, Homo sapiens
attttttttttaaattatt

SEQ ID NO: 3487816 - DNA, 21 bp, Homo sapiens
attttttttttctttttgggg

SEQ ID NO: 3487817 - DNA, 23 bp, Homo sapiens
atttttttttttgttcttgatgg

SEQ ID NO: 3487818 - DNA, 18 bp, Homo sapiens
caaaaacaaaaccagctg

SEQ ID NO: 3487819 - DNA, 16 bp, Homo sapiens
caaaaacgccctcaag

SEQ ID NO: 3487820 - DNA, 22 bp, Homo sapiens
caaaaactgtctttaaaagaga

SEQ ID NO: 3487821 - DNA, 14 bp, Homo sapiens
caaaaagaacaaaa

SEQ ID NO: 3487822 - DNA, 14 bp, Homo sapiens
caaaaagacaaaca

SEQ ID NO: 3487823 - DNA, 16 bp, Homo sapiens
caaaaagcaaaatcat

SEQ ID NO: 3487824 - DNA, 14 bp, Homo sapiens
caaaaataaattta

SEQ ID NO: 3487825 - DNA, 14 bp, Homo sapiens
caaaaattagccgg

SEQ ID NO: 3487826 - DNA, 18 bp, Homo sapiens
caaaaattaggtattttg

SEQ ID NO: 3487827 - DNA, 16 bp, Homo sapiens
caaaaattttgtgaca

SEQ ID NO: 3487828 - DNA, 22 bp, Homo sapiens
caaaacaaaaattaggtatttt

SEQ ID NO: 3487829 - DNA, 18 bp, Homo sapiens
caaaacagaggcacttaa

SEQ ID NO: 3487830 - DNA, 12 bp, Homo sapiens
caaaaccagctg

SEQ ID NO: 3487831 - DNA, 14 bp, Homo sapiens
caaaaccagctgct

SEQ ID NO: 3487832 - DNA, 20 bp, Homo sapiens
caaaacctcatgacagccag

SEQ ID NO: 3487833 - DNA, 15 bp, Homo sapiens
caaaacctgtcctat

SEQ ID NO: 3487834 - DNA, 11 bp, Homo sapiens
caaaactctac

SEQ ID NO: 3487835 - DNA, 13 bp, Homo sapiens
caaaagaagcccc

SEQ ID NO: 3487836 - DNA, 16 bp, Homo sapiens
caaaagaagcccccag

SEQ ID NO: 3487837 - DNA, 13 bp, Homo sapiens
caaaagataatat

SEQ ID NO: 3487838 - DNA, 16 bp, Homo sapiens
caaaagatgcttctca

SEQ ID NO: 3487839 - DNA, 21 bp, Homo sapiens
caaaaggctcgtttggatctg

SEQ ID NO: 3487840 - DNA, 16 bp, Homo sapiens
caaaagtggcctcttt

SEQ ID NO: 3487841 - DNA, 18 bp, Homo sapiens
caaaagtggcctctttgt

SEQ ID NO: 3487842 - DNA, 20 bp, Homo sapiens
caaaagtggcctctttgtct

SEQ ID NO: 3487843 - DNA, 15 bp, Homo sapiens
caaaagttctgactt

SEQ ID NO: 3487844 - DNA, 18 bp, Homo sapiens
caaaagttctgacttgac

SEQ ID NO: 3487845 - DNA, 19 bp, Homo sapiens
caaaataaaaaccttccaa

SEQ ID NO: 3487846 - DNA, 12 bp, Homo sapiens
caaaatagaaaa

SEQ ID NO: 3487847 - DNA, 12 bp, Homo sapiens
caaaatatttaa

SEQ ID NO: 3487848 - DNA, 18 bp, Homo sapiens
caaaatatttaaaaatgt

SEQ ID NO: 3487849 - DNA, 19 bp, Homo sapiens
caaaatatttaaaaatgtc

SEQ ID NO: 3487850 - DNA, 18 bp, Homo sapiens
caaaatattttcctgcca

SEQ ID NO: 3487851 - DNA, 15 bp, Homo sapiens
caaaatcctacagat

SEQ ID NO: 3487852 - DNA, 16 bp, Homo sapiens
caaaatctgttctaac

SEQ ID NO: 3487853 - DNA, 17 bp, Homo sapiens
caaaatggatacataaa

SEQ ID NO: 3487854 - DNA, 15 bp, Homo sapiens
caaaatggcttcagt

SEQ ID NO: 3487855 - DNA, 23 bp, Homo sapiens
caaaatgtaggcttagtttgtgt

SEQ ID NO: 3487856 - DNA, 16 bp, Homo sapiens
caaaattgcaaatctt

SEQ ID NO: 3487857 - DNA, 22 bp, Homo sapiens
caaaattgcaaatcttgaaatt

SEQ ID NO: 3487858 - DNA, 20 bp, Homo sapiens
caaaatttattttataagaa

SEQ ID NO: 3487859 - DNA, 14 bp, Homo sapiens
caaaatttgactaa

SEQ ID NO: 3487860 - DNA, 18 bp, Homo sapiens
caaaattttattcctata

SEQ ID NO: 3487861 - DNA, 14 bp, Homo sapiens
caaacaaaatttct

SEQ ID NO: 3487862 - DNA, 15 bp, Homo sapiens
caaacaaaatttcta

SEQ ID NO: 3487863 - DNA, 18 bp, Homo sapiens
caaacaaaatttctatta

SEQ ID NO: 3487864 - DNA, 14 bp, Homo sapiens
caaacaaagccaga

SEQ ID NO: 3487865 - DNA, 14 bp, Homo sapiens
caaacaaatatgca

SEQ ID NO: 3487866 - DNA, 20 bp, Homo sapiens
caaaccaacaggctaccaac

SEQ ID NO: 3487867 - DNA, 14 bp, Homo sapiens
caaaccacactgga

SEQ ID NO: 3487868 - DNA, 19 bp, Homo sapiens
caaaccactttttgcagct

SEQ ID NO: 3487869 - DNA, 22 bp, Homo sapiens
caaacccagtctcctctccatt

SEQ ID NO: 3487870 - DNA, 23 bp, Homo sapiens
attatagtgatgtaatcttgaat

SEQ ID NO: 3487871 - DNA, 16 bp, Homo sapiens
attatatctaattatt

SEQ ID NO: 3487872 - DNA, 15 bp, Homo sapiens
attatatttacaaat

SEQ ID NO: 3487873 - DNA, 17 bp, Homo sapiens
attatatttacaaatgg

SEQ ID NO: 3487874 - DNA, 14 bp, Homo sapiens
attatatttgacat

SEQ ID NO: 3487875 - DNA, 19 bp, Homo sapiens
attatatttgtgctatagt

SEQ ID NO: 3487876 - DNA, 15 bp, Homo sapiens
attatcatgcaaatg

SEQ ID NO: 3487877 - DNA, 21 bp, Homo sapiens
attatcattgctcccctgata

SEQ ID NO: 3487878 - DNA, 20 bp, Homo sapiens
attatcctcctgttctgaaa

SEQ ID NO: 3487879 - DNA, 21 bp, Homo sapiens
attatcctcctgttctgaaac

SEQ ID NO: 3487880 - DNA, 21 bp, Homo sapiens
attatcctttcctcattaaat

SEQ ID NO: 3487881 - DNA, 22 bp, Homo sapiens
attatctatacatatctttatt

SEQ ID NO: 3487882 - DNA, 14 bp, Homo sapiens
attatggaaaacat

SEQ ID NO: 3487883 - DNA, 17 bp, Homo sapiens
attatgtataaaatgta

SEQ ID NO: 3487884 - DNA, 16 bp, Homo sapiens
attatgttttttaaaa

SEQ ID NO: 3487885 - DNA, 20 bp, Homo sapiens
attatgttttttaaaatatt

SEQ ID NO: 3487886 - DNA, 16 bp, Homo sapiens
attattctcatttagt

SEQ ID NO: 3487887 - DNA, 19 bp, Homo sapiens
attattctcatttagtgcc

SEQ ID NO: 3487888 - DNA, 16 bp, Homo sapiens
attattttgaaacttt

SEQ ID NO: 3487889 - DNA, 16 bp, Homo sapiens
attcaaaatatttaaa

SEQ ID NO: 3487890 - DNA, 18 bp, Homo sapiens
attcaaactgctccaagt

SEQ ID NO: 3487891 - DNA, 19 bp, Homo sapiens
attcaaactggggcctcca

SEQ ID NO: 3487892 - DNA, 21 bp, Homo sapiens
attcaaattctttttttatta

SEQ ID NO: 3487893 - DNA, 13 bp, Homo sapiens
attcaatattgaa

SEQ ID NO: 3487894 - DNA, 14 bp, Homo sapiens
attcaattcctctg

SEQ ID NO: 3487895 - DNA, 18 bp, Homo sapiens
attcaattcctctgggaa

SEQ ID NO: 3487896 - DNA, 17 bp, Homo sapiens
attcacaaacttttata

SEQ ID NO: 3487897 - DNA, 16 bp, Homo sapiens
attcacacacccctca

SEQ ID NO: 3487898 - DNA, 22 bp, Homo sapiens
attcacacacccctcaaaaaaa

SEQ ID NO: 3487899 - DNA, 14 bp, Homo sapiens
attcacagagcctt

SEQ ID NO: 3487900 - DNA, 15 bp, Homo sapiens
attcacagagccttt

SEQ ID NO: 3487901 - DNA, 23 bp, Homo sapiens
attcacagttctttgggccagac

SEQ ID NO: 3487902 - DNA, 23 bp, Homo sapiens
attcaccttccagtgtctcggag

SEQ ID NO: 3487903 - DNA, 15 bp, Homo sapiens
attcactttcatttt

SEQ ID NO: 3487904 - DNA, 18 bp, Homo sapiens
attcagaatatcatcttt

SEQ ID NO: 3487905 - DNA, 20 bp, Homo sapiens
attcagacagatgaggcttt

SEQ ID NO: 3487906 - DNA, 14 bp, Homo sapiens
attcagacaggcaa

SEQ ID NO: 3487907 - DNA, 15 bp, Homo sapiens
attcagcaaaccatt

SEQ ID NO: 3487908 - DNA, 14 bp, Homo sapiens
attcagcctgtttg

SEQ ID NO: 3487909 - DNA, 18 bp, Homo sapiens
attcagtccgcctggccg

SEQ ID NO: 3487910 - DNA, 19 bp, Homo sapiens
attcagtgttaaatgtgat

SEQ ID NO: 3487911 - DNA, 15 bp, Homo sapiens
attcagttttcattt

SEQ ID NO: 3487912 - DNA, 14 bp, Homo sapiens
attcatattctttt

SEQ ID NO: 3487913 - DNA, 14 bp, Homo sapiens
attcatattgaata

SEQ ID NO: 3487914 - DNA, 16 bp, Homo sapiens
attcatcccaactgtc

SEQ ID NO: 3487915 - DNA, 14 bp, Homo sapiens
attcatgctaccca

SEQ ID NO: 3487916 - DNA, 13 bp, Homo sapiens
attcatgtttctt

SEQ ID NO: 3487917 - DNA, 15 bp, Homo sapiens
atttcacccctccct

SEQ ID NO: 3487918 - DNA, 20 bp, Homo sapiens
atttcacccctccctttctc

SEQ ID NO: 3487919 - DNA, 15 bp, Homo sapiens
atttcagaggctgca

SEQ ID NO: 3487920 - DNA, 13 bp, Homo sapiens
atttcagatgtaa

SEQ ID NO: 3487921 - DNA, 20 bp, Homo sapiens
atttcagatgtaatgttttc

SEQ ID NO: 3487922 - DNA, 15 bp, Homo sapiens
atttcaggagcagcc

SEQ ID NO: 3487923 - DNA, 21 bp, Homo sapiens
atttcaggttttgtaaagatg

SEQ ID NO: 3487924 - DNA, 15 bp, Homo sapiens
atttcatctgctctc

SEQ ID NO: 3487925 - DNA, 14 bp, Homo sapiens
atttccacaccaag

SEQ ID NO: 3487926 - DNA, 20 bp, Homo sapiens
atttccactattttcaaaga

SEQ ID NO: 3487927 - DNA, 17 bp, Homo sapiens
atttccagtctccacca

SEQ ID NO: 3487928 - DNA, 23 bp, Homo sapiens
atttccatgtcccctcccagagc

SEQ ID NO: 3487929 - DNA, 12 bp, Homo sapiens
atttcccaggac

SEQ ID NO: 3487930 - DNA, 19 bp, Homo sapiens
atttcccaggaccctgaag

SEQ ID NO: 3487931 - DNA, 19 bp, Homo sapiens
atttcctacacaaatgata

SEQ ID NO: 3487932 - DNA, 18 bp, Homo sapiens
atttcctcataaacattt

SEQ ID NO: 3487933 - DNA, 23 bp, Homo sapiens
atttccttgaatgtggcttgaga

SEQ ID NO: 3487934 - DNA, 14 bp, Homo sapiens
atttcgtgagcccc

SEQ ID NO: 3487935 - DNA, 14 bp, Homo sapiens
atttctaaagttgt

SEQ ID NO: 3487936 - DNA, 16 bp, Homo sapiens
atttctaaagttgtag

SEQ ID NO: 3487937 - DNA, 18 bp, Homo sapiens
atttctactttgaagtca

SEQ ID NO: 3487938 - DNA, 21 bp, Homo sapiens
atttctaggcaaaattgtgaa

SEQ ID NO: 3487939 - DNA, 16 bp, Homo sapiens
atttctatttatttac

SEQ ID NO: 3487940 - DNA, 15 bp, Homo sapiens
atttctatttcataa

SEQ ID NO: 3487941 - DNA, 15 bp, Homo sapiens
atttctatttctcct

SEQ ID NO: 3487942 - DNA, 18 bp, Homo sapiens
atttctatttctcctcca

SEQ ID NO: 3487943 - DNA, 16 bp, Homo sapiens
atttctcagactttgg

SEQ ID NO: 3487944 - DNA, 18 bp, Homo sapiens
atttctgcatatgttgaa

SEQ ID NO: 3487945 - DNA, 17 bp, Homo sapiens
atttctgtattttttgt

SEQ ID NO: 3487946 - DNA, 20 bp, Homo sapiens
atttctgtattttttgtttg

SEQ ID NO: 3487947 - DNA, 15 bp, Homo sapiens
atttctgtctactaa

SEQ ID NO: 3487948 - DNA, 16 bp, Homo sapiens
atttctgtgccctcct

SEQ ID NO: 3487949 - DNA, 13 bp, Homo sapiens
atttctgtgggag

SEQ ID NO: 3487950 - DNA, 16 bp, Homo sapiens
atttctgtgggagaat

SEQ ID NO: 3487951 - DNA, 23 bp, Homo sapiens
atttctgtgttgccaagctccaa

SEQ ID NO: 3487952 - DNA, 17 bp, Homo sapiens
atttcttcataggtaga

SEQ ID NO: 3487953 - DNA, 19 bp, Homo sapiens
atttcttcgttctttttaa

SEQ ID NO: 3487954 - DNA, 19 bp, Homo sapiens
atttcttctcaaacctcca

SEQ ID NO: 3487955 - DNA, 16 bp, Homo sapiens
atttcttcttcacatc

SEQ ID NO: 3487956 - DNA, 17 bp, Homo sapiens
atttctttgctgtaaga

SEQ ID NO: 3487957 - DNA, 21 bp, Homo sapiens
atttcttttgtaataaactat

SEQ ID NO: 3487958 - DNA, 22 bp, Homo sapiens
atttcttttgtaataaactatt

SEQ ID NO: 3487959 - DNA, 16 bp, Homo sapiens
atttctttttttcctt

SEQ ID NO: 3487960 - DNA, 18 bp, Homo sapiens
atttgaacaaagcagaag

SEQ ID NO: 3487961 - DNA, 16 bp, Homo sapiens
atttgaatcttgtctc

SEQ ID NO: 3487962 - DNA, 20 bp, Homo sapiens
atttgaatcttgtctcaatg

SEQ ID NO: 3487963 - DNA, 22 bp, Homo sapiens
atttgaatcttgtctcaatgct

SEQ ID NO: 3487964 - DNA, 12 bp, Homo sapiens
atttgaatgcat

SEQ ID NO: 3487965 - DNA, 15 bp, Homo sapiens
atttgaatgcatttt

SEQ ID NO: 3487966 - DNA, 18 bp, Homo sapiens
atttgaatgcattttgtt

SEQ ID NO: 3487967 - DNA, 23 bp, Homo sapiens
atttgagaatagacccttactag

SEQ ID NO: 3487968 - DNA, 16 bp, Homo sapiens
atttgagcaagtaaca

SEQ ID NO: 3487969 - DNA, 13 bp, Homo sapiens
atttgagtctctt

SEQ ID NO: 3487970 - DNA, 19 bp, Homo sapiens
atttgagtgttttaagata

SEQ ID NO: 3487971 - DNA, 20 bp, Homo sapiens
atttgagttaacctttaaga

SEQ ID NO: 3487972 - DNA, 22 bp, Homo sapiens
atttgagttttgttgaaaagat

SEQ ID NO: 3487973 - DNA, 16 bp, Homo sapiens
atttgataatgacact

SEQ ID NO: 3487974 - DNA, 14 bp, Homo sapiens
atttgattaacatt

SEQ ID NO: 3487975 - DNA, 16 bp, Homo sapiens
atttgattaacatttg

SEQ ID NO: 3487976 - DNA, 16 bp, Homo sapiens
atttgcaaagtactgt

SEQ ID NO: 3487977 - DNA, 20 bp, Homo sapiens
atttgcaagggaaaagtctc

SEQ ID NO: 3487978 - DNA, 23 bp, Homo sapiens
atttgcacagaagcacatgcacc

SEQ ID NO: 3487979 - DNA, 14 bp, Homo sapiens
atttgcaccagttt

SEQ ID NO: 3487980 - DNA, 18 bp, Homo sapiens
atttgcatttcagaatat

SEQ ID NO: 3487981 - DNA, 15 bp, Homo sapiens
atttgcgaatggttc

SEQ ID NO: 3487982 - DNA, 20 bp, Homo sapiens
atttgctgccaaatgcgtat

SEQ ID NO: 3487983 - DNA, 13 bp, Homo sapiens
atttgctggaaca

SEQ ID NO: 3487984 - DNA, 18 bp, Homo sapiens
atttgcttttgaaaagat

SEQ ID NO: 3487985 - DNA, 22 bp, Homo sapiens
atttgggcctgctccagacctg

SEQ ID NO: 3487986 - DNA, 21 bp, Homo sapiens
atttgggcttggaccagatct

SEQ ID NO: 3487987 - DNA, 23 bp, Homo sapiens
atttggggtagctagaggaacca

SEQ ID NO: 3487988 - DNA, 16 bp, Homo sapiens
atttggttcattaatt

SEQ ID NO: 3487989 - DNA, 21 bp, Homo sapiens
atttggttcattaattctata

SEQ ID NO: 3487990 - DNA, 22 bp, Homo sapiens
atttgtaaagttggttggataa

SEQ ID NO: 3487991 - DNA, 22 bp, Homo sapiens
atttgtactgtttaatgttctg

SEQ ID NO: 3487992 - DNA, 14 bp, Homo sapiens
atttgtaggagaaa

SEQ ID NO: 3487993 - DNA, 21 bp, Homo sapiens
atttgtatttttttgcaagtg

SEQ ID NO: 3487994 - DNA, 14 bp, Homo sapiens
atttgtcaaattgt

SEQ ID NO: 3487995 - DNA, 20 bp, Homo sapiens
atttgtcaatttatgaatat

SEQ ID NO: 3487996 - DNA, 21 bp, Homo sapiens
atttgtctttttgttgtaaaa

SEQ ID NO: 3487997 - DNA, 15 bp, Homo sapiens
atttgtgatagcact

SEQ ID NO: 3487998 - DNA, 18 bp, Homo sapiens
atttgtgctatagtattt

SEQ ID NO: 3487999 - DNA, 18 bp, Homo sapiens
atttgtgtaatatgaaat

SEQ ID NO: 3488000 - DNA, 15 bp, Homo sapiens
atttgttatggcaga

SEQ ID NO: 3488001 - DNA, 21 bp, Homo sapiens
atttgttatggcagatgacaa

SEQ ID NO: 3488002 - DNA, 16 bp, Homo sapiens
atttgttattttgcaa

SEQ ID NO: 3488003 - DNA, 13 bp, Homo sapiens
atttgtttttctc

SEQ ID NO: 3488004 - DNA, 15 bp, Homo sapiens
atttgtttttctctt

SEQ ID NO: 3488005 - DNA, 20 bp, Homo sapiens
attttaagacgtgtttgtgt

SEQ ID NO: 3488006 - DNA, 14 bp, Homo sapiens
attttaagtattgc

SEQ ID NO: 3488007 - DNA, 20 bp, Homo sapiens
attttaatttagtaaatgtt

SEQ ID NO: 3488008 - DNA, 17 bp, Homo sapiens
attttacaattgaaatg

SEQ ID NO: 3488009 - DNA, 21 bp, Homo sapiens
attttacaattgaaatgacta

SEQ ID NO: 3488010 - DNA, 19 bp, Homo sapiens
attttactagaaatgggaa

SEQ ID NO: 3488011 - DNA, 21 bp, Homo sapiens
attttactttaaaaggagcca

SEQ ID NO: 3488012 - DNA, 18 bp, Homo sapiens
attttagcccagtgtttt

SEQ ID NO: 3488013 - DNA, 13 bp, Homo sapiens
attttataaacaa

SEQ ID NO: 3488014 - DNA, 13 bp, Homo sapiens
attttataagaaa

SEQ ID NO: 3488015 - DNA, 17 bp, Homo sapiens
attttataagaaaaact

SEQ ID NO: 3488016 - DNA, 15 bp, Homo sapiens
attttatatgtcaaa

SEQ ID NO: 3488017 - DNA, 13 bp, Homo sapiens
attttatctttga

SEQ ID NO: 3488018 - DNA, 23 bp, Homo sapiens
attttatctttgattctccttca

SEQ ID NO: 3488019 - DNA, 21 bp, Homo sapiens
attttatgaaaggtttacatt

SEQ ID NO: 3488020 - DNA, 14 bp, Homo sapiens
attttatggtgcat

SEQ ID NO: 3488021 - DNA, 11 bp, Homo sapiens
attttcaaaga

SEQ ID NO: 3488022 - DNA, 18 bp, Homo sapiens
atgtgacattcttaaaaa

SEQ ID NO: 3488023 - DNA, 22 bp, Homo sapiens
atgtgagtgccttttgcagaag

SEQ ID NO: 3488024 - DNA, 23 bp, Homo sapiens
atgtgagtgccttttgcagaaga

SEQ ID NO: 3488025 - DNA, 20 bp, Homo sapiens
atgtgataaggaaatcaact

SEQ ID NO: 3488026 - DNA, 17 bp, Homo sapiens
atgtgatgaatactgta

SEQ ID NO: 3488027 - DNA, 21 bp, Homo sapiens
atgtgatggtacacagtgggt

SEQ ID NO: 3488028 - DNA, 14 bp, Homo sapiens
atgtgattgtggaa

SEQ ID NO: 3488029 - DNA, 15 bp, Homo sapiens
atgtgatttaaacaa

SEQ ID NO: 3488030 - DNA, 19 bp, Homo sapiens
atgtgcattcttttaaaag

SEQ ID NO: 3488031 - DNA, 21 bp, Homo sapiens
atgtgccaggtttttggtctg

SEQ ID NO: 3488032 - DNA, 13 bp, Homo sapiens
atgtgccatgtat

SEQ ID NO: 3488033 - DNA, 19 bp, Homo sapiens
atgtggacttttttgtaca

SEQ ID NO: 3488034 - DNA, 19 bp, Homo sapiens
atgtggcctaaaaatgcaa

SEQ ID NO: 3488035 - DNA, 20 bp, Homo sapiens
atgtggctggaagatcctgc

SEQ ID NO: 3488036 - DNA, 22 bp, Homo sapiens
atgtggctgtatcttgtttttc

SEQ ID NO: 3488037 - DNA, 17 bp, Homo sapiens
atgtggggctgagctgg

SEQ ID NO: 3488038 - DNA, 15 bp, Homo sapiens
atgtggttacacact

SEQ ID NO: 3488039 - DNA, 14 bp, Homo sapiens
atgtgtatttctta

SEQ ID NO: 3488040 - DNA, 17 bp, Homo sapiens
atgtgtattttattaca

SEQ ID NO: 3488041 - DNA, 13 bp, Homo sapiens
atgtgtgtgcatg

SEQ ID NO: 3488042 - DNA, 17 bp, Homo sapiens
atgtgtttgctttctga

SEQ ID NO: 3488043 - DNA, 23 bp, Homo sapiens
atgttaaactagcatatctgcct

SEQ ID NO: 3488044 - DNA, 13 bp, Homo sapiens
atgttaaataaat

SEQ ID NO: 3488045 - DNA, 22 bp, Homo sapiens
atgttaaataaattgtatattc

SEQ ID NO: 3488046 - DNA, 17 bp, Homo sapiens
atgttaacctaggcagt

SEQ ID NO: 3488047 - DNA, 19 bp, Homo sapiens
atgttaacctaggcagtgg

SEQ ID NO: 3488048 - DNA, 23 bp, Homo sapiens
atgttaacctaggcagtgggagg

SEQ ID NO: 3488049 - DNA, 21 bp, Homo sapiens
atgttaagcagctaaattttc

SEQ ID NO: 3488050 - DNA, 20 bp, Homo sapiens
atgttaattttttggtacaa

SEQ ID NO: 3488051 - DNA, 18 bp, Homo sapiens
atgttaggaaaatttcac

SEQ ID NO: 3488052 - DNA, 19 bp, Homo sapiens
atgttaggaaaatttcaca

SEQ ID NO: 3488053 - DNA, 17 bp, Homo sapiens
atgttatgcataaagtc

SEQ ID NO: 3488054 - DNA, 14 bp, Homo sapiens
atgttattctagta

SEQ ID NO: 3488055 - DNA, 14 bp, Homo sapiens
atgttcacttttga

SEQ ID NO: 3488056 - DNA, 22 bp, Homo sapiens
atgttcacttttgacaaaggca

SEQ ID NO: 3488057 - DNA, 19 bp, Homo sapiens
atgttctaagtctttccat

SEQ ID NO: 3488058 - DNA, 16 bp, Homo sapiens
atgttctctatcattt

SEQ ID NO: 3488059 - DNA, 14 bp, Homo sapiens
atgttctgggacac

SEQ ID NO: 3488060 - DNA, 15 bp, Homo sapiens
atgttctgtcttccc

SEQ ID NO: 3488061 - DNA, 22 bp, Homo sapiens
atgttctttagatggtggcaca

SEQ ID NO: 3488062 - DNA, 19 bp, Homo sapiens
atgttgaaaagtcaaactg

SEQ ID NO: 3488063 - DNA, 14 bp, Homo sapiens
atgttgaatacttt

SEQ ID NO: 3488064 - DNA, 16 bp, Homo sapiens
atgttgaccatgtcta

SEQ ID NO: 3488065 - DNA, 16 bp, Homo sapiens
atgttgagaatcccaa

SEQ ID NO: 3488066 - DNA, 18 bp, Homo sapiens
atgttgattacagtgcag

SEQ ID NO: 3488067 - DNA, 22 bp, Homo sapiens
atgttgcacacccactcagctc

SEQ ID NO: 3488068 - DNA, 14 bp, Homo sapiens
atgttgcccaggca

SEQ ID NO: 3488069 - DNA, 17 bp, Homo sapiens
atgttgctataataaag

SEQ ID NO: 3488070 - DNA, 18 bp, Homo sapiens
atgttggaggagagagcc

SEQ ID NO: 3488071 - DNA, 20 bp, Homo sapiens
atgttggaggagagagcctt

SEQ ID NO: 3488072 - DNA, 16 bp, Homo sapiens
atgttggataaggaat

SEQ ID NO: 3488073 - DNA, 23 bp, Homo sapiens
atgttggccaccaggtgcctttc

SEQ ID NO: 3488074 - DNA, 16 bp, Homo sapiens
atgttggccaggctgg

SEQ ID NO: 3488075 - DNA, 19 bp, Homo sapiens
atgttgggaaacttggctc

SEQ ID NO: 3488076 - DNA, 20 bp, Homo sapiens
atgttgggaaacttggctcg

SEQ ID NO: 3488077 - DNA, 12 bp, Homo sapiens
atgttggtttat

SEQ ID NO: 3488078 - DNA, 20 bp, Homo sapiens
atggcaggacgtgggctggg

SEQ ID NO: 3488079 - DNA, 22 bp, Homo sapiens
atggcaggatggcctggccagg

SEQ ID NO: 3488080 - DNA, 20 bp, Homo sapiens
atggcagtccagccagctcc

SEQ ID NO: 3488081 - DNA, 21 bp, Homo sapiens
atggcagtccagccagctcct

SEQ ID NO: 3488082 - DNA, 15 bp, Homo sapiens
atggcatcacctcca

SEQ ID NO: 3488083 - DNA, 15 bp, Homo sapiens
atggcatgagaaata

SEQ ID NO: 3488084 - DNA, 18 bp, Homo sapiens
atggcatgagaaatacaa

SEQ ID NO: 3488085 - DNA, 20 bp, Homo sapiens
atggccccagcacagcttga

SEQ ID NO: 3488086 - DNA, 17 bp, Homo sapiens
atggcccgacatttctt

SEQ ID NO: 3488087 - DNA, 21 bp, Homo sapiens
atggccctgtagttaggcctg

SEQ ID NO: 3488088 - DNA, 17 bp, Homo sapiens
atggcctcatgtggctg

SEQ ID NO: 3488089 - DNA, 19 bp, Homo sapiens
atggcctcatgtggctgga

SEQ ID NO: 3488090 - DNA, 19 bp, Homo sapiens
atggcctcttgaagagaaa

SEQ ID NO: 3488091 - DNA, 23 bp, Homo sapiens
atggcctcttgaagagaaaaaag

SEQ ID NO: 3488092 - DNA, 21 bp, Homo sapiens
atggccttcccgccggaggcc

SEQ ID NO: 3488093 - DNA, 19 bp, Homo sapiens
atggcgctattgcactcca

SEQ ID NO: 3488094 - DNA, 13 bp, Homo sapiens
atggctcctctca

SEQ ID NO: 3488095 - DNA, 13 bp, Homo sapiens
atggctctatttc

SEQ ID NO: 3488096 - DNA, 15 bp, Homo sapiens
atggctctatttctt

SEQ ID NO: 3488097 - DNA, 23 bp, Homo sapiens
atggctctatttcttcttcacat

SEQ ID NO: 3488098 - DNA, 21 bp, Homo sapiens
atgggaacactggcagactgt

SEQ ID NO: 3488099 - DNA, 20 bp, Homo sapiens
atgggagccgggtctgcctc

SEQ ID NO: 3488100 - DNA, 17 bp, Homo sapiens
atgggattctggacagg

SEQ ID NO: 3488101 - DNA, 19 bp, Homo sapiens
atgggccactgaaatctgt

SEQ ID NO: 3488102 - DNA, 14 bp, Homo sapiens
atgggcccctggcc

SEQ ID NO: 3488103 - DNA, 18 bp, Homo sapiens
atgggcctcctgtgtgtg

SEQ ID NO: 3488104 - DNA, 14 bp, Homo sapiens
atgggcctgaactc

SEQ ID NO: 3488105 - DNA, 17 bp, Homo sapiens
atgggcctgaactcgga

SEQ ID NO: 3488106 - DNA, 18 bp, Homo sapiens
atgggcctgccgggctga

SEQ ID NO: 3488107 - DNA, 20 bp, Homo sapiens
atgggcctttgagcctgatg

SEQ ID NO: 3488108 - DNA, 12 bp, Homo sapiens
atggggaggggc

SEQ ID NO: 3488109 - DNA, 13 bp, Homo sapiens
atggggccagatc

SEQ ID NO: 3488110 - DNA, 15 bp, Homo sapiens
atggggccagatcca

SEQ ID NO: 3488111 - DNA, 21 bp, Homo sapiens
atggggccagatccagcctgg

SEQ ID NO: 3488112 - DNA, 18 bp, Homo sapiens
atgggggaccccttccca

SEQ ID NO: 3488113 - DNA, 14 bp, Homo sapiens
atgggggggcgggg

SEQ ID NO: 3488114 - DNA, 16 bp, Homo sapiens
atggggtctgtaaaat

SEQ ID NO: 3488115 - DNA, 14 bp, Homo sapiens
atgggtgaaggctg

SEQ ID NO: 3488116 - DNA, 15 bp, Homo sapiens
atgggtgaaggctgg

SEQ ID NO: 3488117 - DNA, 16 bp, Homo sapiens
atgggtgaaggctggc

SEQ ID NO: 3488118 - DNA, 18 bp, Homo sapiens
atgggtgaaggctggcat

SEQ ID NO: 3488119 - DNA, 17 bp, Homo sapiens
atggtaagacctctgag

SEQ ID NO: 3488120 - DNA, 14 bp, Homo sapiens
atggtaagtagcag

SEQ ID NO: 3488121 - DNA, 14 bp, Homo sapiens
atggtacaaccttt

SEQ ID NO: 3488122 - DNA, 17 bp, Homo sapiens
atggtaggcatttccta

SEQ ID NO: 3488123 - DNA, 19 bp, Homo sapiens
atggtataatggttgactg

SEQ ID NO: 3488124 - DNA, 19 bp, Homo sapiens
atggtcacacactgatgct

SEQ ID NO: 3488125 - DNA, 16 bp, Homo sapiens
atggtccaggagaagg

SEQ ID NO: 3488126 - DNA, 18 bp, Homo sapiens
atggtccaggagaaggcc

SEQ ID NO: 3488127 - DNA, 17 bp, Homo sapiens
atggtgccccaggacca

SEQ ID NO: 3488128 - DNA, 18 bp, Homo sapiens
atggtgccccaggaccag

SEQ ID NO: 3488129 - DNA, 20 bp, Homo sapiens
atggtgccccaggaccagct

SEQ ID NO: 3488130 - DNA, 21 bp, Homo sapiens
atggtgccccaggaccagctc

SEQ ID NO: 3488131 - DNA, 13 bp, Homo sapiens
atggtgctgagaa

SEQ ID NO: 3488132 - DNA, 16 bp, Homo sapiens
atggtgctgagaagct

SEQ ID NO: 3488133 - DNA, 16 bp, Homo sapiens
atggtggacccagcgg

SEQ ID NO: 3488134 - DNA, 19 bp, Homo sapiens
atggtggaggattgctgcc

SEQ ID NO: 3488135 - DNA, 13 bp, Homo sapiens
atggtggagggcc

SEQ ID NO: 3488136 - DNA, 16 bp, Homo sapiens
atggtggcacattcct

SEQ ID NO: 3488137 - DNA, 17 bp, Homo sapiens
atggtgtgccttccaga

SEQ ID NO: 3488138 - DNA, 18 bp, Homo sapiens
atggttgtattagatgtt

SEQ ID NO: 3488139 - DNA, 16 bp, Homo sapiens
atggtttttaaatttt

SEQ ID NO: 3488140 - DNA, 18 bp, Homo sapiens
atggtttttaaattttgt

SEQ ID NO: 3488141 - DNA, 15 bp, Homo sapiens
atgtaaaaggccaaa

SEQ ID NO: 3488142 - DNA, 21 bp, Homo sapiens
atgtaaacaaaccacagcagg

SEQ ID NO: 3488143 - DNA, 18 bp, Homo sapiens
atgcactgtgaaggaccc

SEQ ID NO: 3488144 - DNA, 21 bp, Homo sapiens
atgcactgttccccctgtgca

SEQ ID NO: 3488145 - DNA, 22 bp, Homo sapiens
atgcactgttccccctgtgcag

SEQ ID NO: 3488146 - DNA, 15 bp, Homo sapiens
atgcagaggcctggg

SEQ ID NO: 3488147 - DNA, 15 bp, Homo sapiens
atgcagaggtctcca

SEQ ID NO: 3488148 - DNA, 21 bp, Homo sapiens
atgcagaggtctccaaactga

SEQ ID NO: 3488149 - DNA, 23 bp, Homo sapiens
atgcagaggtctccaaactgatt

SEQ ID NO: 3488150 - DNA, 20 bp, Homo sapiens
atgcagcgccgtgtcctctc

SEQ ID NO: 3488151 - DNA, 13 bp, Homo sapiens
atgcagggcagtc

SEQ ID NO: 3488152 - DNA, 15 bp, Homo sapiens
atgcagtatggtaca

SEQ ID NO: 3488153 - DNA, 23 bp, Homo sapiens
atgcagtatggtacatttttcaa

SEQ ID NO: 3488154 - DNA, 17 bp, Homo sapiens
atgcagtctctttattt

SEQ ID NO: 3488155 - DNA, 17 bp, Homo sapiens
atgcagtgctcgctgtt

SEQ ID NO: 3488156 - DNA, 11 bp, Homo sapiens
atgcagtttga

SEQ ID NO: 3488157 - DNA, 19 bp, Homo sapiens
atgcagtttgaaattctga

SEQ ID NO: 3488158 - DNA, 15 bp, Homo sapiens
atgcataaagtcagt

SEQ ID NO: 3488159 - DNA, 22 bp, Homo sapiens
atgcatctcactggatgcaaag

SEQ ID NO: 3488160 - DNA, 17 bp, Homo sapiens
atgcatgcactgttccc

SEQ ID NO: 3488161 - DNA, 18 bp, Homo sapiens
atgcatggtgccccagga

SEQ ID NO: 3488162 - DNA, 22 bp, Homo sapiens
atgcatggtgccccaggaccag

SEQ ID NO: 3488163 - DNA, 18 bp, Homo sapiens
atgcatgttgaccatgtc

SEQ ID NO: 3488164 - DNA, 19 bp, Homo sapiens
atgcatgttttccagctcc

SEQ ID NO: 3488165 - DNA, 17 bp, Homo sapiens
atgcattcacctgccct

SEQ ID NO: 3488166 - DNA, 21 bp, Homo sapiens
atgcattgctctggatctgtt

SEQ ID NO: 3488167 - DNA, 11 bp, Homo sapiens
atgcatttata

SEQ ID NO: 3488168 - DNA, 20 bp, Homo sapiens
atgcatttatagatcatttc

SEQ ID NO: 3488169 - DNA, 21 bp, Homo sapiens
atgcatttatagatcatttct

SEQ ID NO: 3488170 - DNA, 18 bp, Homo sapiens
atgccaaaaaaagacagg

SEQ ID NO: 3488171 - DNA, 18 bp, Homo sapiens
atgccaagcactgtgctc

SEQ ID NO: 3488172 - DNA, 21 bp, Homo sapiens
atgccaagcactgtgctcagg

SEQ ID NO: 3488173 - DNA, 17 bp, Homo sapiens
atgccaatattaaatct

SEQ ID NO: 3488174 - DNA, 19 bp, Homo sapiens
atgccaccaacttacaaaa

SEQ ID NO: 3488175 - DNA, 18 bp, Homo sapiens
atgccactcctccctccg

SEQ ID NO: 3488176 - DNA, 23 bp, Homo sapiens
atgccagcttggacatcagtgtt

SEQ ID NO: 3488177 - DNA, 14 bp, Homo sapiens
atgccagtgtgctg

SEQ ID NO: 3488178 - DNA, 21 bp, Homo sapiens
atgccatcctcaaacactgca

SEQ ID NO: 3488179 - DNA, 23 bp, Homo sapiens
atgccatcctcaaacactgcagg

SEQ ID NO: 3488180 - DNA, 14 bp, Homo sapiens
atgccatgatgcct

SEQ ID NO: 3488181 - DNA, 20 bp, Homo sapiens
atgccccagggatgggaggt

SEQ ID NO: 3488182 - DNA, 16 bp, Homo sapiens
atgcccctggctggga

SEQ ID NO: 3488183 - DNA, 13 bp, Homo sapiens
atgccctcctctc

SEQ ID NO: 3488184 - DNA, 15 bp, Homo sapiens
atgccctggaggtgg

SEQ ID NO: 3488185 - DNA, 16 bp, Homo sapiens
atgccctggaggtggc

SEQ ID NO: 3488186 - DNA, 15 bp, Homo sapiens
atgccgatttctgta

SEQ ID NO: 3488187 - DNA, 19 bp, Homo sapiens
atgccgatttctgtaaact

SEQ ID NO: 3488188 - DNA, 16 bp, Homo sapiens
atgcctacttttggcc

SEQ ID NO: 3488189 - DNA, 20 bp, Homo sapiens
atgcctacttttggcctcat

SEQ ID NO: 3488190 - DNA, 21 bp, Homo sapiens
atgcctcactaatttttgtat

SEQ ID NO: 3488191 - DNA, 23 bp, Homo sapiens
atgcctcactaatttttgtatta

SEQ ID NO: 3488192 - DNA, 14 bp, Homo sapiens
atgcctcagtgtat

SEQ ID NO: 3488193 - DNA, 16 bp, Homo sapiens
atgcctcagtgtattt

SEQ ID NO: 3488194 - DNA, 19 bp, Homo sapiens
atgcctcagtgtatttgta

SEQ ID NO: 3488195 - DNA, 20 bp, Homo sapiens
atgcctcagtgtatttgtat

SEQ ID NO: 3488196 - DNA, 19 bp, Homo sapiens
atgcctctgtcttctggac

SEQ ID NO: 3488197 - DNA, 16 bp, Homo sapiens
atgcctgagtgcctgg

SEQ ID NO: 3488198 - DNA, 19 bp, Homo sapiens
atgcctgccccaaacaaat

SEQ ID NO: 3488199 - DNA, 13 bp, Homo sapiens
atgcctggcttcg

SEQ ID NO: 3488200 - DNA, 11 bp, Homo sapiens
atgcctggtgg

SEQ ID NO: 3488201 - DNA, 12 bp, Homo sapiens
atgcctggtggc

SEQ ID NO: 3488202 - DNA, 17 bp, Homo sapiens
atgcctggtggcagctg

SEQ ID NO: 3488203 - DNA, 22 bp, Homo sapiens
atgcgccccctccgccctgcca

SEQ ID NO: 3488204 - DNA, 23 bp, Homo sapiens
atgcgctcagggccatgctgagg

SEQ ID NO: 3488205 - DNA, 18 bp, Homo sapiens
atgcggtagccagcacac

SEQ ID NO: 3488206 - DNA, 20 bp, Homo sapiens
atgcggtagccagcacacag

SEQ ID NO: 3488207 - DNA, 16 bp, Homo sapiens
atgctaatttaaagag

SEQ ID NO: 3488208 - DNA, 18 bp, Homo sapiens
atgctaatttaaagagac

SEQ ID NO: 3488209 - DNA, 15 bp, Homo sapiens
atgctagcaggctgt

SEQ ID NO: 3488210 - DNA, 14 bp, Homo sapiens
atgctattgacaat

SEQ ID NO: 3488211 - DNA, 23 bp, Homo sapiens
atgctattgacaataaaatatta

SEQ ID NO: 3488212 - DNA, 12 bp, Homo sapiens
atgctcagacca

SEQ ID NO: 3488213 - DNA, 13 bp, Homo sapiens
atgctcaggctac

SEQ ID NO: 3488214 - DNA, 21 bp, Homo sapiens
atgctcataacggatcagaaa

SEQ ID NO: 3488215 - DNA, 16 bp, Homo sapiens
atgctcatctgctggt

SEQ ID NO: 3488216 - DNA, 14 bp, Homo sapiens
atataaacctaaaa

SEQ ID NO: 3488217 - DNA, 15 bp, Homo sapiens
atataagaaagacat

SEQ ID NO: 3488218 - DNA, 16 bp, Homo sapiens
atataagaaagacatc

SEQ ID NO: 3488219 - DNA, 22 bp, Homo sapiens
atataagtaaagtgattaaagt

SEQ ID NO: 3488220 - DNA, 13 bp, Homo sapiens
atataagtgctgt

SEQ ID NO: 3488221 - DNA, 15 bp, Homo sapiens
atataagtgctgtat

SEQ ID NO: 3488222 - DNA, 20 bp, Homo sapiens
atataatatatttgtgtatt

SEQ ID NO: 3488223 - DNA, 16 bp, Homo sapiens
atatacaataacataa

SEQ ID NO: 3488224 - DNA, 14 bp, Homo sapiens
atatacaataatgt

SEQ ID NO: 3488225 - DNA, 16 bp, Homo sapiens
atatagcatctttcat

SEQ ID NO: 3488226 - DNA, 19 bp, Homo sapiens
atatagctgtacaaatata

SEQ ID NO: 3488227 - DNA, 20 bp, Homo sapiens
atatagctgtacaaatataa

SEQ ID NO: 3488228 - DNA, 16 bp, Homo sapiens
atatatatatatataa

SEQ ID NO: 3488229 - DNA, 14 bp, Homo sapiens
atatatatgtatgt

SEQ ID NO: 3488230 - DNA, 16 bp, Homo sapiens
atatatattattctca

SEQ ID NO: 3488231 - DNA, 22 bp, Homo sapiens
atatatattattctcatttagt

SEQ ID NO: 3488232 - DNA, 21 bp, Homo sapiens
atatatccttttcttctatgt

SEQ ID NO: 3488233 - DNA, 16 bp, Homo sapiens
atatatctctatttga

SEQ ID NO: 3488234 - DNA, 17 bp, Homo sapiens
atatatctctatttgag

SEQ ID NO: 3488235 - DNA, 15 bp, Homo sapiens
atatatgcactatgt

SEQ ID NO: 3488236 - DNA, 21 bp, Homo sapiens
atatatggcagagttgtaaat

SEQ ID NO: 3488237 - DNA, 22 bp, Homo sapiens
atatatggcagagttgtaaata

SEQ ID NO: 3488238 - DNA, 13 bp, Homo sapiens
atatatgtgtgcc

SEQ ID NO: 3488239 - DNA, 21 bp, Homo sapiens
atatatgttttaagaggcagg

SEQ ID NO: 3488240 - DNA, 16 bp, Homo sapiens
atatattaaaaatata

SEQ ID NO: 3488241 - DNA, 18 bp, Homo sapiens
atatattaaaaatataaa

SEQ ID NO: 3488242 - DNA, 13 bp, Homo sapiens
atatattgcattt

SEQ ID NO: 3488243 - DNA, 14 bp, Homo sapiens
atatattgcatttc

SEQ ID NO: 3488244 - DNA, 17 bp, Homo sapiens
atatattggcactgcta

SEQ ID NO: 3488245 - DNA, 13 bp, Homo sapiens
atatatttaagca

SEQ ID NO: 3488246 - DNA, 13 bp, Homo sapiens
atatatttgtgta

SEQ ID NO: 3488247 - DNA, 13 bp, Homo sapiens
atatattttcaag

SEQ ID NO: 3488248 - DNA, 18 bp, Homo sapiens
atatatttttttttggat

SEQ ID NO: 3488249 - DNA, 14 bp, Homo sapiens
atatcatatgtata

SEQ ID NO: 3488250 - DNA, 20 bp, Homo sapiens
atatcattgttggtgttaat

SEQ ID NO: 3488251 - DNA, 23 bp, Homo sapiens
atatcattgttggtgttaattga

SEQ ID NO: 3488252 - DNA, 21 bp, Homo sapiens
atatcatttattttttacatt

SEQ ID NO: 3488253 - DNA, 18 bp, Homo sapiens
atatccattctttctgat

SEQ ID NO: 3488254 - DNA, 16 bp, Homo sapiens
atatcccaaactgtga

SEQ ID NO: 3488255 - DNA, 13 bp, Homo sapiens
atatcctgcttga

SEQ ID NO: 3488256 - DNA, 21 bp, Homo sapiens
atatccttttcttctatgtag

SEQ ID NO: 3488257 - DNA, 13 bp, Homo sapiens
atatctctatttg

SEQ ID NO: 3488258 - DNA, 14 bp, Homo sapiens
atatctctatttga

SEQ ID NO: 3488259 - DNA, 16 bp, Homo sapiens
atatctctatttgaga

SEQ ID NO: 3488260 - DNA, 22 bp, Homo sapiens
atatctgattgttgtcaggcca

SEQ ID NO: 3488261 - DNA, 16 bp, Homo sapiens
atatctgcctttattg

SEQ ID NO: 3488262 - DNA, 20 bp, Homo sapiens
atatctgcctttattgtgtt

SEQ ID NO: 3488263 - DNA, 13 bp, Homo sapiens
atatctttattaa

SEQ ID NO: 3488264 - DNA, 15 bp, Homo sapiens
atatgaattgtacag

SEQ ID NO: 3488265 - DNA, 22 bp, Homo sapiens
atatgatagcgggaaaaggaga

SEQ ID NO: 3488266 - DNA, 15 bp, Homo sapiens
atatgatgcaaactg

SEQ ID NO: 3488267 - DNA, 19 bp, Homo sapiens
atatgcacacagtgctttc

SEQ ID NO: 3488268 - DNA, 20 bp, Homo sapiens
atatgcagtaaaagaaagaa

SEQ ID NO: 3488269 - DNA, 22 bp, Homo sapiens
atatgcagtctctttattttac

SEQ ID NO: 3488270 - DNA, 23 bp, Homo sapiens
atatgcagtctctttattttact

SEQ ID NO: 3488271 - DNA, 15 bp, Homo sapiens
atatgcatgtgtgtg

SEQ ID NO: 3488272 - DNA, 16 bp, Homo sapiens
atatggcagagttgta

SEQ ID NO: 3488273 - DNA, 23 bp, Homo sapiens
atatggccacagtagtcttgatg

SEQ ID NO: 3488274 - DNA, 12 bp, Homo sapiens
atatgtaaaata

SEQ ID NO: 3488275 - DNA, 16 bp, Homo sapiens
atatgtaacaagccac

SEQ ID NO: 3488276 - DNA, 11 bp, Homo sapiens
atatgtaccaa

SEQ ID NO: 3488277 - DNA, 16 bp, Homo sapiens
atatgtatgtatgtgt

SEQ ID NO: 3488278 - DNA, 21 bp, Homo sapiens
atatgtcgtagaattccttcg

SEQ ID NO: 3488279 - DNA, 19 bp, Homo sapiens
atatgtgtttttcacattt

SEQ ID NO: 3488280 - DNA, 15 bp, Homo sapiens
atatgttcaactgga

SEQ ID NO: 3488281 - DNA, 16 bp, Homo sapiens
atatgttgaatacttt

SEQ ID NO: 3488282 - DNA, 20 bp, Homo sapiens
atatgttttaagaggcaggg

SEQ ID NO: 3488283 - DNA, 13 bp, Homo sapiens
atattaaaaatat

SEQ ID NO: 3488284 - DNA, 14 bp, Homo sapiens
atattaaaaatata

SEQ ID NO: 3488285 - DNA, 17 bp, Homo sapiens
atattaaaaatataaaa

SEQ ID NO: 3488286 - DNA, 12 bp, Homo sapiens
atattaaaatgc

SEQ ID NO: 3488287 - DNA, 13 bp, Homo sapiens
atattaaaatgct

SEQ ID NO: 3488288 - DNA, 12 bp, Homo sapiens
atattaatgtac

SEQ ID NO: 3488289 - DNA, 22 bp, Homo sapiens
atattataatttttttcaatat

SEQ ID NO: 3488290 - DNA, 14 bp, Homo sapiens
atattatgtataaa

SEQ ID NO: 3488291 - DNA, 20 bp, Homo sapiens
atattatgtataaaatgtaa

SEQ ID NO: 3488292 - DNA, 14 bp, Homo sapiens
atattattctcatt

SEQ ID NO: 3488293 - DNA, 15 bp, Homo sapiens
atattattctcattt

SEQ ID NO: 3488294 - DNA, 16 bp, Homo sapiens
atattattctcattta

SEQ ID NO: 3488295 - DNA, 19 bp, Homo sapiens
atattcagaatctttgtta

SEQ ID NO: 3488296 - DNA, 22 bp, Homo sapiens
atattcagacaaaatggataca

SEQ ID NO: 3488297 - DNA, 16 bp, Homo sapiens
atattccaaaataaaa

SEQ ID NO: 3488298 - DNA, 23 bp, Homo sapiens
atattccctagaaacttccaaat

SEQ ID NO: 3488299 - DNA, 12 bp, Homo sapiens
atattcctttga

SEQ ID NO: 3488300 - DNA, 16 bp, Homo sapiens
atattcctttgaagat

SEQ ID NO: 3488301 - DNA, 15 bp, Homo sapiens
atattcttgtgcttt

SEQ ID NO: 3488302 - DNA, 16 bp, Homo sapiens
atattgaaaaaataga

SEQ ID NO: 3488303 - DNA, 21 bp, Homo sapiens
atattgaatataatatatttg

SEQ ID NO: 3488304 - DNA, 16 bp, Homo sapiens
atattgaatttttcct

SEQ ID NO: 3488305 - DNA, 20 bp, Homo sapiens
atattgcacatgtcttaatg

SEQ ID NO: 3488306 - DNA, 19 bp, Homo sapiens
atattgcatttctgtattt

SEQ ID NO: 3488307 - DNA, 22 bp, Homo sapiens
atattgctgagagaaatatgga

SEQ ID NO: 3488308 - DNA, 19 bp, Homo sapiens
atattggacaaagaacctt

SEQ ID NO: 3488309 - DNA, 16 bp, Homo sapiens
atattggtgtactgta

SEQ ID NO: 3488310 - DNA, 17 bp, Homo sapiens
atattggtgtactgtaa

SEQ ID NO: 3488311 - DNA, 17 bp, Homo sapiens
atattgtgtttgtgtat

SEQ ID NO: 3488312 - DNA, 19 bp, Homo sapiens
atattgttttctcctttct

SEQ ID NO: 3488313 - DNA, 21 bp, Homo sapiens
atattgttttctcctttctgg

SEQ ID NO: 3488314 - DNA, 16 bp, Homo sapiens
atatttaaaaatgtct

SEQ ID NO: 3488315 - DNA, 16 bp, Homo sapiens
atatttaactggtgca

SEQ ID NO: 3488316 - DNA, 21 bp, Homo sapiens
atatttaagtataaaatacaa

SEQ ID NO: 3488317 - DNA, 14 bp, Homo sapiens
atatttaatgtttt

SEQ ID NO: 3488318 - DNA, 22 bp, Homo sapiens
atatttaatgttttaaatgtac

SEQ ID NO: 3488319 - DNA, 14 bp, Homo sapiens
atatttataaaact

SEQ ID NO: 3488320 - DNA, 16 bp, Homo sapiens
atatttattacctctg

SEQ ID NO: 3488321 - DNA, 23 bp, Homo sapiens
atgagatgatacatccaaagcag

SEQ ID NO: 3488322 - DNA, 24 bp, Homo sapiens
atgagatgatacatccaaagcaga

SEQ ID NO: 3488323 - DNA, 16 bp, Homo sapiens
atgagcagagcccgga

SEQ ID NO: 3488324 - DNA, 14 bp, Homo sapiens
atgagcatcccagg

SEQ ID NO: 3488325 - DNA, 12 bp, Homo sapiens
atgagcctcagc

SEQ ID NO: 3488326 - DNA, 17 bp, Homo sapiens
atgagcctcagcatcct

SEQ ID NO: 3488327 - DNA, 11 bp, Homo sapiens
atgagcctggc

SEQ ID NO: 3488328 - DNA, 12 bp, Homo sapiens
atgagcctggca

SEQ ID NO: 3488329 - DNA, 16 bp, Homo sapiens
atgagctctacccagg

SEQ ID NO: 3488330 - DNA, 18 bp, Homo sapiens
atgagctctacccagggc

SEQ ID NO: 3488331 - DNA, 21 bp, Homo sapiens
atgaggaggggcccccctgcc

SEQ ID NO: 3488332 - DNA, 19 bp, Homo sapiens
atgaggggacattttggtg

SEQ ID NO: 3488333 - DNA, 11 bp, Homo sapiens
atgaggggaga

SEQ ID NO: 3488334 - DNA, 14 bp, Homo sapiens
atgaggggagagga

SEQ ID NO: 3488335 - DNA, 16 bp, Homo sapiens
atgaggtcagagcctg

SEQ ID NO: 3488336 - DNA, 18 bp, Homo sapiens
atgaggtcagagcctgca

SEQ ID NO: 3488337 - DNA, 19 bp, Homo sapiens
atgaggtcagagcctgcag

SEQ ID NO: 3488338 - DNA, 15 bp, Homo sapiens
atgagtggaaaaagc

SEQ ID NO: 3488339 - DNA, 12 bp, Homo sapiens
atgagtttaaaa

SEQ ID NO: 3488340 - DNA, 13 bp, Homo sapiens
atgagtttttccc

SEQ ID NO: 3488341 - DNA, 13 bp, Homo sapiens
atgatatcattgt

SEQ ID NO: 3488342 - DNA, 14 bp, Homo sapiens
atgatatcattgtt

SEQ ID NO: 3488343 - DNA, 12 bp, Homo sapiens
atgatatgcatt

SEQ ID NO: 3488344 - DNA, 15 bp, Homo sapiens
atgatccaagcaaga

SEQ ID NO: 3488345 - DNA, 16 bp, Homo sapiens
atgatcctaggcattt

SEQ ID NO: 3488346 - DNA, 17 bp, Homo sapiens
atgatctgcaggggtct

SEQ ID NO: 3488347 - DNA, 18 bp, Homo sapiens
atgatctgcaggggtctg

SEQ ID NO: 3488348 - DNA, 23 bp, Homo sapiens
atgatgaaatgaggtcagagcct

SEQ ID NO: 3488349 - DNA, 12 bp, Homo sapiens
atgatgaatgag

SEQ ID NO: 3488350 - DNA, 15 bp, Homo sapiens
atgatgatcctaggc

SEQ ID NO: 3488351 - DNA, 20 bp, Homo sapiens
atgatgctgccggcacagct

SEQ ID NO: 3488352 - DNA, 17 bp, Homo sapiens
atgatggatttaacagc

SEQ ID NO: 3488353 - DNA, 21 bp, Homo sapiens
atgatggatttaacagcatga

SEQ ID NO: 3488354 - DNA, 11 bp, Homo sapiens
atgatgtttgc

SEQ ID NO: 3488355 - DNA, 21 bp, Homo sapiens
atgatgtttgcccaaaattta

SEQ ID NO: 3488356 - DNA, 21 bp, Homo sapiens
atgattaaccacttcagctga

SEQ ID NO: 3488357 - DNA, 16 bp, Homo sapiens
atgattaattcacctt

SEQ ID NO: 3488358 - DNA, 14 bp, Homo sapiens
atgatttcccccct

SEQ ID NO: 3488359 - DNA, 13 bp, Homo sapiens
atgatttccttga

SEQ ID NO: 3488360 - DNA, 16 bp, Homo sapiens
atgatttccttgaatg

SEQ ID NO: 3488361 - DNA, 18 bp, Homo sapiens
atgatttccttgaatgtg

SEQ ID NO: 3488362 - DNA, 21 bp, Homo sapiens
atgcaaaagttctgacttgac

SEQ ID NO: 3488363 - DNA, 23 bp, Homo sapiens
atgcaaactgtgcttctctatga

SEQ ID NO: 3488364 - DNA, 15 bp, Homo sapiens
atgcaaagaaaatca

SEQ ID NO: 3488365 - DNA, 15 bp, Homo sapiens
atgcaaaggctggga

SEQ ID NO: 3488366 - DNA, 17 bp, Homo sapiens
atgcaagagaacatttt

SEQ ID NO: 3488367 - DNA, 23 bp, Homo sapiens
atgcaagagaacattttactgtt

SEQ ID NO: 3488368 - DNA, 23 bp, Homo sapiens
atgcaagatagtttatctaactt

SEQ ID NO: 3488369 - DNA, 23 bp, Homo sapiens
atgcaatagaagtgctcccctct

SEQ ID NO: 3488370 - DNA, 22 bp, Homo sapiens
atgcaatatgtttatcaactca

SEQ ID NO: 3488371 - DNA, 14 bp, Homo sapiens
atgcacaagatgcc

SEQ ID NO: 3488372 - DNA, 21 bp, Homo sapiens
atgcacacagtgctttccgtg

SEQ ID NO: 3488373 - DNA, 18 bp, Homo sapiens
atgcaccaccaagccaag

SEQ ID NO: 3488374 - DNA, 21 bp, Homo sapiens
atgcaccaccaagccaaggga

SEQ ID NO: 3488375 - DNA, 13 bp, Homo sapiens
atgcactgtgaag

SEQ ID NO: 3488376 - DNA, 16 bp, Homo sapiens
cttggaggacagtggg

SEQ ID NO: 3488377 - DNA, 13 bp, Homo sapiens
cttggatcctggg

SEQ ID NO: 3488378 - DNA, 18 bp, Homo sapiens
cttggatgtacctgcccc

SEQ ID NO: 3488379 - DNA, 14 bp, Homo sapiens
ctttctagctgttg

SEQ ID NO: 3488380 - DNA, 16 bp, Homo sapiens
cttctctctgtgggat

SEQ ID NO: 3488381 - DNA, 14 bp, Homo sapiens
cttctctgacttct

SEQ ID NO: 3488382 - DNA, 16 bp, Homo sapiens
cttctctgacttctgc

SEQ ID NO: 3488383 - DNA, 17 bp, Homo sapiens
cttctctgacttctgcc

SEQ ID NO: 3488384 - DNA, 20 bp, Homo sapiens
cttctctgacttctgcctgg

SEQ ID NO: 3488385 - DNA, 14 bp, Homo sapiens
cttctgaatatttt

SEQ ID NO: 3488386 - DNA, 15 bp, Homo sapiens
cttctgaatatttta

SEQ ID NO: 3488387 - DNA, 18 bp, Homo sapiens
cttctgaatattttatct

SEQ ID NO: 3488388 - DNA, 20 bp, Homo sapiens
cttctgccatttctgagatc

SEQ ID NO: 3488389 - DNA, 15 bp, Homo sapiens
cttctgcccttgcca

SEQ ID NO: 3488390 - DNA, 18 bp, Homo sapiens
cttctgccggccctgggg

SEQ ID NO: 3488391 - DNA, 15 bp, Homo sapiens
cttcagggcaggtgg

SEQ ID NO: 3488392 - DNA, 17 bp, Homo sapiens
cttcaggtccaggctgt

SEQ ID NO: 3488393 - DNA, 14 bp, Homo sapiens
cttcagtatgttgt

SEQ ID NO: 3488394 - DNA, 19 bp, Homo sapiens
cttcagtatgttgtcaaag

SEQ ID NO: 3488395 - DNA, 23 bp, Homo sapiens
cttcagtatgttgtcaaagagag

SEQ ID NO: 3488396 - DNA, 13 bp, Homo sapiens
cttcagtggcagc

SEQ ID NO: 3488397 - DNA, 16 bp, Homo sapiens
cttcagtggcagctgc

SEQ ID NO: 3488398 - DNA, 17 bp, Homo sapiens
cttcagtttaatgcaag

SEQ ID NO: 3488399 - DNA, 15 bp, Homo sapiens
cttcatattgctgag

SEQ ID NO: 3488400 - DNA, 15 bp, Homo sapiens
cttcatcgaatctac

SEQ ID NO: 3488401 - DNA, 14 bp, Homo sapiens
cttcatctggctgc

SEQ ID NO: 3488402 - DNA, 14 bp, Homo sapiens
cttcatcttcctgt

SEQ ID NO: 3488403 - DNA, 12 bp, Homo sapiens
cttcatctttta

SEQ ID NO: 3488404 - DNA, 13 bp, Homo sapiens
cttcatggaccaa

SEQ ID NO: 3488405 - DNA, 22 bp, Homo sapiens
cttcatggaccaagaatgagct

SEQ ID NO: 3488406 - DNA, 10 bp, Homo sapiens
cttcatggat

SEQ ID NO: 3488407 - DNA, 13 bp, Homo sapiens
cttcatggatcag

SEQ ID NO: 3488408 - DNA, 21 bp, Homo sapiens
cttcatggcagaaggcaaacc

SEQ ID NO: 3488409 - DNA, 23 bp, Homo sapiens
cttcatgtctattccattccctt

SEQ ID NO: 3488410 - DNA, 15 bp, Homo sapiens
cttcattagagcagg

SEQ ID NO: 3488411 - DNA, 16 bp, Homo sapiens
cttcattagagcaggc

SEQ ID NO: 3488412 - DNA, 15 bp, Homo sapiens
cttcattctttgcag

SEQ ID NO: 3488413 - DNA, 18 bp, Homo sapiens
cttcattgatttcctgtg

SEQ ID NO: 3488414 - DNA, 20 bp, Homo sapiens
cttcattgatttcctgtgtc

SEQ ID NO: 3488415 - DNA, 15 bp, Homo sapiens
cttcattttcagagt

SEQ ID NO: 3488416 - DNA, 19 bp, Homo sapiens
cttcattttcagagtgaca

SEQ ID NO: 3488417 - DNA, 21 bp, Homo sapiens
cttcatttttgtaataacatt

SEQ ID NO: 3488418 - DNA, 14 bp, Homo sapiens
cttccactgagggc

SEQ ID NO: 3488419 - DNA, 15 bp, Homo sapiens
cttccaggctgggca

SEQ ID NO: 3488420 - DNA, 16 bp, Homo sapiens
cttccaggtgcccagc

SEQ ID NO: 3488421 - DNA, 19 bp, Homo sapiens
cttccaggtgcccagctat

SEQ ID NO: 3488422 - DNA, 19 bp, Homo sapiens
cttccagtgtccttagaac

SEQ ID NO: 3488423 - DNA, 16 bp, Homo sapiens
cttccatctctgactt

SEQ ID NO: 3488424 - DNA, 14 bp, Homo sapiens
cttccatgattcta

SEQ ID NO: 3488425 - DNA, 12 bp, Homo sapiens
cttccatttata

SEQ ID NO: 3488426 - DNA, 14 bp, Homo sapiens
cttcccaaacccag

SEQ ID NO: 3488427 - DNA, 17 bp, Homo sapiens
cttcccaaacccagtct

SEQ ID NO: 3488428 - DNA, 18 bp, Homo sapiens
cttcccaatcttcttttt

SEQ ID NO: 3488429 - DNA, 18 bp, Homo sapiens
cttcccagtggctgctgc

SEQ ID NO: 3488430 - DNA, 20 bp, Homo sapiens
cttcccagtggctgctgccc

SEQ ID NO: 3488431 - DNA, 18 bp, Homo sapiens
cttccccaacacgcagga

SEQ ID NO: 3488432 - DNA, 15 bp, Homo sapiens
cttccccacagaact

SEQ ID NO: 3488433 - DNA, 17 bp, Homo sapiens
cttccccacagaactgc

SEQ ID NO: 3488434 - DNA, 15 bp, Homo sapiens
cttcccctgcctcct

SEQ ID NO: 3488435 - DNA, 17 bp, Homo sapiens
cttcccgggccagggct

SEQ ID NO: 3488436 - DNA, 16 bp, Homo sapiens
cttccctaaaatcagg

SEQ ID NO: 3488437 - DNA, 17 bp, Homo sapiens
cttccctacagttgaaa

SEQ ID NO: 3488438 - DNA, 15 bp, Homo sapiens
cttccctcttccctc

SEQ ID NO: 3488439 - DNA, 13 bp, Homo sapiens
cttccgatgacag

SEQ ID NO: 3488440 - DNA, 15 bp, Homo sapiens
cttcctaagcctgtg

SEQ ID NO: 3488441 - DNA, 14 bp, Homo sapiens
cttcctcctggaaa

SEQ ID NO: 3488442 - DNA, 12 bp, Homo sapiens
cttcctcctggg

SEQ ID NO: 3488443 - DNA, 12 bp, Homo sapiens
cttcctctcctt

SEQ ID NO: 3488444 - DNA, 15 bp, Homo sapiens
cttcctctccttcct

SEQ ID NO: 3488445 - DNA, 16 bp, Homo sapiens
cttcctctccttcctt

SEQ ID NO: 3488446 - DNA, 14 bp, Homo sapiens
cttcctctgcaagt

SEQ ID NO: 3488447 - DNA, 21 bp, Homo sapiens
cttcctctgcaagtgctcagg

SEQ ID NO: 3488448 - DNA, 22 bp, Homo sapiens
cttcctctgcaagtgctcaggg

SEQ ID NO: 3488449 - DNA, 23 bp, Homo sapiens
cttcctctgcaagtgctcaggga

SEQ ID NO: 3488450 - DNA, 20 bp, Homo sapiens
cttcctctttggtggcatgg

SEQ ID NO: 3488451 - DNA, 19 bp, Homo sapiens
cttcctgaaactatatttt

SEQ ID NO: 3488452 - DNA, 22 bp, Homo sapiens
cttcctggagcccagaggaggg

SEQ ID NO: 3488453 - DNA, 19 bp, Homo sapiens
cttcctggcctgagagtca

SEQ ID NO: 3488454 - DNA, 18 bp, Homo sapiens
cttcctgtccagctccaa

SEQ ID NO: 3488455 - DNA, 14 bp, Homo sapiens
cttcctgtgtcctg

SEQ ID NO: 3488456 - DNA, 14 bp, Homo sapiens
cttcctgttctgaa

SEQ ID NO: 3488457 - DNA, 22 bp, Homo sapiens
cttccttgacctgcattgtaaa

SEQ ID NO: 3488458 - DNA, 23 bp, Homo sapiens
cttccttgacctgcattgtaaat

SEQ ID NO: 3488459 - DNA, 23 bp, Homo sapiens
cttccttgagacacggagcccag

SEQ ID NO: 3488460 - DNA, 15 bp, Homo sapiens
cttcgaaaggccttc

SEQ ID NO: 3488461 - DNA, 17 bp, Homo sapiens
cttcgaaaggccttcag

SEQ ID NO: 3488462 - DNA, 16 bp, Homo sapiens
cttcgctgtcccccaa

SEQ ID NO: 3488463 - DNA, 15 bp, Homo sapiens
cttcgcttcttgcct

SEQ ID NO: 3488464 - DNA, 16 bp, Homo sapiens
cttcgcttcttgcctc

SEQ ID NO: 3488465 - DNA, 17 bp, Homo sapiens
cttcgcttcttgcctct

SEQ ID NO: 3488466 - DNA, 21 bp, Homo sapiens
cttcgcttcttgcctctgtgc

SEQ ID NO: 3488467 - DNA, 14 bp, Homo sapiens
cttcgggctgtgcc

SEQ ID NO: 3488468 - DNA, 16 bp, Homo sapiens
cttcgggctgtgcccg

SEQ ID NO: 3488469 - DNA, 17 bp, Homo sapiens
cttcggggtagaggctg

SEQ ID NO: 3488470 - DNA, 23 bp, Homo sapiens
cttcggggtagaggctgggagga

SEQ ID NO: 3488471 - DNA, 13 bp, Homo sapiens
cttcgttcttttt

SEQ ID NO: 3488472 - DNA, 19 bp, Homo sapiens
cttctaaacccaatccaaa

SEQ ID NO: 3488473 - DNA, 15 bp, Homo sapiens
cttctaaaggtgttg

SEQ ID NO: 3488474 - DNA, 22 bp, Homo sapiens
cttctaaggaaatggagaagct

SEQ ID NO: 3488475 - DNA, 16 bp, Homo sapiens
cttctagaggctcatg

SEQ ID NO: 3488476 - DNA, 17 bp, Homo sapiens
cttctagaggctcatgg

SEQ ID NO: 3488477 - DNA, 19 bp, Homo sapiens
cttctagaggctcatggcc

SEQ ID NO: 3488478 - DNA, 22 bp, Homo sapiens
cttctagaggctcatggccctg

SEQ ID NO: 3488479 - DNA, 18 bp, Homo sapiens
cttctatgtaggaaaaaa

SEQ ID NO: 3488480 - DNA, 21 bp, Homo sapiens
cttctcaaagctgggattaca

SEQ ID NO: 3488481 - DNA, 14 bp, Homo sapiens
cttctcaccagctg

SEQ ID NO: 3488482 - DNA, 20 bp, Homo sapiens
cttctcaccagctgcaaagt

SEQ ID NO: 3488483 - DNA, 17 bp, Homo sapiens
cttctcatcctgcaggc

SEQ ID NO: 3488484 - DNA, 14 bp, Homo sapiens
cttctcatttcacc

SEQ ID NO: 3488485 - DNA, 15 bp, Homo sapiens
cttctcatttcaccc

SEQ ID NO: 3488486 - DNA, 19 bp, Homo sapiens
cttctccaaaaatctgcct

SEQ ID NO: 3488487 - DNA, 13 bp, Homo sapiens
cttctccaggctg

SEQ ID NO: 3488488 - DNA, 13 bp, Homo sapiens
cttctccagggtc

SEQ ID NO: 3488489 - DNA, 19 bp, Homo sapiens
cttctccagggtccacagg

SEQ ID NO: 3488490 - DNA, 16 bp, Homo sapiens
cttctccatccacatg

SEQ ID NO: 3488491 - DNA, 17 bp, Homo sapiens
cttctcccatctcttcc

SEQ ID NO: 3488492 - DNA, 15 bp, Homo sapiens
cttctcccctcttct

SEQ ID NO: 3488493 - DNA, 18 bp, Homo sapiens
cttctcccctcttctgag

SEQ ID NO: 3488494 - DNA, 20 bp, Homo sapiens
cttctcccctcttctgagct

SEQ ID NO: 3488495 - DNA, 21 bp, Homo sapiens
cttctcccctcttctgagcta

SEQ ID NO: 3488496 - DNA, 22 bp, Homo sapiens
cttctcctatgtgtaaggtgaa

SEQ ID NO: 3488497 - DNA, 17 bp, Homo sapiens
cttctcctcttgtaaat

SEQ ID NO: 3488498 - DNA, 21 bp, Homo sapiens
cttctcctggagttgcattga

SEQ ID NO: 3488499 - DNA, 23 bp, Homo sapiens
cttctccttggaggacagtggga

SEQ ID NO: 3488500 - DNA, 23 bp, Homo sapiens
cttctcggcttggatcctgggct

SEQ ID NO: 3488501 - DNA, 15 bp, Homo sapiens
cttctctatgataat

SEQ ID NO: 3488502 - DNA, 19 bp, Homo sapiens
cttctctatgataattaca

SEQ ID NO: 3488503 - DNA, 21 bp, Homo sapiens
cttctctatgataattacaat

SEQ ID NO: 3488504 - DNA, 19 bp, Homo sapiens
cttctctcaaccttggcct

SEQ ID NO: 3488505 - DNA, 21 bp, Homo sapiens
cttctctcaaccttggccttc

SEQ ID NO: 3488506 - DNA, 23 bp, Homo sapiens
cttctctcaaccttggccttctc

SEQ ID NO: 3488507 - DNA, 23 bp, Homo sapiens
cttctctcactgtgttactgctt

SEQ ID NO: 3488508 - DNA, 22 bp, Homo sapiens
ctgttctagcacttcatctggc

SEQ ID NO: 3488509 - DNA, 15 bp, Homo sapiens
ctgttctcattcctg

SEQ ID NO: 3488510 - DNA, 15 bp, Homo sapiens
ctgttctcttgggaa

SEQ ID NO: 3488511 - DNA, 22 bp, Homo sapiens
ctgttctggaggaaagggagga

SEQ ID NO: 3488512 - DNA, 20 bp, Homo sapiens
ctgttgacatatttaatgtt

SEQ ID NO: 3488513 - DNA, 22 bp, Homo sapiens
ctgttgacatatttaatgtttt

SEQ ID NO: 3488514 - DNA, 15 bp, Homo sapiens
ctgttgagctgtttt

SEQ ID NO: 3488515 - DNA, 17 bp, Homo sapiens
ctgttgcccaggctggc

SEQ ID NO: 3488516 - DNA, 18 bp, Homo sapiens
ctgttgcccaggctggcg

SEQ ID NO: 3488517 - DNA, 22 bp, Homo sapiens
ctgttgctaagccccagcaagc

SEQ ID NO: 3488518 - DNA, 16 bp, Homo sapiens
ctgttgctgaataggc

SEQ ID NO: 3488519 - DNA, 16 bp, Homo sapiens
ctgttggcaggctggc

SEQ ID NO: 3488520 - DNA, 18 bp, Homo sapiens
ctgttggcaggctggcca

SEQ ID NO: 3488521 - DNA, 12 bp, Homo sapiens
ctgttggccagt

SEQ ID NO: 3488522 - DNA, 18 bp, Homo sapiens
ctgttggggtgggtataa

SEQ ID NO: 3488523 - DNA, 20 bp, Homo sapiens
ctgttggggtgggtataaaa

SEQ ID NO: 3488524 - DNA, 22 bp, Homo sapiens
ctgttggggtgggtataaaaga

SEQ ID NO: 3488525 - DNA, 23 bp, Homo sapiens
ctgttggggtgggtataaaagat

SEQ ID NO: 3488526 - DNA, 18 bp, Homo sapiens
ctgttggtcctctctctg

SEQ ID NO: 3488527 - DNA, 19 bp, Homo sapiens
ctgttggtcctctctctgt

SEQ ID NO: 3488528 - DNA, 15 bp, Homo sapiens
ctgtttaatgttctg

SEQ ID NO: 3488529 - DNA, 17 bp, Homo sapiens
ctgtttactgcaaggtt

SEQ ID NO: 3488530 - DNA, 20 bp, Homo sapiens
ctgtttagcagcagccttta

SEQ ID NO: 3488531 - DNA, 20 bp, Homo sapiens
ctgtttataaaaacaaaaac

SEQ ID NO: 3488532 - DNA, 18 bp, Homo sapiens
ctgtttcaaagccaagac

SEQ ID NO: 3488533 - DNA, 11 bp, Homo sapiens
ctgtttcctgt

SEQ ID NO: 3488534 - DNA, 20 bp, Homo sapiens
ctgtttctggaaatgttctt

SEQ ID NO: 3488535 - DNA, 14 bp, Homo sapiens
ctgtttgctgatgg

SEQ ID NO: 3488536 - DNA, 16 bp, Homo sapiens
ctgtttgctgatggtc

SEQ ID NO: 3488537 - DNA, 15 bp, Homo sapiens
ctgtttgtatgaaat

SEQ ID NO: 3488538 - DNA, 16 bp, Homo sapiens
ctgttttcccacgagg

SEQ ID NO: 3488539 - DNA, 12 bp, Homo sapiens
ctgttttcctcc

SEQ ID NO: 3488540 - DNA, 16 bp, Homo sapiens
ctgttttcctcccttc

SEQ ID NO: 3488541 - DNA, 19 bp, Homo sapiens
ctgttttcctcccttctgc

SEQ ID NO: 3488542 - DNA, 23 bp, Homo sapiens
ctgtttttaagctgtttccatag

SEQ ID NO: 3488543 - DNA, 15 bp, Homo sapiens
ctgtttttttttcat

SEQ ID NO: 3488544 - DNA, 23 bp, Homo sapiens
cttaaaaatgttttttcatgtgt

SEQ ID NO: 3488545 - DNA, 18 bp, Homo sapiens
cttaacaaactcttcagt

SEQ ID NO: 3488546 - DNA, 15 bp, Homo sapiens
cttaacaaatacatt

SEQ ID NO: 3488547 - DNA, 23 bp, Homo sapiens
cttaacaaatacattcaaattct

SEQ ID NO: 3488548 - DNA, 14 bp, Homo sapiens
cttaagagaatatt

SEQ ID NO: 3488549 - DNA, 21 bp, Homo sapiens
cttaagatttgtttttctctt

SEQ ID NO: 3488550 - DNA, 15 bp, Homo sapiens
cttaagcaaaagaaa

SEQ ID NO: 3488551 - DNA, 19 bp, Homo sapiens
cttaagcaaaggggacagc

SEQ ID NO: 3488552 - DNA, 14 bp, Homo sapiens
cttaagccctggcc

SEQ ID NO: 3488553 - DNA, 15 bp, Homo sapiens
cttaaggtgaggcct

SEQ ID NO: 3488554 - DNA, 18 bp, Homo sapiens
cttaaggtgaggcctgtc

SEQ ID NO: 3488555 - DNA, 23 bp, Homo sapiens
cttaaggtgaggcctgtctgtga

SEQ ID NO: 3488556 - DNA, 17 bp, Homo sapiens
cttaaggtgtagccaca

SEQ ID NO: 3488557 - DNA, 12 bp, Homo sapiens
cttaatataaat

SEQ ID NO: 3488558 - DNA, 13 bp, Homo sapiens
cttaatataaatt

SEQ ID NO: 3488559 - DNA, 13 bp, Homo sapiens
cttaatcttgctt

SEQ ID NO: 3488560 - DNA, 16 bp, Homo sapiens
cttaatcttgctttct

SEQ ID NO: 3488561 - DNA, 19 bp, Homo sapiens
cttaatgaagtttgaatgt

SEQ ID NO: 3488562 - DNA, 14 bp, Homo sapiens
cttaattgctttcc

SEQ ID NO: 3488563 - DNA, 14 bp, Homo sapiens
cttacaaaaacact

SEQ ID NO: 3488564 - DNA, 15 bp, Homo sapiens
cttacacccatgact

SEQ ID NO: 3488565 - DNA, 22 bp, Homo sapiens
cttacagtaaagtatagaaata

SEQ ID NO: 3488566 - DNA, 20 bp, Homo sapiens
cttacatctggaatctgagg

SEQ ID NO: 3488567 - DNA, 14 bp, Homo sapiens
cttacatgtataaa

SEQ ID NO: 3488568 - DNA, 21 bp, Homo sapiens
cttacccaggtgggtcccggc

SEQ ID NO: 3488569 - DNA, 23 bp, Homo sapiens
cttacccatctgcacccccctgg

SEQ ID NO: 3488570 - DNA, 21 bp, Homo sapiens
cttacctcggtgccttcctct

SEQ ID NO: 3488571 - DNA, 19 bp, Homo sapiens
cttacctgttcagtactct

SEQ ID NO: 3488572 - DNA, 14 bp, Homo sapiens
cttactagccctgc

SEQ ID NO: 3488573 - DNA, 12 bp, Homo sapiens
cttactctttcc

SEQ ID NO: 3488574 - DNA, 15 bp, Homo sapiens
cttactgtagcctca

SEQ ID NO: 3488575 - DNA, 15 bp, Homo sapiens
cttactgtgcaccta

SEQ ID NO: 3488576 - DNA, 15 bp, Homo sapiens
cttacttcttgccct

SEQ ID NO: 3488577 - DNA, 20 bp, Homo sapiens
cttagaaaattcaagcattt

SEQ ID NO: 3488578 - DNA, 12 bp, Homo sapiens
cttagaacattt

SEQ ID NO: 3488579 - DNA, 16 bp, Homo sapiens
cttagaacattttaat

SEQ ID NO: 3488580 - DNA, 19 bp, Homo sapiens
cttagaacattttaattca

SEQ ID NO: 3488581 - DNA, 15 bp, Homo sapiens
cttagaagtcacaca

SEQ ID NO: 3488582 - DNA, 17 bp, Homo sapiens
cttagaatccaaacttg

SEQ ID NO: 3488583 - DNA, 21 bp, Homo sapiens
cttagagggatttctttgctg

SEQ ID NO: 3488584 - DNA, 17 bp, Homo sapiens
cttagattgaagtaaac

SEQ ID NO: 3488585 - DNA, 21 bp, Homo sapiens
cttagcactaccactcctgcc

SEQ ID NO: 3488586 - DNA, 18 bp, Homo sapiens
cttagcagggaaacagct

SEQ ID NO: 3488587 - DNA, 20 bp, Homo sapiens
cttagccatgatctgcaggg

SEQ ID NO: 3488588 - DNA, 17 bp, Homo sapiens
cttagctcccctccaac

SEQ ID NO: 3488589 - DNA, 15 bp, Homo sapiens
cttagcttcaggaac

SEQ ID NO: 3488590 - DNA, 16 bp, Homo sapiens
cttagcttcaggaacc

SEQ ID NO: 3488591 - DNA, 18 bp, Homo sapiens
cttagctttgctctgcca

SEQ ID NO: 3488592 - DNA, 14 bp, Homo sapiens
cttaggcactaaag

SEQ ID NO: 3488593 - DNA, 14 bp, Homo sapiens
cttaggcagggaag

SEQ ID NO: 3488594 - DNA, 21 bp, Homo sapiens
cttaggcccggagctgcccct

SEQ ID NO: 3488595 - DNA, 12 bp, Homo sapiens
cttaggccttcc

SEQ ID NO: 3488596 - DNA, 13 bp, Homo sapiens
cttaggccttcct

SEQ ID NO: 3488597 - DNA, 21 bp, Homo sapiens
cttagtagattaaaaattata

SEQ ID NO: 3488598 - DNA, 23 bp, Homo sapiens
cttagtttgtgtgttgtctcttg

SEQ ID NO: 3488599 - DNA, 14 bp, Homo sapiens
cttataatttaaaa

SEQ ID NO: 3488600 - DNA, 19 bp, Homo sapiens
cttatactgtacaataaaa

SEQ ID NO: 3488601 - DNA, 20 bp, Homo sapiens
cttatagaatatttattacc

SEQ ID NO: 3488602 - DNA, 14 bp, Homo sapiens
cttatagttaatat

SEQ ID NO: 3488603 - DNA, 19 bp, Homo sapiens
cttatagttaatattttgt

SEQ ID NO: 3488604 - DNA, 17 bp, Homo sapiens
cttatagtttgggcttc

SEQ ID NO: 3488605 - DNA, 23 bp, Homo sapiens
cttatagtttgggcttcagccta

SEQ ID NO: 3488606 - DNA, 15 bp, Homo sapiens
cttatccagctggtg

SEQ ID NO: 3488607 - DNA, 16 bp, Homo sapiens
cttatcgggctccagc

SEQ ID NO: 3488608 - DNA, 18 bp, Homo sapiens
cttatcgggctccagcca

SEQ ID NO: 3488609 - DNA, 23 bp, Homo sapiens
cttatggaattgatttgcattga

SEQ ID NO: 3488610 - DNA, 20 bp, Homo sapiens
cttattagagtgtctttcca

SEQ ID NO: 3488611 - DNA, 20 bp, Homo sapiens
cttattcccccctaagcttc

SEQ ID NO: 3488612 - DNA, 12 bp, Homo sapiens
cttattgcccac

SEQ ID NO: 3488613 - DNA, 14 bp, Homo sapiens
cttattgcgctgct

SEQ ID NO: 3488614 - DNA, 13 bp, Homo sapiens
cttcaaggcttca

SEQ ID NO: 3488615 - DNA, 19 bp, Homo sapiens
cttcaaggcttcagtctca

SEQ ID NO: 3488616 - DNA, 15 bp, Homo sapiens
ctgggaggagcccct

SEQ ID NO: 3488617 - DNA, 23 bp, Homo sapiens
ctgggaggagcccctggacatgc

SEQ ID NO: 3488618 - DNA, 15 bp, Homo sapiens
ctgggagggcagcag

SEQ ID NO: 3488619 - DNA, 19 bp, Homo sapiens
ctgggaggtcaaggctgca

SEQ ID NO: 3488620 - DNA, 21 bp, Homo sapiens
ctgggaggtcaaggctgcagt

SEQ ID NO: 3488621 - DNA, 15 bp, Homo sapiens
ctgggagtcaggccc

SEQ ID NO: 3488622 - DNA, 16 bp, Homo sapiens
ctgggagtcaggcccg

SEQ ID NO: 3488623 - DNA, 13 bp, Homo sapiens
ctgggagtgagct

SEQ ID NO: 3488624 - DNA, 23 bp, Homo sapiens
ctgggagttgatcgcctttccca

SEQ ID NO: 3488625 - DNA, 13 bp, Homo sapiens
ctgggatcctaag

SEQ ID NO: 3488626 - DNA, 17 bp, Homo sapiens
ctgggatggtgggcttc

SEQ ID NO: 3488627 - DNA, 19 bp, Homo sapiens
ctgggatggtgggcttcag

SEQ ID NO: 3488628 - DNA, 22 bp, Homo sapiens
ctgggatggtgggcttcagggc

SEQ ID NO: 3488629 - DNA, 16 bp, Homo sapiens
ctgggattaaggggat

SEQ ID NO: 3488630 - DNA, 21 bp, Homo sapiens
ctgggattacaagcgtgagcc

SEQ ID NO: 3488631 - DNA, 17 bp, Homo sapiens
ctgggatttacacttga

SEQ ID NO: 3488632 - DNA, 21 bp, Homo sapiens
ctgggcaaggaggccacgtga

SEQ ID NO: 3488633 - DNA, 17 bp, Homo sapiens
ctgggcacacgcctccc

SEQ ID NO: 3488634 - DNA, 23 bp, Homo sapiens
ctgggcacacgcctcccactggg

SEQ ID NO: 3488635 - DNA, 13 bp, Homo sapiens
ctgggcacttccc

SEQ ID NO: 3488636 - DNA, 22 bp, Homo sapiens
ctgggcagcttgagagggcaaa

SEQ ID NO: 3488637 - DNA, 23 bp, Homo sapiens
ctgggcatagatgcaggtgagcc

SEQ ID NO: 3488638 - DNA, 18 bp, Homo sapiens
ctgggccacttctgggtg

SEQ ID NO: 3488639 - DNA, 13 bp, Homo sapiens
ctgggccagagta

SEQ ID NO: 3488640 - DNA, 17 bp, Homo sapiens
ctgggcccacaaaggca

SEQ ID NO: 3488641 - DNA, 15 bp, Homo sapiens
ctgggccctctctgc

SEQ ID NO: 3488642 - DNA, 13 bp, Homo sapiens
ctgggccctgggc

SEQ ID NO: 3488643 - DNA, 16 bp, Homo sapiens
ctgggccgctgccacg

SEQ ID NO: 3488644 - DNA, 17 bp, Homo sapiens
ctgggccggagggtcag

SEQ ID NO: 3488645 - DNA, 17 bp, Homo sapiens
ctgggccgggcctgggg

SEQ ID NO: 3488646 - DNA, 13 bp, Homo sapiens
ctgggcctgcaga

SEQ ID NO: 3488647 - DNA, 21 bp, Homo sapiens
ctgggctcctaaccttcctgt

SEQ ID NO: 3488648 - DNA, 15 bp, Homo sapiens
ctgggctctggctct

SEQ ID NO: 3488649 - DNA, 15 bp, Homo sapiens
ctgggcttcagtggc

SEQ ID NO: 3488650 - DNA, 18 bp, Homo sapiens
ctgggcttcagtggcagc

SEQ ID NO: 3488651 - DNA, 20 bp, Homo sapiens
ctgggcttcagtggcagctg

SEQ ID NO: 3488652 - DNA, 21 bp, Homo sapiens
ctgggcttcagtggcagctgc

SEQ ID NO: 3488653 - DNA, 12 bp, Homo sapiens
ctggggaaaggg

SEQ ID NO: 3488654 - DNA, 13 bp, Homo sapiens
ctggggaaagggg

SEQ ID NO: 3488655 - DNA, 16 bp, Homo sapiens
ctggggaaggagccag

SEQ ID NO: 3488656 - DNA, 18 bp, Homo sapiens
ctggggaaggagccagtt

SEQ ID NO: 3488657 - DNA, 13 bp, Homo sapiens
ctggggagaaagt

SEQ ID NO: 3488658 - DNA, 15 bp, Homo sapiens
ctggggagtgattac

SEQ ID NO: 3488659 - DNA, 11 bp, Homo sapiens
ctggggcctcc

SEQ ID NO: 3488660 - DNA, 15 bp, Homo sapiens
ctggggcctccagaa

SEQ ID NO: 3488661 - DNA, 15 bp, Homo sapiens
ctggggcctgactgc

SEQ ID NO: 3488662 - DNA, 16 bp, Homo sapiens
ctggggctccgaaatt

SEQ ID NO: 3488663 - DNA, 14 bp, Homo sapiens
ctggggctggcctc

SEQ ID NO: 3488664 - DNA, 13 bp, Homo sapiens
ctggggctggctt

SEQ ID NO: 3488665 - DNA, 16 bp, Homo sapiens
ctggggctgtgttttg

SEQ ID NO: 3488666 - DNA, 13 bp, Homo sapiens
ctgggggaagaag

SEQ ID NO: 3488667 - DNA, 21 bp, Homo sapiens
ctgggggacccctggctctgg

SEQ ID NO: 3488668 - DNA, 15 bp, Homo sapiens
ctgggggctatgtat

SEQ ID NO: 3488669 - DNA, 13 bp, Homo sapiens
ctggggggcagtg

SEQ ID NO: 3488670 - DNA, 14 bp, Homo sapiens
ctgggggtgggcca

SEQ ID NO: 3488671 - DNA, 16 bp, Homo sapiens
ctggggtccagggagc

SEQ ID NO: 3488672 - DNA, 13 bp, Homo sapiens
ctggggtggcctg

SEQ ID NO: 3488673 - DNA, 20 bp, Homo sapiens
ctgggtaactagggaagata

SEQ ID NO: 3488674 - DNA, 22 bp, Homo sapiens
ctgggtaactagggaagataat

SEQ ID NO: 3488675 - DNA, 16 bp, Homo sapiens
ctgggtacttgtggac

SEQ ID NO: 3488676 - DNA, 15 bp, Homo sapiens
ctgggtattaccatg

SEQ ID NO: 3488677 - DNA, 19 bp, Homo sapiens
ctgggtattaccatgtaaa

SEQ ID NO: 3488678 - DNA, 12 bp, Homo sapiens
ctgggtcagtgg

SEQ ID NO: 3488679 - DNA, 13 bp, Homo sapiens
ctgggtgacagag

SEQ ID NO: 3488680 - DNA, 14 bp, Homo sapiens
ctgggtgctcccta

SEQ ID NO: 3488681 - DNA, 15 bp, Homo sapiens
ctgggtgctccctac

SEQ ID NO: 3488682 - DNA, 23 bp, Homo sapiens
ctgggtggacatggcccctgtga

SEQ ID NO: 3488683 - DNA, 16 bp, Homo sapiens
ctgggtggcactgcca

SEQ ID NO: 3488684 - DNA, 21 bp, Homo sapiens
ctgggtggcactgccatgcag

SEQ ID NO: 3488685 - DNA, 13 bp, Homo sapiens
ctgggtggtctgc

SEQ ID NO: 3488686 - DNA, 18 bp, Homo sapiens
ctgggttcactgcaacct

SEQ ID NO: 3488687 - DNA, 18 bp, Homo sapiens
ctgggttgcagacaggaa

SEQ ID NO: 3488688 - DNA, 13 bp, Homo sapiens
ctgggttggaggg

SEQ ID NO: 3488689 - DNA, 15 bp, Homo sapiens
ctgggttggagggtg

SEQ ID NO: 3488690 - DNA, 22 bp, Homo sapiens
ctgggtttaaggggagaggaaa

SEQ ID NO: 3488691 - DNA, 16 bp, Homo sapiens
ctgggtttgaagctgc

SEQ ID NO: 3488692 - DNA, 20 bp, Homo sapiens
ctgggtttgaagctgctgtc

SEQ ID NO: 3488693 - DNA, 23 bp, Homo sapiens
ctgggtttgtttttcaaagcctg

SEQ ID NO: 3488694 - DNA, 15 bp, Homo sapiens
ctggtattcctgcct

SEQ ID NO: 3488695 - DNA, 14 bp, Homo sapiens
ctggtattttatct

SEQ ID NO: 3488696 - DNA, 18 bp, Homo sapiens
ctggtcaaacaaactctc

SEQ ID NO: 3488697 - DNA, 16 bp, Homo sapiens
ctggtccacagggcac

SEQ ID NO: 3488698 - DNA, 18 bp, Homo sapiens
ctggtcccactcagtcca

SEQ ID NO: 3488699 - DNA, 21 bp, Homo sapiens
ctggtccgtgggacggtgccc

SEQ ID NO: 3488700 - DNA, 16 bp, Homo sapiens
ctggtcctacccatcc

SEQ ID NO: 3488701 - DNA, 17 bp, Homo sapiens
ctggtcctacccatccc

SEQ ID NO: 3488702 - DNA, 15 bp, Homo sapiens
ctggtcctggcctcc

SEQ ID NO: 3488703 - DNA, 18 bp, Homo sapiens
ctggtctctaggctgggg

SEQ ID NO: 3488704 - DNA, 20 bp, Homo sapiens
ctggtctctaggctggggaa

SEQ ID NO: 3488705 - DNA, 18 bp, Homo sapiens
ctggtcttgaactcctgg

SEQ ID NO: 3488706 - DNA, 18 bp, Homo sapiens
ctggtgcactttgtaaat

SEQ ID NO: 3488707 - DNA, 19 bp, Homo sapiens
ctggtgcactttgtaaatt

SEQ ID NO: 3488708 - DNA, 21 bp, Homo sapiens
ctggtgccccccacccctgga

SEQ ID NO: 3488709 - DNA, 15 bp, Homo sapiens
ctggtggacccaggg

SEQ ID NO: 3488710 - DNA, 16 bp, Homo sapiens
ctggtggcagagtcct

SEQ ID NO: 3488711 - DNA, 14 bp, Homo sapiens
ctggtggcagctgc

SEQ ID NO: 3488712 - DNA, 16 bp, Homo sapiens
ctggtggcaggggctt

SEQ ID NO: 3488713 - DNA, 22 bp, Homo sapiens
ctggtggccccgtttctggtgg

SEQ ID NO: 3488714 - DNA, 20 bp, Homo sapiens
ctggtggtctgttggcaggc

SEQ ID NO: 3488715 - DNA, 22 bp, Homo sapiens
ctggtggtctgttggcaggctg

SEQ ID NO: 3488716 - DNA, 23 bp, Homo sapiens
ctggtggtctgttggcaggctgg

SEQ ID NO: 3488717 - DNA, 15 bp, Homo sapiens
ctggtggttgctgtt

SEQ ID NO: 3488718 - DNA, 23 bp, Homo sapiens
ctggtggtttgattgtttacagg

SEQ ID NO: 3488719 - DNA, 16 bp, Homo sapiens
ctggttaggatggcag

SEQ ID NO: 3488720 - DNA, 18 bp, Homo sapiens
ctggttaggatggcagga

SEQ ID NO: 3488721 - DNA, 20 bp, Homo sapiens
ctggttcagggttggcccct

SEQ ID NO: 3488722 - DNA, 16 bp, Homo sapiens
ctggttccagggtccc

SEQ ID NO: 3488723 - DNA, 12 bp, Homo sapiens
ctggttctcatc

SEQ ID NO: 3488724 - DNA, 15 bp, Homo sapiens
ctggttctcatcttt

SEQ ID NO: 3488725 - DNA, 16 bp, Homo sapiens
ctggttctcatctttc

SEQ ID NO: 3488726 - DNA, 20 bp, Homo sapiens
ctggttctcatctttcttga

SEQ ID NO: 3488727 - DNA, 23 bp, Homo sapiens
ctggttctgatgatgtgcctggg

SEQ ID NO: 3488728 - DNA, 13 bp, Homo sapiens
ctggttgaagaag

SEQ ID NO: 3488729 - DNA, 19 bp, Homo sapiens
ctggttgaagaagatgatc

SEQ ID NO: 3488730 - DNA, 22 bp, Homo sapiens
ctggttgttgtagtaagagctt

SEQ ID NO: 3488731 - DNA, 19 bp, Homo sapiens
ctggtttctcagaatccaa

SEQ ID NO: 3488732 - DNA, 18 bp, Homo sapiens
ctggtttgtggggcacag

SEQ ID NO: 3488733 - DNA, 10 bp, Homo sapiens
ctgtaaaatc

SEQ ID NO: 3488734 - DNA, 11 bp, Homo sapiens
ctgtaaaatct

SEQ ID NO: 3488735 - DNA, 22 bp, Homo sapiens
ctgtaaaatctttctttcttag

SEQ ID NO: 3488736 - DNA, 22 bp, Homo sapiens
ctgtaaaatgcatgattttgta

SEQ ID NO: 3488737 - DNA, 22 bp, Homo sapiens
ctgtaaacccctttagtggctt

SEQ ID NO: 3488738 - DNA, 16 bp, Homo sapiens
ctgtaaattgctggca

SEQ ID NO: 3488739 - DNA, 20 bp, Homo sapiens
ctgtaacctcttcagaggcc

SEQ ID NO: 3488740 - DNA, 21 bp, Homo sapiens
ctgtaagaaacctactgccca

SEQ ID NO: 3488741 - DNA, 22 bp, Homo sapiens
ctgtaagaaacctactgcccag

SEQ ID NO: 3488742 - DNA, 18 bp, Homo sapiens
ctgtaagaataatttata

SEQ ID NO: 3488743 - DNA, 20 bp, Homo sapiens
ctgtaataaagatgattgtg

SEQ ID NO: 3488744 - DNA, 18 bp, Homo sapiens
ctgtaatcatttgtttac

SEQ ID NO: 3488745 - DNA, 16 bp, Homo sapiens
ctgtaattgtgtgtga

SEQ ID NO: 3488746 - DNA, 12 bp, Homo sapiens
ctgtacaaaggg

SEQ ID NO: 3488747 - DNA, 11 bp, Homo sapiens
ctgtacagggg

SEQ ID NO: 3488748 - DNA, 18 bp, Homo sapiens
ctgtacgtctgacaggca

SEQ ID NO: 3488749 - DNA, 23 bp, Homo sapiens
ctgtactattgcagacctgtcac

SEQ ID NO: 3488750 - DNA, 15 bp, Homo sapiens
ctgtactcttagatg

SEQ ID NO: 3488751 - DNA, 15 bp, Homo sapiens
ctgtacttagaaagt

SEQ ID NO: 3488752 - DNA, 18 bp, Homo sapiens
ctgtacttttcattctct

SEQ ID NO: 3488753 - DNA, 17 bp, Homo sapiens
ctggaagcccagcccct

SEQ ID NO: 3488754 - DNA, 22 bp, Homo sapiens
ctggaagcccagcccctactgc

SEQ ID NO: 3488755 - DNA, 19 bp, Homo sapiens
ctggaagctaatttgcatt

SEQ ID NO: 3488756 - DNA, 22 bp, Homo sapiens
ctggaagctaatttgcattaaa

SEQ ID NO: 3488757 - DNA, 14 bp, Homo sapiens
ctggaaggctgctt

SEQ ID NO: 3488758 - DNA, 17 bp, Homo sapiens
ctggaaggctgctttct

SEQ ID NO: 3488759 - DNA, 14 bp, Homo sapiens
ctggacaaagaatt

SEQ ID NO: 3488760 - DNA, 13 bp, Homo sapiens
ctggacacaggcc

SEQ ID NO: 3488761 - DNA, 13 bp, Homo sapiens
ctggacagcccca

SEQ ID NO: 3488762 - DNA, 12 bp, Homo sapiens
ctggacatgcct

SEQ ID NO: 3488763 - DNA, 21 bp, Homo sapiens
ctggaccagtggtctcacatg

SEQ ID NO: 3488764 - DNA, 12 bp, Homo sapiens
ctggaccccagc

SEQ ID NO: 3488765 - DNA, 15 bp, Homo sapiens
ctggaccctgtggat

SEQ ID NO: 3488766 - DNA, 20 bp, Homo sapiens
ctggacctagggtggcctga

SEQ ID NO: 3488767 - DNA, 20 bp, Homo sapiens
ctggaccttgaactgggtac

SEQ ID NO: 3488768 - DNA, 20 bp, Homo sapiens
ctggactcctgccaccagca

SEQ ID NO: 3488769 - DNA, 23 bp, Homo sapiens
ctggactctcagtctctgagcag

SEQ ID NO: 3488770 - DNA, 15 bp, Homo sapiens
ctggactgaggcctg

SEQ ID NO: 3488771 - DNA, 19 bp, Homo sapiens
ctggacttggcccctgcca

SEQ ID NO: 3488772 - DNA, 18 bp, Homo sapiens
ctggagaccagggagcct

SEQ ID NO: 3488773 - DNA, 19 bp, Homo sapiens
ctggagaccagggagcctt

SEQ ID NO: 3488774 - DNA, 14 bp, Homo sapiens
ctggagatcctcct

SEQ ID NO: 3488775 - DNA, 18 bp, Homo sapiens
ctggagatcctcctgcag

SEQ ID NO: 3488776 - DNA, 16 bp, Homo sapiens
ctggagcactgggctc

SEQ ID NO: 3488777 - DNA, 20 bp, Homo sapiens
ctggagcactgggctcccgg

SEQ ID NO: 3488778 - DNA, 23 bp, Homo sapiens
ctggagcccagaggagggcagca

SEQ ID NO: 3488779 - DNA, 14 bp, Homo sapiens
ctggagcccaggga

SEQ ID NO: 3488780 - DNA, 20 bp, Homo sapiens
ctggagccctccgccttcac

SEQ ID NO: 3488781 - DNA, 16 bp, Homo sapiens
ctggagcctggtgccc

SEQ ID NO: 3488782 - DNA, 17 bp, Homo sapiens
ctggagcctggtgccct

SEQ ID NO: 3488783 - DNA, 23 bp, Homo sapiens
ctggagctctgtgggtctctgga

SEQ ID NO: 3488784 - DNA, 18 bp, Homo sapiens
ctggaggaacacttgatg

SEQ ID NO: 3488785 - DNA, 12 bp, Homo sapiens
ctggaggcccag

SEQ ID NO: 3488786 - DNA, 13 bp, Homo sapiens
ctggaggcccagg

SEQ ID NO: 3488787 - DNA, 17 bp, Homo sapiens
ctggaggcccaggctgg

SEQ ID NO: 3488788 - DNA, 18 bp, Homo sapiens
ctggaggcccaggctggg

SEQ ID NO: 3488789 - DNA, 14 bp, Homo sapiens
ctggaggcccagtt

SEQ ID NO: 3488790 - DNA, 16 bp, Homo sapiens
ctggaggcctcaggtg

SEQ ID NO: 3488791 - DNA, 21 bp, Homo sapiens
ctggaggcctcaggtgctgtc

SEQ ID NO: 3488792 - DNA, 14 bp, Homo sapiens
ctggaggtcagcat

SEQ ID NO: 3488793 - DNA, 20 bp, Homo sapiens
ctggaggtggctgagcccct

SEQ ID NO: 3488794 - DNA, 18 bp, Homo sapiens
ctggagtcccaaatgtca

SEQ ID NO: 3488795 - DNA, 16 bp, Homo sapiens
ctggagttgatctgga

SEQ ID NO: 3488796 - DNA, 14 bp, Homo sapiens
ctggagttgcattg

SEQ ID NO: 3488797 - DNA, 13 bp, Homo sapiens
ctggagtttcatg

SEQ ID NO: 3488798 - DNA, 18 bp, Homo sapiens
ctggagtttcatgtacaa

SEQ ID NO: 3488799 - DNA, 14 bp, Homo sapiens
ctggagtttgggat

SEQ ID NO: 3488800 - DNA, 22 bp, Homo sapiens
ctggatgggcctttgagcctga

SEQ ID NO: 3488801 - DNA, 21 bp, Homo sapiens
ctggatggtgtgccttccaga

SEQ ID NO: 3488802 - DNA, 14 bp, Homo sapiens
ctggatgtccagag

SEQ ID NO: 3488803 - DNA, 17 bp, Homo sapiens
ctggatgtctgaacttt

SEQ ID NO: 3488804 - DNA, 19 bp, Homo sapiens
ctggcaaaaggatctttgt

SEQ ID NO: 3488805 - DNA, 16 bp, Homo sapiens
ctggcaaggacacaga

SEQ ID NO: 3488806 - DNA, 17 bp, Homo sapiens
ctggcaaggacacagat

SEQ ID NO: 3488807 - DNA, 17 bp, Homo sapiens
ctggcacccggcccctg

SEQ ID NO: 3488808 - DNA, 12 bp, Homo sapiens
ctgcctccctag

SEQ ID NO: 3488809 - DNA, 23 bp, Homo sapiens
ctgcctccgcgtgatcaaagcca

SEQ ID NO: 3488810 - DNA, 16 bp, Homo sapiens
ctgcctcctactccag

SEQ ID NO: 3488811 - DNA, 18 bp, Homo sapiens
ctgcctcgaaacacagaa

SEQ ID NO: 3488812 - DNA, 15 bp, Homo sapiens
ctgcctcgaactggc

SEQ ID NO: 3488813 - DNA, 20 bp, Homo sapiens
ctgcctcgaactggctgcaa

SEQ ID NO: 3488814 - DNA, 22 bp, Homo sapiens
ctgcctctgacacacagctctg

SEQ ID NO: 3488815 - DNA, 20 bp, Homo sapiens
ctgcctcttcccggagaatc

SEQ ID NO: 3488816 - DNA, 22 bp, Homo sapiens
ctgcctcttctgggagggcagc

SEQ ID NO: 3488817 - DNA, 19 bp, Homo sapiens
ctgcctgaagtcacacagt

SEQ ID NO: 3488818 - DNA, 23 bp, Homo sapiens
ctgcctgaagtcacacagtgagt

SEQ ID NO: 3488819 - DNA, 16 bp, Homo sapiens
ctgcctgacaaggcca

SEQ ID NO: 3488820 - DNA, 19 bp, Homo sapiens
ctgcctgacaaggccagca

SEQ ID NO: 3488821 - DNA, 17 bp, Homo sapiens
ctgcctgacaggctgtg

SEQ ID NO: 3488822 - DNA, 20 bp, Homo sapiens
ctgcctgacaggctgtgact

SEQ ID NO: 3488823 - DNA, 15 bp, Homo sapiens
ctgcctgcacccctg

SEQ ID NO: 3488824 - DNA, 20 bp, Homo sapiens
ctgcctgccagctgcactga

SEQ ID NO: 3488825 - DNA, 21 bp, Homo sapiens
ctgcctgccagctgcactgat

SEQ ID NO: 3488826 - DNA, 20 bp, Homo sapiens
ctgcctgcccaggcccctgc

SEQ ID NO: 3488827 - DNA, 22 bp, Homo sapiens
ctgcctgcccaggcccctgcca

SEQ ID NO: 3488828 - DNA, 23 bp, Homo sapiens
ctgcctgccggtaaacacgcctg

SEQ ID NO: 3488829 - DNA, 13 bp, Homo sapiens
ctgcctgctttgg

SEQ ID NO: 3488830 - DNA, 20 bp, Homo sapiens
ctgcctgggttttgttccct

SEQ ID NO: 3488831 - DNA, 19 bp, Homo sapiens
ctgcctgtagcccactctg

SEQ ID NO: 3488832 - DNA, 20 bp, Homo sapiens
ctgcctgtagcccactctgc

SEQ ID NO: 3488833 - DNA, 23 bp, Homo sapiens
ctgcctgtctgccccagcccaga

SEQ ID NO: 3488834 - DNA, 23 bp, Homo sapiens
ctgcctgtggcgccgtctccagg

SEQ ID NO: 3488835 - DNA, 21 bp, Homo sapiens
ctgccttaccgagagccaaac

SEQ ID NO: 3488836 - DNA, 18 bp, Homo sapiens
ctgccttagcttcaggaa

SEQ ID NO: 3488837 - DNA, 21 bp, Homo sapiens
ctgccttcctcctgggccctc

SEQ ID NO: 3488838 - DNA, 20 bp, Homo sapiens
ctgccttcgaggtcagagga

SEQ ID NO: 3488839 - DNA, 13 bp, Homo sapiens
ctgccttcgcttc

SEQ ID NO: 3488840 - DNA, 14 bp, Homo sapiens
ctgccttcgcttct

SEQ ID NO: 3488841 - DNA, 20 bp, Homo sapiens
ctgccttcgcttcttgcctc

SEQ ID NO: 3488842 - DNA, 18 bp, Homo sapiens
ctgccttgcctcctcagt

SEQ ID NO: 3488843 - DNA, 14 bp, Homo sapiens
ctgccttggctcag

SEQ ID NO: 3488844 - DNA, 17 bp, Homo sapiens
ctgccttggctcagaca

SEQ ID NO: 3488845 - DNA, 24 bp, Homo sapiens
ctgcctttattgtgtttgtcatta

SEQ ID NO: 3488846 - DNA, 14 bp, Homo sapiens
ctgcctttgcctcc

SEQ ID NO: 3488847 - DNA, 16 bp, Homo sapiens
ctgcgacgcttgctct

SEQ ID NO: 3488848 - DNA, 14 bp, Homo sapiens
ctgcgactttctgc

SEQ ID NO: 3488849 - DNA, 18 bp, Homo sapiens
ctgcgactttctgcctgg

SEQ ID NO: 3488850 - DNA, 19 bp, Homo sapiens
ctgcgactttctgcctgga

SEQ ID NO: 3488851 - DNA, 20 bp, Homo sapiens
ctgcgcctgctgcatgccct

SEQ ID NO: 3488852 - DNA, 23 bp, Homo sapiens
ctgcgcctgctgcatgccctctc

SEQ ID NO: 3488853 - DNA, 20 bp, Homo sapiens
ctgcggagagaggccttgtc

SEQ ID NO: 3488854 - DNA, 12 bp, Homo sapiens
ctgcggccagag

SEQ ID NO: 3488855 - DNA, 15 bp, Homo sapiens
ctgcggccagagccg

SEQ ID NO: 3488856 - DNA, 16 bp, Homo sapiens
ctgcggccagagccga

SEQ ID NO: 3488857 - DNA, 18 bp, Homo sapiens
ctgcgggaagctgacctt

SEQ ID NO: 3488858 - DNA, 22 bp, Homo sapiens
ctgcgggaagctgacctttaac

SEQ ID NO: 3488859 - DNA, 22 bp, Homo sapiens
ctgcgggtgaacaaagcagcca

SEQ ID NO: 3488860 - DNA, 16 bp, Homo sapiens
ctgcggtccacccagg

SEQ ID NO: 3488861 - DNA, 18 bp, Homo sapiens
ctgcggtccacccaggag

SEQ ID NO: 3488862 - DNA, 22 bp, Homo sapiens
ctgcgtgccagtcaagaagaaa

SEQ ID NO: 3488863 - DNA, 18 bp, Homo sapiens
ctgctacctcccttgcct

SEQ ID NO: 3488864 - DNA, 22 bp, Homo sapiens
ctgctactcataagttggacca

SEQ ID NO: 3488865 - DNA, 17 bp, Homo sapiens
ctgctactctgttcctt

SEQ ID NO: 3488866 - DNA, 22 bp, Homo sapiens
ctgctactctgttccttcacat

SEQ ID NO: 3488867 - DNA, 16 bp, Homo sapiens
ctgctagagacgctga

SEQ ID NO: 3488868 - DNA, 12 bp, Homo sapiens
ctgctagatctt

SEQ ID NO: 3488869 - DNA, 23 bp, Homo sapiens
ctgctagatctttattatggaaa

SEQ ID NO: 3488870 - DNA, 15 bp, Homo sapiens
ctgctatagcctggg

SEQ ID NO: 3488871 - DNA, 14 bp, Homo sapiens
ctgctcagctctgg

SEQ ID NO: 3488872 - DNA, 15 bp, Homo sapiens
ctgctcagctctggt

SEQ ID NO: 3488873 - DNA, 13 bp, Homo sapiens
ctgctcagcttct

SEQ ID NO: 3488874 - DNA, 15 bp, Homo sapiens
ctgctcagcttctcc

SEQ ID NO: 3488875 - DNA, 14 bp, Homo sapiens
ctgctccagacctg

SEQ ID NO: 3488876 - DNA, 21 bp, Homo sapiens
ctgctccagacctgatcctgg

SEQ ID NO: 3488877 - DNA, 14 bp, Homo sapiens
ctgctccagctgtt

SEQ ID NO: 3488878 - DNA, 19 bp, Homo sapiens
ctgctccagctgttcagct

SEQ ID NO: 3488879 - DNA, 20 bp, Homo sapiens
ctgctccccagcagcggaac

SEQ ID NO: 3488880 - DNA, 16 bp, Homo sapiens
ctgctccccaggggag

SEQ ID NO: 3488881 - DNA, 16 bp, Homo sapiens
ctgctcctccctctga

SEQ ID NO: 3488882 - DNA, 23 bp, Homo sapiens
ctgctcctctccccagcaagtga

SEQ ID NO: 3488883 - DNA, 13 bp, Homo sapiens
ctgctctcagcct

SEQ ID NO: 3488884 - DNA, 16 bp, Homo sapiens
ctgctctcagcctccc

SEQ ID NO: 3488885 - DNA, 12 bp, Homo sapiens
ctgctctccttc

SEQ ID NO: 3488886 - DNA, 16 bp, Homo sapiens
ctgctctccttcctgg

SEQ ID NO: 3488887 - DNA, 16 bp, Homo sapiens
ctgctctgagccacag

SEQ ID NO: 3488888 - DNA, 18 bp, Homo sapiens
ctgctgacagacacaggc

SEQ ID NO: 3488889 - DNA, 23 bp, Homo sapiens
ctgctgacagacacaggcccggc

SEQ ID NO: 3488890 - DNA, 15 bp, Homo sapiens
ctgctgacagtgttg

SEQ ID NO: 3488891 - DNA, 16 bp, Homo sapiens
ctgctgacctccacag

SEQ ID NO: 3488892 - DNA, 18 bp, Homo sapiens
ctgctgacctccacagct

SEQ ID NO: 3488893 - DNA, 19 bp, Homo sapiens
ctgctgacctccacagctt

SEQ ID NO: 3488894 - DNA, 20 bp, Homo sapiens
ctgctgagatacatacagaa

SEQ ID NO: 3488895 - DNA, 16 bp, Homo sapiens
ctgctgccccgcttcc

SEQ ID NO: 3488896 - DNA, 20 bp, Homo sapiens
ctgctgccccgcttccccac

SEQ ID NO: 3488897 - DNA, 23 bp, Homo sapiens
ctgctgccccgcttccccacaga

SEQ ID NO: 3488898 - DNA, 23 bp, Homo sapiens
ctgctgccctagttttctttcct

SEQ ID NO: 3488899 - DNA, 15 bp, Homo sapiens
ctgctgctcctccct

SEQ ID NO: 3488900 - DNA, 19 bp, Homo sapiens
ctgctgctgccagggcttc

SEQ ID NO: 3488901 - DNA, 16 bp, Homo sapiens
ctgctgcttctccaaa

SEQ ID NO: 3488902 - DNA, 21 bp, Homo sapiens
ctgctggaggcctcaggtgct

SEQ ID NO: 3488903 - DNA, 15 bp, Homo sapiens
ctgctggcccagcca

SEQ ID NO: 3488904 - DNA, 22 bp, Homo sapiens
ctgctggcccagccaaaccctg

SEQ ID NO: 3488905 - DNA, 23 bp, Homo sapiens
ctgctgggatggtgggcttcagg

SEQ ID NO: 3488906 - DNA, 11 bp, Homo sapiens
ctgctgggccc

SEQ ID NO: 3488907 - DNA, 15 bp, Homo sapiens
ctgctggttcagggt

SEQ ID NO: 3488908 - DNA, 15 bp, Homo sapiens
ctgctgtcacctctc

SEQ ID NO: 3488909 - DNA, 16 bp, Homo sapiens
ctgctgtccagtgcct

SEQ ID NO: 3488910 - DNA, 20 bp, Homo sapiens
ctgctgtccagtgcctacat

SEQ ID NO: 3488911 - DNA, 11 bp, Homo sapiens
ctgctgtctct

SEQ ID NO: 3488912 - DNA, 14 bp, Homo sapiens
ctgctgtctctctg

SEQ ID NO: 3488913 - DNA, 17 bp, Homo sapiens
ctgctgtctctctgggc

SEQ ID NO: 3488914 - DNA, 16 bp, Homo sapiens
ctgcttaaaaatgtag

SEQ ID NO: 3488915 - DNA, 23 bp, Homo sapiens
ctgcttcagcctcccgagtagct

SEQ ID NO: 3488916 - DNA, 15 bp, Homo sapiens
ctgcttcatttttgt

SEQ ID NO: 3488917 - DNA, 19 bp, Homo sapiens
ctgcttcatttttgtaata

SEQ ID NO: 3488918 - DNA, 15 bp, Homo sapiens
ctgcttccaggctgg

SEQ ID NO: 3488919 - DNA, 23 bp, Homo sapiens
ctgcttcccaggttcaagcgatt

SEQ ID NO: 3488920 - DNA, 17 bp, Homo sapiens
ctgcttcccatgcctgc

SEQ ID NO: 3488921 - DNA, 13 bp, Homo sapiens
ctgcttgaggcaa

SEQ ID NO: 3488922 - DNA, 22 bp, Homo sapiens
ctgcttgaggcaactcatctta

SEQ ID NO: 3488923 - DNA, 21 bp, Homo sapiens
ctgcttgatgggattctggac

SEQ ID NO: 3488924 - DNA, 17 bp, Homo sapiens
ctgcttggagctgagca

SEQ ID NO: 3488925 - DNA, 12 bp, Homo sapiens
ctgctttctccc

SEQ ID NO: 3488926 - DNA, 13 bp, Homo sapiens
ctgctttctcccc

SEQ ID NO: 3488927 - DNA, 17 bp, Homo sapiens
ctgcttttaactctaga

SEQ ID NO: 3488928 - DNA, 13 bp, Homo sapiens
ctgcttttggcct

SEQ ID NO: 3488929 - DNA, 19 bp, Homo sapiens
ctggaaagcccccccttat

SEQ ID NO: 3488930 - DNA, 19 bp, Homo sapiens
ctggaacaaattatttttg

SEQ ID NO: 3488931 - DNA, 23 bp, Homo sapiens
ctggaacactagacaagccagaa

SEQ ID NO: 3488932 - DNA, 20 bp, Homo sapiens
ctggaacatcatcaaggcac

SEQ ID NO: 3488933 - DNA, 13 bp, Homo sapiens
ctggaacccagac

SEQ ID NO: 3488934 - DNA, 14 bp, Homo sapiens
ctggaacccagact

SEQ ID NO: 3488935 - DNA, 18 bp, Homo sapiens
ctggaacccagactcaga

SEQ ID NO: 3488936 - DNA, 12 bp, Homo sapiens
ctggaacctcag

SEQ ID NO: 3488937 - DNA, 20 bp, Homo sapiens
ctggaacctcagcctggcca

SEQ ID NO: 3488938 - DNA, 22 bp, Homo sapiens
ctggaacctcagcctggccaga

SEQ ID NO: 3488939 - DNA, 23 bp, Homo sapiens
ctggaacctcagcctggccagac

SEQ ID NO: 3488940 - DNA, 18 bp, Homo sapiens
ctggaacctgcaaaaaat

SEQ ID NO: 3488941 - DNA, 14 bp, Homo sapiens
ctggaagagcccag

SEQ ID NO: 3488942 - DNA, 22 bp, Homo sapiens
ctggaagccaaaatgtaggctt

SEQ ID NO: 3488943 - DNA, 21 bp, Homo sapiens
ctgcaagaaaatgatgtgtac

SEQ ID NO: 3488944 - DNA, 19 bp, Homo sapiens
ctgcaagtccttttgtaaa

SEQ ID NO: 3488945 - DNA, 12 bp, Homo sapiens
ctgcaagtgctc

SEQ ID NO: 3488946 - DNA, 13 bp, Homo sapiens
ctgcaagtgctca

SEQ ID NO: 3488947 - DNA, 14 bp, Homo sapiens
ctgcaagtgctcag

SEQ ID NO: 3488948 - DNA, 17 bp, Homo sapiens
ctgcaagtgctcaggga

SEQ ID NO: 3488949 - DNA, 12 bp, Homo sapiens
ctgcaatttcta

SEQ ID NO: 3488950 - DNA, 16 bp, Homo sapiens
ctgcacaagctgcacc

SEQ ID NO: 3488951 - DNA, 11 bp, Homo sapiens
ctgcacagctt

SEQ ID NO: 3488952 - DNA, 17 bp, Homo sapiens
ctgcacagcttttccaa

SEQ ID NO: 3488953 - DNA, 23 bp, Homo sapiens
ctgcacatgactcgggggtgggg

SEQ ID NO: 3488954 - DNA, 17 bp, Homo sapiens
ctgcacccccctgggct

SEQ ID NO: 3488955 - DNA, 13 bp, Homo sapiens
ctgcaccctcagg

SEQ ID NO: 3488956 - DNA, 18 bp, Homo sapiens
ctgcaccctcaggcaggt

SEQ ID NO: 3488957 - DNA, 18 bp, Homo sapiens
ctgcactatagcctaggt

SEQ ID NO: 3488958 - DNA, 20 bp, Homo sapiens
ctgcactatagcctaggtga

SEQ ID NO: 3488959 - DNA, 15 bp, Homo sapiens
ctgcactccagcctg

SEQ ID NO: 3488960 - DNA, 20 bp, Homo sapiens
ctgcactccagcctgggtga

SEQ ID NO: 3488961 - DNA, 19 bp, Homo sapiens
ctgcactgatgctgcccct

SEQ ID NO: 3488962 - DNA, 16 bp, Homo sapiens
ctgcacttgcagactc

SEQ ID NO: 3488963 - DNA, 15 bp, Homo sapiens
ctgcagaccacgccc

SEQ ID NO: 3488964 - DNA, 15 bp, Homo sapiens
ctgcagacttcccag

SEQ ID NO: 3488965 - DNA, 21 bp, Homo sapiens
ctgcagagaaacttaagcaaa

SEQ ID NO: 3488966 - DNA, 22 bp, Homo sapiens
ctgcagagaaacttaagcaaag

SEQ ID NO: 3488967 - DNA, 12 bp, Homo sapiens
ctgcagagcaga

SEQ ID NO: 3488968 - DNA, 23 bp, Homo sapiens
ctgcagagcagatggcagatgca

SEQ ID NO: 3488969 - DNA, 17 bp, Homo sapiens
ctgcagaggccagaggc

SEQ ID NO: 3488970 - DNA, 21 bp, Homo sapiens
ctgcagaggccagaggccccc

SEQ ID NO: 3488971 - DNA, 17 bp, Homo sapiens
ctgcagagtctgcccca

SEQ ID NO: 3488972 - DNA, 12 bp, Homo sapiens
ctgcagccagct

SEQ ID NO: 3488973 - DNA, 14 bp, Homo sapiens
ctgcagccagctca

SEQ ID NO: 3488974 - DNA, 22 bp, Homo sapiens
ctgcagccagctcacgtccagg

SEQ ID NO: 3488975 - DNA, 11 bp, Homo sapiens
ctgcagcctca

SEQ ID NO: 3488976 - DNA, 22 bp, Homo sapiens
ctgcagccttgaactctgggct

SEQ ID NO: 3488977 - DNA, 16 bp, Homo sapiens
ctgcagctccctggct

SEQ ID NO: 3488978 - DNA, 12 bp, Homo sapiens
ctgcagctttgt

SEQ ID NO: 3488979 - DNA, 17 bp, Homo sapiens
ctgcaggacctgcctgt

SEQ ID NO: 3488980 - DNA, 19 bp, Homo sapiens
ctgcaggacttgagaagac

SEQ ID NO: 3488981 - DNA, 23 bp, Homo sapiens
ctgcaggacttgagaagacctca

SEQ ID NO: 3488982 - DNA, 14 bp, Homo sapiens
ctgcaggcagacac

SEQ ID NO: 3488983 - DNA, 15 bp, Homo sapiens
ctgcaggcagacacg

SEQ ID NO: 3488984 - DNA, 17 bp, Homo sapiens
ctgcaggcagacacgga

SEQ ID NO: 3488985 - DNA, 11 bp, Homo sapiens
ctgcaggcagg

SEQ ID NO: 3488986 - DNA, 17 bp, Homo sapiens
ctgcaggccaggccagc

SEQ ID NO: 3488987 - DNA, 18 bp, Homo sapiens
ctgcaggccaggccagct

SEQ ID NO: 3488988 - DNA, 14 bp, Homo sapiens
ctgcaggccctggc

SEQ ID NO: 3488989 - DNA, 22 bp, Homo sapiens
ctgcaggcctaggtgcagctcc

SEQ ID NO: 3488990 - DNA, 22 bp, Homo sapiens
ctgcagggagtccgaaagggac

SEQ ID NO: 3488991 - DNA, 21 bp, Homo sapiens
ctgcaggggtctgggagtcag

SEQ ID NO: 3488992 - DNA, 22 bp, Homo sapiens
ctgcaggggtctgggagtcagg

SEQ ID NO: 3488993 - DNA, 23 bp, Homo sapiens
ctgcagtcaacagttcaaagaag

SEQ ID NO: 3488994 - DNA, 21 bp, Homo sapiens
ctgcatatgttgaatactttt

SEQ ID NO: 3488995 - DNA, 21 bp, Homo sapiens
ctgcatccagagattcatttt

SEQ ID NO: 3488996 - DNA, 22 bp, Homo sapiens
ctgcatcgtttcatcttccaac

SEQ ID NO: 3488997 - DNA, 17 bp, Homo sapiens
ctgcatctaagcccatg

SEQ ID NO: 3488998 - DNA, 13 bp, Homo sapiens
ctgcatgatgttt

SEQ ID NO: 3488999 - DNA, 19 bp, Homo sapiens
ctgcatgccctctcaggcc

SEQ ID NO: 3489000 - DNA, 17 bp, Homo sapiens
ctgcatgtctactcagc

SEQ ID NO: 3489001 - DNA, 20 bp, Homo sapiens
ctgcattaccgcgttgtaaa

SEQ ID NO: 3489002 - DNA, 14 bp, Homo sapiens
ctgcattcttaaca

SEQ ID NO: 3489003 - DNA, 17 bp, Homo sapiens
ctgcattgcccagtctt

SEQ ID NO: 3489004 - DNA, 13 bp, Homo sapiens
ctgcattggcttt

SEQ ID NO: 3489005 - DNA, 14 bp, Homo sapiens
ctgcattgtaaata

SEQ ID NO: 3489006 - DNA, 18 bp, Homo sapiens
ctgcatttagctgtattc

SEQ ID NO: 3489007 - DNA, 17 bp, Homo sapiens
ctgcattttcaccccac

SEQ ID NO: 3489008 - DNA, 22 bp, Homo sapiens
ctgccaaaatgctctagtgcct

SEQ ID NO: 3489009 - DNA, 21 bp, Homo sapiens
ctgccaacttcttcagagctg

SEQ ID NO: 3489010 - DNA, 18 bp, Homo sapiens
ctgccacaccctccccat

SEQ ID NO: 3489011 - DNA, 13 bp, Homo sapiens
ctgccaccaccct

SEQ ID NO: 3489012 - DNA, 15 bp, Homo sapiens
ctgccaccaccctgt

SEQ ID NO: 3489013 - DNA, 18 bp, Homo sapiens
ctctccccacgagggctg

SEQ ID NO: 3489014 - DNA, 22 bp, Homo sapiens
ctctccccagcaagtgagagct

SEQ ID NO: 3489015 - DNA, 13 bp, Homo sapiens
ctctccccagccc

SEQ ID NO: 3489016 - DNA, 16 bp, Homo sapiens
ctctccccagcccaga

SEQ ID NO: 3489017 - DNA, 20 bp, Homo sapiens
ctctccccagcccagagaca

SEQ ID NO: 3489018 - DNA, 20 bp, Homo sapiens
ctctccccaggtccagctct

SEQ ID NO: 3489019 - DNA, 23 bp, Homo sapiens
ctctccccaggtccagctctgga

SEQ ID NO: 3489020 - DNA, 15 bp, Homo sapiens
ctctcccctgacctg

SEQ ID NO: 3489021 - DNA, 17 bp, Homo sapiens
ctctccctcccctgcca

SEQ ID NO: 3489022 - DNA, 23 bp, Homo sapiens
ctctccctctaggctctgccttc

SEQ ID NO: 3489023 - DNA, 12 bp, Homo sapiens
ctctccctgacc

SEQ ID NO: 3489024 - DNA, 21 bp, Homo sapiens
ctctccgaccagacaccttga

SEQ ID NO: 3489025 - DNA, 13 bp, Homo sapiens
ctctcctccgtgg

SEQ ID NO: 3489026 - DNA, 16 bp, Homo sapiens
ctctcctgtcctccct

SEQ ID NO: 3489027 - DNA, 16 bp, Homo sapiens
ctctccttcctggagc

SEQ ID NO: 3489028 - DNA, 12 bp, Homo sapiens
ctctcggaactg

SEQ ID NO: 3489029 - DNA, 16 bp, Homo sapiens
ctctcggaactgcatg

SEQ ID NO: 3489030 - DNA, 19 bp, Homo sapiens
ctctcggaactgcatgctg

SEQ ID NO: 3489031 - DNA, 20 bp, Homo sapiens
ctctcggaactgcatgctgc

SEQ ID NO: 3489032 - DNA, 23 bp, Homo sapiens
ctctcggaactgcatgctgctgg

SEQ ID NO: 3489033 - DNA, 17 bp, Homo sapiens
ctctctccagatgtttc

SEQ ID NO: 3489034 - DNA, 14 bp, Homo sapiens
ctctctcctcctgc

SEQ ID NO: 3489035 - DNA, 20 bp, Homo sapiens
ctctctcctgtactttttcc

SEQ ID NO: 3489036 - DNA, 21 bp, Homo sapiens
ctctctcttcttattacccaa

SEQ ID NO: 3489037 - DNA, 18 bp, Homo sapiens
ctctctgagtcctggccc

SEQ ID NO: 3489038 - DNA, 20 bp, Homo sapiens
ctctctgagtcctggcccaa

SEQ ID NO: 3489039 - DNA, 11 bp, Homo sapiens
ctctctgccct

SEQ ID NO: 3489040 - DNA, 12 bp, Homo sapiens
ctctctgccctg

SEQ ID NO: 3489041 - DNA, 14 bp, Homo sapiens
ctctctgccctgtg

SEQ ID NO: 3489042 - DNA, 17 bp, Homo sapiens
ctctctgccctgtgtac

SEQ ID NO: 3489043 - DNA, 18 bp, Homo sapiens
ctctctgtcccttgctgt

SEQ ID NO: 3489044 - DNA, 19 bp, Homo sapiens
ctctctgtcccttgctgta

SEQ ID NO: 3489045 - DNA, 19 bp, Homo sapiens
ctctcttatagaatattta

SEQ ID NO: 3489046 - DNA, 21 bp, Homo sapiens
ctctcttatagaatatttatt

SEQ ID NO: 3489047 - DNA, 23 bp, Homo sapiens
ctctcttatagaatatttattac

SEQ ID NO: 3489048 - DNA, 18 bp, Homo sapiens
ctctcttcttattaccca

SEQ ID NO: 3489049 - DNA, 22 bp, Homo sapiens
ctctcttgggccaagccagctg

SEQ ID NO: 3489050 - DNA, 23 bp, Homo sapiens
ctctcttgggccaagccagctgc

SEQ ID NO: 3489051 - DNA, 13 bp, Homo sapiens
ctctcttgtcaga

SEQ ID NO: 3489052 - DNA, 18 bp, Homo sapiens
ctctctttgggaatgttt

SEQ ID NO: 3489053 - DNA, 16 bp, Homo sapiens
ctctgaaacagctgcc

SEQ ID NO: 3489054 - DNA, 17 bp, Homo sapiens
ctctgaaacagctgcct

SEQ ID NO: 3489055 - DNA, 20 bp, Homo sapiens
ctctgaaacagctgccttag

SEQ ID NO: 3489056 - DNA, 23 bp, Homo sapiens
ctctgaaacagctgccttagctt

SEQ ID NO: 3489057 - DNA, 17 bp, Homo sapiens
ctctgaaaccagtgtta

SEQ ID NO: 3489058 - DNA, 22 bp, Homo sapiens
ctctgaaagttgtacatgaaat

SEQ ID NO: 3489059 - DNA, 21 bp, Homo sapiens
ctctgaagagtgggtttcaca

SEQ ID NO: 3489060 - DNA, 22 bp, Homo sapiens
ctctgaagggcatcatgcatct

SEQ ID NO: 3489061 - DNA, 17 bp, Homo sapiens
ctctgacacacagctct

SEQ ID NO: 3489062 - DNA, 19 bp, Homo sapiens
ctctgacacacagctctgt

SEQ ID NO: 3489063 - DNA, 20 bp, Homo sapiens
ctctgaccccagcattctca

SEQ ID NO: 3489064 - DNA, 23 bp, Homo sapiens
ctctgaccgaaacagcgctgggt

SEQ ID NO: 3489065 - DNA, 16 bp, Homo sapiens
ctctgactcagggctc

SEQ ID NO: 3489066 - DNA, 17 bp, Homo sapiens
ctctgactcagggctcc

SEQ ID NO: 3489067 - DNA, 20 bp, Homo sapiens
ctctgactcagggctcctgg

SEQ ID NO: 3489068 - DNA, 14 bp, Homo sapiens
ctctgactccactc

SEQ ID NO: 3489069 - DNA, 18 bp, Homo sapiens
ctctgactccactcaaag

SEQ ID NO: 3489070 - DNA, 19 bp, Homo sapiens
ctctgactccactcaaaga

SEQ ID NO: 3489071 - DNA, 13 bp, Homo sapiens
ctctgacttctgc

SEQ ID NO: 3489072 - DNA, 15 bp, Homo sapiens
ctctgacttctgcct

SEQ ID NO: 3489073 - DNA, 17 bp, Homo sapiens
ctctgacttctgcctgg

SEQ ID NO: 3489074 - DNA, 15 bp, Homo sapiens
ctctgagctgtgcag

SEQ ID NO: 3489075 - DNA, 16 bp, Homo sapiens
ctctgaggacactaac

SEQ ID NO: 3489076 - DNA, 17 bp, Homo sapiens
ctctgagtgttttatga

SEQ ID NO: 3489077 - DNA, 22 bp, Homo sapiens
ctctgagtgttttatgagaaag

SEQ ID NO: 3489078 - DNA, 12 bp, Homo sapiens
ctctgatccctc

SEQ ID NO: 3489079 - DNA, 20 bp, Homo sapiens
ctctgatccctctgggggct

SEQ ID NO: 3489080 - DNA, 22 bp, Homo sapiens
ctctgatccctctgggggctct

SEQ ID NO: 3489081 - DNA, 12 bp, Homo sapiens
ctctgcaagtgc

SEQ ID NO: 3489082 - DNA, 16 bp, Homo sapiens
ctctgcaagtgctcag

SEQ ID NO: 3489083 - DNA, 17 bp, Homo sapiens
ctctgcacaagctgcac

SEQ ID NO: 3489084 - DNA, 21 bp, Homo sapiens
ctctgcacctgtaggatattg

SEQ ID NO: 3489085 - DNA, 19 bp, Homo sapiens
ctctgcagacttcccagct

SEQ ID NO: 3489086 - DNA, 23 bp, Homo sapiens
ctctgccaacttcttcagagctg

SEQ ID NO: 3489087 - DNA, 14 bp, Homo sapiens
ctctgcccaaccct

SEQ ID NO: 3489088 - DNA, 24 bp, Homo sapiens
ctctgccccatcctccagcaggga

SEQ ID NO: 3489089 - DNA, 19 bp, Homo sapiens
ctctgccgctacctccctc

SEQ ID NO: 3489090 - DNA, 21 bp, Homo sapiens
ctctgccgctacctccctccc

SEQ ID NO: 3489091 - DNA, 19 bp, Homo sapiens
ctctgcctctgacacacag

SEQ ID NO: 3489092 - DNA, 18 bp, Homo sapiens
ctctgcctcttcccggag

SEQ ID NO: 3489093 - DNA, 10 bp, Homo sapiens
ctctgcctga

SEQ ID NO: 3489094 - DNA, 21 bp, Homo sapiens
ctctgcctgaagtcacacagt

SEQ ID NO: 3489095 - DNA, 20 bp, Homo sapiens
ctctgcctgacaaggccagc

SEQ ID NO: 3489096 - DNA, 21 bp, Homo sapiens
ctctgcctgacaaggccagca

SEQ ID NO: 3489097 - DNA, 14 bp, Homo sapiens
ctctgccttgcctt

SEQ ID NO: 3489098 - DNA, 22 bp, Homo sapiens
ctctgcgtgtcacctgtgcttc

SEQ ID NO: 3489099 - DNA, 18 bp, Homo sapiens
ctctgctcctctccccag

SEQ ID NO: 3489100 - DNA, 21 bp, Homo sapiens
ctctgctcctctccccagcaa

SEQ ID NO: 3489101 - DNA, 16 bp, Homo sapiens
ctctgctcgccttagc

SEQ ID NO: 3489102 - DNA, 16 bp, Homo sapiens
ctctgctgacagacac

SEQ ID NO: 3489103 - DNA, 21 bp, Homo sapiens
ctctgctgacagacacaggcc

SEQ ID NO: 3489104 - DNA, 13 bp, Homo sapiens
ctctgcttcccag

SEQ ID NO: 3489105 - DNA, 16 bp, Homo sapiens
ctctgcttctctgact

SEQ ID NO: 3489106 - DNA, 17 bp, Homo sapiens
ctctggaagattttcat

SEQ ID NO: 3489107 - DNA, 20 bp, Homo sapiens
ctctggaagattttcattga

SEQ ID NO: 3489108 - DNA, 15 bp, Homo sapiens
ctctggacagcccca

SEQ ID NO: 3489109 - DNA, 16 bp, Homo sapiens
ctctggacaggcatgt

SEQ ID NO: 3489110 - DNA, 22 bp, Homo sapiens
ctctggacaggcatgttctctg

SEQ ID NO: 3489111 - DNA, 15 bp, Homo sapiens
ctctggagtggccac

SEQ ID NO: 3489112 - DNA, 16 bp, Homo sapiens
ctctggagtggccact

SEQ ID NO: 3489113 - DNA, 20 bp, Homo sapiens
ctctggagtggccactaagc

SEQ ID NO: 3489114 - DNA, 15 bp, Homo sapiens
ctctggatgcctgat

SEQ ID NO: 3489115 - DNA, 18 bp, Homo sapiens
ctctggccaagggccaga

SEQ ID NO: 3489116 - DNA, 16 bp, Homo sapiens
ctctggccccaggctt

SEQ ID NO: 3489117 - DNA, 18 bp, Homo sapiens
ctctggccccaggcttgt

SEQ ID NO: 3489118 - DNA, 11 bp, Homo sapiens
ctctggctctg

SEQ ID NO: 3489119 - DNA, 17 bp, Homo sapiens
ctctggcttggcctatc

SEQ ID NO: 3489120 - DNA, 21 bp, Homo sapiens
ctctgggagaaaatcatcaag

SEQ ID NO: 3489121 - DNA, 20 bp, Homo sapiens
ctctgggccattctccacag

SEQ ID NO: 3489122 - DNA, 15 bp, Homo sapiens
ctctggggctgtgtt

SEQ ID NO: 3489123 - DNA, 18 bp, Homo sapiens
ctctgggggctctggcca

SEQ ID NO: 3489124 - DNA, 17 bp, Homo sapiens
ctctgggtcagtggtcc

SEQ ID NO: 3489125 - DNA, 20 bp, Homo sapiens
ctctgggtcagtggtccaca

SEQ ID NO: 3489126 - DNA, 15 bp, Homo sapiens
ctctgggtccttcct

SEQ ID NO: 3489127 - DNA, 16 bp, Homo sapiens
ctctgggtccttcctg

SEQ ID NO: 3489128 - DNA, 16 bp, Homo sapiens
ctctggtgataaggac

SEQ ID NO: 3489129 - DNA, 17 bp, Homo sapiens
ctctggtgataaggaca

SEQ ID NO: 3489130 - DNA, 11 bp, Homo sapiens
ctctgtacttt

SEQ ID NO: 3489131 - DNA, 14 bp, Homo sapiens
ctctgtcagtcaca

SEQ ID NO: 3489132 - DNA, 19 bp, Homo sapiens
ctctgtccagctcccgctg

SEQ ID NO: 3489133 - DNA, 22 bp, Homo sapiens
ctctgtcccacttggcatcagc

SEQ ID NO: 3489134 - DNA, 21 bp, Homo sapiens
ctctgtccccttctctcatct

SEQ ID NO: 3489135 - DNA, 15 bp, Homo sapiens
ctctgtcccttgctg

SEQ ID NO: 3489136 - DNA, 16 bp, Homo sapiens
ctctgtcccttgctgt

SEQ ID NO: 3489137 - DNA, 13 bp, Homo sapiens
ctctgtcgcccag

SEQ ID NO: 3489138 - DNA, 14 bp, Homo sapiens
ctctgtctcatcca

SEQ ID NO: 3489139 - DNA, 14 bp, Homo sapiens
ctctgtcttctgga

SEQ ID NO: 3489140 - DNA, 23 bp, Homo sapiens
ctctgtgaacgatttagaaagaa

SEQ ID NO: 3489141 - DNA, 18 bp, Homo sapiens
ctctgtgaagcattcgag

SEQ ID NO: 3489142 - DNA, 15 bp, Homo sapiens
ctctgtgaccaatgt

SEQ ID NO: 3489143 - DNA, 20 bp, Homo sapiens
ctctgtgggtctctggaaga

SEQ ID NO: 3489144 - DNA, 22 bp, Homo sapiens
ctctgtgggtgatggggagggg

SEQ ID NO: 3489145 - DNA, 21 bp, Homo sapiens
ctctgtgtatgagtgtgaatg

SEQ ID NO: 3489146 - DNA, 21 bp, Homo sapiens
ctctgtgtcaggtggggcagc

SEQ ID NO: 3489147 - DNA, 22 bp, Homo sapiens
ctctgtgtcaggtggggcagct

SEQ ID NO: 3489148 - DNA, 13 bp, Homo sapiens
ctcctagagggag

SEQ ID NO: 3489149 - DNA, 15 bp, Homo sapiens
ctcctagagggaggg

SEQ ID NO: 3489150 - DNA, 15 bp, Homo sapiens
ctcctatatatttct

SEQ ID NO: 3489151 - DNA, 16 bp, Homo sapiens
ctcctcacacttactg

SEQ ID NO: 3489152 - DNA, 23 bp, Homo sapiens
ctcctcaggcacacagctactct

SEQ ID NO: 3489153 - DNA, 21 bp, Homo sapiens
ctcctcagtatgtgggggctt

SEQ ID NO: 3489154 - DNA, 22 bp, Homo sapiens
ctcctcagtatgtgggggcttc

SEQ ID NO: 3489155 - DNA, 15 bp, Homo sapiens
ctcctcccacccggc

SEQ ID NO: 3489156 - DNA, 22 bp, Homo sapiens
ctcctcccacccggctgcagag

SEQ ID NO: 3489157 - DNA, 22 bp, Homo sapiens
ctcctcccccctcctctgaaac

SEQ ID NO: 3489158 - DNA, 23 bp, Homo sapiens
ctcctccctgcatctgaccagca

SEQ ID NO: 3489159 - DNA, 13 bp, Homo sapiens
ctcctccgtggca

SEQ ID NO: 3489160 - DNA, 16 bp, Homo sapiens
ctcctcgacatcactg

SEQ ID NO: 3489161 - DNA, 16 bp, Homo sapiens
ctcctcgcaagctggg

SEQ ID NO: 3489162 - DNA, 19 bp, Homo sapiens
ctcctcgcaagctgggtaa

SEQ ID NO: 3489163 - DNA, 14 bp, Homo sapiens
ctcctctcagtgtt

SEQ ID NO: 3489164 - DNA, 23 bp, Homo sapiens
ctcctctcccattgtccctctgc

SEQ ID NO: 3489165 - DNA, 13 bp, Homo sapiens
ctcctctccccag

SEQ ID NO: 3489166 - DNA, 22 bp, Homo sapiens
ctcctctccccagcaagtgaga

SEQ ID NO: 3489167 - DNA, 17 bp, Homo sapiens
ctcctctccccagccca

SEQ ID NO: 3489168 - DNA, 18 bp, Homo sapiens
ctcctctccccagcccag

SEQ ID NO: 3489169 - DNA, 12 bp, Homo sapiens
ctcctctgaaac

SEQ ID NO: 3489170 - DNA, 13 bp, Homo sapiens
ctcctctgaaaca

SEQ ID NO: 3489171 - DNA, 19 bp, Homo sapiens
ctcctctgactcagggctc

SEQ ID NO: 3489172 - DNA, 12 bp, Homo sapiens
ctcctcttgtaa

SEQ ID NO: 3489173 - DNA, 19 bp, Homo sapiens
ctcctgacccattgctgtt

SEQ ID NO: 3489174 - DNA, 16 bp, Homo sapiens
ctcctgaggctttgga

SEQ ID NO: 3489175 - DNA, 18 bp, Homo sapiens
ctcctgcacttacttgct

SEQ ID NO: 3489176 - DNA, 13 bp, Homo sapiens
ctcctgcccacgg

SEQ ID NO: 3489177 - DNA, 14 bp, Homo sapiens
ctcctgccgcagag

SEQ ID NO: 3489178 - DNA, 18 bp, Homo sapiens
ctcctgcctcgaactggc

SEQ ID NO: 3489179 - DNA, 21 bp, Homo sapiens
ctcctgcctcgaactggctgc

SEQ ID NO: 3489180 - DNA, 20 bp, Homo sapiens
ctcctgccttcctcctgggc

SEQ ID NO: 3489181 - DNA, 12 bp, Homo sapiens
ctcctgcctttg

SEQ ID NO: 3489182 - DNA, 17 bp, Homo sapiens
ctcctggagctctgtgg

SEQ ID NO: 3489183 - DNA, 19 bp, Homo sapiens
ctcctggagctctgtgggt

SEQ ID NO: 3489184 - DNA, 16 bp, Homo sapiens
ctcctggcccactgca

SEQ ID NO: 3489185 - DNA, 18 bp, Homo sapiens
ctcctggcccactgcatc

SEQ ID NO: 3489186 - DNA, 12 bp, Homo sapiens
ctcctggcccag

SEQ ID NO: 3489187 - DNA, 15 bp, Homo sapiens
ctcctgggccctctc

SEQ ID NO: 3489188 - DNA, 20 bp, Homo sapiens
ctcctgggccctctctgctc

SEQ ID NO: 3489189 - DNA, 18 bp, Homo sapiens
ctcctgggctaagtgatc

SEQ ID NO: 3489190 - DNA, 22 bp, Homo sapiens
ctcctgggttttgtattctctg

SEQ ID NO: 3489191 - DNA, 23 bp, Homo sapiens
ctcctgggttttgtattctctga

SEQ ID NO: 3489192 - DNA, 17 bp, Homo sapiens
ctcctgtgcaactttcc

SEQ ID NO: 3489193 - DNA, 22 bp, Homo sapiens
ctcctgtggccccaccctgggc

SEQ ID NO: 3489194 - DNA, 16 bp, Homo sapiens
ctcctgtgtgtgcgcc

SEQ ID NO: 3489195 - DNA, 21 bp, Homo sapiens
ctcctgtgtgtgcgcctacag

SEQ ID NO: 3489196 - DNA, 13 bp, Homo sapiens
ctcctgttctgaa

SEQ ID NO: 3489197 - DNA, 12 bp, Homo sapiens
ctccttcagaca

SEQ ID NO: 3489198 - DNA, 20 bp, Homo sapiens
ctccttcctggagcccagag

SEQ ID NO: 3489199 - DNA, 23 bp, Homo sapiens
ctccttcctggagcccagaggag

SEQ ID NO: 3489200 - DNA, 17 bp, Homo sapiens
ctccttcctggcctgag

SEQ ID NO: 3489201 - DNA, 15 bp, Homo sapiens
ctccttcctgtgtgt

SEQ ID NO: 3489202 - DNA, 13 bp, Homo sapiens
ctccttccttgtt

SEQ ID NO: 3489203 - DNA, 13 bp, Homo sapiens
ctccttctccctt

SEQ ID NO: 3489204 - DNA, 12 bp, Homo sapiens
ctccttggagga

SEQ ID NO: 3489205 - DNA, 15 bp, Homo sapiens
ctccttggaggacag

SEQ ID NO: 3489206 - DNA, 19 bp, Homo sapiens
ctccttggaggacagtggg

SEQ ID NO: 3489207 - DNA, 13 bp, Homo sapiens
ctccttgggccct

SEQ ID NO: 3489208 - DNA, 17 bp, Homo sapiens
ctccttgggccctttga

SEQ ID NO: 3489209 - DNA, 18 bp, Homo sapiens
ctccttgggccctttgag

SEQ ID NO: 3489210 - DNA, 12 bp, Homo sapiens
ctccttgttcct

SEQ ID NO: 3489211 - DNA, 15 bp, Homo sapiens
ctccttgttcctaga

SEQ ID NO: 3489212 - DNA, 17 bp, Homo sapiens
ctcctttagcgcccagt

SEQ ID NO: 3489213 - DNA, 16 bp, Homo sapiens
ctcctttcaccacccc

SEQ ID NO: 3489214 - DNA, 22 bp, Homo sapiens
ctcctttccccttccttttaag

SEQ ID NO: 3489215 - DNA, 12 bp, Homo sapiens
ctcctttgtgtg

SEQ ID NO: 3489216 - DNA, 15 bp, Homo sapiens
ctcctttgtgtgtgt

SEQ ID NO: 3489217 - DNA, 17 bp, Homo sapiens
ctcctttgttcccggct

SEQ ID NO: 3489218 - DNA, 15 bp, Homo sapiens
ctcgaaacacagaaa

SEQ ID NO: 3489219 - DNA, 19 bp, Homo sapiens
ctcgaaacacagaaacctt

SEQ ID NO: 3489220 - DNA, 13 bp, Homo sapiens
ctcgaactggctg

SEQ ID NO: 3489221 - DNA, 16 bp, Homo sapiens
ctcgaactggctgcaa

SEQ ID NO: 3489222 - DNA, 23 bp, Homo sapiens
ctcgagcagtcctgcctcagcct

SEQ ID NO: 3489223 - DNA, 13 bp, Homo sapiens
ctcgaggtgcctt

SEQ ID NO: 3489224 - DNA, 20 bp, Homo sapiens
ctcgaggtgccttcttcagg

SEQ ID NO: 3489225 - DNA, 14 bp, Homo sapiens
ctcgagtactgtgg

SEQ ID NO: 3489226 - DNA, 15 bp, Homo sapiens
ctcgattttgtatct

SEQ ID NO: 3489227 - DNA, 16 bp, Homo sapiens
ctcgattttgtatctg

SEQ ID NO: 3489228 - DNA, 13 bp, Homo sapiens
ctcgcaagctggg

SEQ ID NO: 3489229 - DNA, 18 bp, Homo sapiens
ctcgcataggacctttcc

SEQ ID NO: 3489230 - DNA, 14 bp, Homo sapiens
ctcgccaaggccta

SEQ ID NO: 3489231 - DNA, 17 bp, Homo sapiens
ctcgccaaggcctagga

SEQ ID NO: 3489232 - DNA, 14 bp, Homo sapiens
ctcgccccagcagg

SEQ ID NO: 3489233 - DNA, 15 bp, Homo sapiens
ctcgctccctcccag

SEQ ID NO: 3489234 - DNA, 18 bp, Homo sapiens
ctcgctccctcccaggac

SEQ ID NO: 3489235 - DNA, 19 bp, Homo sapiens
ctcgctgccagctctgtat

SEQ ID NO: 3489236 - DNA, 15 bp, Homo sapiens
ctcgctggactctca

SEQ ID NO: 3489237 - DNA, 18 bp, Homo sapiens
ctcgctgtcctttctaga

SEQ ID NO: 3489238 - DNA, 15 bp, Homo sapiens
ctcgctgttgctgaa

SEQ ID NO: 3489239 - DNA, 13 bp, Homo sapiens
ctcggctcagctc

SEQ ID NO: 3489240 - DNA, 13 bp, Homo sapiens
ctcggctctggag

SEQ ID NO: 3489241 - DNA, 18 bp, Homo sapiens
ctcggcttggatcctggg

SEQ ID NO: 3489242 - DNA, 11 bp, Homo sapiens
ctcggtgcctt

SEQ ID NO: 3489243 - DNA, 17 bp, Homo sapiens
ctcggtgtggagaagcg

SEQ ID NO: 3489244 - DNA, 22 bp, Homo sapiens
ctcggtttgccaaaattcattt

SEQ ID NO: 3489245 - DNA, 23 bp, Homo sapiens
ctcgttgactggctgtgtgttgg

SEQ ID NO: 3489246 - DNA, 18 bp, Homo sapiens
ctctaacagctcaggatc

SEQ ID NO: 3489247 - DNA, 22 bp, Homo sapiens
ctctaacagctcaggatctctt

SEQ ID NO: 3489248 - DNA, 17 bp, Homo sapiens
ctctaacctcgccctct

SEQ ID NO: 3489249 - DNA, 20 bp, Homo sapiens
ctctaacctcgccctctcct

SEQ ID NO: 3489250 - DNA, 12 bp, Homo sapiens
ctctaataagaa

SEQ ID NO: 3489251 - DNA, 14 bp, Homo sapiens
ctctaataagaaaa

SEQ ID NO: 3489252 - DNA, 17 bp, Homo sapiens
ctccaaaaatctgcctg

SEQ ID NO: 3489253 - DNA, 18 bp, Homo sapiens
ctccaaactgaagcagcc

SEQ ID NO: 3489254 - DNA, 14 bp, Homo sapiens
ctccaaagatgact

SEQ ID NO: 3489255 - DNA, 19 bp, Homo sapiens
ctccaaagatgacttcccc

SEQ ID NO: 3489256 - DNA, 23 bp, Homo sapiens
ctccaaatctcaatgaagccagc

SEQ ID NO: 3489257 - DNA, 15 bp, Homo sapiens
ctccaacaccaagca

SEQ ID NO: 3489258 - DNA, 22 bp, Homo sapiens
ctccaaccccccagcactgagg

SEQ ID NO: 3489259 - DNA, 19 bp, Homo sapiens
ctccaactgcctaaggccc

SEQ ID NO: 3489260 - DNA, 18 bp, Homo sapiens
ctccaagccccatcttct

SEQ ID NO: 3489261 - DNA, 22 bp, Homo sapiens
ctccacagggcttgttttccaa

SEQ ID NO: 3489262 - DNA, 14 bp, Homo sapiens
ctccacatcctcca

SEQ ID NO: 3489263 - DNA, 15 bp, Homo sapiens
ctccaccttgcgggg

SEQ ID NO: 3489264 - DNA, 13 bp, Homo sapiens
ctccactcaaaga

SEQ ID NO: 3489265 - DNA, 22 bp, Homo sapiens
ctccactcaaagagggtgaggg

SEQ ID NO: 3489266 - DNA, 12 bp, Homo sapiens
ctccactctgct

SEQ ID NO: 3489267 - DNA, 20 bp, Homo sapiens
ctccactctgcttctctgac

SEQ ID NO: 3489268 - DNA, 21 bp, Homo sapiens
ctccacttcttgttccccact

SEQ ID NO: 3489269 - DNA, 23 bp, Homo sapiens
ctccagaagatagcttcacccca

SEQ ID NO: 3489270 - DNA, 16 bp, Homo sapiens
ctccagaagcactggg

SEQ ID NO: 3489271 - DNA, 17 bp, Homo sapiens
ctccagatgcagggcag

SEQ ID NO: 3489272 - DNA, 17 bp, Homo sapiens
ctccagatgtttccaga

SEQ ID NO: 3489273 - DNA, 23 bp, Homo sapiens
ctccagccccttctcagaatcta

SEQ ID NO: 3489274 - DNA, 12 bp, Homo sapiens
ctccagcctcag

SEQ ID NO: 3489275 - DNA, 12 bp, Homo sapiens
ctccagcctgaa

SEQ ID NO: 3489276 - DNA, 19 bp, Homo sapiens
ctccagctgttcagctggt

SEQ ID NO: 3489277 - DNA, 13 bp, Homo sapiens
ctccagcttcccg

SEQ ID NO: 3489278 - DNA, 16 bp, Homo sapiens
ctccaggagcctaccc

SEQ ID NO: 3489279 - DNA, 18 bp, Homo sapiens
ctccaggagcctaccccc

SEQ ID NO: 3489280 - DNA, 19 bp, Homo sapiens
ctccaggagcctaccccct

SEQ ID NO: 3489281 - DNA, 11 bp, Homo sapiens
ctccaggagct

SEQ ID NO: 3489282 - DNA, 20 bp, Homo sapiens
ctccaggcatttagccctca

SEQ ID NO: 3489283 - DNA, 17 bp, Homo sapiens
ctccaggcccaaggctc

SEQ ID NO: 3489284 - DNA, 19 bp, Homo sapiens
ctccaggcccaaggctccc

SEQ ID NO: 3489285 - DNA, 11 bp, Homo sapiens
ctccaggctcc

SEQ ID NO: 3489286 - DNA, 22 bp, Homo sapiens
ctccaggctgtatcccatgagc

SEQ ID NO: 3489287 - DNA, 12 bp, Homo sapiens
ctccagggctgg

SEQ ID NO: 3489288 - DNA, 14 bp, Homo sapiens
ctccagggctggac

SEQ ID NO: 3489289 - DNA, 19 bp, Homo sapiens
ctccagggctggactgagg

SEQ ID NO: 3489290 - DNA, 15 bp, Homo sapiens
ctccaggggctgctt

SEQ ID NO: 3489291 - DNA, 23 bp, Homo sapiens
ctccaggggctgcttcctcctgg

SEQ ID NO: 3489292 - DNA, 20 bp, Homo sapiens
ctccaggtaccttgaccttt

SEQ ID NO: 3489293 - DNA, 16 bp, Homo sapiens
ctccagtaccttgctt

SEQ ID NO: 3489294 - DNA, 16 bp, Homo sapiens
ctccagtagtggacaa

SEQ ID NO: 3489295 - DNA, 20 bp, Homo sapiens
ctccagtatgacagaggagg

SEQ ID NO: 3489296 - DNA, 14 bp, Homo sapiens
ctccagtgccaaca

SEQ ID NO: 3489297 - DNA, 19 bp, Homo sapiens
ctccatcctcatctctctt

SEQ ID NO: 3489298 - DNA, 19 bp, Homo sapiens
ctccatctctcatcctcca

SEQ ID NO: 3489299 - DNA, 20 bp, Homo sapiens
ctccatctctcatcctccag

SEQ ID NO: 3489300 - DNA, 19 bp, Homo sapiens
ctccatggccctgccatgc

SEQ ID NO: 3489301 - DNA, 20 bp, Homo sapiens
ctccatggccctgccatgct

SEQ ID NO: 3489302 - DNA, 14 bp, Homo sapiens
ctccatgtgggcta

SEQ ID NO: 3489303 - DNA, 18 bp, Homo sapiens
ctccattcaatttcaggc

SEQ ID NO: 3489304 - DNA, 15 bp, Homo sapiens
ctccattttagccca

SEQ ID NO: 3489305 - DNA, 20 bp, Homo sapiens
ctcccaaacgccctttcctc

SEQ ID NO: 3489306 - DNA, 21 bp, Homo sapiens
ctcccaatttcagactcccat

SEQ ID NO: 3489307 - DNA, 15 bp, Homo sapiens
ctcccacaaaggaga

SEQ ID NO: 3489308 - DNA, 16 bp, Homo sapiens
ctcccacctcagcctc

SEQ ID NO: 3489309 - DNA, 17 bp, Homo sapiens
ctcccacctcagcctcc

SEQ ID NO: 3489310 - DNA, 22 bp, Homo sapiens
ctcccacgggacctggggcttt

SEQ ID NO: 3489311 - DNA, 14 bp, Homo sapiens
ctcccagcctcagc

SEQ ID NO: 3489312 - DNA, 16 bp, Homo sapiens
ctcccagtacctcctg

SEQ ID NO: 3489313 - DNA, 20 bp, Homo sapiens
ctcccataaccgctgattct

SEQ ID NO: 3489314 - DNA, 15 bp, Homo sapiens
ctcccatccagggcc

SEQ ID NO: 3489315 - DNA, 15 bp, Homo sapiens
ctcccattcctgaag

SEQ ID NO: 3489316 - DNA, 16 bp, Homo sapiens
ctcccattcctgaaga

SEQ ID NO: 3489317 - DNA, 17 bp, Homo sapiens
ctcccattgtccctctg

SEQ ID NO: 3489318 - DNA, 21 bp, Homo sapiens
ctccccaatgagacttgcctt

SEQ ID NO: 3489319 - DNA, 15 bp, Homo sapiens
ctccccacgagggct

SEQ ID NO: 3489320 - DNA, 19 bp, Homo sapiens
ctccccagcattccagccc

SEQ ID NO: 3489321 - DNA, 22 bp, Homo sapiens
ctccccagcattccagcccctc

SEQ ID NO: 3489322 - DNA, 14 bp, Homo sapiens
ctccccagcccaga

SEQ ID NO: 3489323 - DNA, 17 bp, Homo sapiens
ctccccagcccagagac

SEQ ID NO: 3489324 - DNA, 13 bp, Homo sapiens
ctccccagcctgc

SEQ ID NO: 3489325 - DNA, 14 bp, Homo sapiens
ctccccagcctgcg

SEQ ID NO: 3489326 - DNA, 16 bp, Homo sapiens
ctccccagcctgcgcc

SEQ ID NO: 3489327 - DNA, 13 bp, Homo sapiens
ctccccaggactc

SEQ ID NO: 3489328 - DNA, 22 bp, Homo sapiens
ctccccaggactcaccctcata

SEQ ID NO: 3489329 - DNA, 17 bp, Homo sapiens
ctccccaggtccagctc

SEQ ID NO: 3489330 - DNA, 17 bp, Homo sapiens
ctccccatggagccagc

SEQ ID NO: 3489331 - DNA, 18 bp, Homo sapiens
ctccccattcacagagcc

SEQ ID NO: 3489332 - DNA, 21 bp, Homo sapiens
ctcccccaggcctgagctgct

SEQ ID NO: 3489333 - DNA, 20 bp, Homo sapiens
ctcccccccatgcactgtga

SEQ ID NO: 3489334 - DNA, 13 bp, Homo sapiens
ctcccctcagagt

SEQ ID NO: 3489335 - DNA, 24 bp, Homo sapiens
ctcccctccggactggtgccctcc

SEQ ID NO: 3489336 - DNA, 13 bp, Homo sapiens
ctcccctctgaaa

SEQ ID NO: 3489337 - DNA, 16 bp, Homo sapiens
ctcccctgacctgtga

SEQ ID NO: 3489338 - DNA, 17 bp, Homo sapiens
ctcccctgacctgtgag

SEQ ID NO: 3489339 - DNA, 22 bp, Homo sapiens
ctcccctgacctgtgagcccag

SEQ ID NO: 3489340 - DNA, 16 bp, Homo sapiens
ctcccctgcccccagg

SEQ ID NO: 3489341 - DNA, 21 bp, Homo sapiens
ctcccctgcccccaggactgg

SEQ ID NO: 3489342 - DNA, 22 bp, Homo sapiens
ctcccctgcccccaggactggg

SEQ ID NO: 3489343 - DNA, 23 bp, Homo sapiens
ctcccctgcccccaggactgggc

SEQ ID NO: 3489344 - DNA, 22 bp, Homo sapiens
ctccccttgatttaaacacaca

SEQ ID NO: 3489345 - DNA, 17 bp, Homo sapiens
ctcccgaatagctggga

SEQ ID NO: 3489346 - DNA, 16 bp, Homo sapiens
ctcccgagtagctggg

SEQ ID NO: 3489347 - DNA, 17 bp, Homo sapiens
ctcccgagtagctggga

SEQ ID NO: 3489348 - DNA, 20 bp, Homo sapiens
ctcccgagtagggaggacca

SEQ ID NO: 3489349 - DNA, 14 bp, Homo sapiens
ctccctaccacctc

SEQ ID NO: 3489350 - DNA, 15 bp, Homo sapiens
ctccctaccacctcc

SEQ ID NO: 3489351 - DNA, 22 bp, Homo sapiens
ctccctaccacctccccagcct

SEQ ID NO: 3489352 - DNA, 13 bp, Homo sapiens
ctccctcccagga

SEQ ID NO: 3489353 - DNA, 14 bp, Homo sapiens
ctccctcccaggac

SEQ ID NO: 3489354 - DNA, 18 bp, Homo sapiens
ctccctcccctgccattt

SEQ ID NO: 3489355 - DNA, 15 bp, Homo sapiens
ctccctcctggagct

SEQ ID NO: 3489356 - DNA, 20 bp, Homo sapiens
ctccctctaggctctgcctt

SEQ ID NO: 3489357 - DNA, 14 bp, Homo sapiens
ctccctctgaccca

SEQ ID NO: 3489358 - DNA, 13 bp, Homo sapiens
ctccctcttcttt

SEQ ID NO: 3489359 - DNA, 14 bp, Homo sapiens
ctccctcttctttc

SEQ ID NO: 3489360 - DNA, 22 bp, Homo sapiens
ctccctgcatctgaccagcagc

SEQ ID NO: 3489361 - DNA, 14 bp, Homo sapiens
ctccctgcctccag

SEQ ID NO: 3489362 - DNA, 10 bp, Homo sapiens
ctccctgggc

SEQ ID NO: 3489363 - DNA, 19 bp, Homo sapiens
ctccctgtaacctcttcag

SEQ ID NO: 3489364 - DNA, 14 bp, Homo sapiens
ctcactcaccttca

SEQ ID NO: 3489365 - DNA, 11 bp, Homo sapiens
ctcactctgtc

SEQ ID NO: 3489366 - DNA, 12 bp, Homo sapiens
ctcactctgtcg

SEQ ID NO: 3489367 - DNA, 22 bp, Homo sapiens
ctcactctgtcgcccagtctgg

SEQ ID NO: 3489368 - DNA, 16 bp, Homo sapiens
ctcactgcagcctcaa

SEQ ID NO: 3489369 - DNA, 19 bp, Homo sapiens
ctcactgccatgccagctt

SEQ ID NO: 3489370 - DNA, 16 bp, Homo sapiens
ctcactggggcctaca

SEQ ID NO: 3489371 - DNA, 18 bp, Homo sapiens
ctcactggggcctacagc

SEQ ID NO: 3489372 - DNA, 17 bp, Homo sapiens
ctcactgtgttactgct

SEQ ID NO: 3489373 - DNA, 19 bp, Homo sapiens
ctcactgtttgtttttatt

SEQ ID NO: 3489374 - DNA, 21 bp, Homo sapiens
ctcactgtttgtttttattta

SEQ ID NO: 3489375 - DNA, 16 bp, Homo sapiens
ctcactttaaacctgt

SEQ ID NO: 3489376 - DNA, 20 bp, Homo sapiens
ctcactttcctcctgaggct

SEQ ID NO: 3489377 - DNA, 14 bp, Homo sapiens
ctcagaacttgctg

SEQ ID NO: 3489378 - DNA, 13 bp, Homo sapiens
ctcagaagacact

SEQ ID NO: 3489379 - DNA, 15 bp, Homo sapiens
ctcagaagacactga

SEQ ID NO: 3489380 - DNA, 22 bp, Homo sapiens
ctcagaagacactgatgggcaa

SEQ ID NO: 3489381 - DNA, 14 bp, Homo sapiens
ctcagaccagctct

SEQ ID NO: 3489382 - DNA, 15 bp, Homo sapiens
ctcagaccagctctt

SEQ ID NO: 3489383 - DNA, 16 bp, Homo sapiens
ctcagagtatggagct

SEQ ID NO: 3489384 - DNA, 21 bp, Homo sapiens
ctcagataaggtaaaatgcca

SEQ ID NO: 3489385 - DNA, 23 bp, Homo sapiens
ctcagataaggtaaaatgccatg

SEQ ID NO: 3489386 - DNA, 14 bp, Homo sapiens
ctcagatccaggga

SEQ ID NO: 3489387 - DNA, 18 bp, Homo sapiens
ctcagatccagggacaga

SEQ ID NO: 3489388 - DNA, 20 bp, Homo sapiens
ctcagatccagggacagagg

SEQ ID NO: 3489389 - DNA, 19 bp, Homo sapiens
ctcagcaaaagatgcttct

SEQ ID NO: 3489390 - DNA, 14 bp, Homo sapiens
ctcagcacaaggcc

SEQ ID NO: 3489391 - DNA, 20 bp, Homo sapiens
ctcagcagctggtaatcttg

SEQ ID NO: 3489392 - DNA, 17 bp, Homo sapiens
ctcagcatcctggcacc

SEQ ID NO: 3489393 - DNA, 22 bp, Homo sapiens
ctcagcatcctggcacccggcc

SEQ ID NO: 3489394 - DNA, 16 bp, Homo sapiens
ctcagcctcccaaagt

SEQ ID NO: 3489395 - DNA, 22 bp, Homo sapiens
ctcagcctcccaaagtgctggg

SEQ ID NO: 3489396 - DNA, 13 bp, Homo sapiens
ctcagcctcccag

SEQ ID NO: 3489397 - DNA, 12 bp, Homo sapiens
ctcagcctcccg

SEQ ID NO: 3489398 - DNA, 20 bp, Homo sapiens
ctcagcctccggagtagctg

SEQ ID NO: 3489399 - DNA, 14 bp, Homo sapiens
ctcagcctggccag

SEQ ID NO: 3489400 - DNA, 16 bp, Homo sapiens
ctcagcctggccagac

SEQ ID NO: 3489401 - DNA, 17 bp, Homo sapiens
ctcagcctggccagaca

SEQ ID NO: 3489402 - DNA, 15 bp, Homo sapiens
ctcagccttcagaca

SEQ ID NO: 3489403 - DNA, 16 bp, Homo sapiens
ctcagccttcagacag

SEQ ID NO: 3489404 - DNA, 18 bp, Homo sapiens
ctcagccttgccagagat

SEQ ID NO: 3489405 - DNA, 14 bp, Homo sapiens
ctcagcgcggccct

SEQ ID NO: 3489406 - DNA, 14 bp, Homo sapiens
ctcagctccccaga

SEQ ID NO: 3489407 - DNA, 13 bp, Homo sapiens
ctcagctcggctc

SEQ ID NO: 3489408 - DNA, 16 bp, Homo sapiens
ctcagctcggctcagc

SEQ ID NO: 3489409 - DNA, 14 bp, Homo sapiens
ctcagctctgggcc

SEQ ID NO: 3489410 - DNA, 23 bp, Homo sapiens
ctcagctctgggccattctccac

SEQ ID NO: 3489411 - DNA, 18 bp, Homo sapiens
ctcagctcttggctccac

SEQ ID NO: 3489412 - DNA, 20 bp, Homo sapiens
ctcagcttatctcttttata

SEQ ID NO: 3489413 - DNA, 16 bp, Homo sapiens
ctcagcttctcctgtg

SEQ ID NO: 3489414 - DNA, 16 bp, Homo sapiens
ctcaggacagatgcca

SEQ ID NO: 3489415 - DNA, 21 bp, Homo sapiens
ctcaggaccaaagctttcatg

SEQ ID NO: 3489416 - DNA, 21 bp, Homo sapiens
ctcaggagcttgcaagaagca

SEQ ID NO: 3489417 - DNA, 15 bp, Homo sapiens
ctcaggcacacagct

SEQ ID NO: 3489418 - DNA, 14 bp, Homo sapiens
ctcaggcaccagtc

SEQ ID NO: 3489419 - DNA, 13 bp, Homo sapiens
ctcaggccagagc

SEQ ID NO: 3489420 - DNA, 18 bp, Homo sapiens
ctcaggccagagccaagg

SEQ ID NO: 3489421 - DNA, 22 bp, Homo sapiens
ctcaggccggcagccccagcct

SEQ ID NO: 3489422 - DNA, 18 bp, Homo sapiens
ctcagggaaatggccttc

SEQ ID NO: 3489423 - DNA, 23 bp, Homo sapiens
ctcagggaaatggccttcccgcc

SEQ ID NO: 3489424 - DNA, 17 bp, Homo sapiens
ctcagggccatgctgag

SEQ ID NO: 3489425 - DNA, 18 bp, Homo sapiens
ctcagggccatgctgagg

SEQ ID NO: 3489426 - DNA, 19 bp, Homo sapiens
ctcagggccatgctgaggc

SEQ ID NO: 3489427 - DNA, 14 bp, Homo sapiens
ctcagggctcctgg

SEQ ID NO: 3489428 - DNA, 16 bp, Homo sapiens
ctcagggtccagaccc

SEQ ID NO: 3489429 - DNA, 13 bp, Homo sapiens
ctcagggtctctg

SEQ ID NO: 3489430 - DNA, 16 bp, Homo sapiens
ctcagggtctctgctg

SEQ ID NO: 3489431 - DNA, 19 bp, Homo sapiens
ctcagggtctctgctgccg

SEQ ID NO: 3489432 - DNA, 23 bp, Homo sapiens
ctcaggtagaaggttgacacagt

SEQ ID NO: 3489433 - DNA, 14 bp, Homo sapiens
ctcaggtgagaagc

SEQ ID NO: 3489434 - DNA, 13 bp, Homo sapiens
ctcaggtggccat

SEQ ID NO: 3489435 - DNA, 15 bp, Homo sapiens
ctcaggtggccatgc

SEQ ID NO: 3489436 - DNA, 18 bp, Homo sapiens
ctcaggtggccatgcctc

SEQ ID NO: 3489437 - DNA, 21 bp, Homo sapiens
ctcaggtggccatgcctcagc

SEQ ID NO: 3489438 - DNA, 19 bp, Homo sapiens
ctcaggtgtccctgcactt

SEQ ID NO: 3489439 - DNA, 17 bp, Homo sapiens
ctcagtactttggaggc

SEQ ID NO: 3489440 - DNA, 21 bp, Homo sapiens
ctcagtactttggaggcccct

SEQ ID NO: 3489441 - DNA, 22 bp, Homo sapiens
ctcagtatgtgggggcttcatc

SEQ ID NO: 3489442 - DNA, 15 bp, Homo sapiens
ctcagtccatagcag

SEQ ID NO: 3489443 - DNA, 21 bp, Homo sapiens
ctcagtcccaaatccttccca

SEQ ID NO: 3489444 - DNA, 15 bp, Homo sapiens
ctcagtgcaacctct

SEQ ID NO: 3489445 - DNA, 17 bp, Homo sapiens
ctcagtgcaacctctgc

SEQ ID NO: 3489446 - DNA, 22 bp, Homo sapiens
ctcagtgcaacctctgcttccc

SEQ ID NO: 3489447 - DNA, 23 bp, Homo sapiens
ctcagtgcaacctctgcttccca

SEQ ID NO: 3489448 - DNA, 12 bp, Homo sapiens
ctcagtgtattt

SEQ ID NO: 3489449 - DNA, 17 bp, Homo sapiens
ctcagtgtatttgtatt

SEQ ID NO: 3489450 - DNA, 12 bp, Homo sapiens
ctcagtgttttg

SEQ ID NO: 3489451 - DNA, 14 bp, Homo sapiens
ctcagttgtgcagc

SEQ ID NO: 3489452 - DNA, 21 bp, Homo sapiens
ctcagttgtgcagcttttggt

SEQ ID NO: 3489453 - DNA, 17 bp, Homo sapiens
ctcataaaaagcaaaac

SEQ ID NO: 3489454 - DNA, 17 bp, Homo sapiens
ctcataacggatcagaa

SEQ ID NO: 3489455 - DNA, 19 bp, Homo sapiens
ctcataacggatcagaaat

SEQ ID NO: 3489456 - DNA, 22 bp, Homo sapiens
ctcataccatctgctgccccgc

SEQ ID NO: 3489457 - DNA, 20 bp, Homo sapiens
ctcatagtatggtggctggg

SEQ ID NO: 3489458 - DNA, 23 bp, Homo sapiens
ctcatagtatggtggctgggttg

SEQ ID NO: 3489459 - DNA, 18 bp, Homo sapiens
ctcatcattctctgtctc

SEQ ID NO: 3489460 - DNA, 19 bp, Homo sapiens
ctcatcattctctgtctca

SEQ ID NO: 3489461 - DNA, 22 bp, Homo sapiens
ctcatcattctctgtctcatcc

SEQ ID NO: 3489462 - DNA, 16 bp, Homo sapiens
ctcatccatcatcatg

SEQ ID NO: 3489463 - DNA, 12 bp, Homo sapiens
ctcatctcaggt

SEQ ID NO: 3489464 - DNA, 24 bp, Homo sapiens
ctcatctctaacagctcaggatct

SEQ ID NO: 3489465 - DNA, 17 bp, Homo sapiens
ctcatctctctgcccaa

SEQ ID NO: 3489466 - DNA, 17 bp, Homo sapiens
ctcatctctcttgggcc

SEQ ID NO: 3489467 - DNA, 22 bp, Homo sapiens
ctcatctctcttgggccaagcc

SEQ ID NO: 3489468 - DNA, 12 bp, Homo sapiens
ctcatctctgcc

SEQ ID NO: 3489469 - DNA, 14 bp, Homo sapiens
ctcatctctgcctg

SEQ ID NO: 3489470 - DNA, 17 bp, Homo sapiens
ctcatctcttagctccc

SEQ ID NO: 3489471 - DNA, 20 bp, Homo sapiens
ctcatctcttagctcccctc

SEQ ID NO: 3489472 - DNA, 13 bp, Homo sapiens
ctcatctgaggca

SEQ ID NO: 3489473 - DNA, 15 bp, Homo sapiens
ctcatctgctggtcc

SEQ ID NO: 3489474 - DNA, 13 bp, Homo sapiens
ctcatctgtccct

SEQ ID NO: 3489475 - DNA, 15 bp, Homo sapiens
ctcatctgtccctcc

SEQ ID NO: 3489476 - DNA, 13 bp, Homo sapiens
ctcatctttcttg

SEQ ID NO: 3489477 - DNA, 15 bp, Homo sapiens
ctcatgacagccaga

SEQ ID NO: 3489478 - DNA, 20 bp, Homo sapiens
ctcatgacagccagagcctg

SEQ ID NO: 3489479 - DNA, 14 bp, Homo sapiens
ctcatgcccctggc

SEQ ID NO: 3489480 - DNA, 16 bp, Homo sapiens
ctcatgcccctggctg

SEQ ID NO: 3489481 - DNA, 18 bp, Homo sapiens
ctcatggaaactggccag

SEQ ID NO: 3489482 - DNA, 16 bp, Homo sapiens
ctcatgggaaggggag

SEQ ID NO: 3489483 - DNA, 14 bp, Homo sapiens
ctcatgtggctgga

SEQ ID NO: 3489484 - DNA, 18 bp, Homo sapiens
ctatgacatggaggcact

SEQ ID NO: 3489485 - DNA, 20 bp, Homo sapiens
ctatgagtggaaaaagccaa

SEQ ID NO: 3489486 - DNA, 15 bp, Homo sapiens
ctatgatctcaggag

SEQ ID NO: 3489487 - DNA, 23 bp, Homo sapiens
ctatgcatggtgccccaggacca

SEQ ID NO: 3489488 - DNA, 21 bp, Homo sapiens
ctatgctattgacaataaaat

SEQ ID NO: 3489489 - DNA, 18 bp, Homo sapiens
ctatgctggtgaaaacaa

SEQ ID NO: 3489490 - DNA, 15 bp, Homo sapiens
ctatgctttgaaaca

SEQ ID NO: 3489491 - DNA, 17 bp, Homo sapiens
ctatggcagtccagcca

SEQ ID NO: 3489492 - DNA, 21 bp, Homo sapiens
ctatggcagtccagccagctc

SEQ ID NO: 3489493 - DNA, 22 bp, Homo sapiens
ctatggcagtccagccagctcc

SEQ ID NO: 3489494 - DNA, 14 bp, Homo sapiens
ctatggctgcctgc

SEQ ID NO: 3489495 - DNA, 19 bp, Homo sapiens
ctatgggcctgccgggctg

SEQ ID NO: 3489496 - DNA, 21 bp, Homo sapiens
ctatgggtttagttactttag

SEQ ID NO: 3489497 - DNA, 22 bp, Homo sapiens
ctatgtaaacaaaccacagcag

SEQ ID NO: 3489498 - DNA, 15 bp, Homo sapiens
ctatgtaactgcatt

SEQ ID NO: 3489499 - DNA, 15 bp, Homo sapiens
ctatgtaggaaaaaa

SEQ ID NO: 3489500 - DNA, 19 bp, Homo sapiens
ctatgtaggaaaaaaatag

SEQ ID NO: 3489501 - DNA, 20 bp, Homo sapiens
ctatgtagtccgtgctgaca

SEQ ID NO: 3489502 - DNA, 14 bp, Homo sapiens
ctatgtatatacat

SEQ ID NO: 3489503 - DNA, 13 bp, Homo sapiens
ctatgtcccttgc

SEQ ID NO: 3489504 - DNA, 16 bp, Homo sapiens
ctatgtcgagagctgg

SEQ ID NO: 3489505 - DNA, 17 bp, Homo sapiens
ctatgtcgagagctggc

SEQ ID NO: 3489506 - DNA, 20 bp, Homo sapiens
ctatgtctagagcctcttgg

SEQ ID NO: 3489507 - DNA, 23 bp, Homo sapiens
ctatgtctagagcctcttgggga

SEQ ID NO: 3489508 - DNA, 19 bp, Homo sapiens
ctatgtgattttaactctg

SEQ ID NO: 3489509 - DNA, 22 bp, Homo sapiens
ctatgtgattttaactctgtct

SEQ ID NO: 3489510 - DNA, 13 bp, Homo sapiens
ctatgtgtaaggt

SEQ ID NO: 3489511 - DNA, 20 bp, Homo sapiens
ctatgttcaaagactgtgaa

SEQ ID NO: 3489512 - DNA, 18 bp, Homo sapiens
ctatgttctgtcttccca

SEQ ID NO: 3489513 - DNA, 16 bp, Homo sapiens
ctatgttgcccaggca

SEQ ID NO: 3489514 - DNA, 21 bp, Homo sapiens
ctatgttgcccaggcaggtct

SEQ ID NO: 3489515 - DNA, 22 bp, Homo sapiens
ctatgttgcccaggcaggtctt

SEQ ID NO: 3489516 - DNA, 17 bp, Homo sapiens
ctatgttgtaattttac

SEQ ID NO: 3489517 - DNA, 22 bp, Homo sapiens
ctatgtttttgttcaaagccag

SEQ ID NO: 3489518 - DNA, 14 bp, Homo sapiens
ctattaacatgatg

SEQ ID NO: 3489519 - DNA, 15 bp, Homo sapiens
ctattaacatgatgt

SEQ ID NO: 3489520 - DNA, 18 bp, Homo sapiens
ctattaacatgatgtact

SEQ ID NO: 3489521 - DNA, 19 bp, Homo sapiens
ctattaacatgatgtacta

SEQ ID NO: 3489522 - DNA, 22 bp, Homo sapiens
ctattaaggatgtagcttttca

SEQ ID NO: 3489523 - DNA, 19 bp, Homo sapiens
ctattaaggtgatatattt

SEQ ID NO: 3489524 - DNA, 15 bp, Homo sapiens
ctattagagaagaga

SEQ ID NO: 3489525 - DNA, 21 bp, Homo sapiens
ctattataatttaatgcatgt

SEQ ID NO: 3489526 - DNA, 22 bp, Homo sapiens
ctattcaagaggaaatgtcaca

SEQ ID NO: 3489527 - DNA, 11 bp, Homo sapiens
ctattcacaac

SEQ ID NO: 3489528 - DNA, 19 bp, Homo sapiens
ctattcagtggcgagaaat

SEQ ID NO: 3489529 - DNA, 14 bp, Homo sapiens
ctattccattccct

SEQ ID NO: 3489530 - DNA, 14 bp, Homo sapiens
ctattcctgaacta

SEQ ID NO: 3489531 - DNA, 17 bp, Homo sapiens
ctattcctgtaatgaaa

SEQ ID NO: 3489532 - DNA, 21 bp, Homo sapiens
ctattctctccaaaaatgcac

SEQ ID NO: 3489533 - DNA, 23 bp, Homo sapiens
ctattcttgatttatttgcttct

SEQ ID NO: 3489534 - DNA, 20 bp, Homo sapiens
ctattgaattcggaactgtc

SEQ ID NO: 3489535 - DNA, 17 bp, Homo sapiens
ctattgacaataaaata

SEQ ID NO: 3489536 - DNA, 21 bp, Homo sapiens
ctattgaccaccagttaacgt

SEQ ID NO: 3489537 - DNA, 16 bp, Homo sapiens
ctattgcttgggtctc

SEQ ID NO: 3489538 - DNA, 17 bp, Homo sapiens
ctattgcttgggtctct

SEQ ID NO: 3489539 - DNA, 20 bp, Homo sapiens
ctattggcctcccaaaagac

SEQ ID NO: 3489540 - DNA, 13 bp, Homo sapiens
ctatttcggcctt

SEQ ID NO: 3489541 - DNA, 16 bp, Homo sapiens
ctatttcttaaacact

SEQ ID NO: 3489542 - DNA, 11 bp, Homo sapiens
ctattttaaga

SEQ ID NO: 3489543 - DNA, 23 bp, Homo sapiens
ctattttaagactgattttaata

SEQ ID NO: 3489544 - DNA, 12 bp, Homo sapiens
ctattttattcc

SEQ ID NO: 3489545 - DNA, 23 bp, Homo sapiens
ctattttattctaaacagactca

SEQ ID NO: 3489546 - DNA, 13 bp, Homo sapiens
ctattttcaaaga

SEQ ID NO: 3489547 - DNA, 12 bp, Homo sapiens
ctattttcagat

SEQ ID NO: 3489548 - DNA, 17 bp, Homo sapiens
ctattttggattgtata

SEQ ID NO: 3489549 - DNA, 14 bp, Homo sapiens
ctatttttaaataa

SEQ ID NO: 3489550 - DNA, 16 bp, Homo sapiens
ctattttttgacactt

SEQ ID NO: 3489551 - DNA, 17 bp, Homo sapiens
ctcaaaaaaagaaaaag

SEQ ID NO: 3489552 - DNA, 16 bp, Homo sapiens
ctcaaaaacgccctca

SEQ ID NO: 3489553 - DNA, 12 bp, Homo sapiens
ctcaaaagaact

SEQ ID NO: 3489554 - DNA, 12 bp, Homo sapiens
ctcaaacctcca

SEQ ID NO: 3489555 - DNA, 13 bp, Homo sapiens
ctcaaacctccaa

SEQ ID NO: 3489556 - DNA, 20 bp, Homo sapiens
ctcaaactcttgacctcagg

SEQ ID NO: 3489557 - DNA, 20 bp, Homo sapiens
ctcaaagagggtgagggcct

SEQ ID NO: 3489558 - DNA, 22 bp, Homo sapiens
ctcaaagagggtgagggccttc

SEQ ID NO: 3489559 - DNA, 23 bp, Homo sapiens
ctcaaagagggtgagggccttct

SEQ ID NO: 3489560 - DNA, 11 bp, Homo sapiens
ctcaaaggcac

SEQ ID NO: 3489561 - DNA, 15 bp, Homo sapiens
ctcaaatctgaggga

SEQ ID NO: 3489562 - DNA, 16 bp, Homo sapiens
ctcaaatggggccaga

SEQ ID NO: 3489563 - DNA, 17 bp, Homo sapiens
ctcaaatggggccagat

SEQ ID NO: 3489564 - DNA, 21 bp, Homo sapiens
ctcaaatggggccagatccag

SEQ ID NO: 3489565 - DNA, 21 bp, Homo sapiens
ctcaacacctctgcacaagct

SEQ ID NO: 3489566 - DNA, 15 bp, Homo sapiens
ctcaaccatcccctc

SEQ ID NO: 3489567 - DNA, 21 bp, Homo sapiens
ctcaaccccaccatatgaatt

SEQ ID NO: 3489568 - DNA, 15 bp, Homo sapiens
ctcaacctcctgggc

SEQ ID NO: 3489569 - DNA, 23 bp, Homo sapiens
ctcaaccttggccttctcccctc

SEQ ID NO: 3489570 - DNA, 15 bp, Homo sapiens
ctcaacgtattgttt

SEQ ID NO: 3489571 - DNA, 21 bp, Homo sapiens
ctcaagaaataaaaggaagcc

SEQ ID NO: 3489572 - DNA, 17 bp, Homo sapiens
ctcaagatactgctact

SEQ ID NO: 3489573 - DNA, 18 bp, Homo sapiens
ctcaagatgacagctctt

SEQ ID NO: 3489574 - DNA, 18 bp, Homo sapiens
ctcaagccaagcagccaa

SEQ ID NO: 3489575 - DNA, 22 bp, Homo sapiens
ctcaagctggtggcctctgcag

SEQ ID NO: 3489576 - DNA, 14 bp, Homo sapiens
ctcaagtcctcttt

SEQ ID NO: 3489577 - DNA, 17 bp, Homo sapiens
ctcaagtgatcctccca

SEQ ID NO: 3489578 - DNA, 18 bp, Homo sapiens
ctcaagtgatcctcccac

SEQ ID NO: 3489579 - DNA, 19 bp, Homo sapiens
ctcaagtgattctcctgcc

SEQ ID NO: 3489580 - DNA, 20 bp, Homo sapiens
ctcaagtgattctcctgcct

SEQ ID NO: 3489581 - DNA, 17 bp, Homo sapiens
ctcaatcctgcagtggg

SEQ ID NO: 3489582 - DNA, 16 bp, Homo sapiens
ctcaatgaagccagct

SEQ ID NO: 3489583 - DNA, 13 bp, Homo sapiens
ctcaatgctcata

SEQ ID NO: 3489584 - DNA, 15 bp, Homo sapiens
ctcaatgctcataac

SEQ ID NO: 3489585 - DNA, 22 bp, Homo sapiens
ctcaatggaaacatcactgggg

SEQ ID NO: 3489586 - DNA, 16 bp, Homo sapiens
ctcacaacctgaacct

SEQ ID NO: 3489587 - DNA, 13 bp, Homo sapiens
ctcacaagccagc

SEQ ID NO: 3489588 - DNA, 15 bp, Homo sapiens
ctcacaagccagcca

SEQ ID NO: 3489589 - DNA, 20 bp, Homo sapiens
ctcacactgagaatgtaaga

SEQ ID NO: 3489590 - DNA, 21 bp, Homo sapiens
ctcacagtgttgcccaggctg

SEQ ID NO: 3489591 - DNA, 22 bp, Homo sapiens
ctcacatgtcagtaccttcaaa

SEQ ID NO: 3489592 - DNA, 22 bp, Homo sapiens
ctcacatttattctgctcacat

SEQ ID NO: 3489593 - DNA, 14 bp, Homo sapiens
ctcaccagccccag

SEQ ID NO: 3489594 - DNA, 19 bp, Homo sapiens
ctcaccagccccagtgccc

SEQ ID NO: 3489595 - DNA, 12 bp, Homo sapiens
ctcaccagctgc

SEQ ID NO: 3489596 - DNA, 14 bp, Homo sapiens
ctcaccagctgcaa

SEQ ID NO: 3489597 - DNA, 18 bp, Homo sapiens
ctcaccagctgcaaagtg

SEQ ID NO: 3489598 - DNA, 17 bp, Homo sapiens
ctcacccacccctgcac

SEQ ID NO: 3489599 - DNA, 12 bp, Homo sapiens
ctcaccccatcc

SEQ ID NO: 3489600 - DNA, 16 bp, Homo sapiens
ctcacccccttctcca

SEQ ID NO: 3489601 - DNA, 17 bp, Homo sapiens
ctcacccccttctccat

SEQ ID NO: 3489602 - DNA, 21 bp, Homo sapiens
ctcacccccttctccatccac

SEQ ID NO: 3489603 - DNA, 15 bp, Homo sapiens
ctcacctagcctgat

SEQ ID NO: 3489604 - DNA, 10 bp, Homo sapiens
ctcacctccc

SEQ ID NO: 3489605 - DNA, 20 bp, Homo sapiens
ctcacctggggctgctggcc

SEQ ID NO: 3489606 - DNA, 12 bp, Homo sapiens
ctcacctggggt

SEQ ID NO: 3489607 - DNA, 16 bp, Homo sapiens
ctcaccttggcaccag

SEQ ID NO: 3489608 - DNA, 14 bp, Homo sapiens
ctcaccttggggcc

SEQ ID NO: 3489609 - DNA, 13 bp, Homo sapiens
ctcacgcttcaca

SEQ ID NO: 3489610 - DNA, 15 bp, Homo sapiens
ctcacgcttcacagt

SEQ ID NO: 3489611 - DNA, 17 bp, Homo sapiens
catgatgcctctgtctt

SEQ ID NO: 3489612 - DNA, 17 bp, Homo sapiens
catgatgcttttactga

SEQ ID NO: 3489613 - DNA, 13 bp, Homo sapiens
catgatggccagg

SEQ ID NO: 3489614 - DNA, 21 bp, Homo sapiens
catgatggccaggctgatctc

SEQ ID NO: 3489615 - DNA, 13 bp, Homo sapiens
catgatgtttgcc

SEQ ID NO: 3489616 - DNA, 17 bp, Homo sapiens
catgatgtttgcccaaa

SEQ ID NO: 3489617 - DNA, 21 bp, Homo sapiens
catgatgtttgcccaaaattt

SEQ ID NO: 3489618 - DNA, 23 bp, Homo sapiens
catgattaaccacttcagctgac

SEQ ID NO: 3489619 - DNA, 24 bp, Homo sapiens
catgattaaccacttcagctgact

SEQ ID NO: 3489620 - DNA, 14 bp, Homo sapiens
catgattccttcct

SEQ ID NO: 3489621 - DNA, 16 bp, Homo sapiens
catgattccttcctgt

SEQ ID NO: 3489622 - DNA, 15 bp, Homo sapiens
catgcaaaggctggg

SEQ ID NO: 3489623 - DNA, 22 bp, Homo sapiens
catgcaccaggactggctgtgt

SEQ ID NO: 3489624 - DNA, 16 bp, Homo sapiens
catgcactcagctctt

SEQ ID NO: 3489625 - DNA, 10 bp, Homo sapiens
catgcactgt

SEQ ID NO: 3489626 - DNA, 14 bp, Homo sapiens
catgcactgtgaag

SEQ ID NO: 3489627 - DNA, 16 bp, Homo sapiens
catgcactgtgaagga

SEQ ID NO: 3489628 - DNA, 17 bp, Homo sapiens
catgcactgtgaaggac

SEQ ID NO: 3489629 - DNA, 18 bp, Homo sapiens
catgcactgtgaaggacc

SEQ ID NO: 3489630 - DNA, 22 bp, Homo sapiens
catgcactgtgaaggacccttg

SEQ ID NO: 3489631 - DNA, 19 bp, Homo sapiens
catgcagacatgagtgcgt

SEQ ID NO: 3489632 - DNA, 14 bp, Homo sapiens
catgcagtttgaaa

SEQ ID NO: 3489633 - DNA, 21 bp, Homo sapiens
catgcagtttgaaattctgaa

SEQ ID NO: 3489634 - DNA, 17 bp, Homo sapiens
catgcatcttactgaag

SEQ ID NO: 3489635 - DNA, 21 bp, Homo sapiens
catgccaccatggccagccaa

SEQ ID NO: 3489636 - DNA, 14 bp, Homo sapiens
catgcccctggctg

SEQ ID NO: 3489637 - DNA, 15 bp, Homo sapiens
catgcccctggctgg

SEQ ID NO: 3489638 - DNA, 14 bp, Homo sapiens
catgccctcctctc

SEQ ID NO: 3489639 - DNA, 13 bp, Homo sapiens
catgccctctcag

SEQ ID NO: 3489640 - DNA, 16 bp, Homo sapiens
catgccctctcaggcc

SEQ ID NO: 3489641 - DNA, 14 bp, Homo sapiens
catgcctcagccct

SEQ ID NO: 3489642 - DNA, 20 bp, Homo sapiens
catgcctcagccctgaccct

SEQ ID NO: 3489643 - DNA, 18 bp, Homo sapiens
catgcctggtattttcaa

SEQ ID NO: 3489644 - DNA, 13 bp, Homo sapiens
catgcctgtcctg

SEQ ID NO: 3489645 - DNA, 17 bp, Homo sapiens
catgcctgtcctgaaag

SEQ ID NO: 3489646 - DNA, 22 bp, Homo sapiens
catgcgctcagggccatgctga

SEQ ID NO: 3489647 - DNA, 14 bp, Homo sapiens
catgctatgttctg

SEQ ID NO: 3489648 - DNA, 16 bp, Homo sapiens
catgctcatctgctgg

SEQ ID NO: 3489649 - DNA, 14 bp, Homo sapiens
catgctcctggccc

SEQ ID NO: 3489650 - DNA, 20 bp, Homo sapiens
catgctctccaaaccacttt

SEQ ID NO: 3489651 - DNA, 16 bp, Homo sapiens
catgctgaagccaaag

SEQ ID NO: 3489652 - DNA, 16 bp, Homo sapiens
catgctgaggcctggg

SEQ ID NO: 3489653 - DNA, 18 bp, Homo sapiens
catgctgaggcctgggcc

SEQ ID NO: 3489654 - DNA, 18 bp, Homo sapiens
catgctgctagatcttta

SEQ ID NO: 3489655 - DNA, 21 bp, Homo sapiens
catgctggctcagtctgagct

SEQ ID NO: 3489656 - DNA, 23 bp, Homo sapiens
catgcttcatcattccctctcat

SEQ ID NO: 3489657 - DNA, 13 bp, Homo sapiens
catgcttgtgtta

SEQ ID NO: 3489658 - DNA, 18 bp, Homo sapiens
catggacaggctggctcc

SEQ ID NO: 3489659 - DNA, 13 bp, Homo sapiens
catggagagctgg

SEQ ID NO: 3489660 - DNA, 14 bp, Homo sapiens
catggagccagctc

SEQ ID NO: 3489661 - DNA, 22 bp, Homo sapiens
catggagctataactaagcatc

SEQ ID NO: 3489662 - DNA, 16 bp, Homo sapiens
catggaggcactgaag

SEQ ID NO: 3489663 - DNA, 19 bp, Homo sapiens
catggatgggggaactcag

SEQ ID NO: 3489664 - DNA, 19 bp, Homo sapiens
catggattacttctctata

SEQ ID NO: 3489665 - DNA, 21 bp, Homo sapiens
catggatttctctgctcacag

SEQ ID NO: 3489666 - DNA, 14 bp, Homo sapiens
catggccctcccag

SEQ ID NO: 3489667 - DNA, 14 bp, Homo sapiens
catggcctctgcaa

SEQ ID NO: 3489668 - DNA, 14 bp, Homo sapiens
catggctctatttc

SEQ ID NO: 3489669 - DNA, 15 bp, Homo sapiens
catgggcagagccca

SEQ ID NO: 3489670 - DNA, 15 bp, Homo sapiens
catgggcctcctgtg

SEQ ID NO: 3489671 - DNA, 16 bp, Homo sapiens
catgggcctcctgtgt

SEQ ID NO: 3489672 - DNA, 17 bp, Homo sapiens
catgggcctcctgtgtg

SEQ ID NO: 3489673 - DNA, 20 bp, Homo sapiens
catggggagggattctggtt

SEQ ID NO: 3489674 - DNA, 20 bp, Homo sapiens
catgggtatagttcatgtct

SEQ ID NO: 3489675 - DNA, 14 bp, Homo sapiens
catgggtcgggaga

SEQ ID NO: 3489676 - DNA, 15 bp, Homo sapiens
catgggtcgggagag

SEQ ID NO: 3489677 - DNA, 16 bp, Homo sapiens
catgggtcgggagagg

SEQ ID NO: 3489678 - DNA, 18 bp, Homo sapiens
catgggtcgggagagggg

SEQ ID NO: 3489679 - DNA, 19 bp, Homo sapiens
catgggtcgggagagggga

SEQ ID NO: 3489680 - DNA, 20 bp, Homo sapiens
catgggtcgggagaggggac

SEQ ID NO: 3489681 - DNA, 15 bp, Homo sapiens
catggtcacacactg

SEQ ID NO: 3489682 - DNA, 18 bp, Homo sapiens
catggtgaaaagctccat

SEQ ID NO: 3489683 - DNA, 17 bp, Homo sapiens
catggtgccccaggacc

SEQ ID NO: 3489684 - DNA, 18 bp, Homo sapiens
catggtgccccaggacca

SEQ ID NO: 3489685 - DNA, 20 bp, Homo sapiens
catggtgccccaggaccagc

SEQ ID NO: 3489686 - DNA, 20 bp, Homo sapiens
catggtggaaaacgaagctc

SEQ ID NO: 3489687 - DNA, 12 bp, Homo sapiens
catggtgtctgg

SEQ ID NO: 3489688 - DNA, 23 bp, Homo sapiens
catggtgtttttataaagaattc

SEQ ID NO: 3489689 - DNA, 19 bp, Homo sapiens
catggttaaggtaaagtaa

SEQ ID NO: 3489690 - DNA, 16 bp, Homo sapiens
catgtaaactgtgcac

SEQ ID NO: 3489691 - DNA, 18 bp, Homo sapiens
catgtaaccggcatgttt

SEQ ID NO: 3489692 - DNA, 15 bp, Homo sapiens
catgtaactatttct

SEQ ID NO: 3489693 - DNA, 18 bp, Homo sapiens
catgtaactatttcttca

SEQ ID NO: 3489694 - DNA, 23 bp, Homo sapiens
catgtaatgttaatgttatatca

SEQ ID NO: 3489695 - DNA, 20 bp, Homo sapiens
catgtagaaaatttgttatt

SEQ ID NO: 3489696 - DNA, 19 bp, Homo sapiens
catgtagaagctgcatctt

SEQ ID NO: 3489697 - DNA, 20 bp, Homo sapiens
catgtagccccctggcctct

SEQ ID NO: 3489698 - DNA, 13 bp, Homo sapiens
catgtataatttt

SEQ ID NO: 3489699 - DNA, 21 bp, Homo sapiens
catgtataatttttttcttgt

SEQ ID NO: 3489700 - DNA, 22 bp, Homo sapiens
catgtataatttttttcttgta

SEQ ID NO: 3489701 - DNA, 18 bp, Homo sapiens
catgtatcataattacca

SEQ ID NO: 3489702 - DNA, 20 bp, Homo sapiens
catgtcaccggatcctgggt

SEQ ID NO: 3489703 - DNA, 16 bp, Homo sapiens
catgtcagcaaaaagc

SEQ ID NO: 3489704 - DNA, 15 bp, Homo sapiens
catgtcccctcccag

SEQ ID NO: 3489705 - DNA, 16 bp, Homo sapiens
catgtcccctcccaga

SEQ ID NO: 3489706 - DNA, 18 bp, Homo sapiens
catgtcccctcccagagc

SEQ ID NO: 3489707 - DNA, 19 bp, Homo sapiens
catgtctattccattccct

SEQ ID NO: 3489708 - DNA, 22 bp, Homo sapiens
catgtctcctttaagagctctg

SEQ ID NO: 3489709 - DNA, 20 bp, Homo sapiens
catgtctgcagtgtgccccc

SEQ ID NO: 3489710 - DNA, 18 bp, Homo sapiens
catgtcttaatgaagttt

SEQ ID NO: 3489711 - DNA, 23 bp, Homo sapiens
catgtcttctcacaagccagcca

SEQ ID NO: 3489712 - DNA, 12 bp, Homo sapiens
catgtgaaactc

SEQ ID NO: 3489713 - DNA, 20 bp, Homo sapiens
catgtgaaactcatctcatt

SEQ ID NO: 3489714 - DNA, 16 bp, Homo sapiens
catgtgactctgaagc

SEQ ID NO: 3489715 - DNA, 17 bp, Homo sapiens
catgtgactctggcttg

SEQ ID NO: 3489716 - DNA, 18 bp, Homo sapiens
catgtgagcatggtcaca

SEQ ID NO: 3489717 - DNA, 21 bp, Homo sapiens
catgtgccaggtttttggtct

SEQ ID NO: 3489718 - DNA, 18 bp, Homo sapiens
catgtggccatggcctct

SEQ ID NO: 3489719 - DNA, 15 bp, Homo sapiens
ctacctcccttgcct

SEQ ID NO: 3489720 - DNA, 16 bp, Homo sapiens
ctacctcccttgcctt

SEQ ID NO: 3489721 - DNA, 18 bp, Homo sapiens
ctacctctccagcctcag

SEQ ID NO: 3489722 - DNA, 16 bp, Homo sapiens
ctacctctctgtccct

SEQ ID NO: 3489723 - DNA, 20 bp, Homo sapiens
ctacctgacactcccttggg

SEQ ID NO: 3489724 - DNA, 22 bp, Homo sapiens
ctacctgttgagcatcacagaa

SEQ ID NO: 3489725 - DNA, 14 bp, Homo sapiens
ctaccttgaaaata

SEQ ID NO: 3489726 - DNA, 13 bp, Homo sapiens
ctaccttgctttt

SEQ ID NO: 3489727 - DNA, 21 bp, Homo sapiens
ctaccttggttcccccactga

SEQ ID NO: 3489728 - DNA, 16 bp, Homo sapiens
ctactaaaaatacaaa

SEQ ID NO: 3489729 - DNA, 16 bp, Homo sapiens
ctactaaaagtttaga

SEQ ID NO: 3489730 - DNA, 15 bp, Homo sapiens
ctactaattccacac

SEQ ID NO: 3489731 - DNA, 17 bp, Homo sapiens
ctactaattccacacct

SEQ ID NO: 3489732 - DNA, 17 bp, Homo sapiens
ctactataaagagaaga

SEQ ID NO: 3489733 - DNA, 15 bp, Homo sapiens
ctactcagcatttga

SEQ ID NO: 3489734 - DNA, 12 bp, Homo sapiens
ctactccagtat

SEQ ID NO: 3489735 - DNA, 17 bp, Homo sapiens
ctactccagtatgacag

SEQ ID NO: 3489736 - DNA, 20 bp, Homo sapiens
ctactccagtatgacagagg

SEQ ID NO: 3489737 - DNA, 22 bp, Homo sapiens
ctactctccccacgagggctgg

SEQ ID NO: 3489738 - DNA, 13 bp, Homo sapiens
ctactctcctcat

SEQ ID NO: 3489739 - DNA, 13 bp, Homo sapiens
ctactcttacatg

SEQ ID NO: 3489740 - DNA, 14 bp, Homo sapiens
ctactcttacatgt

SEQ ID NO: 3489741 - DNA, 18 bp, Homo sapiens
ctactgcaagagccaagt

SEQ ID NO: 3489742 - DNA, 11 bp, Homo sapiens
ctactgccttt

SEQ ID NO: 3489743 - DNA, 19 bp, Homo sapiens
ctactgtaattttatatga

SEQ ID NO: 3489744 - DNA, 17 bp, Homo sapiens
ctacttcattttcagag

SEQ ID NO: 3489745 - DNA, 23 bp, Homo sapiens
ctacttcattttcagagtgacac

SEQ ID NO: 3489746 - DNA, 17 bp, Homo sapiens
ctacttgattttattgt

SEQ ID NO: 3489747 - DNA, 18 bp, Homo sapiens
ctacttgattttattgta

SEQ ID NO: 3489748 - DNA, 13 bp, Homo sapiens
ctacttggtttgt

SEQ ID NO: 3489749 - DNA, 15 bp, Homo sapiens
ctacttggtttgtgt

SEQ ID NO: 3489750 - DNA, 14 bp, Homo sapiens
ctactttgtccttt

SEQ ID NO: 3489751 - DNA, 20 bp, Homo sapiens
ctactttgtcctttttgtta

SEQ ID NO: 3489752 - DNA, 16 bp, Homo sapiens
ctacttttggcctcat

SEQ ID NO: 3489753 - DNA, 19 bp, Homo sapiens
ctagaaatgggaatcatgg

SEQ ID NO: 3489754 - DNA, 19 bp, Homo sapiens
ctagaaattccccaccctg

SEQ ID NO: 3489755 - DNA, 15 bp, Homo sapiens
ctagaatttattcaa

SEQ ID NO: 3489756 - DNA, 14 bp, Homo sapiens
ctagacaagccaga

SEQ ID NO: 3489757 - DNA, 13 bp, Homo sapiens
ctagagagggagg

SEQ ID NO: 3489758 - DNA, 22 bp, Homo sapiens
ctagagagggaggcaagccctg

SEQ ID NO: 3489759 - DNA, 15 bp, Homo sapiens
ctagagcctcttggg

SEQ ID NO: 3489760 - DNA, 15 bp, Homo sapiens
ctagaggaaaagaaa

SEQ ID NO: 3489761 - DNA, 14 bp, Homo sapiens
ctagaggctcatgg

SEQ ID NO: 3489762 - DNA, 15 bp, Homo sapiens
ctagaggctcatggc

SEQ ID NO: 3489763 - DNA, 17 bp, Homo sapiens
ctagaggctcatggccc

SEQ ID NO: 3489764 - DNA, 15 bp, Homo sapiens
ctagagggacctctc

SEQ ID NO: 3489765 - DNA, 20 bp, Homo sapiens
ctagagggacctctcccagg

SEQ ID NO: 3489766 - DNA, 15 bp, Homo sapiens
ctagagggaggggcc

SEQ ID NO: 3489767 - DNA, 21 bp, Homo sapiens
ctagagggaggggcctaggcc

SEQ ID NO: 3489768 - DNA, 14 bp, Homo sapiens
ctagatacaataaa

SEQ ID NO: 3489769 - DNA, 21 bp, Homo sapiens
ctagatatcgacttgtttttg

SEQ ID NO: 3489770 - DNA, 18 bp, Homo sapiens
ctagatcaaggagcccag

SEQ ID NO: 3489771 - DNA, 19 bp, Homo sapiens
ctagatcaaggagcccaga

SEQ ID NO: 3489772 - DNA, 17 bp, Homo sapiens
ctagatgcaagtctctt

SEQ ID NO: 3489773 - DNA, 21 bp, Homo sapiens
ctagatgctttcctaaatcag

SEQ ID NO: 3489774 - DNA, 17 bp, Homo sapiens
ctagatggtgctgagaa

SEQ ID NO: 3489775 - DNA, 16 bp, Homo sapiens
ctagcacatgcttcaa

SEQ ID NO: 3489776 - DNA, 18 bp, Homo sapiens
ctagcacatgcttcaata

SEQ ID NO: 3489777 - DNA, 12 bp, Homo sapiens
ctagcagcaggg

SEQ ID NO: 3489778 - DNA, 23 bp, Homo sapiens
ctagcagcagggagggcttctgc

SEQ ID NO: 3489779 - DNA, 14 bp, Homo sapiens
ctagcagctgcagt

SEQ ID NO: 3489780 - DNA, 15 bp, Homo sapiens
ctagcaggcacagga

SEQ ID NO: 3489781 - DNA, 23 bp, Homo sapiens
ctagcaggcacaggacacctggc

SEQ ID NO: 3489782 - DNA, 15 bp, Homo sapiens
ctagcatatctgcct

SEQ ID NO: 3489783 - DNA, 17 bp, Homo sapiens
ctagcatatctgccttt

SEQ ID NO: 3489784 - DNA, 23 bp, Homo sapiens
ctagccaaatggtttaacttctg

SEQ ID NO: 3489785 - DNA, 21 bp, Homo sapiens
ctagccctgcggagccggcac

SEQ ID NO: 3489786 - DNA, 21 bp, Homo sapiens
ctagccttagaagtcacacag

SEQ ID NO: 3489787 - DNA, 20 bp, Homo sapiens
ctagctaaaccagaaaggtg

SEQ ID NO: 3489788 - DNA, 20 bp, Homo sapiens
ctagctaccttctctaccca

SEQ ID NO: 3489789 - DNA, 20 bp, Homo sapiens
ctagctctatgtttacaaat

SEQ ID NO: 3489790 - DNA, 22 bp, Homo sapiens
ctagctgggggtgggccaggct

SEQ ID NO: 3489791 - DNA, 14 bp, Homo sapiens
ctaggaaattcttg

SEQ ID NO: 3489792 - DNA, 23 bp, Homo sapiens
ctaggaagagcaggactccaggc

SEQ ID NO: 3489793 - DNA, 18 bp, Homo sapiens
ctaggacgccacccagca

SEQ ID NO: 3489794 - DNA, 23 bp, Homo sapiens
ctaggagaaccaaatctggaagc

SEQ ID NO: 3489795 - DNA, 14 bp, Homo sapiens
ctaggagaagggct

SEQ ID NO: 3489796 - DNA, 15 bp, Homo sapiens
ctaggagaagggctg

SEQ ID NO: 3489797 - DNA, 17 bp, Homo sapiens
ctaggaggaaaaagaaa

SEQ ID NO: 3489798 - DNA, 16 bp, Homo sapiens
ctaggcagtaggccgg

SEQ ID NO: 3489799 - DNA, 17 bp, Homo sapiens
ctaggcatctctgtact

SEQ ID NO: 3489800 - DNA, 23 bp, Homo sapiens
ctaggcccccacttgcctcttcc

SEQ ID NO: 3489801 - DNA, 12 bp, Homo sapiens
ctaggccgggcg

SEQ ID NO: 3489802 - DNA, 16 bp, Homo sapiens
ctaggcctcagccaga

SEQ ID NO: 3489803 - DNA, 18 bp, Homo sapiens
ctaggcctcagccagaga

SEQ ID NO: 3489804 - DNA, 18 bp, Homo sapiens
ctaggcctcctggcccag

SEQ ID NO: 3489805 - DNA, 19 bp, Homo sapiens
ctaggcctcctggcccagg

SEQ ID NO: 3489806 - DNA, 18 bp, Homo sapiens
ctaggcctggccagatgc

SEQ ID NO: 3489807 - DNA, 12 bp, Homo sapiens
ctaggcctgggg

SEQ ID NO: 3489808 - DNA, 14 bp, Homo sapiens
ctaggctctgcctt

SEQ ID NO: 3489809 - DNA, 20 bp, Homo sapiens
ctaggctggagcccagggag

SEQ ID NO: 3489810 - DNA, 11 bp, Homo sapiens
ctaggctgggg

SEQ ID NO: 3489811 - DNA, 21 bp, Homo sapiens
ctagggaaaaaccagcgtgtg

SEQ ID NO: 3489812 - DNA, 17 bp, Homo sapiens
ctagggagccatttgag

SEQ ID NO: 3489813 - DNA, 18 bp, Homo sapiens
ctagggagccatttgaga

SEQ ID NO: 3489814 - DNA, 16 bp, Homo sapiens
ctagggccaagcccag

SEQ ID NO: 3489815 - DNA, 14 bp, Homo sapiens
ctagggcggagagg

SEQ ID NO: 3489816 - DNA, 23 bp, Homo sapiens
ctagggggagccccttctgctca

SEQ ID NO: 3489817 - DNA, 21 bp, Homo sapiens
ctagggtgaggtttagccatc

SEQ ID NO: 3489818 - DNA, 14 bp, Homo sapiens
ctagggtgttctgt

SEQ ID NO: 3489819 - DNA, 16 bp, Homo sapiens
ctaggtcccccaagca

SEQ ID NO: 3489820 - DNA, 24 bp, Homo sapiens
ctaggtgacagagtgagactctgt

SEQ ID NO: 3489821 - DNA, 16 bp, Homo sapiens
ctagtcaatcaagtct

SEQ ID NO: 3489822 - DNA, 13 bp, Homo sapiens
ctagtgctttcct

SEQ ID NO: 3489823 - DNA, 14 bp, Homo sapiens
ctagtggcttgtcc

SEQ ID NO: 3489824 - DNA, 16 bp, Homo sapiens
ctagtgtaacactgca

SEQ ID NO: 3489825 - DNA, 23 bp, Homo sapiens
ctagtgtacctcctctcagtgtt

SEQ ID NO: 3489826 - DNA, 18 bp, Homo sapiens
ctagttactgtggtatgg

SEQ ID NO: 3489827 - DNA, 13 bp, Homo sapiens
ctagttttgttta

SEQ ID NO: 3489828 - DNA, 19 bp, Homo sapiens
ctataaaagctttctgcca

SEQ ID NO: 3489829 - DNA, 18 bp, Homo sapiens
ctataaaatgtcttcaag

SEQ ID NO: 3489830 - DNA, 18 bp, Homo sapiens
ctataaagctagatgctt

SEQ ID NO: 3489831 - DNA, 17 bp, Homo sapiens
ctatacatatctttatt

SEQ ID NO: 3489832 - DNA, 20 bp, Homo sapiens
ctatacatatctttattaat

SEQ ID NO: 3489833 - DNA, 22 bp, Homo sapiens
ctatacatatctttattaatca

SEQ ID NO: 3489834 - DNA, 23 bp, Homo sapiens
ctatactgcttggagctgagcaa

SEQ ID NO: 3489835 - DNA, 19 bp, Homo sapiens
ctatagacccgaggaaact

SEQ ID NO: 3489836 - DNA, 12 bp, Homo sapiens
ctatagactcta

SEQ ID NO: 3489837 - DNA, 17 bp, Homo sapiens
ctatagcctaggtgaca

SEQ ID NO: 3489838 - DNA, 21 bp, Homo sapiens
ctatagcctaggtgacagagt

SEQ ID NO: 3489839 - DNA, 14 bp, Homo sapiens
ctataggtccagaa

SEQ ID NO: 3489840 - DNA, 15 bp, Homo sapiens
ctatagtatttgatt

SEQ ID NO: 3489841 - DNA, 18 bp, Homo sapiens
ctatagtatttgattcaa

SEQ ID NO: 3489842 - DNA, 20 bp, Homo sapiens
ctatagttattaagttcttt

SEQ ID NO: 3489843 - DNA, 16 bp, Homo sapiens
ctatatagtttattga

SEQ ID NO: 3489844 - DNA, 19 bp, Homo sapiens
ctatattgcccaggctggt

SEQ ID NO: 3489845 - DNA, 13 bp, Homo sapiens
ctatatttagatt

SEQ ID NO: 3489846 - DNA, 15 bp, Homo sapiens
ctatcatttaataat

SEQ ID NO: 3489847 - DNA, 16 bp, Homo sapiens
ctatctactctcctca

SEQ ID NO: 3489848 - DNA, 15 bp, Homo sapiens
ctatctcctagggct

SEQ ID NO: 3489849 - DNA, 12 bp, Homo sapiens
ctatctgcctga

SEQ ID NO: 3489850 - DNA, 13 bp, Homo sapiens
ctatctgcctgac

SEQ ID NO: 3489851 - DNA, 14 bp, Homo sapiens
ctatctgtctggtg

SEQ ID NO: 3489852 - DNA, 16 bp, Homo sapiens
gatctcttgagcctgg

SEQ ID NO: 3489853 - DNA, 19 bp, Homo sapiens
gatctcttgagcctgggag

SEQ ID NO: 3489854 - DNA, 21 bp, Homo sapiens
gatctgacatgattccttcct

SEQ ID NO: 3489855 - DNA, 22 bp, Homo sapiens
gatctgacatgattccttcctg

SEQ ID NO: 3489856 - DNA, 14 bp, Homo sapiens
gatctgcaggggtc

SEQ ID NO: 3489857 - DNA, 17 bp, Homo sapiens
gatctggaacccagact

SEQ ID NO: 3489858 - DNA, 21 bp, Homo sapiens
gatctggaacctcagcctggc

SEQ ID NO: 3489859 - DNA, 23 bp, Homo sapiens
gatctggaacctcagcctggcca

SEQ ID NO: 3489860 - DNA, 18 bp, Homo sapiens
gatctgggttcactgcaa

SEQ ID NO: 3489861 - DNA, 15 bp, Homo sapiens
gatctgtatatacaa

SEQ ID NO: 3489862 - DNA, 14 bp, Homo sapiens
gatctgtcctcagc

SEQ ID NO: 3489863 - DNA, 19 bp, Homo sapiens
gatctgtgacacatcgttt

SEQ ID NO: 3489864 - DNA, 19 bp, Homo sapiens
gatctgttttgaaggcaaa

SEQ ID NO: 3489865 - DNA, 19 bp, Homo sapiens
gatcttggcttactgcagc

SEQ ID NO: 3489866 - DNA, 21 bp, Homo sapiens
gatctttattatggaaaacat

SEQ ID NO: 3489867 - DNA, 16 bp, Homo sapiens
gatctttgcagacagg

SEQ ID NO: 3489868 - DNA, 18 bp, Homo sapiens
gatctttgcagacaggca

SEQ ID NO: 3489869 - DNA, 14 bp, Homo sapiens
gatctttgtggcca

SEQ ID NO: 3489870 - DNA, 15 bp, Homo sapiens
gatctttgtggccaa

SEQ ID NO: 3489871 - DNA, 19 bp, Homo sapiens
gatgaaagagaaggtgggt

SEQ ID NO: 3489872 - DNA, 20 bp, Homo sapiens
gatgaaccagccggggcctt

SEQ ID NO: 3489873 - DNA, 17 bp, Homo sapiens
gatgaagttttacattg

SEQ ID NO: 3489874 - DNA, 17 bp, Homo sapiens
gatgacaagatggtaca

SEQ ID NO: 3489875 - DNA, 21 bp, Homo sapiens
gatgacatagcagttacagag

SEQ ID NO: 3489876 - DNA, 20 bp, Homo sapiens
gatgacatgcactcagctct

SEQ ID NO: 3489877 - DNA, 17 bp, Homo sapiens
gatgagcatcccaggat

SEQ ID NO: 3489878 - DNA, 15 bp, Homo sapiens
gatgagcatggagct

SEQ ID NO: 3489879 - DNA, 14 bp, Homo sapiens
gatgagctgggccg

SEQ ID NO: 3489880 - DNA, 18 bp, Homo sapiens
gatgatagaggattttat

SEQ ID NO: 3489881 - DNA, 16 bp, Homo sapiens
gatgattcaggtgcag

SEQ ID NO: 3489882 - DNA, 17 bp, Homo sapiens
gatgcaaagaggcaaga

SEQ ID NO: 3489883 - DNA, 14 bp, Homo sapiens
gatgcaccagccct

SEQ ID NO: 3489884 - DNA, 23 bp, Homo sapiens
gatgcaccagcccttagcaggga

SEQ ID NO: 3489885 - DNA, 21 bp, Homo sapiens
gatgcagcattttgtatttgt

SEQ ID NO: 3489886 - DNA, 22 bp, Homo sapiens
gatgcaggatttgttctctgtc

SEQ ID NO: 3489887 - DNA, 14 bp, Homo sapiens
gatgcagggcagtc

SEQ ID NO: 3489888 - DNA, 22 bp, Homo sapiens
gatgcagtgctcgctgttgctg

SEQ ID NO: 3489889 - DNA, 16 bp, Homo sapiens
gatgcatgtcttttaa

SEQ ID NO: 3489890 - DNA, 22 bp, Homo sapiens
gatgcatgtcttttaaaatgca

SEQ ID NO: 3489891 - DNA, 15 bp, Homo sapiens
gatgccactcctccc

SEQ ID NO: 3489892 - DNA, 17 bp, Homo sapiens
gatgccactcctccctc

SEQ ID NO: 3489893 - DNA, 19 bp, Homo sapiens
gatgccactcctccctccg

SEQ ID NO: 3489894 - DNA, 15 bp, Homo sapiens
gatgccccagggatg

SEQ ID NO: 3489895 - DNA, 18 bp, Homo sapiens
gatgccctggaggtggct

SEQ ID NO: 3489896 - DNA, 14 bp, Homo sapiens
gatgcctacttttg

SEQ ID NO: 3489897 - DNA, 15 bp, Homo sapiens
gatgcctgattgcca

SEQ ID NO: 3489898 - DNA, 22 bp, Homo sapiens
gatgcctgattgccaagctcag

SEQ ID NO: 3489899 - DNA, 18 bp, Homo sapiens
gatgcctggtggcagctg

SEQ ID NO: 3489900 - DNA, 19 bp, Homo sapiens
gatgcctggtggcagctgc

SEQ ID NO: 3489901 - DNA, 16 bp, Homo sapiens
gatgcgcagccccatc

SEQ ID NO: 3489902 - DNA, 14 bp, Homo sapiens
gatgcgcagtgcct

SEQ ID NO: 3489903 - DNA, 16 bp, Homo sapiens
gatgctccttgggccc

SEQ ID NO: 3489904 - DNA, 20 bp, Homo sapiens
gatgctgacattcacctgcc

SEQ ID NO: 3489905 - DNA, 12 bp, Homo sapiens
gatgctgcccct

SEQ ID NO: 3489906 - DNA, 13 bp, Homo sapiens
gatgctgcccctc

SEQ ID NO: 3489907 - DNA, 12 bp, Homo sapiens
gatgctggccca

SEQ ID NO: 3489908 - DNA, 15 bp, Homo sapiens
gatgctggcccaggg

SEQ ID NO: 3489909 - DNA, 17 bp, Homo sapiens
gatgctggcccagggcc

SEQ ID NO: 3489910 - DNA, 18 bp, Homo sapiens
gatgcttacatctggaat

SEQ ID NO: 3489911 - DNA, 19 bp, Homo sapiens
gatggaaccgcaggaagct

SEQ ID NO: 3489912 - DNA, 20 bp, Homo sapiens
gatggaaccgcaggaagctg

SEQ ID NO: 3489913 - DNA, 17 bp, Homo sapiens
gatggatttaacagcat

SEQ ID NO: 3489914 - DNA, 22 bp, Homo sapiens
gatggatttaacagcatgacaa

SEQ ID NO: 3489915 - DNA, 21 bp, Homo sapiens
gatggcaggatggcctggcca

SEQ ID NO: 3489916 - DNA, 22 bp, Homo sapiens
gatggcaggatggcctggccag

SEQ ID NO: 3489917 - DNA, 12 bp, Homo sapiens
gatggccccagc

SEQ ID NO: 3489918 - DNA, 21 bp, Homo sapiens
gatggcctggccagggcctgg

SEQ ID NO: 3489919 - DNA, 13 bp, Homo sapiens
gatggctcctctc

SEQ ID NO: 3489920 - DNA, 20 bp, Homo sapiens
gatgggagggaggctcaggt

SEQ ID NO: 3489921 - DNA, 19 bp, Homo sapiens
gatgggatggtggagggcc

SEQ ID NO: 3489922 - DNA, 13 bp, Homo sapiens
gatgggattctgg

SEQ ID NO: 3489923 - DNA, 17 bp, Homo sapiens
gatgggattctggacag

SEQ ID NO: 3489924 - DNA, 17 bp, Homo sapiens
gatgggcccctggcccc

SEQ ID NO: 3489925 - DNA, 20 bp, Homo sapiens
gagtctcactgttgcccagg

SEQ ID NO: 3489926 - DNA, 22 bp, Homo sapiens
gagtctcactgttgcccaggct

SEQ ID NO: 3489927 - DNA, 15 bp, Homo sapiens
gagtcttgctatatt

SEQ ID NO: 3489928 - DNA, 18 bp, Homo sapiens
gagtgaaagttgccatta

SEQ ID NO: 3489929 - DNA, 12 bp, Homo sapiens
gagtgaaatact

SEQ ID NO: 3489930 - DNA, 22 bp, Homo sapiens
gagtgacacccaagagggctgc

SEQ ID NO: 3489931 - DNA, 14 bp, Homo sapiens
gagtgacagaggca

SEQ ID NO: 3489932 - DNA, 16 bp, Homo sapiens
gagtgacagaggcagc

SEQ ID NO: 3489933 - DNA, 18 bp, Homo sapiens
gagtgacagaggcagccc

SEQ ID NO: 3489934 - DNA, 13 bp, Homo sapiens
gagtgactctcca

SEQ ID NO: 3489935 - DNA, 22 bp, Homo sapiens
gagtgagacccagccctcatcc

SEQ ID NO: 3489936 - DNA, 15 bp, Homo sapiens
gagtgatatggagca

SEQ ID NO: 3489937 - DNA, 17 bp, Homo sapiens
gagtgatatggagcaag

SEQ ID NO: 3489938 - DNA, 21 bp, Homo sapiens
gagtgcaagcccctgctccag

SEQ ID NO: 3489939 - DNA, 22 bp, Homo sapiens
gagtgcagtcctgatcagagcc

SEQ ID NO: 3489940 - DNA, 18 bp, Homo sapiens
gagtgcagtgagccgaga

SEQ ID NO: 3489941 - DNA, 23 bp, Homo sapiens
gagtgccccattcttttgtaatt

SEQ ID NO: 3489942 - DNA, 16 bp, Homo sapiens
gagtggcaggggacag

SEQ ID NO: 3489943 - DNA, 11 bp, Homo sapiens
gagtggccact

SEQ ID NO: 3489944 - DNA, 23 bp, Homo sapiens
gagtgtcctaggagtatcctcat

SEQ ID NO: 3489945 - DNA, 13 bp, Homo sapiens
gagtgtctttcca

SEQ ID NO: 3489946 - DNA, 17 bp, Homo sapiens
gagtgtgcctgaagtcc

SEQ ID NO: 3489947 - DNA, 20 bp, Homo sapiens
gagtgtgcctgaagtcccag

SEQ ID NO: 3489948 - DNA, 17 bp, Homo sapiens
gagtgtgtgataaatca

SEQ ID NO: 3489949 - DNA, 14 bp, Homo sapiens
gagtgttatgtatt

SEQ ID NO: 3489950 - DNA, 15 bp, Homo sapiens
gagtgttatgtattt

SEQ ID NO: 3489951 - DNA, 19 bp, Homo sapiens
gagtgttccccttccactg

SEQ ID NO: 3489952 - DNA, 22 bp, Homo sapiens
gagttaaatagagtatatgcac

SEQ ID NO: 3489953 - DNA, 14 bp, Homo sapiens
gagttaagacctgg

SEQ ID NO: 3489954 - DNA, 17 bp, Homo sapiens
gagttaagacctggcag

SEQ ID NO: 3489955 - DNA, 14 bp, Homo sapiens
gagttagactgttg

SEQ ID NO: 3489956 - DNA, 18 bp, Homo sapiens
gagttaggctattcacaa

SEQ ID NO: 3489957 - DNA, 19 bp, Homo sapiens
gagttcaggtagctgcccc

SEQ ID NO: 3489958 - DNA, 21 bp, Homo sapiens
gagttgaaaatcttataattt

SEQ ID NO: 3489959 - DNA, 20 bp, Homo sapiens
gagttgatctggaacccaga

SEQ ID NO: 3489960 - DNA, 15 bp, Homo sapiens
gagttgattcagctc

SEQ ID NO: 3489961 - DNA, 18 bp, Homo sapiens
gagttgattcagctctgc

SEQ ID NO: 3489962 - DNA, 17 bp, Homo sapiens
gagttgccccgtctctg

SEQ ID NO: 3489963 - DNA, 14 bp, Homo sapiens
gagttgtcactgct

SEQ ID NO: 3489964 - DNA, 19 bp, Homo sapiens
gagttttgttttaaaatta

SEQ ID NO: 3489965 - DNA, 20 bp, Homo sapiens
gagttttgttttttgtttct

SEQ ID NO: 3489966 - DNA, 16 bp, Homo sapiens
gataaagatttcttga

SEQ ID NO: 3489967 - DNA, 16 bp, Homo sapiens
gataaagcagctcagg

SEQ ID NO: 3489968 - DNA, 14 bp, Homo sapiens
gataactttttaaa

SEQ ID NO: 3489969 - DNA, 17 bp, Homo sapiens
gataagaccaccacctc

SEQ ID NO: 3489970 - DNA, 20 bp, Homo sapiens
gataagagggcacacactgt

SEQ ID NO: 3489971 - DNA, 13 bp, Homo sapiens
gataaggaaatca

SEQ ID NO: 3489972 - DNA, 20 bp, Homo sapiens
gataaggtaaaatgccatga

SEQ ID NO: 3489973 - DNA, 16 bp, Homo sapiens
gataagtgtatttttc

SEQ ID NO: 3489974 - DNA, 17 bp, Homo sapiens
gataatatgagaatcag

SEQ ID NO: 3489975 - DNA, 11 bp, Homo sapiens
gataattacaa

SEQ ID NO: 3489976 - DNA, 19 bp, Homo sapiens
gataattacaatacaaagg

SEQ ID NO: 3489977 - DNA, 21 bp, Homo sapiens
gataattagatgattatatat

SEQ ID NO: 3489978 - DNA, 11 bp, Homo sapiens
gatacaataaa

SEQ ID NO: 3489979 - DNA, 21 bp, Homo sapiens
gatacacccaaagtatcagga

SEQ ID NO: 3489980 - DNA, 23 bp, Homo sapiens
gatacaggaaaagctgctgacag

SEQ ID NO: 3489981 - DNA, 18 bp, Homo sapiens
gatacagtcaacaagcct

SEQ ID NO: 3489982 - DNA, 17 bp, Homo sapiens
gatacatccaaagcaga

SEQ ID NO: 3489983 - DNA, 21 bp, Homo sapiens
gatacatccaaagcagacagc

SEQ ID NO: 3489984 - DNA, 23 bp, Homo sapiens
gatacatccaaagcagacagctc

SEQ ID NO: 3489985 - DNA, 12 bp, Homo sapiens
gatacatttctg

SEQ ID NO: 3489986 - DNA, 19 bp, Homo sapiens
gataccatcttctgtacca

SEQ ID NO: 3489987 - DNA, 14 bp, Homo sapiens
gatacctaaaacat

SEQ ID NO: 3489988 - DNA, 23 bp, Homo sapiens
gatactgctactgtaattttata

SEQ ID NO: 3489989 - DNA, 15 bp, Homo sapiens
gaggaagaggctgca

SEQ ID NO: 3489990 - DNA, 16 bp, Homo sapiens
gaggaagtacaaacta

SEQ ID NO: 3489991 - DNA, 13 bp, Homo sapiens
gaggaatgtatat

SEQ ID NO: 3489992 - DNA, 20 bp, Homo sapiens
gaggacaggcgggaggaggt

SEQ ID NO: 3489993 - DNA, 21 bp, Homo sapiens
gaggaccccttaatcttgctt

SEQ ID NO: 3489994 - DNA, 20 bp, Homo sapiens
gaggactgtagggagggcgg

SEQ ID NO: 3489995 - DNA, 22 bp, Homo sapiens
gaggagaaatttgataatgaca

SEQ ID NO: 3489996 - DNA, 23 bp, Homo sapiens
gaggagacggaggggagtagaga

SEQ ID NO: 3489997 - DNA, 12 bp, Homo sapiens
gaggagagagcc

SEQ ID NO: 3489998 - DNA, 15 bp, Homo sapiens
gaggagagagccttg

SEQ ID NO: 3489999 - DNA, 17 bp, Homo sapiens
gaggagatgctccttgg

SEQ ID NO: 3490000 - DNA, 17 bp, Homo sapiens
gaggagccccatctgtc

SEQ ID NO: 3490001 - DNA, 17 bp, Homo sapiens
gaggagcccctggacat

SEQ ID NO: 3490002 - DNA, 22 bp, Homo sapiens
gaggaggggcccccctgccctg

SEQ ID NO: 3490003 - DNA, 17 bp, Homo sapiens
gaggaggtcgaatgggt

SEQ ID NO: 3490004 - DNA, 15 bp, Homo sapiens
gaggaggtgtgagga

SEQ ID NO: 3490005 - DNA, 16 bp, Homo sapiens
gaggagttagccaaac

SEQ ID NO: 3490006 - DNA, 18 bp, Homo sapiens
gaggataaattgccataa

SEQ ID NO: 3490007 - DNA, 16 bp, Homo sapiens
gaggataactttttaa

SEQ ID NO: 3490008 - DNA, 16 bp, Homo sapiens
gaggatctcttgagcc

SEQ ID NO: 3490009 - DNA, 19 bp, Homo sapiens
gaggatctcttgagcctgg

SEQ ID NO: 3490010 - DNA, 17 bp, Homo sapiens
gaggatgggtcagagct

SEQ ID NO: 3490011 - DNA, 13 bp, Homo sapiens
gaggcaagccctg

SEQ ID NO: 3490012 - DNA, 22 bp, Homo sapiens
gaggcaatgggagctgaggcca

SEQ ID NO: 3490013 - DNA, 20 bp, Homo sapiens
gaggcagatgtggggctgag

SEQ ID NO: 3490014 - DNA, 19 bp, Homo sapiens
gaggcagccccattctgcc

SEQ ID NO: 3490015 - DNA, 15 bp, Homo sapiens
gaggcatcctctgac

SEQ ID NO: 3490016 - DNA, 16 bp, Homo sapiens
gaggcatcctctgact

SEQ ID NO: 3490017 - DNA, 17 bp, Homo sapiens
gaggcatcctctgactc

SEQ ID NO: 3490018 - DNA, 20 bp, Homo sapiens
gaggcatcctctgactccac

SEQ ID NO: 3490019 - DNA, 21 bp, Homo sapiens
gaggcatcctctgactccact

SEQ ID NO: 3490020 - DNA, 18 bp, Homo sapiens
gaggccaaaggctggtgg

SEQ ID NO: 3490021 - DNA, 19 bp, Homo sapiens
gaggccaaaggctggtggc

SEQ ID NO: 3490022 - DNA, 18 bp, Homo sapiens
gaggccaacactgtgggt

SEQ ID NO: 3490023 - DNA, 21 bp, Homo sapiens
gaggccaagcagtgcctgcct

SEQ ID NO: 3490024 - DNA, 10 bp, Homo sapiens
gaggccagct

SEQ ID NO: 3490025 - DNA, 22 bp, Homo sapiens
gaggccagctatctgcctgaca

SEQ ID NO: 3490026 - DNA, 13 bp, Homo sapiens
gaggccagggcag

SEQ ID NO: 3490027 - DNA, 17 bp, Homo sapiens
gaggccatgggcctcct

SEQ ID NO: 3490028 - DNA, 18 bp, Homo sapiens
gaggccatgggcctcctg

SEQ ID NO: 3490029 - DNA, 21 bp, Homo sapiens
gaggccatgggcctcctgtgt

SEQ ID NO: 3490030 - DNA, 23 bp, Homo sapiens
gaggccatgggcctcctgtgtgt

SEQ ID NO: 3490031 - DNA, 13 bp, Homo sapiens
gaggcccagttca

SEQ ID NO: 3490032 - DNA, 12 bp, Homo sapiens
gaggccccagcc

SEQ ID NO: 3490033 - DNA, 22 bp, Homo sapiens
gaggccccagcctccctgaagc

SEQ ID NO: 3490034 - DNA, 23 bp, Homo sapiens
gaggccccagcctccctgaagcc

SEQ ID NO: 3490035 - DNA, 15 bp, Homo sapiens
gaggcccccagccca

SEQ ID NO: 3490036 - DNA, 17 bp, Homo sapiens
gaggcccccagcccagg

SEQ ID NO: 3490037 - DNA, 19 bp, Homo sapiens
gaggcccccagcccagggc

SEQ ID NO: 3490038 - DNA, 22 bp, Homo sapiens
gaggcccctatgtagtccgtgc

SEQ ID NO: 3490039 - DNA, 20 bp, Homo sapiens
gaggccccttctaggtggca

SEQ ID NO: 3490040 - DNA, 17 bp, Homo sapiens
gaggccctcgctgccag

SEQ ID NO: 3490041 - DNA, 19 bp, Homo sapiens
gaggccctggtcctggcct

SEQ ID NO: 3490042 - DNA, 12 bp, Homo sapiens
gaggcccttcct

SEQ ID NO: 3490043 - DNA, 16 bp, Homo sapiens
gaggccctttgctgtc

SEQ ID NO: 3490044 - DNA, 12 bp, Homo sapiens
gaggcctcaggt

SEQ ID NO: 3490045 - DNA, 14 bp, Homo sapiens
gagagtctggccct

SEQ ID NO: 3490046 - DNA, 14 bp, Homo sapiens
gagagttttggatg

SEQ ID NO: 3490047 - DNA, 16 bp, Homo sapiens
gagatagcctgtggcc

SEQ ID NO: 3490048 - DNA, 23 bp, Homo sapiens
gagatcaaccccttcgctcctgt

SEQ ID NO: 3490049 - DNA, 18 bp, Homo sapiens
gagatcacgccactgcac

SEQ ID NO: 3490050 - DNA, 19 bp, Homo sapiens
gagatcacgccactgcact

SEQ ID NO: 3490051 - DNA, 13 bp, Homo sapiens
gagatcctcctgc

SEQ ID NO: 3490052 - DNA, 23 bp, Homo sapiens
gagatcctcctgcagaccacgcc

SEQ ID NO: 3490053 - DNA, 21 bp, Homo sapiens
gagatgcaccaccaagccaag

SEQ ID NO: 3490054 - DNA, 20 bp, Homo sapiens
gagatggaagttgcagtgag

SEQ ID NO: 3490055 - DNA, 13 bp, Homo sapiens
gagatggagctac

SEQ ID NO: 3490056 - DNA, 17 bp, Homo sapiens
gagatggagtcttgcta

SEQ ID NO: 3490057 - DNA, 15 bp, Homo sapiens
gagatggatcacata

SEQ ID NO: 3490058 - DNA, 21 bp, Homo sapiens
gagatgggctgaactgagcct

SEQ ID NO: 3490059 - DNA, 15 bp, Homo sapiens
gagattacctcctga

SEQ ID NO: 3490060 - DNA, 13 bp, Homo sapiens
gagattattcctt

SEQ ID NO: 3490061 - DNA, 13 bp, Homo sapiens
gagattcattttc

SEQ ID NO: 3490062 - DNA, 18 bp, Homo sapiens
gagattgcaccactgcac

SEQ ID NO: 3490063 - DNA, 21 bp, Homo sapiens
gagattgcaccactgcactcc

SEQ ID NO: 3490064 - DNA, 19 bp, Homo sapiens
gagatttttaaaaaatatt

SEQ ID NO: 3490065 - DNA, 20 bp, Homo sapiens
gagcaagtatgctgtggagt

SEQ ID NO: 3490066 - DNA, 22 bp, Homo sapiens
gagcacacaggtacagcaacag

SEQ ID NO: 3490067 - DNA, 16 bp, Homo sapiens
gagcacacccagcccc

SEQ ID NO: 3490068 - DNA, 20 bp, Homo sapiens
gagcacccagatcagactct

SEQ ID NO: 3490069 - DNA, 22 bp, Homo sapiens
gagcaccgtgtcaagctgctct

SEQ ID NO: 3490070 - DNA, 14 bp, Homo sapiens
gagcactgatggaa

SEQ ID NO: 3490071 - DNA, 19 bp, Homo sapiens
gagcactgttctgggactc

SEQ ID NO: 3490072 - DNA, 14 bp, Homo sapiens
gagcagacaggaca

SEQ ID NO: 3490073 - DNA, 21 bp, Homo sapiens
gagcagcaggtagcctgctgg

SEQ ID NO: 3490074 - DNA, 19 bp, Homo sapiens
gagcaggactccaggccca

SEQ ID NO: 3490075 - DNA, 20 bp, Homo sapiens
gagcaggactccaggcccaa

SEQ ID NO: 3490076 - DNA, 22 bp, Homo sapiens
gagcaggcggtgggcacccacc

SEQ ID NO: 3490077 - DNA, 21 bp, Homo sapiens
gagcagggctcagcggggaca

SEQ ID NO: 3490078 - DNA, 16 bp, Homo sapiens
gagcagtcctgcctca

SEQ ID NO: 3490079 - DNA, 16 bp, Homo sapiens
gagcagttcagagtgg

SEQ ID NO: 3490080 - DNA, 14 bp, Homo sapiens
gagcatcacagaat

SEQ ID NO: 3490081 - DNA, 20 bp, Homo sapiens
gagcatcggcctagggcccc

SEQ ID NO: 3490082 - DNA, 17 bp, Homo sapiens
gagcatgacagcctgca

SEQ ID NO: 3490083 - DNA, 17 bp, Homo sapiens
gagcatggagctggccg

SEQ ID NO: 3490084 - DNA, 20 bp, Homo sapiens
gagcattttgataccagaag

SEQ ID NO: 3490085 - DNA, 20 bp, Homo sapiens
gagccaacagaagcttccat

SEQ ID NO: 3490086 - DNA, 18 bp, Homo sapiens
gagccaaggggcttcagg

SEQ ID NO: 3490087 - DNA, 14 bp, Homo sapiens
gagccactgccact

SEQ ID NO: 3490088 - DNA, 22 bp, Homo sapiens
gagccactgccactccagtcct

SEQ ID NO: 3490089 - DNA, 14 bp, Homo sapiens
gagccagggtctca

SEQ ID NO: 3490090 - DNA, 21 bp, Homo sapiens
gagccatgtagaagctgcatc

SEQ ID NO: 3490091 - DNA, 17 bp, Homo sapiens
gagcccaccttggctca

SEQ ID NO: 3490092 - DNA, 13 bp, Homo sapiens
ctttttgtgaaga

SEQ ID NO: 3490093 - DNA, 18 bp, Homo sapiens
cttttttaaatattttct

SEQ ID NO: 3490094 - DNA, 22 bp, Homo sapiens
cttttttaaatattttctattt

SEQ ID NO: 3490095 - DNA, 15 bp, Homo sapiens
cttttttcactacat

SEQ ID NO: 3490096 - DNA, 15 bp, Homo sapiens
cttttttctgcctcc

SEQ ID NO: 3490097 - DNA, 19 bp, Homo sapiens
cttttttctgcctccttta

SEQ ID NO: 3490098 - DNA, 16 bp, Homo sapiens
cttttttctttttcct

SEQ ID NO: 3490099 - DNA, 13 bp, Homo sapiens
cttttttgtacat

SEQ ID NO: 3490100 - DNA, 16 bp, Homo sapiens
cttttttgttttttca

SEQ ID NO: 3490101 - DNA, 13 bp, Homo sapiens
gaacacaaagacc

SEQ ID NO: 3490102 - DNA, 22 bp, Homo sapiens
gaacacggccacatcaaagagg

SEQ ID NO: 3490103 - DNA, 15 bp, Homo sapiens
gaacactagacaagc

SEQ ID NO: 3490104 - DNA, 17 bp, Homo sapiens
gaacactagacaagcca

SEQ ID NO: 3490105 - DNA, 16 bp, Homo sapiens
gaacactcttttgctt

SEQ ID NO: 3490106 - DNA, 22 bp, Homo sapiens
gaacactggcagactgtgtaaa

SEQ ID NO: 3490107 - DNA, 15 bp, Homo sapiens
gaacagactggaagc

SEQ ID NO: 3490108 - DNA, 19 bp, Homo sapiens
gaacagactggaagcacag

SEQ ID NO: 3490109 - DNA, 16 bp, Homo sapiens
gaacaggtggttttta

SEQ ID NO: 3490110 - DNA, 15 bp, Homo sapiens
gaacaggtgtttttc

SEQ ID NO: 3490111 - DNA, 16 bp, Homo sapiens
gaacagtcacgcctga

SEQ ID NO: 3490112 - DNA, 19 bp, Homo sapiens
gaacagtcacgcctgaaac

SEQ ID NO: 3490113 - DNA, 20 bp, Homo sapiens
gaacatcatcaaggcactgc

SEQ ID NO: 3490114 - DNA, 21 bp, Homo sapiens
gaacatcatcaaggcactgcc

SEQ ID NO: 3490115 - DNA, 13 bp, Homo sapiens
gaacatgaagcca

SEQ ID NO: 3490116 - DNA, 15 bp, Homo sapiens
gaacatgatgggcct

SEQ ID NO: 3490117 - DNA, 22 bp, Homo sapiens
gaacatgcagtttgaaattctg

SEQ ID NO: 3490118 - DNA, 18 bp, Homo sapiens
gaaccaccacacccagcc

SEQ ID NO: 3490119 - DNA, 21 bp, Homo sapiens
gaaccacgcgggggccttgag

SEQ ID NO: 3490120 - DNA, 17 bp, Homo sapiens
gaaccagccggggcctt

SEQ ID NO: 3490121 - DNA, 17 bp, Homo sapiens
gaaccaggagaagggct

SEQ ID NO: 3490122 - DNA, 22 bp, Homo sapiens
gaaccaggagaagggctggggc

SEQ ID NO: 3490123 - DNA, 13 bp, Homo sapiens
gaacccagactca

SEQ ID NO: 3490124 - DNA, 17 bp, Homo sapiens
gaacccagactcagaca

SEQ ID NO: 3490125 - DNA, 20 bp, Homo sapiens
gaaccccggggtgcccacag

SEQ ID NO: 3490126 - DNA, 15 bp, Homo sapiens
gaacccctggctcct

SEQ ID NO: 3490127 - DNA, 16 bp, Homo sapiens
gaaccctgccatggaa

SEQ ID NO: 3490128 - DNA, 22 bp, Homo sapiens
gaaccctgccatggaactgttt

SEQ ID NO: 3490129 - DNA, 17 bp, Homo sapiens
gaaccctggggcctgac

SEQ ID NO: 3490130 - DNA, 20 bp, Homo sapiens
gaacccttggcttgcccacg

SEQ ID NO: 3490131 - DNA, 21 bp, Homo sapiens
gaacccttggcttgcccacgt

SEQ ID NO: 3490132 - DNA, 13 bp, Homo sapiens
gaaccgcaggaag

SEQ ID NO: 3490133 - DNA, 15 bp, Homo sapiens
gaaccgcaggaagct

SEQ ID NO: 3490134 - DNA, 15 bp, Homo sapiens
gaaccgtaggaccca

SEQ ID NO: 3490135 - DNA, 18 bp, Homo sapiens
gaaccgttttgaagctac

SEQ ID NO: 3490136 - DNA, 18 bp, Homo sapiens
gaacctcacgcacctccc

SEQ ID NO: 3490137 - DNA, 19 bp, Homo sapiens
gaacctcacgcacctccca

SEQ ID NO: 3490138 - DNA, 21 bp, Homo sapiens
gaacctcacgcacctcccatc

SEQ ID NO: 3490139 - DNA, 13 bp, Homo sapiens
gaacctcagcctg

SEQ ID NO: 3490140 - DNA, 17 bp, Homo sapiens
gaacctcagcctggcca

SEQ ID NO: 3490141 - DNA, 18 bp, Homo sapiens
gaacctcagcctggccag

SEQ ID NO: 3490142 - DNA, 19 bp, Homo sapiens
gaacctcagcctggccaga

SEQ ID NO: 3490143 - DNA, 21 bp, Homo sapiens
gaacctcagcctggccagaca

SEQ ID NO: 3490144 - DNA, 18 bp, Homo sapiens
gaacctccccagcctgcg

SEQ ID NO: 3490145 - DNA, 16 bp, Homo sapiens
gaacctcctctgtgaa

SEQ ID NO: 3490146 - DNA, 16 bp, Homo sapiens
gaacctcgagtactgt

SEQ ID NO: 3490147 - DNA, 17 bp, Homo sapiens
gaacctcgagtactgtg

SEQ ID NO: 3490148 - DNA, 23 bp, Homo sapiens
gaaccttacagtaaagtatagaa

SEQ ID NO: 3490149 - DNA, 21 bp, Homo sapiens
gaaccttctggcctcccacag

SEQ ID NO: 3490150 - DNA, 22 bp, Homo sapiens
gaacgaaccttggcctgggccg

SEQ ID NO: 3490151 - DNA, 17 bp, Homo sapiens
gaacggtaaatttctgt

SEQ ID NO: 3490152 - DNA, 13 bp, Homo sapiens
gaacgtaaagaac

SEQ ID NO: 3490153 - DNA, 19 bp, Homo sapiens
gaactaatttcttctcctg

SEQ ID NO: 3490154 - DNA, 21 bp, Homo sapiens
gaactatggacggtgctccag

SEQ ID NO: 3490155 - DNA, 19 bp, Homo sapiens
gaactcaaacttctggctc

SEQ ID NO: 3490156 - DNA, 22 bp, Homo sapiens
gaactcaaatggggccagatcc

SEQ ID NO: 3490157 - DNA, 16 bp, Homo sapiens
gaactcactggggcct

SEQ ID NO: 3490158 - DNA, 15 bp, Homo sapiens
gaactcagatccagg

SEQ ID NO: 3490159 - DNA, 19 bp, Homo sapiens
gaactcagatccagggaca

SEQ ID NO: 3490160 - DNA, 19 bp, Homo sapiens
gaactcatcactgtggctg

SEQ ID NO: 3490161 - DNA, 15 bp, Homo sapiens
gaactcctgacctca

SEQ ID NO: 3490162 - DNA, 14 bp, Homo sapiens
gaactcctggcctc

SEQ ID NO: 3490163 - DNA, 16 bp, Homo sapiens
gaactccttccccact

SEQ ID NO: 3490164 - DNA, 17 bp, Homo sapiens
gaactccttccccactt

SEQ ID NO: 3490165 - DNA, 19 bp, Homo sapiens
gaactctggtggcacagga

SEQ ID NO: 3490166 - DNA, 14 bp, Homo sapiens
gaactgcaggccct

SEQ ID NO: 3490167 - DNA, 19 bp, Homo sapiens
gaactgcaggccctggcct

SEQ ID NO: 3490168 - DNA, 15 bp, Homo sapiens
gaactgcatatgttt

SEQ ID NO: 3490169 - DNA, 15 bp, Homo sapiens
gaactgcatgctgct

SEQ ID NO: 3490170 - DNA, 22 bp, Homo sapiens
gaactgctagtcaagtgcgtcc

SEQ ID NO: 3490171 - DNA, 20 bp, Homo sapiens
gaactggaccctgttgctaa

SEQ ID NO: 3490172 - DNA, 22 bp, Homo sapiens
gaactggaccctgttgctaagc

SEQ ID NO: 3490173 - DNA, 14 bp, Homo sapiens
gaactggagggtga

SEQ ID NO: 3490174 - DNA, 11 bp, Homo sapiens
gaactggctgc

SEQ ID NO: 3490175 - DNA, 12 bp, Homo sapiens
gaactggctgca

SEQ ID NO: 3490176 - DNA, 14 bp, Homo sapiens
gaactgtgccacaa

SEQ ID NO: 3490177 - DNA, 18 bp, Homo sapiens
gaactgtgtgtaattgtt

SEQ ID NO: 3490178 - DNA, 17 bp, Homo sapiens
gaacttacattgttcaa

SEQ ID NO: 3490179 - DNA, 22 bp, Homo sapiens
gaacttagccatttttcaaagc

SEQ ID NO: 3490180 - DNA, 23 bp, Homo sapiens
gaacttccaggtgttactgtaat

SEQ ID NO: 3490181 - DNA, 17 bp, Homo sapiens
gaacttggaggcaccat

SEQ ID NO: 3490182 - DNA, 17 bp, Homo sapiens
gaacttgggccactgtg

SEQ ID NO: 3490183 - DNA, 15 bp, Homo sapiens
gaacttgtctcttca

SEQ ID NO: 3490184 - DNA, 13 bp, Homo sapiens
gaactttcatttt

SEQ ID NO: 3490185 - DNA, 14 bp, Homo sapiens
gaactttcattttt

SEQ ID NO: 3490186 - DNA, 24 bp, Homo sapiens
gaactttccacattcagagcttac

SEQ ID NO: 3490187 - DNA, 14 bp, Homo sapiens
gaactttgggaagc

SEQ ID NO: 3490188 - DNA, 22 bp, Homo sapiens
gaacttttttttttaatgtttt

SEQ ID NO: 3490189 - DNA, 22 bp, Homo sapiens
gaagaacgttttttcctcagtg

SEQ ID NO: 3490190 - DNA, 13 bp, Homo sapiens
gaagaactgcagg

SEQ ID NO: 3490191 - DNA, 19 bp, Homo sapiens
gaagaactgcaggccctgg

SEQ ID NO: 3490192 - DNA, 20 bp, Homo sapiens
gaagaatctgtttcccagca

SEQ ID NO: 3490193 - DNA, 18 bp, Homo sapiens
gaagacaattgacaacag

SEQ ID NO: 3490194 - DNA, 13 bp, Homo sapiens
gaagacacctgca

SEQ ID NO: 3490195 - DNA, 18 bp, Homo sapiens
gaagacagagacctcctg

SEQ ID NO: 3490196 - DNA, 21 bp, Homo sapiens
gaagacagagacctcctgcct

SEQ ID NO: 3490197 - DNA, 22 bp, Homo sapiens
gaagacctggcaaggacacaga

SEQ ID NO: 3490198 - DNA, 19 bp, Homo sapiens
gaagactcattcttctgta

SEQ ID NO: 3490199 - DNA, 23 bp, Homo sapiens
gaagagcaggactccaggcccaa

SEQ ID NO: 3490200 - DNA, 13 bp, Homo sapiens
gaagaggacttcg

SEQ ID NO: 3490201 - DNA, 23 bp, Homo sapiens
gaagaggcctaagtcaaaacttg

SEQ ID NO: 3490202 - DNA, 16 bp, Homo sapiens
gaagagtcctctgaat

SEQ ID NO: 3490203 - DNA, 18 bp, Homo sapiens
gaagagtgggtttcacaa

SEQ ID NO: 3490204 - DNA, 21 bp, Homo sapiens
gaagagttgccccgtctctgt

SEQ ID NO: 3490205 - DNA, 21 bp, Homo sapiens
gaagataagtgtatttttcaa

SEQ ID NO: 3490206 - DNA, 14 bp, Homo sapiens
gaagatagtaactg

SEQ ID NO: 3490207 - DNA, 21 bp, Homo sapiens
gaagatataactattgcccag

SEQ ID NO: 3490208 - DNA, 14 bp, Homo sapiens
gaagatcctgcggg

SEQ ID NO: 3490209 - DNA, 22 bp, Homo sapiens
gaagatcctgcgggtggggctt

SEQ ID NO: 3490210 - DNA, 13 bp, Homo sapiens
gaagatcctgtga

SEQ ID NO: 3490211 - DNA, 20 bp, Homo sapiens
gaagatcctgtgaggagccc

SEQ ID NO: 3490212 - DNA, 22 bp, Homo sapiens
gaagatctctgcagggccgcca

SEQ ID NO: 3490213 - DNA, 15 bp, Homo sapiens
gaagattaagacaga

SEQ ID NO: 3490214 - DNA, 17 bp, Homo sapiens
gaagattaagacagaga

SEQ ID NO: 3490215 - DNA, 16 bp, Homo sapiens
gaagcaccataacttt

SEQ ID NO: 3490216 - DNA, 20 bp, Homo sapiens
gaagcagatgcaaagaggca

SEQ ID NO: 3490217 - DNA, 14 bp, Homo sapiens
gaagcaggctacac

SEQ ID NO: 3490218 - DNA, 18 bp, Homo sapiens
gaagcaggctacactgac

SEQ ID NO: 3490219 - DNA, 23 bp, Homo sapiens
gaagcaggctacactgacactgg

SEQ ID NO: 3490220 - DNA, 12 bp, Homo sapiens
gaagcaggttcc

SEQ ID NO: 3490221 - DNA, 13 bp, Homo sapiens
gaagccaaagagt

SEQ ID NO: 3490222 - DNA, 16 bp, Homo sapiens
gaagccacaggcctga

SEQ ID NO: 3490223 - DNA, 10 bp, Homo sapiens
gaagccagct

SEQ ID NO: 3490224 - DNA, 15 bp, Homo sapiens
gaagccagctgccct

SEQ ID NO: 3490225 - DNA, 18 bp, Homo sapiens
gaagcccaattgctggag

SEQ ID NO: 3490226 - DNA, 19 bp, Homo sapiens
gaagcccagcccctactgc

SEQ ID NO: 3490227 - DNA, 22 bp, Homo sapiens
gaagcccagcccctactgctgt

SEQ ID NO: 3490228 - DNA, 21 bp, Homo sapiens
gaagcccccagctaagaacct

SEQ ID NO: 3490229 - DNA, 16 bp, Homo sapiens
gaagctaatttgcatt

SEQ ID NO: 3490230 - DNA, 20 bp, Homo sapiens
gaagctactgtgtgtgtgaa

SEQ ID NO: 3490231 - DNA, 14 bp, Homo sapiens
gaagctcagactgg

SEQ ID NO: 3490232 - DNA, 20 bp, Homo sapiens
gaagctcctctccccagccc

SEQ ID NO: 3490233 - DNA, 17 bp, Homo sapiens
gactgaaaacctctcct

SEQ ID NO: 3490234 - DNA, 21 bp, Homo sapiens
gactgaacattagttgcacta

SEQ ID NO: 3490235 - DNA, 16 bp, Homo sapiens
gactgcccggcacaga

SEQ ID NO: 3490236 - DNA, 16 bp, Homo sapiens
gactgccttgcctcct

SEQ ID NO: 3490237 - DNA, 17 bp, Homo sapiens
gactgccttgcctcctc

SEQ ID NO: 3490238 - DNA, 19 bp, Homo sapiens
gactgctcagaacttgctg

SEQ ID NO: 3490239 - DNA, 23 bp, Homo sapiens
gactgctcagaacttgctgctgt

SEQ ID NO: 3490240 - DNA, 16 bp, Homo sapiens
gactggaagcacagct

SEQ ID NO: 3490241 - DNA, 18 bp, Homo sapiens
gactggaagcacagcttc

SEQ ID NO: 3490242 - DNA, 12 bp, Homo sapiens
gactggccaggg

SEQ ID NO: 3490243 - DNA, 18 bp, Homo sapiens
gactgggagccgcagcag

SEQ ID NO: 3490244 - DNA, 23 bp, Homo sapiens
gactgggagccgcagcagctccc

SEQ ID NO: 3490245 - DNA, 19 bp, Homo sapiens
gactggtggcaggggcttc

SEQ ID NO: 3490246 - DNA, 13 bp, Homo sapiens
gactgtagggagg

SEQ ID NO: 3490247 - DNA, 22 bp, Homo sapiens
gactgtgtgttgccacaggaca

SEQ ID NO: 3490248 - DNA, 16 bp, Homo sapiens
gactgttttctcttga

SEQ ID NO: 3490249 - DNA, 16 bp, Homo sapiens
gacttaaaagagctca

SEQ ID NO: 3490250 - DNA, 20 bp, Homo sapiens
gacttaagcaaaagaaaaag

SEQ ID NO: 3490251 - DNA, 16 bp, Homo sapiens
gacttagggcaccagg

SEQ ID NO: 3490252 - DNA, 17 bp, Homo sapiens
gacttcagtatgttgtc

SEQ ID NO: 3490253 - DNA, 19 bp, Homo sapiens
gacttcagtatgttgtcaa

SEQ ID NO: 3490254 - DNA, 24 bp, Homo sapiens
gacttcatctcccacctagcagca

SEQ ID NO: 3490255 - DNA, 12 bp, Homo sapiens
gacttcccagct

SEQ ID NO: 3490256 - DNA, 13 bp, Homo sapiens
gacttcccagcta

SEQ ID NO: 3490257 - DNA, 19 bp, Homo sapiens
gacttccccggagggctgc

SEQ ID NO: 3490258 - DNA, 19 bp, Homo sapiens
gacttcctgtccagctcca

SEQ ID NO: 3490259 - DNA, 20 bp, Homo sapiens
gacttcctgtccagctccaa

SEQ ID NO: 3490260 - DNA, 14 bp, Homo sapiens
gacttccttgagac

SEQ ID NO: 3490261 - DNA, 15 bp, Homo sapiens
gacttccttgagaca

SEQ ID NO: 3490262 - DNA, 11 bp, Homo sapiens
gacttgaagtt

SEQ ID NO: 3490263 - DNA, 12 bp, Homo sapiens
gacttgaagttg

SEQ ID NO: 3490264 - DNA, 19 bp, Homo sapiens
gacttgactttagtctgca

SEQ ID NO: 3490265 - DNA, 17 bp, Homo sapiens
gacttgcacagggattc

SEQ ID NO: 3490266 - DNA, 18 bp, Homo sapiens
gacttgcacagggattct

SEQ ID NO: 3490267 - DNA, 14 bp, Homo sapiens
gacttggaagctcc

SEQ ID NO: 3490268 - DNA, 15 bp, Homo sapiens
gacttggaagctccg

SEQ ID NO: 3490269 - DNA, 16 bp, Homo sapiens
gacttggaagctccgc

SEQ ID NO: 3490270 - DNA, 12 bp, Homo sapiens
gactttcaggta

SEQ ID NO: 3490271 - DNA, 14 bp, Homo sapiens
gactttctgcctgg

SEQ ID NO: 3490272 - DNA, 17 bp, Homo sapiens
gactttgtttttaaaat

SEQ ID NO: 3490273 - DNA, 18 bp, Homo sapiens
gaaggccgagaagcaaga

SEQ ID NO: 3490274 - DNA, 17 bp, Homo sapiens
gaaggctgtccttaccc

SEQ ID NO: 3490275 - DNA, 16 bp, Homo sapiens
gaaggcttctctctgt

SEQ ID NO: 3490276 - DNA, 18 bp, Homo sapiens
gaagggcatcatgcatct

SEQ ID NO: 3490277 - DNA, 14 bp, Homo sapiens
gaagggctgcatga

SEQ ID NO: 3490278 - DNA, 18 bp, Homo sapiens
gaagggctgcatgatgtt

SEQ ID NO: 3490279 - DNA, 23 bp, Homo sapiens
gaagggctggggccggggctgag

SEQ ID NO: 3490280 - DNA, 20 bp, Homo sapiens
gaaggggacccccgccccct

SEQ ID NO: 3490281 - DNA, 23 bp, Homo sapiens
gaaggggcaaattcttttgaatt

SEQ ID NO: 3490282 - DNA, 13 bp, Homo sapiens
gaaggtgcctgcc

SEQ ID NO: 3490283 - DNA, 14 bp, Homo sapiens
gaaggtgcctgcca

SEQ ID NO: 3490284 - DNA, 22 bp, Homo sapiens
gaaggtgcctgccatagccagg

SEQ ID NO: 3490285 - DNA, 20 bp, Homo sapiens
gaaggtttacaatttacaaa

SEQ ID NO: 3490286 - DNA, 14 bp, Homo sapiens
gaagtaacagtaac

SEQ ID NO: 3490287 - DNA, 16 bp, Homo sapiens
gaagtaagcctcatca

SEQ ID NO: 3490288 - DNA, 13 bp, Homo sapiens
gaagtaggaagta

SEQ ID NO: 3490289 - DNA, 14 bp, Homo sapiens
gaagtccaatgtgg

SEQ ID NO: 3490290 - DNA, 16 bp, Homo sapiens
gaagtccccaggcccc

SEQ ID NO: 3490291 - DNA, 17 bp, Homo sapiens
gaagtccccaggcccca

SEQ ID NO: 3490292 - DNA, 23 bp, Homo sapiens
gaagtccccaggccccaggaagc

SEQ ID NO: 3490293 - DNA, 14 bp, Homo sapiens
gaagtccttatgtt

SEQ ID NO: 3490294 - DNA, 14 bp, Homo sapiens
gaagtcttttgttc

SEQ ID NO: 3490295 - DNA, 17 bp, Homo sapiens
gaagtgaatgctgggac

SEQ ID NO: 3490296 - DNA, 14 bp, Homo sapiens
gaagtgccatctca

SEQ ID NO: 3490297 - DNA, 19 bp, Homo sapiens
gaagtgctcccctctgaaa

SEQ ID NO: 3490298 - DNA, 18 bp, Homo sapiens
gaagtgtaggcagacaca

SEQ ID NO: 3490299 - DNA, 18 bp, Homo sapiens
gaagtgttgaagggaggt

SEQ ID NO: 3490300 - DNA, 23 bp, Homo sapiens
gaagttacacagaaatgctgctg

SEQ ID NO: 3490301 - DNA, 18 bp, Homo sapiens
gaagttcagaaatttaaa

SEQ ID NO: 3490302 - DNA, 13 bp, Homo sapiens
gaagtttgaatgt

SEQ ID NO: 3490303 - DNA, 14 bp, Homo sapiens
gaagtttgaatgtt

SEQ ID NO: 3490304 - DNA, 16 bp, Homo sapiens
gaagtttgaatgttaa

SEQ ID NO: 3490305 - DNA, 20 bp, Homo sapiens
gaagtttgagatcagcctgg

SEQ ID NO: 3490306 - DNA, 16 bp, Homo sapiens
gaataaaaactttgct

SEQ ID NO: 3490307 - DNA, 15 bp, Homo sapiens
gaataaaatgttgaa

SEQ ID NO: 3490308 - DNA, 21 bp, Homo sapiens
gaataaaatgttgaaaagtca

SEQ ID NO: 3490309 - DNA, 13 bp, Homo sapiens
gaataaagaatac

SEQ ID NO: 3490310 - DNA, 20 bp, Homo sapiens
gaatacaagatattatgtat

SEQ ID NO: 3490311 - DNA, 21 bp, Homo sapiens
gaatacagaggcaactgcatt

SEQ ID NO: 3490312 - DNA, 20 bp, Homo sapiens
gaatactgttaaaggaaaaa

SEQ ID NO: 3490313 - DNA, 14 bp, Homo sapiens
gaatacttgaactt

SEQ ID NO: 3490314 - DNA, 15 bp, Homo sapiens
gaatacttgaacttg

SEQ ID NO: 3490315 - DNA, 16 bp, Homo sapiens
gaatacttgaacttgt

SEQ ID NO: 3490316 - DNA, 14 bp, Homo sapiens
gaatactttataaa

SEQ ID NO: 3490317 - DNA, 20 bp, Homo sapiens
gaatactttttacaattaaa

SEQ ID NO: 3490318 - DNA, 13 bp, Homo sapiens
gaatagcatctgt

SEQ ID NO: 3490319 - DNA, 16 bp, Homo sapiens
gaatagcatctgtaca

SEQ ID NO: 3490320 - DNA, 20 bp, Homo sapiens
gaatagcatctgtacaaagg

SEQ ID NO: 3490321 - DNA, 18 bp, Homo sapiens
gaatagccacatttggaa

SEQ ID NO: 3490322 - DNA, 15 bp, Homo sapiens
gaatagcctgtggcc

SEQ ID NO: 3490323 - DNA, 23 bp, Homo sapiens
gaataggcgatcacaacgtgcat

SEQ ID NO: 3490324 - DNA, 15 bp, Homo sapiens
gaatagtatagacaa

SEQ ID NO: 3490325 - DNA, 23 bp, Homo sapiens
gaatagtctagatggctcctctc

SEQ ID NO: 3490326 - DNA, 20 bp, Homo sapiens
gaatataatatatttgtgta

SEQ ID NO: 3490327 - DNA, 18 bp, Homo sapiens
gaatatagcatctttcat

SEQ ID NO: 3490328 - DNA, 20 bp, Homo sapiens
gaatatatctctatttgaga

SEQ ID NO: 3490329 - DNA, 15 bp, Homo sapiens
gaatatatgtgtgcc

SEQ ID NO: 3490330 - DNA, 16 bp, Homo sapiens
gaatatccatgtactt

SEQ ID NO: 3490331 - DNA, 18 bp, Homo sapiens
gaatatgaatgagaatgt

SEQ ID NO: 3490332 - DNA, 10 bp, Homo sapiens
gaatatttat

SEQ ID NO: 3490333 - DNA, 13 bp, Homo sapiens
gaatatttattac

SEQ ID NO: 3490334 - DNA, 21 bp, Homo sapiens
gaatatttattacctctgata

SEQ ID NO: 3490335 - DNA, 23 bp, Homo sapiens
gaatatttcaagctctgcaacag

SEQ ID NO: 3490336 - DNA, 10 bp, Homo sapiens
gaatatttga

SEQ ID NO: 3490337 - DNA, 20 bp, Homo sapiens
gaatcacttgaacccgggag

SEQ ID NO: 3490338 - DNA, 19 bp, Homo sapiens
gaatcagtataaacaaagt

SEQ ID NO: 3490339 - DNA, 19 bp, Homo sapiens
gaatcagtttccaattatt

SEQ ID NO: 3490340 - DNA, 22 bp, Homo sapiens
gaatcagtttccaattatttga

SEQ ID NO: 3490341 - DNA, 15 bp, Homo sapiens
gaatcatgagcctgc

SEQ ID NO: 3490342 - DNA, 16 bp, Homo sapiens
gaatcatgagcctgct

SEQ ID NO: 3490343 - DNA, 15 bp, Homo sapiens
gaatcatggcctctt

SEQ ID NO: 3490344 - DNA, 12 bp, Homo sapiens
gaatccaaactt

SEQ ID NO: 3490345 - DNA, 17 bp, Homo sapiens
gaatcccaaatttgatt

SEQ ID NO: 3490346 - DNA, 19 bp, Homo sapiens
gaatcccaaatttgattga

SEQ ID NO: 3490347 - DNA, 20 bp, Homo sapiens
gaatcctgcggcaggactgc

SEQ ID NO: 3490348 - DNA, 14 bp, Homo sapiens
gaatctctgtgcct

SEQ ID NO: 3490349 - DNA, 18 bp, Homo sapiens
gaatctctttttgctttc

SEQ ID NO: 3490350 - DNA, 16 bp, Homo sapiens
gaatctgaggcatcct

SEQ ID NO: 3490351 - DNA, 15 bp, Homo sapiens
gaatctgctcacttt

SEQ ID NO: 3490352 - DNA, 12 bp, Homo sapiens
gaatctggagac

SEQ ID NO: 3490353 - DNA, 22 bp, Homo sapiens
gaatctggagaccagggagcct

SEQ ID NO: 3490354 - DNA, 15 bp, Homo sapiens
gaatcttgtctcaat

SEQ ID NO: 3490355 - DNA, 22 bp, Homo sapiens
gaatcttgtctcaatgctcata

SEQ ID NO: 3490356 - DNA, 17 bp, Homo sapiens
gaatctttattgagaaa

SEQ ID NO: 3490357 - DNA, 14 bp, Homo sapiens
gaatgaaagggccc

SEQ ID NO: 3490358 - DNA, 20 bp, Homo sapiens
gaatgaacactcttttgctt

SEQ ID NO: 3490359 - DNA, 18 bp, Homo sapiens
gaatgaaccacatcttgc

SEQ ID NO: 3490360 - DNA, 23 bp, Homo sapiens
gaatgaaccacatcttgctctgc

SEQ ID NO: 3490361 - DNA, 20 bp, Homo sapiens
gaatgagagcgacacagacg

SEQ ID NO: 3490362 - DNA, 18 bp, Homo sapiens
gaatgcagaggtctccaa

SEQ ID NO: 3490363 - DNA, 20 bp, Homo sapiens
gaatgcagtctgtccaggct

SEQ ID NO: 3490364 - DNA, 18 bp, Homo sapiens
gaatgcctgagtgcctgg

SEQ ID NO: 3490365 - DNA, 21 bp, Homo sapiens
gaatgctgcaggacttgagaa

SEQ ID NO: 3490366 - DNA, 19 bp, Homo sapiens
gaatgctgggactcagcct

SEQ ID NO: 3490367 - DNA, 22 bp, Homo sapiens
gaatgcttataggtggcctctc

SEQ ID NO: 3490368 - DNA, 23 bp, Homo sapiens
gaatgggcaattccagaaatctt

SEQ ID NO: 3490369 - DNA, 18 bp, Homo sapiens
gaatgtaagaactacaaa

SEQ ID NO: 3490370 - DNA, 13 bp, Homo sapiens
gaatgtatttatt

SEQ ID NO: 3490371 - DNA, 16 bp, Homo sapiens
gaatgtatttatttgg

SEQ ID NO: 3490372 - DNA, 22 bp, Homo sapiens
gaatgtcaatgccaggatttct

SEQ ID NO: 3490373 - DNA, 13 bp, Homo sapiens
gaatgtgagcaca

SEQ ID NO: 3490374 - DNA, 14 bp, Homo sapiens
gaatgtgtttcaaa

SEQ ID NO: 3490375 - DNA, 13 bp, Homo sapiens
gaatgttaaataa

SEQ ID NO: 3490376 - DNA, 14 bp, Homo sapiens
gaatgttaaataaa

SEQ ID NO: 3490377 - DNA, 16 bp, Homo sapiens
gaatgttaaataaatt

SEQ ID NO: 3490378 - DNA, 23 bp, Homo sapiens
gaatgttaattttttggtacaaa

SEQ ID NO: 3490379 - DNA, 23 bp, Homo sapiens
gaatgttggttttaatacttgat

SEQ ID NO: 3490380 - DNA, 16 bp, Homo sapiens
gaatgtttgcctctgc

SEQ ID NO: 3490381 - DNA, 14 bp, Homo sapiens
gaattaaaaaagca

SEQ ID NO: 3490382 - DNA, 21 bp, Homo sapiens
gacatatttaatgttttaaat

SEQ ID NO: 3490383 - DNA, 14 bp, Homo sapiens
gacatctggaatct

SEQ ID NO: 3490384 - DNA, 20 bp, Homo sapiens
gacatctggaatctggagac

SEQ ID NO: 3490385 - DNA, 22 bp, Homo sapiens
gacatctggaatctggagacca

SEQ ID NO: 3490386 - DNA, 22 bp, Homo sapiens
gacatgattccttcctgttctg

SEQ ID NO: 3490387 - DNA, 24 bp, Homo sapiens
gacatgatttccttgaatgtggct

SEQ ID NO: 3490388 - DNA, 14 bp, Homo sapiens
gacatgcctgtcct

SEQ ID NO: 3490389 - DNA, 15 bp, Homo sapiens
gacatgcctgtcctg

SEQ ID NO: 3490390 - DNA, 16 bp, Homo sapiens
gacatgcctgtcctga

SEQ ID NO: 3490391 - DNA, 19 bp, Homo sapiens
gacatgcctgtcctgaaag

SEQ ID NO: 3490392 - DNA, 22 bp, Homo sapiens
gacatgcctgtcctgaaagcgg

SEQ ID NO: 3490393 - DNA, 16 bp, Homo sapiens
gacatgcggtagccag

SEQ ID NO: 3490394 - DNA, 17 bp, Homo sapiens
gacatgcggtagccagc

SEQ ID NO: 3490395 - DNA, 23 bp, Homo sapiens
gacatgcggtagccagcacacag

SEQ ID NO: 3490396 - DNA, 22 bp, Homo sapiens
gacatgggtattttataatgtt

SEQ ID NO: 3490397 - DNA, 13 bp, Homo sapiens
gacattcatgcct

SEQ ID NO: 3490398 - DNA, 16 bp, Homo sapiens
gacattcatgcctggc

SEQ ID NO: 3490399 - DNA, 18 bp, Homo sapiens
gacattcatgcctggctt

SEQ ID NO: 3490400 - DNA, 14 bp, Homo sapiens
gacattctgccagg

SEQ ID NO: 3490401 - DNA, 21 bp, Homo sapiens
gacattcttgtaaggctttga

SEQ ID NO: 3490402 - DNA, 14 bp, Homo sapiens
gacattgcggacag

SEQ ID NO: 3490403 - DNA, 17 bp, Homo sapiens
gacattgcggacagcca

SEQ ID NO: 3490404 - DNA, 14 bp, Homo sapiens
gacattgcgtttga

SEQ ID NO: 3490405 - DNA, 21 bp, Homo sapiens
gacattgcgtttgacctttta

SEQ ID NO: 3490406 - DNA, 21 bp, Homo sapiens
gacattgtctcctatatattt

SEQ ID NO: 3490407 - DNA, 19 bp, Homo sapiens
gacattgttggccaaagcc

SEQ ID NO: 3490408 - DNA, 13 bp, Homo sapiens
gacatttctctaa

SEQ ID NO: 3490409 - DNA, 16 bp, Homo sapiens
gacatttctctaagag

SEQ ID NO: 3490410 - DNA, 14 bp, Homo sapiens
gacatttcttcata

SEQ ID NO: 3490411 - DNA, 20 bp, Homo sapiens
gaccaagcatcttggggggg

SEQ ID NO: 3490412 - DNA, 14 bp, Homo sapiens
gaccacagcacagc

SEQ ID NO: 3490413 - DNA, 18 bp, Homo sapiens
gcacagctgggatacaca

SEQ ID NO: 3490414 - DNA, 21 bp, Homo sapiens
gcacagcttcatttcctgtgt

SEQ ID NO: 3490415 - DNA, 18 bp, Homo sapiens
gcacagcttgacctgagg

SEQ ID NO: 3490416 - DNA, 13 bp, Homo sapiens
gcacagcttttcc

SEQ ID NO: 3490417 - DNA, 19 bp, Homo sapiens
gcacagcttttccaaaata

SEQ ID NO: 3490418 - DNA, 14 bp, Homo sapiens
gcacaggacatgcg

SEQ ID NO: 3490419 - DNA, 21 bp, Homo sapiens
gcacagttgaagggaggggct

SEQ ID NO: 3490420 - DNA, 19 bp, Homo sapiens
gcacatattagtgcagcca

SEQ ID NO: 3490421 - DNA, 21 bp, Homo sapiens
gcacatctgcattttcacccc

SEQ ID NO: 3490422 - DNA, 20 bp, Homo sapiens
gcacatgtcttaatgaagtt

SEQ ID NO: 3490423 - DNA, 23 bp, Homo sapiens
gcacatgttggaggagagagcct

SEQ ID NO: 3490424 - DNA, 12 bp, Homo sapiens
gcacattccttt

SEQ ID NO: 3490425 - DNA, 21 bp, Homo sapiens
gcacatttaagagacagtcac

SEQ ID NO: 3490426 - DNA, 22 bp, Homo sapiens
gcaccaagggacaggagaagag

SEQ ID NO: 3490427 - DNA, 13 bp, Homo sapiens
gcaccaccaagcc

SEQ ID NO: 3490428 - DNA, 14 bp, Homo sapiens
gcaccagacaccca

SEQ ID NO: 3490429 - DNA, 17 bp, Homo sapiens
gcaccagacacccagga

SEQ ID NO: 3490430 - DNA, 19 bp, Homo sapiens
gcaccagacacccaggact

SEQ ID NO: 3490431 - DNA, 20 bp, Homo sapiens
gcaccagacacccaggactt

SEQ ID NO: 3490432 - DNA, 21 bp, Homo sapiens
gcaccagacacccaggactta

SEQ ID NO: 3490433 - DNA, 16 bp, Homo sapiens
gcaccagcagcctgga

SEQ ID NO: 3490434 - DNA, 11 bp, Homo sapiens
gcaccagccag

SEQ ID NO: 3490435 - DNA, 12 bp, Homo sapiens
gcaccataactt

SEQ ID NO: 3490436 - DNA, 14 bp, Homo sapiens
gcaccatccctttt

SEQ ID NO: 3490437 - DNA, 21 bp, Homo sapiens
gcacccaagacctcagggcac

SEQ ID NO: 3490438 - DNA, 14 bp, Homo sapiens
gcacccaccctggg

SEQ ID NO: 3490439 - DNA, 17 bp, Homo sapiens
gcacccaccctgggacc

SEQ ID NO: 3490440 - DNA, 14 bp, Homo sapiens
gcacccagcccaga

SEQ ID NO: 3490441 - DNA, 14 bp, Homo sapiens
gcacccccctgggc

SEQ ID NO: 3490442 - DNA, 21 bp, Homo sapiens
gcacccccctgggctgagaga

SEQ ID NO: 3490443 - DNA, 14 bp, Homo sapiens
gcaccccgctgcgg

SEQ ID NO: 3490444 - DNA, 14 bp, Homo sapiens
gcacccggcccctg

SEQ ID NO: 3490445 - DNA, 15 bp, Homo sapiens
gcacccggcccctgc

SEQ ID NO: 3490446 - DNA, 17 bp, Homo sapiens
gcacccggcccctgctg

SEQ ID NO: 3490447 - DNA, 19 bp, Homo sapiens
gcaccgtgtcaagctgctc

SEQ ID NO: 3490448 - DNA, 15 bp, Homo sapiens
gcaccgttctgtgca

SEQ ID NO: 3490449 - DNA, 17 bp, Homo sapiens
gcacctaatccaggcag

SEQ ID NO: 3490450 - DNA, 23 bp, Homo sapiens
gcacctaatccaggcagatccag

SEQ ID NO: 3490451 - DNA, 18 bp, Homo sapiens
gcacctacatccccaggt

SEQ ID NO: 3490452 - DNA, 20 bp, Homo sapiens
gcacctacatccccaggtct

SEQ ID NO: 3490453 - DNA, 21 bp, Homo sapiens
gcacctacatccccaggtctc

SEQ ID NO: 3490454 - DNA, 14 bp, Homo sapiens
gcacctcctgcctc

SEQ ID NO: 3490455 - DNA, 14 bp, Homo sapiens
gcacctgcctcagg

SEQ ID NO: 3490456 - DNA, 18 bp, Homo sapiens
gcacctggcatcgcacca

SEQ ID NO: 3490457 - DNA, 21 bp, Homo sapiens
gcacctgtaatcccagctact

SEQ ID NO: 3490458 - DNA, 13 bp, Homo sapiens
gcacggctgctga

SEQ ID NO: 3490459 - DNA, 24 bp, Homo sapiens
gcactagactggtggcaggggctt

SEQ ID NO: 3490460 - DNA, 22 bp, Homo sapiens
gcactatagcctaggtgacaga

SEQ ID NO: 3490461 - DNA, 13 bp, Homo sapiens
gcactcagaagac

SEQ ID NO: 3490462 - DNA, 17 bp, Homo sapiens
gcactcagaagacactg

SEQ ID NO: 3490463 - DNA, 14 bp, Homo sapiens
gcactcaggctctc

SEQ ID NO: 3490464 - DNA, 14 bp, Homo sapiens
gcactccctcctgg

SEQ ID NO: 3490465 - DNA, 17 bp, Homo sapiens
gcactgaaaaaaaatct

SEQ ID NO: 3490466 - DNA, 11 bp, Homo sapiens
gcactgaagcc

SEQ ID NO: 3490467 - DNA, 21 bp, Homo sapiens
gcactgagataccagcgagga

SEQ ID NO: 3490468 - DNA, 11 bp, Homo sapiens
gcactgaggaa

SEQ ID NO: 3490469 - DNA, 13 bp, Homo sapiens
gcactgaggaaga

SEQ ID NO: 3490470 - DNA, 18 bp, Homo sapiens
gcactgaggaagaacggg

SEQ ID NO: 3490471 - DNA, 16 bp, Homo sapiens
gcactgagtgaaggaa

SEQ ID NO: 3490472 - DNA, 22 bp, Homo sapiens
gcactgatgctgcccctcatct

SEQ ID NO: 3490473 - DNA, 19 bp, Homo sapiens
gcactgcagccacagggga

SEQ ID NO: 3490474 - DNA, 17 bp, Homo sapiens
gcactgccatgcagggc

SEQ ID NO: 3490475 - DNA, 16 bp, Homo sapiens
gcactgcttgaggaaa

SEQ ID NO: 3490476 - DNA, 18 bp, Homo sapiens
gcactgggttgactttca

SEQ ID NO: 3490477 - DNA, 13 bp, Homo sapiens
gcactgtgctcag

SEQ ID NO: 3490478 - DNA, 15 bp, Homo sapiens
gcactgttccccctg

SEQ ID NO: 3490479 - DNA, 18 bp, Homo sapiens
gcacttaagagaatattt

SEQ ID NO: 3490480 - DNA, 22 bp, Homo sapiens
gcacttactggtaggaccaagc

SEQ ID NO: 3490481 - DNA, 17 bp, Homo sapiens
gcacttcatctggctgc

SEQ ID NO: 3490482 - DNA, 11 bp, Homo sapiens
gcacttccctg

SEQ ID NO: 3490483 - DNA, 13 bp, Homo sapiens
gcacttgaagaat

SEQ ID NO: 3490484 - DNA, 17 bp, Homo sapiens
gcacttgatgtgtagac

SEQ ID NO: 3490485 - DNA, 22 bp, Homo sapiens
gcacttgggggttcaggcccgg

SEQ ID NO: 3490486 - DNA, 16 bp, Homo sapiens
gcacttgtccagctga

SEQ ID NO: 3490487 - DNA, 23 bp, Homo sapiens
gcactttccgtcaacgttgtact

SEQ ID NO: 3490488 - DNA, 13 bp, Homo sapiens
gcactttgtaaat

SEQ ID NO: 3490489 - DNA, 15 bp, Homo sapiens
gcactttgtaaattc

SEQ ID NO: 3490490 - DNA, 21 bp, Homo sapiens
gcagaacgaaccttggcctgg

SEQ ID NO: 3490491 - DNA, 16 bp, Homo sapiens
gcagaagagggtgtgt

SEQ ID NO: 3490492 - DNA, 15 bp, Homo sapiens
gcagaaggaaaaatg

SEQ ID NO: 3490493 - DNA, 21 bp, Homo sapiens
gcagaaggaaaaatgtgtaat

SEQ ID NO: 3490494 - DNA, 14 bp, Homo sapiens
gcagaagggggtgg

SEQ ID NO: 3490495 - DNA, 16 bp, Homo sapiens
gcagaatgaatctatg

SEQ ID NO: 3490496 - DNA, 18 bp, Homo sapiens
gcagacacagggacttga

SEQ ID NO: 3490497 - DNA, 13 bp, Homo sapiens
gcagacaggcaag

SEQ ID NO: 3490498 - DNA, 23 bp, Homo sapiens
gcagacaggcaagcacctcctgc

SEQ ID NO: 3490499 - DNA, 19 bp, Homo sapiens
gcagactctacagaggcca

SEQ ID NO: 3490500 - DNA, 16 bp, Homo sapiens
gcagacttcccagcta

SEQ ID NO: 3490501 - DNA, 17 bp, Homo sapiens
gcagactttctctgtgt

SEQ ID NO: 3490502 - DNA, 20 bp, Homo sapiens
gcagactttctctgtgtatg

SEQ ID NO: 3490503 - DNA, 20 bp, Homo sapiens
gcagagaaagggacaatgat

SEQ ID NO: 3490504 - DNA, 23 bp, Homo sapiens
gcagagattggaatgggcagctc

SEQ ID NO: 3490505 - DNA, 16 bp, Homo sapiens
gcagagcccggagctc

SEQ ID NO: 3490506 - DNA, 18 bp, Homo sapiens
gcagagcgcgcccctagc

SEQ ID NO: 3490507 - DNA, 12 bp, Homo sapiens
gcagagctggct

SEQ ID NO: 3490508 - DNA, 15 bp, Homo sapiens
gcagagctggctctg

SEQ ID NO: 3490509 - DNA, 14 bp, Homo sapiens
gcagaggaggggcc

SEQ ID NO: 3490510 - DNA, 15 bp, Homo sapiens
gcagaggccagaggc

SEQ ID NO: 3490511 - DNA, 12 bp, Homo sapiens
gcagagggctgg

SEQ ID NO: 3490512 - DNA, 17 bp, Homo sapiens
gcagagggctggaggcc

SEQ ID NO: 3490513 - DNA, 23 bp, Homo sapiens
gcagagtcacacgggggcagctg

SEQ ID NO: 3490514 - DNA, 14 bp, Homo sapiens
gcagagttgtaaat

SEQ ID NO: 3490515 - DNA, 20 bp, Homo sapiens
gcagagttgtaaatatataa

SEQ ID NO: 3490516 - DNA, 21 bp, Homo sapiens
gcagagttgtaaatatataaa

SEQ ID NO: 3490517 - DNA, 12 bp, Homo sapiens
gcagatgacaag

SEQ ID NO: 3490518 - DNA, 19 bp, Homo sapiens
gcagatgaggttgctagag

SEQ ID NO: 3490519 - DNA, 17 bp, Homo sapiens
gcagatgcaaagaggca

SEQ ID NO: 3490520 - DNA, 18 bp, Homo sapiens
gcagatgcaaagaggcaa

SEQ ID NO: 3490521 - DNA, 16 bp, Homo sapiens
gcagatgcacatgttg

SEQ ID NO: 3490522 - DNA, 14 bp, Homo sapiens
gcagcaaattttca

SEQ ID NO: 3490523 - DNA, 19 bp, Homo sapiens
gcagcaccgttctgtgcac

SEQ ID NO: 3490524 - DNA, 13 bp, Homo sapiens
gcagcagcccaag

SEQ ID NO: 3490525 - DNA, 14 bp, Homo sapiens
gcagcagcccaagc

SEQ ID NO: 3490526 - DNA, 20 bp, Homo sapiens
gcagcagcccaagcttccct

SEQ ID NO: 3490527 - DNA, 21 bp, Homo sapiens
gcagcagcccaagcttccctc

SEQ ID NO: 3490528 - DNA, 18 bp, Homo sapiens
gcagcagggagggcttct

SEQ ID NO: 3490529 - DNA, 19 bp, Homo sapiens
gcagcagggagggcttctg

SEQ ID NO: 3490530 - DNA, 20 bp, Homo sapiens
gcagcagggatgccctggag

SEQ ID NO: 3490531 - DNA, 21 bp, Homo sapiens
gcagcagtgtgaggccagggc

SEQ ID NO: 3490532 - DNA, 13 bp, Homo sapiens
gcagccaagctcc

SEQ ID NO: 3490533 - DNA, 17 bp, Homo sapiens
gcagccaagtagcctct

SEQ ID NO: 3490534 - DNA, 20 bp, Homo sapiens
gcagccaagtagcctctcct

SEQ ID NO: 3490535 - DNA, 15 bp, Homo sapiens
gcagccacaggggat

SEQ ID NO: 3490536 - DNA, 12 bp, Homo sapiens
gcagccagaggc

SEQ ID NO: 3490537 - DNA, 14 bp, Homo sapiens
gcagccagaggcac

SEQ ID NO: 3490538 - DNA, 18 bp, Homo sapiens
gcagcccacccctcaaca

SEQ ID NO: 3490539 - DNA, 17 bp, Homo sapiens
gcagccccagcctgcta

SEQ ID NO: 3490540 - DNA, 17 bp, Homo sapiens
gcagccccatctgtgca

SEQ ID NO: 3490541 - DNA, 19 bp, Homo sapiens
gcagccccattctgcctgc

SEQ ID NO: 3490542 - DNA, 21 bp, Homo sapiens
gcagccctgagaaagccctgt

SEQ ID NO: 3490543 - DNA, 22 bp, Homo sapiens
gcagccgtttgagaagaaaaca

SEQ ID NO: 3490544 - DNA, 19 bp, Homo sapiens
gcagcctcaacctcctggg

SEQ ID NO: 3490545 - DNA, 12 bp, Homo sapiens
gcagcctctccc

SEQ ID NO: 3490546 - DNA, 14 bp, Homo sapiens
gcatgacatttctt

SEQ ID NO: 3490547 - DNA, 17 bp, Homo sapiens
gcatgagaaatacaaaa

SEQ ID NO: 3490548 - DNA, 18 bp, Homo sapiens
gcatgatccaagcaagac

SEQ ID NO: 3490549 - DNA, 15 bp, Homo sapiens
gcatgattttgtaac

SEQ ID NO: 3490550 - DNA, 17 bp, Homo sapiens
gcatgcactgttccccc

SEQ ID NO: 3490551 - DNA, 21 bp, Homo sapiens
gcatgcactgttccccctgtg

SEQ ID NO: 3490552 - DNA, 14 bp, Homo sapiens
gcatggaaggggct

SEQ ID NO: 3490553 - DNA, 20 bp, Homo sapiens
gcatgggtcgggagagggga

SEQ ID NO: 3490554 - DNA, 17 bp, Homo sapiens
gcatggtgccccaggac

SEQ ID NO: 3490555 - DNA, 18 bp, Homo sapiens
gcatggtgccccaggacc

SEQ ID NO: 3490556 - DNA, 23 bp, Homo sapiens
gcatggtgccccaggaccagctc

SEQ ID NO: 3490557 - DNA, 15 bp, Homo sapiens
gcatgtcttttaaaa

SEQ ID NO: 3490558 - DNA, 13 bp, Homo sapiens
gcatgtgggcttc

SEQ ID NO: 3490559 - DNA, 14 bp, Homo sapiens
gcatgttctctgag

SEQ ID NO: 3490560 - DNA, 21 bp, Homo sapiens
gcatgttctctgaggacacta

SEQ ID NO: 3490561 - DNA, 20 bp, Homo sapiens
gcattaccgcgttgtaaaat

SEQ ID NO: 3490562 - DNA, 23 bp, Homo sapiens
gcattaccgcgttgtaaaatata

SEQ ID NO: 3490563 - DNA, 15 bp, Homo sapiens
gcattatataccatt

SEQ ID NO: 3490564 - DNA, 14 bp, Homo sapiens
gcattattgcatta

SEQ ID NO: 3490565 - DNA, 15 bp, Homo sapiens
gcattccagcccctc

SEQ ID NO: 3490566 - DNA, 16 bp, Homo sapiens
gcattccagcccctct

SEQ ID NO: 3490567 - DNA, 19 bp, Homo sapiens
gcattccagcccctctggt

SEQ ID NO: 3490568 - DNA, 22 bp, Homo sapiens
gcattcggtacttacccggaga

SEQ ID NO: 3490569 - DNA, 16 bp, Homo sapiens
gcattcttttaaaaga

SEQ ID NO: 3490570 - DNA, 16 bp, Homo sapiens
gcattgaacacaaact

SEQ ID NO: 3490571 - DNA, 22 bp, Homo sapiens
gcattgaacacaaactgtaaat

SEQ ID NO: 3490572 - DNA, 23 bp, Homo sapiens
gcattgaacacaaactgtaaata

SEQ ID NO: 3490573 - DNA, 21 bp, Homo sapiens
gcattgagaactgcatatgtt

SEQ ID NO: 3490574 - DNA, 13 bp, Homo sapiens
gcattgcctgtga

SEQ ID NO: 3490575 - DNA, 19 bp, Homo sapiens
gcattgtatcgatgttatg

SEQ ID NO: 3490576 - DNA, 14 bp, Homo sapiens
gcattgtcctgtga

SEQ ID NO: 3490577 - DNA, 17 bp, Homo sapiens
gcattgtttctgtgggc

SEQ ID NO: 3490578 - DNA, 17 bp, Homo sapiens
gcatttcaattcctggc

SEQ ID NO: 3490579 - DNA, 19 bp, Homo sapiens
gcatttcacaaaacagcct

SEQ ID NO: 3490580 - DNA, 21 bp, Homo sapiens
gcatttcctatcacctatttc

SEQ ID NO: 3490581 - DNA, 15 bp, Homo sapiens
gcatttgaatgcatt

SEQ ID NO: 3490582 - DNA, 17 bp, Homo sapiens
gcatttgatctgttgca

SEQ ID NO: 3490583 - DNA, 13 bp, Homo sapiens
gcatttgctgaat

SEQ ID NO: 3490584 - DNA, 17 bp, Homo sapiens
gcatttgctgaatacag

SEQ ID NO: 3490585 - DNA, 23 bp, Homo sapiens
gcatttgctgaatacagaggcaa

SEQ ID NO: 3490586 - DNA, 23 bp, Homo sapiens
gcatttggattggggtccctcta

SEQ ID NO: 3490587 - DNA, 22 bp, Homo sapiens
gcattttggagagtttcctgaa

SEQ ID NO: 3490588 - DNA, 23 bp, Homo sapiens
gcattttggagagtttcctgaaa

SEQ ID NO: 3490589 - DNA, 16 bp, Homo sapiens
gcattttgtttggtat

SEQ ID NO: 3490590 - DNA, 21 bp, Homo sapiens
gcattttgtttggtattgtat

SEQ ID NO: 3490591 - DNA, 16 bp, Homo sapiens
gcattttttatgatat

SEQ ID NO: 3490592 - DNA, 17 bp, Homo sapiens
gcattttttatgatatc

SEQ ID NO: 3490593 - DNA, 16 bp, Homo sapiens
gcatttttttattcag

SEQ ID NO: 3490594 - DNA, 17 bp, Homo sapiens
gcatttttttattcagc

SEQ ID NO: 3490595 - DNA, 19 bp, Homo sapiens
gcatttttttattcagcag

SEQ ID NO: 3490596 - DNA, 16 bp, Homo sapiens
gccaaaaaggatacat

SEQ ID NO: 3490597 - DNA, 17 bp, Homo sapiens
gccaaaattcatttcta

SEQ ID NO: 3490598 - DNA, 15 bp, Homo sapiens
gccaaaccctgtctg

SEQ ID NO: 3490599 - DNA, 13 bp, Homo sapiens
gccaaacctctgt

SEQ ID NO: 3490600 - DNA, 19 bp, Homo sapiens
gccaaacctctgttcagtg

SEQ ID NO: 3490601 - DNA, 16 bp, Homo sapiens
gccaaagagcctttcc

SEQ ID NO: 3490602 - DNA, 20 bp, Homo sapiens
gccaaagccaaagctaggcc

SEQ ID NO: 3490603 - DNA, 22 bp, Homo sapiens
gccaaagctaggcctggccaga

SEQ ID NO: 3490604 - DNA, 20 bp, Homo sapiens
gccaaaggctggtggcaagt

SEQ ID NO: 3490605 - DNA, 15 bp, Homo sapiens
gccaaatagcaaaga

SEQ ID NO: 3490606 - DNA, 16 bp, Homo sapiens
gccaacactcaagaag

SEQ ID NO: 3490607 - DNA, 21 bp, Homo sapiens
gccaacactgtgggtgtgtga

SEQ ID NO: 3490608 - DNA, 20 bp, Homo sapiens
gccaacttcttcagagctga

SEQ ID NO: 3490609 - DNA, 15 bp, Homo sapiens
gccaagaaacgtctt

SEQ ID NO: 3490610 - DNA, 22 bp, Homo sapiens
gccaagaaacgtcttctaaact

SEQ ID NO: 3490611 - DNA, 18 bp, Homo sapiens
gccaagcactgtgctcag

SEQ ID NO: 3490612 - DNA, 15 bp, Homo sapiens
gccaagccagctgcc

SEQ ID NO: 3490613 - DNA, 12 bp, Homo sapiens
gccaaggagctg

SEQ ID NO: 3490614 - DNA, 13 bp, Homo sapiens
gccaaggagctgc

SEQ ID NO: 3490615 - DNA, 14 bp, Homo sapiens
gccaaggagctgct

SEQ ID NO: 3490616 - DNA, 20 bp, Homo sapiens
gccaaggagctgctatagcc

SEQ ID NO: 3490617 - DNA, 21 bp, Homo sapiens
gccaaggagctgctatagcct

SEQ ID NO: 3490618 - DNA, 23 bp, Homo sapiens
gccaaggagctgctatagcctgg

SEQ ID NO: 3490619 - DNA, 21 bp, Homo sapiens
gccaaggagggtgagtgcaag

SEQ ID NO: 3490620 - DNA, 21 bp, Homo sapiens
gccaaggctgggggaagaagc

SEQ ID NO: 3490621 - DNA, 19 bp, Homo sapiens
gccaagggaacctgtgtcc

SEQ ID NO: 3490622 - DNA, 14 bp, Homo sapiens
gccaagggccagac

SEQ ID NO: 3490623 - DNA, 16 bp, Homo sapiens
gccaagggccagacag

SEQ ID NO: 3490624 - DNA, 23 bp, Homo sapiens
gccaaggtgggaggattgcttga

SEQ ID NO: 3490625 - DNA, 15 bp, Homo sapiens
gccaagtttatatac

SEQ ID NO: 3490626 - DNA, 22 bp, Homo sapiens
gccaatgtattgataagagggc

SEQ ID NO: 3490627 - DNA, 20 bp, Homo sapiens
gccaattatgttaaactagc

SEQ ID NO: 3490628 - DNA, 17 bp, Homo sapiens
gccaattcagacaggca

SEQ ID NO: 3490629 - DNA, 15 bp, Homo sapiens
gccacaaataaaatg

SEQ ID NO: 3490630 - DNA, 19 bp, Homo sapiens
gccacaaggacttcctgtc

SEQ ID NO: 3490631 - DNA, 20 bp, Homo sapiens
gccacaaggtggtgcttctg

SEQ ID NO: 3490632 - DNA, 20 bp, Homo sapiens
gccacaatgcagttctgagc

SEQ ID NO: 3490633 - DNA, 15 bp, Homo sapiens
gccacaccctcccca

SEQ ID NO: 3490634 - DNA, 12 bp, Homo sapiens
gccacaggacac

SEQ ID NO: 3490635 - DNA, 12 bp, Homo sapiens
gccacaggcctg

SEQ ID NO: 3490636 - DNA, 20 bp, Homo sapiens
gccacaggcctgagatttca

SEQ ID NO: 3490637 - DNA, 23 bp, Homo sapiens
gccacaggcctgagatttcatct

SEQ ID NO: 3490638 - DNA, 21 bp, Homo sapiens
gccacagggtctgcctccagc

SEQ ID NO: 3490639 - DNA, 18 bp, Homo sapiens
gccacagtagtcttgatg

SEQ ID NO: 3490640 - DNA, 19 bp, Homo sapiens
gccacatttggaatacttt

SEQ ID NO: 3490641 - DNA, 22 bp, Homo sapiens
gccacatttggaatactttttg

SEQ ID NO: 3490642 - DNA, 18 bp, Homo sapiens
gccaccaacttacaaaaa

SEQ ID NO: 3490643 - DNA, 22 bp, Homo sapiens
gccaccaagagggacgcctggg

SEQ ID NO: 3490644 - DNA, 21 bp, Homo sapiens
gccagagaagtctggtcagag

SEQ ID NO: 3490645 - DNA, 22 bp, Homo sapiens
gccagagaagtctggtcagagc

SEQ ID NO: 3490646 - DNA, 16 bp, Homo sapiens
gccagagatccaaaag

SEQ ID NO: 3490647 - DNA, 23 bp, Homo sapiens
gccagagatccaaaagaagcccc

SEQ ID NO: 3490648 - DNA, 18 bp, Homo sapiens
gccagaggcccccagccc

SEQ ID NO: 3490649 - DNA, 20 bp, Homo sapiens
gccagaggcccccagcccag

SEQ ID NO: 3490650 - DNA, 23 bp, Homo sapiens
gccagaggcccccagcccagggc

SEQ ID NO: 3490651 - DNA, 24 bp, Homo sapiens
gccagaggcccccagcccagggct

SEQ ID NO: 3490652 - DNA, 16 bp, Homo sapiens
gccagaggtgcttcac

SEQ ID NO: 3490653 - DNA, 11 bp, Homo sapiens
gccagatccag

SEQ ID NO: 3490654 - DNA, 15 bp, Homo sapiens
gccagatccagcctg

SEQ ID NO: 3490655 - DNA, 17 bp, Homo sapiens
gccagatcctcttctca

SEQ ID NO: 3490656 - DNA, 12 bp, Homo sapiens
gccagatgctgc

SEQ ID NO: 3490657 - DNA, 15 bp, Homo sapiens
gccagatgctgcaga

SEQ ID NO: 3490658 - DNA, 14 bp, Homo sapiens
gccagatttgtctt

SEQ ID NO: 3490659 - DNA, 15 bp, Homo sapiens
gccagatttgtcttt

SEQ ID NO: 3490660 - DNA, 20 bp, Homo sapiens
gccagatttgtctttttgtt

SEQ ID NO: 3490661 - DNA, 22 bp, Homo sapiens
gccagcacacagggcagtgagg

SEQ ID NO: 3490662 - DNA, 22 bp, Homo sapiens
gccagcctgcgggaagctgacc

SEQ ID NO: 3490663 - DNA, 19 bp, Homo sapiens
gccagcgggaatggcagct

SEQ ID NO: 3490664 - DNA, 19 bp, Homo sapiens
gccagctcacagtgctgtg

SEQ ID NO: 3490665 - DNA, 15 bp, Homo sapiens
gccagctctgtatca

SEQ ID NO: 3490666 - DNA, 13 bp, Homo sapiens
gccagctgctccc

SEQ ID NO: 3490667 - DNA, 17 bp, Homo sapiens
gccagctggcagcagag

SEQ ID NO: 3490668 - DNA, 18 bp, Homo sapiens
gccagctggcagcagagt

SEQ ID NO: 3490669 - DNA, 22 bp, Homo sapiens
gccaggaccagtcaacctgggc

SEQ ID NO: 3490670 - DNA, 22 bp, Homo sapiens
gccaggccagagggagtgacag

SEQ ID NO: 3490671 - DNA, 13 bp, Homo sapiens
gccaggccagctg

SEQ ID NO: 3490672 - DNA, 14 bp, Homo sapiens
gccaggccccaggc

SEQ ID NO: 3490673 - DNA, 18 bp, Homo sapiens
gccaggcccccaagcctg

SEQ ID NO: 3490674 - DNA, 23 bp, Homo sapiens
gccaggcccccaagcctgcagtc

SEQ ID NO: 3490675 - DNA, 22 bp, Homo sapiens
gccaggctgaccacagcacagc

SEQ ID NO: 3490676 - DNA, 16 bp, Homo sapiens
gccagggagaagctcc

SEQ ID NO: 3490677 - DNA, 16 bp, Homo sapiens
gccagggcctggaaga

SEQ ID NO: 3490678 - DNA, 15 bp, Homo sapiens
gccagggctgcccct

SEQ ID NO: 3490679 - DNA, 16 bp, Homo sapiens
gccagggctgccccta

SEQ ID NO: 3490680 - DNA, 22 bp, Homo sapiens
gccaggggaaaatcagcctgct

SEQ ID NO: 3490681 - DNA, 23 bp, Homo sapiens
gccaggggaaaatcagcctgctc

SEQ ID NO: 3490682 - DNA, 19 bp, Homo sapiens
gccaggggcgaggcccttc

SEQ ID NO: 3490683 - DNA, 19 bp, Homo sapiens
gccaggggggtgaggagct

SEQ ID NO: 3490684 - DNA, 22 bp, Homo sapiens
gccaggggggtgaggagctggg

SEQ ID NO: 3490685 - DNA, 23 bp, Homo sapiens
gccaggttctccgttagctcctg

SEQ ID NO: 3490686 - DNA, 18 bp, Homo sapiens
gccagtcaagaagaaaaa

SEQ ID NO: 3490687 - DNA, 13 bp, Homo sapiens
gccagtccaggct

SEQ ID NO: 3490688 - DNA, 20 bp, Homo sapiens
gccagtccaggctgccgtgg

SEQ ID NO: 3490689 - DNA, 22 bp, Homo sapiens
gccagtctcactgtgggaaggc

SEQ ID NO: 3490690 - DNA, 20 bp, Homo sapiens
gccagtgacctgaggaagcg

SEQ ID NO: 3490691 - DNA, 15 bp, Homo sapiens
gccagtgagccactc

SEQ ID NO: 3490692 - DNA, 13 bp, Homo sapiens
gccagtgtgctga

SEQ ID NO: 3490693 - DNA, 21 bp, Homo sapiens
gccagttctttccataataaa

SEQ ID NO: 3490694 - DNA, 10 bp, Homo sapiens
gccataatat

SEQ ID NO: 3490695 - DNA, 13 bp, Homo sapiens
gccataatatgat

SEQ ID NO: 3490696 - DNA, 19 bp, Homo sapiens
gccataatatgatgcaaac

SEQ ID NO: 3490697 - DNA, 14 bp, Homo sapiens
gccatagccaggag

SEQ ID NO: 3490698 - DNA, 22 bp, Homo sapiens
gccatatgacaagcctttgtgc

SEQ ID NO: 3490699 - DNA, 15 bp, Homo sapiens
gccatcaaaatgctt

SEQ ID NO: 3490700 - DNA, 18 bp, Homo sapiens
gccatcaaaatgcttttt

SEQ ID NO: 3490701 - DNA, 19 bp, Homo sapiens
gccatcaaaatgcttttta

SEQ ID NO: 3490702 - DNA, 21 bp, Homo sapiens
gccatctcaattgtgctttgt

SEQ ID NO: 3490703 - DNA, 21 bp, Homo sapiens
gccatctcatgaggggagagg

SEQ ID NO: 3490704 - DNA, 21 bp, Homo sapiens
gccatctgggctcctccaggg

SEQ ID NO: 3490705 - DNA, 23 bp, Homo sapiens
gccatctggttaggatggcagga

SEQ ID NO: 3490706 - DNA, 22 bp, Homo sapiens
gccatgatctgcaggggtctgg

SEQ ID NO: 3490707 - DNA, 17 bp, Homo sapiens
gccatgatggcaacaga

SEQ ID NO: 3490708 - DNA, 23 bp, Homo sapiens
gccatgatggcaacagatctgga

SEQ ID NO: 3490709 - DNA, 13 bp, Homo sapiens
gccatgccagctt

SEQ ID NO: 3490710 - DNA, 18 bp, Homo sapiens
gccatgccagcttatctc

SEQ ID NO: 3490711 - DNA, 14 bp, Homo sapiens
gccatgcctcagcc

SEQ ID NO: 3490712 - DNA, 19 bp, Homo sapiens
gccatgctgaggcctgggc

SEQ ID NO: 3490713 - DNA, 18 bp, Homo sapiens
gccatggagagctggagc

SEQ ID NO: 3490714 - DNA, 20 bp, Homo sapiens
gccatggagagctggagcct

SEQ ID NO: 3490715 - DNA, 23 bp, Homo sapiens
gccatggagagctggagcctggt

SEQ ID NO: 3490716 - DNA, 16 bp, Homo sapiens
gccatgtagaagctgc

SEQ ID NO: 3490717 - DNA, 16 bp, Homo sapiens
gccatgtataattttt

SEQ ID NO: 3490718 - DNA, 22 bp, Homo sapiens
gccatgtctgcagtgtgccccc

SEQ ID NO: 3490719 - DNA, 14 bp, Homo sapiens
gccatgtgactctg

SEQ ID NO: 3490720 - DNA, 18 bp, Homo sapiens
gccatgtgactctggctt

SEQ ID NO: 3490721 - DNA, 20 bp, Homo sapiens
gccatgttggccaggctggt

SEQ ID NO: 3490722 - DNA, 19 bp, Homo sapiens
gccattacccagctaaata

SEQ ID NO: 3490723 - DNA, 14 bp, Homo sapiens
gccattagccaagg

SEQ ID NO: 3490724 - DNA, 16 bp, Homo sapiens
gccattctcttgcatt

SEQ ID NO: 3490725 - DNA, 18 bp, Homo sapiens
gccattctcttgcattgt

SEQ ID NO: 3490726 - DNA, 17 bp, Homo sapiens
gccattgtgaaccaatg

SEQ ID NO: 3490727 - DNA, 11 bp, Homo sapiens
gccatttgaga

SEQ ID NO: 3490728 - DNA, 17 bp, Homo sapiens
gcccaactgtgtagcat

SEQ ID NO: 3490729 - DNA, 17 bp, Homo sapiens
gcccaagccagaggctg

SEQ ID NO: 3490730 - DNA, 14 bp, Homo sapiens
gcccaaggctcccg

SEQ ID NO: 3490731 - DNA, 15 bp, Homo sapiens
gcccaagggatctgg

SEQ ID NO: 3490732 - DNA, 12 bp, Homo sapiens
gcccaatattat

SEQ ID NO: 3490733 - DNA, 16 bp, Homo sapiens
gcccaccttggctcaa

SEQ ID NO: 3490734 - DNA, 18 bp, Homo sapiens
gcccaccttggctcaagt

SEQ ID NO: 3490735 - DNA, 19 bp, Homo sapiens
gcccacgctggagtgcagt

SEQ ID NO: 3490736 - DNA, 21 bp, Homo sapiens
gcccactgtcctgggcctgca

SEQ ID NO: 3490737 - DNA, 18 bp, Homo sapiens
gcccagaaaacctccagt

SEQ ID NO: 3490738 - DNA, 21 bp, Homo sapiens
gcccagacttgcggggggtgg

SEQ ID NO: 3490739 - DNA, 20 bp, Homo sapiens
gcccagagacatacttgaag

SEQ ID NO: 3490740 - DNA, 21 bp, Homo sapiens
gcccagagagggtggtgacct

SEQ ID NO: 3490741 - DNA, 20 bp, Homo sapiens
gcccagattcccctgtgtca

SEQ ID NO: 3490742 - DNA, 21 bp, Homo sapiens
gcccagattcccctgtgtcat

SEQ ID NO: 3490743 - DNA, 21 bp, Homo sapiens
gcccagcccctactgctgtga

SEQ ID NO: 3490744 - DNA, 12 bp, Homo sapiens
gcccagccctcc

SEQ ID NO: 3490745 - DNA, 18 bp, Homo sapiens
gcccagctatacctgtgc

SEQ ID NO: 3490746 - DNA, 19 bp, Homo sapiens
gcccagctatacctgtgcc

SEQ ID NO: 3490747 - DNA, 15 bp, Homo sapiens
gcccagctccaaggg

SEQ ID NO: 3490748 - DNA, 18 bp, Homo sapiens
gcccagctgggtcaggca

SEQ ID NO: 3490749 - DNA, 20 bp, Homo sapiens
gcccagctgggtcaggcagg

SEQ ID NO: 3490750 - DNA, 15 bp, Homo sapiens
gcccaggcactgcaa

SEQ ID NO: 3490751 - DNA, 11 bp, Homo sapiens
gcccaggcagg

SEQ ID NO: 3490752 - DNA, 15 bp, Homo sapiens
gcccaggcccctgcc

SEQ ID NO: 3490753 - DNA, 18 bp, Homo sapiens
gcccaggcccctgccacc

SEQ ID NO: 3490754 - DNA, 21 bp, Homo sapiens
gcccaggcccctgccaccctg

SEQ ID NO: 3490755 - DNA, 22 bp, Homo sapiens
gcccaggcccctgccaccctgg

SEQ ID NO: 3490756 - DNA, 14 bp, Homo sapiens
gcccaggctggcgt

SEQ ID NO: 3490757 - DNA, 22 bp, Homo sapiens
gcccaggctggcgtgcagtggt

SEQ ID NO: 3490758 - DNA, 20 bp, Homo sapiens
gcccagggagcggaaagcag

SEQ ID NO: 3490759 - DNA, 21 bp, Homo sapiens
gcccagggagcggaaagcagc

SEQ ID NO: 3490760 - DNA, 23 bp, Homo sapiens
gcccagggagcggaaagcagctc

SEQ ID NO: 3490761 - DNA, 18 bp, Homo sapiens
gcccagggcatcttgctg

SEQ ID NO: 3490762 - DNA, 12 bp, Homo sapiens
gcccagggctcc

SEQ ID NO: 3490763 - DNA, 17 bp, Homo sapiens
gcccaggtttctggtct

SEQ ID NO: 3490764 - DNA, 17 bp, Homo sapiens
gcccagtccttccacct

SEQ ID NO: 3490765 - DNA, 22 bp, Homo sapiens
gcccagtctggaatgcagtggt

SEQ ID NO: 3490766 - DNA, 18 bp, Homo sapiens
gcccagtctttcatgtgt

SEQ ID NO: 3490767 - DNA, 22 bp, Homo sapiens
gcccagttgggtggatgcctgg

SEQ ID NO: 3490768 - DNA, 12 bp, Homo sapiens
gcccatccttcc

SEQ ID NO: 3490769 - DNA, 14 bp, Homo sapiens
gcccatctcaggac

SEQ ID NO: 3490770 - DNA, 18 bp, Homo sapiens
gccccaatccctttatta

SEQ ID NO: 3490771 - DNA, 16 bp, Homo sapiens
gccccaccctgggccc

SEQ ID NO: 3490772 - DNA, 20 bp, Homo sapiens
gccccaccctgggccctggg

SEQ ID NO: 3490773 - DNA, 22 bp, Homo sapiens
gccccaccctgggccctgggct

SEQ ID NO: 3490774 - DNA, 23 bp, Homo sapiens
gccccaccctgggccctgggctg

SEQ ID NO: 3490775 - DNA, 14 bp, Homo sapiens
gctggagcactggg

SEQ ID NO: 3490776 - DNA, 16 bp, Homo sapiens
gctggaggcccaggct

SEQ ID NO: 3490777 - DNA, 14 bp, Homo sapiens
gctggaggcctcag

SEQ ID NO: 3490778 - DNA, 19 bp, Homo sapiens
gctggaggcctcaggtgct

SEQ ID NO: 3490779 - DNA, 20 bp, Homo sapiens
gctggagtacagtggtgcca

SEQ ID NO: 3490780 - DNA, 20 bp, Homo sapiens
gctggagtgcagtggtgtga

SEQ ID NO: 3490781 - DNA, 21 bp, Homo sapiens
gctggatgctccttccaacag

SEQ ID NO: 3490782 - DNA, 14 bp, Homo sapiens
gctggccagtccag

SEQ ID NO: 3490783 - DNA, 15 bp, Homo sapiens
gctggccagtccagg

SEQ ID NO: 3490784 - DNA, 17 bp, Homo sapiens
gctggccagtccaggct

SEQ ID NO: 3490785 - DNA, 13 bp, Homo sapiens
gctggcccagggc

SEQ ID NO: 3490786 - DNA, 21 bp, Homo sapiens
gctggcccagggcccagagcc

SEQ ID NO: 3490787 - DNA, 22 bp, Homo sapiens
gctggccccgccgcctggtact

SEQ ID NO: 3490788 - DNA, 21 bp, Homo sapiens
gctggcctcccaaatgagcca

SEQ ID NO: 3490789 - DNA, 14 bp, Homo sapiens
gctggcgtgcagtg

SEQ ID NO: 3490790 - DNA, 15 bp, Homo sapiens
gctggctacgcctct

SEQ ID NO: 3490791 - DNA, 17 bp, Homo sapiens
gctggctccagatgcag

SEQ ID NO: 3490792 - DNA, 22 bp, Homo sapiens
gctggctccagatgcagggcag

SEQ ID NO: 3490793 - DNA, 23 bp, Homo sapiens
gctggctccagatgcagggcagt

SEQ ID NO: 3490794 - DNA, 12 bp, Homo sapiens
gctggctctgag

SEQ ID NO: 3490795 - DNA, 12 bp, Homo sapiens
gctggctggcct

SEQ ID NO: 3490796 - DNA, 21 bp, Homo sapiens
gctggctggggtggcctgtgt

SEQ ID NO: 3490797 - DNA, 22 bp, Homo sapiens
gctggctggggtggcctgtgtg

SEQ ID NO: 3490798 - DNA, 16 bp, Homo sapiens
gctgggaactcacctg

SEQ ID NO: 3490799 - DNA, 20 bp, Homo sapiens
gctgggacgtggctcagcca

SEQ ID NO: 3490800 - DNA, 18 bp, Homo sapiens
gctgggactacaggcacc

SEQ ID NO: 3490801 - DNA, 22 bp, Homo sapiens
gctgggactcagccttcagaca

SEQ ID NO: 3490802 - DNA, 13 bp, Homo sapiens
gctgggagctcca

SEQ ID NO: 3490803 - DNA, 14 bp, Homo sapiens
gctgggagctccac

SEQ ID NO: 3490804 - DNA, 16 bp, Homo sapiens
gctgggagctccactc

SEQ ID NO: 3490805 - DNA, 18 bp, Homo sapiens
gctgggagctccactctg

SEQ ID NO: 3490806 - DNA, 21 bp, Homo sapiens
gctgggagctccactctgctt

SEQ ID NO: 3490807 - DNA, 22 bp, Homo sapiens
gctgggagctccactctgcttc

SEQ ID NO: 3490808 - DNA, 15 bp, Homo sapiens
gctgggaggagcccc

SEQ ID NO: 3490809 - DNA, 23 bp, Homo sapiens
gctgggatacacacggctccccc

SEQ ID NO: 3490810 - DNA, 18 bp, Homo sapiens
gctgggatggtgggcttc

SEQ ID NO: 3490811 - DNA, 20 bp, Homo sapiens
gctgggcacacgcctcccac

SEQ ID NO: 3490812 - DNA, 18 bp, Homo sapiens
gctgggccctctcttctc

SEQ ID NO: 3490813 - DNA, 23 bp, Homo sapiens
gctgggggaagaagctctctcct

SEQ ID NO: 3490814 - DNA, 19 bp, Homo sapiens
gctgggggcctcagtgcca

SEQ ID NO: 3490815 - DNA, 20 bp, Homo sapiens
gctggggtggcctgtgtggc

SEQ ID NO: 3490816 - DNA, 22 bp, Homo sapiens
gctgggtggcaccagcagcctg

SEQ ID NO: 3490817 - DNA, 17 bp, Homo sapiens
gctgggtggcccctgtc

SEQ ID NO: 3490818 - DNA, 14 bp, Homo sapiens
gctggtcccactca

SEQ ID NO: 3490819 - DNA, 19 bp, Homo sapiens
gctggtcccactcagtcca

SEQ ID NO: 3490820 - DNA, 16 bp, Homo sapiens
gctggtccgtgggacg

SEQ ID NO: 3490821 - DNA, 19 bp, Homo sapiens
gctggtgaaaacaattttt

SEQ ID NO: 3490822 - DNA, 18 bp, Homo sapiens
gctggtgagtgatgcggc

SEQ ID NO: 3490823 - DNA, 21 bp, Homo sapiens
gctggtggacccagggaacag

SEQ ID NO: 3490824 - DNA, 14 bp, Homo sapiens
gctggtggcagagt

SEQ ID NO: 3490825 - DNA, 15 bp, Homo sapiens
gctggtggcccagga

SEQ ID NO: 3490826 - DNA, 18 bp, Homo sapiens
gctggtgtcacctgaaga

SEQ ID NO: 3490827 - DNA, 15 bp, Homo sapiens
gctggttcagggttg

SEQ ID NO: 3490828 - DNA, 20 bp, Homo sapiens
gctggttcggatttggggtg

SEQ ID NO: 3490829 - DNA, 15 bp, Homo sapiens
gctgtaagatgtctg

SEQ ID NO: 3490830 - DNA, 16 bp, Homo sapiens
gctgtaagatgtctgt

SEQ ID NO: 3490831 - DNA, 15 bp, Homo sapiens
gctgtaatcatttgt

SEQ ID NO: 3490832 - DNA, 16 bp, Homo sapiens
gctgtacaaatataag

SEQ ID NO: 3490833 - DNA, 23 bp, Homo sapiens
gctgtagtaggcatttttaccat

SEQ ID NO: 3490834 - DNA, 14 bp, Homo sapiens
gctgtataaaatca

SEQ ID NO: 3490835 - DNA, 17 bp, Homo sapiens
gctgtatcccatgagcc

SEQ ID NO: 3490836 - DNA, 20 bp, Homo sapiens
gctgtatcccatgagcctca

SEQ ID NO: 3490837 - DNA, 18 bp, Homo sapiens
gctgtatcttgtttttcc

SEQ ID NO: 3490838 - DNA, 13 bp, Homo sapiens
gctgtattttgaa

SEQ ID NO: 3490839 - DNA, 13 bp, Homo sapiens
gctgtcacctctc

SEQ ID NO: 3490840 - DNA, 20 bp, Homo sapiens
gctgtcccatagtccctgcc

SEQ ID NO: 3490841 - DNA, 23 bp, Homo sapiens
gctgtcccatagtccctgccacg

SEQ ID NO: 3490842 - DNA, 13 bp, Homo sapiens
gctgtcctcaggt

SEQ ID NO: 3490843 - DNA, 21 bp, Homo sapiens
gctgtcctcaggtggccatgc

SEQ ID NO: 3490844 - DNA, 14 bp, Homo sapiens
gctgtcctttctag

SEQ ID NO: 3490845 - DNA, 13 bp, Homo sapiens
gctgtctctctgg

SEQ ID NO: 3490846 - DNA, 14 bp, Homo sapiens
gctgtctctctggg

SEQ ID NO: 3490847 - DNA, 15 bp, Homo sapiens
gctgtctctctgggc

SEQ ID NO: 3490848 - DNA, 15 bp, Homo sapiens
gctgtctgcagcctt

SEQ ID NO: 3490849 - DNA, 13 bp, Homo sapiens
gctgtctggccag

SEQ ID NO: 3490850 - DNA, 23 bp, Homo sapiens
gctgtcttgttgcggatggatgg

SEQ ID NO: 3490851 - DNA, 21 bp, Homo sapiens
gctgtgaaccctggggcctga

SEQ ID NO: 3490852 - DNA, 15 bp, Homo sapiens
gctgtgactcttctc

SEQ ID NO: 3490853 - DNA, 17 bp, Homo sapiens
gctgtgctatggtgctc

SEQ ID NO: 3490854 - DNA, 15 bp, Homo sapiens
gctgtgctctggaca

SEQ ID NO: 3490855 - DNA, 16 bp, Homo sapiens
gctgtgctctggacag

SEQ ID NO: 3490856 - DNA, 18 bp, Homo sapiens
gctgtgcttgaaggccct

SEQ ID NO: 3490857 - DNA, 23 bp, Homo sapiens
gctgtgcttgaaggccctgctga

SEQ ID NO: 3490858 - DNA, 23 bp, Homo sapiens
gctgtggagacaatgtctgcagc

SEQ ID NO: 3490859 - DNA, 14 bp, Homo sapiens
gctgtgtctaaact

SEQ ID NO: 3490860 - DNA, 13 bp, Homo sapiens
gctgtgtgacctt

SEQ ID NO: 3490861 - DNA, 17 bp, Homo sapiens
gctgttgacatatttaa

SEQ ID NO: 3490862 - DNA, 12 bp, Homo sapiens
gctgttgagctg

SEQ ID NO: 3490863 - DNA, 18 bp, Homo sapiens
gctgttgagctgttttcc

SEQ ID NO: 3490864 - DNA, 12 bp, Homo sapiens
gctgttgctgaa

SEQ ID NO: 3490865 - DNA, 21 bp, Homo sapiens
gctgttggctgggggcctcag

SEQ ID NO: 3490866 - DNA, 16 bp, Homo sapiens
gctgttggtcctctct

SEQ ID NO: 3490867 - DNA, 19 bp, Homo sapiens
gctgttggtcctctctctg

SEQ ID NO: 3490868 - DNA, 21 bp, Homo sapiens
gctgttggtcctctctctgtg

SEQ ID NO: 3490869 - DNA, 22 bp, Homo sapiens
gctgttggtcctctctctgtgg

SEQ ID NO: 3490870 - DNA, 20 bp, Homo sapiens
gctgtttgcttcaccgtgga

SEQ ID NO: 3490871 - DNA, 21 bp, Homo sapiens
gctgttttcctcccttctgct

SEQ ID NO: 3490872 - DNA, 14 bp, Homo sapiens
gctgtttttgttgt

SEQ ID NO: 3490873 - DNA, 15 bp, Homo sapiens
gctgtttttgttgtg

SEQ ID NO: 3490874 - DNA, 21 bp, Homo sapiens
gcttaagatttgtttttctct

SEQ ID NO: 3490875 - DNA, 16 bp, Homo sapiens
gcttaatcattttcat

SEQ ID NO: 3490876 - DNA, 21 bp, Homo sapiens
gcttactagccctgcggagcc

SEQ ID NO: 3490877 - DNA, 17 bp, Homo sapiens
gcttagaaaattcaagc

SEQ ID NO: 3490878 - DNA, 19 bp, Homo sapiens
gcttagctttgctctgcca

SEQ ID NO: 3490879 - DNA, 20 bp, Homo sapiens
gcttagtttgtgtgttgtct

SEQ ID NO: 3490880 - DNA, 22 bp, Homo sapiens
gcttatctcttttatatttgta

SEQ ID NO: 3490881 - DNA, 15 bp, Homo sapiens
gcttatggtaccaga

SEQ ID NO: 3490882 - DNA, 22 bp, Homo sapiens
gcttcaatcggcttgtgggtga

SEQ ID NO: 3490883 - DNA, 13 bp, Homo sapiens
gcttcacagtgat

SEQ ID NO: 3490884 - DNA, 19 bp, Homo sapiens
gcttcacggaagagccttg

SEQ ID NO: 3490885 - DNA, 12 bp, Homo sapiens
gcttcagcctcc

SEQ ID NO: 3490886 - DNA, 23 bp, Homo sapiens
gcttcaggaacctcgagtactgt

SEQ ID NO: 3490887 - DNA, 13 bp, Homo sapiens
gcttcagggcagg

SEQ ID NO: 3490888 - DNA, 17 bp, Homo sapiens
gcttcagtggcagctgc

SEQ ID NO: 3490889 - DNA, 18 bp, Homo sapiens
gcttcagtggcagctgct

SEQ ID NO: 3490890 - DNA, 19 bp, Homo sapiens
gcttcagtggcagctgctt

SEQ ID NO: 3490891 - DNA, 16 bp, Homo sapiens
gcttcatctctttaga

SEQ ID NO: 3490892 - DNA, 17 bp, Homo sapiens
gcttcatggcagaaggc

SEQ ID NO: 3490893 - DNA, 16 bp, Homo sapiens
gcttcatttcctgtgt

SEQ ID NO: 3490894 - DNA, 14 bp, Homo sapiens
gcttcatttttgta

SEQ ID NO: 3490895 - DNA, 12 bp, Homo sapiens
gcttccaggctg

SEQ ID NO: 3490896 - DNA, 15 bp, Homo sapiens
gcttccaggctgggc

SEQ ID NO: 3490897 - DNA, 16 bp, Homo sapiens
gcttccatagctgctg

SEQ ID NO: 3490898 - DNA, 18 bp, Homo sapiens
gcttccatagctgctgcc

SEQ ID NO: 3490899 - DNA, 20 bp, Homo sapiens
gcttccatagctgctgccct

SEQ ID NO: 3490900 - DNA, 15 bp, Homo sapiens
gcttccatgattcta

SEQ ID NO: 3490901 - DNA, 18 bp, Homo sapiens
gcttccatgattctattt

SEQ ID NO: 3490902 - DNA, 12 bp, Homo sapiens
gcttccccacag

SEQ ID NO: 3490903 - DNA, 18 bp, Homo sapiens
gcttccccttttgccaat

SEQ ID NO: 3490904 - DNA, 13 bp, Homo sapiens
gcttcctcctgga

SEQ ID NO: 3490905 - DNA, 16 bp, Homo sapiens
gcttcctgtcctccca

SEQ ID NO: 3490906 - DNA, 23 bp, Homo sapiens
gcttccttgtagcgactaaacta

SEQ ID NO: 3490907 - DNA, 20 bp, Homo sapiens
gattctcctgcctcagcctc

SEQ ID NO: 3490908 - DNA, 21 bp, Homo sapiens
gattctcctgcctcagcctcc

SEQ ID NO: 3490909 - DNA, 11 bp, Homo sapiens
gattctccttc

SEQ ID NO: 3490910 - DNA, 16 bp, Homo sapiens
gattctgcagtaaatc

SEQ ID NO: 3490911 - DNA, 16 bp, Homo sapiens
gattcttcaaaagcat

SEQ ID NO: 3490912 - DNA, 12 bp, Homo sapiens
gattcttctgct

SEQ ID NO: 3490913 - DNA, 13 bp, Homo sapiens
gattcttctgctt

SEQ ID NO: 3490914 - DNA, 23 bp, Homo sapiens
gattcttttgtatgtaacaattg

SEQ ID NO: 3490915 - DNA, 16 bp, Homo sapiens
gattgacagctttgct

SEQ ID NO: 3490916 - DNA, 21 bp, Homo sapiens
gattgcaacaggctgggcttc

SEQ ID NO: 3490917 - DNA, 16 bp, Homo sapiens
gattgcaccactgcac

SEQ ID NO: 3490918 - DNA, 23 bp, Homo sapiens
gattgcaccactgcactccagcc

SEQ ID NO: 3490919 - DNA, 16 bp, Homo sapiens
gattgcacgtgcctgt

SEQ ID NO: 3490920 - DNA, 18 bp, Homo sapiens
gattgcttgagctcagga

SEQ ID NO: 3490921 - DNA, 18 bp, Homo sapiens
gattggctcacactgaga

SEQ ID NO: 3490922 - DNA, 19 bp, Homo sapiens
gattggtatgatgctgccg

SEQ ID NO: 3490923 - DNA, 23 bp, Homo sapiens
gattgtaaaccgctttggcctga

SEQ ID NO: 3490924 - DNA, 21 bp, Homo sapiens
gattgtggaatgttggataag

SEQ ID NO: 3490925 - DNA, 14 bp, Homo sapiens
gattgttaaaataa

SEQ ID NO: 3490926 - DNA, 11 bp, Homo sapiens
gattgtttaca

SEQ ID NO: 3490927 - DNA, 15 bp, Homo sapiens
gatttaaacacacag

SEQ ID NO: 3490928 - DNA, 18 bp, Homo sapiens
gatttaacagcatgacaa

SEQ ID NO: 3490929 - DNA, 16 bp, Homo sapiens
gatttatttgcttctt

SEQ ID NO: 3490930 - DNA, 20 bp, Homo sapiens
gatttcaaaagattgtgttc

SEQ ID NO: 3490931 - DNA, 23 bp, Homo sapiens
gatttcagggagacaagagggaa

SEQ ID NO: 3490932 - DNA, 21 bp, Homo sapiens
gatttcatctgctctccttcc

SEQ ID NO: 3490933 - DNA, 13 bp, Homo sapiens
gatttccatattt

SEQ ID NO: 3490934 - DNA, 19 bp, Homo sapiens
gatttccatattttatttt

SEQ ID NO: 3490935 - DNA, 13 bp, Homo sapiens
gatttcctgtgtc

SEQ ID NO: 3490936 - DNA, 13 bp, Homo sapiens
gatttccttgaat

SEQ ID NO: 3490937 - DNA, 20 bp, Homo sapiens
gatttctctgctcacagaag

SEQ ID NO: 3490938 - DNA, 17 bp, Homo sapiens
gatttctttgctgtaag

SEQ ID NO: 3490939 - DNA, 19 bp, Homo sapiens
gatttctttgctgtaagat

SEQ ID NO: 3490940 - DNA, 22 bp, Homo sapiens
gatttcttttgtaataaactat

SEQ ID NO: 3490941 - DNA, 19 bp, Homo sapiens
gatttgaagaacatgtgag

SEQ ID NO: 3490942 - DNA, 15 bp, Homo sapiens
gatttgcattgaaca

SEQ ID NO: 3490943 - DNA, 21 bp, Homo sapiens
gatttgcattgaacacaaact

SEQ ID NO: 3490944 - DNA, 13 bp, Homo sapiens
gatttggggtgga

SEQ ID NO: 3490945 - DNA, 15 bp, Homo sapiens
gatttgtttttctct

SEQ ID NO: 3490946 - DNA, 16 bp, Homo sapiens
gattttaactctgtct

SEQ ID NO: 3490947 - DNA, 19 bp, Homo sapiens
gattttaagtattgtttcc

SEQ ID NO: 3490948 - DNA, 18 bp, Homo sapiens
gattttaatcaagttgaa

SEQ ID NO: 3490949 - DNA, 19 bp, Homo sapiens
gattttacaattgaaatga

SEQ ID NO: 3490950 - DNA, 19 bp, Homo sapiens
gattttatgatcagtgttg

SEQ ID NO: 3490951 - DNA, 19 bp, Homo sapiens
gattttcacattcttggct

SEQ ID NO: 3490952 - DNA, 16 bp, Homo sapiens
gattttcattgaggat

SEQ ID NO: 3490953 - DNA, 18 bp, Homo sapiens
gattttgctgtatatttg

SEQ ID NO: 3490954 - DNA, 17 bp, Homo sapiens
gatttttaaaaaatatt

SEQ ID NO: 3490955 - DNA, 15 bp, Homo sapiens
gatttttagaattaa

SEQ ID NO: 3490956 - DNA, 17 bp, Homo sapiens
gcaaaattgcaaatctt

SEQ ID NO: 3490957 - DNA, 15 bp, Homo sapiens
gcaaaccacactgga

SEQ ID NO: 3490958 - DNA, 19 bp, Homo sapiens
gcaaacccatcaacaaaaa

SEQ ID NO: 3490959 - DNA, 18 bp, Homo sapiens
gcaaagaggcaagaggct

SEQ ID NO: 3490960 - DNA, 22 bp, Homo sapiens
gcaaagatctgtcctcagcctt

SEQ ID NO: 3490961 - DNA, 14 bp, Homo sapiens
gcaaagcgacgtta

SEQ ID NO: 3490962 - DNA, 13 bp, Homo sapiens
gcaaaggctggga

SEQ ID NO: 3490963 - DNA, 20 bp, Homo sapiens
gcaaagggcatgggtcggga

SEQ ID NO: 3490964 - DNA, 23 bp, Homo sapiens
gcaaagggcatgggtcgggagag

SEQ ID NO: 3490965 - DNA, 18 bp, Homo sapiens
gcaaagggtccagaagga

SEQ ID NO: 3490966 - DNA, 12 bp, Homo sapiens
gcaaagtactgt

SEQ ID NO: 3490967 - DNA, 15 bp, Homo sapiens
gcaaagtattgtaaa

SEQ ID NO: 3490968 - DNA, 17 bp, Homo sapiens
gcaaagtattgtaaatt

SEQ ID NO: 3490969 - DNA, 18 bp, Homo sapiens
gcaaagtgttttgtacca

SEQ ID NO: 3490970 - DNA, 11 bp, Homo sapiens
gcaaagttaaa

SEQ ID NO: 3490971 - DNA, 17 bp, Homo sapiens
gcaaatcctatgtgatt

SEQ ID NO: 3490972 - DNA, 19 bp, Homo sapiens
gcaaatcctatgtgatttt

SEQ ID NO: 3490973 - DNA, 20 bp, Homo sapiens
gcaaatgcccaagggaaaga

SEQ ID NO: 3490974 - DNA, 16 bp, Homo sapiens
gcaaatgtttaaacat

SEQ ID NO: 3490975 - DNA, 17 bp, Homo sapiens
gcaacagatctggaacc

SEQ ID NO: 3490976 - DNA, 20 bp, Homo sapiens
gcaacagatctggaacctca

SEQ ID NO: 3490977 - DNA, 15 bp, Homo sapiens
gcaacagcctttgaa

SEQ ID NO: 3490978 - DNA, 16 bp, Homo sapiens
gcaacaggaatctcag

SEQ ID NO: 3490979 - DNA, 19 bp, Homo sapiens
gcaacaggccattgtgaac

SEQ ID NO: 3490980 - DNA, 13 bp, Homo sapiens
gcaacaggctggg

SEQ ID NO: 3490981 - DNA, 22 bp, Homo sapiens
gcaacattgttcacctttgtag

SEQ ID NO: 3490982 - DNA, 13 bp, Homo sapiens
gcaacattttctt

SEQ ID NO: 3490983 - DNA, 18 bp, Homo sapiens
gcaacccccagcctgcta

SEQ ID NO: 3490984 - DNA, 19 bp, Homo sapiens
gcaacctccgcctcttggg

SEQ ID NO: 3490985 - DNA, 20 bp, Homo sapiens
gcaacctccgcctcttgggt

SEQ ID NO: 3490986 - DNA, 23 bp, Homo sapiens
gcaacctcttggcctgatcagac

SEQ ID NO: 3490987 - DNA, 21 bp, Homo sapiens
gcaagaactcatcactgtggc

SEQ ID NO: 3490988 - DNA, 21 bp, Homo sapiens
gcttctctgacttctgcctgg

SEQ ID NO: 3490989 - DNA, 22 bp, Homo sapiens
gcttctctgtgaacgatttaga

SEQ ID NO: 3490990 - DNA, 20 bp, Homo sapiens
gcttctggaatttgttcaag

SEQ ID NO: 3490991 - DNA, 17 bp, Homo sapiens
gcttctggccaggaagc

SEQ ID NO: 3490992 - DNA, 18 bp, Homo sapiens
gcttctgtggggcccctc

SEQ ID NO: 3490993 - DNA, 15 bp, Homo sapiens
gcttcttccaggtgc

SEQ ID NO: 3490994 - DNA, 19 bp, Homo sapiens
gcttcttctcctatgtgta

SEQ ID NO: 3490995 - DNA, 15 bp, Homo sapiens
gcttcttgcctctgt

SEQ ID NO: 3490996 - DNA, 16 bp, Homo sapiens
gcttcttgcctctgtg

SEQ ID NO: 3490997 - DNA, 16 bp, Homo sapiens
gcttcttgtttccttg

SEQ ID NO: 3490998 - DNA, 20 bp, Homo sapiens
gcttgaaggccctgctgagt

SEQ ID NO: 3490999 - DNA, 20 bp, Homo sapiens
gcttgatgggattctggaca

SEQ ID NO: 3491000 - DNA, 22 bp, Homo sapiens
gcttgatgggattctggacagg

SEQ ID NO: 3491001 - DNA, 14 bp, Homo sapiens
gcttgattctgcag

SEQ ID NO: 3491002 - DNA, 12 bp, Homo sapiens
gcttgcaagaag

SEQ ID NO: 3491003 - DNA, 13 bp, Homo sapiens
gcttgcctgcagg

SEQ ID NO: 3491004 - DNA, 14 bp, Homo sapiens
gcttgcctgcaggc

SEQ ID NO: 3491005 - DNA, 20 bp, Homo sapiens
gcttgcttatgtgtaggtga

SEQ ID NO: 3491006 - DNA, 16 bp, Homo sapiens
gcttggaccagatcta

SEQ ID NO: 3491007 - DNA, 16 bp, Homo sapiens
gcttggacggctgggc

SEQ ID NO: 3491008 - DNA, 18 bp, Homo sapiens
gcttggagcagaggggct

SEQ ID NO: 3491009 - DNA, 16 bp, Homo sapiens
gcttggggcttcctaa

SEQ ID NO: 3491010 - DNA, 15 bp, Homo sapiens
gcttggtctgtttga

SEQ ID NO: 3491011 - DNA, 18 bp, Homo sapiens
gcttgtaaatagctcagg

SEQ ID NO: 3491012 - DNA, 19 bp, Homo sapiens
gcttgtaaatagctcaggt

SEQ ID NO: 3491013 - DNA, 22 bp, Homo sapiens
gcttgtcccctcctcactccct

SEQ ID NO: 3491014 - DNA, 22 bp, Homo sapiens
gcttgttgaaaacccagactgt

SEQ ID NO: 3491015 - DNA, 21 bp, Homo sapiens
gcttgtttgctcacctggggt

SEQ ID NO: 3491016 - DNA, 19 bp, Homo sapiens
gctttaagatatctttgga

SEQ ID NO: 3491017 - DNA, 20 bp, Homo sapiens
gctttagaaaggttttgagc

SEQ ID NO: 3491018 - DNA, 19 bp, Homo sapiens
gctttatcctctttagagt

SEQ ID NO: 3491019 - DNA, 23 bp, Homo sapiens
gctttcaaaggagctcgaaggat

SEQ ID NO: 3491020 - DNA, 13 bp, Homo sapiens
gctttcagggagg

SEQ ID NO: 3491021 - DNA, 18 bp, Homo sapiens
gctttcagggaggccctg

SEQ ID NO: 3491022 - DNA, 20 bp, Homo sapiens
gctttcatgtaaactgtgca

SEQ ID NO: 3491023 - DNA, 19 bp, Homo sapiens
gctttccaaaccttatctc

SEQ ID NO: 3491024 - DNA, 15 bp, Homo sapiens
gctttcctaaatcag

SEQ ID NO: 3491025 - DNA, 20 bp, Homo sapiens
gctttcgtccacagcttcct

SEQ ID NO: 3491026 - DNA, 19 bp, Homo sapiens
gctttcgtctccagcccct

SEQ ID NO: 3491027 - DNA, 17 bp, Homo sapiens
gctttctgatcaaggcc

SEQ ID NO: 3491028 - DNA, 21 bp, Homo sapiens
gctttctgctcagcttctcct

SEQ ID NO: 3491029 - DNA, 20 bp, Homo sapiens
gctttgattcatagtaactt

SEQ ID NO: 3491030 - DNA, 22 bp, Homo sapiens
gctttggacctaaatggcctca

SEQ ID NO: 3491031 - DNA, 15 bp, Homo sapiens
gctttggcagtgcca

SEQ ID NO: 3491032 - DNA, 14 bp, Homo sapiens
gctttggcctgagt

SEQ ID NO: 3491033 - DNA, 13 bp, Homo sapiens
gctttggcttctt

SEQ ID NO: 3491034 - DNA, 21 bp, Homo sapiens
gcttttagtattttagtgaac

SEQ ID NO: 3491035 - DNA, 14 bp, Homo sapiens
gcttttccttgggg

SEQ ID NO: 3491036 - DNA, 12 bp, Homo sapiens
gcttttctgttt

SEQ ID NO: 3491037 - DNA, 18 bp, Homo sapiens
gcttttctgtttcctgta

SEQ ID NO: 3491038 - DNA, 11 bp, Homo sapiens
gcttttggcaa

SEQ ID NO: 3491039 - DNA, 14 bp, Homo sapiens
gcttttggtcatca

SEQ ID NO: 3491040 - DNA, 20 bp, Homo sapiens
gcttttgtctaattaaaaca

SEQ ID NO: 3491041 - DNA, 21 bp, Homo sapiens
gcttttgtctaattaaaacac

SEQ ID NO: 3491042 - DNA, 17 bp, Homo sapiens
gctttttatttctgcat

SEQ ID NO: 3491043 - DNA, 21 bp, Homo sapiens
gctttttatttctgcatatgt

SEQ ID NO: 3491044 - DNA, 17 bp, Homo sapiens
gcttttttgttttggct

SEQ ID NO: 3491045 - DNA, 12 bp, Homo sapiens
ggaaaaaaatgt

SEQ ID NO: 3491046 - DNA, 15 bp, Homo sapiens
ggaaaaaagcaaaaa

SEQ ID NO: 3491047 - DNA, 16 bp, Homo sapiens
ggaaaaaataacaatg

SEQ ID NO: 3491048 - DNA, 20 bp, Homo sapiens
ggaaaaaataacaatgaaag

SEQ ID NO: 3491049 - DNA, 21 bp, Homo sapiens
ggaaaaactgagacaggcagt

SEQ ID NO: 3491050 - DNA, 13 bp, Homo sapiens
ggaaaaatagcct

SEQ ID NO: 3491051 - DNA, 12 bp, Homo sapiens
ggaaaaatgtgt

SEQ ID NO: 3491052 - DNA, 18 bp, Homo sapiens
ggaaaagcagctctcccc

SEQ ID NO: 3491053 - DNA, 19 bp, Homo sapiens
ggaaaagcggacatcagct

SEQ ID NO: 3491054 - DNA, 16 bp, Homo sapiens
ggaaaataatactgct

SEQ ID NO: 3491055 - DNA, 23 bp, Homo sapiens
ggaaaatcagcctgctccagctg

SEQ ID NO: 3491056 - DNA, 14 bp, Homo sapiens
ggaaaatgcattgt

SEQ ID NO: 3491057 - DNA, 16 bp, Homo sapiens
ggaaacaacagcttta

SEQ ID NO: 3491058 - DNA, 22 bp, Homo sapiens
ggaaacagactcgattcatatt

SEQ ID NO: 3491059 - DNA, 21 bp, Homo sapiens
ggaaaccacagctgctggaga

SEQ ID NO: 3491060 - DNA, 23 bp, Homo sapiens
ggaaagatggtgtgggtgtcctg

SEQ ID NO: 3491061 - DNA, 12 bp, Homo sapiens
ggaaaggggaca

SEQ ID NO: 3491062 - DNA, 16 bp, Homo sapiens
ggaaaggtggtgtttc

SEQ ID NO: 3491063 - DNA, 15 bp, Homo sapiens
ggaaataacagagag

SEQ ID NO: 3491064 - DNA, 16 bp, Homo sapiens
ggaaatcaacttgctt

SEQ ID NO: 3491065 - DNA, 15 bp, Homo sapiens
ggaaatgaaagaaag

SEQ ID NO: 3491066 - DNA, 14 bp, Homo sapiens
ggaaatgcatttat

SEQ ID NO: 3491067 - DNA, 18 bp, Homo sapiens
ggaaatgtcacagaagca

SEQ ID NO: 3491068 - DNA, 12 bp, Homo sapiens
ggaaatgttctt

SEQ ID NO: 3491069 - DNA, 16 bp, Homo sapiens
ggaacactactcttac

SEQ ID NO: 3491070 - DNA, 20 bp, Homo sapiens
ggaacactagacaagccaga

SEQ ID NO: 3491071 - DNA, 21 bp, Homo sapiens
ggaacactagacaagccagaa

SEQ ID NO: 3491072 - DNA, 23 bp, Homo sapiens
ggaacatcatcaaggcactgcct

SEQ ID NO: 3491073 - DNA, 21 bp, Homo sapiens
ggaaccgtggtatgtctgcca

SEQ ID NO: 3491074 - DNA, 20 bp, Homo sapiens
ggaacctcagcctggccaga

SEQ ID NO: 3491075 - DNA, 21 bp, Homo sapiens
ggaacctcagcctggccagac

SEQ ID NO: 3491076 - DNA, 14 bp, Homo sapiens
ggaacctccccagc

SEQ ID NO: 3491077 - DNA, 16 bp, Homo sapiens
ggaacctccccagcct

SEQ ID NO: 3491078 - DNA, 22 bp, Homo sapiens
ggaacctcgagtactgtgggca

SEQ ID NO: 3491079 - DNA, 20 bp, Homo sapiens
ggaacggtaaatttctgtgg

SEQ ID NO: 3491080 - DNA, 13 bp, Homo sapiens
ggaactcagatcc

SEQ ID NO: 3491081 - DNA, 20 bp, Homo sapiens
ggaactcagatccagggaca

SEQ ID NO: 3491082 - DNA, 15 bp, Homo sapiens
ggaactgcatgctgc

SEQ ID NO: 3491083 - DNA, 15 bp, Homo sapiens
ggaactggagggtga

SEQ ID NO: 3491084 - DNA, 15 bp, Homo sapiens
ggaagaaagaatgtt

SEQ ID NO: 3491085 - DNA, 22 bp, Homo sapiens
ggaagacaatgtgaaaagaaaa

SEQ ID NO: 3491086 - DNA, 12 bp, Homo sapiens
ggaagacagaga

SEQ ID NO: 3491087 - DNA, 13 bp, Homo sapiens
ggaagagaaaaaa

SEQ ID NO: 3491088 - DNA, 13 bp, Homo sapiens
ggaagagcaggac

SEQ ID NO: 3491089 - DNA, 13 bp, Homo sapiens
ggaagaggctgca

SEQ ID NO: 3491090 - DNA, 20 bp, Homo sapiens
ggaagagtgactctccaggg

SEQ ID NO: 3491091 - DNA, 14 bp, Homo sapiens
ggaagatttctaaa

SEQ ID NO: 3491092 - DNA, 18 bp, Homo sapiens
ggaagatttctaaataaa

SEQ ID NO: 3491093 - DNA, 19 bp, Homo sapiens
ggaagccccttactatgat

SEQ ID NO: 3491094 - DNA, 23 bp, Homo sapiens
ggaagcgaaaggggatggagtga

SEQ ID NO: 3491095 - DNA, 16 bp, Homo sapiens
ggaagctaatttgcat

SEQ ID NO: 3491096 - DNA, 11 bp, Homo sapiens
ggaagctccgc

SEQ ID NO: 3491097 - DNA, 15 bp, Homo sapiens
ggaagctgctccgtg

SEQ ID NO: 3491098 - DNA, 22 bp, Homo sapiens
ggaagcttgttgaaaacccaga

SEQ ID NO: 3491099 - DNA, 12 bp, Homo sapiens
ggaaggagccag

SEQ ID NO: 3491100 - DNA, 23 bp, Homo sapiens
ggaaggccaggaccatgcaggga

SEQ ID NO: 3491101 - DNA, 16 bp, Homo sapiens
ggaaggggacccccgc

SEQ ID NO: 3491102 - DNA, 15 bp, Homo sapiens
ggaaggggccagagg

SEQ ID NO: 3491103 - DNA, 21 bp, Homo sapiens
ggaaggggcccgtgggagtca

SEQ ID NO: 3491104 - DNA, 16 bp, Homo sapiens
ggaaggggcttctgga

SEQ ID NO: 3491105 - DNA, 23 bp, Homo sapiens
ggaagtaacagtaacgcagggga

SEQ ID NO: 3491106 - DNA, 17 bp, Homo sapiens
ggaggatgtaaggcctt

SEQ ID NO: 3491107 - DNA, 18 bp, Homo sapiens
ggaggatgttctgggaca

SEQ ID NO: 3491108 - DNA, 21 bp, Homo sapiens
ggaggatgttctgggacacag

SEQ ID NO: 3491109 - DNA, 22 bp, Homo sapiens
ggaggattgctgccagagaagt

SEQ ID NO: 3491110 - DNA, 20 bp, Homo sapiens
ggaggcagaggttgcagtga

SEQ ID NO: 3491111 - DNA, 20 bp, Homo sapiens
ggaggcagatgtggggctga

SEQ ID NO: 3491112 - DNA, 22 bp, Homo sapiens
ggaggccaagcagtgcctgcct

SEQ ID NO: 3491113 - DNA, 13 bp, Homo sapiens
ggaggccagccag

SEQ ID NO: 3491114 - DNA, 21 bp, Homo sapiens
ggaggccagctatctgcctga

SEQ ID NO: 3491115 - DNA, 23 bp, Homo sapiens
ggaggccaggccggcgagccctg

SEQ ID NO: 3491116 - DNA, 16 bp, Homo sapiens
ggaggccagtgagcca

SEQ ID NO: 3491117 - DNA, 14 bp, Homo sapiens
ggaggcccaggctg

SEQ ID NO: 3491118 - DNA, 16 bp, Homo sapiens
ggaggcccaggctggg

SEQ ID NO: 3491119 - DNA, 13 bp, Homo sapiens
ggaggcccagttc

SEQ ID NO: 3491120 - DNA, 17 bp, Homo sapiens
ggaggcccgcagagcgc

SEQ ID NO: 3491121 - DNA, 15 bp, Homo sapiens
ggaggcctcaggtgc

SEQ ID NO: 3491122 - DNA, 18 bp, Homo sapiens
ggaggcgtctcgggagag

SEQ ID NO: 3491123 - DNA, 21 bp, Homo sapiens
ggaggctcacccccttctcca

SEQ ID NO: 3491124 - DNA, 15 bp, Homo sapiens
ggaggctccagaggg

SEQ ID NO: 3491125 - DNA, 15 bp, Homo sapiens
ggaggctgcctccca

SEQ ID NO: 3491126 - DNA, 13 bp, Homo sapiens
ggagggagatgga

SEQ ID NO: 3491127 - DNA, 21 bp, Homo sapiens
ggagggcacattccttgcctg

SEQ ID NO: 3491128 - DNA, 16 bp, Homo sapiens
ggagggcagcagaagg

SEQ ID NO: 3491129 - DNA, 15 bp, Homo sapiens
ggagggcagcagggc

SEQ ID NO: 3491130 - DNA, 16 bp, Homo sapiens
ggagggcagcagggct

SEQ ID NO: 3491131 - DNA, 23 bp, Homo sapiens
ggagggccacatgggaggctcac

SEQ ID NO: 3491132 - DNA, 22 bp, Homo sapiens
ggagggctgtcatctgtgcact

SEQ ID NO: 3491133 - DNA, 15 bp, Homo sapiens
ggaggtatgggctgg

SEQ ID NO: 3491134 - DNA, 16 bp, Homo sapiens
ggaggtatgggctggg

SEQ ID NO: 3491135 - DNA, 14 bp, Homo sapiens
ggaggtcgaggcag

SEQ ID NO: 3491136 - DNA, 15 bp, Homo sapiens
ggaggtcgaggcagg

SEQ ID NO: 3491137 - DNA, 16 bp, Homo sapiens
ggaggtcgaggcagga

SEQ ID NO: 3491138 - DNA, 18 bp, Homo sapiens
ggaggtcgaggcaggagg

SEQ ID NO: 3491139 - DNA, 19 bp, Homo sapiens
ggaggttgatcagatctga

SEQ ID NO: 3491140 - DNA, 14 bp, Homo sapiens
ggaggtttgtcggg

SEQ ID NO: 3491141 - DNA, 17 bp, Homo sapiens
ggagtaaccgctccagg

SEQ ID NO: 3491142 - DNA, 13 bp, Homo sapiens
ggagtagctagtt

SEQ ID NO: 3491143 - DNA, 13 bp, Homo sapiens
ggagtcacacagt

SEQ ID NO: 3491144 - DNA, 21 bp, Homo sapiens
ggagtcacacagtgttggagg

SEQ ID NO: 3491145 - DNA, 23 bp, Homo sapiens
ggagtcatctcaaccatcccctc

SEQ ID NO: 3491146 - DNA, 14 bp, Homo sapiens
ggagtcatgtgcct

SEQ ID NO: 3491147 - DNA, 18 bp, Homo sapiens
ggagtcatttgagtctct

SEQ ID NO: 3491148 - DNA, 21 bp, Homo sapiens
ggagtcatttgagtctcttaa

SEQ ID NO: 3491149 - DNA, 21 bp, Homo sapiens
ggagtcccaccttggctgcag

SEQ ID NO: 3491150 - DNA, 23 bp, Homo sapiens
ggagtcccaccttggctgcaggg

SEQ ID NO: 3491151 - DNA, 22 bp, Homo sapiens
ggagtcgtggggtgtgctggga

SEQ ID NO: 3491152 - DNA, 24 bp, Homo sapiens
ggagtcgtggggtgtgctgggagc

SEQ ID NO: 3491153 - DNA, 18 bp, Homo sapiens
ggagtctgtcctgtgacg

SEQ ID NO: 3491154 - DNA, 16 bp, Homo sapiens
ggagtgacagaggcag

SEQ ID NO: 3491155 - DNA, 12 bp, Homo sapiens
ggagtgagctgg

SEQ ID NO: 3491156 - DNA, 14 bp, Homo sapiens
ggagtgcagtgagc

SEQ ID NO: 3491157 - DNA, 15 bp, Homo sapiens
ggagtgcagtgagcc

SEQ ID NO: 3491158 - DNA, 14 bp, Homo sapiens
ggagtgcagtggtg

SEQ ID NO: 3491159 - DNA, 13 bp, Homo sapiens
ggagtgtcctctt

SEQ ID NO: 3491160 - DNA, 24 bp, Homo sapiens
ggagtgtcctcttccctctctgca

SEQ ID NO: 3491161 - DNA, 12 bp, Homo sapiens
ggagtgttcccc

SEQ ID NO: 3491162 - DNA, 14 bp, Homo sapiens
ggagttagccaaac

SEQ ID NO: 3491163 - DNA, 20 bp, Homo sapiens
ggagttgatcgcctttccca

SEQ ID NO: 3491164 - DNA, 16 bp, Homo sapiens
ggataaaacagcatta

SEQ ID NO: 3491165 - DNA, 17 bp, Homo sapiens
ggataaaacagcattag

SEQ ID NO: 3491166 - DNA, 18 bp, Homo sapiens
ggataaattgccataata

SEQ ID NO: 3491167 - DNA, 17 bp, Homo sapiens
ggatacttaacaaatac

SEQ ID NO: 3491168 - DNA, 19 bp, Homo sapiens
ggatagagaatgttccaga

SEQ ID NO: 3491169 - DNA, 13 bp, Homo sapiens
ggatagatgctgg

SEQ ID NO: 3491170 - DNA, 18 bp, Homo sapiens
ggatagatgctggcccag

SEQ ID NO: 3491171 - DNA, 19 bp, Homo sapiens
ggatagatgctggcccagg

SEQ ID NO: 3491172 - DNA, 20 bp, Homo sapiens
ggatagatgctggcccaggg

SEQ ID NO: 3491173 - DNA, 15 bp, Homo sapiens
ggatattccaaaata

SEQ ID NO: 3491174 - DNA, 13 bp, Homo sapiens
ggatcagccagga

SEQ ID NO: 3491175 - DNA, 19 bp, Homo sapiens
ggatcatctgccgtgcctg

SEQ ID NO: 3491176 - DNA, 18 bp, Homo sapiens
ggatccctcatctgtccc

SEQ ID NO: 3491177 - DNA, 18 bp, Homo sapiens
ggatccgtttgaccaatt

SEQ ID NO: 3491178 - DNA, 16 bp, Homo sapiens
ggatcctcataggtca

SEQ ID NO: 3491179 - DNA, 21 bp, Homo sapiens
ggatctggtagggggaaaatg

SEQ ID NO: 3491180 - DNA, 15 bp, Homo sapiens
ggatctttgtggcca

SEQ ID NO: 3491181 - DNA, 12 bp, Homo sapiens
ggatgagaaagg

SEQ ID NO: 3491182 - DNA, 13 bp, Homo sapiens
ggatgagcagagc

SEQ ID NO: 3491183 - DNA, 22 bp, Homo sapiens
ggatgcagtgctcgctgttgct

SEQ ID NO: 3491184 - DNA, 20 bp, Homo sapiens
ggatgcattcgagatggcag

SEQ ID NO: 3491185 - DNA, 22 bp, Homo sapiens
ggatgccaatattaaatctgct

SEQ ID NO: 3491186 - DNA, 19 bp, Homo sapiens
ggatgccactcctccctcc

SEQ ID NO: 3491187 - DNA, 12 bp, Homo sapiens
ggatgccctgga

SEQ ID NO: 3491188 - DNA, 18 bp, Homo sapiens
ggatgccctggaggtggc

SEQ ID NO: 3491189 - DNA, 13 bp, Homo sapiens
ggatgcctggtgg

SEQ ID NO: 3491190 - DNA, 20 bp, Homo sapiens
ggatgcctggtggcagctgc

SEQ ID NO: 3491191 - DNA, 19 bp, Homo sapiens
ggatggaaggttggatgga

SEQ ID NO: 3491192 - DNA, 19 bp, Homo sapiens
ggatgggaggtatgggctg

SEQ ID NO: 3491193 - DNA, 18 bp, Homo sapiens
ggatgggcctttgagcct

SEQ ID NO: 3491194 - DNA, 15 bp, Homo sapiens
ggatgggggaactca

SEQ ID NO: 3491195 - DNA, 17 bp, Homo sapiens
ggatgggggaactcaga

SEQ ID NO: 3491196 - DNA, 18 bp, Homo sapiens
ggatggtgtgccttccag

SEQ ID NO: 3491197 - DNA, 14 bp, Homo sapiens
ggatgtccagagct

SEQ ID NO: 3491198 - DNA, 18 bp, Homo sapiens
ggatgtgattgtggaatg

SEQ ID NO: 3491199 - DNA, 18 bp, Homo sapiens
ggatgtggttttcttaag

SEQ ID NO: 3491200 - DNA, 13 bp, Homo sapiens
ggatgttctggga

SEQ ID NO: 3491201 - DNA, 15 bp, Homo sapiens
ggatgttctgggaca

SEQ ID NO: 3491202 - DNA, 15 bp, Homo sapiens
ggattaatatgaaaa

SEQ ID NO: 3491203 - DNA, 15 bp, Homo sapiens
ggattcgcttgagtt

SEQ ID NO: 3491204 - DNA, 21 bp, Homo sapiens
ggattctcatgggaaggggag

SEQ ID NO: 3491205 - DNA, 18 bp, Homo sapiens
ggattctggttccagggt

SEQ ID NO: 3491206 - DNA, 19 bp, Homo sapiens
ggattctggttccagggtc

SEQ ID NO: 3491207 - DNA, 17 bp, Homo sapiens
ggattggggtccctcta

SEQ ID NO: 3491208 - DNA, 15 bp, Homo sapiens
ggacaatatgtgcca

SEQ ID NO: 3491209 - DNA, 15 bp, Homo sapiens
ggacacagctcttct

SEQ ID NO: 3491210 - DNA, 18 bp, Homo sapiens
ggacacagctcttctcca

SEQ ID NO: 3491211 - DNA, 21 bp, Homo sapiens
ggacacagctcttctccaggc

SEQ ID NO: 3491212 - DNA, 19 bp, Homo sapiens
ggacacctgggagaaatct

SEQ ID NO: 3491213 - DNA, 17 bp, Homo sapiens
ggacactcaaaagctgg

SEQ ID NO: 3491214 - DNA, 15 bp, Homo sapiens
ggacagaggccccag

SEQ ID NO: 3491215 - DNA, 18 bp, Homo sapiens
ggacagaggccccagcct

SEQ ID NO: 3491216 - DNA, 21 bp, Homo sapiens
ggacagaggttatctgtccca

SEQ ID NO: 3491217 - DNA, 19 bp, Homo sapiens
ggacagatccagggactga

SEQ ID NO: 3491218 - DNA, 20 bp, Homo sapiens
ggacagccacggccaggcca

SEQ ID NO: 3491219 - DNA, 14 bp, Homo sapiens
ggacagccccaccc

SEQ ID NO: 3491220 - DNA, 11 bp, Homo sapiens
ggacagctcct

SEQ ID NO: 3491221 - DNA, 19 bp, Homo sapiens
ggacagctccttctgtcct

SEQ ID NO: 3491222 - DNA, 12 bp, Homo sapiens
ggacagctgtgt

SEQ ID NO: 3491223 - DNA, 15 bp, Homo sapiens
ggacaggagaagaga

SEQ ID NO: 3491224 - DNA, 17 bp, Homo sapiens
ggacaggagaagagagg

SEQ ID NO: 3491225 - DNA, 17 bp, Homo sapiens
ggacaggatgtgtttgc

SEQ ID NO: 3491226 - DNA, 16 bp, Homo sapiens
ggacaggccgcagctc

SEQ ID NO: 3491227 - DNA, 13 bp, Homo sapiens
ggacaggctcttc

SEQ ID NO: 3491228 - DNA, 20 bp, Homo sapiens
ggacaggctcttctttccca

SEQ ID NO: 3491229 - DNA, 23 bp, Homo sapiens
ggacaggctggctccagatgcag

SEQ ID NO: 3491230 - DNA, 15 bp, Homo sapiens
ggacagtcagctctt

SEQ ID NO: 3491231 - DNA, 23 bp, Homo sapiens
ggacagtgcttgatacaggaaca

SEQ ID NO: 3491232 - DNA, 20 bp, Homo sapiens
ggacatccccccgccaaaag

SEQ ID NO: 3491233 - DNA, 16 bp, Homo sapiens
ggacatgctgaagcca

SEQ ID NO: 3491234 - DNA, 20 bp, Homo sapiens
ggacattgcggacagccacg

SEQ ID NO: 3491235 - DNA, 11 bp, Homo sapiens
ggaccaagaat

SEQ ID NO: 3491236 - DNA, 21 bp, Homo sapiens
ggaccaagaatgagctggttt

SEQ ID NO: 3491237 - DNA, 20 bp, Homo sapiens
ggaccacaactattttcaga

SEQ ID NO: 3491238 - DNA, 13 bp, Homo sapiens
ggaccagctcagg

SEQ ID NO: 3491239 - DNA, 22 bp, Homo sapiens
ggaccagctcaggacagatgcc

SEQ ID NO: 3491240 - DNA, 17 bp, Homo sapiens
ggacccagcgggcaggt

SEQ ID NO: 3491241 - DNA, 21 bp, Homo sapiens
ggaccccagcaagtggtccta

SEQ ID NO: 3491242 - DNA, 14 bp, Homo sapiens
ggacccccgccccc

SEQ ID NO: 3491243 - DNA, 16 bp, Homo sapiens
ggacccccgccccctg

SEQ ID NO: 3491244 - DNA, 14 bp, Homo sapiens
ggacccctggctct

SEQ ID NO: 3491245 - DNA, 13 bp, Homo sapiens
ggaccctgttgct

SEQ ID NO: 3491246 - DNA, 22 bp, Homo sapiens
ggacctaaatggcctcatgtgg

SEQ ID NO: 3491247 - DNA, 23 bp, Homo sapiens
ggacctcaggtgagaagcagagg

SEQ ID NO: 3491248 - DNA, 14 bp, Homo sapiens
ggacctctcccagg

SEQ ID NO: 3491249 - DNA, 17 bp, Homo sapiens
ggacctggtgctgcctc

SEQ ID NO: 3491250 - DNA, 18 bp, Homo sapiens
ggaccttcgggctgtgcc

SEQ ID NO: 3491251 - DNA, 15 bp, Homo sapiens
ggaccttgaactggg

SEQ ID NO: 3491252 - DNA, 17 bp, Homo sapiens
ggaccttgaactgggta

SEQ ID NO: 3491253 - DNA, 16 bp, Homo sapiens
ggacgcaggcccctct

SEQ ID NO: 3491254 - DNA, 20 bp, Homo sapiens
ggacgcctgggggtgccagg

SEQ ID NO: 3491255 - DNA, 15 bp, Homo sapiens
ggacgctttgtctgt

SEQ ID NO: 3491256 - DNA, 19 bp, Homo sapiens
ggacggtgcccaagccaga

SEQ ID NO: 3491257 - DNA, 20 bp, Homo sapiens
ggacggtgctccaggcaggc

SEQ ID NO: 3491258 - DNA, 20 bp, Homo sapiens
ggactaatccaatacctctt

SEQ ID NO: 3491259 - DNA, 20 bp, Homo sapiens
ggactacaggtgtgagtcac

SEQ ID NO: 3491260 - DNA, 18 bp, Homo sapiens
ggactagagggacctctc

SEQ ID NO: 3491261 - DNA, 19 bp, Homo sapiens
ggactagagggacctctcc

SEQ ID NO: 3491262 - DNA, 21 bp, Homo sapiens
ggactagagggacctctccca

SEQ ID NO: 3491263 - DNA, 16 bp, Homo sapiens
ggactcaatgcactga

SEQ ID NO: 3491264 - DNA, 18 bp, Homo sapiens
ggactcaatgcactgaca

SEQ ID NO: 3491265 - DNA, 17 bp, Homo sapiens
ggactcagctccccaga

SEQ ID NO: 3491266 - DNA, 16 bp, Homo sapiens
ggactcaggcgggaca

SEQ ID NO: 3491267 - DNA, 15 bp, Homo sapiens
ggactcagggcagcg

SEQ ID NO: 3491268 - DNA, 22 bp, Homo sapiens
ggactcagggcagcgccaggct

SEQ ID NO: 3491269 - DNA, 22 bp, Homo sapiens
ggactccatctctcatcctcca

SEQ ID NO: 3491270 - DNA, 22 bp, Homo sapiens
ggactcctgccaccagcatcca

SEQ ID NO: 3491271 - DNA, 17 bp, Homo sapiens
ggactctcagtctctga

SEQ ID NO: 3491272 - DNA, 23 bp, Homo sapiens
ggactctggaagattttcattga

SEQ ID NO: 3491273 - DNA, 16 bp, Homo sapiens
ggactgaaaacctctc

SEQ ID NO: 3491274 - DNA, 18 bp, Homo sapiens
ggactgaaaacctctcct

SEQ ID NO: 3491275 - DNA, 13 bp, Homo sapiens
ggactgaggcctg

SEQ ID NO: 3491276 - DNA, 20 bp, Homo sapiens
ggacttccccggagggctgc

SEQ ID NO: 3491277 - DNA, 20 bp, Homo sapiens
ggacttcctgtccagctcca

SEQ ID NO: 3491278 - DNA, 23 bp, Homo sapiens
ggacttcctgtccagctccaacc

SEQ ID NO: 3491279 - DNA, 19 bp, Homo sapiens
ggacttgaactttcctgga

SEQ ID NO: 3491280 - DNA, 15 bp, Homo sapiens
ggacttggaagctcc

SEQ ID NO: 3491281 - DNA, 18 bp, Homo sapiens
ggagaaaatcatcaagaa

SEQ ID NO: 3491282 - DNA, 22 bp, Homo sapiens
ggagaaatctggcttctggcca

SEQ ID NO: 3491283 - DNA, 13 bp, Homo sapiens
ggagaagccagga

SEQ ID NO: 3491284 - DNA, 15 bp, Homo sapiens
ggagaagctctgttt

SEQ ID NO: 3491285 - DNA, 17 bp, Homo sapiens
ggagacaggcagagctg

SEQ ID NO: 3491286 - DNA, 20 bp, Homo sapiens
ggagaccggggtatcctggg

SEQ ID NO: 3491287 - DNA, 16 bp, Homo sapiens
ggagactcctaggcag

SEQ ID NO: 3491288 - DNA, 17 bp, Homo sapiens
ggagactgggctgaggg

SEQ ID NO: 3491289 - DNA, 20 bp, Homo sapiens
ggagactgggctgagggagc

SEQ ID NO: 3491290 - DNA, 16 bp, Homo sapiens
ggagactgtcttcccg

SEQ ID NO: 3491291 - DNA, 12 bp, Homo sapiens
ggagagaaaaca

SEQ ID NO: 3491292 - DNA, 14 bp, Homo sapiens
ggagagaaaatata

SEQ ID NO: 3491293 - DNA, 18 bp, Homo sapiens
ggagagatagcctgtggc

SEQ ID NO: 3491294 - DNA, 22 bp, Homo sapiens
ggagagccaccaagagggacgc

SEQ ID NO: 3491295 - DNA, 13 bp, Homo sapiens
ggagagctggagc

SEQ ID NO: 3491296 - DNA, 17 bp, Homo sapiens
ggagagctggagcctgg

SEQ ID NO: 3491297 - DNA, 16 bp, Homo sapiens
ggagaggggacgcagg

SEQ ID NO: 3491298 - DNA, 14 bp, Homo sapiens
ggagatagggaaag

SEQ ID NO: 3491299 - DNA, 20 bp, Homo sapiens
ggagatcaaggagaggaggc

SEQ ID NO: 3491300 - DNA, 17 bp, Homo sapiens
ggagcaaagttaaaagc

SEQ ID NO: 3491301 - DNA, 17 bp, Homo sapiens
ggagcacacccagcccc

SEQ ID NO: 3491302 - DNA, 12 bp, Homo sapiens
ggagcagagggg

SEQ ID NO: 3491303 - DNA, 21 bp, Homo sapiens
ggagccactcctctgactcag

SEQ ID NO: 3491304 - DNA, 13 bp, Homo sapiens
ggagccactgcca

SEQ ID NO: 3491305 - DNA, 21 bp, Homo sapiens
ggagccagctccctctattta

SEQ ID NO: 3491306 - DNA, 18 bp, Homo sapiens
ggagccagtaaacagagg

SEQ ID NO: 3491307 - DNA, 14 bp, Homo sapiens
ggagcccactgtcc

SEQ ID NO: 3491308 - DNA, 17 bp, Homo sapiens
ggagcccactgtcctgg

SEQ ID NO: 3491309 - DNA, 23 bp, Homo sapiens
ggagcccactgtcctgggcctgc

SEQ ID NO: 3491310 - DNA, 16 bp, Homo sapiens
ggagcccagctctgaa

SEQ ID NO: 3491311 - DNA, 12 bp, Homo sapiens
ggagcccagggc

SEQ ID NO: 3491312 - DNA, 12 bp, Homo sapiens
ggagccccatct

SEQ ID NO: 3491313 - DNA, 16 bp, Homo sapiens
ggagccccgaggcctt

SEQ ID NO: 3491314 - DNA, 22 bp, Homo sapiens
ggagccccgaggccttctctga

SEQ ID NO: 3491315 - DNA, 24 bp, Homo sapiens
ggagcccctggacatgcctgtcct

SEQ ID NO: 3491316 - DNA, 21 bp, Homo sapiens
ggagccccttctgctcagctc

SEQ ID NO: 3491317 - DNA, 18 bp, Homo sapiens
ggagccctccgccttcac

SEQ ID NO: 3491318 - DNA, 13 bp, Homo sapiens
ggagccgcagcag

SEQ ID NO: 3491319 - DNA, 20 bp, Homo sapiens
ggggcctaggcctcagccag

SEQ ID NO: 3491320 - DNA, 19 bp, Homo sapiens
ggggcctggagatcctcct

SEQ ID NO: 3491321 - DNA, 21 bp, Homo sapiens
ggggcgatcgcggcggagctg

SEQ ID NO: 3491322 - DNA, 17 bp, Homo sapiens
ggggctgaggtgggagg

SEQ ID NO: 3491323 - DNA, 15 bp, Homo sapiens
ggggctgctggcctg

SEQ ID NO: 3491324 - DNA, 19 bp, Homo sapiens
ggggctgcttcctcctgga

SEQ ID NO: 3491325 - DNA, 17 bp, Homo sapiens
ggggctggcactgactg

SEQ ID NO: 3491326 - DNA, 21 bp, Homo sapiens
ggggctttcgtccacagcttc

SEQ ID NO: 3491327 - DNA, 19 bp, Homo sapiens
gggggagaaccactgaccc

SEQ ID NO: 3491328 - DNA, 22 bp, Homo sapiens
gggggagccccttctgctcagc

SEQ ID NO: 3491329 - DNA, 21 bp, Homo sapiens
gggggatgccactcctccctc

SEQ ID NO: 3491330 - DNA, 22 bp, Homo sapiens
gggggatgccactcctccctcc

SEQ ID NO: 3491331 - DNA, 22 bp, Homo sapiens
gggggcagatcttggactcatg

SEQ ID NO: 3491332 - DNA, 13 bp, Homo sapiens
gggggcagggctg

SEQ ID NO: 3491333 - DNA, 14 bp, Homo sapiens
gggggcaggtgctg

SEQ ID NO: 3491334 - DNA, 14 bp, Homo sapiens
gggggctctggcca

SEQ ID NO: 3491335 - DNA, 13 bp, Homo sapiens
gggggtggccgct

SEQ ID NO: 3491336 - DNA, 19 bp, Homo sapiens
ggggtagctagaggaacca

SEQ ID NO: 3491337 - DNA, 18 bp, Homo sapiens
ggggtcatgccctcctct

SEQ ID NO: 3491338 - DNA, 19 bp, Homo sapiens
ggggtcatgccctcctctc

SEQ ID NO: 3491339 - DNA, 17 bp, Homo sapiens
ggggtccagggagcagg

SEQ ID NO: 3491340 - DNA, 20 bp, Homo sapiens
ggggtctggagttgatctgg

SEQ ID NO: 3491341 - DNA, 15 bp, Homo sapiens
ggggtgaggagctgg

SEQ ID NO: 3491342 - DNA, 16 bp, Homo sapiens
ggggtgcccacaggcc

SEQ ID NO: 3491343 - DNA, 13 bp, Homo sapiens
ggggtgggccagg

SEQ ID NO: 3491344 - DNA, 17 bp, Homo sapiens
ggggtgggccaggctga

SEQ ID NO: 3491345 - DNA, 16 bp, Homo sapiens
ggggtggggtcatgcc

SEQ ID NO: 3491346 - DNA, 11 bp, Homo sapiens
ggggtgggtca

SEQ ID NO: 3491347 - DNA, 11 bp, Homo sapiens
ggggttttgtt

SEQ ID NO: 3491348 - DNA, 23 bp, Homo sapiens
gggtacttgtggacacagctctt

SEQ ID NO: 3491349 - DNA, 21 bp, Homo sapiens
gggtatgttaacctaggcagt

SEQ ID NO: 3491350 - DNA, 13 bp, Homo sapiens
gggtccagaagga

SEQ ID NO: 3491351 - DNA, 16 bp, Homo sapiens
gggtccagggagcagg

SEQ ID NO: 3491352 - DNA, 19 bp, Homo sapiens
gggtccaggggatgggagg

SEQ ID NO: 3491353 - DNA, 15 bp, Homo sapiens
gggtccccagctccc

SEQ ID NO: 3491354 - DNA, 17 bp, Homo sapiens
gggtccccagctcccca

SEQ ID NO: 3491355 - DNA, 18 bp, Homo sapiens
gggtcccggctctgtggg

SEQ ID NO: 3491356 - DNA, 19 bp, Homo sapiens
gggtcctcttctgggcctg

SEQ ID NO: 3491357 - DNA, 13 bp, Homo sapiens
gggtcctggccat

SEQ ID NO: 3491358 - DNA, 15 bp, Homo sapiens
gggtcctggccatcc

SEQ ID NO: 3491359 - DNA, 17 bp, Homo sapiens
gggtcctggccatccca

SEQ ID NO: 3491360 - DNA, 15 bp, Homo sapiens
gggtcggctgaccat

SEQ ID NO: 3491361 - DNA, 18 bp, Homo sapiens
gggtcgggagaggggacg

SEQ ID NO: 3491362 - DNA, 14 bp, Homo sapiens
gggtctcactctgt

SEQ ID NO: 3491363 - DNA, 22 bp, Homo sapiens
gggtctggcagcctcccatcca

SEQ ID NO: 3491364 - DNA, 14 bp, Homo sapiens
gggtctgtaaaatc

SEQ ID NO: 3491365 - DNA, 14 bp, Homo sapiens
gggtgaaggctggc

SEQ ID NO: 3491366 - DNA, 19 bp, Homo sapiens
gggtgacagagcaagtgag

SEQ ID NO: 3491367 - DNA, 18 bp, Homo sapiens
gggtgacgggactcaggc

SEQ ID NO: 3491368 - DNA, 21 bp, Homo sapiens
gggtgagggccttcttaagat

SEQ ID NO: 3491369 - DNA, 20 bp, Homo sapiens
gggtggagaactcctagggt

SEQ ID NO: 3491370 - DNA, 13 bp, Homo sapiens
gggtggatgcctg

SEQ ID NO: 3491371 - DNA, 19 bp, Homo sapiens
gggtggcaccagcagcctg

SEQ ID NO: 3491372 - DNA, 23 bp, Homo sapiens
gggtggcctaagagttgagctct

SEQ ID NO: 3491373 - DNA, 19 bp, Homo sapiens
gggtgggccaggctgatgg

SEQ ID NO: 3491374 - DNA, 11 bp, Homo sapiens
gggtgggggtg

SEQ ID NO: 3491375 - DNA, 17 bp, Homo sapiens
gggtggggtcatgccct

SEQ ID NO: 3491376 - DNA, 21 bp, Homo sapiens
gggtggggtcatgccctcctc

SEQ ID NO: 3491377 - DNA, 11 bp, Homo sapiens
gggtgggtcag

SEQ ID NO: 3491378 - DNA, 21 bp, Homo sapiens
gggtgggtcagaaccctgcca

SEQ ID NO: 3491379 - DNA, 12 bp, Homo sapiens
gggtggtgacct

SEQ ID NO: 3491380 - DNA, 22 bp, Homo sapiens
gggtgtcctgcctgtctgcccc

SEQ ID NO: 3491381 - DNA, 21 bp, Homo sapiens
gggtgtgcaatgtctgagtga

SEQ ID NO: 3491382 - DNA, 13 bp, Homo sapiens
gggtgtgctggga

SEQ ID NO: 3491383 - DNA, 13 bp, Homo sapiens
gggtgtgggaggc

SEQ ID NO: 3491384 - DNA, 16 bp, Homo sapiens
gggtgtgggaggcccg

SEQ ID NO: 3491385 - DNA, 13 bp, Homo sapiens
gggttcatttgtg

SEQ ID NO: 3491386 - DNA, 13 bp, Homo sapiens
gggttctgcctct

SEQ ID NO: 3491387 - DNA, 21 bp, Homo sapiens
gggttctgcctgccagctgca

SEQ ID NO: 3491388 - DNA, 16 bp, Homo sapiens
gggttggcccctgccc

SEQ ID NO: 3491389 - DNA, 19 bp, Homo sapiens
gggttggcccctgcccggc

SEQ ID NO: 3491390 - DNA, 23 bp, Homo sapiens
gggttttgccatgttggccaggc

SEQ ID NO: 3491391 - DNA, 10 bp, Homo sapiens
gggttttgtt

SEQ ID NO: 3491392 - DNA, 19 bp, Homo sapiens
gggtttttagagaatgtgt

SEQ ID NO: 3491393 - DNA, 16 bp, Homo sapiens
ggtaaacacgcctgca

SEQ ID NO: 3491394 - DNA, 22 bp, Homo sapiens
ggtaaaggagcatttttttatt

SEQ ID NO: 3491395 - DNA, 13 bp, Homo sapiens
ggtaaatttctgt

SEQ ID NO: 3491396 - DNA, 18 bp, Homo sapiens
ggtaacagggagactgca

SEQ ID NO: 3491397 - DNA, 18 bp, Homo sapiens
ggtaatattgataagcta

SEQ ID NO: 3491398 - DNA, 21 bp, Homo sapiens
ggtacaacctttattcttttc

SEQ ID NO: 3491399 - DNA, 19 bp, Homo sapiens
ggtacacaactagttttgt

SEQ ID NO: 3491400 - DNA, 23 bp, Homo sapiens
ggtacagcaacaggaatctcaga

SEQ ID NO: 3491401 - DNA, 16 bp, Homo sapiens
ggtacccaattcaatt

SEQ ID NO: 3491402 - DNA, 18 bp, Homo sapiens
ggtacgcagcccagagca

SEQ ID NO: 3491403 - DNA, 23 bp, Homo sapiens
ggtactataaaagctttctgcca

SEQ ID NO: 3491404 - DNA, 15 bp, Homo sapiens
ggtacttcttgaagg

SEQ ID NO: 3491405 - DNA, 16 bp, Homo sapiens
ggtagccatcatggat

SEQ ID NO: 3491406 - DNA, 13 bp, Homo sapiens
ggtagcctgctgg

SEQ ID NO: 3491407 - DNA, 19 bp, Homo sapiens
ggtagctgcccctggctct

SEQ ID NO: 3491408 - DNA, 15 bp, Homo sapiens
ggtaggttcagccaa

SEQ ID NO: 3491409 - DNA, 16 bp, Homo sapiens
ggtaggttcagccaag

SEQ ID NO: 3491410 - DNA, 12 bp, Homo sapiens
ggtataaaagat

SEQ ID NO: 3491411 - DNA, 19 bp, Homo sapiens
ggtatcaggtgctgccatc

SEQ ID NO: 3491412 - DNA, 15 bp, Homo sapiens
ggtatgatgctgccg

SEQ ID NO: 3491413 - DNA, 23 bp, Homo sapiens
ggtatgggctgggggctatgtat

SEQ ID NO: 3491414 - DNA, 12 bp, Homo sapiens
ggtatgtttaat

SEQ ID NO: 3491415 - DNA, 18 bp, Homo sapiens
ggtatgtttaatctgtta

SEQ ID NO: 3491416 - DNA, 14 bp, Homo sapiens
ggtattaccatgta

SEQ ID NO: 3491417 - DNA, 20 bp, Homo sapiens
ggtattgtatttattcaata

SEQ ID NO: 3491418 - DNA, 22 bp, Homo sapiens
ggtattgtatttattcaataaa

SEQ ID NO: 3491419 - DNA, 16 bp, Homo sapiens
ggtcaacagttttcct

SEQ ID NO: 3491420 - DNA, 22 bp, Homo sapiens
ggtcacaaatcctaaaagaagc

SEQ ID NO: 3491421 - DNA, 14 bp, Homo sapiens
ggtcacacactgat

SEQ ID NO: 3491422 - DNA, 15 bp, Homo sapiens
ggtcacagcggaggt

SEQ ID NO: 3491423 - DNA, 21 bp, Homo sapiens
ggtcacagcggaggtgtggag

SEQ ID NO: 3491424 - DNA, 15 bp, Homo sapiens
ggtcacttgggaaga

SEQ ID NO: 3491425 - DNA, 22 bp, Homo sapiens
ggtcacttgggaagaggacttc

SEQ ID NO: 3491426 - DNA, 15 bp, Homo sapiens
ggtcagaaacaggac

SEQ ID NO: 3491427 - DNA, 16 bp, Homo sapiens
ggtcagaaacaggacc

SEQ ID NO: 3491428 - DNA, 17 bp, Homo sapiens
ggtcagaaacaggaccg

SEQ ID NO: 3491429 - DNA, 18 bp, Homo sapiens
ggtcagaaacaggaccgg

SEQ ID NO: 3491430 - DNA, 17 bp, Homo sapiens
ggtcagagatgggctga

SEQ ID NO: 3491431 - DNA, 19 bp, Homo sapiens
ggtcagagatgggctgaac

SEQ ID NO: 3491432 - DNA, 23 bp, Homo sapiens
ggtcagaggagagatagcctgtg

SEQ ID NO: 3491433 - DNA, 19 bp, Homo sapiens
ggtcatcgagatggagcta

SEQ ID NO: 3491434 - DNA, 23 bp, Homo sapiens
ggtcatcgattcaaactgctcca

SEQ ID NO: 3491435 - DNA, 15 bp, Homo sapiens
ggtcatttatgaaaa

SEQ ID NO: 3491436 - DNA, 15 bp, Homo sapiens
ggtccacagggcacc

SEQ ID NO: 3491437 - DNA, 17 bp, Homo sapiens
ggtccacatcccgggac

SEQ ID NO: 3491438 - DNA, 13 bp, Homo sapiens
ggtccacccagga

SEQ ID NO: 3491439 - DNA, 17 bp, Homo sapiens
ggtccacccaggagccc

SEQ ID NO: 3491440 - DNA, 20 bp, Homo sapiens
ggtccagaaggagacaggca

SEQ ID NO: 3491441 - DNA, 11 bp, Homo sapiens
ggtccagctct

SEQ ID NO: 3491442 - DNA, 13 bp, Homo sapiens
ggtccagctctgg

SEQ ID NO: 3491443 - DNA, 14 bp, Homo sapiens
ggtccccagctccc

SEQ ID NO: 3491444 - DNA, 17 bp, Homo sapiens
ggtcccggctctgtggg

SEQ ID NO: 3491445 - DNA, 18 bp, Homo sapiens
ggtcccggctctgtgggt

SEQ ID NO: 3491446 - DNA, 13 bp, Homo sapiens
ggtccgtgggacg

SEQ ID NO: 3491447 - DNA, 16 bp, Homo sapiens
ggtcctcccctctctt

SEQ ID NO: 3491448 - DNA, 17 bp, Homo sapiens
ggtcctcccctctcttg

SEQ ID NO: 3491449 - DNA, 14 bp, Homo sapiens
ggtcctctctctgt

SEQ ID NO: 3491450 - DNA, 23 bp, Homo sapiens
ggtcctctgtcagtcacagccac

SEQ ID NO: 3491451 - DNA, 17 bp, Homo sapiens
ggtcctgaaagtaactc

SEQ ID NO: 3491452 - DNA, 21 bp, Homo sapiens
ggtcctggccatcccacaagt

SEQ ID NO: 3491453 - DNA, 20 bp, Homo sapiens
ggtcctgttaacgtcatctc

SEQ ID NO: 3491454 - DNA, 21 bp, Homo sapiens
ggtcctttgggaaaggagaag

SEQ ID NO: 3491455 - DNA, 12 bp, Homo sapiens
ggtcgggagagg

SEQ ID NO: 3491456 - DNA, 18 bp, Homo sapiens
gggaggtcaaggctgcag

SEQ ID NO: 3491457 - DNA, 18 bp, Homo sapiens
gggaggtcgaggcaggag

SEQ ID NO: 3491458 - DNA, 19 bp, Homo sapiens
gggaggtcgaggcaggagg

SEQ ID NO: 3491459 - DNA, 16 bp, Homo sapiens
gggaggtgaccccagg

SEQ ID NO: 3491460 - DNA, 13 bp, Homo sapiens
gggaggtggaagg

SEQ ID NO: 3491461 - DNA, 14 bp, Homo sapiens
gggaggtggaagga

SEQ ID NO: 3491462 - DNA, 18 bp, Homo sapiens
gggaggttgatcagatct

SEQ ID NO: 3491463 - DNA, 19 bp, Homo sapiens
gggagtcaggcccggccta

SEQ ID NO: 3491464 - DNA, 17 bp, Homo sapiens
gggagtctgaagcagat

SEQ ID NO: 3491465 - DNA, 17 bp, Homo sapiens
gggagtgacagaggcag

SEQ ID NO: 3491466 - DNA, 17 bp, Homo sapiens
gggatcacaggtgtcag

SEQ ID NO: 3491467 - DNA, 11 bp, Homo sapiens
gggatgaaaga

SEQ ID NO: 3491468 - DNA, 15 bp, Homo sapiens
gggatgaaagagaag

SEQ ID NO: 3491469 - DNA, 21 bp, Homo sapiens
gggatgagcatggagctggcc

SEQ ID NO: 3491470 - DNA, 12 bp, Homo sapiens
gggatgggaggt

SEQ ID NO: 3491471 - DNA, 14 bp, Homo sapiens
gggatgtgacatgc

SEQ ID NO: 3491472 - DNA, 20 bp, Homo sapiens
gggattaatatgaaaactta

SEQ ID NO: 3491473 - DNA, 15 bp, Homo sapiens
gggattacaggtgtg

SEQ ID NO: 3491474 - DNA, 18 bp, Homo sapiens
gggcaacccccagcctgc

SEQ ID NO: 3491475 - DNA, 20 bp, Homo sapiens
gggcaacccccagcctgcta

SEQ ID NO: 3491476 - DNA, 20 bp, Homo sapiens
gggcaagctccgcaggactt

SEQ ID NO: 3491477 - DNA, 20 bp, Homo sapiens
gggcaagggttaaggcctga

SEQ ID NO: 3491478 - DNA, 14 bp, Homo sapiens
gggcaatttagaaa

SEQ ID NO: 3491479 - DNA, 23 bp, Homo sapiens
gggcacaccgggcactcagaaga

SEQ ID NO: 3491480 - DNA, 16 bp, Homo sapiens
gggcacagggtctcta

SEQ ID NO: 3491481 - DNA, 15 bp, Homo sapiens
gggcaccagccagcg

SEQ ID NO: 3491482 - DNA, 18 bp, Homo sapiens
gggcaccaggggtttctc

SEQ ID NO: 3491483 - DNA, 20 bp, Homo sapiens
gggcaccaggggtttctcgc

SEQ ID NO: 3491484 - DNA, 12 bp, Homo sapiens
gggcacccaccc

SEQ ID NO: 3491485 - DNA, 19 bp, Homo sapiens
gggcactcagaagacactg

SEQ ID NO: 3491486 - DNA, 16 bp, Homo sapiens
gggcagagctggctct

SEQ ID NO: 3491487 - DNA, 22 bp, Homo sapiens
gggcagatcttggactcatgag

SEQ ID NO: 3491488 - DNA, 22 bp, Homo sapiens
gggcaggactcagctccccaga

SEQ ID NO: 3491489 - DNA, 16 bp, Homo sapiens
gggcagggctgtgctt

SEQ ID NO: 3491490 - DNA, 14 bp, Homo sapiens
gggcaggtggggtg

SEQ ID NO: 3491491 - DNA, 13 bp, Homo sapiens
gggcatcatgcat

SEQ ID NO: 3491492 - DNA, 16 bp, Homo sapiens
gggcatcttgctggct

SEQ ID NO: 3491493 - DNA, 17 bp, Homo sapiens
gggcatcttgctggcta

SEQ ID NO: 3491494 - DNA, 18 bp, Homo sapiens
gggcatgggtcgggagag

SEQ ID NO: 3491495 - DNA, 21 bp, Homo sapiens
gggcatgggtcgggagagggg

SEQ ID NO: 3491496 - DNA, 22 bp, Homo sapiens
gggcatgggtcgggagagggga

SEQ ID NO: 3491497 - DNA, 15 bp, Homo sapiens
gggccaaacgctgag

SEQ ID NO: 3491498 - DNA, 11 bp, Homo sapiens
gggccaagcca

SEQ ID NO: 3491499 - DNA, 12 bp, Homo sapiens
gggccaagccag

SEQ ID NO: 3491500 - DNA, 15 bp, Homo sapiens
gggccaagccagctg

SEQ ID NO: 3491501 - DNA, 19 bp, Homo sapiens
gggccaagccagctgccta

SEQ ID NO: 3491502 - DNA, 17 bp, Homo sapiens
gggccagacagaccttc

SEQ ID NO: 3491503 - DNA, 19 bp, Homo sapiens
gggccagacagaccttcac

SEQ ID NO: 3491504 - DNA, 11 bp, Homo sapiens
gggccagagcc

SEQ ID NO: 3491505 - DNA, 14 bp, Homo sapiens
gggccagagccagg

SEQ ID NO: 3491506 - DNA, 15 bp, Homo sapiens
gggccagagccaggg

SEQ ID NO: 3491507 - DNA, 19 bp, Homo sapiens
gggccagatccagcctggg

SEQ ID NO: 3491508 - DNA, 13 bp, Homo sapiens
gggccagggctgc

SEQ ID NO: 3491509 - DNA, 22 bp, Homo sapiens
gggccagtctgtggatcagaga

SEQ ID NO: 3491510 - DNA, 14 bp, Homo sapiens
gggccatgctgagg

SEQ ID NO: 3491511 - DNA, 19 bp, Homo sapiens
gggccatgctgaggcctgg

SEQ ID NO: 3491512 - DNA, 16 bp, Homo sapiens
gggccattctccacag

SEQ ID NO: 3491513 - DNA, 19 bp, Homo sapiens
gggcccagagcccagctcc

SEQ ID NO: 3491514 - DNA, 13 bp, Homo sapiens
gggcccatctctt

SEQ ID NO: 3491515 - DNA, 12 bp, Homo sapiens
gggcccccacag

SEQ ID NO: 3491516 - DNA, 16 bp, Homo sapiens
gggcccggccagccat

SEQ ID NO: 3491517 - DNA, 23 bp, Homo sapiens
gggcccggcccgcgccacaggac

SEQ ID NO: 3491518 - DNA, 16 bp, Homo sapiens
gggccctctctgctct

SEQ ID NO: 3491519 - DNA, 19 bp, Homo sapiens
gggccctgccctggcaggg

SEQ ID NO: 3491520 - DNA, 13 bp, Homo sapiens
gggccctgggctg

SEQ ID NO: 3491521 - DNA, 15 bp, Homo sapiens
gggccctgggctgga

SEQ ID NO: 3491522 - DNA, 20 bp, Homo sapiens
gggccgccagggagacctgg

SEQ ID NO: 3491523 - DNA, 12 bp, Homo sapiens
gggccgctgcca

SEQ ID NO: 3491524 - DNA, 15 bp, Homo sapiens
gggccgctgccaccc

SEQ ID NO: 3491525 - DNA, 15 bp, Homo sapiens
gggccggagggtcag

SEQ ID NO: 3491526 - DNA, 13 bp, Homo sapiens
gggccggggctga

SEQ ID NO: 3491527 - DNA, 16 bp, Homo sapiens
gggccgtatctccggc

SEQ ID NO: 3491528 - DNA, 19 bp, Homo sapiens
gggccgtatctccggctcc

SEQ ID NO: 3491529 - DNA, 15 bp, Homo sapiens
gggcctcagtgccac

SEQ ID NO: 3491530 - DNA, 14 bp, Homo sapiens
gggcctcagtgccc

SEQ ID NO: 3491531 - DNA, 16 bp, Homo sapiens
gggcctcagtgcccca

SEQ ID NO: 3491532 - DNA, 20 bp, Homo sapiens
gggcctcagtgtgcccatct

SEQ ID NO: 3491533 - DNA, 13 bp, Homo sapiens
gggcctcctgtgt

SEQ ID NO: 3491534 - DNA, 23 bp, Homo sapiens
gggcctgacagtgtgggacaggc

SEQ ID NO: 3491535 - DNA, 17 bp, Homo sapiens
gggcctgactgctcaga

SEQ ID NO: 3491536 - DNA, 20 bp, Homo sapiens
gggcctgccgggctgagggc

SEQ ID NO: 3491537 - DNA, 14 bp, Homo sapiens
gggcctgctccaga

SEQ ID NO: 3491538 - DNA, 12 bp, Homo sapiens
gggcctggagat

SEQ ID NO: 3491539 - DNA, 16 bp, Homo sapiens
gggccttcttaagata

SEQ ID NO: 3491540 - DNA, 16 bp, Homo sapiens
gggccttgatgactgc

SEQ ID NO: 3491541 - DNA, 18 bp, Homo sapiens
gggccttgatgactgcct

SEQ ID NO: 3491542 - DNA, 18 bp, Homo sapiens
gggcgcaaagggcatggg

SEQ ID NO: 3491543 - DNA, 21 bp, Homo sapiens
gggcggtgagaggggaacaga

SEQ ID NO: 3491544 - DNA, 18 bp, Homo sapiens
gggctagttgggcttcct

SEQ ID NO: 3491545 - DNA, 17 bp, Homo sapiens
gggctatggtgtggact

SEQ ID NO: 3491546 - DNA, 21 bp, Homo sapiens
gggctcagcggggacagctcc

SEQ ID NO: 3491547 - DNA, 14 bp, Homo sapiens
gggctccctgactg

SEQ ID NO: 3491548 - DNA, 22 bp, Homo sapiens
gggctccgaaattccaaggccc

SEQ ID NO: 3491549 - DNA, 15 bp, Homo sapiens
gggctcttctcattt

SEQ ID NO: 3491550 - DNA, 17 bp, Homo sapiens
gggctgaatgacagtga

SEQ ID NO: 3491551 - DNA, 17 bp, Homo sapiens
gggctgagggcctgctg

SEQ ID NO: 3491552 - DNA, 18 bp, Homo sapiens
gggctgagggcctgctgg

SEQ ID NO: 3491553 - DNA, 16 bp, Homo sapiens
gggctgaggtgggagg

SEQ ID NO: 3491554 - DNA, 20 bp, Homo sapiens
gggctgcatgatgtttgccc

SEQ ID NO: 3491555 - DNA, 19 bp, Homo sapiens
gggctgcttcctcctggaa

SEQ ID NO: 3491556 - DNA, 19 bp, Homo sapiens
gggctggactgaggcctga

SEQ ID NO: 3491557 - DNA, 14 bp, Homo sapiens
gggctggaggccca

SEQ ID NO: 3491558 - DNA, 19 bp, Homo sapiens
gggctggaggcccaggctg

SEQ ID NO: 3491559 - DNA, 11 bp, Homo sapiens
gggctggctgg

SEQ ID NO: 3491560 - DNA, 14 bp, Homo sapiens
gggcttagagcagt

SEQ ID NO: 3491561 - DNA, 17 bp, Homo sapiens
gggcttcagggcaggtg

SEQ ID NO: 3491562 - DNA, 17 bp, Homo sapiens
gggcttcagtggcagct

SEQ ID NO: 3491563 - DNA, 19 bp, Homo sapiens
ggggaaaatcagcctgctc

SEQ ID NO: 3491564 - DNA, 21 bp, Homo sapiens
ggggaaaatcagcctgctcca

SEQ ID NO: 3491565 - DNA, 24 bp, Homo sapiens
ggggaaaatcagcctgctccagct

SEQ ID NO: 3491566 - DNA, 15 bp, Homo sapiens
ggggaaggagccagt

SEQ ID NO: 3491567 - DNA, 21 bp, Homo sapiens
ggggaaggagccagtttgccg

SEQ ID NO: 3491568 - DNA, 18 bp, Homo sapiens
ggggaatgtttgcctctg

SEQ ID NO: 3491569 - DNA, 20 bp, Homo sapiens
ggggacagctccttctgtcc

SEQ ID NO: 3491570 - DNA, 13 bp, Homo sapiens
ggggacagctgtg

SEQ ID NO: 3491571 - DNA, 16 bp, Homo sapiens
ggggacctaggctcct

SEQ ID NO: 3491572 - DNA, 17 bp, Homo sapiens
ggggacctaggctcctc

SEQ ID NO: 3491573 - DNA, 15 bp, Homo sapiens
ggggacgcaggcccc

SEQ ID NO: 3491574 - DNA, 21 bp, Homo sapiens
ggggacgcaggcccctctcct

SEQ ID NO: 3491575 - DNA, 22 bp, Homo sapiens
ggggacgcaggcccctctcctc

SEQ ID NO: 3491576 - DNA, 11 bp, Homo sapiens
ggggagaaagt

SEQ ID NO: 3491577 - DNA, 17 bp, Homo sapiens
ggggagactgggctgag

SEQ ID NO: 3491578 - DNA, 19 bp, Homo sapiens
ggggagcccactgtcctgg

SEQ ID NO: 3491579 - DNA, 14 bp, Homo sapiens
ggggagggtgacag

SEQ ID NO: 3491580 - DNA, 14 bp, Homo sapiens
ggggagtatgcaaa

SEQ ID NO: 3491581 - DNA, 16 bp, Homo sapiens
ggggagtctgaagcag

SEQ ID NO: 3491582 - DNA, 17 bp, Homo sapiens
ggggagttaagacctgg

SEQ ID NO: 3491583 - DNA, 17 bp, Homo sapiens
ggggatcacagcctctg

SEQ ID NO: 3491584 - DNA, 21 bp, Homo sapiens
ggggatccctcccccccatgc

SEQ ID NO: 3491585 - DNA, 23 bp, Homo sapiens
ggggatccctcccccccatgcac

SEQ ID NO: 3491586 - DNA, 18 bp, Homo sapiens
ggggatggagtgagccca

SEQ ID NO: 3491587 - DNA, 10 bp, Homo sapiens
ggggcaggca

SEQ ID NO: 3491588 - DNA, 14 bp, Homo sapiens
ggggcattgctgac

SEQ ID NO: 3491589 - DNA, 21 bp, Homo sapiens
ggggcattgctgactgtgtat

SEQ ID NO: 3491590 - DNA, 13 bp, Homo sapiens
ggggccagatcca

SEQ ID NO: 3491591 - DNA, 14 bp, Homo sapiens
ggggccagatccag

SEQ ID NO: 3491592 - DNA, 19 bp, Homo sapiens
ggggcccagggcaagctcc

SEQ ID NO: 3491593 - DNA, 22 bp, Homo sapiens
ggggccgctgccacccacctcc

SEQ ID NO: 3491594 - DNA, 22 bp, Homo sapiens
ggctgacttgtgttcatgtgga

SEQ ID NO: 3491595 - DNA, 14 bp, Homo sapiens
ggctgagaacactg

SEQ ID NO: 3491596 - DNA, 14 bp, Homo sapiens
ggctgaggctggca

SEQ ID NO: 3491597 - DNA, 16 bp, Homo sapiens
ggctgagggagcctgg

SEQ ID NO: 3491598 - DNA, 15 bp, Homo sapiens
ggctgagggcctgct

SEQ ID NO: 3491599 - DNA, 16 bp, Homo sapiens
ggctgagggtgccctt

SEQ ID NO: 3491600 - DNA, 18 bp, Homo sapiens
ggctgatgtcaatttctg

SEQ ID NO: 3491601 - DNA, 13 bp, Homo sapiens
ggctgcagggagt

SEQ ID NO: 3491602 - DNA, 22 bp, Homo sapiens
ggctgcccctaatctctgtagg

SEQ ID NO: 3491603 - DNA, 19 bp, Homo sapiens
ggctgccgagacagaccct

SEQ ID NO: 3491604 - DNA, 22 bp, Homo sapiens
ggctgccgagacagaccctctg

SEQ ID NO: 3491605 - DNA, 19 bp, Homo sapiens
ggctgcgacgcttgctctg

SEQ ID NO: 3491606 - DNA, 17 bp, Homo sapiens
ggctgcggcgtctgtct

SEQ ID NO: 3491607 - DNA, 16 bp, Homo sapiens
ggctgctgacctccac

SEQ ID NO: 3491608 - DNA, 14 bp, Homo sapiens
ggctgctgcccagg

SEQ ID NO: 3491609 - DNA, 13 bp, Homo sapiens
ggctgctggcctg

SEQ ID NO: 3491610 - DNA, 17 bp, Homo sapiens
ggctgcttcctcctgga

SEQ ID NO: 3491611 - DNA, 22 bp, Homo sapiens
ggctggaagatcctgcgggtgg

SEQ ID NO: 3491612 - DNA, 17 bp, Homo sapiens
ggctggaatgcagtggt

SEQ ID NO: 3491613 - DNA, 13 bp, Homo sapiens
ggctggactgagg

SEQ ID NO: 3491614 - DNA, 17 bp, Homo sapiens
ggctggactgaggcctg

SEQ ID NO: 3491615 - DNA, 13 bp, Homo sapiens
ggctggagtacag

SEQ ID NO: 3491616 - DNA, 16 bp, Homo sapiens
ggctggagtgaggaaa

SEQ ID NO: 3491617 - DNA, 14 bp, Homo sapiens
ggctggcacaggac

SEQ ID NO: 3491618 - DNA, 14 bp, Homo sapiens
ggctggcgtgcagt

SEQ ID NO: 3491619 - DNA, 16 bp, Homo sapiens
ggctggcgtgcagtgg

SEQ ID NO: 3491620 - DNA, 20 bp, Homo sapiens
ggctggcgtgcagtggtgcg

SEQ ID NO: 3491621 - DNA, 19 bp, Homo sapiens
ggctgggaactcacctggg

SEQ ID NO: 3491622 - DNA, 18 bp, Homo sapiens
ggctgggacgtggctcag

SEQ ID NO: 3491623 - DNA, 23 bp, Homo sapiens
ggctgggacgtggctcagccagc

SEQ ID NO: 3491624 - DNA, 18 bp, Homo sapiens
ggctgggaggagcccctg

SEQ ID NO: 3491625 - DNA, 23 bp, Homo sapiens
ggctgggaggagcccctggacat

SEQ ID NO: 3491626 - DNA, 17 bp, Homo sapiens
ggctgggcaaggaggcc

SEQ ID NO: 3491627 - DNA, 13 bp, Homo sapiens
ggctgggcttcag

SEQ ID NO: 3491628 - DNA, 18 bp, Homo sapiens
ggctgggcttcagtggca

SEQ ID NO: 3491629 - DNA, 21 bp, Homo sapiens
ggctggggaagtcctctgggt

SEQ ID NO: 3491630 - DNA, 18 bp, Homo sapiens
ggctgggggagagccgtg

SEQ ID NO: 3491631 - DNA, 17 bp, Homo sapiens
ggctgggggcctcagtg

SEQ ID NO: 3491632 - DNA, 20 bp, Homo sapiens
ggctggggtggcctgtgtgg

SEQ ID NO: 3491633 - DNA, 13 bp, Homo sapiens
ggctggtggccca

SEQ ID NO: 3491634 - DNA, 14 bp, Homo sapiens
ggctggtggcccag

SEQ ID NO: 3491635 - DNA, 20 bp, Homo sapiens
ggctgtatcccatgagcctc

SEQ ID NO: 3491636 - DNA, 22 bp, Homo sapiens
ggctgtatcccatgagcctcag

SEQ ID NO: 3491637 - DNA, 13 bp, Homo sapiens
ggctgtcggcgct

SEQ ID NO: 3491638 - DNA, 15 bp, Homo sapiens
ggctgtcggcgctgc

SEQ ID NO: 3491639 - DNA, 18 bp, Homo sapiens
ggctgtgctacctgagcc

SEQ ID NO: 3491640 - DNA, 20 bp, Homo sapiens
ggctgtgctccctggttctg

SEQ ID NO: 3491641 - DNA, 12 bp, Homo sapiens
ggctgtgctggg

SEQ ID NO: 3491642 - DNA, 16 bp, Homo sapiens
ggctgtgctgggagaa

SEQ ID NO: 3491643 - DNA, 18 bp, Homo sapiens
ggctgtgtttccatctca

SEQ ID NO: 3491644 - DNA, 18 bp, Homo sapiens
ggcttagctttgctctgc

SEQ ID NO: 3491645 - DNA, 16 bp, Homo sapiens
ggcttatccagctggt

SEQ ID NO: 3491646 - DNA, 20 bp, Homo sapiens
ggcttcacggaagagccttg

SEQ ID NO: 3491647 - DNA, 21 bp, Homo sapiens
ggcttcacggaagagccttgc

SEQ ID NO: 3491648 - DNA, 19 bp, Homo sapiens
ggcttcaggcaattctcct

SEQ ID NO: 3491649 - DNA, 18 bp, Homo sapiens
ggcttcagggcaggtggg

SEQ ID NO: 3491650 - DNA, 16 bp, Homo sapiens
ggcttcaggtccaggc

SEQ ID NO: 3491651 - DNA, 15 bp, Homo sapiens
ggcttcagtggcagc

SEQ ID NO: 3491652 - DNA, 16 bp, Homo sapiens
ggcttcatctctttag

SEQ ID NO: 3491653 - DNA, 18 bp, Homo sapiens
ggcttcatctctttagag

SEQ ID NO: 3491654 - DNA, 20 bp, Homo sapiens
ggcttcatctctttagagaa

SEQ ID NO: 3491655 - DNA, 17 bp, Homo sapiens
ggcttcccagtggctgc

SEQ ID NO: 3491656 - DNA, 22 bp, Homo sapiens
ggcttcccagtggctgctgccc

SEQ ID NO: 3491657 - DNA, 22 bp, Homo sapiens
ggcttcctcttccgggcagaaa

SEQ ID NO: 3491658 - DNA, 18 bp, Homo sapiens
ggcttctggccaggaagc

SEQ ID NO: 3491659 - DNA, 19 bp, Homo sapiens
ggcttctgtggggcccctc

SEQ ID NO: 3491660 - DNA, 21 bp, Homo sapiens
ggcttgagaaatatggacact

SEQ ID NO: 3491661 - DNA, 17 bp, Homo sapiens
ggcttgccccactctgc

SEQ ID NO: 3491662 - DNA, 15 bp, Homo sapiens
ggcttgcttatgtgt

SEQ ID NO: 3491663 - DNA, 15 bp, Homo sapiens
ggcttggatcctggg

SEQ ID NO: 3491664 - DNA, 17 bp, Homo sapiens
ggcttggcctatctcct

SEQ ID NO: 3491665 - DNA, 16 bp, Homo sapiens
ggcttgtcactagcag

SEQ ID NO: 3491666 - DNA, 21 bp, Homo sapiens
ggcttgtcactagcagctgca

SEQ ID NO: 3491667 - DNA, 20 bp, Homo sapiens
ggctttatcctctttagagt

SEQ ID NO: 3491668 - DNA, 20 bp, Homo sapiens
ggctttcgtccacagcttcc

SEQ ID NO: 3491669 - DNA, 12 bp, Homo sapiens
ggctttggattt

SEQ ID NO: 3491670 - DNA, 20 bp, Homo sapiens
ggctttttactattaacatg

SEQ ID NO: 3491671 - DNA, 22 bp, Homo sapiens
ggctttttactattaacatgat

SEQ ID NO: 3491672 - DNA, 15 bp, Homo sapiens
gggaaaaaaatgttg

SEQ ID NO: 3491673 - DNA, 13 bp, Homo sapiens
gggaaaagcagct

SEQ ID NO: 3491674 - DNA, 14 bp, Homo sapiens
gggaaacttggctc

SEQ ID NO: 3491675 - DNA, 17 bp, Homo sapiens
gggaaaggggacaagga

SEQ ID NO: 3491676 - DNA, 13 bp, Homo sapiens
gggaacagccact

SEQ ID NO: 3491677 - DNA, 13 bp, Homo sapiens
gggaacctgtgtc

SEQ ID NO: 3491678 - DNA, 14 bp, Homo sapiens
gggaacctgtgtcc

SEQ ID NO: 3491679 - DNA, 16 bp, Homo sapiens
gggaactcagatccag

SEQ ID NO: 3491680 - DNA, 20 bp, Homo sapiens
gggaagcttctgtctccagc

SEQ ID NO: 3491681 - DNA, 22 bp, Homo sapiens
gggaaggcatgacacacctggg

SEQ ID NO: 3491682 - DNA, 12 bp, Homo sapiens
gggaaggccagc

SEQ ID NO: 3491683 - DNA, 14 bp, Homo sapiens
gggaatcagaactc

SEQ ID NO: 3491684 - DNA, 15 bp, Homo sapiens
gggaatggcagctgc

SEQ ID NO: 3491685 - DNA, 22 bp, Homo sapiens
gggacaagtggactcagggcag

SEQ ID NO: 3491686 - DNA, 19 bp, Homo sapiens
gggacagaggccccagcct

SEQ ID NO: 3491687 - DNA, 21 bp, Homo sapiens
gggacagaggccccagcctcc

SEQ ID NO: 3491688 - DNA, 12 bp, Homo sapiens
gggacagctcct

SEQ ID NO: 3491689 - DNA, 21 bp, Homo sapiens
gggacagctccttctgtccta

SEQ ID NO: 3491690 - DNA, 22 bp, Homo sapiens
gggacagtaataagaatggaaa

SEQ ID NO: 3491691 - DNA, 18 bp, Homo sapiens
gggaccaaccctggggaa

SEQ ID NO: 3491692 - DNA, 21 bp, Homo sapiens
gggacccaatgtaggagctgc

SEQ ID NO: 3491693 - DNA, 19 bp, Homo sapiens
gggacccccgccccctgcc

SEQ ID NO: 3491694 - DNA, 21 bp, Homo sapiens
gggacccccgccccctgccct

SEQ ID NO: 3491695 - DNA, 14 bp, Homo sapiens
gggaccccttccca

SEQ ID NO: 3491696 - DNA, 16 bp, Homo sapiens
gggaccccttcccaca

SEQ ID NO: 3491697 - DNA, 14 bp, Homo sapiens
gggacctaggctcc

SEQ ID NO: 3491698 - DNA, 16 bp, Homo sapiens
gggacctaggctcctc

SEQ ID NO: 3491699 - DNA, 14 bp, Homo sapiens
gggacgcaggcccc

SEQ ID NO: 3491700 - DNA, 17 bp, Homo sapiens
gggacggtgcccaagcc

SEQ ID NO: 3491701 - DNA, 14 bp, Homo sapiens
gggacgtggctcag

SEQ ID NO: 3491702 - DNA, 20 bp, Homo sapiens
gggacgtggctcagccagca

SEQ ID NO: 3491703 - DNA, 17 bp, Homo sapiens
gggactcaatgcactga

SEQ ID NO: 3491704 - DNA, 12 bp, Homo sapiens
gggactccaggt

SEQ ID NO: 3491705 - DNA, 22 bp, Homo sapiens
gggactccaggtcttgaggaga

SEQ ID NO: 3491706 - DNA, 18 bp, Homo sapiens
gggactgaaaacctctcc

SEQ ID NO: 3491707 - DNA, 19 bp, Homo sapiens
gggactgaaaacctctcct

SEQ ID NO: 3491708 - DNA, 15 bp, Homo sapiens
gggactgaagccaaa

SEQ ID NO: 3491709 - DNA, 18 bp, Homo sapiens
gggactgaagccaaagtt

SEQ ID NO: 3491710 - DNA, 13 bp, Homo sapiens
gggacttgaagtt

SEQ ID NO: 3491711 - DNA, 18 bp, Homo sapiens
gggacttggaagctccgc

SEQ ID NO: 3491712 - DNA, 19 bp, Homo sapiens
gggagaaatacttgaactt

SEQ ID NO: 3491713 - DNA, 12 bp, Homo sapiens
gggagaagctcc

SEQ ID NO: 3491714 - DNA, 20 bp, Homo sapiens
gggagacagttgagagcggg

SEQ ID NO: 3491715 - DNA, 14 bp, Homo sapiens
gggagactgggctg

SEQ ID NO: 3491716 - DNA, 14 bp, Homo sapiens
gggagaggggacgc

SEQ ID NO: 3491717 - DNA, 19 bp, Homo sapiens
gggagaggggacgcaggcc

SEQ ID NO: 3491718 - DNA, 19 bp, Homo sapiens
gggagatggatcaatcaaa

SEQ ID NO: 3491719 - DNA, 21 bp, Homo sapiens
gggagcaggcggtgggcaccc

SEQ ID NO: 3491720 - DNA, 21 bp, Homo sapiens
gggagcccactgtcctgggcc

SEQ ID NO: 3491721 - DNA, 21 bp, Homo sapiens
gggagctccaactcagaaggg

SEQ ID NO: 3491722 - DNA, 21 bp, Homo sapiens
gggagctcttgacagaaagca

SEQ ID NO: 3491723 - DNA, 22 bp, Homo sapiens
gggaggatgttctgggacacag

SEQ ID NO: 3491724 - DNA, 21 bp, Homo sapiens
gggaggattgcttgagctcag

SEQ ID NO: 3491725 - DNA, 13 bp, Homo sapiens
gggaggcaaatgg

SEQ ID NO: 3491726 - DNA, 18 bp, Homo sapiens
gggaggccccactgggga

SEQ ID NO: 3491727 - DNA, 15 bp, Homo sapiens
gggaggctcaggtcc

SEQ ID NO: 3491728 - DNA, 21 bp, Homo sapiens
gggagggcggcaggggcctgg

SEQ ID NO: 3491729 - DNA, 15 bp, Homo sapiens
gggagggggatccga

SEQ ID NO: 3491730 - DNA, 13 bp, Homo sapiens
ggccccaggaagc

SEQ ID NO: 3491731 - DNA, 14 bp, Homo sapiens
ggccccaggaagcc

SEQ ID NO: 3491732 - DNA, 18 bp, Homo sapiens
ggcccccacttgcctctt

SEQ ID NO: 3491733 - DNA, 14 bp, Homo sapiens
ggcccccagcccag

SEQ ID NO: 3491734 - DNA, 18 bp, Homo sapiens
ggcccccagcccagggct

SEQ ID NO: 3491735 - DNA, 23 bp, Homo sapiens
ggcccccagcccagggctcctgc

SEQ ID NO: 3491736 - DNA, 15 bp, Homo sapiens
ggcccccatctcatg

SEQ ID NO: 3491737 - DNA, 16 bp, Homo sapiens
ggcccccctgccctgt

SEQ ID NO: 3491738 - DNA, 15 bp, Homo sapiens
ggccccgccgcctgg

SEQ ID NO: 3491739 - DNA, 18 bp, Homo sapiens
ggccccgccgcctggtac

SEQ ID NO: 3491740 - DNA, 13 bp, Homo sapiens
ggcccctctcctc

SEQ ID NO: 3491741 - DNA, 16 bp, Homo sapiens
ggcccctgccaccctg

SEQ ID NO: 3491742 - DNA, 13 bp, Homo sapiens
ggcccctgcccgg

SEQ ID NO: 3491743 - DNA, 16 bp, Homo sapiens
ggcccctgcccggctg

SEQ ID NO: 3491744 - DNA, 12 bp, Homo sapiens
ggcccctgccct

SEQ ID NO: 3491745 - DNA, 23 bp, Homo sapiens
ggcccctgctggttcagggttgg

SEQ ID NO: 3491746 - DNA, 19 bp, Homo sapiens
ggcccctgctgtctctctg

SEQ ID NO: 3491747 - DNA, 13 bp, Homo sapiens
ggcccctggcccc

SEQ ID NO: 3491748 - DNA, 23 bp, Homo sapiens
ggcccggagctgcccctctctgg

SEQ ID NO: 3491749 - DNA, 14 bp, Homo sapiens
ggcccggcagggcg

SEQ ID NO: 3491750 - DNA, 15 bp, Homo sapiens
ggcccggctccaggc

SEQ ID NO: 3491751 - DNA, 22 bp, Homo sapiens
ggccctccctgttccccagaga

SEQ ID NO: 3491752 - DNA, 19 bp, Homo sapiens
ggccctcgctgccagctct

SEQ ID NO: 3491753 - DNA, 21 bp, Homo sapiens
ggccctcgctgccagctctgt

SEQ ID NO: 3491754 - DNA, 14 bp, Homo sapiens
ggccctctctgctc

SEQ ID NO: 3491755 - DNA, 21 bp, Homo sapiens
ggccctctctgctctgcgtgt

SEQ ID NO: 3491756 - DNA, 19 bp, Homo sapiens
ggccctctggagtggccac

SEQ ID NO: 3491757 - DNA, 15 bp, Homo sapiens
ggccctgggctggaa

SEQ ID NO: 3491758 - DNA, 15 bp, Homo sapiens
ggccctggtcctggc

SEQ ID NO: 3491759 - DNA, 18 bp, Homo sapiens
ggccctggtcctggcctc

SEQ ID NO: 3491760 - DNA, 22 bp, Homo sapiens
ggccctgtagttaggcctggct

SEQ ID NO: 3491761 - DNA, 19 bp, Homo sapiens
ggccctgttctcctcccca

SEQ ID NO: 3491762 - DNA, 16 bp, Homo sapiens
ggccgagtccaagctg

SEQ ID NO: 3491763 - DNA, 15 bp, Homo sapiens
ggccgctgccaccca

SEQ ID NO: 3491764 - DNA, 22 bp, Homo sapiens
ggccgctgccacccacctccct

SEQ ID NO: 3491765 - DNA, 23 bp, Homo sapiens
ggccgctgccacccacctccctg

SEQ ID NO: 3491766 - DNA, 17 bp, Homo sapiens
ggccggcgagccctgtg

SEQ ID NO: 3491767 - DNA, 18 bp, Homo sapiens
ggccgtcccgcctgcaga

SEQ ID NO: 3491768 - DNA, 19 bp, Homo sapiens
ggccgttgatgttggctgg

SEQ ID NO: 3491769 - DNA, 16 bp, Homo sapiens
ggcctaggtgcagctc

SEQ ID NO: 3491770 - DNA, 16 bp, Homo sapiens
ggcctattgcttgggt

SEQ ID NO: 3491771 - DNA, 23 bp, Homo sapiens
ggcctattgcttgggtctctctc

SEQ ID NO: 3491772 - DNA, 23 bp, Homo sapiens
ggcctcaagtgattctcctgcct

SEQ ID NO: 3491773 - DNA, 12 bp, Homo sapiens
ggcctcacccac

SEQ ID NO: 3491774 - DNA, 13 bp, Homo sapiens
ggcctcagtgcca

SEQ ID NO: 3491775 - DNA, 17 bp, Homo sapiens
ggcctcatgtggctgga

SEQ ID NO: 3491776 - DNA, 20 bp, Homo sapiens
ggcctccagaactcactggg

SEQ ID NO: 3491777 - DNA, 13 bp, Homo sapiens
ggcctccatcctc

SEQ ID NO: 3491778 - DNA, 15 bp, Homo sapiens
ggcctccatcctcat

SEQ ID NO: 3491779 - DNA, 15 bp, Homo sapiens
ggcctcccctgccac

SEQ ID NO: 3491780 - DNA, 17 bp, Homo sapiens
ggcctcccctgccacca

SEQ ID NO: 3491781 - DNA, 19 bp, Homo sapiens
ggcctcccctgccaccagg

SEQ ID NO: 3491782 - DNA, 16 bp, Homo sapiens
ggcctctgtgccttct

SEQ ID NO: 3491783 - DNA, 21 bp, Homo sapiens
ggcctgaactcggacaagtga

SEQ ID NO: 3491784 - DNA, 23 bp, Homo sapiens
ggcctgaagagtcctctgaatga

SEQ ID NO: 3491785 - DNA, 17 bp, Homo sapiens
ggcctgaagccagctgc

SEQ ID NO: 3491786 - DNA, 22 bp, Homo sapiens
ggcctgaatcatgagcctgctg

SEQ ID NO: 3491787 - DNA, 21 bp, Homo sapiens
ggcctgacagtgtgggacagg

SEQ ID NO: 3491788 - DNA, 14 bp, Homo sapiens
ggcctgactgctca

SEQ ID NO: 3491789 - DNA, 15 bp, Homo sapiens
ggcctgactgctcag

SEQ ID NO: 3491790 - DNA, 18 bp, Homo sapiens
ggcctgagagtcagctct

SEQ ID NO: 3491791 - DNA, 20 bp, Homo sapiens
ggcctgagatttcatctgct

SEQ ID NO: 3491792 - DNA, 15 bp, Homo sapiens
ggcctgagcctcccg

SEQ ID NO: 3491793 - DNA, 18 bp, Homo sapiens
ggcctgagcgctcctgcc

SEQ ID NO: 3491794 - DNA, 18 bp, Homo sapiens
ggcctgagctgcttcact

SEQ ID NO: 3491795 - DNA, 18 bp, Homo sapiens
ggcctgcctccagggctg

SEQ ID NO: 3491796 - DNA, 20 bp, Homo sapiens
ggcctgcctccagggctgga

SEQ ID NO: 3491797 - DNA, 18 bp, Homo sapiens
ggcctgcgccagtcctgc

SEQ ID NO: 3491798 - DNA, 14 bp, Homo sapiens
ggcctgctccagac

SEQ ID NO: 3491799 - DNA, 18 bp, Homo sapiens
ggcctgctccagacctga

SEQ ID NO: 3491800 - DNA, 20 bp, Homo sapiens
ggcctgctggaggcctcagg

SEQ ID NO: 3491801 - DNA, 15 bp, Homo sapiens
ggcctggagatcctc

SEQ ID NO: 3491802 - DNA, 18 bp, Homo sapiens
ggcctggagatcctcctg

SEQ ID NO: 3491803 - DNA, 19 bp, Homo sapiens
ggcctggagatcctcctgc

SEQ ID NO: 3491804 - DNA, 14 bp, Homo sapiens
ggcctggcagctca

SEQ ID NO: 3491805 - DNA, 16 bp, Homo sapiens
ggcctggccagatgca

SEQ ID NO: 3491806 - DNA, 21 bp, Homo sapiens
ggcctggccagatgcaccagc

SEQ ID NO: 3491807 - DNA, 20 bp, Homo sapiens
ggcctggctcattctgcacc

SEQ ID NO: 3491808 - DNA, 21 bp, Homo sapiens
ggcctgggccgtatctccggc

SEQ ID NO: 3491809 - DNA, 18 bp, Homo sapiens
ggcctggggtaccaagag

SEQ ID NO: 3491810 - DNA, 14 bp, Homo sapiens
ggcctgtctgtgac

SEQ ID NO: 3491811 - DNA, 21 bp, Homo sapiens
ggccttatcgggctccagcca

SEQ ID NO: 3491812 - DNA, 22 bp, Homo sapiens
ggccttatcgggctccagccat

SEQ ID NO: 3491813 - DNA, 22 bp, Homo sapiens
ggccttcccgccggaggccagc

SEQ ID NO: 3491814 - DNA, 23 bp, Homo sapiens
ggccttctcccctcttctgagct

SEQ ID NO: 3491815 - DNA, 17 bp, Homo sapiens
ggccttgatgactgcct

SEQ ID NO: 3491816 - DNA, 14 bp, Homo sapiens
ggcctttaaaattt

SEQ ID NO: 3491817 - DNA, 13 bp, Homo sapiens
ggcctttggcttc

SEQ ID NO: 3491818 - DNA, 18 bp, Homo sapiens
ggcgacagttttccttct

SEQ ID NO: 3491819 - DNA, 22 bp, Homo sapiens
ggcgagagtctggccctagact

SEQ ID NO: 3491820 - DNA, 17 bp, Homo sapiens
ggcgatccacctgtctc

SEQ ID NO: 3491821 - DNA, 19 bp, Homo sapiens
ggcgccgcaaaccacactg

SEQ ID NO: 3491822 - DNA, 20 bp, Homo sapiens
ggcgccgcaaaccacactgg

SEQ ID NO: 3491823 - DNA, 13 bp, Homo sapiens
ggcggagccggcc

SEQ ID NO: 3491824 - DNA, 13 bp, Homo sapiens
ggcggagctggcc

SEQ ID NO: 3491825 - DNA, 14 bp, Homo sapiens
ggcggagctggccc

SEQ ID NO: 3491826 - DNA, 17 bp, Homo sapiens
ggcggcaggggcctgga

SEQ ID NO: 3491827 - DNA, 16 bp, Homo sapiens
ggcggcgggcggctgg

SEQ ID NO: 3491828 - DNA, 18 bp, Homo sapiens
ggcggctcggaggaagcc

SEQ ID NO: 3491829 - DNA, 22 bp, Homo sapiens
ggcgggtgcctgtaatcccagc

SEQ ID NO: 3491830 - DNA, 14 bp, Homo sapiens
ggcggtggacttga

SEQ ID NO: 3491831 - DNA, 21 bp, Homo sapiens
ggcggtgggcacccaccctgg

SEQ ID NO: 3491832 - DNA, 22 bp, Homo sapiens
ggcggtgggcacccaccctggg

SEQ ID NO: 3491833 - DNA, 19 bp, Homo sapiens
ggctaaggcgtggagctgc

SEQ ID NO: 3491834 - DNA, 22 bp, Homo sapiens
ggctaaggcgtggagctgcctg

SEQ ID NO: 3491835 - DNA, 19 bp, Homo sapiens
ggctcaagcgattctcctg

SEQ ID NO: 3491836 - DNA, 15 bp, Homo sapiens
ggctcacactgagaa

SEQ ID NO: 3491837 - DNA, 16 bp, Homo sapiens
ggctcactgcagcctc

SEQ ID NO: 3491838 - DNA, 18 bp, Homo sapiens
ggctcagtgcaacctctg

SEQ ID NO: 3491839 - DNA, 17 bp, Homo sapiens
ggctcatggccctgtag

SEQ ID NO: 3491840 - DNA, 19 bp, Homo sapiens
ggctccagatgcagggcag

SEQ ID NO: 3491841 - DNA, 15 bp, Homo sapiens
ggctcccagcctcag

SEQ ID NO: 3491842 - DNA, 18 bp, Homo sapiens
ggctccctgactgggagt

SEQ ID NO: 3491843 - DNA, 12 bp, Homo sapiens
ggctccttcacc

SEQ ID NO: 3491844 - DNA, 17 bp, Homo sapiens
ggctcgaatctctgtgc

SEQ ID NO: 3491845 - DNA, 19 bp, Homo sapiens
ggctcgattttgtatctgc

SEQ ID NO: 3491846 - DNA, 16 bp, Homo sapiens
ggctcgccaaggccta

SEQ ID NO: 3491847 - DNA, 17 bp, Homo sapiens
ggctcgccaaggcctag

SEQ ID NO: 3491848 - DNA, 14 bp, Homo sapiens
ggctcgtttggatc

SEQ ID NO: 3491849 - DNA, 12 bp, Homo sapiens
ggctctctgagt

SEQ ID NO: 3491850 - DNA, 20 bp, Homo sapiens
ggctctctgagtcctggccc

SEQ ID NO: 3491851 - DNA, 13 bp, Homo sapiens
ggctctggccaag

SEQ ID NO: 3491852 - DNA, 12 bp, Homo sapiens
ggctctggctct

SEQ ID NO: 3491853 - DNA, 19 bp, Homo sapiens
ggctctgggccgggcctgg

SEQ ID NO: 3491854 - DNA, 22 bp, Homo sapiens
ggctctgtgggtgatggggagg

SEQ ID NO: 3491855 - DNA, 13 bp, Homo sapiens
ggctcttctcatt

SEQ ID NO: 3491856 - DNA, 16 bp, Homo sapiens
ggctgaaattctcctg

SEQ ID NO: 3491857 - DNA, 17 bp, Homo sapiens
ggctgaaattctcctgg

SEQ ID NO: 3491858 - DNA, 18 bp, Homo sapiens
ggctgaaattctcctgga

SEQ ID NO: 3491859 - DNA, 16 bp, Homo sapiens
ggctgaatagcagaag

SEQ ID NO: 3491860 - DNA, 17 bp, Homo sapiens
ggctgaccacagcacag

SEQ ID NO: 3491861 - DNA, 19 bp, Homo sapiens
ggctgaccacagcacagcc

SEQ ID NO: 3491862 - DNA, 15 bp, Homo sapiens
ggctgacgtgtgagg

SEQ ID NO: 3491863 - DNA, 23 bp, Homo sapiens
ggctgacgtgtgagggaggacag

SEQ ID NO: 3491864 - DNA, 20 bp, Homo sapiens
ggctgactggatgtccagag

SEQ ID NO: 3491865 - DNA, 22 bp, Homo sapiens
ggctgactggatgtccagagct

SEQ ID NO: 3491866 - DNA, 20 bp, Homo sapiens
ggtcggtaggttcagccaag

SEQ ID NO: 3491867 - DNA, 13 bp, Homo sapiens
ggtctaaagtgtt

SEQ ID NO: 3491868 - DNA, 21 bp, Homo sapiens
ggtctcgctttgttgcccagg

SEQ ID NO: 3491869 - DNA, 15 bp, Homo sapiens
ggtctctaggctggg

SEQ ID NO: 3491870 - DNA, 19 bp, Homo sapiens
ggtctctgttgactggctg

SEQ ID NO: 3491871 - DNA, 17 bp, Homo sapiens
ggtctgagtctatgttc

SEQ ID NO: 3491872 - DNA, 23 bp, Homo sapiens
ggtctgcaggcagggctgactct

SEQ ID NO: 3491873 - DNA, 15 bp, Homo sapiens
ggtctgcctccagcc

SEQ ID NO: 3491874 - DNA, 15 bp, Homo sapiens
ggtctggcagcctcc

SEQ ID NO: 3491875 - DNA, 21 bp, Homo sapiens
ggtctgggaggaatggacaga

SEQ ID NO: 3491876 - DNA, 16 bp, Homo sapiens
ggtctgtgcatttctg

SEQ ID NO: 3491877 - DNA, 16 bp, Homo sapiens
ggtctgttggcaggct

SEQ ID NO: 3491878 - DNA, 18 bp, Homo sapiens
ggtctgttggcaggctgg

SEQ ID NO: 3491879 - DNA, 19 bp, Homo sapiens
ggtctgttggcaggctggc

SEQ ID NO: 3491880 - DNA, 21 bp, Homo sapiens
ggtcttgaactcctggcctca

SEQ ID NO: 3491881 - DNA, 20 bp, Homo sapiens
ggtctttcagtactttttta

SEQ ID NO: 3491882 - DNA, 19 bp, Homo sapiens
ggtctttcctaaggctgca

SEQ ID NO: 3491883 - DNA, 15 bp, Homo sapiens
ggtctttgtaagaac

SEQ ID NO: 3491884 - DNA, 15 bp, Homo sapiens
ggtgaaatgaagcaa

SEQ ID NO: 3491885 - DNA, 14 bp, Homo sapiens
ggtgaattttcaag

SEQ ID NO: 3491886 - DNA, 19 bp, Homo sapiens
ggtgaattttcaaggcctt

SEQ ID NO: 3491887 - DNA, 16 bp, Homo sapiens
ggtgacctctgcctga

SEQ ID NO: 3491888 - DNA, 21 bp, Homo sapiens
ggtgacctctgcctgaagtca

SEQ ID NO: 3491889 - DNA, 12 bp, Homo sapiens
ggtgactctgtc

SEQ ID NO: 3491890 - DNA, 13 bp, Homo sapiens
ggtgactctgtcc

SEQ ID NO: 3491891 - DNA, 19 bp, Homo sapiens
ggtgacttcacagtgaagt

SEQ ID NO: 3491892 - DNA, 21 bp, Homo sapiens
ggtgagaattgggcggctctg

SEQ ID NO: 3491893 - DNA, 20 bp, Homo sapiens
ggtgagcggatcacaaggtc

SEQ ID NO: 3491894 - DNA, 18 bp, Homo sapiens
ggtgatccacccacctca

SEQ ID NO: 3491895 - DNA, 13 bp, Homo sapiens
ggtgcaaggaaaa

SEQ ID NO: 3491896 - DNA, 15 bp, Homo sapiens
ggtgcagctcctcag

SEQ ID NO: 3491897 - DNA, 14 bp, Homo sapiens
ggtgcccaagccag

SEQ ID NO: 3491898 - DNA, 22 bp, Homo sapiens
ggtgcccaagccagaggctggg

SEQ ID NO: 3491899 - DNA, 17 bp, Homo sapiens
ggtgccccaggaccagc

SEQ ID NO: 3491900 - DNA, 19 bp, Homo sapiens
ggtgcctgccatagccagg

SEQ ID NO: 3491901 - DNA, 20 bp, Homo sapiens
ggtgccttcttcagggcctg

SEQ ID NO: 3491902 - DNA, 12 bp, Homo sapiens
ggtgctaaatct

SEQ ID NO: 3491903 - DNA, 15 bp, Homo sapiens
ggtgctacgcctgca

SEQ ID NO: 3491904 - DNA, 17 bp, Homo sapiens
ggtgctgcctctacctg

SEQ ID NO: 3491905 - DNA, 13 bp, Homo sapiens
ggtgctggtcccg

SEQ ID NO: 3491906 - DNA, 19 bp, Homo sapiens
ggtgctgtcctcaggtggc

SEQ ID NO: 3491907 - DNA, 19 bp, Homo sapiens
ggtggaacatatggtctcc

SEQ ID NO: 3491908 - DNA, 21 bp, Homo sapiens
ggtggacttgaactttcctgg

SEQ ID NO: 3491909 - DNA, 10 bp, Homo sapiens
ggtggaggat

SEQ ID NO: 3491910 - DNA, 13 bp, Homo sapiens
ggtggatgcctgg

SEQ ID NO: 3491911 - DNA, 14 bp, Homo sapiens
ggtggatgcctggt

SEQ ID NO: 3491912 - DNA, 22 bp, Homo sapiens
ggtggatggccccagcacagct

SEQ ID NO: 3491913 - DNA, 13 bp, Homo sapiens
ggtggcagctgcg

SEQ ID NO: 3491914 - DNA, 18 bp, Homo sapiens
ggtggcagtggaggtggg

SEQ ID NO: 3491915 - DNA, 20 bp, Homo sapiens
ggtggccgctgagtggcagg

SEQ ID NO: 3491916 - DNA, 21 bp, Homo sapiens
ggtggctagtcaagctcctcc

SEQ ID NO: 3491917 - DNA, 11 bp, Homo sapiens
ggtggctgggc

SEQ ID NO: 3491918 - DNA, 18 bp, Homo sapiens
ggtggctgggttggaggg

SEQ ID NO: 3491919 - DNA, 16 bp, Homo sapiens
ggtgggaatcagatct

SEQ ID NO: 3491920 - DNA, 18 bp, Homo sapiens
ggtgggcacccaccctgg

SEQ ID NO: 3491921 - DNA, 12 bp, Homo sapiens
ggtgggccaggc

SEQ ID NO: 3491922 - DNA, 20 bp, Homo sapiens
ggtgggcttcccagtggctg

SEQ ID NO: 3491923 - DNA, 17 bp, Homo sapiens
ggtggggcagcttgagg

SEQ ID NO: 3491924 - DNA, 23 bp, Homo sapiens
ggtggggtcatgccctcctctcc

SEQ ID NO: 3491925 - DNA, 14 bp, Homo sapiens
ggtgggtccatggg

SEQ ID NO: 3491926 - DNA, 22 bp, Homo sapiens
ggtggtctgttggcaggctggc

SEQ ID NO: 3491927 - DNA, 14 bp, Homo sapiens
ggtggtggcctggt

SEQ ID NO: 3491928 - DNA, 23 bp, Homo sapiens
ggtgtagctcttagaggaaggag

SEQ ID NO: 3491929 - DNA, 20 bp, Homo sapiens
ggtgtcctgcctgtctgccc

SEQ ID NO: 3491930 - DNA, 23 bp, Homo sapiens
ggtgtctccaaccccccagcact

SEQ ID NO: 3491931 - DNA, 15 bp, Homo sapiens
ggtgtgatcgtctga

SEQ ID NO: 3491932 - DNA, 18 bp, Homo sapiens
ggtgtgatcgtctgactg

SEQ ID NO: 3491933 - DNA, 23 bp, Homo sapiens
ggtgtgcacatctctgcttgagt

SEQ ID NO: 3491934 - DNA, 16 bp, Homo sapiens
ggtgtgcaccagggtt

SEQ ID NO: 3491935 - DNA, 17 bp, Homo sapiens
ggtgtgcaccagggttg

SEQ ID NO: 3491936 - DNA, 18 bp, Homo sapiens
ggtgtgccttccagatcc

SEQ ID NO: 3491937 - DNA, 13 bp, Homo sapiens
ggtgtgctctgat

SEQ ID NO: 3491938 - DNA, 12 bp, Homo sapiens
ggtgtggagaag

SEQ ID NO: 3491939 - DNA, 23 bp, Homo sapiens
ggtgtggagaagcggctggcagc

SEQ ID NO: 3491940 - DNA, 15 bp, Homo sapiens
ggtgtgggtgtcctg

SEQ ID NO: 3491941 - DNA, 23 bp, Homo sapiens
ggtgtgtccccctctgtccaggc

SEQ ID NO: 3491942 - DNA, 21 bp, Homo sapiens
ggtgttatcaccgtgggctcc

SEQ ID NO: 3491943 - DNA, 16 bp, Homo sapiens
ggtgttttatttccta

SEQ ID NO: 3491944 - DNA, 20 bp, Homo sapiens
ggttaaaaaaatggcagtga

SEQ ID NO: 3491945 - DNA, 13 bp, Homo sapiens
ggttaaggcctga

SEQ ID NO: 3491946 - DNA, 21 bp, Homo sapiens
ggttacccagttagctctcaa

SEQ ID NO: 3491947 - DNA, 13 bp, Homo sapiens
ggttatggagagg

SEQ ID NO: 3491948 - DNA, 20 bp, Homo sapiens
ggttatttagggaactgctt

SEQ ID NO: 3491949 - DNA, 21 bp, Homo sapiens
ggttcagggttggcccctgcc

SEQ ID NO: 3491950 - DNA, 16 bp, Homo sapiens
ggttcccttcctattc

SEQ ID NO: 3491951 - DNA, 21 bp, Homo sapiens
ggttccgcttggagcagaggg

SEQ ID NO: 3491952 - DNA, 20 bp, Homo sapiens
ggttcggatttggggtggat

SEQ ID NO: 3491953 - DNA, 18 bp, Homo sapiens
ggttctaggcatctctgt

SEQ ID NO: 3491954 - DNA, 23 bp, Homo sapiens
ggttctaggcatctctgtacttt

SEQ ID NO: 3491955 - DNA, 16 bp, Homo sapiens
ggttctgcctgctttg

SEQ ID NO: 3491956 - DNA, 13 bp, Homo sapiens
ggttcttcccttt

SEQ ID NO: 3491957 - DNA, 22 bp, Homo sapiens
ggttcttgagccagccaggccc

SEQ ID NO: 3491958 - DNA, 16 bp, Homo sapiens
ggttgaactctggtgg

SEQ ID NO: 3491959 - DNA, 15 bp, Homo sapiens
ggttgaccccagagg

SEQ ID NO: 3491960 - DNA, 19 bp, Homo sapiens
ggttgctgttttcctccct

SEQ ID NO: 3491961 - DNA, 20 bp, Homo sapiens
ggttgctgttttcctccctt

SEQ ID NO: 3491962 - DNA, 14 bp, Homo sapiens
ggttggagcccagg

SEQ ID NO: 3491963 - DNA, 21 bp, Homo sapiens
ggttggagcccagggcatctt

SEQ ID NO: 3491964 - DNA, 18 bp, Homo sapiens
ggttggcaaaaaggcagg

SEQ ID NO: 3491965 - DNA, 21 bp, Homo sapiens
ggtttacaatttacaaagtgt

SEQ ID NO: 3491966 - DNA, 17 bp, Homo sapiens
ggtttacctagagaaca

SEQ ID NO: 3491967 - DNA, 17 bp, Homo sapiens
ggtttaggctggtggcc

SEQ ID NO: 3491968 - DNA, 20 bp, Homo sapiens
ggtttaggctggtggcccag

SEQ ID NO: 3491969 - DNA, 19 bp, Homo sapiens
ggtttccttaaaattttta

SEQ ID NO: 3491970 - DNA, 20 bp, Homo sapiens
ggtttctcagaatccaaaga

SEQ ID NO: 3491971 - DNA, 23 bp, Homo sapiens
ggtttggccatctctggatgcct

SEQ ID NO: 3491972 - DNA, 15 bp, Homo sapiens
ggtttggctgtgtct

SEQ ID NO: 3491973 - DNA, 14 bp, Homo sapiens
ggtttgtgttcttc

SEQ ID NO: 3491974 - DNA, 17 bp, Homo sapiens
ggtttgtttttcaaagc

SEQ ID NO: 3491975 - DNA, 14 bp, Homo sapiens
ggttttacatttta

SEQ ID NO: 3491976 - DNA, 16 bp, Homo sapiens
ggttttaggatactta

SEQ ID NO: 3491977 - DNA, 15 bp, Homo sapiens
ggttttatattttta

SEQ ID NO: 3491978 - DNA, 17 bp, Homo sapiens
ggttttgtattctctga

SEQ ID NO: 3491979 - DNA, 19 bp, Homo sapiens
ggtttttacttaactgttt

SEQ ID NO: 3491980 - DNA, 15 bp, Homo sapiens
ggtttttagagaatg

SEQ ID NO: 3491981 - DNA, 15 bp, Homo sapiens
gtaaaaaattcacat

SEQ ID NO: 3491982 - DNA, 22 bp, Homo sapiens
gtaaaaggccaaacctctgttc

SEQ ID NO: 3491983 - DNA, 14 bp, Homo sapiens
gtaaaataaaatta

SEQ ID NO: 3491984 - DNA, 15 bp, Homo sapiens
gtaaaatctttcttt

SEQ ID NO: 3491985 - DNA, 21 bp, Homo sapiens
gtaaaatctttctttcttaga

SEQ ID NO: 3491986 - DNA, 16 bp, Homo sapiens
gtaaaattgccatatt

SEQ ID NO: 3491987 - DNA, 22 bp, Homo sapiens
gtaaacacgcctgcaaacgctg

SEQ ID NO: 3491988 - DNA, 16 bp, Homo sapiens
gtaaacataccaacat

SEQ ID NO: 3491989 - DNA, 19 bp, Homo sapiens
gtaaacataccaacatgtt

SEQ ID NO: 3491990 - DNA, 16 bp, Homo sapiens
gtaaacgctgtcccta

SEQ ID NO: 3491991 - DNA, 17 bp, Homo sapiens
gtaaagaactttttctt

SEQ ID NO: 3491992 - DNA, 20 bp, Homo sapiens
gtaaagctgttcaaacccag

SEQ ID NO: 3491993 - DNA, 20 bp, Homo sapiens
gtaaagggcgcaaagggcat

SEQ ID NO: 3491994 - DNA, 18 bp, Homo sapiens
gtaaagttggttggataa

SEQ ID NO: 3491995 - DNA, 13 bp, Homo sapiens
gtaaataaaaaga

SEQ ID NO: 3491996 - DNA, 13 bp, Homo sapiens
gtaaataaagccc

SEQ ID NO: 3491997 - DNA, 20 bp, Homo sapiens
gtaaataggatttttagaat

SEQ ID NO: 3491998 - DNA, 17 bp, Homo sapiens
gtaaataggttcttctt

SEQ ID NO: 3491999 - DNA, 19 bp, Homo sapiens
gtaaatatataaatatata

SEQ ID NO: 3492000 - DNA, 17 bp, Homo sapiens
gtaaatgcagcgtgaag

SEQ ID NO: 3492001 - DNA, 22 bp, Homo sapiens
gtaaatggcttatccagctggt

SEQ ID NO: 3492002 - DNA, 16 bp, Homo sapiens
gtaacactttacaatg

SEQ ID NO: 3492003 - DNA, 23 bp, Homo sapiens
gtaacatagctgaggtaaaaact

SEQ ID NO: 3492004 - DNA, 23 bp, Homo sapiens
gtaacatgatgttaactttgtgg

SEQ ID NO: 3492005 - DNA, 23 bp, Homo sapiens
gtaacccagattttgctgtatat

SEQ ID NO: 3492006 - DNA, 18 bp, Homo sapiens
gtaactatttcttcagag

SEQ ID NO: 3492007 - DNA, 13 bp, Homo sapiens
gtaactctttctt

SEQ ID NO: 3492008 - DNA, 13 bp, Homo sapiens
gtaactgacaact

SEQ ID NO: 3492009 - DNA, 13 bp, Homo sapiens
gtaactgttcttg

SEQ ID NO: 3492010 - DNA, 20 bp, Homo sapiens
gtaacttcttatggaattga

SEQ ID NO: 3492011 - DNA, 20 bp, Homo sapiens
gtaactttttacattacaga

SEQ ID NO: 3492012 - DNA, 20 bp, Homo sapiens
gtaagaaacctactgcccag

SEQ ID NO: 3492013 - DNA, 13 bp, Homo sapiens
gtaagcctcatca

SEQ ID NO: 3492014 - DNA, 13 bp, Homo sapiens
gtaaggccttagc

SEQ ID NO: 3492015 - DNA, 14 bp, Homo sapiens
gtaataacatttaa

SEQ ID NO: 3492016 - DNA, 16 bp, Homo sapiens
gtaataacatttaatt

SEQ ID NO: 3492017 - DNA, 20 bp, Homo sapiens
gtaataagaatggaaaagag

SEQ ID NO: 3492018 - DNA, 12 bp, Homo sapiens
gtaatatgaaat

SEQ ID NO: 3492019 - DNA, 20 bp, Homo sapiens
gtaatcccagcactttggga

SEQ ID NO: 3492020 - DNA, 20 bp, Homo sapiens
gtaatcccagctacttggga

SEQ ID NO: 3492021 - DNA, 20 bp, Homo sapiens
gtaatgagtttaaaaatcaa

SEQ ID NO: 3492022 - DNA, 13 bp, Homo sapiens
gtaatgtgaatct

SEQ ID NO: 3492023 - DNA, 23 bp, Homo sapiens
gtaattagtaacatgtgttaagt

SEQ ID NO: 3492024 - DNA, 17 bp, Homo sapiens
gtaatttagattgtaaa

SEQ ID NO: 3492025 - DNA, 18 bp, Homo sapiens
gtaatttagattgtaaac

SEQ ID NO: 3492026 - DNA, 13 bp, Homo sapiens
gtaatttcctaga

SEQ ID NO: 3492027 - DNA, 21 bp, Homo sapiens
gtaatttctttttttcctttt

SEQ ID NO: 3492028 - DNA, 15 bp, Homo sapiens
gtaatttgtaaaatg

SEQ ID NO: 3492029 - DNA, 21 bp, Homo sapiens
gtaattttgttctagttttca

SEQ ID NO: 3492030 - DNA, 18 bp, Homo sapiens
gtacaaactaaggtgcta

SEQ ID NO: 3492031 - DNA, 22 bp, Homo sapiens
gtacaataagtgtttttgtatt

SEQ ID NO: 3492032 - DNA, 12 bp, Homo sapiens
gtacaatcatgt

SEQ ID NO: 3492033 - DNA, 16 bp, Homo sapiens
gtacacacacatacac

SEQ ID NO: 3492034 - DNA, 13 bp, Homo sapiens
gtacacagagaag

SEQ ID NO: 3492035 - DNA, 17 bp, Homo sapiens
gtacagaatatttctat

SEQ ID NO: 3492036 - DNA, 23 bp, Homo sapiens
gtacagacagagaatatgtctgc

SEQ ID NO: 3492037 - DNA, 12 bp, Homo sapiens
gtacagcccaga

SEQ ID NO: 3492038 - DNA, 12 bp, Homo sapiens
gtacaggcagca

SEQ ID NO: 3492039 - DNA, 19 bp, Homo sapiens
gtacagtcttgcagcagga

SEQ ID NO: 3492040 - DNA, 14 bp, Homo sapiens
gtacagttttattt

SEQ ID NO: 3492041 - DNA, 20 bp, Homo sapiens
gtacatctattttggattgt

SEQ ID NO: 3492042 - DNA, 20 bp, Homo sapiens
gtacatgaaatttttgtaaa

SEQ ID NO: 3492043 - DNA, 21 bp, Homo sapiens
gtacatttttcaactttgaat

SEQ ID NO: 3492044 - DNA, 22 bp, Homo sapiens
gtacatttttcaactttgaata

SEQ ID NO: 3492045 - DNA, 21 bp, Homo sapiens
gtaccaagaatcttggtttgc

SEQ ID NO: 3492046 - DNA, 17 bp, Homo sapiens
gtaccagatgcagctca

SEQ ID NO: 3492047 - DNA, 15 bp, Homo sapiens
gtaccagtgaatttt

SEQ ID NO: 3492048 - DNA, 19 bp, Homo sapiens
gtaccagtgaatttttgca

SEQ ID NO: 3492049 - DNA, 22 bp, Homo sapiens
gtacccaatagctgcccatttc

SEQ ID NO: 3492050 - DNA, 12 bp, Homo sapiens
gtacccactgct

SEQ ID NO: 3492051 - DNA, 13 bp, Homo sapiens
gtacccactgctc

SEQ ID NO: 3492052 - DNA, 16 bp, Homo sapiens
gtacccactgctctgg

SEQ ID NO: 3492053 - DNA, 14 bp, Homo sapiens
gtacctatggctgc

SEQ ID NO: 3492054 - DNA, 13 bp, Homo sapiens
gtacctcctctca

SEQ ID NO: 3492055 - DNA, 18 bp, Homo sapiens
gtacctcctctcagtgtt

SEQ ID NO: 3492056 - DNA, 22 bp, Homo sapiens
gtaccttttttgttttttcaaa

SEQ ID NO: 3492057 - DNA, 23 bp, Homo sapiens
gtaccttttttgttttttcaaaa

SEQ ID NO: 3492058 - DNA, 13 bp, Homo sapiens
gtactaaagccaa

SEQ ID NO: 3492059 - DNA, 15 bp, Homo sapiens
gtactagtgttctgt

SEQ ID NO: 3492060 - DNA, 15 bp, Homo sapiens
gtactgtatgtgatg

SEQ ID NO: 3492061 - DNA, 22 bp, Homo sapiens
gtactgtgggcaatttagaaaa

SEQ ID NO: 3492062 - DNA, 23 bp, Homo sapiens
gtacttacccggagaaggccgct

SEQ ID NO: 3492063 - DNA, 20 bp, Homo sapiens
gtacttcccgggccagggct

SEQ ID NO: 3492064 - DNA, 19 bp, Homo sapiens
gtacttctccaccctgctc

SEQ ID NO: 3492065 - DNA, 20 bp, Homo sapiens
gtacttctccaccctgctct

SEQ ID NO: 3492066 - DNA, 23 bp, Homo sapiens
gtacttgaagtctaaaagcagaa

SEQ ID NO: 3492067 - DNA, 16 bp, Homo sapiens
gtacttgtggacacag

SEQ ID NO: 3492068 - DNA, 20 bp, Homo sapiens
gtacttgtggacacagctct

SEQ ID NO: 3492069 - DNA, 14 bp, Homo sapiens
gtactttggaggcc

SEQ ID NO: 3492070 - DNA, 22 bp, Homo sapiens
gtacttttcattctcttttaat

SEQ ID NO: 3492071 - DNA, 21 bp, Homo sapiens
gtacttttcccatttgtaatt

SEQ ID NO: 3492072 - DNA, 14 bp, Homo sapiens
gtactttttgtgaa

SEQ ID NO: 3492073 - DNA, 20 bp, Homo sapiens
gtacttttttaaatattttc

SEQ ID NO: 3492074 - DNA, 21 bp, Homo sapiens
gtacttttttaaatattttct

SEQ ID NO: 3492075 - DNA, 12 bp, Homo sapiens
gtagaaaaacat

SEQ ID NO: 3492076 - DNA, 15 bp, Homo sapiens
gtagaaactgcaggg

SEQ ID NO: 3492077 - DNA, 21 bp, Homo sapiens
gtagaaaggcctttaaaattt

SEQ ID NO: 3492078 - DNA, 17 bp, Homo sapiens
gtagaaataatatgcat

SEQ ID NO: 3492079 - DNA, 22 bp, Homo sapiens
gtagaaatggttgtattagatg

SEQ ID NO: 3492080 - DNA, 19 bp, Homo sapiens
gtagaccttgttacttctg

SEQ ID NO: 3492081 - DNA, 12 bp, Homo sapiens
gtagagacaggg

SEQ ID NO: 3492082 - DNA, 10 bp, Homo sapiens
gtagagccag

SEQ ID NO: 3492083 - DNA, 15 bp, Homo sapiens
gtagagccagggtct

SEQ ID NO: 3492084 - DNA, 11 bp, Homo sapiens
gtagagctggg

SEQ ID NO: 3492085 - DNA, 15 bp, Homo sapiens
gtagagtgtgcctga

SEQ ID NO: 3492086 - DNA, 22 bp, Homo sapiens
gtagatattggacaaagaacct

SEQ ID NO: 3492087 - DNA, 15 bp, Homo sapiens
gtagatgcgcagccc

SEQ ID NO: 3492088 - DNA, 22 bp, Homo sapiens
gtagcaaccatttgtaaaacat

SEQ ID NO: 3492089 - DNA, 15 bp, Homo sapiens
gtagcagtgtaccca

SEQ ID NO: 3492090 - DNA, 13 bp, Homo sapiens
gtagccacaccag

SEQ ID NO: 3492091 - DNA, 16 bp, Homo sapiens
gtagccacaccaggat

SEQ ID NO: 3492092 - DNA, 15 bp, Homo sapiens
gtagccagcacacag

SEQ ID NO: 3492093 - DNA, 16 bp, Homo sapiens
gtagccccctggcctc

SEQ ID NO: 3492094 - DNA, 23 bp, Homo sapiens
gtagccccctggcctctgtgcct

SEQ ID NO: 3492095 - DNA, 21 bp, Homo sapiens
gtagcctctcctgtatttaac

SEQ ID NO: 3492096 - DNA, 14 bp, Homo sapiens
gtagctagaggaac

SEQ ID NO: 3492097 - DNA, 14 bp, Homo sapiens
gtagctgaaatgca

SEQ ID NO: 3492098 - DNA, 15 bp, Homo sapiens
gtaggaaaaaaatag

SEQ ID NO: 3492099 - DNA, 15 bp, Homo sapiens
gtaggaagtaggaag

SEQ ID NO: 3492100 - DNA, 19 bp, Homo sapiens
gtaggaccaagcatcttgg

SEQ ID NO: 3492101 - DNA, 18 bp, Homo sapiens
gtaggacccaagcagaga

SEQ ID NO: 3492102 - DNA, 11 bp, Homo sapiens
gtaggcagaca

SEQ ID NO: 3492103 - DNA, 14 bp, Homo sapiens
gtaggcatttccta

SEQ ID NO: 3492104 - DNA, 16 bp, Homo sapiens
gtagggaattcttctg

SEQ ID NO: 3492105 - DNA, 13 bp, Homo sapiens
gtagggagggcgg

SEQ ID NO: 3492106 - DNA, 22 bp, Homo sapiens
gtagggcgggaggatgttctgg

SEQ ID NO: 3492107 - DNA, 22 bp, Homo sapiens
gtaggtactttttgtgaagacg

SEQ ID NO: 3492108 - DNA, 16 bp, Homo sapiens
gtaggtgaacagtcac

SEQ ID NO: 3492109 - DNA, 22 bp, Homo sapiens
gtagtcagaattagctgcttct

SEQ ID NO: 3492110 - DNA, 16 bp, Homo sapiens
gtagtccgtgctgaca

SEQ ID NO: 3492111 - DNA, 22 bp, Homo sapiens
gtagtcctcataaaaagcaaaa

SEQ ID NO: 3492112 - DNA, 18 bp, Homo sapiens
gtagtgaagctctcaccc

SEQ ID NO: 3492113 - DNA, 22 bp, Homo sapiens
gtagtttttacagctgtgttat

SEQ ID NO: 3492114 - DNA, 12 bp, Homo sapiens
gtataaaagatg

SEQ ID NO: 3492115 - DNA, 13 bp, Homo sapiens
gtataaaagatgg

SEQ ID NO: 3492116 - DNA, 19 bp, Homo sapiens
gtataaaatgtaacactga

SEQ ID NO: 3492117 - DNA, 20 bp, Homo sapiens
gtataagtggaggcacttta

SEQ ID NO: 3492118 - DNA, 23 bp, Homo sapiens
gtataatggttgactgggtttct

SEQ ID NO: 3492119 - DNA, 18 bp, Homo sapiens
gtatagcatgcatctgtt

SEQ ID NO: 3492120 - DNA, 12 bp, Homo sapiens
gtatatactttt

SEQ ID NO: 3492121 - DNA, 19 bp, Homo sapiens
gtatatataagaaagacat

SEQ ID NO: 3492122 - DNA, 12 bp, Homo sapiens
gtatattcactt

SEQ ID NO: 3492123 - DNA, 20 bp, Homo sapiens
gtatatttgtgatagcactt

SEQ ID NO: 3492124 - DNA, 23 bp, Homo sapiens
gtatatttgtgatagcactttct

SEQ ID NO: 3492125 - DNA, 15 bp, Homo sapiens
gtatcaaataaaatt

SEQ ID NO: 3492126 - DNA, 18 bp, Homo sapiens
gtatcactgtctttccta

SEQ ID NO: 3492127 - DNA, 18 bp, Homo sapiens
gtatcaggtgctgccatc

SEQ ID NO: 3492128 - DNA, 18 bp, Homo sapiens
gtatcagtcagtgctgga

SEQ ID NO: 3492129 - DNA, 23 bp, Homo sapiens
gtatcagtcagtgctggagaaat

SEQ ID NO: 3492130 - DNA, 11 bp, Homo sapiens
gtatccagtca

SEQ ID NO: 3492131 - DNA, 21 bp, Homo sapiens
gtatgatcacggctcactgca

SEQ ID NO: 3492132 - DNA, 14 bp, Homo sapiens
gtatgatgctgccg

SEQ ID NO: 3492133 - DNA, 23 bp, Homo sapiens
gtatgatttataaacagacaata

SEQ ID NO: 3492134 - DNA, 21 bp, Homo sapiens
gtatgctgatcatcgccagag

SEQ ID NO: 3492135 - DNA, 18 bp, Homo sapiens
gtatggagagaaaacaga

SEQ ID NO: 3492136 - DNA, 21 bp, Homo sapiens
gtatgggctgggggctatgta

SEQ ID NO: 3492137 - DNA, 22 bp, Homo sapiens
gtatgggctgggggctatgtat

SEQ ID NO: 3492138 - DNA, 13 bp, Homo sapiens
gtatggtggctgg

SEQ ID NO: 3492139 - DNA, 16 bp, Homo sapiens
gtatggtggctgggtt

SEQ ID NO: 3492140 - DNA, 11 bp, Homo sapiens
gtatgtctgtc

SEQ ID NO: 3492141 - DNA, 16 bp, Homo sapiens
gtatgtgctgtaattt

SEQ ID NO: 3492142 - DNA, 16 bp, Homo sapiens
gtatgtgggggcttca

SEQ ID NO: 3492143 - DNA, 17 bp, Homo sapiens
gtatgttaacctaggca

SEQ ID NO: 3492144 - DNA, 18 bp, Homo sapiens
gtatgttaacctaggcag

SEQ ID NO: 3492145 - DNA, 16 bp, Homo sapiens
gtatgttgtcaaagag

SEQ ID NO: 3492146 - DNA, 17 bp, Homo sapiens
gtatgttgtcaaagaga

SEQ ID NO: 3492147 - DNA, 19 bp, Homo sapiens
gtatgtttaatctgttatg

SEQ ID NO: 3492148 - DNA, 16 bp, Homo sapiens
gtatgtttttttccaa

SEQ ID NO: 3492149 - DNA, 19 bp, Homo sapiens
gtattaaaaaaaacaaaaa

SEQ ID NO: 3492150 - DNA, 13 bp, Homo sapiens
gtattaaagacag

SEQ ID NO: 3492151 - DNA, 17 bp, Homo sapiens
gtattaccatgtaaata

SEQ ID NO: 3492152 - DNA, 18 bp, Homo sapiens
gtattaccatgtaaataa

SEQ ID NO: 3492153 - DNA, 23 bp, Homo sapiens
gtattaccatgtaaataatctgt

SEQ ID NO: 3492154 - DNA, 13 bp, Homo sapiens
gtattagatgttc

SEQ ID NO: 3492155 - DNA, 15 bp, Homo sapiens
gtattagatgttctc

SEQ ID NO: 3492156 - DNA, 15 bp, Homo sapiens
gtattagttgccaat

SEQ ID NO: 3492157 - DNA, 19 bp, Homo sapiens
gtattcatatattgcattt

SEQ ID NO: 3492158 - DNA, 12 bp, Homo sapiens
gtattctctgag

SEQ ID NO: 3492159 - DNA, 19 bp, Homo sapiens
gtattctctgagctgtgca

SEQ ID NO: 3492160 - DNA, 17 bp, Homo sapiens
gtattgagatattacac

SEQ ID NO: 3492161 - DNA, 20 bp, Homo sapiens
gtattgtaaaaaattcacat

SEQ ID NO: 3492162 - DNA, 12 bp, Homo sapiens
gtattgtaaatt

SEQ ID NO: 3492163 - DNA, 13 bp, Homo sapiens
gtattgtaaatta

SEQ ID NO: 3492164 - DNA, 20 bp, Homo sapiens
gtattgtaaattatatttgt

SEQ ID NO: 3492165 - DNA, 18 bp, Homo sapiens
gtatttaattagtgctaa

SEQ ID NO: 3492166 - DNA, 19 bp, Homo sapiens
gtatttaattagtgctaag

SEQ ID NO: 3492167 - DNA, 20 bp, Homo sapiens
gtatttaattagtgctaagt

SEQ ID NO: 3492168 - DNA, 11 bp, Homo sapiens
gtatttattca

SEQ ID NO: 3492169 - DNA, 13 bp, Homo sapiens
gtatttattcaat

SEQ ID NO: 3492170 - DNA, 13 bp, Homo sapiens
gtatttcaaattg

SEQ ID NO: 3492171 - DNA, 15 bp, Homo sapiens
gtattttgtgtcctc

SEQ ID NO: 3492172 - DNA, 24 bp, Homo sapiens
gtattttgtgtcctccaggagctt

SEQ ID NO: 3492173 - DNA, 19 bp, Homo sapiens
gtattttgtttttgtctta

SEQ ID NO: 3492174 - DNA, 14 bp, Homo sapiens
gtattttttccttt

SEQ ID NO: 3492175 - DNA, 14 bp, Homo sapiens
gtatttttttgcaa

SEQ ID NO: 3492176 - DNA, 16 bp, Homo sapiens
gtatttttttgcaagt

SEQ ID NO: 3492177 - DNA, 17 bp, Homo sapiens
gtatttttttgcaagtg

SEQ ID NO: 3492178 - DNA, 20 bp, Homo sapiens
gtcaaacaaactctctgaac

SEQ ID NO: 3492179 - DNA, 16 bp, Homo sapiens
gtcaaatctgggctca

SEQ ID NO: 3492180 - DNA, 17 bp, Homo sapiens
gtcaacccttctggaaa

SEQ ID NO: 3492181 - DNA, 19 bp, Homo sapiens
gtcaacccttctggaaact

SEQ ID NO: 3492182 - DNA, 14 bp, Homo sapiens
gtcaacctgggcaa

SEQ ID NO: 3492183 - DNA, 19 bp, Homo sapiens
gtcaagagggtctgaggaa

SEQ ID NO: 3492184 - DNA, 18 bp, Homo sapiens
ggcacccaagacctcagg

SEQ ID NO: 3492185 - DNA, 20 bp, Homo sapiens
ggcacccaccatcatgtctg

SEQ ID NO: 3492186 - DNA, 13 bp, Homo sapiens
ggcacccaccctg

SEQ ID NO: 3492187 - DNA, 14 bp, Homo sapiens
ggcacccaccctgg

SEQ ID NO: 3492188 - DNA, 18 bp, Homo sapiens
ggcacccggcccctgctg

SEQ ID NO: 3492189 - DNA, 18 bp, Homo sapiens
ggcacctaatccaggcag

SEQ ID NO: 3492190 - DNA, 19 bp, Homo sapiens
ggcacctaatccaggcaga

SEQ ID NO: 3492191 - DNA, 17 bp, Homo sapiens
ggcacctataaaacagg

SEQ ID NO: 3492192 - DNA, 17 bp, Homo sapiens
ggcacctctcttgaacc

SEQ ID NO: 3492193 - DNA, 20 bp, Homo sapiens
ggcacggtcttccctcttcc

SEQ ID NO: 3492194 - DNA, 18 bp, Homo sapiens
ggcactcagaagacactg

SEQ ID NO: 3492195 - DNA, 20 bp, Homo sapiens
ggcactcagaagacactgat

SEQ ID NO: 3492196 - DNA, 13 bp, Homo sapiens
ggcacttccctgc

SEQ ID NO: 3492197 - DNA, 14 bp, Homo sapiens
ggcacttccctgct

SEQ ID NO: 3492198 - DNA, 17 bp, Homo sapiens
ggcagaaacaataaaac

SEQ ID NO: 3492199 - DNA, 17 bp, Homo sapiens
ggcagaaggcaaaccca

SEQ ID NO: 3492200 - DNA, 18 bp, Homo sapiens
ggcagactctttatgctt

SEQ ID NO: 3492201 - DNA, 23 bp, Homo sapiens
ggcagagattggaatgggcagct

SEQ ID NO: 3492202 - DNA, 12 bp, Homo sapiens
ggcagagcccaa

SEQ ID NO: 3492203 - DNA, 14 bp, Homo sapiens
ggcagagctgcatc

SEQ ID NO: 3492204 - DNA, 18 bp, Homo sapiens
ggcagagctgctcccctc

SEQ ID NO: 3492205 - DNA, 19 bp, Homo sapiens
ggcagagctggctctgagc

SEQ ID NO: 3492206 - DNA, 20 bp, Homo sapiens
ggcagagggctggaggccca

SEQ ID NO: 3492207 - DNA, 15 bp, Homo sapiens
ggcagagtcctggag

SEQ ID NO: 3492208 - DNA, 17 bp, Homo sapiens
ggcagagttgtaaatat

SEQ ID NO: 3492209 - DNA, 23 bp, Homo sapiens
ggcagatacaggaaaagctgctg

SEQ ID NO: 3492210 - DNA, 22 bp, Homo sapiens
ggcagatgtggggctgagctgg

SEQ ID NO: 3492211 - DNA, 16 bp, Homo sapiens
ggcagattcccactgc

SEQ ID NO: 3492212 - DNA, 14 bp, Homo sapiens
ggcagcacagagac

SEQ ID NO: 3492213 - DNA, 13 bp, Homo sapiens
ggcagcagtgtga

SEQ ID NO: 3492214 - DNA, 14 bp, Homo sapiens
ggcagcagtgtgag

SEQ ID NO: 3492215 - DNA, 19 bp, Homo sapiens
ggcagcagtgtgaggccag

SEQ ID NO: 3492216 - DNA, 20 bp, Homo sapiens
ggcagccccattctgcctgc

SEQ ID NO: 3492217 - DNA, 22 bp, Homo sapiens
ggcagccccattctgcctgccc

SEQ ID NO: 3492218 - DNA, 23 bp, Homo sapiens
ggcagccccattctgcctgccca

SEQ ID NO: 3492219 - DNA, 14 bp, Homo sapiens
ggcagcctcccatc

SEQ ID NO: 3492220 - DNA, 21 bp, Homo sapiens
ggcagcctcccatccagggcc

SEQ ID NO: 3492221 - DNA, 12 bp, Homo sapiens
ggcagcgacccc

SEQ ID NO: 3492222 - DNA, 14 bp, Homo sapiens
ggcagcgaccccag

SEQ ID NO: 3492223 - DNA, 22 bp, Homo sapiens
ggcagcgccaggctgaccacag

SEQ ID NO: 3492224 - DNA, 24 bp, Homo sapiens
ggcagctgcggtccacccaggagc

SEQ ID NO: 3492225 - DNA, 19 bp, Homo sapiens
ggcaggacaacgaggaagc

SEQ ID NO: 3492226 - DNA, 23 bp, Homo sapiens
ggcaggaccttcgggctgtgccc

SEQ ID NO: 3492227 - DNA, 16 bp, Homo sapiens
ggcaggactcagctcc

SEQ ID NO: 3492228 - DNA, 14 bp, Homo sapiens
ggcaggactgcaga

SEQ ID NO: 3492229 - DNA, 17 bp, Homo sapiens
ggcaggactgcagagca

SEQ ID NO: 3492230 - DNA, 19 bp, Homo sapiens
ggcaggactgcagagcaga

SEQ ID NO: 3492231 - DNA, 15 bp, Homo sapiens
ggcaggatggcctgg

SEQ ID NO: 3492232 - DNA, 19 bp, Homo sapiens
ggcaggatggcctggccag

SEQ ID NO: 3492233 - DNA, 17 bp, Homo sapiens
ggcaggctaaggcgtgg

SEQ ID NO: 3492234 - DNA, 22 bp, Homo sapiens
ggcaggctaaggcgtggagctg

SEQ ID NO: 3492235 - DNA, 19 bp, Homo sapiens
ggcagggcgggcagagggc

SEQ ID NO: 3492236 - DNA, 16 bp, Homo sapiens
ggcagggctgtgcttg

SEQ ID NO: 3492237 - DNA, 14 bp, Homo sapiens
ggcaggggacagga

SEQ ID NO: 3492238 - DNA, 20 bp, Homo sapiens
ggcagggtctcactctgtcg

SEQ ID NO: 3492239 - DNA, 23 bp, Homo sapiens
ggcaggtcttgaactcctggcct

SEQ ID NO: 3492240 - DNA, 19 bp, Homo sapiens
ggcaggtgctggagcactg

SEQ ID NO: 3492241 - DNA, 20 bp, Homo sapiens
ggcagtcattggctgtctcc

SEQ ID NO: 3492242 - DNA, 16 bp, Homo sapiens
ggcagtccagccagct

SEQ ID NO: 3492243 - DNA, 18 bp, Homo sapiens
ggcagtccagccagctcc

SEQ ID NO: 3492244 - DNA, 21 bp, Homo sapiens
ggcagtgagggagggctgtca

SEQ ID NO: 3492245 - DNA, 12 bp, Homo sapiens
ggcagtggaggt

SEQ ID NO: 3492246 - DNA, 14 bp, Homo sapiens
ggcagtgggagctg

SEQ ID NO: 3492247 - DNA, 17 bp, Homo sapiens
ggcagtgggagctgcct

SEQ ID NO: 3492248 - DNA, 15 bp, Homo sapiens
ggcagttctgggtgc

SEQ ID NO: 3492249 - DNA, 23 bp, Homo sapiens
ggcagtttcagagatggacagag

SEQ ID NO: 3492250 - DNA, 19 bp, Homo sapiens
ggcatagatgcaggtgagc

SEQ ID NO: 3492251 - DNA, 21 bp, Homo sapiens
ggcatagctccccgcttctgc

SEQ ID NO: 3492252 - DNA, 23 bp, Homo sapiens
ggcatcatgcatcttactgaagg

SEQ ID NO: 3492253 - DNA, 14 bp, Homo sapiens
ggcatcctctgact

SEQ ID NO: 3492254 - DNA, 17 bp, Homo sapiens
ggcatcctctgactcca

SEQ ID NO: 3492255 - DNA, 22 bp, Homo sapiens
ggcatgaagtttccttggctgg

SEQ ID NO: 3492256 - DNA, 13 bp, Homo sapiens
ggcatgagaaata

SEQ ID NO: 3492257 - DNA, 14 bp, Homo sapiens
ggcatgggtcggga

SEQ ID NO: 3492258 - DNA, 14 bp, Homo sapiens
ggcatgtgggcttc

SEQ ID NO: 3492259 - DNA, 23 bp, Homo sapiens
ggcatgttagcccttcctccaat

SEQ ID NO: 3492260 - DNA, 23 bp, Homo sapiens
ggcatgttctctgaggacactaa

SEQ ID NO: 3492261 - DNA, 16 bp, Homo sapiens
ggcattaacacaaagg

SEQ ID NO: 3492262 - DNA, 23 bp, Homo sapiens
ggcattgatggggaaggaggctg

SEQ ID NO: 3492263 - DNA, 21 bp, Homo sapiens
ggcatttcaattcctggccct

SEQ ID NO: 3492264 - DNA, 16 bp, Homo sapiens
ggcatttcctgctgaa

SEQ ID NO: 3492265 - DNA, 15 bp, Homo sapiens
ggccaaacctctgtt

SEQ ID NO: 3492266 - DNA, 17 bp, Homo sapiens
ggccaacatggcgaaac

SEQ ID NO: 3492267 - DNA, 11 bp, Homo sapiens
ggccaagccag

SEQ ID NO: 3492268 - DNA, 18 bp, Homo sapiens
ggccaagccagctgccta

SEQ ID NO: 3492269 - DNA, 15 bp, Homo sapiens
ggccaaggagctgct

SEQ ID NO: 3492270 - DNA, 16 bp, Homo sapiens
ggccaaggagctgcta

SEQ ID NO: 3492271 - DNA, 21 bp, Homo sapiens
ggccacacatcctgctgggcc

SEQ ID NO: 3492272 - DNA, 21 bp, Homo sapiens
ggccacactcagcacaaggcc

SEQ ID NO: 3492273 - DNA, 13 bp, Homo sapiens
ggccacctcccca

SEQ ID NO: 3492274 - DNA, 17 bp, Homo sapiens
ggccacctccccagcat

SEQ ID NO: 3492275 - DNA, 13 bp, Homo sapiens
ggccactccgaga

SEQ ID NO: 3492276 - DNA, 11 bp, Homo sapiens
ggccactgtga

SEQ ID NO: 3492277 - DNA, 15 bp, Homo sapiens
ggccacttctgggtg

SEQ ID NO: 3492278 - DNA, 21 bp, Homo sapiens
ggccacttctgggtggggcag

SEQ ID NO: 3492279 - DNA, 16 bp, Homo sapiens
ggccagacacaggccc

SEQ ID NO: 3492280 - DNA, 17 bp, Homo sapiens
ggccagacacaggccct

SEQ ID NO: 3492281 - DNA, 18 bp, Homo sapiens
ggccagacacaggccctc

SEQ ID NO: 3492282 - DNA, 19 bp, Homo sapiens
ggccagacagaccttcaca

SEQ ID NO: 3492283 - DNA, 21 bp, Homo sapiens
ggccagacagaccttcacaga

SEQ ID NO: 3492284 - DNA, 23 bp, Homo sapiens
ggccagagagcctggtgctgctg

SEQ ID NO: 3492285 - DNA, 14 bp, Homo sapiens
ggccagagccaagg

SEQ ID NO: 3492286 - DNA, 16 bp, Homo sapiens
ggccagaggcccccag

SEQ ID NO: 3492287 - DNA, 22 bp, Homo sapiens
ggccagaggcccccagcccagg

SEQ ID NO: 3492288 - DNA, 12 bp, Homo sapiens
ggccagatccag

SEQ ID NO: 3492289 - DNA, 16 bp, Homo sapiens
ggccagatgcaccagc

SEQ ID NO: 3492290 - DNA, 19 bp, Homo sapiens
ggccagatgcaccagccct

SEQ ID NO: 3492291 - DNA, 14 bp, Homo sapiens
ggccagctggcagc

SEQ ID NO: 3492292 - DNA, 17 bp, Homo sapiens
ggccagctggcagcaga

SEQ ID NO: 3492293 - DNA, 18 bp, Homo sapiens
ggccagctggcagcagag

SEQ ID NO: 3492294 - DNA, 17 bp, Homo sapiens
ggccaggccactgggcc

SEQ ID NO: 3492295 - DNA, 16 bp, Homo sapiens
ggccaggccagaggga

SEQ ID NO: 3492296 - DNA, 16 bp, Homo sapiens
ggccaggctggtctca

SEQ ID NO: 3492297 - DNA, 17 bp, Homo sapiens
ggccagggagaagctcc

SEQ ID NO: 3492298 - DNA, 18 bp, Homo sapiens
ggccagggagaagctcct

SEQ ID NO: 3492299 - DNA, 16 bp, Homo sapiens
ggccagtacctttcca

SEQ ID NO: 3492300 - DNA, 16 bp, Homo sapiens
ggccagtccaggctgc

SEQ ID NO: 3492301 - DNA, 20 bp, Homo sapiens
ggccagtgtgacaaggattg

SEQ ID NO: 3492302 - DNA, 14 bp, Homo sapiens
ggccatcccacaag

SEQ ID NO: 3492303 - DNA, 15 bp, Homo sapiens
ggccatgatggcaac

SEQ ID NO: 3492304 - DNA, 18 bp, Homo sapiens
ggccatgatggcaacaga

SEQ ID NO: 3492305 - DNA, 18 bp, Homo sapiens
ggccatgctgaggcctgg

SEQ ID NO: 3492306 - DNA, 19 bp, Homo sapiens
ggccatgctgaggcctggg

SEQ ID NO: 3492307 - DNA, 14 bp, Homo sapiens
ggccatggagagct

SEQ ID NO: 3492308 - DNA, 17 bp, Homo sapiens
ggccatggagagctgga

SEQ ID NO: 3492309 - DNA, 17 bp, Homo sapiens
ggccattaggaaactgt

SEQ ID NO: 3492310 - DNA, 20 bp, Homo sapiens
ggcccaaatccagtgtgcac

SEQ ID NO: 3492311 - DNA, 17 bp, Homo sapiens
ggcccagggcaagctcc

SEQ ID NO: 3492312 - DNA, 14 bp, Homo sapiens
ggcccagggcccag

SEQ ID NO: 3492313 - DNA, 15 bp, Homo sapiens
ggcccagggcccaga

SEQ ID NO: 3492314 - DNA, 16 bp, Homo sapiens
ggcccagggcccagag

SEQ ID NO: 3492315 - DNA, 17 bp, Homo sapiens
ggcccagggcccagagc

SEQ ID NO: 3492316 - DNA, 22 bp, Homo sapiens
ggcccagggcccagagcccagc

SEQ ID NO: 3492317 - DNA, 15 bp, Homo sapiens
ggcccaggtgagtcc

SEQ ID NO: 3492318 - DNA, 15 bp, Homo sapiens
ggccccaccctgggc

SEQ ID NO: 3492319 - DNA, 18 bp, Homo sapiens
ggccccagcacagcttga

SEQ ID NO: 3492320 - DNA, 18 bp, Homo sapiens
gtccccagctccccagga

SEQ ID NO: 3492321 - DNA, 12 bp, Homo sapiens
gtccccatctgt

SEQ ID NO: 3492322 - DNA, 11 bp, Homo sapiens
gtccccccacc

SEQ ID NO: 3492323 - DNA, 22 bp, Homo sapiens
gtcccctcccagagctggtgga

SEQ ID NO: 3492324 - DNA, 18 bp, Homo sapiens
gtccccttctctcatctc

SEQ ID NO: 3492325 - DNA, 19 bp, Homo sapiens
gtccccttctctcatctct

SEQ ID NO: 3492326 - DNA, 16 bp, Homo sapiens
gtcccggctctgtggg

SEQ ID NO: 3492327 - DNA, 15 bp, Homo sapiens
gtcccggggccagca

SEQ ID NO: 3492328 - DNA, 17 bp, Homo sapiens
gtcccggggccagcact

SEQ ID NO: 3492329 - DNA, 21 bp, Homo sapiens
gtcccggggccagcacttcca

SEQ ID NO: 3492330 - DNA, 15 bp, Homo sapiens
gtcccggggctccac

SEQ ID NO: 3492331 - DNA, 14 bp, Homo sapiens
gtccctctgcccca

SEQ ID NO: 3492332 - DNA, 21 bp, Homo sapiens
gtccctctgccccatcctcca

SEQ ID NO: 3492333 - DNA, 12 bp, Homo sapiens
gtccctctgtgt

SEQ ID NO: 3492334 - DNA, 13 bp, Homo sapiens
gtccctctgtgta

SEQ ID NO: 3492335 - DNA, 22 bp, Homo sapiens
gtccctgccacgaatttctgtg

SEQ ID NO: 3492336 - DNA, 15 bp, Homo sapiens
gtccctggggctagg

SEQ ID NO: 3492337 - DNA, 16 bp, Homo sapiens
gtccggaatgccaccc

SEQ ID NO: 3492338 - DNA, 15 bp, Homo sapiens
gtccgtgctgacagc

SEQ ID NO: 3492339 - DNA, 19 bp, Homo sapiens
gtccgtgggacggtgccca

SEQ ID NO: 3492340 - DNA, 13 bp, Homo sapiens
gtcctacccaccc

SEQ ID NO: 3492341 - DNA, 15 bp, Homo sapiens
gtcctacccaccctc

SEQ ID NO: 3492342 - DNA, 16 bp, Homo sapiens
gtcctacccaccctcc

SEQ ID NO: 3492343 - DNA, 18 bp, Homo sapiens
gtcctacccatccccgca

SEQ ID NO: 3492344 - DNA, 23 bp, Homo sapiens
gtcctactctgtgtcaggtgggg

SEQ ID NO: 3492345 - DNA, 14 bp, Homo sapiens
gtcctaggcctcaa

SEQ ID NO: 3492346 - DNA, 16 bp, Homo sapiens
gtcctcagccttgcca

SEQ ID NO: 3492347 - DNA, 16 bp, Homo sapiens
gtcctcaggtggccat

SEQ ID NO: 3492348 - DNA, 22 bp, Homo sapiens
gtcctccaacaccaagcacagc

SEQ ID NO: 3492349 - DNA, 14 bp, Homo sapiens
gtcctccaagccag

SEQ ID NO: 3492350 - DNA, 14 bp, Homo sapiens
gtcctccaggagct

SEQ ID NO: 3492351 - DNA, 15 bp, Homo sapiens
gtcctccaggagctt

SEQ ID NO: 3492352 - DNA, 21 bp, Homo sapiens
gtcctcccaatttcagactcc

SEQ ID NO: 3492353 - DNA, 14 bp, Homo sapiens
gtcctcctctgtga

SEQ ID NO: 3492354 - DNA, 23 bp, Homo sapiens
gtcctctagaaataggttaaact

SEQ ID NO: 3492355 - DNA, 13 bp, Homo sapiens
gtcctctgaatga

SEQ ID NO: 3492356 - DNA, 18 bp, Homo sapiens
gtcctctgtcagtcacag

SEQ ID NO: 3492357 - DNA, 19 bp, Homo sapiens
gtcctctgtcagtcacagc

SEQ ID NO: 3492358 - DNA, 19 bp, Homo sapiens
gtgaagatctcactctgcc

SEQ ID NO: 3492359 - DNA, 17 bp, Homo sapiens
gtgaagcaccaagctca

SEQ ID NO: 3492360 - DNA, 16 bp, Homo sapiens
gtgaagctaatgacca

SEQ ID NO: 3492361 - DNA, 18 bp, Homo sapiens
gtgaagctaatgaccaac

SEQ ID NO: 3492362 - DNA, 12 bp, Homo sapiens
gtgaaggaccct

SEQ ID NO: 3492363 - DNA, 13 bp, Homo sapiens
gtgaaggctggca

SEQ ID NO: 3492364 - DNA, 17 bp, Homo sapiens
gtgaaggcttctctctg

SEQ ID NO: 3492365 - DNA, 23 bp, Homo sapiens
gtgaataatacagtatctcaggg

SEQ ID NO: 3492366 - DNA, 23 bp, Homo sapiens
gtgaatgatcaagtcctttgtga

SEQ ID NO: 3492367 - DNA, 15 bp, Homo sapiens
gtgaatgccagtgtg

SEQ ID NO: 3492368 - DNA, 18 bp, Homo sapiens
gtgaatgccagtgtgctg

SEQ ID NO: 3492369 - DNA, 17 bp, Homo sapiens
gtgaattttcaaggcct

SEQ ID NO: 3492370 - DNA, 15 bp, Homo sapiens
gtgaatttttctcta

SEQ ID NO: 3492371 - DNA, 15 bp, Homo sapiens
gtgaatttttgcaat

SEQ ID NO: 3492372 - DNA, 16 bp, Homo sapiens
gtgacaaaccatccag

SEQ ID NO: 3492373 - DNA, 23 bp, Homo sapiens
gtgacaaaccatccagtggaggt

SEQ ID NO: 3492374 - DNA, 16 bp, Homo sapiens
gtgacaacacttgtgt

SEQ ID NO: 3492375 - DNA, 20 bp, Homo sapiens
gtgacaaggattgctactgt

SEQ ID NO: 3492376 - DNA, 19 bp, Homo sapiens
gtgacaattctgtttttaa

SEQ ID NO: 3492377 - DNA, 18 bp, Homo sapiens
gtgacacccaagagggct

SEQ ID NO: 3492378 - DNA, 20 bp, Homo sapiens
gtgacagggaaacctttttt

SEQ ID NO: 3492379 - DNA, 16 bp, Homo sapiens
gtgaccaatgtcttga

SEQ ID NO: 3492380 - DNA, 15 bp, Homo sapiens
gtgacccccagctcc

SEQ ID NO: 3492381 - DNA, 17 bp, Homo sapiens
gtgacccccagctccgg

SEQ ID NO: 3492382 - DNA, 14 bp, Homo sapiens
gtgacctgaggaag

SEQ ID NO: 3492383 - DNA, 20 bp, Homo sapiens
gtgagaacctgggttgcaga

SEQ ID NO: 3492384 - DNA, 22 bp, Homo sapiens
gtgagaacctgggttgcagaca

SEQ ID NO: 3492385 - DNA, 20 bp, Homo sapiens
gtgagaaggtgttggacagg

SEQ ID NO: 3492386 - DNA, 20 bp, Homo sapiens
gtgagaagtgaatgctggga

SEQ ID NO: 3492387 - DNA, 21 bp, Homo sapiens
gtgagaagtgaatgctgggac

SEQ ID NO: 3492388 - DNA, 17 bp, Homo sapiens
gtgagaataggcagccc

SEQ ID NO: 3492389 - DNA, 20 bp, Homo sapiens
gtgagacagtccagcctgga

SEQ ID NO: 3492390 - DNA, 22 bp, Homo sapiens
gtgagaccctgtctcaaaaaaa

SEQ ID NO: 3492391 - DNA, 22 bp, Homo sapiens
gtgagactcgagaactttcatt

SEQ ID NO: 3492392 - DNA, 16 bp, Homo sapiens
gtgagactctgtctca

SEQ ID NO: 3492393 - DNA, 13 bp, Homo sapiens
gtgagccactgca

SEQ ID NO: 3492394 - DNA, 15 bp, Homo sapiens
gtgagccactgcacc

SEQ ID NO: 3492395 - DNA, 18 bp, Homo sapiens
gtgagcccagctgggtca

SEQ ID NO: 3492396 - DNA, 20 bp, Homo sapiens
gtgagcccagctgggtcagg

SEQ ID NO: 3492397 - DNA, 16 bp, Homo sapiens
gtgagccccatcttca

SEQ ID NO: 3492398 - DNA, 16 bp, Homo sapiens
gtgagctaggagaagg

SEQ ID NO: 3492399 - DNA, 20 bp, Homo sapiens
gtgagctaggagaagggctg

SEQ ID NO: 3492400 - DNA, 15 bp, Homo sapiens
gtgaggaaagtcatt

SEQ ID NO: 3492401 - DNA, 21 bp, Homo sapiens
gtgaggagccccatctgtcta

SEQ ID NO: 3492402 - DNA, 14 bp, Homo sapiens
gtgaggccagggca

SEQ ID NO: 3492403 - DNA, 15 bp, Homo sapiens
gtgaggccagggcag

SEQ ID NO: 3492404 - DNA, 14 bp, Homo sapiens
gtgaggcctgtctg

SEQ ID NO: 3492405 - DNA, 13 bp, Homo sapiens
gtgagggccttct

SEQ ID NO: 3492406 - DNA, 19 bp, Homo sapiens
gtgagtcaccaagcccagt

SEQ ID NO: 3492407 - DNA, 23 bp, Homo sapiens
gtgagtgtttctatgagtggaaa

SEQ ID NO: 3492408 - DNA, 13 bp, Homo sapiens
gtgatatggagca

SEQ ID NO: 3492409 - DNA, 17 bp, Homo sapiens
gtgatatggagcaagag

SEQ ID NO: 3492410 - DNA, 17 bp, Homo sapiens
gtgatcacagcagcttc

SEQ ID NO: 3492411 - DNA, 20 bp, Homo sapiens
gtgatccacccacctcagcc

SEQ ID NO: 3492412 - DNA, 20 bp, Homo sapiens
gtgatcctcccacctcagcc

SEQ ID NO: 3492413 - DNA, 22 bp, Homo sapiens
gtgatcctcccacctcagcctc

SEQ ID NO: 3492414 - DNA, 22 bp, Homo sapiens
gtgatcgatgattcaggtgcag

SEQ ID NO: 3492415 - DNA, 16 bp, Homo sapiens
gtgatgccctgccctt

SEQ ID NO: 3492416 - DNA, 13 bp, Homo sapiens
gtgatgcggcaga

SEQ ID NO: 3492417 - DNA, 13 bp, Homo sapiens
gtgatgctgtgat

SEQ ID NO: 3492418 - DNA, 14 bp, Homo sapiens
gtgatggggcaagg

SEQ ID NO: 3492419 - DNA, 15 bp, Homo sapiens
gtgatgtgaagccaa

SEQ ID NO: 3492420 - DNA, 16 bp, Homo sapiens
gtgattctcctgcctc

SEQ ID NO: 3492421 - DNA, 18 bp, Homo sapiens
gtgattctcctgcctcag

SEQ ID NO: 3492422 - DNA, 19 bp, Homo sapiens
gtgattctcctgcctcagc

SEQ ID NO: 3492423 - DNA, 17 bp, Homo sapiens
gtgattgacagctttgc

SEQ ID NO: 3492424 - DNA, 16 bp, Homo sapiens
gtgattgggacagagg

SEQ ID NO: 3492425 - DNA, 19 bp, Homo sapiens
gtgattgtggaatggagat

SEQ ID NO: 3492426 - DNA, 19 bp, Homo sapiens
gtgattttaactctgtctt

SEQ ID NO: 3492427 - DNA, 21 bp, Homo sapiens
gtgcaacctctgcttcccagg

SEQ ID NO: 3492428 - DNA, 22 bp, Homo sapiens
gtgcaataaatctgacccagtg

SEQ ID NO: 3492429 - DNA, 21 bp, Homo sapiens
gtgcaatgtctgagtgaacct

SEQ ID NO: 3492430 - DNA, 13 bp, Homo sapiens
gtgcacaagtgtg

SEQ ID NO: 3492431 - DNA, 23 bp, Homo sapiens
gtgcacagtaaacgtgtttgtgg

SEQ ID NO: 3492432 - DNA, 18 bp, Homo sapiens
gtgcacatctgtgtcttg

SEQ ID NO: 3492433 - DNA, 13 bp, Homo sapiens
gtgcactttgtaa

SEQ ID NO: 3492434 - DNA, 14 bp, Homo sapiens
gtgcactttgtaaa

SEQ ID NO: 3492435 - DNA, 15 bp, Homo sapiens
gtgcactttgtaaat

SEQ ID NO: 3492436 - DNA, 17 bp, Homo sapiens
gtgcagccgctgagcga

SEQ ID NO: 3492437 - DNA, 15 bp, Homo sapiens
gtgcagctcctcagc

SEQ ID NO: 3492438 - DNA, 12 bp, Homo sapiens
gtgcattctcct

SEQ ID NO: 3492439 - DNA, 23 bp, Homo sapiens
gtgcatttgtgctagaaattttc

SEQ ID NO: 3492440 - DNA, 13 bp, Homo sapiens
gtgccaacactca

SEQ ID NO: 3492441 - DNA, 22 bp, Homo sapiens
gtgccaacactcaagaagcagg

SEQ ID NO: 3492442 - DNA, 13 bp, Homo sapiens
gtgccaggaccag

SEQ ID NO: 3492443 - DNA, 16 bp, Homo sapiens
gtgccatcattgctgt

SEQ ID NO: 3492444 - DNA, 22 bp, Homo sapiens
gtgccatcattgctgtctgcag

SEQ ID NO: 3492445 - DNA, 22 bp, Homo sapiens
gtgccatgtaaatccccactgg

SEQ ID NO: 3492446 - DNA, 16 bp, Homo sapiens
gtgccatgtgccaggt

SEQ ID NO: 3492447 - DNA, 12 bp, Homo sapiens
gtgcccaagcca

SEQ ID NO: 3492448 - DNA, 19 bp, Homo sapiens
gtgcccaagccagaggctg

SEQ ID NO: 3492449 - DNA, 23 bp, Homo sapiens
gtgcccagctatacctgtgcctc

SEQ ID NO: 3492450 - DNA, 15 bp, Homo sapiens
gtgccccaggaccag

SEQ ID NO: 3492451 - DNA, 13 bp, Homo sapiens
gtgcccccactga

SEQ ID NO: 3492452 - DNA, 15 bp, Homo sapiens
gtgcccccactgacc

SEQ ID NO: 3492453 - DNA, 19 bp, Homo sapiens
gtgcccccactgaccagaa

SEQ ID NO: 3492454 - DNA, 21 bp, Homo sapiens
gtgccccccacccctggaaga

SEQ ID NO: 3492455 - DNA, 12 bp, Homo sapiens
gtgcccctgctg

SEQ ID NO: 3492456 - DNA, 15 bp, Homo sapiens
gtgccctccttccca

SEQ ID NO: 3492457 - DNA, 12 bp, Homo sapiens
gtgccctgcccc

SEQ ID NO: 3492458 - DNA, 23 bp, Homo sapiens
gtgcctacatcccgggcctcagt

SEQ ID NO: 3492459 - DNA, 22 bp, Homo sapiens
gtgcctcggcttttctcagctg

SEQ ID NO: 3492460 - DNA, 21 bp, Homo sapiens
gtgcctgccatagccaggagc

SEQ ID NO: 3492461 - DNA, 19 bp, Homo sapiens
gttcattttgagtattttt

SEQ ID NO: 3492462 - DNA, 19 bp, Homo sapiens
gttccacttgtttgcactg

SEQ ID NO: 3492463 - DNA, 14 bp, Homo sapiens
gttccagacattct

SEQ ID NO: 3492464 - DNA, 20 bp, Homo sapiens
gttccagggtccctctgtgt

SEQ ID NO: 3492465 - DNA, 21 bp, Homo sapiens
gttccagggtccctctgtgta

SEQ ID NO: 3492466 - DNA, 17 bp, Homo sapiens
gttcccatgtagccccc

SEQ ID NO: 3492467 - DNA, 21 bp, Homo sapiens
gttcccccttcacaaagccca

SEQ ID NO: 3492468 - DNA, 15 bp, Homo sapiens
gttccctctccctgt

SEQ ID NO: 3492469 - DNA, 19 bp, Homo sapiens
gttcctactttagccactg

SEQ ID NO: 3492470 - DNA, 15 bp, Homo sapiens
gttcctgtccctgcg

SEQ ID NO: 3492471 - DNA, 21 bp, Homo sapiens
gtttgcgggggtctgagtcta

SEQ ID NO: 3492472 - DNA, 16 bp, Homo sapiens
gtttgctgatggtctg

SEQ ID NO: 3492473 - DNA, 21 bp, Homo sapiens
gtttggactgcagaagcaagg

SEQ ID NO: 3492474 - DNA, 15 bp, Homo sapiens
gtttggccatctctg

SEQ ID NO: 3492475 - DNA, 12 bp, Homo sapiens
gtttggcctcca

SEQ ID NO: 3492476 - DNA, 13 bp, Homo sapiens
gtttggcctccat

SEQ ID NO: 3492477 - DNA, 22 bp, Homo sapiens
gtttggctgtgtctaaactgca

SEQ ID NO: 3492478 - DNA, 11 bp, Homo sapiens
gtttgggcttc

SEQ ID NO: 3492479 - DNA, 18 bp, Homo sapiens
gtttggggatgagaaagg

SEQ ID NO: 3492480 - DNA, 19 bp, Homo sapiens
gtttgtaactttttacatt

SEQ ID NO: 3492481 - DNA, 17 bp, Homo sapiens
gtttgtcacatgaaaca

SEQ ID NO: 3492482 - DNA, 17 bp, Homo sapiens
gtttgttggatccgttt

SEQ ID NO: 3492483 - DNA, 12 bp, Homo sapiens
gttttaaaatta

SEQ ID NO: 3492484 - DNA, 14 bp, Homo sapiens
gttttaaaattaaa

SEQ ID NO: 3492485 - DNA, 14 bp, Homo sapiens
gttttaagaggcag

SEQ ID NO: 3492486 - DNA, 21 bp, Homo sapiens
gttttacattgttgagctatt

SEQ ID NO: 3492487 - DNA, 16 bp, Homo sapiens
gttttactgcagcttt

SEQ ID NO: 3492488 - DNA, 16 bp, Homo sapiens
gttttagaaggttctc

SEQ ID NO: 3492489 - DNA, 11 bp, Homo sapiens
gttttaggata

SEQ ID NO: 3492490 - DNA, 22 bp, Homo sapiens
gttttaggatacttaacaaata

SEQ ID NO: 3492491 - DNA, 15 bp, Homo sapiens
gttttatccataatg

SEQ ID NO: 3492492 - DNA, 16 bp, Homo sapiens
gttttatccataatga

SEQ ID NO: 3492493 - DNA, 13 bp, Homo sapiens
gttttcaatgatg

SEQ ID NO: 3492494 - DNA, 12 bp, Homo sapiens
gttttcactctt

SEQ ID NO: 3492495 - DNA, 16 bp, Homo sapiens
gttttcagtttgtata

SEQ ID NO: 3492496 - DNA, 14 bp, Homo sapiens
gttttcatcaagac

SEQ ID NO: 3492497 - DNA, 20 bp, Homo sapiens
gttttccaggtttaagctgt

SEQ ID NO: 3492498 - DNA, 21 bp, Homo sapiens
gttttccctgacctccctcta

SEQ ID NO: 3492499 - DNA, 18 bp, Homo sapiens
gttttcctcccttctgct

SEQ ID NO: 3492500 - DNA, 22 bp, Homo sapiens
gttttcttaaggtgaggcctgt

SEQ ID NO: 3492501 - DNA, 15 bp, Homo sapiens
gttttcttgttgctt

SEQ ID NO: 3492502 - DNA, 20 bp, Homo sapiens
gttttcttgttgctttgttg

SEQ ID NO: 3492503 - DNA, 17 bp, Homo sapiens
gttttctttatgtcttt

SEQ ID NO: 3492504 - DNA, 15 bp, Homo sapiens
gttttctttcctcct

SEQ ID NO: 3492505 - DNA, 20 bp, Homo sapiens
gttttctttgcaaagtattg

SEQ ID NO: 3492506 - DNA, 18 bp, Homo sapiens
gttttgaagctactgtgt

SEQ ID NO: 3492507 - DNA, 21 bp, Homo sapiens
gttttgaaggcaaaattgcaa

SEQ ID NO: 3492508 - DNA, 15 bp, Homo sapiens
gttttgagttttgta

SEQ ID NO: 3492509 - DNA, 16 bp, Homo sapiens
gttttgccatgttggc

SEQ ID NO: 3492510 - DNA, 20 bp, Homo sapiens
gttttgccatgttggccagg

SEQ ID NO: 3492511 - DNA, 12 bp, Homo sapiens
gttttgtacatg

SEQ ID NO: 3492512 - DNA, 12 bp, Homo sapiens
gttttgttgagc

SEQ ID NO: 3492513 - DNA, 16 bp, Homo sapiens
gttttgtttattaaat

SEQ ID NO: 3492514 - DNA, 15 bp, Homo sapiens
gtttttaaattttgt

SEQ ID NO: 3492515 - DNA, 13 bp, Homo sapiens
gtttttagagaat

SEQ ID NO: 3492516 - DNA, 23 bp, Homo sapiens
gtttttagagaatgtgtttcaaa

SEQ ID NO: 3492517 - DNA, 21 bp, Homo sapiens
gtttttcatcttttattttgg

SEQ ID NO: 3492518 - DNA, 15 bp, Homo sapiens
gtttttccactactg

SEQ ID NO: 3492519 - DNA, 18 bp, Homo sapiens
gtttttgccactgattta

SEQ ID NO: 3492520 - DNA, 15 bp, Homo sapiens
gttttttcctcagtg

SEQ ID NO: 3492521 - DNA, 13 bp, Homo sapiens
gttttttcctttg

SEQ ID NO: 3492522 - DNA, 17 bp, Homo sapiens
gttttttggcttgctta

SEQ ID NO: 3492523 - DNA, 22 bp, Homo sapiens
gttttttgttggagtgtttcta

SEQ ID NO: 3492524 - DNA, 20 bp, Homo sapiens
gtttttttgtcaacattgtg

SEQ ID NO: 3492525 - DNA, 14 bp, Homo sapiens
gtttttttttcatt

SEQ ID NO: 3492526 - DNA, 19 bp, Homo sapiens
taaaaaaaaagatctgttt

SEQ ID NO: 3492527 - DNA, 11 bp, Homo sapiens
taaaaaacaac

SEQ ID NO: 3492528 - DNA, 19 bp, Homo sapiens
taaaaaagatatattaaaa

SEQ ID NO: 3492529 - DNA, 14 bp, Homo sapiens
taaaaaatattttc

SEQ ID NO: 3492530 - DNA, 16 bp, Homo sapiens
taaaaaatattttctc

SEQ ID NO: 3492531 - DNA, 16 bp, Homo sapiens
taaaaaatgtcttctt

SEQ ID NO: 3492532 - DNA, 21 bp, Homo sapiens
taaaaacaaaaacaaaaccag

SEQ ID NO: 3492533 - DNA, 14 bp, Homo sapiens
taaaaaccttccaa

SEQ ID NO: 3492534 - DNA, 16 bp, Homo sapiens
taaaaaccttccaaac

SEQ ID NO: 3492535 - DNA, 20 bp, Homo sapiens
taaaaaggaatccactccca

SEQ ID NO: 3492536 - DNA, 19 bp, Homo sapiens
taaaaaggcacctataaaa

SEQ ID NO: 3492537 - DNA, 15 bp, Homo sapiens
taaaaagtggaaaaa

SEQ ID NO: 3492538 - DNA, 14 bp, Homo sapiens
taaaaataaatccc

SEQ ID NO: 3492539 - DNA, 19 bp, Homo sapiens
taaaaataaatcccatgga

SEQ ID NO: 3492540 - DNA, 12 bp, Homo sapiens
taaaaatataaa

SEQ ID NO: 3492541 - DNA, 14 bp, Homo sapiens
taaaaatataaaac

SEQ ID NO: 3492542 - DNA, 15 bp, Homo sapiens
taaaaatcacactgt

SEQ ID NO: 3492543 - DNA, 23 bp, Homo sapiens
taaaaatgtcttgctgttgacat

SEQ ID NO: 3492544 - DNA, 20 bp, Homo sapiens
taaaacaaaacaaaacaaca

SEQ ID NO: 3492545 - DNA, 17 bp, Homo sapiens
taaaacaaaatttgact

SEQ ID NO: 3492546 - DNA, 23 bp, Homo sapiens
taaaacaataaaattttttttca

SEQ ID NO: 3492547 - DNA, 14 bp, Homo sapiens
taaaacaatattgt

SEQ ID NO: 3492548 - DNA, 17 bp, Homo sapiens
taaaacactttcaaaac

SEQ ID NO: 3492549 - DNA, 13 bp, Homo sapiens
taaaacagtatct

SEQ ID NO: 3492550 - DNA, 10 bp, Homo sapiens
taaaactgcg

SEQ ID NO: 3492551 - DNA, 18 bp, Homo sapiens
taaaactggctttggctt

SEQ ID NO: 3492552 - DNA, 20 bp, Homo sapiens
taaaactgggcctgtagctc

SEQ ID NO: 3492553 - DNA, 11 bp, Homo sapiens
taaaagacaaa

SEQ ID NO: 3492554 - DNA, 12 bp, Homo sapiens
taaaagacaaat

SEQ ID NO: 3492555 - DNA, 15 bp, Homo sapiens
taaaagacaagactt

SEQ ID NO: 3492556 - DNA, 20 bp, Homo sapiens
taaaagacagtgaaagaaaa

SEQ ID NO: 3492557 - DNA, 21 bp, Homo sapiens
taaaagacttccctaacactt

SEQ ID NO: 3492558 - DNA, 19 bp, Homo sapiens
taaaagagctcagacattt

SEQ ID NO: 3492559 - DNA, 12 bp, Homo sapiens
taaaagatataa

SEQ ID NO: 3492560 - DNA, 20 bp, Homo sapiens
taaaagatataagtgctgta

SEQ ID NO: 3492561 - DNA, 21 bp, Homo sapiens
taaaagatggggtctgtaaaa

SEQ ID NO: 3492562 - DNA, 16 bp, Homo sapiens
taaaaggactctggaa

SEQ ID NO: 3492563 - DNA, 18 bp, Homo sapiens
taaaaggccaaacctctg

SEQ ID NO: 3492564 - DNA, 11 bp, Homo sapiens
taaaagtttag

SEQ ID NO: 3492565 - DNA, 12 bp, Homo sapiens
taaaataaactg

SEQ ID NO: 3492566 - DNA, 13 bp, Homo sapiens
taaaataaactgt

SEQ ID NO: 3492567 - DNA, 13 bp, Homo sapiens
taaaataaatata

SEQ ID NO: 3492568 - DNA, 21 bp, Homo sapiens
taaaataactagtgttgcttg

SEQ ID NO: 3492569 - DNA, 18 bp, Homo sapiens
taaaataatgcaaagaat

SEQ ID NO: 3492570 - DNA, 13 bp, Homo sapiens
taaaatagaatat

SEQ ID NO: 3492571 - DNA, 20 bp, Homo sapiens
taaaatagaatatagcatct

SEQ ID NO: 3492572 - DNA, 16 bp, Homo sapiens
taaaatattattgaac

SEQ ID NO: 3492573 - DNA, 12 bp, Homo sapiens
taaaatattttg

SEQ ID NO: 3492574 - DNA, 21 bp, Homo sapiens
taaaatcagccaattatgtta

SEQ ID NO: 3492575 - DNA, 15 bp, Homo sapiens
taaaatcctcaatcc

SEQ ID NO: 3492576 - DNA, 14 bp, Homo sapiens
taaaatctgtcacg

SEQ ID NO: 3492577 - DNA, 21 bp, Homo sapiens
taaaatctttctttcttagaa

SEQ ID NO: 3492578 - DNA, 19 bp, Homo sapiens
taaaatgcatgattttgta

SEQ ID NO: 3492579 - DNA, 22 bp, Homo sapiens
taaaatggatgccttgaataat

SEQ ID NO: 3492580 - DNA, 15 bp, Homo sapiens
taaaatgtaaagcca

SEQ ID NO: 3492581 - DNA, 16 bp, Homo sapiens
taaaatgtaacactga

SEQ ID NO: 3492582 - DNA, 17 bp, Homo sapiens
taaaatgttcacttttg

SEQ ID NO: 3492583 - DNA, 22 bp, Homo sapiens
taaaatgttcacttttgacaaa

SEQ ID NO: 3492584 - DNA, 14 bp, Homo sapiens
taaaatgttgaaaa

SEQ ID NO: 3492585 - DNA, 18 bp, Homo sapiens
taaaatgttgaaaagtca

SEQ ID NO: 3492586 - DNA, 20 bp, Homo sapiens
taaaatgttgaaaagtcaaa

SEQ ID NO: 3492587 - DNA, 13 bp, Homo sapiens
taaaattgaaagg

SEQ ID NO: 3492588 - DNA, 16 bp, Homo sapiens
taaaattgccatattg

SEQ ID NO: 3492589 - DNA, 20 bp, Homo sapiens
taaaatttttttagaaagca

SEQ ID NO: 3492590 - DNA, 17 bp, Homo sapiens
taaaattttttttcatg

SEQ ID NO: 3492591 - DNA, 23 bp, Homo sapiens
taaacaatgaaatattgctgtat

SEQ ID NO: 3492592 - DNA, 13 bp, Homo sapiens
taaacagacaata

SEQ ID NO: 3492593 - DNA, 15 bp, Homo sapiens
taaacagatatcttc

SEQ ID NO: 3492594 - DNA, 21 bp, Homo sapiens
taaacagatatcttcagttta

SEQ ID NO: 3492595 - DNA, 15 bp, Homo sapiens
taaacatcacacaca

SEQ ID NO: 3492596 - DNA, 20 bp, Homo sapiens
taaacatccaatattttctt

SEQ ID NO: 3492597 - DNA, 20 bp, Homo sapiens
taaaccgctttggcctgagt

SEQ ID NO: 3492598 - DNA, 13 bp, Homo sapiens
taaacctaaaaaa

SEQ ID NO: 3492599 - DNA, 19 bp, Homo sapiens
taaacctgtttttttttca

SEQ ID NO: 3492600 - DNA, 20 bp, Homo sapiens
taaacctgtttttttttcat

SEQ ID NO: 3492601 - DNA, 21 bp, Homo sapiens
taaacctgtttttttttcatt

SEQ ID NO: 3492602 - DNA, 19 bp, Homo sapiens
taaactagcatatctgcct

SEQ ID NO: 3492603 - DNA, 23 bp, Homo sapiens
taaactagcatatctgcctttat

SEQ ID NO: 3492604 - DNA, 14 bp, Homo sapiens
taaactcatttata

SEQ ID NO: 3492605 - DNA, 15 bp, Homo sapiens
taaactccttcctgg

SEQ ID NO: 3492606 - DNA, 20 bp, Homo sapiens
taaactcttcacaaaatctg

SEQ ID NO: 3492607 - DNA, 10 bp, Homo sapiens
taaactgcat

SEQ ID NO: 3492608 - DNA, 14 bp, Homo sapiens
taaactgtaaacta

SEQ ID NO: 3492609 - DNA, 14 bp, Homo sapiens
taaactgtgcacca

SEQ ID NO: 3492610 - DNA, 13 bp, Homo sapiens
taaactgttgctc

SEQ ID NO: 3492611 - DNA, 18 bp, Homo sapiens
taaacttccccatcttct

SEQ ID NO: 3492612 - DNA, 20 bp, Homo sapiens
taaagaaaaatatcttggcc

SEQ ID NO: 3492613 - DNA, 15 bp, Homo sapiens
taaagaaccagtccc

SEQ ID NO: 3492614 - DNA, 14 bp, Homo sapiens
taaagaagatctgt

SEQ ID NO: 3492615 - DNA, 17 bp, Homo sapiens
taaagaagttgaagttt

SEQ ID NO: 3492616 - DNA, 12 bp, Homo sapiens
taaagaatactt

SEQ ID NO: 3492617 - DNA, 17 bp, Homo sapiens
taaagaatacttgaact

SEQ ID NO: 3492618 - DNA, 16 bp, Homo sapiens
taaagaattcttgaaa

SEQ ID NO: 3492619 - DNA, 15 bp, Homo sapiens
taaagacaaagacaa

SEQ ID NO: 3492620 - DNA, 19 bp, Homo sapiens
taaagacaaagacaaattc

SEQ ID NO: 3492621 - DNA, 15 bp, Homo sapiens
taaagactaagtagc

SEQ ID NO: 3492622 - DNA, 19 bp, Homo sapiens
taaagaggcgttgctttca

SEQ ID NO: 3492623 - DNA, 14 bp, Homo sapiens
taaagatgattgaa

SEQ ID NO: 3492624 - DNA, 14 bp, Homo sapiens
taaagatttcttga

SEQ ID NO: 3492625 - DNA, 15 bp, Homo sapiens
taaagcaatatgcat

SEQ ID NO: 3492626 - DNA, 13 bp, Homo sapiens
taaagcatttata

SEQ ID NO: 3492627 - DNA, 17 bp, Homo sapiens
taaagctaccattttac

SEQ ID NO: 3492628 - DNA, 23 bp, Homo sapiens
taaagctgttctcattcctgttc

SEQ ID NO: 3492629 - DNA, 22 bp, Homo sapiens
taaaggatgtgattgtggaatg

SEQ ID NO: 3492630 - DNA, 17 bp, Homo sapiens
taaaggctcgattttgt

SEQ ID NO: 3492631 - DNA, 18 bp, Homo sapiens
taaaggctcgattttgta

SEQ ID NO: 3492632 - DNA, 12 bp, Homo sapiens
taaaggttgtga

SEQ ID NO: 3492633 - DNA, 13 bp, Homo sapiens
taaagtagaagag

SEQ ID NO: 3492634 - DNA, 18 bp, Homo sapiens
taaagtagaagagggttt

SEQ ID NO: 3492635 - DNA, 17 bp, Homo sapiens
taaagtagtcctgtgaa

SEQ ID NO: 3492636 - DNA, 14 bp, Homo sapiens
taaagtgaattgtt

SEQ ID NO: 3492637 - DNA, 19 bp, Homo sapiens
taaagtgactaatggcatg

SEQ ID NO: 3492638 - DNA, 16 bp, Homo sapiens
taaagtgataatttct

SEQ ID NO: 3492639 - DNA, 14 bp, Homo sapiens
taaagtgtttgaaa

SEQ ID NO: 3492640 - DNA, 17 bp, Homo sapiens
taaagttgtaacaaata

SEQ ID NO: 3492641 - DNA, 14 bp, Homo sapiens
taaagtttgcttag

SEQ ID NO: 3492642 - DNA, 18 bp, Homo sapiens
taaataaaatcatgtagt

SEQ ID NO: 3492643 - DNA, 22 bp, Homo sapiens
taaataaaatgcacaaaacttt

SEQ ID NO: 3492644 - DNA, 20 bp, Homo sapiens
taaataaactgttgctcgtt

SEQ ID NO: 3492645 - DNA, 16 bp, Homo sapiens
taaataaattgtatat

SEQ ID NO: 3492646 - DNA, 16 bp, Homo sapiens
taaataatttcctaca

SEQ ID NO: 3492647 - DNA, 13 bp, Homo sapiens
taaatacagtctt

SEQ ID NO: 3492648 - DNA, 20 bp, Homo sapiens
taaatacagtcttccatttg

SEQ ID NO: 3492649 - DNA, 23 bp, Homo sapiens
taaatacagtcttccatttgcaa

SEQ ID NO: 3492650 - DNA, 12 bp, Homo sapiens
taaatatataaa

SEQ ID NO: 3492651 - DNA, 16 bp, Homo sapiens
taaatatataaatata

SEQ ID NO: 3492652 - DNA, 19 bp, Homo sapiens
taaatatatataaacctaa

SEQ ID NO: 3492653 - DNA, 13 bp, Homo sapiens
taaatatatatta

SEQ ID NO: 3492654 - DNA, 13 bp, Homo sapiens
taaatattttcta

SEQ ID NO: 3492655 - DNA, 15 bp, Homo sapiens
taaatctgacccagt

SEQ ID NO: 3492656 - DNA, 16 bp, Homo sapiens
taaatctgacccagtg

SEQ ID NO: 3492657 - DNA, 20 bp, Homo sapiens
taaatctgctggagtttcat

SEQ ID NO: 3492658 - DNA, 23 bp, Homo sapiens
taaatggcctcatgtggctggaa

SEQ ID NO: 3492659 - DNA, 16 bp, Homo sapiens
taaatgtgcattcttt

SEQ ID NO: 3492660 - DNA, 21 bp, Homo sapiens
taaatgtgttttgtttattaa

SEQ ID NO: 3492661 - DNA, 17 bp, Homo sapiens
taaatgttaactacata

SEQ ID NO: 3492662 - DNA, 16 bp, Homo sapiens
taaattcacaaacttt

SEQ ID NO: 3492663 - DNA, 12 bp, Homo sapiens
taaattcctctt

SEQ ID NO: 3492664 - DNA, 20 bp, Homo sapiens
taaattcctctttgctttgc

SEQ ID NO: 3492665 - DNA, 14 bp, Homo sapiens
taaattctgattct

SEQ ID NO: 3492666 - DNA, 22 bp, Homo sapiens
taaattgaatcagtataaacaa

SEQ ID NO: 3492667 - DNA, 13 bp, Homo sapiens
taaattgccataa

SEQ ID NO: 3492668 - DNA, 16 bp, Homo sapiens
taaattgccataatat

SEQ ID NO: 3492669 - DNA, 17 bp, Homo sapiens
taaattgctaatgttgc

SEQ ID NO: 3492670 - DNA, 17 bp, Homo sapiens
taaattgtatattcact

SEQ ID NO: 3492671 - DNA, 18 bp, Homo sapiens
taaattgtatattcactt

SEQ ID NO: 3492672 - DNA, 19 bp, Homo sapiens
taaattgtatattcacttt

SEQ ID NO: 3492673 - DNA, 12 bp, Homo sapiens
taaatttattaa

SEQ ID NO: 3492674 - DNA, 16 bp, Homo sapiens
taaatttattaaataa

SEQ ID NO: 3492675 - DNA, 15 bp, Homo sapiens
taacaaatacattca

SEQ ID NO: 3492676 - DNA, 15 bp, Homo sapiens
taacaatattttatc

SEQ ID NO: 3492677 - DNA, 12 bp, Homo sapiens
taacacacagct

SEQ ID NO: 3492678 - DNA, 14 bp, Homo sapiens
taacacacagctcc

SEQ ID NO: 3492679 - DNA, 17 bp, Homo sapiens
taacacacagctcccat

SEQ ID NO: 3492680 - DNA, 15 bp, Homo sapiens
taacagctgaattat

SEQ ID NO: 3492681 - DNA, 19 bp, Homo sapiens
taacaggcagatacaggaa

SEQ ID NO: 3492682 - DNA, 19 bp, Homo sapiens
taacatgaggggacatttt

SEQ ID NO: 3492683 - DNA, 23 bp, Homo sapiens
taacatgaggggacattttggtg

SEQ ID NO: 3492684 - DNA, 13 bp, Homo sapiens
taacatgatgtac

SEQ ID NO: 3492685 - DNA, 14 bp, Homo sapiens
taacatgatgtact

SEQ ID NO: 3492686 - DNA, 15 bp, Homo sapiens
taacatgatgtacta

SEQ ID NO: 3492687 - DNA, 23 bp, Homo sapiens
taacattctattgactttcttaa

SEQ ID NO: 3492688 - DNA, 15 bp, Homo sapiens
taacatttaatttag

SEQ ID NO: 3492689 - DNA, 20 bp, Homo sapiens
taaccactgcaagtcctttt

SEQ ID NO: 3492690 - DNA, 18 bp, Homo sapiens
taacccccactggactga

SEQ ID NO: 3492691 - DNA, 20 bp, Homo sapiens
taaccctggtggttgctgtt

SEQ ID NO: 3492692 - DNA, 16 bp, Homo sapiens
taacctcgccctctcc

SEQ ID NO: 3492693 - DNA, 20 bp, Homo sapiens
taacctctttttaaggacac

SEQ ID NO: 3492694 - DNA, 21 bp, Homo sapiens
taacctctttttaaggacact

SEQ ID NO: 3492695 - DNA, 13 bp, Homo sapiens
taacctttcagaa

SEQ ID NO: 3492696 - DNA, 20 bp, Homo sapiens
taacgataaaagacagtgaa

SEQ ID NO: 3492697 - DNA, 16 bp, Homo sapiens
taacgtgaaacttata

SEQ ID NO: 3492698 - DNA, 15 bp, Homo sapiens
taacgtgcactgtaa

SEQ ID NO: 3492699 - DNA, 17 bp, Homo sapiens
taactactccggagaca

SEQ ID NO: 3492700 - DNA, 17 bp, Homo sapiens
taactagaatttattca

SEQ ID NO: 3492701 - DNA, 17 bp, Homo sapiens
taactattgcccaggtt

SEQ ID NO: 3492702 - DNA, 17 bp, Homo sapiens
taactccctttttacac

SEQ ID NO: 3492703 - DNA, 13 bp, Homo sapiens
taactcttttgga

SEQ ID NO: 3492704 - DNA, 20 bp, Homo sapiens
taactgagtagctctcctga

SEQ ID NO: 3492705 - DNA, 23 bp, Homo sapiens
taactggcagttttccattggtt

SEQ ID NO: 3492706 - DNA, 13 bp, Homo sapiens
taactgtaaatca

SEQ ID NO: 3492707 - DNA, 14 bp, Homo sapiens
taacttcctgtact

SEQ ID NO: 3492708 - DNA, 18 bp, Homo sapiens
taacttcttatggaattg

SEQ ID NO: 3492709 - DNA, 19 bp, Homo sapiens
taacttcttatggaattga

SEQ ID NO: 3492710 - DNA, 19 bp, Homo sapiens
taactttcatgctacagaa

SEQ ID NO: 3492711 - DNA, 13 bp, Homo sapiens
taactttttacat

SEQ ID NO: 3492712 - DNA, 10 bp, Homo sapiens
taagaaaaac

SEQ ID NO: 3492713 - DNA, 21 bp, Homo sapiens
taagaaaaccaccccttagat

SEQ ID NO: 3492714 - DNA, 12 bp, Homo sapiens
taagaaaagatt

SEQ ID NO: 3492715 - DNA, 19 bp, Homo sapiens
taagaaaagattttaatca

SEQ ID NO: 3492716 - DNA, 20 bp, Homo sapiens
taagaaacaactctttgaga

SEQ ID NO: 3492717 - DNA, 20 bp, Homo sapiens
taagaaacacactgaggcag

SEQ ID NO: 3492718 - DNA, 21 bp, Homo sapiens
taagaaacacactgaggcagg

SEQ ID NO: 3492719 - DNA, 23 bp, Homo sapiens
taagaaacacactgaggcaggga

SEQ ID NO: 3492720 - DNA, 23 bp, Homo sapiens
taagaaacctactgcccaggcac

SEQ ID NO: 3492721 - DNA, 17 bp, Homo sapiens
taagaacccctctgctt

SEQ ID NO: 3492722 - DNA, 14 bp, Homo sapiens
taagaacctggaac

SEQ ID NO: 3492723 - DNA, 18 bp, Homo sapiens
taagaaggcaaaaatgta

SEQ ID NO: 3492724 - DNA, 14 bp, Homo sapiens
taagaatgcattat

SEQ ID NO: 3492725 - DNA, 19 bp, Homo sapiens
taagaattttaaatatttt

SEQ ID NO: 3492726 - DNA, 17 bp, Homo sapiens
taagacatgatttcctt

SEQ ID NO: 3492727 - DNA, 18 bp, Homo sapiens
taagaccaccacctcaga

SEQ ID NO: 3492728 - DNA, 13 bp, Homo sapiens
taagacctctgag

SEQ ID NO: 3492729 - DNA, 18 bp, Homo sapiens
taagacctggcagctctg

SEQ ID NO: 3492730 - DNA, 18 bp, Homo sapiens
taagagggcacacactgt

SEQ ID NO: 3492731 - DNA, 18 bp, Homo sapiens
taagatcactgccagaga

SEQ ID NO: 3492732 - DNA, 22 bp, Homo sapiens
taagatgccttgaattgtctag

SEQ ID NO: 3492733 - DNA, 12 bp, Homo sapiens
taagatgtctgt

SEQ ID NO: 3492734 - DNA, 17 bp, Homo sapiens
taagcaaaggggacagc

SEQ ID NO: 3492735 - DNA, 14 bp, Homo sapiens
taagcaacatcttt

SEQ ID NO: 3492736 - DNA, 17 bp, Homo sapiens
taagcagaccactgata

SEQ ID NO: 3492737 - DNA, 20 bp, Homo sapiens
taagcagaccactgataaaa

SEQ ID NO: 3492738 - DNA, 13 bp, Homo sapiens
taagcagaggagg

SEQ ID NO: 3492739 - DNA, 15 bp, Homo sapiens
taagcagaggagggg

SEQ ID NO: 3492740 - DNA, 19 bp, Homo sapiens
taagccacttaaaatgttc

SEQ ID NO: 3492741 - DNA, 22 bp, Homo sapiens
gtgctgccatccaggttcagct

SEQ ID NO: 3492742 - DNA, 19 bp, Homo sapiens
gtgctgcctctacctgaca

SEQ ID NO: 3492743 - DNA, 17 bp, Homo sapiens
gtgctgggagaaatact

SEQ ID NO: 3492744 - DNA, 22 bp, Homo sapiens
gtgctgggagctccactctgct

SEQ ID NO: 3492745 - DNA, 16 bp, Homo sapiens
gtgctgtataaaatca

SEQ ID NO: 3492746 - DNA, 17 bp, Homo sapiens
gtgctgtataaaatcag

SEQ ID NO: 3492747 - DNA, 13 bp, Homo sapiens
gtgcttccttgta

SEQ ID NO: 3492748 - DNA, 14 bp, Homo sapiens
gtgcttcgggccct

SEQ ID NO: 3492749 - DNA, 15 bp, Homo sapiens
gtgcttgaaggccct

SEQ ID NO: 3492750 - DNA, 20 bp, Homo sapiens
gtgcttgaaggccctgctga

SEQ ID NO: 3492751 - DNA, 18 bp, Homo sapiens
gtgcttgatagaaatgcc

SEQ ID NO: 3492752 - DNA, 16 bp, Homo sapiens
gtgcttgccacagagc

SEQ ID NO: 3492753 - DNA, 21 bp, Homo sapiens
gtgcttgtttgctcacctggg

SEQ ID NO: 3492754 - DNA, 22 bp, Homo sapiens
gtgcttgtttgctcacctgggg

SEQ ID NO: 3492755 - DNA, 13 bp, Homo sapiens
gtgctttatattt

SEQ ID NO: 3492756 - DNA, 14 bp, Homo sapiens
gtgctttatgctga

SEQ ID NO: 3492757 - DNA, 22 bp, Homo sapiens
gtggaaaaactgagacaggcag

SEQ ID NO: 3492758 - DNA, 18 bp, Homo sapiens
gtggaaaaatagcctgcc

SEQ ID NO: 3492759 - DNA, 18 bp, Homo sapiens
gtggaaatgcgcatgagt

SEQ ID NO: 3492760 - DNA, 16 bp, Homo sapiens
gtggaaggaccctgtg

SEQ ID NO: 3492761 - DNA, 21 bp, Homo sapiens
gtggaaggaccctgtgccctc

SEQ ID NO: 3492762 - DNA, 21 bp, Homo sapiens
gtggaaggcattgtcctgtga

SEQ ID NO: 3492763 - DNA, 18 bp, Homo sapiens
gtggacacagctcttctc

SEQ ID NO: 3492764 - DNA, 23 bp, Homo sapiens
gtggacacagctcttctccaggc

SEQ ID NO: 3492765 - DNA, 24 bp, Homo sapiens
gtggacacagctcttctccaggct

SEQ ID NO: 3492766 - DNA, 22 bp, Homo sapiens
gtggacagtctgctctagatga

SEQ ID NO: 3492767 - DNA, 19 bp, Homo sapiens
gtggacccagcgggcaggt

SEQ ID NO: 3492768 - DNA, 15 bp, Homo sapiens
gtggactaaaagata

SEQ ID NO: 3492769 - DNA, 23 bp, Homo sapiens
gtggactaaaagatataagtgct

SEQ ID NO: 3492770 - DNA, 16 bp, Homo sapiens
gtggagaactcctagg

SEQ ID NO: 3492771 - DNA, 22 bp, Homo sapiens
gtggagaagccacaggcctgag

SEQ ID NO: 3492772 - DNA, 12 bp, Homo sapiens
gtggagatgccc

SEQ ID NO: 3492773 - DNA, 22 bp, Homo sapiens
gtggaggattgctgccagagaa

SEQ ID NO: 3492774 - DNA, 23 bp, Homo sapiens
gtggagggacaagtggactcagg

SEQ ID NO: 3492775 - DNA, 23 bp, Homo sapiens
gtggagggcacattccttgcctg

SEQ ID NO: 3492776 - DNA, 20 bp, Homo sapiens
gtggagtccgccaaaggccc

SEQ ID NO: 3492777 - DNA, 17 bp, Homo sapiens
gtggagtgcagtggtgc

SEQ ID NO: 3492778 - DNA, 21 bp, Homo sapiens
gtggatcagagatgcaccacc

SEQ ID NO: 3492779 - DNA, 15 bp, Homo sapiens
gtggatgatgtttcg

SEQ ID NO: 3492780 - DNA, 21 bp, Homo sapiens
gtggatgcctggtggcagctg

SEQ ID NO: 3492781 - DNA, 22 bp, Homo sapiens
gtggcacattcctttgggtatg

SEQ ID NO: 3492782 - DNA, 12 bp, Homo sapiens
gtggcactgcca

SEQ ID NO: 3492783 - DNA, 21 bp, Homo sapiens
gtggcagctgcggtccaccca

SEQ ID NO: 3492784 - DNA, 22 bp, Homo sapiens
gtggcagctgcggtccacccag

SEQ ID NO: 3492785 - DNA, 18 bp, Homo sapiens
gtggcaggggacaggagt

SEQ ID NO: 3492786 - DNA, 16 bp, Homo sapiens
gtggcagtgggagctg

SEQ ID NO: 3492787 - DNA, 14 bp, Homo sapiens
gtggcatcacctta

SEQ ID NO: 3492788 - DNA, 21 bp, Homo sapiens
gtggcatgtccacgtgtgtgt

SEQ ID NO: 3492789 - DNA, 19 bp, Homo sapiens
gtggccatggcctctgcaa

SEQ ID NO: 3492790 - DNA, 21 bp, Homo sapiens
gtggccccaccctgggccctg

SEQ ID NO: 3492791 - DNA, 23 bp, Homo sapiens
gtggccccaccctgggccctggg

SEQ ID NO: 3492792 - DNA, 23 bp, Homo sapiens
gtggccccgtttctggtggtctg

SEQ ID NO: 3492793 - DNA, 19 bp, Homo sapiens
gtggccctgtcctgccatg

SEQ ID NO: 3492794 - DNA, 22 bp, Homo sapiens
gtggcctctccttgtggcctgg

SEQ ID NO: 3492795 - DNA, 13 bp, Homo sapiens
gtggcctctttgt

SEQ ID NO: 3492796 - DNA, 15 bp, Homo sapiens
gtggcctggtccctg

SEQ ID NO: 3492797 - DNA, 13 bp, Homo sapiens
gtggcctgtgtgg

SEQ ID NO: 3492798 - DNA, 20 bp, Homo sapiens
gtggcgactctatagactct

SEQ ID NO: 3492799 - DNA, 15 bp, Homo sapiens
gtggctcagccagca

SEQ ID NO: 3492800 - DNA, 15 bp, Homo sapiens
gtggctcctcccagc

SEQ ID NO: 3492801 - DNA, 17 bp, Homo sapiens
gtggctgagcccctgtc

SEQ ID NO: 3492802 - DNA, 20 bp, Homo sapiens
gtggctgcctcatttagaga

SEQ ID NO: 3492803 - DNA, 13 bp, Homo sapiens
gtggctgctgccc

SEQ ID NO: 3492804 - DNA, 15 bp, Homo sapiens
gtggctgctgcccag

SEQ ID NO: 3492805 - DNA, 20 bp, Homo sapiens
gtggctggaagatcctgcgg

SEQ ID NO: 3492806 - DNA, 21 bp, Homo sapiens
gtggctgggtccaggggatgg

SEQ ID NO: 3492807 - DNA, 15 bp, Homo sapiens
gtggctgtctggaaa

SEQ ID NO: 3492808 - DNA, 22 bp, Homo sapiens
gtggcttgagaaatatggacac

SEQ ID NO: 3492809 - DNA, 14 bp, Homo sapiens
gtgggaactggagg

SEQ ID NO: 3492810 - DNA, 13 bp, Homo sapiens
gtgggaaggccag

SEQ ID NO: 3492811 - DNA, 14 bp, Homo sapiens
gtgggaaggccagc

SEQ ID NO: 3492812 - DNA, 19 bp, Homo sapiens
gtgggaggcaaatgggatg

SEQ ID NO: 3492813 - DNA, 15 bp, Homo sapiens
gtgggagtcatctca

SEQ ID NO: 3492814 - DNA, 17 bp, Homo sapiens
gtgggcaaacaggcagt

SEQ ID NO: 3492815 - DNA, 13 bp, Homo sapiens
gtgggcaggaaaa

SEQ ID NO: 3492816 - DNA, 14 bp, Homo sapiens
gtgggcaggaaaag

SEQ ID NO: 3492817 - DNA, 17 bp, Homo sapiens
gtgggccaacaaagaac

SEQ ID NO: 3492818 - DNA, 16 bp, Homo sapiens
gtgggccagtctgtgg

SEQ ID NO: 3492819 - DNA, 15 bp, Homo sapiens
gtgggctccctgact

SEQ ID NO: 3492820 - DNA, 20 bp, Homo sapiens
gtgggctgggccctctcttc

SEQ ID NO: 3492821 - DNA, 17 bp, Homo sapiens
gtggggcagcttgaggg

SEQ ID NO: 3492822 - DNA, 12 bp, Homo sapiens
gtggggctgagc

SEQ ID NO: 3492823 - DNA, 18 bp, Homo sapiens
gtggggctgagctgggga

SEQ ID NO: 3492824 - DNA, 12 bp, Homo sapiens
gtggggcttggg

SEQ ID NO: 3492825 - DNA, 20 bp, Homo sapiens
gtgggggatcacagcctctg

SEQ ID NO: 3492826 - DNA, 15 bp, Homo sapiens
gtgggggtgggtcag

SEQ ID NO: 3492827 - DNA, 18 bp, Homo sapiens
gtgggggttgctgtataa

SEQ ID NO: 3492828 - DNA, 21 bp, Homo sapiens
gtggggtcatgccctcctctc

SEQ ID NO: 3492829 - DNA, 13 bp, Homo sapiens
gtggggtgtgctg

SEQ ID NO: 3492830 - DNA, 22 bp, Homo sapiens
gtggggtttcgcagcctgagtc

SEQ ID NO: 3492831 - DNA, 16 bp, Homo sapiens
gtgggtataaaagatg

SEQ ID NO: 3492832 - DNA, 9 bp, Homo sapiens
gtgggtcag

SEQ ID NO: 3492833 - DNA, 22 bp, Homo sapiens
gtgggtccatgggcagagccca

SEQ ID NO: 3492834 - DNA, 14 bp, Homo sapiens
gtgggtctctggaa

SEQ ID NO: 3492835 - DNA, 18 bp, Homo sapiens
gtgggtgtcctgcctgtc

SEQ ID NO: 3492836 - DNA, 12 bp, Homo sapiens
gtgggtgtgtga

SEQ ID NO: 3492837 - DNA, 17 bp, Homo sapiens
gtggtagagtgtgcctg

SEQ ID NO: 3492838 - DNA, 23 bp, Homo sapiens
gtggtaggtactttttgtgaaga

SEQ ID NO: 3492839 - DNA, 14 bp, Homo sapiens
gtggtatgtctgcc

SEQ ID NO: 3492840 - DNA, 15 bp, Homo sapiens
gtggtatgtctgcca

SEQ ID NO: 3492841 - DNA, 12 bp, Homo sapiens
gtggtctaaagt

SEQ ID NO: 3492842 - DNA, 16 bp, Homo sapiens
gtggtctgcaggcagg

SEQ ID NO: 3492843 - DNA, 20 bp, Homo sapiens
gtggtctgttggcaggctgg

SEQ ID NO: 3492844 - DNA, 18 bp, Homo sapiens
gtggtgccatcattgctg

SEQ ID NO: 3492845 - DNA, 23 bp, Homo sapiens
gtggtgccatcattgctgtctgc

SEQ ID NO: 3492846 - DNA, 22 bp, Homo sapiens
gtggtggagccagtaaacagag

SEQ ID NO: 3492847 - DNA, 14 bp, Homo sapiens
gtggtgggaatcag

SEQ ID NO: 3492848 - DNA, 19 bp, Homo sapiens
gtggtggtaaccctggtgg

SEQ ID NO: 3492849 - DNA, 14 bp, Homo sapiens
gtggtgtggagaag

SEQ ID NO: 3492850 - DNA, 20 bp, Homo sapiens
gtggtgtttcctgcaggcca

SEQ ID NO: 3492851 - DNA, 17 bp, Homo sapiens
tgcattttcaccccacc

SEQ ID NO: 3492852 - DNA, 17 bp, Homo sapiens
tgcatttttctgcagaa

SEQ ID NO: 3492853 - DNA, 19 bp, Homo sapiens
tgccaaaaaggatacataa

SEQ ID NO: 3492854 - DNA, 21 bp, Homo sapiens
tgccaaaaaggatacataatg

SEQ ID NO: 3492855 - DNA, 18 bp, Homo sapiens
tgccaaatataaataaaa

SEQ ID NO: 3492856 - DNA, 20 bp, Homo sapiens
tgccaacaatcctagtgctt

SEQ ID NO: 3492857 - DNA, 21 bp, Homo sapiens
tgccaacaatcctagtgcttt

SEQ ID NO: 3492858 - DNA, 22 bp, Homo sapiens
tgccaacactcaagaagcaggc

SEQ ID NO: 3492859 - DNA, 17 bp, Homo sapiens
tgccaacctattttgaa

SEQ ID NO: 3492860 - DNA, 21 bp, Homo sapiens
tgccaacttcttcagagctga

SEQ ID NO: 3492861 - DNA, 15 bp, Homo sapiens
tgccaagcactgtgc

SEQ ID NO: 3492862 - DNA, 16 bp, Homo sapiens
tgccaagctccaagcc

SEQ ID NO: 3492863 - DNA, 18 bp, Homo sapiens
tgccaatattaaatctgc

SEQ ID NO: 3492864 - DNA, 21 bp, Homo sapiens
tgccaatattaaatctgctgg

SEQ ID NO: 3492865 - DNA, 16 bp, Homo sapiens
tgccacaaggacttcc

SEQ ID NO: 3492866 - DNA, 19 bp, Homo sapiens
tgccacaaggacttcctgt

SEQ ID NO: 3492867 - DNA, 18 bp, Homo sapiens
tgccacaatgcagttctg

SEQ ID NO: 3492868 - DNA, 22 bp, Homo sapiens
tgccacacaaggatagatgctg

SEQ ID NO: 3492869 - DNA, 16 bp, Homo sapiens
tgccacagagcgggga

SEQ ID NO: 3492870 - DNA, 13 bp, Homo sapiens
tgccacagcctcc

SEQ ID NO: 3492871 - DNA, 13 bp, Homo sapiens
tgccacaggacac

SEQ ID NO: 3492872 - DNA, 14 bp, Homo sapiens
tgccacaggacaca

SEQ ID NO: 3492873 - DNA, 14 bp, Homo sapiens
tgccaccaccctgt

SEQ ID NO: 3492874 - DNA, 20 bp, Homo sapiens
tgccaccaccctgtcttcct

SEQ ID NO: 3492875 - DNA, 18 bp, Homo sapiens
tgccaccactataaaatg

SEQ ID NO: 3492876 - DNA, 15 bp, Homo sapiens
tgccaccagcatcca

SEQ ID NO: 3492877 - DNA, 13 bp, Homo sapiens
tgccaccaggcca

SEQ ID NO: 3492878 - DNA, 17 bp, Homo sapiens
tgccaccaggccacctc

SEQ ID NO: 3492879 - DNA, 18 bp, Homo sapiens
tgccaccaggccacctcc

SEQ ID NO: 3492880 - DNA, 18 bp, Homo sapiens
tgccaccatggccagcca

SEQ ID NO: 3492881 - DNA, 17 bp, Homo sapiens
tgccacccacctccctg

SEQ ID NO: 3492882 - DNA, 20 bp, Homo sapiens
tgccacccacctccctgcct

SEQ ID NO: 3492883 - DNA, 22 bp, Homo sapiens
tgccacccacctccctgcctcc

SEQ ID NO: 3492884 - DNA, 20 bp, Homo sapiens
tgccacccctaaactccagg

SEQ ID NO: 3492885 - DNA, 14 bp, Homo sapiens
tgccacctcctgcc

SEQ ID NO: 3492886 - DNA, 22 bp, Homo sapiens
tgccactacggaatagttggct

SEQ ID NO: 3492887 - DNA, 13 bp, Homo sapiens
tgccactcactag

SEQ ID NO: 3492888 - DNA, 14 bp, Homo sapiens
tgccactcactagg

SEQ ID NO: 3492889 - DNA, 20 bp, Homo sapiens
tgccactcactaggccccca

SEQ ID NO: 3492890 - DNA, 21 bp, Homo sapiens
tgccactcactaggcccccac

SEQ ID NO: 3492891 - DNA, 22 bp, Homo sapiens
tgccactcactaggcccccact

SEQ ID NO: 3492892 - DNA, 18 bp, Homo sapiens
tgccactccagtcctgcc

SEQ ID NO: 3492893 - DNA, 15 bp, Homo sapiens
tgccactcctccctc

SEQ ID NO: 3492894 - DNA, 19 bp, Homo sapiens
tgccactgccttcgcttct

SEQ ID NO: 3492895 - DNA, 15 bp, Homo sapiens
tgccagagataaact

SEQ ID NO: 3492896 - DNA, 22 bp, Homo sapiens
tgatccacccacctcagcctcc

SEQ ID NO: 3492897 - DNA, 23 bp, Homo sapiens
tgatccataaagacaatcactgc

SEQ ID NO: 3492898 - DNA, 16 bp, Homo sapiens
tgatccatccagcttg

SEQ ID NO: 3492899 - DNA, 19 bp, Homo sapiens
tgatccatccagcttgcca

SEQ ID NO: 3492900 - DNA, 14 bp, Homo sapiens
tgatccctctgggg

SEQ ID NO: 3492901 - DNA, 15 bp, Homo sapiens
tgatcctcccacctc

SEQ ID NO: 3492902 - DNA, 16 bp, Homo sapiens
tgatcctcccacctca

SEQ ID NO: 3492903 - DNA, 20 bp, Homo sapiens
tgatcctcccacctcagcct

SEQ ID NO: 3492904 - DNA, 14 bp, Homo sapiens
tgatcctctcacct

SEQ ID NO: 3492905 - DNA, 15 bp, Homo sapiens
tgatcctggaggccc

SEQ ID NO: 3492906 - DNA, 17 bp, Homo sapiens
tgatcctggaggcccag

SEQ ID NO: 3492907 - DNA, 20 bp, Homo sapiens
tgatcctgtattcagacaga

SEQ ID NO: 3492908 - DNA, 21 bp, Homo sapiens
tgatcctgtattcagacagat

SEQ ID NO: 3492909 - DNA, 14 bp, Homo sapiens
tgatcctgtgaagt

SEQ ID NO: 3492910 - DNA, 21 bp, Homo sapiens
tgatctaccttgaattgatat

SEQ ID NO: 3492911 - DNA, 14 bp, Homo sapiens
tgatctcaggagct

SEQ ID NO: 3492912 - DNA, 14 bp, Homo sapiens
tgatctggaaccca

SEQ ID NO: 3492913 - DNA, 18 bp, Homo sapiens
tgatctttgcagacaggc

SEQ ID NO: 3492914 - DNA, 20 bp, Homo sapiens
tgatctttgcagacaggcaa

SEQ ID NO: 3492915 - DNA, 12 bp, Homo sapiens
tgatcttttaag

SEQ ID NO: 3492916 - DNA, 22 bp, Homo sapiens
tgatcttttaagtttccttccc

SEQ ID NO: 3492917 - DNA, 18 bp, Homo sapiens
tgatgacaaaaaatgttt

SEQ ID NO: 3492918 - DNA, 13 bp, Homo sapiens
tgatgaggtattt

SEQ ID NO: 3492919 - DNA, 16 bp, Homo sapiens
tgatgaggtatttttt

SEQ ID NO: 3492920 - DNA, 19 bp, Homo sapiens
tgatgaggtattttttcct

SEQ ID NO: 3492921 - DNA, 20 bp, Homo sapiens
tgatgatcctaggcatttgc

SEQ ID NO: 3492922 - DNA, 20 bp, Homo sapiens
tgatgatctttgcagacagg

SEQ ID NO: 3492923 - DNA, 22 bp, Homo sapiens
tgatgatctttgcagacaggca

SEQ ID NO: 3492924 - DNA, 19 bp, Homo sapiens
tgatgcaggatttgttctc

SEQ ID NO: 3492925 - DNA, 13 bp, Homo sapiens
tgatgcatgtctt

SEQ ID NO: 3492926 - DNA, 14 bp, Homo sapiens
tgatgccctgccct

SEQ ID NO: 3492927 - DNA, 21 bp, Homo sapiens
tgatgcctctgtcttctggac

SEQ ID NO: 3492928 - DNA, 23 bp, Homo sapiens
tgatgctacaggatttgaaattg

SEQ ID NO: 3492929 - DNA, 15 bp, Homo sapiens
tgatgctgcccctca

SEQ ID NO: 3492930 - DNA, 20 bp, Homo sapiens
tgatgctgccggcacagctg

SEQ ID NO: 3492931 - DNA, 23 bp, Homo sapiens
tgatgctgccggcacagctggga

SEQ ID NO: 3492932 - DNA, 16 bp, Homo sapiens
tgatgcttacatctgg

SEQ ID NO: 3492933 - DNA, 16 bp, Homo sapiens
tgatggcaacagatct

SEQ ID NO: 3492934 - DNA, 17 bp, Homo sapiens
tgatgggattctggaca

SEQ ID NO: 3492935 - DNA, 21 bp, Homo sapiens
tgatgggcaacccccagcctg

SEQ ID NO: 3492936 - DNA, 22 bp, Homo sapiens
tgatgtaatcttgaattgtaac

SEQ ID NO: 3492937 - DNA, 17 bp, Homo sapiens
tgatgtacacattttgt

SEQ ID NO: 3492938 - DNA, 17 bp, Homo sapiens
tgatgtactaaagtaga

SEQ ID NO: 3492939 - DNA, 18 bp, Homo sapiens
tgatgtcaatttctgtgt

SEQ ID NO: 3492940 - DNA, 23 bp, Homo sapiens
tgatgtcaatttctgtgttgcca

SEQ ID NO: 3492941 - DNA, 14 bp, Homo sapiens
tgatgtgaagccaa

SEQ ID NO: 3492942 - DNA, 22 bp, Homo sapiens
tgatgtgaagccaattcagaca

SEQ ID NO: 3492943 - DNA, 20 bp, Homo sapiens
tgatgttaactttgtggtct

SEQ ID NO: 3492944 - DNA, 17 bp, Homo sapiens
tgatgtttagaaaagta

SEQ ID NO: 3492945 - DNA, 15 bp, Homo sapiens
tgatgtttgcccaaa

SEQ ID NO: 3492946 - DNA, 18 bp, Homo sapiens
tgattaaatatttgaaga

SEQ ID NO: 3492947 - DNA, 24 bp, Homo sapiens
tgattactgtcaaggctgcttaga

SEQ ID NO: 3492948 - DNA, 13 bp, Homo sapiens
tgattatatgtca

SEQ ID NO: 3492949 - DNA, 14 bp, Homo sapiens
tgattattcagtgt

SEQ ID NO: 3492950 - DNA, 16 bp, Homo sapiens
tgattattcagtgtca

SEQ ID NO: 3492951 - DNA, 19 bp, Homo sapiens
tgattcaaaatatttaaaa

SEQ ID NO: 3492952 - DNA, 23 bp, Homo sapiens
tgattcaaaatatttaaaaatgt

SEQ ID NO: 3492953 - DNA, 21 bp, Homo sapiens
tgattcaagccattccaaagt

SEQ ID NO: 3492954 - DNA, 21 bp, Homo sapiens
tgattcaattcaacactccct

SEQ ID NO: 3492955 - DNA, 13 bp, Homo sapiens
tgattcagctctg

SEQ ID NO: 3492956 - DNA, 12 bp, Homo sapiens
tgattcagtgtt

SEQ ID NO: 3492957 - DNA, 17 bp, Homo sapiens
tgagcagggctcagcgg

SEQ ID NO: 3492958 - DNA, 20 bp, Homo sapiens
tgagcagggctcagcgggga

SEQ ID NO: 3492959 - DNA, 22 bp, Homo sapiens
tgagcagggctcagcggggaca

SEQ ID NO: 3492960 - DNA, 14 bp, Homo sapiens
tgagcatcacagaa

SEQ ID NO: 3492961 - DNA, 16 bp, Homo sapiens
tgagcatggagctggc

SEQ ID NO: 3492962 - DNA, 18 bp, Homo sapiens
tgagccacctgccctttt

SEQ ID NO: 3492963 - DNA, 13 bp, Homo sapiens
tgagccactgcac

SEQ ID NO: 3492964 - DNA, 14 bp, Homo sapiens
tgagccactgcacc

SEQ ID NO: 3492965 - DNA, 12 bp, Homo sapiens
tgagccccatct

SEQ ID NO: 3492966 - DNA, 14 bp, Homo sapiens
tgagccccatcttc

SEQ ID NO: 3492967 - DNA, 21 bp, Homo sapiens
tgagccccatcttcacccagg

SEQ ID NO: 3492968 - DNA, 21 bp, Homo sapiens
tgagcccctgtctagagaggg

SEQ ID NO: 3492969 - DNA, 22 bp, Homo sapiens
tgagccctcagaacccttggct

SEQ ID NO: 3492970 - DNA, 19 bp, Homo sapiens
tgagccgagatcacgccac

SEQ ID NO: 3492971 - DNA, 22 bp, Homo sapiens
tgagccgagatcacgccactgc

SEQ ID NO: 3492972 - DNA, 15 bp, Homo sapiens
tgagcctcagcatcc

SEQ ID NO: 3492973 - DNA, 17 bp, Homo sapiens
tgagcctcagcatcctg

SEQ ID NO: 3492974 - DNA, 21 bp, Homo sapiens
tgagcctcagcatcctggcac

SEQ ID NO: 3492975 - DNA, 22 bp, Homo sapiens
tgagcctcagcatcctggcacc

SEQ ID NO: 3492976 - DNA, 12 bp, Homo sapiens
tgagcctctgct

SEQ ID NO: 3492977 - DNA, 10 bp, Homo sapiens
tgagcctggc

SEQ ID NO: 3492978 - DNA, 16 bp, Homo sapiens
tgagcctggcaagaat

SEQ ID NO: 3492979 - DNA, 22 bp, Homo sapiens
tgagcgaggagatgctccttgg

SEQ ID NO: 3492980 - DNA, 18 bp, Homo sapiens
tgagcgcctccatccaag

SEQ ID NO: 3492981 - DNA, 20 bp, Homo sapiens
tgagcgcctccatccaaggc

SEQ ID NO: 3492982 - DNA, 21 bp, Homo sapiens
tgagcggtgctgtcctcaggt

SEQ ID NO: 3492983 - DNA, 21 bp, Homo sapiens
tgagctactgccgtcagtgct

SEQ ID NO: 3492984 - DNA, 23 bp, Homo sapiens
tgagctcccaggtgcagccagag

SEQ ID NO: 3492985 - DNA, 17 bp, Homo sapiens
tgagctctacccagggc

SEQ ID NO: 3492986 - DNA, 22 bp, Homo sapiens
tgagctctacccagggcctgca

SEQ ID NO: 3492987 - DNA, 22 bp, Homo sapiens
tgagctcttgtgaggaaagtca

SEQ ID NO: 3492988 - DNA, 23 bp, Homo sapiens
tgagctcttgtgaggaaagtcat

SEQ ID NO: 3492989 - DNA, 13 bp, Homo sapiens
tgagctgcttcac

SEQ ID NO: 3492990 - DNA, 19 bp, Homo sapiens
tgagctgcttcactaggga

SEQ ID NO: 3492991 - DNA, 11 bp, Homo sapiens
tgagctgtttt

SEQ ID NO: 3492992 - DNA, 16 bp, Homo sapiens
tgaggaaaataatgta

SEQ ID NO: 3492993 - DNA, 16 bp, Homo sapiens
tgaggaaacaacagct

SEQ ID NO: 3492994 - DNA, 18 bp, Homo sapiens
tgaggaaaggccagctgg

SEQ ID NO: 3492995 - DNA, 15 bp, Homo sapiens
tgaggaaagtcattg

SEQ ID NO: 3492996 - DNA, 17 bp, Homo sapiens
tgaggaaagtcattggc

SEQ ID NO: 3492997 - DNA, 19 bp, Homo sapiens
tgaggaaagtcattggctt

SEQ ID NO: 3492998 - DNA, 22 bp, Homo sapiens
tgaggaaagtcattggctttat

SEQ ID NO: 3492999 - DNA, 23 bp, Homo sapiens
tgaggaagaacggggctcttctc

SEQ ID NO: 3493000 - DNA, 17 bp, Homo sapiens
tgaggagagaaaatata

SEQ ID NO: 3493001 - DNA, 19 bp, Homo sapiens
tgaggagagagacagagag

SEQ ID NO: 3493002 - DNA, 20 bp, Homo sapiens
tgaggagccccatctgtcta

SEQ ID NO: 3493003 - DNA, 13 bp, Homo sapiens
tgaggataacttt

SEQ ID NO: 3493004 - DNA, 17 bp, Homo sapiens
tgaggatgtcactcaga

SEQ ID NO: 3493005 - DNA, 14 bp, Homo sapiens
tgaggcaagagaat

SEQ ID NO: 3493006 - DNA, 21 bp, Homo sapiens
tgaggcagcagtgtgaggcca

SEQ ID NO: 3493007 - DNA, 13 bp, Homo sapiens
tgaggcagggaag

SEQ ID NO: 3493008 - DNA, 22 bp, Homo sapiens
tgaggcagggaagtccccaggc

SEQ ID NO: 3493009 - DNA, 14 bp, Homo sapiens
tgaggccagggcag

SEQ ID NO: 3493010 - DNA, 12 bp, Homo sapiens
tgaggcctgggc

SEQ ID NO: 3493011 - DNA, 22 bp, Homo sapiens
tgaggcctgggccgctgccacg

SEQ ID NO: 3493012 - DNA, 19 bp, Homo sapiens
tgaggctttccatgggacc

SEQ ID NO: 3493013 - DNA, 13 bp, Homo sapiens
tgaggctttggat

SEQ ID NO: 3493014 - DNA, 18 bp, Homo sapiens
tgaggctttggatttgac

SEQ ID NO: 3493015 - DNA, 15 bp, Homo sapiens
tgagggcctgctgga

SEQ ID NO: 3493016 - DNA, 18 bp, Homo sapiens
tgagggcctgctggaggc

SEQ ID NO: 3493017 - DNA, 13 bp, Homo sapiens
tgagggccttctt

SEQ ID NO: 3493018 - DNA, 16 bp, Homo sapiens
tgaggggagaggagac

SEQ ID NO: 3493019 - DNA, 20 bp, Homo sapiens
tgagggtcattctttattct

SEQ ID NO: 3493020 - DNA, 19 bp, Homo sapiens
tgagggtgcccttttccag

SEQ ID NO: 3493021 - DNA, 20 bp, Homo sapiens
tgagggtgcccttttccagc

SEQ ID NO: 3493022 - DNA, 20 bp, Homo sapiens
tgagggttgggctggtgtca

SEQ ID NO: 3493023 - DNA, 13 bp, Homo sapiens
tgaggtcactgct

SEQ ID NO: 3493024 - DNA, 19 bp, Homo sapiens
tgaggtcagagcctgcagt

SEQ ID NO: 3493025 - DNA, 21 bp, Homo sapiens
tgagtatctcctcgcaagctg

SEQ ID NO: 3493026 - DNA, 21 bp, Homo sapiens
tcttttacctgctgcttctcc

SEQ ID NO: 3493027 - DNA, 14 bp, Homo sapiens
tcttttactgggtt

SEQ ID NO: 3493028 - DNA, 14 bp, Homo sapiens
tcttttatatttgt

SEQ ID NO: 3493029 - DNA, 16 bp, Homo sapiens
tcttttcacagcaaca

SEQ ID NO: 3493030 - DNA, 20 bp, Homo sapiens
tcttttcacagcaacatttt

SEQ ID NO: 3493031 - DNA, 17 bp, Homo sapiens
tcttttcccctttcctg

SEQ ID NO: 3493032 - DNA, 14 bp, Homo sapiens
tcttttgaattgtt

SEQ ID NO: 3493033 - DNA, 16 bp, Homo sapiens
tcttttgattatgttt

SEQ ID NO: 3493034 - DNA, 15 bp, Homo sapiens
tcttttgtaatttaa

SEQ ID NO: 3493035 - DNA, 17 bp, Homo sapiens
tcttttgtatgtaaatg

SEQ ID NO: 3493036 - DNA, 15 bp, Homo sapiens
tctttttaaggacac

SEQ ID NO: 3493037 - DNA, 22 bp, Homo sapiens
tctttttaaggacactggggtc

SEQ ID NO: 3493038 - DNA, 15 bp, Homo sapiens
tctttttgttgtaaa

SEQ ID NO: 3493039 - DNA, 16 bp, Homo sapiens
tctttttgttgtaaaa

SEQ ID NO: 3493040 - DNA, 18 bp, Homo sapiens
tgaaaaaatgtatatgca

SEQ ID NO: 3493041 - DNA, 23 bp, Homo sapiens
tgaaaaactggcaacattccaag

SEQ ID NO: 3493042 - DNA, 13 bp, Homo sapiens
tgaaaacccagac

SEQ ID NO: 3493043 - DNA, 20 bp, Homo sapiens
tgaaaagaaaaatgagcctg

SEQ ID NO: 3493044 - DNA, 22 bp, Homo sapiens
tgaaaagaaaaatgagcctggc

SEQ ID NO: 3493045 - DNA, 14 bp, Homo sapiens
tgaaaagtcaaact

SEQ ID NO: 3493046 - DNA, 16 bp, Homo sapiens
tgaaaataagaataga

SEQ ID NO: 3493047 - DNA, 15 bp, Homo sapiens
tgaaacaacttggaa

SEQ ID NO: 3493048 - DNA, 20 bp, Homo sapiens
tgaaacacaaacaatagtaa

SEQ ID NO: 3493049 - DNA, 15 bp, Homo sapiens
tgaaacagaaaaata

SEQ ID NO: 3493050 - DNA, 16 bp, Homo sapiens
tgaaacagctgcctta

SEQ ID NO: 3493051 - DNA, 21 bp, Homo sapiens
tgaaaccctggaccagtggtc

SEQ ID NO: 3493052 - DNA, 16 bp, Homo sapiens
tgaaacctacacactg

SEQ ID NO: 3493053 - DNA, 21 bp, Homo sapiens
tgaaactccaccttgcgggga

SEQ ID NO: 3493054 - DNA, 21 bp, Homo sapiens
tgaaactttgaggataacttt

SEQ ID NO: 3493055 - DNA, 13 bp, Homo sapiens
tgaaagaaaataa

SEQ ID NO: 3493056 - DNA, 15 bp, Homo sapiens
tgaaagactgaagaa

SEQ ID NO: 3493057 - DNA, 22 bp, Homo sapiens
tgaaagaggacgtgttacccac

SEQ ID NO: 3493058 - DNA, 18 bp, Homo sapiens
tgaaagccctgagctttc

SEQ ID NO: 3493059 - DNA, 16 bp, Homo sapiens
tgaaagcggctgcctc

SEQ ID NO: 3493060 - DNA, 11 bp, Homo sapiens
tgaaagctgtg

SEQ ID NO: 3493061 - DNA, 16 bp, Homo sapiens
tgaaaggaacattttt

SEQ ID NO: 3493062 - DNA, 22 bp, Homo sapiens
tgaaaggagagcatcggcctag

SEQ ID NO: 3493063 - DNA, 14 bp, Homo sapiens
tgaaaggagccctt

SEQ ID NO: 3493064 - DNA, 17 bp, Homo sapiens
tgaaagggcccagagag

SEQ ID NO: 3493065 - DNA, 18 bp, Homo sapiens
tgaaagtccagaaactgt

SEQ ID NO: 3493066 - DNA, 17 bp, Homo sapiens
tgaaagtgacagagacc

SEQ ID NO: 3493067 - DNA, 14 bp, Homo sapiens
tgaaagttgccatt

SEQ ID NO: 3493068 - DNA, 15 bp, Homo sapiens
tcttcaaggcttcag

SEQ ID NO: 3493069 - DNA, 21 bp, Homo sapiens
tcttcacctgattcaactaaa

SEQ ID NO: 3493070 - DNA, 12 bp, Homo sapiens
tcttcagagctg

SEQ ID NO: 3493071 - DNA, 23 bp, Homo sapiens
tcttcagagtttgtcatatactg

SEQ ID NO: 3493072 - DNA, 13 bp, Homo sapiens
tcttcagggcctg

SEQ ID NO: 3493073 - DNA, 15 bp, Homo sapiens
tcttcagttaattct

SEQ ID NO: 3493074 - DNA, 16 bp, Homo sapiens
tcttcagtttaatgca

SEQ ID NO: 3493075 - DNA, 18 bp, Homo sapiens
tcttcatctaatatgata

SEQ ID NO: 3493076 - DNA, 16 bp, Homo sapiens
tcttcatctgcccaac

SEQ ID NO: 3493077 - DNA, 19 bp, Homo sapiens
tcttcatgtctattccatt

SEQ ID NO: 3493078 - DNA, 17 bp, Homo sapiens
tcttccacaaagaaaat

SEQ ID NO: 3493079 - DNA, 17 bp, Homo sapiens
tcttcccgaaccccaag

SEQ ID NO: 3493080 - DNA, 16 bp, Homo sapiens
tcttccctctctgcag

SEQ ID NO: 3493081 - DNA, 22 bp, Homo sapiens
tcttcccttttacatactgctg

SEQ ID NO: 3493082 - DNA, 15 bp, Homo sapiens
tcttccgggcagaaa

SEQ ID NO: 3493083 - DNA, 18 bp, Homo sapiens
tcttcctaccctgcctcc

SEQ ID NO: 3493084 - DNA, 21 bp, Homo sapiens
tcttcctaccctgcctccctt

SEQ ID NO: 3493085 - DNA, 15 bp, Homo sapiens
tcttcctttctcctt

SEQ ID NO: 3493086 - DNA, 19 bp, Homo sapiens
tcttctatgtaggaaaaaa

SEQ ID NO: 3493087 - DNA, 16 bp, Homo sapiens
tcttctcaaagctggg

SEQ ID NO: 3493088 - DNA, 10 bp, Homo sapiens
tcttctcatt

SEQ ID NO: 3493089 - DNA, 22 bp, Homo sapiens
tcttctcatttcacccctccct

SEQ ID NO: 3493090 - DNA, 23 bp, Homo sapiens
tcttctcatttcacccctccctt

SEQ ID NO: 3493091 - DNA, 12 bp, Homo sapiens
tcttctccccag

SEQ ID NO: 3493092 - DNA, 21 bp, Homo sapiens
tcttctctcaaccttggcctt

SEQ ID NO: 3493093 - DNA, 21 bp, Homo sapiens
tcttctctggcgacagttttc

SEQ ID NO: 3493094 - DNA, 16 bp, Homo sapiens
tcttctgaatatttta

SEQ ID NO: 3493095 - DNA, 14 bp, Homo sapiens
tcttctgagctagt

SEQ ID NO: 3493096 - DNA, 22 bp, Homo sapiens
tcttctgcttcagcctcccgag

SEQ ID NO: 3493097 - DNA, 12 bp, Homo sapiens
tcttctggctca

SEQ ID NO: 3493098 - DNA, 22 bp, Homo sapiens
tcttcttcacatccattgtctc

SEQ ID NO: 3493099 - DNA, 14 bp, Homo sapiens
tcttcttcaccatt

SEQ ID NO: 3493100 - DNA, 19 bp, Homo sapiens
tcttctttcagacttgcca

SEQ ID NO: 3493101 - DNA, 12 bp, Homo sapiens
tcttctttccca

SEQ ID NO: 3493102 - DNA, 23 bp, Homo sapiens
tctgctcatcattctctgtctca

SEQ ID NO: 3493103 - DNA, 21 bp, Homo sapiens
tctgctcctttccccttcctt

SEQ ID NO: 3493104 - DNA, 16 bp, Homo sapiens
tctgctcgccttagca

SEQ ID NO: 3493105 - DNA, 18 bp, Homo sapiens
tctgctctattatataaa

SEQ ID NO: 3493106 - DNA, 13 bp, Homo sapiens
tctgctctccttc

SEQ ID NO: 3493107 - DNA, 21 bp, Homo sapiens
tctgctctgcgtgtcacctgt

SEQ ID NO: 3493108 - DNA, 19 bp, Homo sapiens
tctgctgacagacacaggc

SEQ ID NO: 3493109 - DNA, 20 bp, Homo sapiens
tctgctgacagacacaggcc

SEQ ID NO: 3493110 - DNA, 22 bp, Homo sapiens
tctgctgacagacacaggcccg

SEQ ID NO: 3493111 - DNA, 16 bp, Homo sapiens
tctgcttctctgactt

SEQ ID NO: 3493112 - DNA, 18 bp, Homo sapiens
tctgcttgacaacatctg

SEQ ID NO: 3493113 - DNA, 19 bp, Homo sapiens
tctgcttgacaacatctga

SEQ ID NO: 3493114 - DNA, 12 bp, Homo sapiens
tctgcttgagtc

SEQ ID NO: 3493115 - DNA, 22 bp, Homo sapiens
tctggaaacctgtcattgtatt

SEQ ID NO: 3493116 - DNA, 13 bp, Homo sapiens
tctggaaaggggg

SEQ ID NO: 3493117 - DNA, 13 bp, Homo sapiens
tctggaacccaga

SEQ ID NO: 3493118 - DNA, 15 bp, Homo sapiens
tctggaacctcagcc

SEQ ID NO: 3493119 - DNA, 17 bp, Homo sapiens
tctggaacctcagcctg

SEQ ID NO: 3493120 - DNA, 15 bp, Homo sapiens
tctggaatgcagtgg

SEQ ID NO: 3493121 - DNA, 19 bp, Homo sapiens
tctggacagccccaccctg

SEQ ID NO: 3493122 - DNA, 20 bp, Homo sapiens
tctggacagccccaccctgg

SEQ ID NO: 3493123 - DNA, 19 bp, Homo sapiens
tctggacaggatgtgtttg

SEQ ID NO: 3493124 - DNA, 21 bp, Homo sapiens
tctggacaggcatgttctctg

SEQ ID NO: 3493125 - DNA, 17 bp, Homo sapiens
tctggacagtcagctct

SEQ ID NO: 3493126 - DNA, 18 bp, Homo sapiens
tctggacagtcagctctt

SEQ ID NO: 3493127 - DNA, 19 bp, Homo sapiens
tctggactgccccagaaaa

SEQ ID NO: 3493128 - DNA, 20 bp, Homo sapiens
tctctgcctgacaaggccag

SEQ ID NO: 3493129 - DNA, 15 bp, Homo sapiens
tctctgccttgcctt

SEQ ID NO: 3493130 - DNA, 16 bp, Homo sapiens
tctctgccttgccttt

SEQ ID NO: 3493131 - DNA, 21 bp, Homo sapiens
tctctgctctgcgtgtcacct

SEQ ID NO: 3493132 - DNA, 19 bp, Homo sapiens
tctctgcttgagtcaggtt

SEQ ID NO: 3493133 - DNA, 17 bp, Homo sapiens
tctctggcgacagtttt

SEQ ID NO: 3493134 - DNA, 16 bp, Homo sapiens
tctctgggagaaaatc

SEQ ID NO: 3493135 - DNA, 22 bp, Homo sapiens
tctctgggagaaaatcatcaag

SEQ ID NO: 3493136 - DNA, 15 bp, Homo sapiens
tctctgggcctcaga

SEQ ID NO: 3493137 - DNA, 17 bp, Homo sapiens
tctctgggcctcagagg

SEQ ID NO: 3493138 - DNA, 16 bp, Homo sapiens
tctctgtacttttcat

SEQ ID NO: 3493139 - DNA, 14 bp, Homo sapiens
tctctgtcccttgc

SEQ ID NO: 3493140 - DNA, 16 bp, Homo sapiens
tctctgtgaacgattt

SEQ ID NO: 3493141 - DNA, 22 bp, Homo sapiens
tctctgtgaacgatttagaaag

SEQ ID NO: 3493142 - DNA, 19 bp, Homo sapiens
tctctgtgagactcgagaa

SEQ ID NO: 3493143 - DNA, 17 bp, Homo sapiens
tctcttatagaatattt

SEQ ID NO: 3493144 - DNA, 20 bp, Homo sapiens
tctcttatagaatatttatt

SEQ ID NO: 3493145 - DNA, 17 bp, Homo sapiens
tctcaccccatcccaca

SEQ ID NO: 3493146 - DNA, 12 bp, Homo sapiens
tctcacctcagc

SEQ ID NO: 3493147 - DNA, 12 bp, Homo sapiens
tctcactctgtc

SEQ ID NO: 3493148 - DNA, 16 bp, Homo sapiens
tctcactctgtcgccc

SEQ ID NO: 3493149 - DNA, 17 bp, Homo sapiens
tctcactggatgcaaag

SEQ ID NO: 3493150 - DNA, 21 bp, Homo sapiens
tctcactgtgggaaggccagc

SEQ ID NO: 3493151 - DNA, 23 bp, Homo sapiens
tctcactgtgttactgctttgca

SEQ ID NO: 3493152 - DNA, 17 bp, Homo sapiens
tctcactgttgcccagg

SEQ ID NO: 3493153 - DNA, 14 bp, Homo sapiens
tccctctgacccag

SEQ ID NO: 3493154 - DNA, 18 bp, Homo sapiens
tccctctgggggctctgg

SEQ ID NO: 3493155 - DNA, 23 bp, Homo sapiens
tccctctgggggctctggccaag

SEQ ID NO: 3493156 - DNA, 20 bp, Homo sapiens
tccctctgtcatcctcagga

SEQ ID NO: 3493157 - DNA, 15 bp, Homo sapiens
tccctcttccctcag

SEQ ID NO: 3493158 - DNA, 20 bp, Homo sapiens
tccctcttctttcagacttg

SEQ ID NO: 3493159 - DNA, 16 bp, Homo sapiens
tccctgaccctgtata

SEQ ID NO: 3493160 - DNA, 17 bp, Homo sapiens
tccctgacctccctcta

SEQ ID NO: 3493161 - DNA, 14 bp, Homo sapiens
tccctgactcattc

SEQ ID NO: 3493162 - DNA, 15 bp, Homo sapiens
tccctgactgggagt

SEQ ID NO: 3493163 - DNA, 16 bp, Homo sapiens
tccctgacttttctgt

SEQ ID NO: 3493164 - DNA, 21 bp, Homo sapiens
tccctgagaaacccaccagcc

SEQ ID NO: 3493165 - DNA, 22 bp, Homo sapiens
tccctgaggatgggtcagagct

SEQ ID NO: 3493166 - DNA, 20 bp, Homo sapiens
tcccaatcttctttttcagg

SEQ ID NO: 3493167 - DNA, 15 bp, Homo sapiens
tcccaattcacatct

SEQ ID NO: 3493168 - DNA, 17 bp, Homo sapiens
tcccaatttcagactcc

SEQ ID NO: 3493169 - DNA, 14 bp, Homo sapiens
tcccacaagtggtg

SEQ ID NO: 3493170 - DNA, 21 bp, Homo sapiens
tcccacaggacatttctctaa

SEQ ID NO: 3493171 - DNA, 16 bp, Homo sapiens
tcccacctagcagcac

SEQ ID NO: 3493172 - DNA, 18 bp, Homo sapiens
tcccacctcagcctcccg

SEQ ID NO: 3493173 - DNA, 19 bp, Homo sapiens
tcccacctgcatctggggc

SEQ ID NO: 3493174 - DNA, 18 bp, Homo sapiens
tcccacgggacctggggc

SEQ ID NO: 3493175 - DNA, 12 bp, Homo sapiens
tcccactgccag

SEQ ID NO: 3493176 - DNA, 21 bp, Homo sapiens
tcccacttggcatcagctggc

SEQ ID NO: 3493177 - DNA, 23 bp, Homo sapiens
tcccacttggcatcagctggcgt

SEQ ID NO: 3493178 - DNA, 17 bp, Homo sapiens
tcccagaacacactcca

SEQ ID NO: 3493179 - DNA, 21 bp, Homo sapiens
tcccagagctggtggacccag

SEQ ID NO: 3493180 - DNA, 20 bp, Homo sapiens
tcccagattggctcacactg

SEQ ID NO: 3493181 - DNA, 23 bp, Homo sapiens
tcccagattggctcacactgaga

SEQ ID NO: 3493182 - DNA, 19 bp, Homo sapiens
tcccagcactttgggaggc

SEQ ID NO: 3493183 - DNA, 16 bp, Homo sapiens
tcccagctacaccttt

SEQ ID NO: 3493184 - DNA, 16 bp, Homo sapiens
tcccagctacctcaac

SEQ ID NO: 3493185 - DNA, 16 bp, Homo sapiens
tcccagctactcggga

SEQ ID NO: 3493186 - DNA, 19 bp, Homo sapiens
tcccagctacttgggaggc

SEQ ID NO: 3493187 - DNA, 15 bp, Homo sapiens
tcatgtactttttag

SEQ ID NO: 3493188 - DNA, 21 bp, Homo sapiens
tcatgtctattccattccctt

SEQ ID NO: 3493189 - DNA, 16 bp, Homo sapiens
tcatgtcttctcacaa

SEQ ID NO: 3493190 - DNA, 17 bp, Homo sapiens
tcatgtgcctctgtcct

SEQ ID NO: 3493191 - DNA, 16 bp, Homo sapiens
tcatgtggctggaaga

SEQ ID NO: 3493192 - DNA, 20 bp, Homo sapiens
tcatgtgtgcaacagggtat

SEQ ID NO: 3493193 - DNA, 15 bp, Homo sapiens
tcatgttggtttatt

SEQ ID NO: 3493194 - DNA, 16 bp, Homo sapiens
tcatgtttcttaaatg

SEQ ID NO: 3493195 - DNA, 15 bp, Homo sapiens
tcatgttttaacaaa

SEQ ID NO: 3493196 - DNA, 13 bp, Homo sapiens
tcattaatgacac

SEQ ID NO: 3493197 - DNA, 19 bp, Homo sapiens
tcattaatgacacttgtcc

SEQ ID NO: 3493198 - DNA, 17 bp, Homo sapiens
tcattactgcttcattt

SEQ ID NO: 3493199 - DNA, 18 bp, Homo sapiens
tcattactgcttcatttt

SEQ ID NO: 3493200 - DNA, 22 bp, Homo sapiens
tcattactgcttcatttttgta

SEQ ID NO: 3493201 - DNA, 12 bp, Homo sapiens
tcattagagcag

SEQ ID NO: 3493202 - DNA, 13 bp, Homo sapiens
tcattagagcagg

SEQ ID NO: 3493203 - DNA, 15 bp, Homo sapiens
tcattagagcaggcg

SEQ ID NO: 3493204 - DNA, 20 bp, Homo sapiens
tcattagcctgagtagaaag

SEQ ID NO: 3493205 - DNA, 14 bp, Homo sapiens
tcattatttgtcaa

SEQ ID NO: 3493206 - DNA, 16 bp, Homo sapiens
tcattcaaaagttgaa

SEQ ID NO: 3493207 - DNA, 19 bp, Homo sapiens
tcattcagcagcaaatttt

SEQ ID NO: 3493208 - DNA, 21 bp, Homo sapiens
tcattcagcagcaaattttca

SEQ ID NO: 3493209 - DNA, 18 bp, Homo sapiens
tcattcagcctttagaaa

SEQ ID NO: 3493210 - DNA, 17 bp, Homo sapiens
tcattccctctcatctc

SEQ ID NO: 3493211 - DNA, 15 bp, Homo sapiens
tcattccctgtagtt

SEQ ID NO: 3493212 - DNA, 16 bp, Homo sapiens
tcattccgttgtctgt

SEQ ID NO: 3493213 - DNA, 18 bp, Homo sapiens
tcattctgaaggagcccc

SEQ ID NO: 3493214 - DNA, 13 bp, Homo sapiens
tcattctgcacct

SEQ ID NO: 3493215 - DNA, 14 bp, Homo sapiens
tcattctgcacctt

SEQ ID NO: 3493216 - DNA, 18 bp, Homo sapiens
tcattctgcaccttgcca

SEQ ID NO: 3493217 - DNA, 12 bp, Homo sapiens
tcattcttctgt

SEQ ID NO: 3493218 - DNA, 15 bp, Homo sapiens
tcattgatttcctgt

SEQ ID NO: 3493219 - DNA, 19 bp, Homo sapiens
tcattgatttcctgtgtca

SEQ ID NO: 3493220 - DNA, 14 bp, Homo sapiens
tcattgctgtagga

SEQ ID NO: 3493221 - DNA, 21 bp, Homo sapiens
tcattgctgtctgcagccttg

SEQ ID NO: 3493222 - DNA, 11 bp, Homo sapiens
tcattggcttt

SEQ ID NO: 3493223 - DNA, 12 bp, Homo sapiens
tcattgtattca

SEQ ID NO: 3493224 - DNA, 14 bp, Homo sapiens
tcattgtattcaga

SEQ ID NO: 3493225 - DNA, 12 bp, Homo sapiens
tcattgttctgt

SEQ ID NO: 3493226 - DNA, 13 bp, Homo sapiens
tcattgttctgta

SEQ ID NO: 3493227 - DNA, 13 bp, Homo sapiens
tcatttagtgccc

SEQ ID NO: 3493228 - DNA, 14 bp, Homo sapiens
tcatttcacccctc

SEQ ID NO: 3493229 - DNA, 15 bp, Homo sapiens
tcatttcacccctcc

SEQ ID NO: 3493230 - DNA, 16 bp, Homo sapiens
tcatttcacccctccc

SEQ ID NO: 3493231 - DNA, 17 bp, Homo sapiens
tcatttctatttctcct

SEQ ID NO: 3493232 - DNA, 21 bp, Homo sapiens
tcatttctatttctcctccat

SEQ ID NO: 3493233 - DNA, 21 bp, Homo sapiens
tcatttgagcagggctcagcg

SEQ ID NO: 3493234 - DNA, 14 bp, Homo sapiens
tcatttgctgtgaa

SEQ ID NO: 3493235 - DNA, 14 bp, Homo sapiens
tcatttgtcacaca

SEQ ID NO: 3493236 - DNA, 17 bp, Homo sapiens
tcattttatatgtcaaa

SEQ ID NO: 3493237 - DNA, 18 bp, Homo sapiens
tcattttatatgtcaaag

SEQ ID NO: 3493238 - DNA, 21 bp, Homo sapiens
tcattttatatgtcaaagcag

SEQ ID NO: 3493239 - DNA, 13 bp, Homo sapiens
tcattttcagagt

SEQ ID NO: 3493240 - DNA, 12 bp, Homo sapiens
tcattttgcact

SEQ ID NO: 3493241 - DNA, 13 bp, Homo sapiens
tcattttgcactg

SEQ ID NO: 3493242 - DNA, 18 bp, Homo sapiens
tcatttttttccaggctg

SEQ ID NO: 3493243 - DNA, 18 bp, Homo sapiens
tccaaaaatctgcctggg

SEQ ID NO: 3493244 - DNA, 15 bp, Homo sapiens
tccaaaccttatctc

SEQ ID NO: 3493245 - DNA, 23 bp, Homo sapiens
tccaaagagtagaattgcattga

SEQ ID NO: 3493246 - DNA, 11 bp, Homo sapiens
tccaaagcaaa

SEQ ID NO: 3493247 - DNA, 23 bp, Homo sapiens
tccaaaggccatggagagctgga

SEQ ID NO: 3493248 - DNA, 16 bp, Homo sapiens
tccaacaggagctggg

SEQ ID NO: 3493249 - DNA, 21 bp, Homo sapiens
tccaaccccccagcactgagg

SEQ ID NO: 3493250 - DNA, 22 bp, Homo sapiens
tccaaccccccagcactgagga

SEQ ID NO: 3493251 - DNA, 13 bp, Homo sapiens
tccaaccttccca

SEQ ID NO: 3493252 - DNA, 14 bp, Homo sapiens
tccaaccttcccaa

SEQ ID NO: 3493253 - DNA, 13 bp, Homo sapiens
tccaacgtttgga

SEQ ID NO: 3493254 - DNA, 15 bp, Homo sapiens
tccaacgtttggaag

SEQ ID NO: 3493255 - DNA, 21 bp, Homo sapiens
tccaactgcctaaggcccttt

SEQ ID NO: 3493256 - DNA, 23 bp, Homo sapiens
tccaacttggctgcaggaatctt

SEQ ID NO: 3493257 - DNA, 18 bp, Homo sapiens
tccaagaatagcatctgt

SEQ ID NO: 3493258 - DNA, 16 bp, Homo sapiens
tccaagagtctgatga

SEQ ID NO: 3493259 - DNA, 17 bp, Homo sapiens
tccaagagtctgatgat

SEQ ID NO: 3493260 - DNA, 18 bp, Homo sapiens
tccaagatattttaaaat

SEQ ID NO: 3493261 - DNA, 22 bp, Homo sapiens
tccaagatattttaaaatctgt

SEQ ID NO: 3493262 - DNA, 17 bp, Homo sapiens
tccaagcaacagccttt

SEQ ID NO: 3493263 - DNA, 15 bp, Homo sapiens
tccaagccagcggga

SEQ ID NO: 3493264 - DNA, 15 bp, Homo sapiens
tccaagccccatctt

SEQ ID NO: 3493265 - DNA, 22 bp, Homo sapiens
tccaagctgggagattcaaggg

SEQ ID NO: 3493266 - DNA, 19 bp, Homo sapiens
tccaaggaaaccacagctg

SEQ ID NO: 3493267 - DNA, 23 bp, Homo sapiens
tccaatcagagaccaggccctgg

SEQ ID NO: 3493268 - DNA, 16 bp, Homo sapiens
tccaatcctatgtttt

SEQ ID NO: 3493269 - DNA, 23 bp, Homo sapiens
tccaattatttgactttaattta

SEQ ID NO: 3493270 - DNA, 15 bp, Homo sapiens
tccaattttaattta

SEQ ID NO: 3493271 - DNA, 19 bp, Homo sapiens
tccacaaagaaaattccta

SEQ ID NO: 3493272 - DNA, 21 bp, Homo sapiens
tccacaaagaaaattcctata

SEQ ID NO: 3493273 - DNA, 21 bp, Homo sapiens
tccacaagtgccgcaaattgt

SEQ ID NO: 3493274 - DNA, 18 bp, Homo sapiens
tccacacccaattccact

SEQ ID NO: 3493275 - DNA, 17 bp, Homo sapiens
tccacactgccggcagg

SEQ ID NO: 3493276 - DNA, 19 bp, Homo sapiens
tccacagcaaccccaggct

SEQ ID NO: 3493277 - DNA, 12 bp, Homo sapiens
tccacagggcac

SEQ ID NO: 3493278 - DNA, 13 bp, Homo sapiens
tccacatcctcca

SEQ ID NO: 3493279 - DNA, 17 bp, Homo sapiens
tccaccaagaaagcagg

SEQ ID NO: 3493280 - DNA, 19 bp, Homo sapiens
tccaccaggaacctcttca

SEQ ID NO: 3493281 - DNA, 21 bp, Homo sapiens
tccaccaggaacctcttcaga

SEQ ID NO: 3493282 - DNA, 12 bp, Homo sapiens
tccacccacctc

SEQ ID NO: 3493283 - DNA, 18 bp, Homo sapiens
tccacccacctcagcctc

SEQ ID NO: 3493284 - DNA, 12 bp, Homo sapiens
tccaccctgctc

SEQ ID NO: 3493285 - DNA, 14 bp, Homo sapiens
tccaccctgctctc

SEQ ID NO: 3493286 - DNA, 16 bp, Homo sapiens
tccacgactgtctcca

SEQ ID NO: 3493287 - DNA, 23 bp, Homo sapiens
tcaaataaagagagaacaggact

SEQ ID NO: 3493288 - DNA, 20 bp, Homo sapiens
tcaaatggaagacacattga

SEQ ID NO: 3493289 - DNA, 18 bp, Homo sapiens
tcaaatggggccagatcc

SEQ ID NO: 3493290 - DNA, 19 bp, Homo sapiens
tcaaatggggccagatcca

SEQ ID NO: 3493291 - DNA, 20 bp, Homo sapiens
tcaaatggggccagatccag

SEQ ID NO: 3493292 - DNA, 20 bp, Homo sapiens
tcaaatggtaggcatttcct

SEQ ID NO: 3493293 - DNA, 21 bp, Homo sapiens
tcaaatggtaggcatttccta

SEQ ID NO: 3493294 - DNA, 24 bp, Homo sapiens
tcaaattataagagacagacactt

SEQ ID NO: 3493295 - DNA, 23 bp, Homo sapiens
tcaaattctttttttattattat

SEQ ID NO: 3493296 - DNA, 17 bp, Homo sapiens
tcaacaataaaattttt

SEQ ID NO: 3493297 - DNA, 14 bp, Homo sapiens
tcaacagttttcct

SEQ ID NO: 3493298 - DNA, 17 bp, Homo sapiens
tcaacagttttcctatg

SEQ ID NO: 3493299 - DNA, 23 bp, Homo sapiens
tcaacagttttcctatgctttga

SEQ ID NO: 3493300 - DNA, 12 bp, Homo sapiens
tcaacatctttt

SEQ ID NO: 3493301 - DNA, 17 bp, Homo sapiens
tcaacatttattttgag

SEQ ID NO: 3493302 - DNA, 18 bp, Homo sapiens
tcaacccccatttctatt

SEQ ID NO: 3493303 - DNA, 17 bp, Homo sapiens
tcaaccctcagccttga

SEQ ID NO: 3493304 - DNA, 14 bp, Homo sapiens
tcaacctcctgggc

SEQ ID NO: 3493305 - DNA, 15 bp, Homo sapiens
tcaaccttggccttc

SEQ ID NO: 3493306 - DNA, 15 bp, Homo sapiens
tcaacgtattgtttc

SEQ ID NO: 3493307 - DNA, 20 bp, Homo sapiens
tcaactaaaaaaaaaaaagt

SEQ ID NO: 3493308 - DNA, 13 bp, Homo sapiens
tcaactatgtagg

SEQ ID NO: 3493309 - DNA, 20 bp, Homo sapiens
tcaactgccaaaatgctcta

SEQ ID NO: 3493310 - DNA, 14 bp, Homo sapiens
tcaacttgcttatc

SEQ ID NO: 3493311 - DNA, 15 bp, Homo sapiens
tcaactttgaataaa

SEQ ID NO: 3493312 - DNA, 16 bp, Homo sapiens
tcaactttgaataaag

SEQ ID NO: 3493313 - DNA, 16 bp, Homo sapiens
tcaactttttattgcc

SEQ ID NO: 3493314 - DNA, 17 bp, Homo sapiens
tcaactttttattgcct

SEQ ID NO: 3493315 - DNA, 22 bp, Homo sapiens
tcaactttttattgccttctca

SEQ ID NO: 3493316 - DNA, 21 bp, Homo sapiens
tcaagaaataaaaggaagcca

SEQ ID NO: 3493317 - DNA, 23 bp, Homo sapiens
tcaagaacatgatgggcctgaac

SEQ ID NO: 3493318 - DNA, 14 bp, Homo sapiens
tcaagaagaaaaag

SEQ ID NO: 3493319 - DNA, 23 bp, Homo sapiens
tcaagaagcaggctacactgaca

SEQ ID NO: 3493320 - DNA, 14 bp, Homo sapiens
tcaagaagggctgc

SEQ ID NO: 3493321 - DNA, 15 bp, Homo sapiens
tcaagaagggctgca

SEQ ID NO: 3493322 - DNA, 18 bp, Homo sapiens
tcaagaagggctgcatga

SEQ ID NO: 3493323 - DNA, 20 bp, Homo sapiens
tcaagactggaaggtgggga

SEQ ID NO: 3493324 - DNA, 22 bp, Homo sapiens
tcaagatactgctactgtaatt

SEQ ID NO: 3493325 - DNA, 17 bp, Homo sapiens
tcaagatgacagctctt

SEQ ID NO: 3493326 - DNA, 21 bp, Homo sapiens
tcaagatgggggcagggctgt

SEQ ID NO: 3493327 - DNA, 18 bp, Homo sapiens
tcaagcagtcgtgcctgt

SEQ ID NO: 3493328 - DNA, 21 bp, Homo sapiens
tcaagcagtcgtgcctgtgtc

SEQ ID NO: 3493329 - DNA, 23 bp, Homo sapiens
tcaagcagtcgtgcctgtgtcca

SEQ ID NO: 3493330 - DNA, 16 bp, Homo sapiens
tcaagccaagcagcca

SEQ ID NO: 3493331 - DNA, 19 bp, Homo sapiens
tcaagcctgtgcaaaaaaa

SEQ ID NO: 3493332 - DNA, 16 bp, Homo sapiens
tcaagcgattctcctg

SEQ ID NO: 3493333 - DNA, 17 bp, Homo sapiens
tcaagcgattctcctgc

SEQ ID NO: 3493334 - DNA, 16 bp, Homo sapiens
tcaagcgattcttctg

SEQ ID NO: 3493335 - DNA, 18 bp, Homo sapiens
tcaagcgattcttctgct

SEQ ID NO: 3493336 - DNA, 13 bp, Homo sapiens
tcaagctcctcct

SEQ ID NO: 3493337 - DNA, 20 bp, Homo sapiens
tcaaggaacttgaaaaatac

SEQ ID NO: 3493338 - DNA, 14 bp, Homo sapiens
tcaaggagaggagg

SEQ ID NO: 3493339 - DNA, 23 bp, Homo sapiens
tcaaggagcccagaaaacctcca

SEQ ID NO: 3493340 - DNA, 12 bp, Homo sapiens
tcaaggccttca

SEQ ID NO: 3493341 - DNA, 21 bp, Homo sapiens
tcaaggccttcagtttatttc

SEQ ID NO: 3493342 - DNA, 16 bp, Homo sapiens
tcaagggtgcgtctgg

SEQ ID NO: 3493343 - DNA, 12 bp, Homo sapiens
tcaagtatttgg

SEQ ID NO: 3493344 - DNA, 22 bp, Homo sapiens
tcaagtcctcttttctgagagg

SEQ ID NO: 3493345 - DNA, 15 bp, Homo sapiens
tcaagtcctttgtga

SEQ ID NO: 3493346 - DNA, 16 bp, Homo sapiens
tcaagtctctgctggc

SEQ ID NO: 3493347 - DNA, 17 bp, Homo sapiens
tcaagtgatcctcccac

SEQ ID NO: 3493348 - DNA, 17 bp, Homo sapiens
tcaagtgattctcctgc

SEQ ID NO: 3493349 - DNA, 21 bp, Homo sapiens
tcaagtgattctcctgcctca

SEQ ID NO: 3493350 - DNA, 11 bp, Homo sapiens
tcaagtttact

SEQ ID NO: 3493351 - DNA, 15 bp, Homo sapiens
tcaggtgtccctgca

SEQ ID NO: 3493352 - DNA, 22 bp, Homo sapiens
tcaggtgtccctgcacttgcag

SEQ ID NO: 3493353 - DNA, 13 bp, Homo sapiens
tcaggttttgtaa

SEQ ID NO: 3493354 - DNA, 21 bp, Homo sapiens
tcagtaagacgacaaggaaag

SEQ ID NO: 3493355 - DNA, 22 bp, Homo sapiens
tcagtaagacgacaaggaaagg

SEQ ID NO: 3493356 - DNA, 14 bp, Homo sapiens
tcagtactttttta

SEQ ID NO: 3493357 - DNA, 23 bp, Homo sapiens
tcagtacttttttaaatattttc

SEQ ID NO: 3493358 - DNA, 20 bp, Homo sapiens
tcagtagtttgagaccagcc

SEQ ID NO: 3493359 - DNA, 17 bp, Homo sapiens
tcagtatccatgctctt

SEQ ID NO: 3493360 - DNA, 16 bp, Homo sapiens
tcagtatgtgggggct

SEQ ID NO: 3493361 - DNA, 18 bp, Homo sapiens
tcagtatgtgggggcttc

SEQ ID NO: 3493362 - DNA, 19 bp, Homo sapiens
tcagtatgtgggggcttca

SEQ ID NO: 3493363 - DNA, 22 bp, Homo sapiens
tcagtatgtgggggcttcatct

SEQ ID NO: 3493364 - DNA, 23 bp, Homo sapiens
tcagtatgtgggggcttcatctc

SEQ ID NO: 3493365 - DNA, 15 bp, Homo sapiens
tcagtatgttgtcaa

SEQ ID NO: 3493366 - DNA, 17 bp, Homo sapiens
tcagtctgattcccaag

SEQ ID NO: 3493367 - DNA, 19 bp, Homo sapiens
tcagtctgattcccaagct

SEQ ID NO: 3493368 - DNA, 22 bp, Homo sapiens
tcagtctgattcccaagctctg

SEQ ID NO: 3493369 - DNA, 17 bp, Homo sapiens
tcagtgcagcatataca

SEQ ID NO: 3493370 - DNA, 16 bp, Homo sapiens
tcagtgcatttgtgct

SEQ ID NO: 3493371 - DNA, 19 bp, Homo sapiens
tcagtgctccctcacatgt

SEQ ID NO: 3493372 - DNA, 13 bp, Homo sapiens
tcagtgctgtgct

SEQ ID NO: 3493373 - DNA, 14 bp, Homo sapiens
tcagtgctgtgctg

SEQ ID NO: 3493374 - DNA, 16 bp, Homo sapiens
tcagtgctgtgctgtg

SEQ ID NO: 3493375 - DNA, 12 bp, Homo sapiens
tcagtggagcca

SEQ ID NO: 3493376 - DNA, 12 bp, Homo sapiens
tcagtggcagct

SEQ ID NO: 3493377 - DNA, 13 bp, Homo sapiens
tcagtggcagctg

SEQ ID NO: 3493378 - DNA, 16 bp, Homo sapiens
tcagtggcagctgctt

SEQ ID NO: 3493379 - DNA, 19 bp, Homo sapiens
tcagtggggctctctgagt

SEQ ID NO: 3493380 - DNA, 20 bp, Homo sapiens
tcagtggttatttagggaac

SEQ ID NO: 3493381 - DNA, 18 bp, Homo sapiens
tcagtgtaccatttgcct

SEQ ID NO: 3493382 - DNA, 15 bp, Homo sapiens
tcagtgttaaatgtg

SEQ ID NO: 3493383 - DNA, 21 bp, Homo sapiens
tcagtgttaaatgtgatgaat

SEQ ID NO: 3493384 - DNA, 15 bp, Homo sapiens
tcagtgttacctgtg

SEQ ID NO: 3493385 - DNA, 17 bp, Homo sapiens
tcagtgttacctgtgtg

SEQ ID NO: 3493386 - DNA, 18 bp, Homo sapiens
tcagtgttacctgtgtgc

SEQ ID NO: 3493387 - DNA, 19 bp, Homo sapiens
tcagtgttacctgtgtgct

SEQ ID NO: 3493388 - DNA, 15 bp, Homo sapiens
tcagtgttttggact

SEQ ID NO: 3493389 - DNA, 16 bp, Homo sapiens
tcagtgttttggactc

SEQ ID NO: 3493390 - DNA, 14 bp, Homo sapiens
tcagttaattctta

SEQ ID NO: 3493391 - DNA, 17 bp, Homo sapiens
tcagttactctgaaggg

SEQ ID NO: 3493392 - DNA, 22 bp, Homo sapiens
tcagttagagctgacacaaacc

SEQ ID NO: 3493393 - DNA, 12 bp, Homo sapiens
tcagttctgcct

SEQ ID NO: 3493394 - DNA, 13 bp, Homo sapiens
tcagttctgcctt

SEQ ID NO: 3493395 - DNA, 18 bp, Homo sapiens
tcagttgattttctggat

SEQ ID NO: 3493396 - DNA, 13 bp, Homo sapiens
tcagttgtgcagc

SEQ ID NO: 3493397 - DNA, 21 bp, Homo sapiens
tcagtttattttttcttctgt

SEQ ID NO: 3493398 - DNA, 20 bp, Homo sapiens
tcagtttccaattatttgac

SEQ ID NO: 3493399 - DNA, 15 bp, Homo sapiens
tcagtttgtatatac

SEQ ID NO: 3493400 - DNA, 12 bp, Homo sapiens
tcagttttcatt

SEQ ID NO: 3493401 - DNA, 17 bp, Homo sapiens
tcagttttttgttttac

SEQ ID NO: 3493402 - DNA, 20 bp, Homo sapiens
tcagttttttgttttacaat

SEQ ID NO: 3493403 - DNA, 14 bp, Homo sapiens
tcataacggatcag

SEQ ID NO: 3493404 - DNA, 19 bp, Homo sapiens
tcataacggatcagaaata

SEQ ID NO: 3493405 - DNA, 20 bp, Homo sapiens
tcataagtatttcaaattgg

SEQ ID NO: 3493406 - DNA, 14 bp, Homo sapiens
tcataatctttgct

SEQ ID NO: 3493407 - DNA, 15 bp, Homo sapiens
tcataatctttgctt

SEQ ID NO: 3493408 - DNA, 15 bp, Homo sapiens
tcataccaatgaaaa

SEQ ID NO: 3493409 - DNA, 15 bp, Homo sapiens
tcataccatctgctg

SEQ ID NO: 3493410 - DNA, 22 bp, Homo sapiens
tcataggtagaaacaaatactt

SEQ ID NO: 3493411 - DNA, 17 bp, Homo sapiens
tcataggttgagcaatt

SEQ ID NO: 3493412 - DNA, 18 bp, Homo sapiens
tcatagtagtttttacag

SEQ ID NO: 3493413 - DNA, 15 bp, Homo sapiens
tcatagtatggtggc

SEQ ID NO: 3493414 - DNA, 21 bp, Homo sapiens
tcatagtatggtggctgggtt

SEQ ID NO: 3493415 - DNA, 17 bp, Homo sapiens
tcatatattgcatttct

SEQ ID NO: 3493416 - DNA, 18 bp, Homo sapiens
tcatatattgcatttctg

SEQ ID NO: 3493417 - DNA, 20 bp, Homo sapiens
tcatatgaaaggtgccatgg

SEQ ID NO: 3493418 - DNA, 22 bp, Homo sapiens
tcatatgtagccttcacacaga

SEQ ID NO: 3493419 - DNA, 22 bp, Homo sapiens
tcatatttagtattgaatactt

SEQ ID NO: 3493420 - DNA, 11 bp, Homo sapiens
tcatcaagaag

SEQ ID NO: 3493421 - DNA, 18 bp, Homo sapiens
tcatcaagaagggctgca

SEQ ID NO: 3493422 - DNA, 21 bp, Homo sapiens
tcatcaagaagggctgcatga

SEQ ID NO: 3493423 - DNA, 11 bp, Homo sapiens
tcatcaagact

SEQ ID NO: 3493424 - DNA, 19 bp, Homo sapiens
tcatcaaggcactgcctga

SEQ ID NO: 3493425 - DNA, 14 bp, Homo sapiens
tcatcactgtggct

SEQ ID NO: 3493426 - DNA, 15 bp, Homo sapiens
tcatcactgtggctg

SEQ ID NO: 3493427 - DNA, 22 bp, Homo sapiens
tcatcattctctgtctcatcca

SEQ ID NO: 3493428 - DNA, 17 bp, Homo sapiens
tcatccactgtgccatg

SEQ ID NO: 3493429 - DNA, 18 bp, Homo sapiens
tcatccactgtgccatgt

SEQ ID NO: 3493430 - DNA, 23 bp, Homo sapiens
tcatccactgtgccatgtgccag

SEQ ID NO: 3493431 - DNA, 21 bp, Homo sapiens
tcatccagggctctgaccagt

SEQ ID NO: 3493432 - DNA, 14 bp, Homo sapiens
tcatccatcatcat

SEQ ID NO: 3493433 - DNA, 17 bp, Homo sapiens
tcatcccctcacttgcc

SEQ ID NO: 3493434 - DNA, 23 bp, Homo sapiens
tcatcccgagcacctccacatcc

SEQ ID NO: 3493435 - DNA, 14 bp, Homo sapiens
tcatccgcactgta

SEQ ID NO: 3493436 - DNA, 18 bp, Homo sapiens
tcatcctattctttcgaa

SEQ ID NO: 3493437 - DNA, 13 bp, Homo sapiens
tcatcctgcaggc

SEQ ID NO: 3493438 - DNA, 15 bp, Homo sapiens
tcatcctgtgctcgg

SEQ ID NO: 3493439 - DNA, 14 bp, Homo sapiens
tcatcgaatctact

SEQ ID NO: 3493440 - DNA, 22 bp, Homo sapiens
tcatctatagttgatatgtttt

SEQ ID NO: 3493441 - DNA, 17 bp, Homo sapiens
tactaagtgatgctgtg

SEQ ID NO: 3493442 - DNA, 20 bp, Homo sapiens
tactaccttgaaaataagaa

SEQ ID NO: 3493443 - DNA, 22 bp, Homo sapiens
tactactttgttaggattttca

SEQ ID NO: 3493444 - DNA, 23 bp, Homo sapiens
tactaggaagaacgttttttcct

SEQ ID NO: 3493445 - DNA, 20 bp, Homo sapiens
tactagggagccatttgaga

SEQ ID NO: 3493446 - DNA, 19 bp, Homo sapiens
tactaggtaacttcatatt

SEQ ID NO: 3493447 - DNA, 14 bp, Homo sapiens
tactagtgttctgt

SEQ ID NO: 3493448 - DNA, 17 bp, Homo sapiens
tactatctactctcctc

SEQ ID NO: 3493449 - DNA, 16 bp, Homo sapiens
tactatgatctcagga

SEQ ID NO: 3493450 - DNA, 13 bp, Homo sapiens
tactatgcctgtg

SEQ ID NO: 3493451 - DNA, 21 bp, Homo sapiens
tactatgtatgtttttttcca

SEQ ID NO: 3493452 - DNA, 22 bp, Homo sapiens
tactattcagtggcgagaaata

SEQ ID NO: 3493453 - DNA, 14 bp, Homo sapiens
tactcaggaagaac

SEQ ID NO: 3493454 - DNA, 22 bp, Homo sapiens
tactcataagttggaccagagg

SEQ ID NO: 3493455 - DNA, 14 bp, Homo sapiens
tactcctcacactt

SEQ ID NO: 3493456 - DNA, 14 bp, Homo sapiens
tactctagatacct

SEQ ID NO: 3493457 - DNA, 15 bp, Homo sapiens
tactctccccacgag

SEQ ID NO: 3493458 - DNA, 16 bp, Homo sapiens
tactctcctcatctct

SEQ ID NO: 3493459 - DNA, 12 bp, Homo sapiens
tactctgaaggg

SEQ ID NO: 3493460 - DNA, 22 bp, Homo sapiens
tactctgaagggcatcatgcat

SEQ ID NO: 3493461 - DNA, 21 bp, Homo sapiens
tactctgtgtcaggtggggca

SEQ ID NO: 3493462 - DNA, 15 bp, Homo sapiens
tactctttctgtata

SEQ ID NO: 3493463 - DNA, 15 bp, Homo sapiens
tactgaactttctta

SEQ ID NO: 3493464 - DNA, 17 bp, Homo sapiens
tactgaccctggggctg

SEQ ID NO: 3493465 - DNA, 14 bp, Homo sapiens
tactgcaagagcca

SEQ ID NO: 3493466 - DNA, 12 bp, Homo sapiens
tactgccttaat

SEQ ID NO: 3493467 - DNA, 18 bp, Homo sapiens
tactgcctttagaaaata

SEQ ID NO: 3493468 - DNA, 19 bp, Homo sapiens
tactgcttcatttttgtaa

SEQ ID NO: 3493469 - DNA, 22 bp, Homo sapiens
tactggcaaaaggatctttgtg

SEQ ID NO: 3493470 - DNA, 16 bp, Homo sapiens
tactgggttcttaacc

SEQ ID NO: 3493471 - DNA, 15 bp, Homo sapiens
tactggttggctccc

SEQ ID NO: 3493472 - DNA, 18 bp, Homo sapiens
tactgtaacactttacaa

SEQ ID NO: 3493473 - DNA, 14 bp, Homo sapiens
tactgtacaataaa

SEQ ID NO: 3493474 - DNA, 23 bp, Homo sapiens
tactgtattttgtattgtttcaa

SEQ ID NO: 3493475 - DNA, 12 bp, Homo sapiens
tactgtgggcaa

SEQ ID NO: 3493476 - DNA, 17 bp, Homo sapiens
tactgtgggcaatttag

SEQ ID NO: 3493477 - DNA, 19 bp, Homo sapiens
tactgtgggcaatttagaa

SEQ ID NO: 3493478 - DNA, 19 bp, Homo sapiens
tactgtgtgtgtgaatgaa

SEQ ID NO: 3493479 - DNA, 15 bp, Homo sapiens
tacttaacaaataca

SEQ ID NO: 3493480 - DNA, 16 bp, Homo sapiens
tacttaacaaatacat

SEQ ID NO: 3493481 - DNA, 20 bp, Homo sapiens
tacttacaaatgactcctaa

SEQ ID NO: 3493482 - DNA, 18 bp, Homo sapiens
tacttctccaccctgctc

SEQ ID NO: 3493483 - DNA, 14 bp, Homo sapiens
tacttctctataaa

SEQ ID NO: 3493484 - DNA, 22 bp, Homo sapiens
tacttctctataaaaaatatgt

SEQ ID NO: 3493485 - DNA, 16 bp, Homo sapiens
tacttctttgctttgc

SEQ ID NO: 3493486 - DNA, 17 bp, Homo sapiens
tacttgaacttgcctct

SEQ ID NO: 3493487 - DNA, 11 bp, Homo sapiens
tacttgaaggg

SEQ ID NO: 3493488 - DNA, 12 bp, Homo sapiens
tacttgaagggc

SEQ ID NO: 3493489 - DNA, 18 bp, Homo sapiens
tacttgaagggccagagc

SEQ ID NO: 3493490 - DNA, 22 bp, Homo sapiens
tacttgaagggccagagccagg

SEQ ID NO: 3493491 - DNA, 16 bp, Homo sapiens
tacttgactcagtgat

SEQ ID NO: 3493492 - DNA, 16 bp, Homo sapiens
tacttgtgatttcgat

SEQ ID NO: 3493493 - DNA, 13 bp, Homo sapiens
tacttgtggacac

SEQ ID NO: 3493494 - DNA, 14 bp, Homo sapiens
tacttgtggacaca

SEQ ID NO: 3493495 - DNA, 19 bp, Homo sapiens
tacttgtggacacagctct

SEQ ID NO: 3493496 - DNA, 20 bp, Homo sapiens
tacttgtggactaaaagata

SEQ ID NO: 3493497 - DNA, 20 bp, Homo sapiens
tactttgtcctttttgttat

SEQ ID NO: 3493498 - DNA, 16 bp, Homo sapiens
tacttttcattctctt

SEQ ID NO: 3493499 - DNA, 17 bp, Homo sapiens
tactttttcttgtattc

SEQ ID NO: 3493500 - DNA, 21 bp, Homo sapiens
tacttttttaaatattttcta

SEQ ID NO: 3493501 - DNA, 21 bp, Homo sapiens
tacttttttttttttttggta

SEQ ID NO: 3493502 - DNA, 13 bp, Homo sapiens
tagaaaaagcagt

SEQ ID NO: 3493503 - DNA, 18 bp, Homo sapiens
tagaaaaatagcaacttg

SEQ ID NO: 3493504 - DNA, 18 bp, Homo sapiens
tagaaacctctctatttt

SEQ ID NO: 3493505 - DNA, 19 bp, Homo sapiens
tagaaactaattgacttta

SEQ ID NO: 3493506 - DNA, 15 bp, Homo sapiens
tagaaacttccaaat

SEQ ID NO: 3493507 - DNA, 13 bp, Homo sapiens
tagaaagcatttg

SEQ ID NO: 3493508 - DNA, 15 bp, Homo sapiens
tagaaagcatttgaa

SEQ ID NO: 3493509 - DNA, 19 bp, Homo sapiens
tagaaagcatttgaatgca

SEQ ID NO: 3493510 - DNA, 20 bp, Homo sapiens
tagaaagcatttgaatgcat

SEQ ID NO: 3493511 - DNA, 13 bp, Homo sapiens
tagaaaggccttt

SEQ ID NO: 3493512 - DNA, 21 bp, Homo sapiens
tagaaagtaagagctctaagt

SEQ ID NO: 3493513 - DNA, 16 bp, Homo sapiens
tagaaatggaaatttt

SEQ ID NO: 3493514 - DNA, 16 bp, Homo sapiens
tagaaatgggaatcat

SEQ ID NO: 3493515 - DNA, 13 bp, Homo sapiens
tagaaattttcaa

SEQ ID NO: 3493516 - DNA, 22 bp, Homo sapiens
tagaaccaccaacaagcaagct

SEQ ID NO: 3493517 - DNA, 20 bp, Homo sapiens
tagaagacaattgacaacag

SEQ ID NO: 3493518 - DNA, 21 bp, Homo sapiens
tagaaggatgtacatttccaa

SEQ ID NO: 3493519 - DNA, 17 bp, Homo sapiens
tagaagtgccatctcaa

SEQ ID NO: 3493520 - DNA, 15 bp, Homo sapiens
tagaagttaccaaat

SEQ ID NO: 3493521 - DNA, 23 bp, Homo sapiens
tagaatagtgttctgcaaaaata

SEQ ID NO: 3493522 - DNA, 16 bp, Homo sapiens
tagaatatagcatctt

SEQ ID NO: 3493523 - DNA, 20 bp, Homo sapiens
tagaatatttattacctctg

SEQ ID NO: 3493524 - DNA, 15 bp, Homo sapiens
tagaatgcatctcat

SEQ ID NO: 3493525 - DNA, 21 bp, Homo sapiens
tagaattaaaaaagcatactt

SEQ ID NO: 3493526 - DNA, 17 bp, Homo sapiens
tagaattccttcgaaag

SEQ ID NO: 3493527 - DNA, 13 bp, Homo sapiens
tagaattgcattg

SEQ ID NO: 3493528 - DNA, 15 bp, Homo sapiens
tagaatttttaccca

SEQ ID NO: 3493529 - DNA, 17 bp, Homo sapiens
tagacaagagaatgctg

SEQ ID NO: 3493530 - DNA, 13 bp, Homo sapiens
tagacaagccaga

SEQ ID NO: 3493531 - DNA, 21 bp, Homo sapiens
tagacactccccgaagtcttt

SEQ ID NO: 3493532 - DNA, 18 bp, Homo sapiens
tagacagccaaaggctgg

SEQ ID NO: 3493533 - DNA, 21 bp, Homo sapiens
tagaccttttttttttttcca

SEQ ID NO: 3493534 - DNA, 21 bp, Homo sapiens
tagactcggggtgcttccttg

SEQ ID NO: 3493535 - DNA, 18 bp, Homo sapiens
tagactttaggctttcag

SEQ ID NO: 3493536 - DNA, 21 bp, Homo sapiens
tagactttaggctttcagctt

SEQ ID NO: 3493537 - DNA, 15 bp, Homo sapiens
tagagaagtccaagc

SEQ ID NO: 3493538 - DNA, 15 bp, Homo sapiens
tagagaatgagaaat

SEQ ID NO: 3493539 - DNA, 16 bp, Homo sapiens
tagagaatgtgtttca

SEQ ID NO: 3493540 - DNA, 12 bp, Homo sapiens
tagagacaacaa

SEQ ID NO: 3493541 - DNA, 16 bp, Homo sapiens
tagagagagaccactt

SEQ ID NO: 3493542 - DNA, 15 bp, Homo sapiens
tagagatgaggtttc

SEQ ID NO: 3493543 - DNA, 14 bp, Homo sapiens
tagagcactgccac

SEQ ID NO: 3493544 - DNA, 16 bp, Homo sapiens
tagagcactgccacca

SEQ ID NO: 3493545 - DNA, 14 bp, Homo sapiens
tagagccagggtct

SEQ ID NO: 3493546 - DNA, 16 bp, Homo sapiens
taggtgacagagtgag

SEQ ID NO: 3493547 - DNA, 14 bp, Homo sapiens
taggtgcagctcct

SEQ ID NO: 3493548 - DNA, 19 bp, Homo sapiens
taggtgcccttggaggcca

SEQ ID NO: 3493549 - DNA, 15 bp, Homo sapiens
taggtggcaaggctg

SEQ ID NO: 3493550 - DNA, 18 bp, Homo sapiens
taggttaataaagatgat

SEQ ID NO: 3493551 - DNA, 15 bp, Homo sapiens
taggttcccctgtca

SEQ ID NO: 3493552 - DNA, 15 bp, Homo sapiens
tagtaaaaatacaaa

SEQ ID NO: 3493553 - DNA, 14 bp, Homo sapiens
tagtaattctcagg

SEQ ID NO: 3493554 - DNA, 15 bp, Homo sapiens
tagtaattctcaggc

SEQ ID NO: 3493555 - DNA, 14 bp, Homo sapiens
tagtaattgacatg

SEQ ID NO: 3493556 - DNA, 14 bp, Homo sapiens
tagtaatttctttt

SEQ ID NO: 3493557 - DNA, 13 bp, Homo sapiens
tagtagagacagg

SEQ ID NO: 3493558 - DNA, 14 bp, Homo sapiens
tagtagattaaaaa

SEQ ID NO: 3493559 - DNA, 14 bp, Homo sapiens
tagtcaagctcctc

SEQ ID NO: 3493560 - DNA, 15 bp, Homo sapiens
tagtcaagctcctcc

SEQ ID NO: 3493561 - DNA, 21 bp, Homo sapiens
tagtcaatcaagtctgtttac

SEQ ID NO: 3493562 - DNA, 21 bp, Homo sapiens
tagtcatgctgctagatcttt

SEQ ID NO: 3493563 - DNA, 16 bp, Homo sapiens
tagtccctgccacgaa

SEQ ID NO: 3493564 - DNA, 21 bp, Homo sapiens
tagtcgtgagctcttgtgagg

SEQ ID NO: 3493565 - DNA, 17 bp, Homo sapiens
tagtctaacacagttga

SEQ ID NO: 3493566 - DNA, 23 bp, Homo sapiens
tagtctgcaaaatgaggaatgta

SEQ ID NO: 3493567 - DNA, 18 bp, Homo sapiens
tagtctttgccagtcatt

SEQ ID NO: 3493568 - DNA, 21 bp, Homo sapiens
tagtcttttgcttttggcaaa

SEQ ID NO: 3493569 - DNA, 23 bp, Homo sapiens
tagtgaaataaattctgattctt

SEQ ID NO: 3493570 - DNA, 21 bp, Homo sapiens
tagtgcattgtttctgtgggc

SEQ ID NO: 3493571 - DNA, 13 bp, Homo sapiens
tagtgctaagtgt

SEQ ID NO: 3493572 - DNA, 14 bp, Homo sapiens
tagtgctaagtgtg

SEQ ID NO: 3493573 - DNA, 17 bp, Homo sapiens
tagtgctaagtgtgaac

SEQ ID NO: 3493574 - DNA, 20 bp, Homo sapiens
tagtggcttaaaacaacact

SEQ ID NO: 3493575 - DNA, 21 bp, Homo sapiens
tagtgtacctcctctcagtgt

SEQ ID NO: 3493576 - DNA, 23 bp, Homo sapiens
tagtgtacctcctctcagtgttt

SEQ ID NO: 3493577 - DNA, 19 bp, Homo sapiens
tagttaagacatgatttcc

SEQ ID NO: 3493578 - DNA, 23 bp, Homo sapiens
tagttaagacatgatttccttga

SEQ ID NO: 3493579 - DNA, 16 bp, Homo sapiens
tagttaaggagcctaa

SEQ ID NO: 3493580 - DNA, 14 bp, Homo sapiens
tagttaatattttg

SEQ ID NO: 3493581 - DNA, 22 bp, Homo sapiens
tagttcagcatccgcaggtgct

SEQ ID NO: 3493582 - DNA, 17 bp, Homo sapiens
tagttcatgtctgctat

SEQ ID NO: 3493583 - DNA, 18 bp, Homo sapiens
tagttctgtagaaatggt

SEQ ID NO: 3493584 - DNA, 17 bp, Homo sapiens
tagttgacaattctgca

SEQ ID NO: 3493585 - DNA, 17 bp, Homo sapiens
tagttgcactaactgct

SEQ ID NO: 3493586 - DNA, 12 bp, Homo sapiens
tattctatgtag

SEQ ID NO: 3493587 - DNA, 16 bp, Homo sapiens
tattctgttggccagt

SEQ ID NO: 3493588 - DNA, 20 bp, Homo sapiens
tattcttgatttatttgctt

SEQ ID NO: 3493589 - DNA, 13 bp, Homo sapiens
tattcttgtgctt

SEQ ID NO: 3493590 - DNA, 13 bp, Homo sapiens
tattgaaatatta

SEQ ID NO: 3493591 - DNA, 21 bp, Homo sapiens
tattgaaatattatagagagt

SEQ ID NO: 3493592 - DNA, 20 bp, Homo sapiens
tattgaatacttacattctc

SEQ ID NO: 3493593 - DNA, 21 bp, Homo sapiens
tattgaatataatatatttgt

SEQ ID NO: 3493594 - DNA, 11 bp, Homo sapiens
tattgaatcta

SEQ ID NO: 3493595 - DNA, 16 bp, Homo sapiens
tattgaatctatttaa

SEQ ID NO: 3493596 - DNA, 20 bp, Homo sapiens
tattgacaataaaatattat

SEQ ID NO: 3493597 - DNA, 13 bp, Homo sapiens
tattgacacagaa

SEQ ID NO: 3493598 - DNA, 15 bp, Homo sapiens
tattgactttcttaa

SEQ ID NO: 3493599 - DNA, 14 bp, Homo sapiens
tattgactttgtct

SEQ ID NO: 3493600 - DNA, 23 bp, Homo sapiens
tattgagggtcattctttattct

SEQ ID NO: 3493601 - DNA, 14 bp, Homo sapiens
tattgagtcaaatg

SEQ ID NO: 3493602 - DNA, 20 bp, Homo sapiens
tattgcacaactctactgtt

SEQ ID NO: 3493603 - DNA, 14 bp, Homo sapiens
tattgcatctgtat

SEQ ID NO: 3493604 - DNA, 21 bp, Homo sapiens
tattgcatctgtataagtaag

SEQ ID NO: 3493605 - DNA, 18 bp, Homo sapiens
tattgcatttctgtattt

SEQ ID NO: 3493606 - DNA, 22 bp, Homo sapiens
tattgcatttggattggggtcc

SEQ ID NO: 3493607 - DNA, 15 bp, Homo sapiens
tattgcccaggctgg

SEQ ID NO: 3493608 - DNA, 13 bp, Homo sapiens
tattgcccaggtt

SEQ ID NO: 3493609 - DNA, 11 bp, Homo sapiens
tattgccttct

SEQ ID NO: 3493610 - DNA, 17 bp, Homo sapiens
tattgccttctcaccag

SEQ ID NO: 3493611 - DNA, 14 bp, Homo sapiens
tattgcgctgctac

SEQ ID NO: 3493612 - DNA, 19 bp, Homo sapiens
tattgctgagagaaatatg

SEQ ID NO: 3493613 - DNA, 23 bp, Homo sapiens
tattgcttcttctcctatgtgta

SEQ ID NO: 3493614 - DNA, 16 bp, Homo sapiens
tattggcactgctaaa

SEQ ID NO: 3493615 - DNA, 19 bp, Homo sapiens
tattggcactgctaaaata

SEQ ID NO: 3493616 - DNA, 23 bp, Homo sapiens
tattggcactgctaaaatagaat

SEQ ID NO: 3493617 - DNA, 18 bp, Homo sapiens
tattgtaaaaaattcaca

SEQ ID NO: 3493618 - DNA, 19 bp, Homo sapiens
tattgtaaaaaattcacat

SEQ ID NO: 3493619 - DNA, 11 bp, Homo sapiens
tattgtacctc

SEQ ID NO: 3493620 - DNA, 13 bp, Homo sapiens
tattgtacctctc

SEQ ID NO: 3493621 - DNA, 18 bp, Homo sapiens
tattgtatttattcaata

SEQ ID NO: 3493622 - DNA, 20 bp, Homo sapiens
tattgtatttattcaataaa

SEQ ID NO: 3493623 - DNA, 16 bp, Homo sapiens
tattgtgtttgtcatt

SEQ ID NO: 3493624 - DNA, 17 bp, Homo sapiens
tattgttccagcagttt

SEQ ID NO: 3493625 - DNA, 14 bp, Homo sapiens
tattgtttatgtaa

SEQ ID NO: 3493626 - DNA, 17 bp, Homo sapiens
tatttaaaaatgtcttg

SEQ ID NO: 3493627 - DNA, 18 bp, Homo sapiens
tatttaaattacaatttt

SEQ ID NO: 3493628 - DNA, 22 bp, Homo sapiens
tatttaactggtgcactttgta

SEQ ID NO: 3493629 - DNA, 20 bp, Homo sapiens
tatttaagcaacatcttttt

SEQ ID NO: 3493630 - DNA, 12 bp, Homo sapiens
tatttaatgttt

SEQ ID NO: 3493631 - DNA, 15 bp, Homo sapiens
tatttaatgttttaa

SEQ ID NO: 3493632 - DNA, 16 bp, Homo sapiens
tatttaattagtgcta

SEQ ID NO: 3493633 - DNA, 17 bp, Homo sapiens
tatttaattagtgctaa

SEQ ID NO: 3493634 - DNA, 18 bp, Homo sapiens
tatttaattagtgctaag

SEQ ID NO: 3493635 - DNA, 14 bp, Homo sapiens
tatttaccaaaaat

SEQ ID NO: 3493636 - DNA, 19 bp, Homo sapiens
tatttacgctttgattcat

SEQ ID NO: 3493637 - DNA, 14 bp, Homo sapiens
tatttactgagctt

SEQ ID NO: 3493638 - DNA, 21 bp, Homo sapiens
tatttactgagcttctctgtg

SEQ ID NO: 3493639 - DNA, 23 bp, Homo sapiens
tatttactgagcttctctgtgaa

SEQ ID NO: 3493640 - DNA, 15 bp, Homo sapiens
tatttataaaacttc

SEQ ID NO: 3493641 - DNA, 17 bp, Homo sapiens
tatttatatgtacatga

SEQ ID NO: 3493642 - DNA, 16 bp, Homo sapiens
tatttatctgattaag

SEQ ID NO: 3493643 - DNA, 13 bp, Homo sapiens
tatttatgtttgc

SEQ ID NO: 3493644 - DNA, 13 bp, Homo sapiens
tatttattacctc

SEQ ID NO: 3493645 - DNA, 14 bp, Homo sapiens
tatttattatttat

SEQ ID NO: 3493646 - DNA, 19 bp, Homo sapiens
tatttattattttcacctg

SEQ ID NO: 3493647 - DNA, 20 bp, Homo sapiens
tatttattcaataaagtatt

SEQ ID NO: 3493648 - DNA, 22 bp, Homo sapiens
tatttattcattatttgtcaaa

SEQ ID NO: 3493649 - DNA, 17 bp, Homo sapiens
tatttatttactgagct

SEQ ID NO: 3493650 - DNA, 19 bp, Homo sapiens
tatttatttgattaggtat

SEQ ID NO: 3493651 - DNA, 18 bp, Homo sapiens
tatttcaaattggagctt

SEQ ID NO: 3493652 - DNA, 20 bp, Homo sapiens
tatttcagatgtaatgtttt

SEQ ID NO: 3493653 - DNA, 21 bp, Homo sapiens
tatttcagatgtaatgttttc

SEQ ID NO: 3493654 - DNA, 19 bp, Homo sapiens
tatttcagtgttacctgtg

SEQ ID NO: 3493655 - DNA, 16 bp, Homo sapiens
tatttccactattttc

SEQ ID NO: 3493656 - DNA, 15 bp, Homo sapiens
tatttccctcccctg

SEQ ID NO: 3493657 - DNA, 15 bp, Homo sapiens
tatttcgaaagctgc

SEQ ID NO: 3493658 - DNA, 14 bp, Homo sapiens
tatttctattatta

SEQ ID NO: 3493659 - DNA, 21 bp, Homo sapiens
tatttctattattaattgcaa

SEQ ID NO: 3493660 - DNA, 15 bp, Homo sapiens
tatattattctcatt

SEQ ID NO: 3493661 - DNA, 23 bp, Homo sapiens
tatattgttgttactttttcttg

SEQ ID NO: 3493662 - DNA, 21 bp, Homo sapiens
tatatttagattgttaaaata

SEQ ID NO: 3493663 - DNA, 16 bp, Homo sapiens
tatatttatactgtat

SEQ ID NO: 3493664 - DNA, 17 bp, Homo sapiens
tatatttgtaggagaaa

SEQ ID NO: 3493665 - DNA, 21 bp, Homo sapiens
tatatttgtgatagcactttc

SEQ ID NO: 3493666 - DNA, 13 bp, Homo sapiens
tatattttgtcat

SEQ ID NO: 3493667 - DNA, 14 bp, Homo sapiens
tatattttgtcata

SEQ ID NO: 3493668 - DNA, 19 bp, Homo sapiens
tatcaaatgcagtatattt

SEQ ID NO: 3493669 - DNA, 21 bp, Homo sapiens
tatcaaatgcagtatatttct

SEQ ID NO: 3493670 - DNA, 15 bp, Homo sapiens
tatcaagcagccaag

SEQ ID NO: 3493671 - DNA, 22 bp, Homo sapiens
tatcaattggaaaggaagaaaa

SEQ ID NO: 3493672 - DNA, 19 bp, Homo sapiens
tatcaccgtgggctccctg

SEQ ID NO: 3493673 - DNA, 18 bp, Homo sapiens
tatcacctcattctgaac

SEQ ID NO: 3493674 - DNA, 20 bp, Homo sapiens
tatcaggacccagaggaagg

SEQ ID NO: 3493675 - DNA, 21 bp, Homo sapiens
tatcaggacccagaggaaggg

SEQ ID NO: 3493676 - DNA, 17 bp, Homo sapiens
tatcaggtgctgccatc

SEQ ID NO: 3493677 - DNA, 16 bp, Homo sapiens
tatcatattattatcc

SEQ ID NO: 3493678 - DNA, 16 bp, Homo sapiens
tatcatggtgaaaagc

SEQ ID NO: 3493679 - DNA, 19 bp, Homo sapiens
tatcatttaataatatact

SEQ ID NO: 3493680 - DNA, 21 bp, Homo sapiens
tatcatttaataatatacttg

SEQ ID NO: 3493681 - DNA, 15 bp, Homo sapiens
tatccagacagtggg

SEQ ID NO: 3493682 - DNA, 21 bp, Homo sapiens
tatccaggtaatccaagatat

SEQ ID NO: 3493683 - DNA, 22 bp, Homo sapiens
tatccataatgatggatttaac

SEQ ID NO: 3493684 - DNA, 23 bp, Homo sapiens
tatccattcccaagatgcctgat

SEQ ID NO: 3493685 - DNA, 17 bp, Homo sapiens
tatcctagcacatgctt

SEQ ID NO: 3493686 - DNA, 24 bp, Homo sapiens
tatcctagcacatgcttcaatagt

SEQ ID NO: 3493687 - DNA, 16 bp, Homo sapiens
tatcctcctgttctga

SEQ ID NO: 3493688 - DNA, 18 bp, Homo sapiens
tatcctcctgttctgaaa

SEQ ID NO: 3493689 - DNA, 16 bp, Homo sapiens
tatcctctttagagtt

SEQ ID NO: 3493690 - DNA, 17 bp, Homo sapiens
tatcctctttagagtta

SEQ ID NO: 3493691 - DNA, 23 bp, Homo sapiens
tatcctctttagagttagactgt

SEQ ID NO: 3493692 - DNA, 11 bp, Homo sapiens
tatcctggtgc

SEQ ID NO: 3493693 - DNA, 17 bp, Homo sapiens
tatccttaatattttat

SEQ ID NO: 3493694 - DNA, 16 bp, Homo sapiens
tatccttcctctcctt

SEQ ID NO: 3493695 - DNA, 16 bp, Homo sapiens
tatccttctacttgtc

SEQ ID NO: 3493696 - DNA, 19 bp, Homo sapiens
tatccttgggggctcccag

SEQ ID NO: 3493697 - DNA, 23 bp, Homo sapiens
tatccttgggggctcccagggca

SEQ ID NO: 3493698 - DNA, 18 bp, Homo sapiens
tatccttttcttctatgt

SEQ ID NO: 3493699 - DNA, 23 bp, Homo sapiens
tatcgacttgtttttgcacatgt

SEQ ID NO: 3493700 - DNA, 14 bp, Homo sapiens
tatctaaaagaaat

SEQ ID NO: 3493701 - DNA, 13 bp, Homo sapiens
tatctaaagttat

SEQ ID NO: 3493702 - DNA, 14 bp, Homo sapiens
tatctaaagttata

SEQ ID NO: 3493703 - DNA, 19 bp, Homo sapiens
tatctaaagttatatttca

SEQ ID NO: 3493704 - DNA, 13 bp, Homo sapiens
tatctaagaatac

SEQ ID NO: 3493705 - DNA, 18 bp, Homo sapiens
tatctaagaatacagctt

SEQ ID NO: 3493706 - DNA, 16 bp, Homo sapiens
tatctcacttgtgcca

SEQ ID NO: 3493707 - DNA, 14 bp, Homo sapiens
tatctccggctccc

SEQ ID NO: 3493708 - DNA, 14 bp, Homo sapiens
tgcctcagcctccc

SEQ ID NO: 3493709 - DNA, 16 bp, Homo sapiens
tgcctcagcctcccga

SEQ ID NO: 3493710 - DNA, 17 bp, Homo sapiens
tgcctcagcctcccgag

SEQ ID NO: 3493711 - DNA, 22 bp, Homo sapiens
tgcctcatttagagaggaaaag

SEQ ID NO: 3493712 - DNA, 13 bp, Homo sapiens
tgcctccagccaa

SEQ ID NO: 3493713 - DNA, 19 bp, Homo sapiens
tgcctccaggaaccacacc

SEQ ID NO: 3493714 - DNA, 18 bp, Homo sapiens
tgcctccagggctggact

SEQ ID NO: 3493715 - DNA, 21 bp, Homo sapiens
tgcctccagggctggactgag

SEQ ID NO: 3493716 - DNA, 18 bp, Homo sapiens
tgcctccccggctcgagc

SEQ ID NO: 3493717 - DNA, 17 bp, Homo sapiens
tgcctcccctctccttc

SEQ ID NO: 3493718 - DNA, 22 bp, Homo sapiens
tgcctccgcgtgatcaaagcca

SEQ ID NO: 3493719 - DNA, 13 bp, Homo sapiens
tgcctcgaaacac

SEQ ID NO: 3493720 - DNA, 17 bp, Homo sapiens
tgcctcgaaacacagaa

SEQ ID NO: 3493721 - DNA, 15 bp, Homo sapiens
tgcctctacctgaca

SEQ ID NO: 3493722 - DNA, 16 bp, Homo sapiens
tgcctctgacacacag

SEQ ID NO: 3493723 - DNA, 14 bp, Homo sapiens
tgcctctgcctctg

SEQ ID NO: 3493724 - DNA, 13 bp, Homo sapiens
tgcctctgtcccc

SEQ ID NO: 3493725 - DNA, 15 bp, Homo sapiens
tgcctctgtcccctt

SEQ ID NO: 3493726 - DNA, 17 bp, Homo sapiens
tgcctctgtccccttct

SEQ ID NO: 3493727 - DNA, 20 bp, Homo sapiens
tgcctctgtccccttctctc

SEQ ID NO: 3493728 - DNA, 16 bp, Homo sapiens
tgcctctgtcttctgg

SEQ ID NO: 3493729 - DNA, 18 bp, Homo sapiens
tgcctctgtcttctggac

SEQ ID NO: 3493730 - DNA, 21 bp, Homo sapiens
tgcctctgtgctgtgtgtgac

SEQ ID NO: 3493731 - DNA, 19 bp, Homo sapiens
tgcctcttctgggagggca

SEQ ID NO: 3493732 - DNA, 16 bp, Homo sapiens
tgcctctttcatccac

SEQ ID NO: 3493733 - DNA, 18 bp, Homo sapiens
tgcctcttttacctgctg

SEQ ID NO: 3493734 - DNA, 19 bp, Homo sapiens
tgcctcttttacctgctgc

SEQ ID NO: 3493735 - DNA, 21 bp, Homo sapiens
tgcctcttttacctgctgctt

SEQ ID NO: 3493736 - DNA, 13 bp, Homo sapiens
tgcctgaagaaca

SEQ ID NO: 3493737 - DNA, 21 bp, Homo sapiens
tgcctgactagggagccatgt

SEQ ID NO: 3493738 - DNA, 15 bp, Homo sapiens
tgcctgattgccaag

SEQ ID NO: 3493739 - DNA, 15 bp, Homo sapiens
tgcctgccagctgca

SEQ ID NO: 3493740 - DNA, 16 bp, Homo sapiens
tgcctgccagctgcac

SEQ ID NO: 3493741 - DNA, 17 bp, Homo sapiens
tgcctgccatagccagg

SEQ ID NO: 3493742 - DNA, 23 bp, Homo sapiens
tgcctggcaggctgtctggccag

SEQ ID NO: 3493743 - DNA, 14 bp, Homo sapiens
tgcctggtattttc

SEQ ID NO: 3493744 - DNA, 15 bp, Homo sapiens
ccactttttgcagct

SEQ ID NO: 3493745 - DNA, 13 bp, Homo sapiens
aaaaaaaaaccaa

SEQ ID NO: 3493746 - DNA, 11 bp, Homo sapiens
aaaaaaaagaa

SEQ ID NO: 3493747 - DNA, 12 bp, Homo sapiens
aaaaaaaagaat

SEQ ID NO: 3493748 - DNA, 13 bp, Homo sapiens
aaaaaaagaataa

SEQ ID NO: 3493749 - DNA, 14 bp, Homo sapiens
aaaaaaagatctgt

SEQ ID NO: 3493750 - DNA, 12 bp, Homo sapiens
aaaaaaatgaaa

SEQ ID NO: 3493751 - DNA, 15 bp, Homo sapiens
aaaaaatctgcagaa

SEQ ID NO: 3493752 - DNA, 13 bp, Homo sapiens
aaaaaatgttgtt

SEQ ID NO: 3493753 - DNA, 11 bp, Homo sapiens
aaaaaattggt

SEQ ID NO: 3493754 - DNA, 16 bp, Homo sapiens
aaaaacatagaaaaat

SEQ ID NO: 3493755 - DNA, 14 bp, Homo sapiens
aaaaacatattctt

SEQ ID NO: 3493756 - DNA, 12 bp, Homo sapiens
aaaaacattgcc

SEQ ID NO: 3493757 - DNA, 15 bp, Homo sapiens
aaaaacattgccttt

SEQ ID NO: 3493758 - DNA, 13 bp, Homo sapiens
aaaaacattgttt

SEQ ID NO: 3493759 - DNA, 16 bp, Homo sapiens
aaaaaccacacaaaga

SEQ ID NO: 3493760 - DNA, 20 bp, Homo sapiens
aaaaaccctatatgcttact

SEQ ID NO: 3493761 - DNA, 21 bp, Homo sapiens
aaaaaccctatatgcttactg

SEQ ID NO: 3493762 - DNA, 12 bp, Homo sapiens
aaaaacttacaa

SEQ ID NO: 3493763 - DNA, 15 bp, Homo sapiens
aaaaagaaaggaggg

SEQ ID NO: 3493764 - DNA, 14 bp, Homo sapiens
aaaaagacagggct

SEQ ID NO: 3493765 - DNA, 16 bp, Homo sapiens
aaaaagatgacccatt

SEQ ID NO: 3493766 - DNA, 14 bp, Homo sapiens
aaaaaggaggaaga

SEQ ID NO: 3493767 - DNA, 13 bp, Homo sapiens
aaaaaggctgaaa

SEQ ID NO: 3493768 - DNA, 14 bp, Homo sapiens
aaaaagtattattt

SEQ ID NO: 3493769 - DNA, 15 bp, Homo sapiens
aaaaagtattatttt

SEQ ID NO: 3493770 - DNA, 19 bp, Homo sapiens
aaaaagtcaccattctgca

SEQ ID NO: 3493771 - DNA, 24 bp, Homo sapiens
aaaaagtcaccattctgcatttag

SEQ ID NO: 3493772 - DNA, 23 bp, Homo sapiens
aaaaagtccaattttaatttagt

SEQ ID NO: 3493773 - DNA, 20 bp, Homo sapiens
aaaaagtctgtatggcatga

SEQ ID NO: 3493774 - DNA, 14 bp, Homo sapiens
aaaaataacaatga

SEQ ID NO: 3493775 - DNA, 13 bp, Homo sapiens
aaaaatactcaga

SEQ ID NO: 3493776 - DNA, 15 bp, Homo sapiens
aaaaatagcaacttg

SEQ ID NO: 3493777 - DNA, 17 bp, Homo sapiens
aaaaatagcaacttgtg

SEQ ID NO: 3493778 - DNA, 18 bp, Homo sapiens
aaaaatctgcagaaggaa

SEQ ID NO: 3493779 - DNA, 18 bp, Homo sapiens
aaaaatgcaaatcctatg

SEQ ID NO: 3493780 - DNA, 23 bp, Homo sapiens
aaaaatgcaaatcctatgtgatt

SEQ ID NO: 3493781 - DNA, 16 bp, Homo sapiens
aaaaatgtatatgcac

SEQ ID NO: 3493782 - DNA, 12 bp, Homo sapiens
aaaaattaaaat

SEQ ID NO: 3493783 - DNA, 14 bp, Homo sapiens
aaaaattatttttt

SEQ ID NO: 3493784 - DNA, 15 bp, Homo sapiens
aaaacaaaaagaaca

SEQ ID NO: 3493785 - DNA, 15 bp, Homo sapiens
aaaacaaaaccagct

SEQ ID NO: 3493786 - DNA, 18 bp, Homo sapiens
aaaacaaaaccagctgct

SEQ ID NO: 3493787 - DNA, 15 bp, Homo sapiens
aaaacaaaactgcat

SEQ ID NO: 3493788 - DNA, 12 bp, Homo sapiens
aaaacaaaattt

SEQ ID NO: 3493789 - DNA, 12 bp, Homo sapiens
aaaacaaagaag

SEQ ID NO: 3493790 - DNA, 23 bp, Homo sapiens
aaaacatagaaatggaaattttg

SEQ ID NO: 3493791 - DNA, 19 bp, Homo sapiens
aaaacatattcttgtgctt

SEQ ID NO: 3493792 - DNA, 13 bp, Homo sapiens
aaaacatctattc

SEQ ID NO: 3493793 - DNA, 21 bp, Homo sapiens
aaaacatctattctctccaaa

SEQ ID NO: 3493794 - DNA, 13 bp, Homo sapiens
aaaacatgtatgt

SEQ ID NO: 3493795 - DNA, 16 bp, Homo sapiens
aaaacattaagaaaat

SEQ ID NO: 3493796 - DNA, 18 bp, Homo sapiens
aaaacattaagaaaatca

SEQ ID NO: 3493797 - DNA, 14 bp, Homo sapiens
aaaaccaagaagat

SEQ ID NO: 3493798 - DNA, 19 bp, Homo sapiens
aaaaccaatgttttgcagt

SEQ ID NO: 3493799 - DNA, 12 bp, Homo sapiens
aaaaccacacaa

SEQ ID NO: 3493800 - DNA, 20 bp, Homo sapiens
aaaaccagctgctactcata

SEQ ID NO: 3493801 - DNA, 18 bp, Homo sapiens
aaaacccagactgtctcc

SEQ ID NO: 3493802 - DNA, 21 bp, Homo sapiens
aaaaccctatatgcttactgt

SEQ ID NO: 3493803 - DNA, 14 bp, Homo sapiens
aaaaccttttgaaa

SEQ ID NO: 3493804 - DNA, 21 bp, Homo sapiens
aaaacgaagctcattcccaac

SEQ ID NO: 3493805 - DNA, 15 bp, Homo sapiens
aaaactctacttaat

SEQ ID NO: 3493806 - DNA, 23 bp, Homo sapiens
aaaactgaaagtgaaagtccaga

SEQ ID NO: 3493807 - DNA, 21 bp, Homo sapiens
aaaactggcaacattccaaga

SEQ ID NO: 3493808 - DNA, 15 bp, Homo sapiens
aaaacttgtgctata

SEQ ID NO: 3493809 - DNA, 17 bp, Homo sapiens
aaaacttgtgctataaa

SEQ ID NO: 3493810 - DNA, 18 bp, Homo sapiens
aaaagaacatgcagtttg

SEQ ID NO: 3493811 - DNA, 11 bp, Homo sapiens
aaaagaagttt

SEQ ID NO: 3493812 - DNA, 20 bp, Homo sapiens
aaaagacaaggaaaaaataa

SEQ ID NO: 3493813 - DNA, 18 bp, Homo sapiens
aaaagagctcagacattt

SEQ ID NO: 3493814 - DNA, 12 bp, Homo sapiens
aaaagagggggg

SEQ ID NO: 3493815 - DNA, 19 bp, Homo sapiens
aaaagataatattttacat

SEQ ID NO: 3493816 - DNA, 12 bp, Homo sapiens
aaaagatataag

SEQ ID NO: 3493817 - DNA, 14 bp, Homo sapiens
aaaagatataagtg

SEQ ID NO: 3493818 - DNA, 21 bp, Homo sapiens
aaaagatatattaaaaatata

SEQ ID NO: 3493819 - DNA, 22 bp, Homo sapiens
aaaagatatattaaaaatataa

SEQ ID NO: 3493820 - DNA, 23 bp, Homo sapiens
aaaagatctgttttgaaggcaaa

SEQ ID NO: 3493821 - DNA, 19 bp, Homo sapiens
aaaagatggggtctgtaaa

SEQ ID NO: 3493822 - DNA, 14 bp, Homo sapiens
aaaagattttaatc

SEQ ID NO: 3493823 - DNA, 12 bp, Homo sapiens
aaaagcaaaatc

SEQ ID NO: 3493824 - DNA, 14 bp, Homo sapiens
aaaagcaaaatcat

SEQ ID NO: 3493825 - DNA, 16 bp, Homo sapiens
aaaagcacttgaagaa

SEQ ID NO: 3493826 - DNA, 15 bp, Homo sapiens
aaaagcagagcattt

SEQ ID NO: 3493827 - DNA, 16 bp, Homo sapiens
aaaagcagagcatttt

SEQ ID NO: 3493828 - DNA, 17 bp, Homo sapiens
aaaagcagctctcccct

SEQ ID NO: 3493829 - DNA, 16 bp, Homo sapiens
aaaagcgcttttcctt

SEQ ID NO: 3493830 - DNA, 13 bp, Homo sapiens
aaaagctgctcag

SEQ ID NO: 3493831 - DNA, 14 bp, Homo sapiens
aaaaggactctgga

SEQ ID NO: 3493832 - DNA, 15 bp, Homo sapiens
aaaaggccaaacctc

SEQ ID NO: 3493833 - DNA, 19 bp, Homo sapiens
aaaaggccaaacctctgtt

SEQ ID NO: 3493834 - DNA, 17 bp, Homo sapiens
aaaaggctcgtttggat

SEQ ID NO: 3493835 - DNA, 19 bp, Homo sapiens
aaaaggctcgtttggatct

SEQ ID NO: 3493836 - DNA, 13 bp, Homo sapiens
aaaaggggctcct

SEQ ID NO: 3493837 - DNA, 16 bp, Homo sapiens
aaaaggtttacagaat

SEQ ID NO: 3493838 - DNA, 13 bp, Homo sapiens
aaaagtattatca

SEQ ID NO: 3493839 - DNA, 21 bp, Homo sapiens
aaaagtcagtatcatattatt

SEQ ID NO: 3493840 - DNA, 22 bp, Homo sapiens
aaaagtccaattttaatttagt

SEQ ID NO: 3493841 - DNA, 16 bp, Homo sapiens
aaaagtggcctctttg

SEQ ID NO: 3493842 - DNA, 17 bp, Homo sapiens
aaaagtggcctctttgt

SEQ ID NO: 3493843 - DNA, 17 bp, Homo sapiens
aaaagtgggcttgattc

SEQ ID NO: 3493844 - DNA, 18 bp, Homo sapiens
aaaagttaatgcttaaga

SEQ ID NO: 3493845 - DNA, 15 bp, Homo sapiens
aaaataaaaaatgtg

SEQ ID NO: 3493846 - DNA, 12 bp, Homo sapiens
aaaataaaacag

SEQ ID NO: 3493847 - DNA, 14 bp, Homo sapiens
aaaataaaacagta

SEQ ID NO: 3493848 - DNA, 19 bp, Homo sapiens
aaaataaaaggactctgga

SEQ ID NO: 3493849 - DNA, 15 bp, Homo sapiens
aaaataaacactaca

SEQ ID NO: 3493850 - DNA, 12 bp, Homo sapiens
aaaataaatata

SEQ ID NO: 3493851 - DNA, 14 bp, Homo sapiens
aaaataaatttata

SEQ ID NO: 3493852 - DNA, 15 bp, Homo sapiens
aaaatacttttcctt

SEQ ID NO: 3493853 - DNA, 19 bp, Homo sapiens
aaaatactttttctaatga

SEQ ID NO: 3493854 - DNA, 23 bp, Homo sapiens
aaaatagaatatagcatctttca

SEQ ID NO: 3493855 - DNA, 12 bp, Homo sapiens
aaaataggcagg

SEQ ID NO: 3493856 - DNA, 13 bp, Homo sapiens
aaaataggcagga

SEQ ID NO: 3493857 - DNA, 23 bp, Homo sapiens
aaaatagttaagacatgatttcc

SEQ ID NO: 3493858 - DNA, 14 bp, Homo sapiens
aaaatataaaactg

SEQ ID NO: 3493859 - DNA, 17 bp, Homo sapiens
aaaatataaaactgcgt

SEQ ID NO: 3493860 - DNA, 22 bp, Homo sapiens
aaaatataaaactgcgttaaag

SEQ ID NO: 3493861 - DNA, 12 bp, Homo sapiens
aaaatataagta

SEQ ID NO: 3493862 - DNA, 18 bp, Homo sapiens
aaaatataagtaaagtga

SEQ ID NO: 3493863 - DNA, 16 bp, Homo sapiens
aaaatatagctgtaca

SEQ ID NO: 3493864 - DNA, 16 bp, Homo sapiens
aaaatatatgtatttt

SEQ ID NO: 3493865 - DNA, 16 bp, Homo sapiens
aaaatatttaaaaatg

SEQ ID NO: 3493866 - DNA, 19 bp, Homo sapiens
aaaatatttaaaaatgtct

SEQ ID NO: 3493867 - DNA, 13 bp, Homo sapiens
aaaatattttctc

SEQ ID NO: 3493868 - DNA, 18 bp, Homo sapiens
aaaatattttgtctaaaa

SEQ ID NO: 3493869 - DNA, 20 bp, Homo sapiens
aaaatattttgtctaaaatg

SEQ ID NO: 3493870 - DNA, 23 bp, Homo sapiens
aaaatcaactttttattgccttc

SEQ ID NO: 3493871 - DNA, 15 bp, Homo sapiens
aaaatcaattaacca

SEQ ID NO: 3493872 - DNA, 13 bp, Homo sapiens
aaaatcagcctgc

SEQ ID NO: 3493873 - DNA, 13 bp, Homo sapiens
aaaatctgcctgg

SEQ ID NO: 3493874 - DNA, 20 bp, Homo sapiens
aaaatctgtcacgtagaact

SEQ ID NO: 3493875 - DNA, 21 bp, Homo sapiens
aacctgggattcaggaatgtg

SEQ ID NO: 3493876 - DNA, 22 bp, Homo sapiens
aacctgtgcccaggccagcttc

SEQ ID NO: 3493877 - DNA, 22 bp, Homo sapiens
aacctgtttctacctatatgca

SEQ ID NO: 3493878 - DNA, 22 bp, Homo sapiens
aaccttatctccacaacctctt

SEQ ID NO: 3493879 - DNA, 15 bp, Homo sapiens
aaccttattgtacct

SEQ ID NO: 3493880 - DNA, 12 bp, Homo sapiens
aaccttccaaac

SEQ ID NO: 3493881 - DNA, 21 bp, Homo sapiens
aacgaaccttggcctgggccg

SEQ ID NO: 3493882 - DNA, 12 bp, Homo sapiens
aacgaggaagcc

SEQ ID NO: 3493883 - DNA, 12 bp, Homo sapiens
aacgatttagaa

SEQ ID NO: 3493884 - DNA, 13 bp, Homo sapiens
aacgatttagaaa

SEQ ID NO: 3493885 - DNA, 18 bp, Homo sapiens
aacgcctcccctgcccca

SEQ ID NO: 3493886 - DNA, 16 bp, Homo sapiens
aacgctcctttgtgtg

SEQ ID NO: 3493887 - DNA, 11 bp, Homo sapiens
aacgctgcctg

SEQ ID NO: 3493888 - DNA, 12 bp, Homo sapiens
aacgctgcctgc

SEQ ID NO: 3493889 - DNA, 15 bp, Homo sapiens
aacgctgcctgcccg

SEQ ID NO: 3493890 - DNA, 19 bp, Homo sapiens
aacggccctgcagccagct

SEQ ID NO: 3493891 - DNA, 19 bp, Homo sapiens
aacgtctttttgtttgttt

SEQ ID NO: 3493892 - DNA, 14 bp, Homo sapiens
aacgtgcaaagcca

SEQ ID NO: 3493893 - DNA, 18 bp, Homo sapiens
aacgtgcaaagccaaggc

SEQ ID NO: 3493894 - DNA, 11 bp, Homo sapiens
aacgtgcattg

SEQ ID NO: 3493895 - DNA, 23 bp, Homo sapiens
aacgtgcattgtgcttctttctt

SEQ ID NO: 3493896 - DNA, 15 bp, Homo sapiens
aactaaactcattta

SEQ ID NO: 3493897 - DNA, 18 bp, Homo sapiens
aactaaggtgctaaatct

SEQ ID NO: 3493898 - DNA, 17 bp, Homo sapiens
aactagaatttattcaa

SEQ ID NO: 3493899 - DNA, 14 bp, Homo sapiens
aactagatggtgct

SEQ ID NO: 3493900 - DNA, 20 bp, Homo sapiens
aactagctctatgtttacaa

SEQ ID NO: 3493901 - DNA, 18 bp, Homo sapiens
aactcaaatggggccaga

SEQ ID NO: 3493902 - DNA, 21 bp, Homo sapiens
aactcagaaacatcagttact

SEQ ID NO: 3493903 - DNA, 12 bp, Homo sapiens
aactcagatcca

SEQ ID NO: 3493904 - DNA, 15 bp, Homo sapiens
aactcagatccaggg

SEQ ID NO: 3493905 - DNA, 15 bp, Homo sapiens
aactcagttttaact

SEQ ID NO: 3493906 - DNA, 21 bp, Homo sapiens
aactcatccctaatgctgcag

SEQ ID NO: 3493907 - DNA, 12 bp, Homo sapiens
aactcatctcat

SEQ ID NO: 3493908 - DNA, 14 bp, Homo sapiens
aactcattccagat

SEQ ID NO: 3493909 - DNA, 18 bp, Homo sapiens
aactccataagtaagaaa

SEQ ID NO: 3493910 - DNA, 14 bp, Homo sapiens
aactccctttttac

SEQ ID NO: 3493911 - DNA, 19 bp, Homo sapiens
aactccctttttacacttt

SEQ ID NO: 3493912 - DNA, 21 bp, Homo sapiens
aactccctttttacactttat

SEQ ID NO: 3493913 - DNA, 17 bp, Homo sapiens
aactccgagtgaactgg

SEQ ID NO: 3493914 - DNA, 12 bp, Homo sapiens
aactcctcccat

SEQ ID NO: 3493915 - DNA, 23 bp, Homo sapiens
aactcctcgacatcactgttcat

SEQ ID NO: 3493916 - DNA, 15 bp, Homo sapiens
aactcgtatagcatg

SEQ ID NO: 3493917 - DNA, 23 bp, Homo sapiens
aactctagctgggggtgggccag

SEQ ID NO: 3493918 - DNA, 12 bp, Homo sapiens
aactctctgaac

SEQ ID NO: 3493919 - DNA, 10 bp, Homo sapiens
aactctcttt

SEQ ID NO: 3493920 - DNA, 13 bp, Homo sapiens
aactctggtggca

SEQ ID NO: 3493921 - DNA, 16 bp, Homo sapiens
aactctgtggcattat

SEQ ID NO: 3493922 - DNA, 22 bp, Homo sapiens
aactctgttgcaagtgcaataa

SEQ ID NO: 3493923 - DNA, 13 bp, Homo sapiens
aactcttaaaaat

SEQ ID NO: 3493924 - DNA, 18 bp, Homo sapiens
aactcttcacaaaatctg

SEQ ID NO: 3493925 - DNA, 15 bp, Homo sapiens
aactcttcactcttc

SEQ ID NO: 3493926 - DNA, 23 bp, Homo sapiens
aactcttcagttaattcttagat

SEQ ID NO: 3493927 - DNA, 14 bp, Homo sapiens
aactctttgagaaa

SEQ ID NO: 3493928 - DNA, 13 bp, Homo sapiens
aactcttttggac

SEQ ID NO: 3493929 - DNA, 13 bp, Homo sapiens
aactgaaagtgaa

SEQ ID NO: 3493930 - DNA, 13 bp, Homo sapiens
aactgagcctagc

SEQ ID NO: 3493931 - DNA, 14 bp, Homo sapiens
aactgcaggccctg

SEQ ID NO: 3493932 - DNA, 16 bp, Homo sapiens
aactgcaggccctggc

SEQ ID NO: 3493933 - DNA, 20 bp, Homo sapiens
aactgcaggccctggcctcc

SEQ ID NO: 3493934 - DNA, 21 bp, Homo sapiens
aactgcaggccctggcctccc

SEQ ID NO: 3493935 - DNA, 14 bp, Homo sapiens
aactgcatgctgct

SEQ ID NO: 3493936 - DNA, 21 bp, Homo sapiens
aactgcattaccgcgttgtaa

SEQ ID NO: 3493937 - DNA, 20 bp, Homo sapiens
aactgcctcgaaacacagaa

SEQ ID NO: 3493938 - DNA, 16 bp, Homo sapiens
aactgctcagctctgg

SEQ ID NO: 3493939 - DNA, 15 bp, Homo sapiens
aactgctgactgttt

SEQ ID NO: 3493940 - DNA, 17 bp, Homo sapiens
aactggaccctgttgct

SEQ ID NO: 3493941 - DNA, 22 bp, Homo sapiens
aactggcaggcaggctcccagg

SEQ ID NO: 3493942 - DNA, 14 bp, Homo sapiens
aactggtcttcctt

SEQ ID NO: 3493943 - DNA, 15 bp, Homo sapiens
aactggtcttccttt

SEQ ID NO: 3493944 - DNA, 12 bp, Homo sapiens
aactgtaaatca

SEQ ID NO: 3493945 - DNA, 13 bp, Homo sapiens
aactgtaatacaa

SEQ ID NO: 3493946 - DNA, 23 bp, Homo sapiens
aactgtagcaagaactgcacggt

SEQ ID NO: 3493947 - DNA, 20 bp, Homo sapiens
aactgtgcttctctatgata

SEQ ID NO: 3493948 - DNA, 14 bp, Homo sapiens
aactgtgtgtaatt

SEQ ID NO: 3493949 - DNA, 22 bp, Homo sapiens
aactgtgtgtaattgttccttt

SEQ ID NO: 3493950 - DNA, 19 bp, Homo sapiens
aactgtgtttcaagttcaa

SEQ ID NO: 3493951 - DNA, 13 bp, Homo sapiens
aactgttcccacc

SEQ ID NO: 3493952 - DNA, 14 bp, Homo sapiens
aactgtttccttca

SEQ ID NO: 3493953 - DNA, 21 bp, Homo sapiens
aacttaagcaaaggggacagc

SEQ ID NO: 3493954 - DNA, 12 bp, Homo sapiens
aacttacaaaaa

SEQ ID NO: 3493955 - DNA, 19 bp, Homo sapiens
aacttacattgttcaatta

SEQ ID NO: 3493956 - DNA, 20 bp, Homo sapiens
aacttacattgttcaattag

SEQ ID NO: 3493957 - DNA, 19 bp, Homo sapiens
aacttatcctaaaacaaat

SEQ ID NO: 3493958 - DNA, 19 bp, Homo sapiens
aacttccaggtgttactgt

SEQ ID NO: 3493959 - DNA, 18 bp, Homo sapiens
aacttccccatcttctaa

SEQ ID NO: 3493960 - DNA, 21 bp, Homo sapiens
aacttcgctgtcccccaacac

SEQ ID NO: 3493961 - DNA, 15 bp, Homo sapiens
aacttcttatggaat

SEQ ID NO: 3493962 - DNA, 21 bp, Homo sapiens
aacttgaaatatcctgcttga

SEQ ID NO: 3493963 - DNA, 19 bp, Homo sapiens
aacttgaccctgagctgac

SEQ ID NO: 3493964 - DNA, 21 bp, Homo sapiens
aacttgcaatataacattcta

SEQ ID NO: 3493965 - DNA, 16 bp, Homo sapiens
aacttgcagtgtcttt

SEQ ID NO: 3493966 - DNA, 18 bp, Homo sapiens
aacttgcctcttttacct

SEQ ID NO: 3493967 - DNA, 21 bp, Homo sapiens
aacttggctcgaatctctgtg

SEQ ID NO: 3493968 - DNA, 15 bp, Homo sapiens
aactttaagaggaca

SEQ ID NO: 3493969 - DNA, 17 bp, Homo sapiens
aactttattaaatacaa

SEQ ID NO: 3493970 - DNA, 19 bp, Homo sapiens
aactttattaaatacaaaa

SEQ ID NO: 3493971 - DNA, 19 bp, Homo sapiens
aactttcctcttcctgcct

SEQ ID NO: 3493972 - DNA, 15 bp, Homo sapiens
aactttcctggatgt

SEQ ID NO: 3493973 - DNA, 12 bp, Homo sapiens
aactttgaataa

SEQ ID NO: 3493974 - DNA, 15 bp, Homo sapiens
aactttgaataaaga

SEQ ID NO: 3493975 - DNA, 17 bp, Homo sapiens
aactttgaataaagaat

SEQ ID NO: 3493976 - DNA, 22 bp, Homo sapiens
aactttgtggtctaaagtgttt

SEQ ID NO: 3493977 - DNA, 17 bp, Homo sapiens
aacttttcaatgacatt

SEQ ID NO: 3493978 - DNA, 12 bp, Homo sapiens
aactttttacat

SEQ ID NO: 3493979 - DNA, 13 bp, Homo sapiens
aactttttacatt

SEQ ID NO: 3493980 - DNA, 14 bp, Homo sapiens
aactttttattgcc

SEQ ID NO: 3493981 - DNA, 23 bp, Homo sapiens
aactttttattgccttctcacca

SEQ ID NO: 3493982 - DNA, 19 bp, Homo sapiens
aagaaaaaatattttccct

SEQ ID NO: 3493983 - DNA, 17 bp, Homo sapiens
aagaaaaatgagcctgg

SEQ ID NO: 3493984 - DNA, 18 bp, Homo sapiens
aagaaaacatctattctc

SEQ ID NO: 3493985 - DNA, 22 bp, Homo sapiens
aagaaaagattttaatcaagtt

SEQ ID NO: 3493986 - DNA, 15 bp, Homo sapiens
aagaaaagtgcatat

SEQ ID NO: 3493987 - DNA, 20 bp, Homo sapiens
aagaaaagtgcatatttatc

SEQ ID NO: 3493988 - DNA, 17 bp, Homo sapiens
aagaaaatcatattgct

SEQ ID NO: 3493989 - DNA, 19 bp, Homo sapiens
aagaaacaactctttgaga

SEQ ID NO: 3493990 - DNA, 17 bp, Homo sapiens
aagaaagatgtatatag

SEQ ID NO: 3493991 - DNA, 23 bp, Homo sapiens
aagaaataaaaggaagccaaaga

SEQ ID NO: 3493992 - DNA, 15 bp, Homo sapiens
aagaacaatattgac

SEQ ID NO: 3493993 - DNA, 21 bp, Homo sapiens
aagaacggggctcttctcatt

SEQ ID NO: 3493994 - DNA, 21 bp, Homo sapiens
aagaactacaaacaaaatttc

SEQ ID NO: 3493995 - DNA, 18 bp, Homo sapiens
aagaactgcaggccctgg

SEQ ID NO: 3493996 - DNA, 22 bp, Homo sapiens
aagaactgcaggccctggcctc

SEQ ID NO: 3493997 - DNA, 20 bp, Homo sapiens
aagaactgtgtttcaagttc

SEQ ID NO: 3493998 - DNA, 13 bp, Homo sapiens
aagaagacttttt

SEQ ID NO: 3493999 - DNA, 14 bp, Homo sapiens
aagaagatctgtaa

SEQ ID NO: 3494000 - DNA, 15 bp, Homo sapiens
aagaagcccccagct

SEQ ID NO: 3494001 - DNA, 19 bp, Homo sapiens
aagaagcccccagctaaga

SEQ ID NO: 3494002 - DNA, 23 bp, Homo sapiens
aagaaggaatataccttttttgt

SEQ ID NO: 3494003 - DNA, 21 bp, Homo sapiens
aagaagggctgcatgatgttt

SEQ ID NO: 3494004 - DNA, 21 bp, Homo sapiens
aagaaggggacaatggcagaa

SEQ ID NO: 3494005 - DNA, 16 bp, Homo sapiens
aagaagtgagtgtttc

SEQ ID NO: 3494006 - DNA, 20 bp, Homo sapiens
aagaagtgagtgtttctatg

SEQ ID NO: 3494007 - DNA, 20 bp, Homo sapiens
aagaataaaatgttgaaaag

SEQ ID NO: 3494008 - DNA, 22 bp, Homo sapiens
aagggcatgggtcgggagaggg

SEQ ID NO: 3494009 - DNA, 15 bp, Homo sapiens
aagggccagacagac

SEQ ID NO: 3494010 - DNA, 22 bp, Homo sapiens
aagggccagacagaccttcaca

SEQ ID NO: 3494011 - DNA, 11 bp, Homo sapiens
aagggccagag

SEQ ID NO: 3494012 - DNA, 14 bp, Homo sapiens
aagggccagagcca

SEQ ID NO: 3494013 - DNA, 13 bp, Homo sapiens
aagggcccagaga

SEQ ID NO: 3494014 - DNA, 15 bp, Homo sapiens
aagggcgcaaagggc

SEQ ID NO: 3494015 - DNA, 19 bp, Homo sapiens
aagggcgcaaagggcatgg

SEQ ID NO: 3494016 - DNA, 21 bp, Homo sapiens
aagggcgcaaagggcatgggt

SEQ ID NO: 3494017 - DNA, 16 bp, Homo sapiens
aagggctatgtaaata

SEQ ID NO: 3494018 - DNA, 13 bp, Homo sapiens
aagggctgaaccc

SEQ ID NO: 3494019 - DNA, 20 bp, Homo sapiens
aagggctgaaccctcagcct

SEQ ID NO: 3494020 - DNA, 21 bp, Homo sapiens
aagggctgaaccctcagcctt

SEQ ID NO: 3494021 - DNA, 14 bp, Homo sapiens
aagggctgcatgat

SEQ ID NO: 3494022 - DNA, 15 bp, Homo sapiens
aagggctgcatgatg

SEQ ID NO: 3494023 - DNA, 20 bp, Homo sapiens
aagggctgcatgatgtttgc

SEQ ID NO: 3494024 - DNA, 21 bp, Homo sapiens
aagggctggggccggggctga

SEQ ID NO: 3494025 - DNA, 23 bp, Homo sapiens
aaggggaatgtttgcctctgcct

SEQ ID NO: 3494026 - DNA, 11 bp, Homo sapiens
aaggggacagc

SEQ ID NO: 3494027 - DNA, 16 bp, Homo sapiens
aaggggacagctgtgt

SEQ ID NO: 3494028 - DNA, 16 bp, Homo sapiens
aaggggagcccactgt

SEQ ID NO: 3494029 - DNA, 15 bp, Homo sapiens
aaggggatggagtga

SEQ ID NO: 3494030 - DNA, 12 bp, Homo sapiens
aaggggcacctc

SEQ ID NO: 3494031 - DNA, 17 bp, Homo sapiens
aaggggccagaggctcg

SEQ ID NO: 3494032 - DNA, 20 bp, Homo sapiens
aaggggcggtgcccacaccg

SEQ ID NO: 3494033 - DNA, 22 bp, Homo sapiens
aaggggcttcaggtccaggctg

SEQ ID NO: 3494034 - DNA, 17 bp, Homo sapiens
aagggggtggtgtctcc

SEQ ID NO: 3494035 - DNA, 17 bp, Homo sapiens
aaggggtcaaaatttgc

SEQ ID NO: 3494036 - DNA, 17 bp, Homo sapiens
aagggtatcaggtgctg

SEQ ID NO: 3494037 - DNA, 16 bp, Homo sapiens
aagggttaaggcctga

SEQ ID NO: 3494038 - DNA, 14 bp, Homo sapiens
aaggtaaaatgcca

SEQ ID NO: 3494039 - DNA, 18 bp, Homo sapiens
aaggtaaaatgccatgat

SEQ ID NO: 3494040 - DNA, 22 bp, Homo sapiens
aaggtaaaatgccatgatgcct

SEQ ID NO: 3494041 - DNA, 16 bp, Homo sapiens
aaggtcacctgggctg

SEQ ID NO: 3494042 - DNA, 14 bp, Homo sapiens
aaggtgaggcctgt

SEQ ID NO: 3494043 - DNA, 17 bp, Homo sapiens
aaggtgatatatttaaa

SEQ ID NO: 3494044 - DNA, 17 bp, Homo sapiens
aaggttcactaaagcag

SEQ ID NO: 3494045 - DNA, 23 bp, Homo sapiens
aaggttccgcttggagcagaggg

SEQ ID NO: 3494046 - DNA, 16 bp, Homo sapiens
aaggttggagcccagg

SEQ ID NO: 3494047 - DNA, 18 bp, Homo sapiens
aaggttggagcccagggc

SEQ ID NO: 3494048 - DNA, 21 bp, Homo sapiens
aaggtttacaatttacaaagt

SEQ ID NO: 3494049 - DNA, 19 bp, Homo sapiens
aaggtttaggctggtggcc

SEQ ID NO: 3494050 - DNA, 21 bp, Homo sapiens
aaggtttaggctggtggccca

SEQ ID NO: 3494051 - DNA, 12 bp, Homo sapiens
aagtaagaaaat

SEQ ID NO: 3494052 - DNA, 13 bp, Homo sapiens
aagtaagaaaata

SEQ ID NO: 3494053 - DNA, 18 bp, Homo sapiens
aagtaagaaaatattttg

SEQ ID NO: 3494054 - DNA, 19 bp, Homo sapiens
aagtaagaaaatattttgt

SEQ ID NO: 3494055 - DNA, 15 bp, Homo sapiens
aagtaagagctctaa

SEQ ID NO: 3494056 - DNA, 19 bp, Homo sapiens
aagtacaaactaaggtgct

SEQ ID NO: 3494057 - DNA, 15 bp, Homo sapiens
aagtacctcagcatt

SEQ ID NO: 3494058 - DNA, 19 bp, Homo sapiens
aagtacctttcctacattt

SEQ ID NO: 3494059 - DNA, 22 bp, Homo sapiens
aagtacctttcctacattttct

SEQ ID NO: 3494060 - DNA, 15 bp, Homo sapiens
aagtactgtaagaat

SEQ ID NO: 3494061 - DNA, 20 bp, Homo sapiens
aagtacttctccaccctgct

SEQ ID NO: 3494062 - DNA, 23 bp, Homo sapiens
aagtacttctccaccctgctctc

SEQ ID NO: 3494063 - DNA, 12 bp, Homo sapiens
aagtagaagagg

SEQ ID NO: 3494064 - DNA, 22 bp, Homo sapiens
aagtagcagggggggaaatgca

SEQ ID NO: 3494065 - DNA, 15 bp, Homo sapiens
aagtattattttcca

SEQ ID NO: 3494066 - DNA, 19 bp, Homo sapiens
aagtattgcatctgtataa

SEQ ID NO: 3494067 - DNA, 14 bp, Homo sapiens
aagtattgtaaatt

SEQ ID NO: 3494068 - DNA, 15 bp, Homo sapiens
aagtattgtaaatta

SEQ ID NO: 3494069 - DNA, 19 bp, Homo sapiens
aagtatttaattagtgcta

SEQ ID NO: 3494070 - DNA, 22 bp, Homo sapiens
aagtatttaattagtgctaagt

SEQ ID NO: 3494071 - DNA, 13 bp, Homo sapiens
aagtatttcaaat

SEQ ID NO: 3494072 - DNA, 22 bp, Homo sapiens
aagtatttcaaattggagcttc

SEQ ID NO: 3494073 - DNA, 15 bp, Homo sapiens
aagtcaaattaataa

SEQ ID NO: 3494074 - DNA, 16 bp, Homo sapiens
aagtcaacctgcctga

SEQ ID NO: 3494075 - DNA, 24 bp, Homo sapiens
aagtcacacagtattacttctgct

SEQ ID NO: 3494076 - DNA, 13 bp, Homo sapiens
aagtcacacagtg

SEQ ID NO: 3494077 - DNA, 16 bp, Homo sapiens
aagtcaccctagccct

SEQ ID NO: 3494078 - DNA, 20 bp, Homo sapiens
aagtcaccctagccctctcc

SEQ ID NO: 3494079 - DNA, 18 bp, Homo sapiens
aagtcagtatcatattat

SEQ ID NO: 3494080 - DNA, 21 bp, Homo sapiens
aagtcatctatagttgatatg

SEQ ID NO: 3494081 - DNA, 14 bp, Homo sapiens
aagtcatgtgcatt

SEQ ID NO: 3494082 - DNA, 15 bp, Homo sapiens
aagtcatgtgcattt

SEQ ID NO: 3494083 - DNA, 13 bp, Homo sapiens
aagtcattggctt

SEQ ID NO: 3494084 - DNA, 21 bp, Homo sapiens
aagtccccaggccccaggaag

SEQ ID NO: 3494085 - DNA, 17 bp, Homo sapiens
aagtccctgtcacctct

SEQ ID NO: 3494086 - DNA, 21 bp, Homo sapiens
aagtcctccctgacttttctg

SEQ ID NO: 3494087 - DNA, 23 bp, Homo sapiens
aagtcctccctgacttttctgtg

SEQ ID NO: 3494088 - DNA, 17 bp, Homo sapiens
aagtcctgtatgtctgt

SEQ ID NO: 3494089 - DNA, 20 bp, Homo sapiens
aagtcctgtatgtctgtcat

SEQ ID NO: 3494090 - DNA, 17 bp, Homo sapiens
aagtcctttgtgaatat

SEQ ID NO: 3494091 - DNA, 15 bp, Homo sapiens
aagtccttttgtaaa

SEQ ID NO: 3494092 - DNA, 14 bp, Homo sapiens
aagtctgtttactg

SEQ ID NO: 3494093 - DNA, 22 bp, Homo sapiens
aagtcttatatattgtagataa

SEQ ID NO: 3494094 - DNA, 14 bp, Homo sapiens
aagtcttttgttcg

SEQ ID NO: 3494095 - DNA, 21 bp, Homo sapiens
aagtgaaaaaggaggaagaga

SEQ ID NO: 3494096 - DNA, 17 bp, Homo sapiens
aagtgaatttttctcta

SEQ ID NO: 3494097 - DNA, 19 bp, Homo sapiens
aagtgaatttttctctaac

SEQ ID NO: 3494098 - DNA, 18 bp, Homo sapiens
aagtgagaataggcagcc

SEQ ID NO: 3494099 - DNA, 14 bp, Homo sapiens
aagtgagagctggg

SEQ ID NO: 3494100 - DNA, 15 bp, Homo sapiens
aagtgagagctgggt

SEQ ID NO: 3494101 - DNA, 20 bp, Homo sapiens
aagtgatcctcccacctcag

SEQ ID NO: 3494102 - DNA, 19 bp, Homo sapiens
aagtgatgctgtgatacct

SEQ ID NO: 3494103 - DNA, 20 bp, Homo sapiens
aagtgattctcctgcctcag

SEQ ID NO: 3494104 - DNA, 15 bp, Homo sapiens
aagtgccatctcaat

SEQ ID NO: 3494105 - DNA, 11 bp, Homo sapiens
aagtgctcagg

SEQ ID NO: 3494106 - DNA, 15 bp, Homo sapiens
aagtgctcagggaaa

SEQ ID NO: 3494107 - DNA, 23 bp, Homo sapiens
aagtgctggcaaccactaagaat

SEQ ID NO: 3494108 - DNA, 12 bp, Homo sapiens
aagtgctgtata

SEQ ID NO: 3494109 - DNA, 15 bp, Homo sapiens
aagtgctgtataaaa

SEQ ID NO: 3494110 - DNA, 19 bp, Homo sapiens
aagtgctgtataaaatcag

SEQ ID NO: 3494111 - DNA, 22 bp, Homo sapiens
aagtgctgtataaaatcagcca

SEQ ID NO: 3494112 - DNA, 22 bp, Homo sapiens
aagtggcctctttgtctaaaac

SEQ ID NO: 3494113 - DNA, 18 bp, Homo sapiens
aagtggtggtaaccctgg

SEQ ID NO: 3494114 - DNA, 19 bp, Homo sapiens
aagtgtaagaaacacactg

SEQ ID NO: 3494115 - DNA, 13 bp, Homo sapiens
aagtgtaggcaga

SEQ ID NO: 3494116 - DNA, 14 bp, Homo sapiens
aagtgtaggcagac

SEQ ID NO: 3494117 - DNA, 16 bp, Homo sapiens
aagtgtaggcagacac

SEQ ID NO: 3494118 - DNA, 17 bp, Homo sapiens
aagtgtaggcagacaca

SEQ ID NO: 3494119 - DNA, 19 bp, Homo sapiens
aagtgtaggcagacacagg

SEQ ID NO: 3494120 - DNA, 13 bp, Homo sapiens
aagtgtatttttc

SEQ ID NO: 3494121 - DNA, 11 bp, Homo sapiens
aagtgtctttt

SEQ ID NO: 3494122 - DNA, 19 bp, Homo sapiens
aagtgtcttttgacatttt

SEQ ID NO: 3494123 - DNA, 21 bp, Homo sapiens
aagtgtgaactggaccctgtt

SEQ ID NO: 3494124 - DNA, 13 bp, Homo sapiens
aagtgtgtattaa

SEQ ID NO: 3494125 - DNA, 15 bp, Homo sapiens
aagtgtgtattaaaa

SEQ ID NO: 3494126 - DNA, 22 bp, Homo sapiens
aagttacacagaaatgctgctg

SEQ ID NO: 3494127 - DNA, 23 bp, Homo sapiens
aagttacacagaaatgctgctgg

SEQ ID NO: 3494128 - DNA, 20 bp, Homo sapiens
aagttactaggtaacttcat

SEQ ID NO: 3494129 - DNA, 21 bp, Homo sapiens
aagttactaggtaacttcata

SEQ ID NO: 3494130 - DNA, 14 bp, Homo sapiens
aagttattttacct

SEQ ID NO: 3494131 - DNA, 15 bp, Homo sapiens
aagttatttttgtac

SEQ ID NO: 3494132 - DNA, 16 bp, Homo sapiens
aagttatttttgtaca

SEQ ID NO: 3494133 - DNA, 21 bp, Homo sapiens
aagttcaccagactctataaa

SEQ ID NO: 3494134 - DNA, 15 bp, Homo sapiens
aagttctgacttgac

SEQ ID NO: 3494135 - DNA, 13 bp, Homo sapiens
aagttctgctttc

SEQ ID NO: 3494136 - DNA, 21 bp, Homo sapiens
aagttgagaaggtgcctgcca

SEQ ID NO: 3494137 - DNA, 15 bp, Homo sapiens
aagttgcacggctgc

SEQ ID NO: 3494138 - DNA, 16 bp, Homo sapiens
aagttgcacggctgct

SEQ ID NO: 3494139 - DNA, 18 bp, Homo sapiens
aagttgcacggctgctga

SEQ ID NO: 3494140 - DNA, 15 bp, Homo sapiens
aatattttaagtatt

SEQ ID NO: 3494141 - DNA, 13 bp, Homo sapiens
aatattttggatg

SEQ ID NO: 3494142 - DNA, 19 bp, Homo sapiens
aatattttgtctaaaatgc

SEQ ID NO: 3494143 - DNA, 21 bp, Homo sapiens
aatcaacttgcttatcaactt

SEQ ID NO: 3494144 - DNA, 10 bp, Homo sapiens
aatcaacttt

SEQ ID NO: 3494145 - DNA, 13 bp, Homo sapiens
aatcaacttttta

SEQ ID NO: 3494146 - DNA, 15 bp, Homo sapiens
aatcagatctttatt

SEQ ID NO: 3494147 - DNA, 18 bp, Homo sapiens
aatcagccaattatgtta

SEQ ID NO: 3494148 - DNA, 13 bp, Homo sapiens
aatcagcctgctc

SEQ ID NO: 3494149 - DNA, 18 bp, Homo sapiens
aatcaggaatattttcca

SEQ ID NO: 3494150 - DNA, 14 bp, Homo sapiens
aatcagtataaaca

SEQ ID NO: 3494151 - DNA, 15 bp, Homo sapiens
aatcatcaagtcttt

SEQ ID NO: 3494152 - DNA, 19 bp, Homo sapiens
aatcatggcctcttgaaga

SEQ ID NO: 3494153 - DNA, 21 bp, Homo sapiens
aatcatgttctggtggtttga

SEQ ID NO: 3494154 - DNA, 19 bp, Homo sapiens
aatcatttctatttctcct

SEQ ID NO: 3494155 - DNA, 16 bp, Homo sapiens
aatcatttgtttacat

SEQ ID NO: 3494156 - DNA, 20 bp, Homo sapiens
aatccaaatggcgtctggaa

SEQ ID NO: 3494157 - DNA, 23 bp, Homo sapiens
aatccaatcagagaccaggccct

SEQ ID NO: 3494158 - DNA, 17 bp, Homo sapiens
aatccagacccggctgc

SEQ ID NO: 3494159 - DNA, 19 bp, Homo sapiens
aatccagacccggctgcgt

SEQ ID NO: 3494160 - DNA, 21 bp, Homo sapiens
aatccaggcagatccaggact

SEQ ID NO: 3494161 - DNA, 20 bp, Homo sapiens
aatccagtgtgcacccctcc

SEQ ID NO: 3494162 - DNA, 13 bp, Homo sapiens
aatcccagctact

SEQ ID NO: 3494163 - DNA, 17 bp, Homo sapiens
aatcccatttaaaaaaa

SEQ ID NO: 3494164 - DNA, 23 bp, Homo sapiens
aatcccttgtacctatggctgcc

SEQ ID NO: 3494165 - DNA, 20 bp, Homo sapiens
aatcctaccttgcttttgct

SEQ ID NO: 3494166 - DNA, 9 bp, Homo sapiens
aatcctcct

SEQ ID NO: 3494167 - DNA, 11 bp, Homo sapiens
aatcctcctcc

SEQ ID NO: 3494168 - DNA, 13 bp, Homo sapiens
aatccttttgtag

SEQ ID NO: 3494169 - DNA, 23 bp, Homo sapiens
aatcggatctggggctctgggat

SEQ ID NO: 3494170 - DNA, 19 bp, Homo sapiens
aatctagaggaaaagaaag

SEQ ID NO: 3494171 - DNA, 17 bp, Homo sapiens
aatctataaacaatgaa

SEQ ID NO: 3494172 - DNA, 13 bp, Homo sapiens
aatctcaccccat

SEQ ID NO: 3494173 - DNA, 22 bp, Homo sapiens
aatctcaccccatcccacaccc

SEQ ID NO: 3494174 - DNA, 16 bp, Homo sapiens
aatctcagttgatttt

SEQ ID NO: 3494175 - DNA, 15 bp, Homo sapiens
aatctcattactgct

SEQ ID NO: 3494176 - DNA, 13 bp, Homo sapiens
aatctcttccttc

SEQ ID NO: 3494177 - DNA, 13 bp, Homo sapiens
aatctgacccagt

SEQ ID NO: 3494178 - DNA, 17 bp, Homo sapiens
aatctgaggcatcctct

SEQ ID NO: 3494179 - DNA, 18 bp, Homo sapiens
aatctgaggcatcctctg

SEQ ID NO: 3494180 - DNA, 20 bp, Homo sapiens
aatctgaggcatcctctgac

SEQ ID NO: 3494181 - DNA, 17 bp, Homo sapiens
aatctgatggcttctcc

SEQ ID NO: 3494182 - DNA, 17 bp, Homo sapiens
aatctgcagaaggaaaa

SEQ ID NO: 3494183 - DNA, 14 bp, Homo sapiens
aatctggagaccag

SEQ ID NO: 3494184 - DNA, 15 bp, Homo sapiens
aatctggagaccagg

SEQ ID NO: 3494185 - DNA, 13 bp, Homo sapiens
aatctgtcaagag

SEQ ID NO: 3494186 - DNA, 17 bp, Homo sapiens
aatctgtgggtctggga

SEQ ID NO: 3494187 - DNA, 19 bp, Homo sapiens
aatctgtgggtctgggagt

SEQ ID NO: 3494188 - DNA, 20 bp, Homo sapiens
aatcttaaggtgtagccaca

SEQ ID NO: 3494189 - DNA, 23 bp, Homo sapiens
aatcttacagctgggtggcactg

SEQ ID NO: 3494190 - DNA, 16 bp, Homo sapiens
aatcttataatttaaa

SEQ ID NO: 3494191 - DNA, 13 bp, Homo sapiens
aatcttctttttc

SEQ ID NO: 3494192 - DNA, 13 bp, Homo sapiens
aatcttgctctgc

SEQ ID NO: 3494193 - DNA, 14 bp, Homo sapiens
aatcttgctttctt

SEQ ID NO: 3494194 - DNA, 13 bp, Homo sapiens
aatcttgtctcaa

SEQ ID NO: 3494195 - DNA, 18 bp, Homo sapiens
aatcttgtctcaatgctc

SEQ ID NO: 3494196 - DNA, 21 bp, Homo sapiens
aatctttaaaagatgctttta

SEQ ID NO: 3494197 - DNA, 18 bp, Homo sapiens
aatctttattgagaaaga

SEQ ID NO: 3494198 - DNA, 21 bp, Homo sapiens
aatctttcaaaccagcttcat

SEQ ID NO: 3494199 - DNA, 14 bp, Homo sapiens
aatctttctttctt

SEQ ID NO: 3494200 - DNA, 21 bp, Homo sapiens
aatcttttacaactgcctcga

SEQ ID NO: 3494201 - DNA, 15 bp, Homo sapiens
aatgaacactctttt

SEQ ID NO: 3494202 - DNA, 18 bp, Homo sapiens
aatgaacccctggctcct

SEQ ID NO: 3494203 - DNA, 23 bp, Homo sapiens
aatgaacccctggctccttcacc

SEQ ID NO: 3494204 - DNA, 16 bp, Homo sapiens
aatgaagtttgaatgt

SEQ ID NO: 3494205 - DNA, 22 bp, Homo sapiens
aatgaagtttgaatgttaaata

SEQ ID NO: 3494206 - DNA, 18 bp, Homo sapiens
aatgacactgtttcctga

SEQ ID NO: 3494207 - DNA, 13 bp, Homo sapiens
aatgagaaatgga

SEQ ID NO: 3494208 - DNA, 13 bp, Homo sapiens
aatgagaatctac

SEQ ID NO: 3494209 - DNA, 17 bp, Homo sapiens
aatgagaatgtgccatg

SEQ ID NO: 3494210 - DNA, 15 bp, Homo sapiens
aatgagacttgcctt

SEQ ID NO: 3494211 - DNA, 17 bp, Homo sapiens
aatgagacttgccttcc

SEQ ID NO: 3494212 - DNA, 13 bp, Homo sapiens
aatgaggaatgta

SEQ ID NO: 3494213 - DNA, 22 bp, Homo sapiens
aatgaggagagaaaatatatgt

SEQ ID NO: 3494214 - DNA, 16 bp, Homo sapiens
aatgaggtcagagcct

SEQ ID NO: 3494215 - DNA, 14 bp, Homo sapiens
aatgagtttaaaaa

SEQ ID NO: 3494216 - DNA, 17 bp, Homo sapiens
aatgagtttaaaaatca

SEQ ID NO: 3494217 - DNA, 20 bp, Homo sapiens
aatgataatattgtggtgcc

SEQ ID NO: 3494218 - DNA, 16 bp, Homo sapiens
aatgatagtagagtga

SEQ ID NO: 3494219 - DNA, 23 bp, Homo sapiens
aatgatcctgtattcagacagat

SEQ ID NO: 3494220 - DNA, 16 bp, Homo sapiens
aatgatggatttaaca

SEQ ID NO: 3494221 - DNA, 22 bp, Homo sapiens
aatgatggatttaacagcatga

SEQ ID NO: 3494222 - DNA, 21 bp, Homo sapiens
aatgatgtgtacccaaacgtg

SEQ ID NO: 3494223 - DNA, 23 bp, Homo sapiens
aatgattcagtgttaaatgtgat

SEQ ID NO: 3494224 - DNA, 16 bp, Homo sapiens
aatgcaagagaacatt

SEQ ID NO: 3494225 - DNA, 19 bp, Homo sapiens
aatgcaagagaacatttta

SEQ ID NO: 3494226 - DNA, 23 bp, Homo sapiens
aatgcaagagaacattttactgt

SEQ ID NO: 3494227 - DNA, 17 bp, Homo sapiens
aatgcaatagaagtgct

SEQ ID NO: 3494228 - DNA, 12 bp, Homo sapiens
aatgcacaaaca

SEQ ID NO: 3494229 - DNA, 22 bp, Homo sapiens
aatgcagcagggatgccctgga

SEQ ID NO: 3494230 - DNA, 15 bp, Homo sapiens
aatgcagtatggtac

SEQ ID NO: 3494231 - DNA, 16 bp, Homo sapiens
aatgcatctagattat

SEQ ID NO: 3494232 - DNA, 16 bp, Homo sapiens
aatgcatgattttgta

SEQ ID NO: 3494233 - DNA, 13 bp, Homo sapiens
aatgcattattga

SEQ ID NO: 3494234 - DNA, 18 bp, Homo sapiens
aatgcattttgtttggta

SEQ ID NO: 3494235 - DNA, 19 bp, Homo sapiens
aatgccaagcacttctttt

SEQ ID NO: 3494236 - DNA, 22 bp, Homo sapiens
aatgccactgccttcgcttctt

SEQ ID NO: 3494237 - DNA, 13 bp, Homo sapiens
aatgccagtgtgc

SEQ ID NO: 3494238 - DNA, 18 bp, Homo sapiens
aatgccgcgatgggtcag

SEQ ID NO: 3494239 - DNA, 15 bp, Homo sapiens
aatgcctcagtgtat

SEQ ID NO: 3494240 - DNA, 16 bp, Homo sapiens
aatgcctgagtgcctg

SEQ ID NO: 3494241 - DNA, 16 bp, Homo sapiens
aatgctcctctctttg

SEQ ID NO: 3494242 - DNA, 19 bp, Homo sapiens
aatgctccttgttcctaga

SEQ ID NO: 3494243 - DNA, 11 bp, Homo sapiens
aatgctctagt

SEQ ID NO: 3494244 - DNA, 13 bp, Homo sapiens
aatgctctctctt

SEQ ID NO: 3494245 - DNA, 12 bp, Homo sapiens
aatgctgcagat

SEQ ID NO: 3494246 - DNA, 20 bp, Homo sapiens
aatgctgcagatttgggctg

SEQ ID NO: 3494247 - DNA, 14 bp, Homo sapiens
aatgctgctggcca

SEQ ID NO: 3494248 - DNA, 12 bp, Homo sapiens
aatgctgtacat

SEQ ID NO: 3494249 - DNA, 17 bp, Homo sapiens
aatgctgtacatctatt

SEQ ID NO: 3494250 - DNA, 20 bp, Homo sapiens
aatgcttatcatctaaagat

SEQ ID NO: 3494251 - DNA, 14 bp, Homo sapiens
aatggaagacacat

SEQ ID NO: 3494252 - DNA, 20 bp, Homo sapiens
aatggaggccatatttccat

SEQ ID NO: 3494253 - DNA, 22 bp, Homo sapiens
aatggagtcatttgagtctctt

SEQ ID NO: 3494254 - DNA, 23 bp, Homo sapiens
aatggcatgagaaatacaaaaat

SEQ ID NO: 3494255 - DNA, 15 bp, Homo sapiens
aatggcctcatgtgg

SEQ ID NO: 3494256 - DNA, 13 bp, Homo sapiens
aatgggaaatggg

SEQ ID NO: 3494257 - DNA, 21 bp, Homo sapiens
aatgggagctgaggccacact

SEQ ID NO: 3494258 - DNA, 14 bp, Homo sapiens
aatggggccagatc

SEQ ID NO: 3494259 - DNA, 16 bp, Homo sapiens
aatgggtttttccctg

SEQ ID NO: 3494260 - DNA, 18 bp, Homo sapiens
aatggtaggcatttccta

SEQ ID NO: 3494261 - DNA, 21 bp, Homo sapiens
aatggtggaggattgctgcca

SEQ ID NO: 3494262 - DNA, 22 bp, Homo sapiens
aatggtggggaactataaagaa

SEQ ID NO: 3494263 - DNA, 16 bp, Homo sapiens
aatggttgtattagat

SEQ ID NO: 3494264 - DNA, 18 bp, Homo sapiens
aatggttgtattagatgt

SEQ ID NO: 3494265 - DNA, 17 bp, Homo sapiens
aatggtttaacttctgc

SEQ ID NO: 3494266 - DNA, 22 bp, Homo sapiens
aatggtttaacttctgcctgtg

SEQ ID NO: 3494267 - DNA, 14 bp, Homo sapiens
aatgtaaacatttt

SEQ ID NO: 3494268 - DNA, 20 bp, Homo sapiens
aatgtaaaggagtcaaaact

SEQ ID NO: 3494269 - DNA, 23 bp, Homo sapiens
aatgtaattgtaattttgaaatg

SEQ ID NO: 3494270 - DNA, 15 bp, Homo sapiens
aatgtacagacatat

SEQ ID NO: 3494271 - DNA, 16 bp, Homo sapiens
aatgtacagacatatt

SEQ ID NO: 3494272 - DNA, 17 bp, Homo sapiens
aatgtacatctggcctt

SEQ ID NO: 3494273 - DNA, 16 bp, Homo sapiens
acagatctggaacctc

SEQ ID NO: 3494274 - DNA, 19 bp, Homo sapiens
acagatgaaacacaaacaa

SEQ ID NO: 3494275 - DNA, 20 bp, Homo sapiens
acagatgaaacacaaacaat

SEQ ID NO: 3494276 - DNA, 14 bp, Homo sapiens
acagatgcctactt

SEQ ID NO: 3494277 - DNA, 17 bp, Homo sapiens
acagatgcctacttttg

SEQ ID NO: 3494278 - DNA, 13 bp, Homo sapiens
acagattaatatt

SEQ ID NO: 3494279 - DNA, 20 bp, Homo sapiens
acagatttaatacagtttat

SEQ ID NO: 3494280 - DNA, 17 bp, Homo sapiens
acagattttgatagcaa

SEQ ID NO: 3494281 - DNA, 19 bp, Homo sapiens
acagcaacaggaatctcag

SEQ ID NO: 3494282 - DNA, 14 bp, Homo sapiens
acagcaaccccagg

SEQ ID NO: 3494283 - DNA, 22 bp, Homo sapiens
acagcagcctggggctggcctc

SEQ ID NO: 3494284 - DNA, 21 bp, Homo sapiens
acagcaggatcgaagggtttt

SEQ ID NO: 3494285 - DNA, 22 bp, Homo sapiens
acagcaggatcgaagggttttt

SEQ ID NO: 3494286 - DNA, 18 bp, Homo sapiens
acagcatgacaaaaatta

SEQ ID NO: 3494287 - DNA, 12 bp, Homo sapiens
acagcattagat

SEQ ID NO: 3494288 - DNA, 13 bp, Homo sapiens
acagcattagata

SEQ ID NO: 3494289 - DNA, 15 bp, Homo sapiens
acagcattagatagt

SEQ ID NO: 3494290 - DNA, 16 bp, Homo sapiens
acagccaaaggctggc

SEQ ID NO: 3494291 - DNA, 20 bp, Homo sapiens
acagccaacacgcacctgcc

SEQ ID NO: 3494292 - DNA, 16 bp, Homo sapiens
acagccaactagcccc

SEQ ID NO: 3494293 - DNA, 16 bp, Homo sapiens
acagccacggccaggc

SEQ ID NO: 3494294 - DNA, 13 bp, Homo sapiens
acagccccaccct

SEQ ID NO: 3494295 - DNA, 15 bp, Homo sapiens
acagccccaccctgg

SEQ ID NO: 3494296 - DNA, 19 bp, Homo sapiens
acagcctcccctgccaggg

SEQ ID NO: 3494297 - DNA, 22 bp, Homo sapiens
acagcctcccctgccagggcag

SEQ ID NO: 3494298 - DNA, 16 bp, Homo sapiens
acagccttgtccccct

SEQ ID NO: 3494299 - DNA, 14 bp, Homo sapiens
acagcctttgaatg

SEQ ID NO: 3494300 - DNA, 15 bp, Homo sapiens
acagcctttgaatgt

SEQ ID NO: 3494301 - DNA, 12 bp, Homo sapiens
acagcgctgggt

SEQ ID NO: 3494302 - DNA, 15 bp, Homo sapiens
acagctaacacacag

SEQ ID NO: 3494303 - DNA, 23 bp, Homo sapiens
acagctactctccccacgagggc

SEQ ID NO: 3494304 - DNA, 18 bp, Homo sapiens
acagctccttctgtccta

SEQ ID NO: 3494305 - DNA, 13 bp, Homo sapiens
acagctctgtcct

SEQ ID NO: 3494306 - DNA, 14 bp, Homo sapiens
acagctctgtcctg

SEQ ID NO: 3494307 - DNA, 18 bp, Homo sapiens
acagctcttctccaggct

SEQ ID NO: 3494308 - DNA, 16 bp, Homo sapiens
acagctgaattatcta

SEQ ID NO: 3494309 - DNA, 21 bp, Homo sapiens
acagctgccttagcttcagga

SEQ ID NO: 3494310 - DNA, 23 bp, Homo sapiens
acagctgggtggcactgccatgc

SEQ ID NO: 3494311 - DNA, 12 bp, Homo sapiens
acagctgtgtta

SEQ ID NO: 3494312 - DNA, 15 bp, Homo sapiens
acagcttcctgtccc

SEQ ID NO: 3494313 - DNA, 19 bp, Homo sapiens
acagcttgacctgaggctg

SEQ ID NO: 3494314 - DNA, 22 bp, Homo sapiens
acagcttgacctgaggctgtgg

SEQ ID NO: 3494315 - DNA, 22 bp, Homo sapiens
acagcttgctgtcacttcttca

SEQ ID NO: 3494316 - DNA, 12 bp, Homo sapiens
acagctttctga

SEQ ID NO: 3494317 - DNA, 18 bp, Homo sapiens
acagctttctgaccttca

SEQ ID NO: 3494318 - DNA, 15 bp, Homo sapiens
acaggaaaagctgct

SEQ ID NO: 3494319 - DNA, 16 bp, Homo sapiens
acaggaaaagctgctg

SEQ ID NO: 3494320 - DNA, 17 bp, Homo sapiens
acaggaaaagctgctga

SEQ ID NO: 3494321 - DNA, 15 bp, Homo sapiens
acaggaatctcagag

SEQ ID NO: 3494322 - DNA, 14 bp, Homo sapiens
acaggacacagtca

SEQ ID NO: 3494323 - DNA, 16 bp, Homo sapiens
acaggacacctggccg

SEQ ID NO: 3494324 - DNA, 17 bp, Homo sapiens
acaggacacctggccgc

SEQ ID NO: 3494325 - DNA, 14 bp, Homo sapiens
acaggatgaaggca

SEQ ID NO: 3494326 - DNA, 16 bp, Homo sapiens
acaggatgtgtttgct

SEQ ID NO: 3494327 - DNA, 16 bp, Homo sapiens
acaggcaagcacctcc

SEQ ID NO: 3494328 - DNA, 18 bp, Homo sapiens
acaggcaagcacctcctg

SEQ ID NO: 3494329 - DNA, 23 bp, Homo sapiens
acaggcacccaccatcatgtctg

SEQ ID NO: 3494330 - DNA, 13 bp, Homo sapiens
acaggcagagctg

SEQ ID NO: 3494331 - DNA, 21 bp, Homo sapiens
acaggcatgggtgcaaggaaa

SEQ ID NO: 3494332 - DNA, 20 bp, Homo sapiens
acaggcccggctccaggctc

SEQ ID NO: 3494333 - DNA, 21 bp, Homo sapiens
acaggcccggctccaggctcc

SEQ ID NO: 3494334 - DNA, 16 bp, Homo sapiens
acaggccgccctgcgg

SEQ ID NO: 3494335 - DNA, 17 bp, Homo sapiens
acaggctcttctttccc

SEQ ID NO: 3494336 - DNA, 19 bp, Homo sapiens
acaggctcttctttcccaa

SEQ ID NO: 3494337 - DNA, 20 bp, Homo sapiens
acaggctcttctttcccaaa

SEQ ID NO: 3494338 - DNA, 12 bp, Homo sapiens
acaggctgggct

SEQ ID NO: 3494339 - DNA, 22 bp, Homo sapiens
acaggctgggcttcagtggcag

SEQ ID NO: 3494340 - DNA, 23 bp, Homo sapiens
acaggctgggcttcagtggcagc

SEQ ID NO: 3494341 - DNA, 22 bp, Homo sapiens
acagggactgaaaacctctcct

SEQ ID NO: 3494342 - DNA, 16 bp, Homo sapiens
acagggacttgaagtt

SEQ ID NO: 3494343 - DNA, 10 bp, Homo sapiens
acagggaggg

SEQ ID NO: 3494344 - DNA, 13 bp, Homo sapiens
acagggcttgttt

SEQ ID NO: 3494345 - DNA, 15 bp, Homo sapiens
acagggtctgcctcc

SEQ ID NO: 3494346 - DNA, 22 bp, Homo sapiens
acagggtctgcctccagccaaa

SEQ ID NO: 3494347 - DNA, 15 bp, Homo sapiens
acagggtttcaccat

SEQ ID NO: 3494348 - DNA, 16 bp, Homo sapiens
acaggtcttcatcgaa

SEQ ID NO: 3494349 - DNA, 22 bp, Homo sapiens
acaggtggaaaaactgagacag

SEQ ID NO: 3494350 - DNA, 22 bp, Homo sapiens
acaggtgggcttcccagtggct

SEQ ID NO: 3494351 - DNA, 20 bp, Homo sapiens
acaggtgtgaaccaccacac

SEQ ID NO: 3494352 - DNA, 23 bp, Homo sapiens
acaggtgtgagtcaccaagccca

SEQ ID NO: 3494353 - DNA, 15 bp, Homo sapiens
acaggttgggatggg

SEQ ID NO: 3494354 - DNA, 21 bp, Homo sapiens
acagtaaatatcccaaactgt

SEQ ID NO: 3494355 - DNA, 19 bp, Homo sapiens
acagtaacgcaggggaaac

SEQ ID NO: 3494356 - DNA, 16 bp, Homo sapiens
acagtacaggcagcac

SEQ ID NO: 3494357 - DNA, 20 bp, Homo sapiens
acagtacaggcagcacagag

SEQ ID NO: 3494358 - DNA, 22 bp, Homo sapiens
acagtaggagcccagctctgaa

SEQ ID NO: 3494359 - DNA, 11 bp, Homo sapiens
acagtatctct

SEQ ID NO: 3494360 - DNA, 18 bp, Homo sapiens
acagtatgcttgctctaa

SEQ ID NO: 3494361 - DNA, 17 bp, Homo sapiens
acagtatgtcccatagg

SEQ ID NO: 3494362 - DNA, 16 bp, Homo sapiens
acagtattacttctgc

SEQ ID NO: 3494363 - DNA, 20 bp, Homo sapiens
acagtattatacgctggcaa

SEQ ID NO: 3494364 - DNA, 15 bp, Homo sapiens
acagtcaacaagcct

SEQ ID NO: 3494365 - DNA, 16 bp, Homo sapiens
acagtcacgcctgaaa

SEQ ID NO: 3494366 - DNA, 18 bp, Homo sapiens
acagtcacgcctgaaact

SEQ ID NO: 3494367 - DNA, 20 bp, Homo sapiens
acagtcacgcctgaaacttt

SEQ ID NO: 3494368 - DNA, 20 bp, Homo sapiens
acagtcagatttccagtctc

SEQ ID NO: 3494369 - DNA, 18 bp, Homo sapiens
acagtccagcctggagat

SEQ ID NO: 3494370 - DNA, 13 bp, Homo sapiens
acagtcttccaca

SEQ ID NO: 3494371 - DNA, 19 bp, Homo sapiens
acagtcttccatttgcaag

SEQ ID NO: 3494372 - DNA, 15 bp, Homo sapiens
acagtcttgcagcag

SEQ ID NO: 3494373 - DNA, 15 bp, Homo sapiens
acagtgctctaggct

SEQ ID NO: 3494374 - DNA, 21 bp, Homo sapiens
acagtgctgcagctccctggc

SEQ ID NO: 3494375 - DNA, 16 bp, Homo sapiens
acagtgtctgtgtgtg

SEQ ID NO: 3494376 - DNA, 19 bp, Homo sapiens
acagtgtgggacaggctct

SEQ ID NO: 3494377 - DNA, 20 bp, Homo sapiens
acagtgtgggacaggctctt

SEQ ID NO: 3494378 - DNA, 21 bp, Homo sapiens
acagtgtgggacaggctcttc

SEQ ID NO: 3494379 - DNA, 16 bp, Homo sapiens
acagttaaggaatata

SEQ ID NO: 3494380 - DNA, 22 bp, Homo sapiens
acagttcaaaattctaaatgta

SEQ ID NO: 3494381 - DNA, 19 bp, Homo sapiens
acagttctttgggccagac

SEQ ID NO: 3494382 - DNA, 20 bp, Homo sapiens
acagttctttgggccagaca

SEQ ID NO: 3494383 - DNA, 15 bp, Homo sapiens
acagttgaaaaacag

SEQ ID NO: 3494384 - DNA, 16 bp, Homo sapiens
acagttgaaaaacagc

SEQ ID NO: 3494385 - DNA, 22 bp, Homo sapiens
acagttgaagggaggggctgtg

SEQ ID NO: 3494386 - DNA, 14 bp, Homo sapiens
acataaacttttgc

SEQ ID NO: 3494387 - DNA, 23 bp, Homo sapiens
acataagatcactgccagagata

SEQ ID NO: 3494388 - DNA, 19 bp, Homo sapiens
acataataaacgatgttgt

SEQ ID NO: 3494389 - DNA, 23 bp, Homo sapiens
acataataaacgatgttgtgatg

SEQ ID NO: 3494390 - DNA, 14 bp, Homo sapiens
acataataaattaa

SEQ ID NO: 3494391 - DNA, 19 bp, Homo sapiens
acataatgggccactgaaa

SEQ ID NO: 3494392 - DNA, 20 bp, Homo sapiens
acataatgggccactgaaat

SEQ ID NO: 3494393 - DNA, 22 bp, Homo sapiens
acatacaattatttttacagtt

SEQ ID NO: 3494394 - DNA, 15 bp, Homo sapiens
acatacgcttttaat

SEQ ID NO: 3494395 - DNA, 16 bp, Homo sapiens
acatacttgaagggcc

SEQ ID NO: 3494396 - DNA, 12 bp, Homo sapiens
acatagaaatgg

SEQ ID NO: 3494397 - DNA, 20 bp, Homo sapiens
acatagaaatggaaattttg

SEQ ID NO: 3494398 - DNA, 22 bp, Homo sapiens
acatagaaatggaaattttgct

SEQ ID NO: 3494399 - DNA, 16 bp, Homo sapiens
acatagcatgacattt

SEQ ID NO: 3494400 - DNA, 19 bp, Homo sapiens
acatagcatgacatttctt

SEQ ID NO: 3494401 - DNA, 16 bp, Homo sapiens
acatagccctaactcc

SEQ ID NO: 3494402 - DNA, 22 bp, Homo sapiens
acatagtgcattgtttctgtgg

SEQ ID NO: 3494403 - DNA, 13 bp, Homo sapiens
acatataaaataa

SEQ ID NO: 3494404 - DNA, 15 bp, Homo sapiens
acatatctttattaa

SEQ ID NO: 3494405 - DNA, 19 bp, Homo sapiens
actaaaagatataagtgct

SEQ ID NO: 3494406 - DNA, 20 bp, Homo sapiens
actaaaagatataagtgctg

SEQ ID NO: 3494407 - DNA, 16 bp, Homo sapiens
actaaactcatttata

SEQ ID NO: 3494408 - DNA, 23 bp, Homo sapiens
actaaactctctttgggaatgtt

SEQ ID NO: 3494409 - DNA, 20 bp, Homo sapiens
actaaagaagatctgtaatt

SEQ ID NO: 3494410 - DNA, 23 bp, Homo sapiens
actaaagccaaacatatatatac

SEQ ID NO: 3494411 - DNA, 12 bp, Homo sapiens
actaaccacgct

SEQ ID NO: 3494412 - DNA, 23 bp, Homo sapiens
actaaccagggaagctgtccctc

SEQ ID NO: 3494413 - DNA, 12 bp, Homo sapiens
actaactgctgg

SEQ ID NO: 3494414 - DNA, 20 bp, Homo sapiens
actaactgctggtttttaaa

SEQ ID NO: 3494415 - DNA, 13 bp, Homo sapiens
actaagcagagga

SEQ ID NO: 3494416 - DNA, 14 bp, Homo sapiens
actaagcagaggag

SEQ ID NO: 3494417 - DNA, 21 bp, Homo sapiens
actaaggggcccggccagcca

SEQ ID NO: 3494418 - DNA, 14 bp, Homo sapiens
actaagtgatgctg

SEQ ID NO: 3494419 - DNA, 16 bp, Homo sapiens
actaagtgatgctgtg

SEQ ID NO: 3494420 - DNA, 15 bp, Homo sapiens
actaataaaccagtt

SEQ ID NO: 3494421 - DNA, 21 bp, Homo sapiens
actaatccaatacctcttgga

SEQ ID NO: 3494422 - DNA, 12 bp, Homo sapiens
actaatggcatg

SEQ ID NO: 3494423 - DNA, 21 bp, Homo sapiens
actaattatactactttgtta

SEQ ID NO: 3494424 - DNA, 14 bp, Homo sapiens
actaatttcaaaat

SEQ ID NO: 3494425 - DNA, 20 bp, Homo sapiens
actaatttcaaaatgctttt

SEQ ID NO: 3494426 - DNA, 15 bp, Homo sapiens
actaattttaaaatg

SEQ ID NO: 3494427 - DNA, 13 bp, Homo sapiens
actacaaatcaag

SEQ ID NO: 3494428 - DNA, 16 bp, Homo sapiens
actacaaccaatggaa

SEQ ID NO: 3494429 - DNA, 17 bp, Homo sapiens
actacagctatgaagaa

SEQ ID NO: 3494430 - DNA, 15 bp, Homo sapiens
actacaggcacccac

SEQ ID NO: 3494431 - DNA, 23 bp, Homo sapiens
actacaggtgtgagtcaccaagc

SEQ ID NO: 3494432 - DNA, 15 bp, Homo sapiens
actacatattgtctg

SEQ ID NO: 3494433 - DNA, 16 bp, Homo sapiens
actactaaaagtttag

SEQ ID NO: 3494434 - DNA, 21 bp, Homo sapiens
actactaaaagtttagaactt

SEQ ID NO: 3494435 - DNA, 17 bp, Homo sapiens
actactcccccaggtgg

SEQ ID NO: 3494436 - DNA, 20 bp, Homo sapiens
actactccggagacagggtt

SEQ ID NO: 3494437 - DNA, 22 bp, Homo sapiens
actactgcctttagaaaatata

SEQ ID NO: 3494438 - DNA, 22 bp, Homo sapiens
actactttgttaggattttcac

SEQ ID NO: 3494439 - DNA, 20 bp, Homo sapiens
actagaaatgggaatcatgg

SEQ ID NO: 3494440 - DNA, 17 bp, Homo sapiens
actagacaagccagaac

SEQ ID NO: 3494441 - DNA, 21 bp, Homo sapiens
actagacaagccagaacttga

SEQ ID NO: 3494442 - DNA, 22 bp, Homo sapiens
actagactggtggcaggggctt

SEQ ID NO: 3494443 - DNA, 18 bp, Homo sapiens
actagagggacctctccc

SEQ ID NO: 3494444 - DNA, 13 bp, Homo sapiens
actagcagctgca

SEQ ID NO: 3494445 - DNA, 17 bp, Homo sapiens
actagcatatctgcctt

SEQ ID NO: 3494446 - DNA, 21 bp, Homo sapiens
actagcctaggtcataaagag

SEQ ID NO: 3494447 - DNA, 14 bp, Homo sapiens
actagctatggtgt

SEQ ID NO: 3494448 - DNA, 18 bp, Homo sapiens
actaggaaatccattcac

SEQ ID NO: 3494449 - DNA, 22 bp, Homo sapiens
actaggcccccacttgcctctt

SEQ ID NO: 3494450 - DNA, 17 bp, Homo sapiens
actagggaagataatat

SEQ ID NO: 3494451 - DNA, 22 bp, Homo sapiens
actagggaatcctgcggcagga

SEQ ID NO: 3494452 - DNA, 14 bp, Homo sapiens
actagggagccatg

SEQ ID NO: 3494453 - DNA, 19 bp, Homo sapiens
actagggatccctcatctg

SEQ ID NO: 3494454 - DNA, 16 bp, Homo sapiens
actaggtaacttcata

SEQ ID NO: 3494455 - DNA, 13 bp, Homo sapiens
actagtgcaaatc

SEQ ID NO: 3494456 - DNA, 13 bp, Homo sapiens
actagtgttctgt

SEQ ID NO: 3494457 - DNA, 18 bp, Homo sapiens
actataaaatgtcttcaa

SEQ ID NO: 3494458 - DNA, 12 bp, Homo sapiens
actataaagaga

SEQ ID NO: 3494459 - DNA, 14 bp, Homo sapiens
actataagaacttt

SEQ ID NO: 3494460 - DNA, 18 bp, Homo sapiens
actatattgattgtcctt

SEQ ID NO: 3494461 - DNA, 15 bp, Homo sapiens
actatattttgtcat

SEQ ID NO: 3494462 - DNA, 15 bp, Homo sapiens
actatctactctcct

SEQ ID NO: 3494463 - DNA, 14 bp, Homo sapiens
actatgatctcagg

SEQ ID NO: 3494464 - DNA, 15 bp, Homo sapiens
actatgatctcagga

SEQ ID NO: 3494465 - DNA, 24 bp, Homo sapiens
actatgcatggtgccccaggacca

SEQ ID NO: 3494466 - DNA, 15 bp, Homo sapiens
actatgctttccttc

SEQ ID NO: 3494467 - DNA, 24 bp, Homo sapiens
actatggataaactaaacacgtga

SEQ ID NO: 3494468 - DNA, 16 bp, Homo sapiens
actatggtatttgagt

SEQ ID NO: 3494469 - DNA, 15 bp, Homo sapiens
actatgtatatacat

SEQ ID NO: 3494470 - DNA, 21 bp, Homo sapiens
actatgtctagagcctcttgg

SEQ ID NO: 3494471 - DNA, 15 bp, Homo sapiens
actattaaaatattt

SEQ ID NO: 3494472 - DNA, 17 bp, Homo sapiens
actattaaaatattttg

SEQ ID NO: 3494473 - DNA, 12 bp, Homo sapiens
actattaacatg

SEQ ID NO: 3494474 - DNA, 14 bp, Homo sapiens
actattaacatgat

SEQ ID NO: 3494475 - DNA, 19 bp, Homo sapiens
actattaaggatgtagctt

SEQ ID NO: 3494476 - DNA, 21 bp, Homo sapiens
actattataatttaatgcatg

SEQ ID NO: 3494477 - DNA, 14 bp, Homo sapiens
actattcctaggag

SEQ ID NO: 3494478 - DNA, 20 bp, Homo sapiens
actattgcagacctgtcacc

SEQ ID NO: 3494479 - DNA, 12 bp, Homo sapiens
actatttatctg

SEQ ID NO: 3494480 - DNA, 19 bp, Homo sapiens
actatttattgactctggg

SEQ ID NO: 3494481 - DNA, 13 bp, Homo sapiens
actatttcttcag

SEQ ID NO: 3494482 - DNA, 16 bp, Homo sapiens
actatttcttcagagt

SEQ ID NO: 3494483 - DNA, 14 bp, Homo sapiens
actattttcaaaga

SEQ ID NO: 3494484 - DNA, 16 bp, Homo sapiens
actcaaactcttaaaa

SEQ ID NO: 3494485 - DNA, 22 bp, Homo sapiens
actcaaagtttcagagaccatt

SEQ ID NO: 3494486 - DNA, 18 bp, Homo sapiens
actcaaatgctcagacca

SEQ ID NO: 3494487 - DNA, 21 bp, Homo sapiens
actcaaatgctcagaccagct

SEQ ID NO: 3494488 - DNA, 14 bp, Homo sapiens
actcaagccaagca

SEQ ID NO: 3494489 - DNA, 16 bp, Homo sapiens
actcaagccaagcagc

SEQ ID NO: 3494490 - DNA, 22 bp, Homo sapiens
actcaatgaaatatgtgaagcc

SEQ ID NO: 3494491 - DNA, 14 bp, Homo sapiens
actcaatgcactga

SEQ ID NO: 3494492 - DNA, 14 bp, Homo sapiens
actcacctggggct

SEQ ID NO: 3494493 - DNA, 18 bp, Homo sapiens
actcacctggggctgctg

SEQ ID NO: 3494494 - DNA, 19 bp, Homo sapiens
actcacctggggctgctgg

SEQ ID NO: 3494495 - DNA, 14 bp, Homo sapiens
actcactaggcccc

SEQ ID NO: 3494496 - DNA, 21 bp, Homo sapiens
actcactaggcccccacttgc

SEQ ID NO: 3494497 - DNA, 22 bp, Homo sapiens
actcactaggcccccacttgcc

SEQ ID NO: 3494498 - DNA, 15 bp, Homo sapiens
actcagaaacatcag

SEQ ID NO: 3494499 - DNA, 15 bp, Homo sapiens
actcagaagacactg

SEQ ID NO: 3494500 - DNA, 20 bp, Homo sapiens
actcagaagcctctgggtca

SEQ ID NO: 3494501 - DNA, 12 bp, Homo sapiens
actcagatccag

SEQ ID NO: 3494502 - DNA, 14 bp, Homo sapiens
actcagatccaggg

SEQ ID NO: 3494503 - DNA, 15 bp, Homo sapiens
actcagcacaaggcc

SEQ ID NO: 3494504 - DNA, 22 bp, Homo sapiens
actcagcatttgattaacattt

SEQ ID NO: 3494505 - DNA, 11 bp, Homo sapiens
actcagccttc

SEQ ID NO: 3494506 - DNA, 14 bp, Homo sapiens
actcagctccccag

SEQ ID NO: 3494507 - DNA, 14 bp, Homo sapiens
actcagctccgtga

SEQ ID NO: 3494508 - DNA, 20 bp, Homo sapiens
actcaggcgggacagtgctg

SEQ ID NO: 3494509 - DNA, 23 bp, Homo sapiens
actcaggcgggacagtgctgcag

SEQ ID NO: 3494510 - DNA, 22 bp, Homo sapiens
actcagggcagcgccaggctga

SEQ ID NO: 3494511 - DNA, 19 bp, Homo sapiens
actcagtccatagcagaga

SEQ ID NO: 3494512 - DNA, 14 bp, Homo sapiens
actcatgagaagtt

SEQ ID NO: 3494513 - DNA, 13 bp, Homo sapiens
actcattcaaaag

SEQ ID NO: 3494514 - DNA, 15 bp, Homo sapiens
actcattcttctgta

SEQ ID NO: 3494515 - DNA, 21 bp, Homo sapiens
actcatttataaagctaaaat

SEQ ID NO: 3494516 - DNA, 11 bp, Homo sapiens
actccaaagat

SEQ ID NO: 3494517 - DNA, 15 bp, Homo sapiens
actccaaagatgact

SEQ ID NO: 3494518 - DNA, 12 bp, Homo sapiens
actccagcctgg

SEQ ID NO: 3494519 - DNA, 13 bp, Homo sapiens
actccagcctggg

SEQ ID NO: 3494520 - DNA, 14 bp, Homo sapiens
actccaggcccaag

SEQ ID NO: 3494521 - DNA, 16 bp, Homo sapiens
actccaggcccaaggc

SEQ ID NO: 3494522 - DNA, 20 bp, Homo sapiens
actccagtatgacagaggag

SEQ ID NO: 3494523 - DNA, 13 bp, Homo sapiens
actccagtcctgc

SEQ ID NO: 3494524 - DNA, 21 bp, Homo sapiens
actccatctctcatcctccag

SEQ ID NO: 3494525 - DNA, 19 bp, Homo sapiens
actcccaaggttggagccc

SEQ ID NO: 3494526 - DNA, 14 bp, Homo sapiens
actcccccaggtgg

SEQ ID NO: 3494527 - DNA, 14 bp, Homo sapiens
actccccgaagtct

SEQ ID NO: 3494528 - DNA, 17 bp, Homo sapiens
actccccgaagtctttt

SEQ ID NO: 3494529 - DNA, 21 bp, Homo sapiens
actcccttcccatgacccagg

SEQ ID NO: 3494530 - DNA, 23 bp, Homo sapiens
actcccttcccatgacccaggct

SEQ ID NO: 3494531 - DNA, 15 bp, Homo sapiens
actccctttttacac

SEQ ID NO: 3494532 - DNA, 16 bp, Homo sapiens
actccctttttacact

SEQ ID NO: 3494533 - DNA, 18 bp, Homo sapiens
actccgagtgaactggtc

SEQ ID NO: 3494534 - DNA, 17 bp, Homo sapiens
actccgctcactgaact

SEQ ID NO: 3494535 - DNA, 14 bp, Homo sapiens
actccggagacagg

SEQ ID NO: 3494536 - DNA, 16 bp, Homo sapiens
actccggagacagggt

SEQ ID NO: 3494537 - DNA, 14 bp, Homo sapiens
actccggccctcct

SEQ ID NO: 3494538 - DNA, 17 bp, Homo sapiens
agaagcccccagctaag

SEQ ID NO: 3494539 - DNA, 16 bp, Homo sapiens
agaagcctctgcctcc

SEQ ID NO: 3494540 - DNA, 21 bp, Homo sapiens
agaagcctgatgctgacattc

SEQ ID NO: 3494541 - DNA, 17 bp, Homo sapiens
agaagctcctctcccca

SEQ ID NO: 3494542 - DNA, 19 bp, Homo sapiens
agaagctctcgggctagga

SEQ ID NO: 3494543 - DNA, 18 bp, Homo sapiens
agaagctctgattttgct

SEQ ID NO: 3494544 - DNA, 23 bp, Homo sapiens
agaagctctgtttataaaaacaa

SEQ ID NO: 3494545 - DNA, 20 bp, Homo sapiens
agaagctcttactctttcct

SEQ ID NO: 3494546 - DNA, 17 bp, Homo sapiens
agaaggaaaaatgtgta

SEQ ID NO: 3494547 - DNA, 16 bp, Homo sapiens
agaaggagacaggcag

SEQ ID NO: 3494548 - DNA, 18 bp, Homo sapiens
agaaggcatttgcagggt

SEQ ID NO: 3494549 - DNA, 14 bp, Homo sapiens
agaaggccgctgcc

SEQ ID NO: 3494550 - DNA, 18 bp, Homo sapiens
agaagggagctagccaga

SEQ ID NO: 3494551 - DNA, 17 bp, Homo sapiens
agaaggtgcctgccata

SEQ ID NO: 3494552 - DNA, 17 bp, Homo sapiens
agaagtcaaagtaaaac

SEQ ID NO: 3494553 - DNA, 14 bp, Homo sapiens
agaagtcatggccc

SEQ ID NO: 3494554 - DNA, 21 bp, Homo sapiens
agaagtcctgtatgtctgtca

SEQ ID NO: 3494555 - DNA, 22 bp, Homo sapiens
agaagtcctgtatgtctgtcat

SEQ ID NO: 3494556 - DNA, 21 bp, Homo sapiens
agaagtgagaataggcagccc

SEQ ID NO: 3494557 - DNA, 16 bp, Homo sapiens
agaagtgccatctcaa

SEQ ID NO: 3494558 - DNA, 21 bp, Homo sapiens
agaagtttcagttgtccttaa

SEQ ID NO: 3494559 - DNA, 23 bp, Homo sapiens
agaagtttgcactatctttcagc

SEQ ID NO: 3494560 - DNA, 17 bp, Homo sapiens
agaagttttaaattttg

SEQ ID NO: 3494561 - DNA, 20 bp, Homo sapiens
agaataaaatgttgaaaagt

SEQ ID NO: 3494562 - DNA, 13 bp, Homo sapiens
agaataatttata

SEQ ID NO: 3494563 - DNA, 17 bp, Homo sapiens
agaatacagctttctga

SEQ ID NO: 3494564 - DNA, 19 bp, Homo sapiens
agaatagcatctgtacaaa

SEQ ID NO: 3494565 - DNA, 21 bp, Homo sapiens
agaatagcatctgtacaaagg

SEQ ID NO: 3494566 - DNA, 17 bp, Homo sapiens
agaatagccacatttgg

SEQ ID NO: 3494567 - DNA, 19 bp, Homo sapiens
agaataggcattaacacaa

SEQ ID NO: 3494568 - DNA, 20 bp, Homo sapiens
agaatatagcatctttcata

SEQ ID NO: 3494569 - DNA, 14 bp, Homo sapiens
agaatatcatcttt

SEQ ID NO: 3494570 - DNA, 14 bp, Homo sapiens
agaatatgaatgag

SEQ ID NO: 3494571 - DNA, 19 bp, Homo sapiens
agaatatgaatgagaatgt

SEQ ID NO: 3494572 - DNA, 20 bp, Homo sapiens
agaatattagctttactgtt

SEQ ID NO: 3494573 - DNA, 21 bp, Homo sapiens
agaatattagctttactgttt

SEQ ID NO: 3494574 - DNA, 11 bp, Homo sapiens
agaatatttat

SEQ ID NO: 3494575 - DNA, 22 bp, Homo sapiens
agaatcacttctgagaactcat

SEQ ID NO: 3494576 - DNA, 19 bp, Homo sapiens
agaatccctagactttagg

SEQ ID NO: 3494577 - DNA, 16 bp, Homo sapiens
agaatccttttgtaga

SEQ ID NO: 3494578 - DNA, 22 bp, Homo sapiens
agaatccttttgtagaatgaac

SEQ ID NO: 3494579 - DNA, 21 bp, Homo sapiens
agaatctcattactgcttcat

SEQ ID NO: 3494580 - DNA, 13 bp, Homo sapiens
agaatctcttgaa

SEQ ID NO: 3494581 - DNA, 18 bp, Homo sapiens
agaatctttattgagaaa

SEQ ID NO: 3494582 - DNA, 19 bp, Homo sapiens
agaatctttattgagaaag

SEQ ID NO: 3494583 - DNA, 18 bp, Homo sapiens
agaatgaaagggcccaga

SEQ ID NO: 3494584 - DNA, 16 bp, Homo sapiens
agaatgaaatgtatgt

SEQ ID NO: 3494585 - DNA, 19 bp, Homo sapiens
agaatgagagcgacacaga

SEQ ID NO: 3494586 - DNA, 18 bp, Homo sapiens
agaatgctagcaggctgt

SEQ ID NO: 3494587 - DNA, 15 bp, Homo sapiens
agaatgtgccatgta

SEQ ID NO: 3494588 - DNA, 21 bp, Homo sapiens
agaatgtgtttaaacttggtt

SEQ ID NO: 3494589 - DNA, 17 bp, Homo sapiens
agaatgttactgcctta

SEQ ID NO: 3494590 - DNA, 19 bp, Homo sapiens
agaatgttccagacattct

SEQ ID NO: 3494591 - DNA, 20 bp, Homo sapiens
agaattactgtaactgatta

SEQ ID NO: 3494592 - DNA, 14 bp, Homo sapiens
agaattagctgctt

SEQ ID NO: 3494593 - DNA, 22 bp, Homo sapiens
agaattagctttttcatcccct

SEQ ID NO: 3494594 - DNA, 21 bp, Homo sapiens
agaattatttcacaaataata

SEQ ID NO: 3494595 - DNA, 19 bp, Homo sapiens
agaattcattccccagctc

SEQ ID NO: 3494596 - DNA, 22 bp, Homo sapiens
agaattcattccccagctccat

SEQ ID NO: 3494597 - DNA, 15 bp, Homo sapiens
agaattccaaagcaa

SEQ ID NO: 3494598 - DNA, 16 bp, Homo sapiens
agaattccaaagcaaa

SEQ ID NO: 3494599 - DNA, 21 bp, Homo sapiens
agaattccttcgaaaggcctt

SEQ ID NO: 3494600 - DNA, 18 bp, Homo sapiens
agaattggctgaactcat

SEQ ID NO: 3494601 - DNA, 13 bp, Homo sapiens
agaatttattcaa

SEQ ID NO: 3494602 - DNA, 23 bp, Homo sapiens
agaatttgtgttgaaggaacttg

SEQ ID NO: 3494603 - DNA, 17 bp, Homo sapiens
agaattttaaatatttt

SEQ ID NO: 3494604 - DNA, 17 bp, Homo sapiens
agacaaattctgtttct

SEQ ID NO: 3494605 - DNA, 19 bp, Homo sapiens
agacaaattctgtttcttg

SEQ ID NO: 3494606 - DNA, 19 bp, Homo sapiens
agacaagacttcagtatgt

SEQ ID NO: 3494607 - DNA, 17 bp, Homo sapiens
agacaagccagaacttg

SEQ ID NO: 3494608 - DNA, 18 bp, Homo sapiens
agacaatatgtgagtgcc

SEQ ID NO: 3494609 - DNA, 21 bp, Homo sapiens
agacaatgtctgcagccctga

SEQ ID NO: 3494610 - DNA, 20 bp, Homo sapiens
agacaatgtgaaaagaaaaa

SEQ ID NO: 3494611 - DNA, 22 bp, Homo sapiens
agacaatgttgtgtttggattt

SEQ ID NO: 3494612 - DNA, 18 bp, Homo sapiens
agacaatttgcacatctt

SEQ ID NO: 3494613 - DNA, 19 bp, Homo sapiens
agacacaacaactcctagg

SEQ ID NO: 3494614 - DNA, 12 bp, Homo sapiens
agacacaggccc

SEQ ID NO: 3494615 - DNA, 16 bp, Homo sapiens
agacacaggcccggct

SEQ ID NO: 3494616 - DNA, 17 bp, Homo sapiens
agacacaggcccggctc

SEQ ID NO: 3494617 - DNA, 19 bp, Homo sapiens
agacacaggcccggctcca

SEQ ID NO: 3494618 - DNA, 19 bp, Homo sapiens
agacacagggacttgaagt

SEQ ID NO: 3494619 - DNA, 20 bp, Homo sapiens
agacacagggacttgaagtt

SEQ ID NO: 3494620 - DNA, 22 bp, Homo sapiens
agacacagggacttgaagttgt

SEQ ID NO: 3494621 - DNA, 18 bp, Homo sapiens
agacaccttgacagggca

SEQ ID NO: 3494622 - DNA, 19 bp, Homo sapiens
agacaccttgacagggcac

SEQ ID NO: 3494623 - DNA, 22 bp, Homo sapiens
agacaccttggacatcctcctc

SEQ ID NO: 3494624 - DNA, 23 bp, Homo sapiens
agacactccccgaagtcttttgt

SEQ ID NO: 3494625 - DNA, 17 bp, Homo sapiens
agacagaaccttgttat

SEQ ID NO: 3494626 - DNA, 15 bp, Homo sapiens
agacagacacacaca

SEQ ID NO: 3494627 - DNA, 18 bp, Homo sapiens
agacagagaatatgtctg

SEQ ID NO: 3494628 - DNA, 20 bp, Homo sapiens
agacagagaggactgtaggg

SEQ ID NO: 3494629 - DNA, 16 bp, Homo sapiens
agacagagcctcgctc

SEQ ID NO: 3494630 - DNA, 19 bp, Homo sapiens
agacagagtctcactgttg

SEQ ID NO: 3494631 - DNA, 20 bp, Homo sapiens
agacagagtctcactgttgc

SEQ ID NO: 3494632 - DNA, 22 bp, Homo sapiens
agacagcttctcatcctgcagg

SEQ ID NO: 3494633 - DNA, 22 bp, Homo sapiens
agacaggcagtttcagagatgg

SEQ ID NO: 3494634 - DNA, 15 bp, Homo sapiens
agacaggtggcctag

SEQ ID NO: 3494635 - DNA, 12 bp, Homo sapiens
agacagtcttgc

SEQ ID NO: 3494636 - DNA, 21 bp, Homo sapiens
agacagttttgagaacgtaaa

SEQ ID NO: 3494637 - DNA, 21 bp, Homo sapiens
agacatacttgaagggccaga

SEQ ID NO: 3494638 - DNA, 14 bp, Homo sapiens
agacatcttcagat

SEQ ID NO: 3494639 - DNA, 20 bp, Homo sapiens
agacattctcgcttccctga

SEQ ID NO: 3494640 - DNA, 14 bp, Homo sapiens
agacattctgccag

SEQ ID NO: 3494641 - DNA, 16 bp, Homo sapiens
agaccaccacctcaga

SEQ ID NO: 3494642 - DNA, 19 bp, Homo sapiens
agaccacgcccgtcctgcc

SEQ ID NO: 3494643 - DNA, 20 bp, Homo sapiens
agaccacgcccgtcctgcct

SEQ ID NO: 3494644 - DNA, 24 bp, Homo sapiens
agaccacgcccgtcctgcctgtgg

SEQ ID NO: 3494645 - DNA, 15 bp, Homo sapiens
agaccaggctgtgtc

SEQ ID NO: 3494646 - DNA, 16 bp, Homo sapiens
agaccaggctgtgtcc

SEQ ID NO: 3494647 - DNA, 16 bp, Homo sapiens
agacccagatctcatg

SEQ ID NO: 3494648 - DNA, 18 bp, Homo sapiens
agacccagccctcatccc

SEQ ID NO: 3494649 - DNA, 18 bp, Homo sapiens
agaccccaagaggaagtt

SEQ ID NO: 3494650 - DNA, 19 bp, Homo sapiens
agaccccaagaggaagttc

SEQ ID NO: 3494651 - DNA, 19 bp, Homo sapiens
agacccccggaacaagcct

SEQ ID NO: 3494652 - DNA, 15 bp, Homo sapiens
agacccgaggaaact

SEQ ID NO: 3494653 - DNA, 16 bp, Homo sapiens
agacccttctggtgcc

SEQ ID NO: 3494654 - DNA, 15 bp, Homo sapiens
agacctaatgctcct

SEQ ID NO: 3494655 - DNA, 14 bp, Homo sapiens
agacctcagggcac

SEQ ID NO: 3494656 - DNA, 12 bp, Homo sapiens
agacctctggat

SEQ ID NO: 3494657 - DNA, 23 bp, Homo sapiens
agacctctggattaggtctctgt

SEQ ID NO: 3494658 - DNA, 19 bp, Homo sapiens
agacctgacacctttcata

SEQ ID NO: 3494659 - DNA, 15 bp, Homo sapiens
agacctgatcctgga

SEQ ID NO: 3494660 - DNA, 23 bp, Homo sapiens
agacctgatcctggaggcccagt

SEQ ID NO: 3494661 - DNA, 16 bp, Homo sapiens
agacctggacacaggc

SEQ ID NO: 3494662 - DNA, 19 bp, Homo sapiens
agacctggacacaggcctg

SEQ ID NO: 3494663 - DNA, 22 bp, Homo sapiens
agacctggcaaggacacagatg

SEQ ID NO: 3494664 - DNA, 17 bp, Homo sapiens
agacctggcagctctgg

SEQ ID NO: 3494665 - DNA, 18 bp, Homo sapiens
agaccttctaggacgcca

SEQ ID NO: 3494666 - DNA, 22 bp, Homo sapiens
agaccttgttacttctgaggta

SEQ ID NO: 3494667 - DNA, 14 bp, Homo sapiens
agacgccagtagca

SEQ ID NO: 3494668 - DNA, 13 bp, Homo sapiens
agcagtgcaggca

SEQ ID NO: 3494669 - DNA, 13 bp, Homo sapiens
agcagttctgatg

SEQ ID NO: 3494670 - DNA, 20 bp, Homo sapiens
agcagtttctgtcctgctgg

SEQ ID NO: 3494671 - DNA, 18 bp, Homo sapiens
agcagttttcaagtcaaa

SEQ ID NO: 3494672 - DNA, 12 bp, Homo sapiens
agcatacaactt

SEQ ID NO: 3494673 - DNA, 22 bp, Homo sapiens
agcatactttgtaaataggatt

SEQ ID NO: 3494674 - DNA, 17 bp, Homo sapiens
agcatatacaataatgt

SEQ ID NO: 3494675 - DNA, 22 bp, Homo sapiens
agcatatcgtaaagctgttcaa

SEQ ID NO: 3494676 - DNA, 16 bp, Homo sapiens
agcatatctgccttta

SEQ ID NO: 3494677 - DNA, 20 bp, Homo sapiens
agcatatctgcctttattgt

SEQ ID NO: 3494678 - DNA, 22 bp, Homo sapiens
agcatatctgcctttattgtgt

SEQ ID NO: 3494679 - DNA, 13 bp, Homo sapiens
agcatcacagaat

SEQ ID NO: 3494680 - DNA, 21 bp, Homo sapiens
agcatccgcaggtgctggtcc

SEQ ID NO: 3494681 - DNA, 23 bp, Homo sapiens
agcatcctggcacccggcccctg

SEQ ID NO: 3494682 - DNA, 14 bp, Homo sapiens
agcatcggcctagg

SEQ ID NO: 3494683 - DNA, 19 bp, Homo sapiens
agcatctccggggctttgt

SEQ ID NO: 3494684 - DNA, 19 bp, Homo sapiens
agcatctgcattgcccagt

SEQ ID NO: 3494685 - DNA, 24 bp, Homo sapiens
agcatctgcattgcccagtctttc

SEQ ID NO: 3494686 - DNA, 12 bp, Homo sapiens
agcatctgtaca

SEQ ID NO: 3494687 - DNA, 17 bp, Homo sapiens
agcatctgtacaaaggg

SEQ ID NO: 3494688 - DNA, 19 bp, Homo sapiens
agcatcttgcatccaaacc

SEQ ID NO: 3494689 - DNA, 14 bp, Homo sapiens
agcatctttcatat

SEQ ID NO: 3494690 - DNA, 20 bp, Homo sapiens
agcatgaatttttttcatct

SEQ ID NO: 3494691 - DNA, 14 bp, Homo sapiens
agcatgacagcctg

SEQ ID NO: 3494692 - DNA, 14 bp, Homo sapiens
agcatggagctggc

SEQ ID NO: 3494693 - DNA, 16 bp, Homo sapiens
agcatggagctggccg

SEQ ID NO: 3494694 - DNA, 21 bp, Homo sapiens
agcatgggggaccccttccca

SEQ ID NO: 3494695 - DNA, 23 bp, Homo sapiens
agcatgggggaccccttcccaca

SEQ ID NO: 3494696 - DNA, 16 bp, Homo sapiens
agcatggtcacaagca

SEQ ID NO: 3494697 - DNA, 17 bp, Homo sapiens
agcatgtcgtcaaagct

SEQ ID NO: 3494698 - DNA, 20 bp, Homo sapiens
agcatgtcgtcaaagctgaa

SEQ ID NO: 3494699 - DNA, 16 bp, Homo sapiens
agcatttaatccaaac

SEQ ID NO: 3494700 - DNA, 13 bp, Homo sapiens
agcatttgaatgc

SEQ ID NO: 3494701 - DNA, 12 bp, Homo sapiens
agcattttcctc

SEQ ID NO: 3494702 - DNA, 22 bp, Homo sapiens
agcattttgctaaatgtgaatg

SEQ ID NO: 3494703 - DNA, 15 bp, Homo sapiens
agcattttgtatttg

SEQ ID NO: 3494704 - DNA, 17 bp, Homo sapiens
agcattttttatgatat

SEQ ID NO: 3494705 - DNA, 19 bp, Homo sapiens
agcatttttttaaaagaag

SEQ ID NO: 3494706 - DNA, 19 bp, Homo sapiens
agcatttttttattcagca

SEQ ID NO: 3494707 - DNA, 14 bp, Homo sapiens
agccaaaccctgtc

SEQ ID NO: 3494708 - DNA, 15 bp, Homo sapiens
agccaaaccctgtct

SEQ ID NO: 3494709 - DNA, 15 bp, Homo sapiens
agccaaacgggagct

SEQ ID NO: 3494710 - DNA, 16 bp, Homo sapiens
agccaaacgggagctt

SEQ ID NO: 3494711 - DNA, 19 bp, Homo sapiens
agccaaacgggagcttttg

SEQ ID NO: 3494712 - DNA, 16 bp, Homo sapiens
agccaaagctaggcct

SEQ ID NO: 3494713 - DNA, 20 bp, Homo sapiens
agccaaagctaggcctggcc

SEQ ID NO: 3494714 - DNA, 18 bp, Homo sapiens
agccaacacgcacctgcc

SEQ ID NO: 3494715 - DNA, 19 bp, Homo sapiens
agccaacacgcacctgcct

SEQ ID NO: 3494716 - DNA, 22 bp, Homo sapiens
agccaacacgcacctgcctcag

SEQ ID NO: 3494717 - DNA, 18 bp, Homo sapiens
agccaacagaagcttcca

SEQ ID NO: 3494718 - DNA, 20 bp, Homo sapiens
agccaacatgtggctcctcc

SEQ ID NO: 3494719 - DNA, 16 bp, Homo sapiens
agccaagaaagatgta

SEQ ID NO: 3494720 - DNA, 22 bp, Homo sapiens
agccaagacctcacacacacaa

SEQ ID NO: 3494721 - DNA, 13 bp, Homo sapiens
agccaagcagcca

SEQ ID NO: 3494722 - DNA, 21 bp, Homo sapiens
agccaagcttcaaccctcagc

SEQ ID NO: 3494723 - DNA, 14 bp, Homo sapiens
agccaaggcagcga

SEQ ID NO: 3494724 - DNA, 22 bp, Homo sapiens
agccaaggcagcgaccccagga

SEQ ID NO: 3494725 - DNA, 16 bp, Homo sapiens
agccaaggggcttcag

SEQ ID NO: 3494726 - DNA, 20 bp, Homo sapiens
agccaagtagcctctcctgt

SEQ ID NO: 3494727 - DNA, 23 bp, Homo sapiens
agccaagtgtggtagagtgtgcc

SEQ ID NO: 3494728 - DNA, 18 bp, Homo sapiens
agccaataacacacagct

SEQ ID NO: 3494729 - DNA, 16 bp, Homo sapiens
agccaattatgttaaa

SEQ ID NO: 3494730 - DNA, 16 bp, Homo sapiens
agccaattcagacagg

SEQ ID NO: 3494731 - DNA, 17 bp, Homo sapiens
agccacaccaggataga

SEQ ID NO: 3494732 - DNA, 14 bp, Homo sapiens
agccacaggcctga

SEQ ID NO: 3494733 - DNA, 17 bp, Homo sapiens
agccacaggcctgagat

SEQ ID NO: 3494734 - DNA, 22 bp, Homo sapiens
agccacatttggaatacttttt

SEQ ID NO: 3494735 - DNA, 22 bp, Homo sapiens
agccaccttttgggaatgtttt

SEQ ID NO: 3494736 - DNA, 17 bp, Homo sapiens
agccacggccaggccag

SEQ ID NO: 3494737 - DNA, 22 bp, Homo sapiens
agccactaagaacccctctgct

SEQ ID NO: 3494738 - DNA, 15 bp, Homo sapiens
agccactcccctcca

SEQ ID NO: 3494739 - DNA, 14 bp, Homo sapiens
agccactcctctga

SEQ ID NO: 3494740 - DNA, 15 bp, Homo sapiens
agccactgagcaatg

SEQ ID NO: 3494741 - DNA, 13 bp, Homo sapiens
agccactgcaccg

SEQ ID NO: 3494742 - DNA, 21 bp, Homo sapiens
agccactgcaccgggccacag

SEQ ID NO: 3494743 - DNA, 22 bp, Homo sapiens
agccactgcaccgggccacaga

SEQ ID NO: 3494744 - DNA, 21 bp, Homo sapiens
agccactgccactccagtcct

SEQ ID NO: 3494745 - DNA, 20 bp, Homo sapiens
agccactggctgctaacaag

SEQ ID NO: 3494746 - DNA, 13 bp, Homo sapiens
agccagaggactg

SEQ ID NO: 3494747 - DNA, 14 bp, Homo sapiens
agccagaggactgt

SEQ ID NO: 3494748 - DNA, 18 bp, Homo sapiens
agccagaggctgggttca

SEQ ID NO: 3494749 - DNA, 18 bp, Homo sapiens
agccagatttgtcttttt

SEQ ID NO: 3494750 - DNA, 13 bp, Homo sapiens
agccagcacacag

SEQ ID NO: 3494751 - DNA, 17 bp, Homo sapiens
agccagcacacagggca

SEQ ID NO: 3494752 - DNA, 19 bp, Homo sapiens
agccagcacacagggcagt

SEQ ID NO: 3494753 - DNA, 22 bp, Homo sapiens
agccagcacttgtccagctgag

SEQ ID NO: 3494754 - DNA, 21 bp, Homo sapiens
agccagcagcagcccaagctt

SEQ ID NO: 3494755 - DNA, 16 bp, Homo sapiens
agccagcgtcctcctc

SEQ ID NO: 3494756 - DNA, 23 bp, Homo sapiens
agccagctcacagtgctgtgtgc

SEQ ID NO: 3494757 - DNA, 17 bp, Homo sapiens
agccaggaatttcccag

SEQ ID NO: 3494758 - DNA, 22 bp, Homo sapiens
agccaggaatttcccaggaccc

SEQ ID NO: 3494759 - DNA, 23 bp, Homo sapiens
agccaggaatttcccaggaccct

SEQ ID NO: 3494760 - DNA, 14 bp, Homo sapiens
agccaggagctgtc

SEQ ID NO: 3494761 - DNA, 17 bp, Homo sapiens
agccaggagctgtcacc

SEQ ID NO: 3494762 - DNA, 12 bp, Homo sapiens
agccagggtctc

SEQ ID NO: 3494763 - DNA, 18 bp, Homo sapiens
agccagtaaacagaggag

SEQ ID NO: 3494764 - DNA, 18 bp, Homo sapiens
agccagtgacctgaggaa

SEQ ID NO: 3494765 - DNA, 19 bp, Homo sapiens
agccagtgacctgaggaag

SEQ ID NO: 3494766 - DNA, 23 bp, Homo sapiens
agccatatgacaagcctttgtgc

SEQ ID NO: 3494767 - DNA, 13 bp, Homo sapiens
agccatcaaaatg

SEQ ID NO: 3494768 - DNA, 14 bp, Homo sapiens
agccatcaaaatgc

SEQ ID NO: 3494769 - DNA, 18 bp, Homo sapiens
agccatcaaaatgctttt

SEQ ID NO: 3494770 - DNA, 21 bp, Homo sapiens
agccatctcatgaggggagag

SEQ ID NO: 3494771 - DNA, 23 bp, Homo sapiens
agccatgatctgcaggggtctgg

SEQ ID NO: 3494772 - DNA, 18 bp, Homo sapiens
agccatgctggaaaataa

SEQ ID NO: 3494773 - DNA, 23 bp, Homo sapiens
agccatgtacagacagagaatat

SEQ ID NO: 3494774 - DNA, 15 bp, Homo sapiens
agccatgtgaaactc

SEQ ID NO: 3494775 - DNA, 20 bp, Homo sapiens
agcccaatattataattttt

SEQ ID NO: 3494776 - DNA, 23 bp, Homo sapiens
agcccacccctcaacacctctgc

SEQ ID NO: 3494777 - DNA, 14 bp, Homo sapiens
agcccactctgctc

SEQ ID NO: 3494778 - DNA, 14 bp, Homo sapiens
agcccactgtcctg

SEQ ID NO: 3494779 - DNA, 20 bp, Homo sapiens
agcccactgtcctgggcctg

SEQ ID NO: 3494780 - DNA, 22 bp, Homo sapiens
agcccactgtcctgggcctgca

SEQ ID NO: 3494781 - DNA, 15 bp, Homo sapiens
agcccacttctgcca

SEQ ID NO: 3494782 - DNA, 12 bp, Homo sapiens
agcccagacaaa

SEQ ID NO: 3494783 - DNA, 10 bp, Homo sapiens
agcccagaga

SEQ ID NO: 3494784 - DNA, 13 bp, Homo sapiens
agcccagagcaga

SEQ ID NO: 3494785 - DNA, 14 bp, Homo sapiens
agcccagaggaggg

SEQ ID NO: 3494786 - DNA, 15 bp, Homo sapiens
agcccagaggagggc

SEQ ID NO: 3494787 - DNA, 17 bp, Homo sapiens
agcccagattcccctgt

SEQ ID NO: 3494788 - DNA, 18 bp, Homo sapiens
agcccagattcccctgtg

SEQ ID NO: 3494789 - DNA, 19 bp, Homo sapiens
agcccagcccctactgctg

SEQ ID NO: 3494790 - DNA, 16 bp, Homo sapiens
agcccagctgggtcag

SEQ ID NO: 3494791 - DNA, 21 bp, Homo sapiens
agcccagctgggtcaggcagg

SEQ ID NO: 3494792 - DNA, 18 bp, Homo sapiens
agcccagggagcggaaag

SEQ ID NO: 3494793 - DNA, 21 bp, Homo sapiens
agcccagggagcggaaagcag

SEQ ID NO: 3494794 - DNA, 23 bp, Homo sapiens
agcccagggctcctgcacttact

SEQ ID NO: 3494795 - DNA, 18 bp, Homo sapiens
agcccagtagaccttgtt

SEQ ID NO: 3494796 - DNA, 17 bp, Homo sapiens
agccccacagtggaatt

SEQ ID NO: 3494797 - DNA, 13 bp, Homo sapiens
agccccagcctgc

SEQ ID NO: 3494798 - DNA, 15 bp, Homo sapiens
agccccagtgcccac

SEQ ID NO: 3494799 - DNA, 15 bp, Homo sapiens
agccccatctgtgca

SEQ ID NO: 3494800 - DNA, 12 bp, Homo sapiens
aggagaagccag

SEQ ID NO: 3494801 - DNA, 15 bp, Homo sapiens
aggagaagccaggaa

SEQ ID NO: 3494802 - DNA, 19 bp, Homo sapiens
aggagaagggctgaaccct

SEQ ID NO: 3494803 - DNA, 18 bp, Homo sapiens
aggagaagggctggggcc

SEQ ID NO: 3494804 - DNA, 18 bp, Homo sapiens
aggagacaggcagagctg

SEQ ID NO: 3494805 - DNA, 14 bp, Homo sapiens
aggagagagacaga

SEQ ID NO: 3494806 - DNA, 17 bp, Homo sapiens
aggagagatagcctgtg

SEQ ID NO: 3494807 - DNA, 20 bp, Homo sapiens
aggagagatagcctgtggcc

SEQ ID NO: 3494808 - DNA, 15 bp, Homo sapiens
aggagcaaagttaaa

SEQ ID NO: 3494809 - DNA, 14 bp, Homo sapiens
aggagcagtgcagg

SEQ ID NO: 3494810 - DNA, 22 bp, Homo sapiens
aggagcatttttttattcagca

SEQ ID NO: 3494811 - DNA, 23 bp, Homo sapiens
aggagcatttttttattcagcag

SEQ ID NO: 3494812 - DNA, 23 bp, Homo sapiens
aggagccagtttgccggatacaa

SEQ ID NO: 3494813 - DNA, 17 bp, Homo sapiens
aggagccccatctgtct

SEQ ID NO: 3494814 - DNA, 19 bp, Homo sapiens
aggagccccattcctggga

SEQ ID NO: 3494815 - DNA, 21 bp, Homo sapiens
aggagccccattcctgggaaa

SEQ ID NO: 3494816 - DNA, 17 bp, Homo sapiens
aggagccccgaggcctt

SEQ ID NO: 3494817 - DNA, 21 bp, Homo sapiens
aggagcccctggacatgcctg

SEQ ID NO: 3494818 - DNA, 22 bp, Homo sapiens
aggagcccctggacatgcctgt

SEQ ID NO: 3494819 - DNA, 21 bp, Homo sapiens
aggagcccttatctgtgctca

SEQ ID NO: 3494820 - DNA, 23 bp, Homo sapiens
aggagctgccttggctcagacat

SEQ ID NO: 3494821 - DNA, 11 bp, Homo sapiens
aggagctgcta

SEQ ID NO: 3494822 - DNA, 20 bp, Homo sapiens
aggagctgctatagcctggg

SEQ ID NO: 3494823 - DNA, 20 bp, Homo sapiens
aggagctggggatccctccc

SEQ ID NO: 3494824 - DNA, 20 bp, Homo sapiens
aggagctgtcaccaaggaaa

SEQ ID NO: 3494825 - DNA, 16 bp, Homo sapiens
aggagcttcctgtcct

SEQ ID NO: 3494826 - DNA, 20 bp, Homo sapiens
aggagcttcttgtttccttg

SEQ ID NO: 3494827 - DNA, 22 bp, Homo sapiens
aggagcttcttgtttccttgtt

SEQ ID NO: 3494828 - DNA, 16 bp, Homo sapiens
aggaggatgtaaggcc

SEQ ID NO: 3494829 - DNA, 19 bp, Homo sapiens
aggaggccacgtgatgtgg

SEQ ID NO: 3494830 - DNA, 22 bp, Homo sapiens
aggaggccaggccggcgagccc

SEQ ID NO: 3494831 - DNA, 17 bp, Homo sapiens
aggaggctccagagggc

SEQ ID NO: 3494832 - DNA, 17 bp, Homo sapiens
aggagggcgttcttagg

SEQ ID NO: 3494833 - DNA, 21 bp, Homo sapiens
aggagggcgttcttaggctgc

SEQ ID NO: 3494834 - DNA, 19 bp, Homo sapiens
aggaggggaaaaaaatgtt

SEQ ID NO: 3494835 - DNA, 16 bp, Homo sapiens
aggagggtgtaatgga

SEQ ID NO: 3494836 - DNA, 20 bp, Homo sapiens
aggagtccactttgtttcgt

SEQ ID NO: 3494837 - DNA, 14 bp, Homo sapiens
aggagtgtcctctt

SEQ ID NO: 3494838 - DNA, 16 bp, Homo sapiens
aggagtgtggccacgt

SEQ ID NO: 3494839 - DNA, 15 bp, Homo sapiens
aggagttagccaaac

SEQ ID NO: 3494840 - DNA, 17 bp, Homo sapiens
aggagttatttgtaatg

SEQ ID NO: 3494841 - DNA, 23 bp, Homo sapiens
aggagttcagggtcatagcatgc

SEQ ID NO: 3494842 - DNA, 19 bp, Homo sapiens
aggagttcctaaccagcct

SEQ ID NO: 3494843 - DNA, 20 bp, Homo sapiens
aggagttccttgatctgtat

SEQ ID NO: 3494844 - DNA, 17 bp, Homo sapiens
aggatacgctgctctca

SEQ ID NO: 3494845 - DNA, 22 bp, Homo sapiens
aggatactgtaacactttacaa

SEQ ID NO: 3494846 - DNA, 23 bp, Homo sapiens
aggatagctaactgtaaatcatg

SEQ ID NO: 3494847 - DNA, 13 bp, Homo sapiens
aggatattaaaat

SEQ ID NO: 3494848 - DNA, 14 bp, Homo sapiens
aggatattaaaatg

SEQ ID NO: 3494849 - DNA, 14 bp, Homo sapiens
aggatattccaaaa

SEQ ID NO: 3494850 - DNA, 13 bp, Homo sapiens
aggatcagtctga

SEQ ID NO: 3494851 - DNA, 13 bp, Homo sapiens
aggatcagttttt

SEQ ID NO: 3494852 - DNA, 22 bp, Homo sapiens
aggatcagttttttgttttaca

SEQ ID NO: 3494853 - DNA, 14 bp, Homo sapiens
aggatctacttttt

SEQ ID NO: 3494854 - DNA, 18 bp, Homo sapiens
aggatctcttgagcctgg

SEQ ID NO: 3494855 - DNA, 16 bp, Homo sapiens
aggatgagcagagccc

SEQ ID NO: 3494856 - DNA, 15 bp, Homo sapiens
aggatggcaggacgt

SEQ ID NO: 3494857 - DNA, 15 bp, Homo sapiens
aggatgtaaggcctt

SEQ ID NO: 3494858 - DNA, 16 bp, Homo sapiens
aggatgtaaggcctta

SEQ ID NO: 3494859 - DNA, 15 bp, Homo sapiens
aggatgtagcttttc

SEQ ID NO: 3494860 - DNA, 18 bp, Homo sapiens
aggatgtgtttgctttct

SEQ ID NO: 3494861 - DNA, 18 bp, Homo sapiens
aggatgttctgggacaca

SEQ ID NO: 3494862 - DNA, 22 bp, Homo sapiens
aggattctcatgggaaggggag

SEQ ID NO: 3494863 - DNA, 15 bp, Homo sapiens
aggattgctactgtc

SEQ ID NO: 3494864 - DNA, 18 bp, Homo sapiens
aggattgctactgtccta

SEQ ID NO: 3494865 - DNA, 14 bp, Homo sapiens
aggattgctgccag

SEQ ID NO: 3494866 - DNA, 16 bp, Homo sapiens
aggattgctgccagag

SEQ ID NO: 3494867 - DNA, 20 bp, Homo sapiens
aggattgctgccagagaagt

SEQ ID NO: 3494868 - DNA, 12 bp, Homo sapiens
aggatttttaga

SEQ ID NO: 3494869 - DNA, 15 bp, Homo sapiens
aggcaaaaatgtaaa

SEQ ID NO: 3494870 - DNA, 13 bp, Homo sapiens
aggcaaaattgca

SEQ ID NO: 3494871 - DNA, 20 bp, Homo sapiens
aggcaaaattgcaaatcttg

SEQ ID NO: 3494872 - DNA, 15 bp, Homo sapiens
aggcaaaattgtgaa

SEQ ID NO: 3494873 - DNA, 17 bp, Homo sapiens
aggcaaaattgtgaagc

SEQ ID NO: 3494874 - DNA, 22 bp, Homo sapiens
aggcaaacccatcaacaaaaat

SEQ ID NO: 3494875 - DNA, 19 bp, Homo sapiens
aggcaaagggtccagaagg

SEQ ID NO: 3494876 - DNA, 19 bp, Homo sapiens
aggcaagcacctcctgcct

SEQ ID NO: 3494877 - DNA, 14 bp, Homo sapiens
aggcaatgctggct

SEQ ID NO: 3494878 - DNA, 14 bp, Homo sapiens
aggcaattctcctg

SEQ ID NO: 3494879 - DNA, 13 bp, Homo sapiens
aggcacacagcta

SEQ ID NO: 3494880 - DNA, 15 bp, Homo sapiens
aggcacacagctact

SEQ ID NO: 3494881 - DNA, 21 bp, Homo sapiens
aggcacctataaaacaggtca

SEQ ID NO: 3494882 - DNA, 11 bp, Homo sapiens
aggcactgaag

SEQ ID NO: 3494883 - DNA, 13 bp, Homo sapiens
aggcactgcctga

SEQ ID NO: 3494884 - DNA, 14 bp, Homo sapiens
aggcactgcctgat

SEQ ID NO: 3494885 - DNA, 21 bp, Homo sapiens
aggcagacacagggacttgaa

SEQ ID NO: 3494886 - DNA, 11 bp, Homo sapiens
aggcagacacg

SEQ ID NO: 3494887 - DNA, 18 bp, Homo sapiens
aggcagacacggatctga

SEQ ID NO: 3494888 - DNA, 20 bp, Homo sapiens
aggcagacacggatctgaga

SEQ ID NO: 3494889 - DNA, 20 bp, Homo sapiens
aggcagactctttatgcttg

SEQ ID NO: 3494890 - DNA, 22 bp, Homo sapiens
aggcagactctttatgcttgca

SEQ ID NO: 3494891 - DNA, 13 bp, Homo sapiens
aggcagagaaagg

SEQ ID NO: 3494892 - DNA, 13 bp, Homo sapiens
aggcagatacagg

SEQ ID NO: 3494893 - DNA, 23 bp, Homo sapiens
aggcagatgtggggctgagctgg

SEQ ID NO: 3494894 - DNA, 22 bp, Homo sapiens
aggcagcagtgtgaggccaggg

SEQ ID NO: 3494895 - DNA, 22 bp, Homo sapiens
aggcagccccattctgcctgcc

SEQ ID NO: 3494896 - DNA, 12 bp, Homo sapiens
aggcagcgaccc

SEQ ID NO: 3494897 - DNA, 15 bp, Homo sapiens
aggcagcgaccccag

SEQ ID NO: 3494898 - DNA, 13 bp, Homo sapiens
aggcaggaagccc

SEQ ID NO: 3494899 - DNA, 23 bp, Homo sapiens
aggcaggacatgctgaagccaaa

SEQ ID NO: 3494900 - DNA, 23 bp, Homo sapiens
aggcaggaccttcgggctgtgcc

SEQ ID NO: 3494901 - DNA, 16 bp, Homo sapiens
aggcaggctcccaggg

SEQ ID NO: 3494902 - DNA, 17 bp, Homo sapiens
aggcagggctgcattgg

SEQ ID NO: 3494903 - DNA, 12 bp, Homo sapiens
aggcagggtctc

SEQ ID NO: 3494904 - DNA, 18 bp, Homo sapiens
aggcagggtctcactctg

SEQ ID NO: 3494905 - DNA, 19 bp, Homo sapiens
aggcagggtctcactctgt

SEQ ID NO: 3494906 - DNA, 21 bp, Homo sapiens
aggcagggtctcactctgtcg

SEQ ID NO: 3494907 - DNA, 22 bp, Homo sapiens
aggcagggtctcactctgtcgc

SEQ ID NO: 3494908 - DNA, 17 bp, Homo sapiens
aggcaggtgggatggat

SEQ ID NO: 3494909 - DNA, 15 bp, Homo sapiens
aggcagtaggccggt

SEQ ID NO: 3494910 - DNA, 22 bp, Homo sapiens
aggcagtaggccggtgtgcctg

SEQ ID NO: 3494911 - DNA, 21 bp, Homo sapiens
aggcagtattttgtgtcctcc

SEQ ID NO: 3494912 - DNA, 13 bp, Homo sapiens
aggcagtgggagg

SEQ ID NO: 3494913 - DNA, 16 bp, Homo sapiens
aggcagtgggaggcaa

SEQ ID NO: 3494914 - DNA, 23 bp, Homo sapiens
aggcagtttcagagatggacaga

SEQ ID NO: 3494915 - DNA, 20 bp, Homo sapiens
aggcatccttcctcacacca

SEQ ID NO: 3494916 - DNA, 22 bp, Homo sapiens
aggcatctctgtactttgcttg

SEQ ID NO: 3494917 - DNA, 12 bp, Homo sapiens
aggcatggtggc

SEQ ID NO: 3494918 - DNA, 17 bp, Homo sapiens
aggcatgtgtgaaacat

SEQ ID NO: 3494919 - DNA, 18 bp, Homo sapiens
aggcatgttctctgagga

SEQ ID NO: 3494920 - DNA, 20 bp, Homo sapiens
aggcattgccaagggctttg

SEQ ID NO: 3494921 - DNA, 16 bp, Homo sapiens
aggcattgtcctgtga

SEQ ID NO: 3494922 - DNA, 12 bp, Homo sapiens
aggcatttccta

SEQ ID NO: 3494923 - DNA, 18 bp, Homo sapiens
aggcatttgcagggtcct

SEQ ID NO: 3494924 - DNA, 20 bp, Homo sapiens
aggcatttgctgaatacaga

SEQ ID NO: 3494925 - DNA, 17 bp, Homo sapiens
aggccaacactgtgggt

SEQ ID NO: 3494926 - DNA, 14 bp, Homo sapiens
aggccacctcccca

SEQ ID NO: 3494927 - DNA, 19 bp, Homo sapiens
aggccacgtgatgtggagg

SEQ ID NO: 3494928 - DNA, 18 bp, Homo sapiens
aggccagaggcccccagc

SEQ ID NO: 3494929 - DNA, 22 bp, Homo sapiens
aggccagaggcccccagcccag

SEQ ID NO: 3494930 - DNA, 10 bp, Homo sapiens
aggccagcta

SEQ ID NO: 3494931 - DNA, 19 bp, Homo sapiens
aggccagctatctgcctga

SEQ ID NO: 3494932 - DNA, 18 bp, Homo sapiens
agtatctcctcgcaagct

SEQ ID NO: 3494933 - DNA, 19 bp, Homo sapiens
agtatctcctcgcaagctg

SEQ ID NO: 3494934 - DNA, 13 bp, Homo sapiens
agtatgacagagg

SEQ ID NO: 3494935 - DNA, 14 bp, Homo sapiens
agtatggagctcag

SEQ ID NO: 3494936 - DNA, 14 bp, Homo sapiens
agtatggtggctgg

SEQ ID NO: 3494937 - DNA, 23 bp, Homo sapiens
agtatgtgggggcttcatctctt

SEQ ID NO: 3494938 - DNA, 15 bp, Homo sapiens
agtatgttgtcaaag

SEQ ID NO: 3494939 - DNA, 15 bp, Homo sapiens
agtattacttctgct

SEQ ID NO: 3494940 - DNA, 18 bp, Homo sapiens
agtattacttctgctaca

SEQ ID NO: 3494941 - DNA, 18 bp, Homo sapiens
agtattattttccaaaag

SEQ ID NO: 3494942 - DNA, 17 bp, Homo sapiens
agtattgtaaattatat

SEQ ID NO: 3494943 - DNA, 13 bp, Homo sapiens
agtatttaattag

SEQ ID NO: 3494944 - DNA, 14 bp, Homo sapiens
agtatttaattagt

SEQ ID NO: 3494945 - DNA, 16 bp, Homo sapiens
agtatttaattagtgc

SEQ ID NO: 3494946 - DNA, 21 bp, Homo sapiens
agtatttaattagtgctaagt

SEQ ID NO: 3494947 - DNA, 13 bp, Homo sapiens
agtatttgattca

SEQ ID NO: 3494948 - DNA, 19 bp, Homo sapiens
agtatttttgctgcttctg

SEQ ID NO: 3494949 - DNA, 18 bp, Homo sapiens
agtcaacagttcaaagaa

SEQ ID NO: 3494950 - DNA, 19 bp, Homo sapiens
agtcaacagttcaaagaag

SEQ ID NO: 3494951 - DNA, 18 bp, Homo sapiens
agtcaagctcctcctccc

SEQ ID NO: 3494952 - DNA, 20 bp, Homo sapiens
agtcaagctcctcctccctg

SEQ ID NO: 3494953 - DNA, 23 bp, Homo sapiens
agtcacacagtattacttctgct

SEQ ID NO: 3494954 - DNA, 15 bp, Homo sapiens
agtcacacagtgagt

SEQ ID NO: 3494955 - DNA, 23 bp, Homo sapiens
agtcacacagtgagtcgaggaca

SEQ ID NO: 3494956 - DNA, 15 bp, Homo sapiens
agtcaccaagcccag

SEQ ID NO: 3494957 - DNA, 20 bp, Homo sapiens
agtcacgcctgaaactttga

SEQ ID NO: 3494958 - DNA, 23 bp, Homo sapiens
agtcactgtgagctcccaggtgc

SEQ ID NO: 3494959 - DNA, 19 bp, Homo sapiens
agtcagaattagctgcttc

SEQ ID NO: 3494960 - DNA, 20 bp, Homo sapiens
agtcagccccgacttcctga

SEQ ID NO: 3494961 - DNA, 14 bp, Homo sapiens
agtcagctctctgc

SEQ ID NO: 3494962 - DNA, 12 bp, Homo sapiens
agtcaggaaagg

SEQ ID NO: 3494963 - DNA, 18 bp, Homo sapiens
agtcagggaagagcagtg

SEQ ID NO: 3494964 - DNA, 16 bp, Homo sapiens
agtcagggacccctgc

SEQ ID NO: 3494965 - DNA, 16 bp, Homo sapiens
agtcagttgaaattct

SEQ ID NO: 3494966 - DNA, 14 bp, Homo sapiens
agtcagtttgcagt

SEQ ID NO: 3494967 - DNA, 19 bp, Homo sapiens
agtcatgctgctagatctt

SEQ ID NO: 3494968 - DNA, 13 bp, Homo sapiens
agtcatgtgcatt

SEQ ID NO: 3494969 - DNA, 13 bp, Homo sapiens
agtcatgtgcctc

SEQ ID NO: 3494970 - DNA, 20 bp, Homo sapiens
agtcatgtgcctctgtcctt

SEQ ID NO: 3494971 - DNA, 13 bp, Homo sapiens
agtcattcagcag

SEQ ID NO: 3494972 - DNA, 22 bp, Homo sapiens
agtcattcagcagcaaattttc

SEQ ID NO: 3494973 - DNA, 14 bp, Homo sapiens
agtcattggcttta

SEQ ID NO: 3494974 - DNA, 16 bp, Homo sapiens
agtcatttgagtctct

SEQ ID NO: 3494975 - DNA, 18 bp, Homo sapiens
agtcatttgagtctctta

SEQ ID NO: 3494976 - DNA, 23 bp, Homo sapiens
agtccaaggaaaccacagctgct

SEQ ID NO: 3494977 - DNA, 14 bp, Homo sapiens
agtccaatgtggca

SEQ ID NO: 3494978 - DNA, 20 bp, Homo sapiens
agtccagaaactgttcccac

SEQ ID NO: 3494979 - DNA, 12 bp, Homo sapiens
agtccagccagc

SEQ ID NO: 3494980 - DNA, 14 bp, Homo sapiens
agtccagccagctc

SEQ ID NO: 3494981 - DNA, 17 bp, Homo sapiens
agtccagccagctcctg

SEQ ID NO: 3494982 - DNA, 13 bp, Homo sapiens
agtccagcctgga

SEQ ID NO: 3494983 - DNA, 19 bp, Homo sapiens
agtccaggaggccctggtc

SEQ ID NO: 3494984 - DNA, 12 bp, Homo sapiens
agtcccaacccc

SEQ ID NO: 3494985 - DNA, 17 bp, Homo sapiens
agtcccaccctgctgct

SEQ ID NO: 3494986 - DNA, 18 bp, Homo sapiens
agtcccaccttggctgca

SEQ ID NO: 3494987 - DNA, 20 bp, Homo sapiens
agtcccaccttggctgcagg

SEQ ID NO: 3494988 - DNA, 21 bp, Homo sapiens
agtcccaccttggctgcaggg

SEQ ID NO: 3494989 - DNA, 23 bp, Homo sapiens
agtcccaccttggctgcagggag

SEQ ID NO: 3494990 - DNA, 20 bp, Homo sapiens
agtcccaggcccagtgcagt

SEQ ID NO: 3494991 - DNA, 17 bp, Homo sapiens
agtccccaggccccagg

SEQ ID NO: 3494992 - DNA, 19 bp, Homo sapiens
agtccccaggccccaggaa

SEQ ID NO: 3494993 - DNA, 21 bp, Homo sapiens
agtccccaggccccaggaagc

SEQ ID NO: 3494994 - DNA, 18 bp, Homo sapiens
agtccccattttctggta

SEQ ID NO: 3494995 - DNA, 16 bp, Homo sapiens
agtcccgaaatttgga

SEQ ID NO: 3494996 - DNA, 23 bp, Homo sapiens
agtccgaaagggacttggaagct

SEQ ID NO: 3494997 - DNA, 20 bp, Homo sapiens
agtccgcctggccggctcca

SEQ ID NO: 3494998 - DNA, 20 bp, Homo sapiens
agtccgtgctgacagctgct

SEQ ID NO: 3494999 - DNA, 23 bp, Homo sapiens
agtcctagttttcctacttataa

SEQ ID NO: 3495000 - DNA, 12 bp, Homo sapiens
agtcctctgaat

SEQ ID NO: 3495001 - DNA, 20 bp, Homo sapiens
agtcctgccaccaccctgtc

SEQ ID NO: 3495002 - DNA, 21 bp, Homo sapiens
agtcctgccaccaccctgtct

SEQ ID NO: 3495003 - DNA, 19 bp, Homo sapiens
agtcctgctacctcccttg

SEQ ID NO: 3495004 - DNA, 22 bp, Homo sapiens
agtcctgctacctcccttgcct

SEQ ID NO: 3495005 - DNA, 23 bp, Homo sapiens
agtcctggactcctgccaccagc

SEQ ID NO: 3495006 - DNA, 21 bp, Homo sapiens
agtcctggagcaatcacagat

SEQ ID NO: 3495007 - DNA, 13 bp, Homo sapiens
agtcctggcccaa

SEQ ID NO: 3495008 - DNA, 15 bp, Homo sapiens
agtcctgtatgtctg

SEQ ID NO: 3495009 - DNA, 19 bp, Homo sapiens
agtcctgtgaatgccactg

SEQ ID NO: 3495010 - DNA, 21 bp, Homo sapiens
agtcctgtgaatgccactgcc

SEQ ID NO: 3495011 - DNA, 22 bp, Homo sapiens
agtcctgtgaatgccactgcct

SEQ ID NO: 3495012 - DNA, 14 bp, Homo sapiens
agtccttaaaaatc

SEQ ID NO: 3495013 - DNA, 22 bp, Homo sapiens
agtcctttgtgaatattttcaa

SEQ ID NO: 3495014 - DNA, 20 bp, Homo sapiens
agtcggaacggagaaaggtg

SEQ ID NO: 3495015 - DNA, 21 bp, Homo sapiens
agtcgtgagctcttgtgagga

SEQ ID NO: 3495016 - DNA, 12 bp, Homo sapiens
agtcgtgcctgt

SEQ ID NO: 3495017 - DNA, 19 bp, Homo sapiens
agtcgtggggtgtgctggg

SEQ ID NO: 3495018 - DNA, 20 bp, Homo sapiens
agtcgtggggtgtgctggga

SEQ ID NO: 3495019 - DNA, 23 bp, Homo sapiens
agtctaaatattcagaatctttg

SEQ ID NO: 3495020 - DNA, 17 bp, Homo sapiens
agtctagatggctcctc

SEQ ID NO: 3495021 - DNA, 19 bp, Homo sapiens
agtctagatggctcctctc

SEQ ID NO: 3495022 - DNA, 15 bp, Homo sapiens
agtctagtgtagtat

SEQ ID NO: 3495023 - DNA, 23 bp, Homo sapiens
agtctatggccaggtatgcatgg

SEQ ID NO: 3495024 - DNA, 16 bp, Homo sapiens
agtctcactgttgccc

SEQ ID NO: 3495025 - DNA, 21 bp, Homo sapiens
agtctcactgttgcccaggct

SEQ ID NO: 3495026 - DNA, 23 bp, Homo sapiens
agtctcactgttgcccaggctgg

SEQ ID NO: 3495027 - DNA, 19 bp, Homo sapiens
agtctcactttgtcgccca

SEQ ID NO: 3495028 - DNA, 18 bp, Homo sapiens
agtctcaggagtctctgg

SEQ ID NO: 3495029 - DNA, 16 bp, Homo sapiens
agtctccaccaggaac

SEQ ID NO: 3495030 - DNA, 13 bp, Homo sapiens
agtctctgccttg

SEQ ID NO: 3495031 - DNA, 16 bp, Homo sapiens
agtctctgctggccca

SEQ ID NO: 3495032 - DNA, 20 bp, Homo sapiens
agtctgaacctatttcttaa

SEQ ID NO: 3495033 - DNA, 20 bp, Homo sapiens
agtctgattcccaagctctg

SEQ ID NO: 3495034 - DNA, 22 bp, Homo sapiens
agtctggccctagactcggggt

SEQ ID NO: 3495035 - DNA, 15 bp, Homo sapiens
agtctggtcagagcc

SEQ ID NO: 3495036 - DNA, 17 bp, Homo sapiens
agtctggtcagagccac

SEQ ID NO: 3495037 - DNA, 22 bp, Homo sapiens
agtctggtcagagccacagggt

SEQ ID NO: 3495038 - DNA, 21 bp, Homo sapiens
agtctgtgttcaaaaatatat

SEQ ID NO: 3495039 - DNA, 16 bp, Homo sapiens
agtcttacgaatactt

SEQ ID NO: 3495040 - DNA, 15 bp, Homo sapiens
agtcttccatttgca

SEQ ID NO: 3495041 - DNA, 17 bp, Homo sapiens
agtcttgacgagtgtga

SEQ ID NO: 3495042 - DNA, 21 bp, Homo sapiens
agtctttaggtctttgtaaga

SEQ ID NO: 3495043 - DNA, 17 bp, Homo sapiens
agtcttttgttcgcatg

SEQ ID NO: 3495044 - DNA, 17 bp, Homo sapiens
agtgaaaaaggaggaag

SEQ ID NO: 3495045 - DNA, 23 bp, Homo sapiens
agtgaaaaaggaggaagagaaaa

SEQ ID NO: 3495046 - DNA, 19 bp, Homo sapiens
agtgaaagtgaggaaataa

SEQ ID NO: 3495047 - DNA, 16 bp, Homo sapiens
agtgaaagttgccatt

SEQ ID NO: 3495048 - DNA, 21 bp, Homo sapiens
agtgaaataaattctgattct

SEQ ID NO: 3495049 - DNA, 22 bp, Homo sapiens
agtgaaataaattctgattctt

SEQ ID NO: 3495050 - DNA, 15 bp, Homo sapiens
agtgaacctgtataa

SEQ ID NO: 3495051 - DNA, 20 bp, Homo sapiens
agtgaacttgggccactgtg

SEQ ID NO: 3495052 - DNA, 15 bp, Homo sapiens
agtgaaggcttctct

SEQ ID NO: 3495053 - DNA, 23 bp, Homo sapiens
agtgaaggtttacaatttacaaa

SEQ ID NO: 3495054 - DNA, 19 bp, Homo sapiens
agtgaatgattcagtgtta

SEQ ID NO: 3495055 - DNA, 17 bp, Homo sapiens
agtgaatgccagtgtgc

SEQ ID NO: 3495056 - DNA, 14 bp, Homo sapiens
agtgaatgctggga

SEQ ID NO: 3495057 - DNA, 15 bp, Homo sapiens
agtgaatgctgggac

SEQ ID NO: 3495058 - DNA, 19 bp, Homo sapiens
agtgaatgctgggactcag

SEQ ID NO: 3495059 - DNA, 17 bp, Homo sapiens
agtgaatttttctctaa

SEQ ID NO: 3495060 - DNA, 14 bp, Homo sapiens
agtgaatttttgca

SEQ ID NO: 3495061 - DNA, 14 bp, Homo sapiens
agtgacaaaataga

SEQ ID NO: 3495062 - DNA, 13 bp, Homo sapiens
agtgacaaaccat

SEQ ID NO: 3495063 - DNA, 15 bp, Homo sapiens
atagatgctggccca

SEQ ID NO: 3495064 - DNA, 23 bp, Homo sapiens
atagatgctggcccagggcccag

SEQ ID NO: 3495065 - DNA, 13 bp, Homo sapiens
atagcaagtgaat

SEQ ID NO: 3495066 - DNA, 18 bp, Homo sapiens
atagcacccctactcaca

SEQ ID NO: 3495067 - DNA, 11 bp, Homo sapiens
atagcactttc

SEQ ID NO: 3495068 - DNA, 14 bp, Homo sapiens
atagcagattttaa

SEQ ID NO: 3495069 - DNA, 22 bp, Homo sapiens
atagcagattttaattttgaat

SEQ ID NO: 3495070 - DNA, 19 bp, Homo sapiens
atagcatctgtacaaaggg

SEQ ID NO: 3495071 - DNA, 20 bp, Homo sapiens
atagcatctttcatatggta

SEQ ID NO: 3495072 - DNA, 13 bp, Homo sapiens
atagcatgcatct

SEQ ID NO: 3495073 - DNA, 13 bp, Homo sapiens
atagccacatttg

SEQ ID NO: 3495074 - DNA, 16 bp, Homo sapiens
atagccacatttggaa

SEQ ID NO: 3495075 - DNA, 22 bp, Homo sapiens
atagccacatttggaatacttt

SEQ ID NO: 3495076 - DNA, 23 bp, Homo sapiens
atagccacatttggaatactttt

SEQ ID NO: 3495077 - DNA, 21 bp, Homo sapiens
atagccaggagcgcatctcaa

SEQ ID NO: 3495078 - DNA, 18 bp, Homo sapiens
atagcctgcctcttctct

SEQ ID NO: 3495079 - DNA, 11 bp, Homo sapiens
atagcctgtgg

SEQ ID NO: 3495080 - DNA, 21 bp, Homo sapiens
atagcgctgtttttgttgtgt

SEQ ID NO: 3495081 - DNA, 15 bp, Homo sapiens
atagctaactgtaaa

SEQ ID NO: 3495082 - DNA, 23 bp, Homo sapiens
atagctccccgcttctgcctgca

SEQ ID NO: 3495083 - DNA, 18 bp, Homo sapiens
ataggaatgtagaagtct

SEQ ID NO: 3495084 - DNA, 17 bp, Homo sapiens
ataggcgtaactaattt

SEQ ID NO: 3495085 - DNA, 17 bp, Homo sapiens
atagggaatatatctct

SEQ ID NO: 3495086 - DNA, 14 bp, Homo sapiens
ataggtcagagatg

SEQ ID NO: 3495087 - DNA, 23 bp, Homo sapiens
ataggttaataaagatgattgaa

SEQ ID NO: 3495088 - DNA, 13 bp, Homo sapiens
ataggttgagcaa

SEQ ID NO: 3495089 - DNA, 14 bp, Homo sapiens
atagtaattctcag

SEQ ID NO: 3495090 - DNA, 14 bp, Homo sapiens
atagtaatttgtaa

SEQ ID NO: 3495091 - DNA, 17 bp, Homo sapiens
atagtaatttgtaaagt

SEQ ID NO: 3495092 - DNA, 15 bp, Homo sapiens
atagtatggtggctg

SEQ ID NO: 3495093 - DNA, 16 bp, Homo sapiens
atagtatggtggctgg

SEQ ID NO: 3495094 - DNA, 12 bp, Homo sapiens
atagtatttgat

SEQ ID NO: 3495095 - DNA, 14 bp, Homo sapiens
atagtctagtgtag

SEQ ID NO: 3495096 - DNA, 15 bp, Homo sapiens
atagtctagtgtagt

SEQ ID NO: 3495097 - DNA, 23 bp, Homo sapiens
atagtgaaataaattctgattct

SEQ ID NO: 3495098 - DNA, 20 bp, Homo sapiens
atagtgatgtaatcttgaat

SEQ ID NO: 3495099 - DNA, 17 bp, Homo sapiens
atagtggcttaaaacaa

SEQ ID NO: 3495100 - DNA, 17 bp, Homo sapiens
atagtgttaactgtcag

SEQ ID NO: 3495101 - DNA, 15 bp, Homo sapiens
atagttaatattttg

SEQ ID NO: 3495102 - DNA, 14 bp, Homo sapiens
atataaaataatgc

SEQ ID NO: 3495103 - DNA, 21 bp, Homo sapiens
atataaacctaaaaaagatat

SEQ ID NO: 3495104 - DNA, 12 bp, Homo sapiens
atataaatatat

SEQ ID NO: 3495105 - DNA, 22 bp, Homo sapiens
atataaattcactttcattttt

SEQ ID NO: 3495106 - DNA, 12 bp, Homo sapiens
atataagaaaga

SEQ ID NO: 3495107 - DNA, 18 bp, Homo sapiens
atataagaaagacatctt

SEQ ID NO: 3495108 - DNA, 14 bp, Homo sapiens
atataagtaaagtg

SEQ ID NO: 3495109 - DNA, 18 bp, Homo sapiens
atataagtgctgtataaa

SEQ ID NO: 3495110 - DNA, 20 bp, Homo sapiens
atataagtggtgcttagaaa

SEQ ID NO: 3495111 - DNA, 23 bp, Homo sapiens
atataatatgcacacagtgcttt

SEQ ID NO: 3495112 - DNA, 14 bp, Homo sapiens
atatacaattatat

SEQ ID NO: 3495113 - DNA, 14 bp, Homo sapiens
atataccatttatc

SEQ ID NO: 3495114 - DNA, 21 bp, Homo sapiens
atataccttttttgttccact

SEQ ID NO: 3495115 - DNA, 14 bp, Homo sapiens
atatacttgtggac

SEQ ID NO: 3495116 - DNA, 15 bp, Homo sapiens
atatacttgtggact

SEQ ID NO: 3495117 - DNA, 20 bp, Homo sapiens
atatacttttttttctttaa

SEQ ID NO: 3495118 - DNA, 18 bp, Homo sapiens
atatagcacttttgaaga

SEQ ID NO: 3495119 - DNA, 15 bp, Homo sapiens
atatagcatctttca

SEQ ID NO: 3495120 - DNA, 15 bp, Homo sapiens
atatagctgtacaaa

SEQ ID NO: 3495121 - DNA, 17 bp, Homo sapiens
atatagctgtacaaata

SEQ ID NO: 3495122 - DNA, 10 bp, Homo sapiens
atatataaaa

SEQ ID NO: 3495123 - DNA, 18 bp, Homo sapiens
atatataaaataaatata

SEQ ID NO: 3495124 - DNA, 18 bp, Homo sapiens
atatataagaaagacatc

SEQ ID NO: 3495125 - DNA, 22 bp, Homo sapiens
atatatacatagcatgacattt

SEQ ID NO: 3495126 - DNA, 13 bp, Homo sapiens
atatatataaacc

SEQ ID NO: 3495127 - DNA, 19 bp, Homo sapiens
atatatctaagttcacagt

SEQ ID NO: 3495128 - DNA, 20 bp, Homo sapiens
atatatggcagagttgtaaa

SEQ ID NO: 3495129 - DNA, 10 bp, Homo sapiens
atatatgtat

SEQ ID NO: 3495130 - DNA, 22 bp, Homo sapiens
atatatgtatgtatgtgtgtgt

SEQ ID NO: 3495131 - DNA, 12 bp, Homo sapiens
atatatgtattt

SEQ ID NO: 3495132 - DNA, 18 bp, Homo sapiens
atatatgtgaggatgtat

SEQ ID NO: 3495133 - DNA, 15 bp, Homo sapiens
atatatgtgtttttc

SEQ ID NO: 3495134 - DNA, 21 bp, Homo sapiens
atatatgtgtttttcacattt

SEQ ID NO: 3495135 - DNA, 17 bp, Homo sapiens
atatattaaaaatataa

SEQ ID NO: 3495136 - DNA, 12 bp, Homo sapiens
atatattattct

SEQ ID NO: 3495137 - DNA, 15 bp, Homo sapiens
atatattgcatttct

SEQ ID NO: 3495138 - DNA, 21 bp, Homo sapiens
atatattgcatttctgtattt

SEQ ID NO: 3495139 - DNA, 18 bp, Homo sapiens
atatattgttgttacttt

SEQ ID NO: 3495140 - DNA, 12 bp, Homo sapiens
atatatttctat

SEQ ID NO: 3495141 - DNA, 13 bp, Homo sapiens
atatatttctatt

SEQ ID NO: 3495142 - DNA, 12 bp, Homo sapiens
atatcaaatgca

SEQ ID NO: 3495143 - DNA, 17 bp, Homo sapiens
atatcattgttggtgtt

SEQ ID NO: 3495144 - DNA, 14 bp, Homo sapiens
atatcctttgcctc

SEQ ID NO: 3495145 - DNA, 17 bp, Homo sapiens
atatcgacttgtttttg

SEQ ID NO: 3495146 - DNA, 15 bp, Homo sapiens
atatctaaagttata

SEQ ID NO: 3495147 - DNA, 18 bp, Homo sapiens
atatctgcctttattgtg

SEQ ID NO: 3495148 - DNA, 14 bp, Homo sapiens
atatcttcagttta

SEQ ID NO: 3495149 - DNA, 22 bp, Homo sapiens
atatcttcagtttaatgcaaga

SEQ ID NO: 3495150 - DNA, 16 bp, Homo sapiens
atatctttattaatca

SEQ ID NO: 3495151 - DNA, 13 bp, Homo sapiens
atatgaacatata

SEQ ID NO: 3495152 - DNA, 17 bp, Homo sapiens
atatgatgcaaactgtg

SEQ ID NO: 3495153 - DNA, 18 bp, Homo sapiens
atatgctcttttgtttgg

SEQ ID NO: 3495154 - DNA, 15 bp, Homo sapiens
atatgctgcaacaaa

SEQ ID NO: 3495155 - DNA, 20 bp, Homo sapiens
atatggacacttaatactac

SEQ ID NO: 3495156 - DNA, 18 bp, Homo sapiens
atatggcagagttgtaaa

SEQ ID NO: 3495157 - DNA, 22 bp, Homo sapiens
atatggcagagttgtaaatata

SEQ ID NO: 3495158 - DNA, 23 bp, Homo sapiens
atatgggaacactggcagactgt

SEQ ID NO: 3495159 - DNA, 20 bp, Homo sapiens
atatgtaaaataaaattatg

SEQ ID NO: 3495160 - DNA, 17 bp, Homo sapiens
atatgtaacaagccacc

SEQ ID NO: 3495161 - DNA, 14 bp, Homo sapiens
atatgtacatgaga

SEQ ID NO: 3495162 - DNA, 21 bp, Homo sapiens
atatgtatatatatatatgca

SEQ ID NO: 3495163 - DNA, 20 bp, Homo sapiens
atatgtatatatatgtatgt

SEQ ID NO: 3495164 - DNA, 16 bp, Homo sapiens
atatgtatttaccaaa

SEQ ID NO: 3495165 - DNA, 16 bp, Homo sapiens
atatgtcgtagaattc

SEQ ID NO: 3495166 - DNA, 19 bp, Homo sapiens
atatgtgccaatcaatagc

SEQ ID NO: 3495167 - DNA, 23 bp, Homo sapiens
atatgttaagcagctaaattttc

SEQ ID NO: 3495168 - DNA, 12 bp, Homo sapiens
atatgttcaact

SEQ ID NO: 3495169 - DNA, 16 bp, Homo sapiens
atatgttcaactggag

SEQ ID NO: 3495170 - DNA, 20 bp, Homo sapiens
atatgttgctataataaaga

SEQ ID NO: 3495171 - DNA, 14 bp, Homo sapiens
atattaaaaagtct

SEQ ID NO: 3495172 - DNA, 18 bp, Homo sapiens
atattaaaaatataaaac

SEQ ID NO: 3495173 - DNA, 21 bp, Homo sapiens
atattaaaaatataaaactgc

SEQ ID NO: 3495174 - DNA, 14 bp, Homo sapiens
atattaaaatgcta

SEQ ID NO: 3495175 - DNA, 22 bp, Homo sapiens
atattaaagagaaagcccgctt

SEQ ID NO: 3495176 - DNA, 13 bp, Homo sapiens
atattaaatctgc

SEQ ID NO: 3495177 - DNA, 22 bp, Homo sapiens
atattaaggaagacaatgtgaa

SEQ ID NO: 3495178 - DNA, 19 bp, Homo sapiens
atattaatagtaatttgta

SEQ ID NO: 3495179 - DNA, 21 bp, Homo sapiens
atattagctttactgtttgtt

SEQ ID NO: 3495180 - DNA, 14 bp, Homo sapiens
atattatagagagt

SEQ ID NO: 3495181 - DNA, 15 bp, Homo sapiens
atattatgagatgct

SEQ ID NO: 3495182 - DNA, 22 bp, Homo sapiens
atattatgtataaaatgtaaca

SEQ ID NO: 3495183 - DNA, 20 bp, Homo sapiens
atattcagaatctttgttaa

SEQ ID NO: 3495184 - DNA, 12 bp, Homo sapiens
atattccaaaat

SEQ ID NO: 3495185 - DNA, 15 bp, Homo sapiens
atattctatttttat

SEQ ID NO: 3495186 - DNA, 16 bp, Homo sapiens
atattctgctctatta

SEQ ID NO: 3495187 - DNA, 16 bp, Homo sapiens
atattctgttggccag

SEQ ID NO: 3495188 - DNA, 18 bp, Homo sapiens
atattgaagaatttgttt

SEQ ID NO: 3495189 - DNA, 22 bp, Homo sapiens
atattgataagctattgtctgt

SEQ ID NO: 3495190 - DNA, 13 bp, Homo sapiens
atattgcacatgt

SEQ ID NO: 3495191 - DNA, 15 bp, Homo sapiens
atattgcacatgtct

SEQ ID NO: 3495192 - DNA, 12 bp, Homo sapiens
atattgcatttc

SEQ ID NO: 3495193 - DNA, 17 bp, Homo sapiens
atattgcatttctgtat

SEQ ID NO: 3495194 - DNA, 16 bp, Homo sapiens
atattgcccaggctgg

SEQ ID NO: 3495195 - DNA, 17 bp, Homo sapiens
atattgctgtatagctc

SEQ ID NO: 3495196 - DNA, 19 bp, Homo sapiens
atgagaatgtgccatgtat

SEQ ID NO: 3495197 - DNA, 20 bp, Homo sapiens
atgagaatgtgccatgtata

SEQ ID NO: 3495198 - DNA, 16 bp, Homo sapiens
atgagacttgccttcc

SEQ ID NO: 3495199 - DNA, 15 bp, Homo sapiens
atgagagcgacacag

SEQ ID NO: 3495200 - DNA, 15 bp, Homo sapiens
atgagagttttggat

SEQ ID NO: 3495201 - DNA, 16 bp, Homo sapiens
atgagatttttaaaaa

SEQ ID NO: 3495202 - DNA, 20 bp, Homo sapiens
atgagatttttaaaaaatat

SEQ ID NO: 3495203 - DNA, 22 bp, Homo sapiens
atgagcagagcccggagctccg

SEQ ID NO: 3495204 - DNA, 18 bp, Homo sapiens
atgagcatggagctggcc

SEQ ID NO: 3495205 - DNA, 14 bp, Homo sapiens
atgagcctgctgga

SEQ ID NO: 3495206 - DNA, 20 bp, Homo sapiens
atgagcctgctggaagccca

SEQ ID NO: 3495207 - DNA, 14 bp, Homo sapiens
atgagcctggcaag

SEQ ID NO: 3495208 - DNA, 19 bp, Homo sapiens
atgagctctacccagggcc

SEQ ID NO: 3495209 - DNA, 17 bp, Homo sapiens
atgaggagagaaaatat

SEQ ID NO: 3495210 - DNA, 19 bp, Homo sapiens
atgaggagagaaaatatat

SEQ ID NO: 3495211 - DNA, 13 bp, Homo sapiens
atgaggctttcca

SEQ ID NO: 3495212 - DNA, 20 bp, Homo sapiens
atgagggtatcaaataaaat

SEQ ID NO: 3495213 - DNA, 20 bp, Homo sapiens
atgaggtcagagcctgcagt

SEQ ID NO: 3495214 - DNA, 22 bp, Homo sapiens
atgaggtcagagcctgcagtta

SEQ ID NO: 3495215 - DNA, 16 bp, Homo sapiens
atgagtgcgtgctcag

SEQ ID NO: 3495216 - DNA, 15 bp, Homo sapiens
atgataaaacacaaa

SEQ ID NO: 3495217 - DNA, 20 bp, Homo sapiens
atgataagttcctttccttt

SEQ ID NO: 3495218 - DNA, 19 bp, Homo sapiens
atgataattacaatacaaa

SEQ ID NO: 3495219 - DNA, 15 bp, Homo sapiens
atgatacatccaaag

SEQ ID NO: 3495220 - DNA, 20 bp, Homo sapiens
atgatagcgggaaaaggaga

SEQ ID NO: 3495221 - DNA, 22 bp, Homo sapiens
atgataggttaataaagatgat

SEQ ID NO: 3495222 - DNA, 20 bp, Homo sapiens
atgatcagtggacagtctgc

SEQ ID NO: 3495223 - DNA, 20 bp, Homo sapiens
atgatcctgtattcagacag

SEQ ID NO: 3495224 - DNA, 18 bp, Homo sapiens
atgatgaaatgaggtcag

SEQ ID NO: 3495225 - DNA, 22 bp, Homo sapiens
atgatgcctctgtcttctggac

SEQ ID NO: 3495226 - DNA, 12 bp, Homo sapiens
atgatgctgccg

SEQ ID NO: 3495227 - DNA, 22 bp, Homo sapiens
atgatgctgccggcacagctgg

SEQ ID NO: 3495228 - DNA, 21 bp, Homo sapiens
atgatgcttttactgaacttt

SEQ ID NO: 3495229 - DNA, 15 bp, Homo sapiens
atgatggatgccaat

SEQ ID NO: 3495230 - DNA, 13 bp, Homo sapiens
atgatgggcctga

SEQ ID NO: 3495231 - DNA, 15 bp, Homo sapiens
atgatgggcctgaac

SEQ ID NO: 3495232 - DNA, 23 bp, Homo sapiens
atgatggggccctaattcagcca

SEQ ID NO: 3495233 - DNA, 14 bp, Homo sapiens
atgatgtgcctggg

SEQ ID NO: 3495234 - DNA, 16 bp, Homo sapiens
atgatgtgcctgggtg

SEQ ID NO: 3495235 - DNA, 14 bp, Homo sapiens
atgatgtgtatata

SEQ ID NO: 3495236 - DNA, 21 bp, Homo sapiens
atgatgtttcgtgaagtatac

SEQ ID NO: 3495237 - DNA, 14 bp, Homo sapiens
atgatgtttgccca

SEQ ID NO: 3495238 - DNA, 12 bp, Homo sapiens
atgattcaagcc

SEQ ID NO: 3495239 - DNA, 13 bp, Homo sapiens
atgattcaagcca

SEQ ID NO: 3495240 - DNA, 16 bp, Homo sapiens
atgattcagtgttaaa

SEQ ID NO: 3495241 - DNA, 13 bp, Homo sapiens
atgattccttcct

SEQ ID NO: 3495242 - DNA, 20 bp, Homo sapiens
atgatttataaacagacaat

SEQ ID NO: 3495243 - DNA, 21 bp, Homo sapiens
atgatttccttgaatgtggct

SEQ ID NO: 3495244 - DNA, 23 bp, Homo sapiens
atgcaaaaggttcactaaagcag

SEQ ID NO: 3495245 - DNA, 16 bp, Homo sapiens
atgcaaatagcaaaac

SEQ ID NO: 3495246 - DNA, 18 bp, Homo sapiens
atgcaaatcctatgtgat

SEQ ID NO: 3495247 - DNA, 17 bp, Homo sapiens
atgcaagacgccctcta

SEQ ID NO: 3495248 - DNA, 22 bp, Homo sapiens
atgcaatagaagtgctcccctc

SEQ ID NO: 3495249 - DNA, 23 bp, Homo sapiens
atgcacaagatgccccagggatg

SEQ ID NO: 3495250 - DNA, 23 bp, Homo sapiens
atgcacatgttggaggagagagc

SEQ ID NO: 3495251 - DNA, 14 bp, Homo sapiens
atgcaccaccaagc

SEQ ID NO: 3495252 - DNA, 15 bp, Homo sapiens
atgcaccaccaagcc

SEQ ID NO: 3495253 - DNA, 14 bp, Homo sapiens
atgcactatgtata

SEQ ID NO: 3495254 - DNA, 19 bp, Homo sapiens
atgcagaatgttgattaca

SEQ ID NO: 3495255 - DNA, 18 bp, Homo sapiens
atgcagaggcctggggga

SEQ ID NO: 3495256 - DNA, 17 bp, Homo sapiens
atgcagaggtctccaaa

SEQ ID NO: 3495257 - DNA, 19 bp, Homo sapiens
atgcagcagggatgccctg

SEQ ID NO: 3495258 - DNA, 13 bp, Homo sapiens
atgcagcgtgaag

SEQ ID NO: 3495259 - DNA, 13 bp, Homo sapiens
atgcagctcaaga

SEQ ID NO: 3495260 - DNA, 17 bp, Homo sapiens
atgcaggtgaaacccag

SEQ ID NO: 3495261 - DNA, 22 bp, Homo sapiens
atgcagtctctttattttacta

SEQ ID NO: 3495262 - DNA, 23 bp, Homo sapiens
atgcagtgctcgctgttgctgaa

SEQ ID NO: 3495263 - DNA, 23 bp, Homo sapiens
atgcagtggtatgatcacggctc

SEQ ID NO: 3495264 - DNA, 14 bp, Homo sapiens
atgcagtttgaaat

SEQ ID NO: 3495265 - DNA, 15 bp, Homo sapiens
atgcagtttgaaatt

SEQ ID NO: 3495266 - DNA, 16 bp, Homo sapiens
atgcagtttgaaattc

SEQ ID NO: 3495267 - DNA, 22 bp, Homo sapiens
atgcagtttgaaattctgaatt

SEQ ID NO: 3495268 - DNA, 16 bp, Homo sapiens
atgcataatgtcttta

SEQ ID NO: 3495269 - DNA, 14 bp, Homo sapiens
atgcatctagatta

SEQ ID NO: 3495270 - DNA, 12 bp, Homo sapiens
atgcatctgttt

SEQ ID NO: 3495271 - DNA, 14 bp, Homo sapiens
atgcatcttactga

SEQ ID NO: 3495272 - DNA, 18 bp, Homo sapiens
atgcatcttactgaaggt

SEQ ID NO: 3495273 - DNA, 17 bp, Homo sapiens
atgcatggtgccccagg

SEQ ID NO: 3495274 - DNA, 20 bp, Homo sapiens
atgcatggtgccccaggacc

SEQ ID NO: 3495275 - DNA, 15 bp, Homo sapiens
atgcatgtcttttaa

SEQ ID NO: 3495276 - DNA, 13 bp, Homo sapiens
atgcatgtgtgtg

SEQ ID NO: 3495277 - DNA, 12 bp, Homo sapiens
atgcatttgact

SEQ ID NO: 3495278 - DNA, 16 bp, Homo sapiens
atgccaagcactgtgc

SEQ ID NO: 3495279 - DNA, 19 bp, Homo sapiens
atgccaagcactgtgctca

SEQ ID NO: 3495280 - DNA, 20 bp, Homo sapiens
atgccaccaacttacaaaaa

SEQ ID NO: 3495281 - DNA, 17 bp, Homo sapiens
atgccactcctccctcc

SEQ ID NO: 3495282 - DNA, 17 bp, Homo sapiens
atgccactgccttcgct

SEQ ID NO: 3495283 - DNA, 20 bp, Homo sapiens
atgccagtgtgctgatgggc

SEQ ID NO: 3495284 - DNA, 16 bp, Homo sapiens
atgccatcatctcctg

SEQ ID NO: 3495285 - DNA, 17 bp, Homo sapiens
atgccccctcagtgagg

SEQ ID NO: 3495286 - DNA, 15 bp, Homo sapiens
atgccctcctctccc

SEQ ID NO: 3495287 - DNA, 13 bp, Homo sapiens
atgccctctcagg

SEQ ID NO: 3495288 - DNA, 12 bp, Homo sapiens
atgccctgtgca

SEQ ID NO: 3495289 - DNA, 15 bp, Homo sapiens
atgcccttaaatcat

SEQ ID NO: 3495290 - DNA, 19 bp, Homo sapiens
atgccgatatactctagat

SEQ ID NO: 3495291 - DNA, 17 bp, Homo sapiens
atgccgcgatgggtcag

SEQ ID NO: 3495292 - DNA, 18 bp, Homo sapiens
atgccgcgatgggtcagg

SEQ ID NO: 3495293 - DNA, 13 bp, Homo sapiens
atgcctcagccct

SEQ ID NO: 3495294 - DNA, 14 bp, Homo sapiens
atgcctggtatttt

SEQ ID NO: 3495295 - DNA, 19 bp, Homo sapiens
atgcctggtggcagctgcg

SEQ ID NO: 3495296 - DNA, 15 bp, Homo sapiens
atgcctgtcctgaaa

SEQ ID NO: 3495297 - DNA, 17 bp, Homo sapiens
atgcctgtcctgaaagc

SEQ ID NO: 3495298 - DNA, 20 bp, Homo sapiens
atgcctgtcctgaaagcggc

SEQ ID NO: 3495299 - DNA, 21 bp, Homo sapiens
atgcctgtcctgaaagcggct

SEQ ID NO: 3495300 - DNA, 18 bp, Homo sapiens
atgccttgaattgtctag

SEQ ID NO: 3495301 - DNA, 21 bp, Homo sapiens
atgcgattcagttcaccgcta

SEQ ID NO: 3495302 - DNA, 14 bp, Homo sapiens
atgcgcagtgcctt

SEQ ID NO: 3495303 - DNA, 14 bp, Homo sapiens
atgcggtagccagc

SEQ ID NO: 3495304 - DNA, 15 bp, Homo sapiens
atgcggtagccagca

SEQ ID NO: 3495305 - DNA, 22 bp, Homo sapiens
atgctatgagaccattcagaat

SEQ ID NO: 3495306 - DNA, 15 bp, Homo sapiens
atgctattgacaata

SEQ ID NO: 3495307 - DNA, 21 bp, Homo sapiens
atgctattgacaataaaatat

SEQ ID NO: 3495308 - DNA, 17 bp, Homo sapiens
atgctcagaccagctct

SEQ ID NO: 3495309 - DNA, 13 bp, Homo sapiens
atgctcatctgct

SEQ ID NO: 3495310 - DNA, 14 bp, Homo sapiens
atgctcctctcttt

SEQ ID NO: 3495311 - DNA, 15 bp, Homo sapiens
atgctccttgggccc

SEQ ID NO: 3495312 - DNA, 15 bp, Homo sapiens
atgctccttgttcct

SEQ ID NO: 3495313 - DNA, 16 bp, Homo sapiens
atgctctagtgccttc

SEQ ID NO: 3495314 - DNA, 21 bp, Homo sapiens
atgctcttgaccttgtagaga

SEQ ID NO: 3495315 - DNA, 22 bp, Homo sapiens
atgctgacattcacctgcccca

SEQ ID NO: 3495316 - DNA, 17 bp, Homo sapiens
atgctgaggcctgggcc

SEQ ID NO: 3495317 - DNA, 13 bp, Homo sapiens
atgctgagggtgt

SEQ ID NO: 3495318 - DNA, 17 bp, Homo sapiens
atgctgagggtgtttct

SEQ ID NO: 3495319 - DNA, 12 bp, Homo sapiens
atgctgccggca

SEQ ID NO: 3495320 - DNA, 18 bp, Homo sapiens
atgctgccggcacagctg

SEQ ID NO: 3495321 - DNA, 12 bp, Homo sapiens
atgctgctggcc

SEQ ID NO: 3495322 - DNA, 13 bp, Homo sapiens
atgctgctggcca

SEQ ID NO: 3495323 - DNA, 19 bp, Homo sapiens
atgctggatgctccttcca

SEQ ID NO: 3495324 - DNA, 12 bp, Homo sapiens
atgctggcccag

SEQ ID NO: 3495325 - DNA, 16 bp, Homo sapiens
atgctggcccagggcc

SEQ ID NO: 3495326 - DNA, 18 bp, Homo sapiens
atgctggcccagggccca

SEQ ID NO: 3495327 - DNA, 22 bp, Homo sapiens
atgctggcccagggcccagagc

SEQ ID NO: 3495328 - DNA, 18 bp, Homo sapiens
atgctggctgttggctgg

SEQ ID NO: 3495329 - DNA, 20 bp, Homo sapiens
attcccaacgtgcaaagcca

SEQ ID NO: 3495330 - DNA, 21 bp, Homo sapiens
attcccaacgtgcaaagccaa

SEQ ID NO: 3495331 - DNA, 18 bp, Homo sapiens
attcccaagctctgctcc

SEQ ID NO: 3495332 - DNA, 19 bp, Homo sapiens
attcccaagctctgctcct

SEQ ID NO: 3495333 - DNA, 14 bp, Homo sapiens
attccccagctcca

SEQ ID NO: 3495334 - DNA, 15 bp, Homo sapiens
attcccccctaagct

SEQ ID NO: 3495335 - DNA, 14 bp, Homo sapiens
attcccctgtgtca

SEQ ID NO: 3495336 - DNA, 17 bp, Homo sapiens
attccctagaaacttcc

SEQ ID NO: 3495337 - DNA, 14 bp, Homo sapiens
attcccttcggcca

SEQ ID NO: 3495338 - DNA, 16 bp, Homo sapiens
attccgtagccagctg

SEQ ID NO: 3495339 - DNA, 22 bp, Homo sapiens
attcctctgggaatgttacatt

SEQ ID NO: 3495340 - DNA, 14 bp, Homo sapiens
attcctctttgctt

SEQ ID NO: 3495341 - DNA, 15 bp, Homo sapiens
attcctctttgcttt

SEQ ID NO: 3495342 - DNA, 16 bp, Homo sapiens
attcctctttgctttg

SEQ ID NO: 3495343 - DNA, 18 bp, Homo sapiens
attcctctttgctttgct

SEQ ID NO: 3495344 - DNA, 18 bp, Homo sapiens
attccttcctgttctgaa

SEQ ID NO: 3495345 - DNA, 18 bp, Homo sapiens
attccttcgaaaggcctt

SEQ ID NO: 3495346 - DNA, 19 bp, Homo sapiens
attccttcgaaaggccttc

SEQ ID NO: 3495347 - DNA, 21 bp, Homo sapiens
attcggaactgtcctttcctt

SEQ ID NO: 3495348 - DNA, 21 bp, Homo sapiens
attcggtatccccccatcttg

SEQ ID NO: 3495349 - DNA, 21 bp, Homo sapiens
attcggtgtgcaccagggttg

SEQ ID NO: 3495350 - DNA, 22 bp, Homo sapiens
attctagaaagtactttggcct

SEQ ID NO: 3495351 - DNA, 20 bp, Homo sapiens
attctagatgcaagtctctt

SEQ ID NO: 3495352 - DNA, 22 bp, Homo sapiens
attctagtactagaaactgaag

SEQ ID NO: 3495353 - DNA, 18 bp, Homo sapiens
attctcagggtctctgct

SEQ ID NO: 3495354 - DNA, 19 bp, Homo sapiens
attctcagggtctctgctg

SEQ ID NO: 3495355 - DNA, 20 bp, Homo sapiens
attctcagggtctctgctgc

SEQ ID NO: 3495356 - DNA, 19 bp, Homo sapiens
attctcatgggaaggggag

SEQ ID NO: 3495357 - DNA, 17 bp, Homo sapiens
attctcatttgtcacac

SEQ ID NO: 3495358 - DNA, 13 bp, Homo sapiens
attctcctgcctc

SEQ ID NO: 3495359 - DNA, 17 bp, Homo sapiens
attctcctgcctcagcc

SEQ ID NO: 3495360 - DNA, 20 bp, Homo sapiens
attctcctgcctcagcctcc

SEQ ID NO: 3495361 - DNA, 15 bp, Homo sapiens
attctcctggatgct

SEQ ID NO: 3495362 - DNA, 15 bp, Homo sapiens
attctccttcagccc

SEQ ID NO: 3495363 - DNA, 18 bp, Homo sapiens
attctccttcagccctca

SEQ ID NO: 3495364 - DNA, 19 bp, Homo sapiens
attctctccaaaaatgcac

SEQ ID NO: 3495365 - DNA, 16 bp, Homo sapiens
attctctgtctcatcc

SEQ ID NO: 3495366 - DNA, 19 bp, Homo sapiens
attctctgtctcatccatc

SEQ ID NO: 3495367 - DNA, 16 bp, Homo sapiens
attctcttgcattgtg

SEQ ID NO: 3495368 - DNA, 15 bp, Homo sapiens
attctgaaggagccc

SEQ ID NO: 3495369 - DNA, 14 bp, Homo sapiens
attctgaatctcaa

SEQ ID NO: 3495370 - DNA, 14 bp, Homo sapiens
attctgaatttgca

SEQ ID NO: 3495371 - DNA, 15 bp, Homo sapiens
attctgaatttgcaa

SEQ ID NO: 3495372 - DNA, 20 bp, Homo sapiens
attctgactcggtttctcca

SEQ ID NO: 3495373 - DNA, 19 bp, Homo sapiens
attctgcaccttgccaggg

SEQ ID NO: 3495374 - DNA, 20 bp, Homo sapiens
attctgcagtaaatctttta

SEQ ID NO: 3495375 - DNA, 22 bp, Homo sapiens
attctgcatttagctgtattca

SEQ ID NO: 3495376 - DNA, 23 bp, Homo sapiens
attctgccaggcccccaagcctg

SEQ ID NO: 3495377 - DNA, 11 bp, Homo sapiens
attctgcctgc

SEQ ID NO: 3495378 - DNA, 13 bp, Homo sapiens
attctgcctgccc

SEQ ID NO: 3495379 - DNA, 16 bp, Homo sapiens
attctgcctgcccagg

SEQ ID NO: 3495380 - DNA, 20 bp, Homo sapiens
attctgcttaaagttgtaac

SEQ ID NO: 3495381 - DNA, 18 bp, Homo sapiens
attctggacagtcagctc

SEQ ID NO: 3495382 - DNA, 15 bp, Homo sapiens
attctgtcttgttca

SEQ ID NO: 3495383 - DNA, 21 bp, Homo sapiens
attctgtcttgttcattttga

SEQ ID NO: 3495384 - DNA, 23 bp, Homo sapiens
attctgtcttgttcattttgagt

SEQ ID NO: 3495385 - DNA, 16 bp, Homo sapiens
attcttaacaaactct

SEQ ID NO: 3495386 - DNA, 17 bp, Homo sapiens
attcttaacaaactctt

SEQ ID NO: 3495387 - DNA, 21 bp, Homo sapiens
attcttaagacttgcatttaa

SEQ ID NO: 3495388 - DNA, 23 bp, Homo sapiens
attcttagatacactaaaaatct

SEQ ID NO: 3495389 - DNA, 13 bp, Homo sapiens
attcttaggcaga

SEQ ID NO: 3495390 - DNA, 22 bp, Homo sapiens
attcttcccttttaaacacatt

SEQ ID NO: 3495391 - DNA, 12 bp, Homo sapiens
attcttctgctt

SEQ ID NO: 3495392 - DNA, 19 bp, Homo sapiens
attcttgatttatttgctt

SEQ ID NO: 3495393 - DNA, 22 bp, Homo sapiens
attcttgatttatttgcttctt

SEQ ID NO: 3495394 - DNA, 17 bp, Homo sapiens
attcttgccaaatataa

SEQ ID NO: 3495395 - DNA, 18 bp, Homo sapiens
attctttaaatatatatt

SEQ ID NO: 3495396 - DNA, 18 bp, Homo sapiens
attctttactattaaaat

SEQ ID NO: 3495397 - DNA, 20 bp, Homo sapiens
attctttcaattctgtaggt

SEQ ID NO: 3495398 - DNA, 21 bp, Homo sapiens
attctttcccaattcacatct

SEQ ID NO: 3495399 - DNA, 13 bp, Homo sapiens
attcttttaaaag

SEQ ID NO: 3495400 - DNA, 19 bp, Homo sapiens
attcttttccaaaataaaa

SEQ ID NO: 3495401 - DNA, 15 bp, Homo sapiens
attcttttgaattgt

SEQ ID NO: 3495402 - DNA, 18 bp, Homo sapiens
attgaaaggcattctctg

SEQ ID NO: 3495403 - DNA, 17 bp, Homo sapiens
attgaacacaaactgta

SEQ ID NO: 3495404 - DNA, 18 bp, Homo sapiens
attgaacacaaactgtaa

SEQ ID NO: 3495405 - DNA, 19 bp, Homo sapiens
attgaacttactgtagcct

SEQ ID NO: 3495406 - DNA, 16 bp, Homo sapiens
attgaacttgaaatct

SEQ ID NO: 3495407 - DNA, 15 bp, Homo sapiens
attgaatacttacat

SEQ ID NO: 3495408 - DNA, 16 bp, Homo sapiens
attgaatacttacatt

SEQ ID NO: 3495409 - DNA, 14 bp, Homo sapiens
attgaatctattta

SEQ ID NO: 3495410 - DNA, 18 bp, Homo sapiens
attgaatctatttaagta

SEQ ID NO: 3495411 - DNA, 20 bp, Homo sapiens
attgaattcttggttgagga

SEQ ID NO: 3495412 - DNA, 23 bp, Homo sapiens
attgaatttttcctatgctattg

SEQ ID NO: 3495413 - DNA, 17 bp, Homo sapiens
attgacaataaaatatt

SEQ ID NO: 3495414 - DNA, 18 bp, Homo sapiens
attgacaataaaatatta

SEQ ID NO: 3495415 - DNA, 17 bp, Homo sapiens
attgacaataatttcag

SEQ ID NO: 3495416 - DNA, 12 bp, Homo sapiens
attgacacagaa

SEQ ID NO: 3495417 - DNA, 19 bp, Homo sapiens
attgacagctttgctgctg

SEQ ID NO: 3495418 - DNA, 15 bp, Homo sapiens
attgactctgggtcc

SEQ ID NO: 3495419 - DNA, 23 bp, Homo sapiens
attgactctgggtccttcctgaa

SEQ ID NO: 3495420 - DNA, 17 bp, Homo sapiens
attgagaaagagcactt

SEQ ID NO: 3495421 - DNA, 18 bp, Homo sapiens
attgagaaagagcactta

SEQ ID NO: 3495422 - DNA, 22 bp, Homo sapiens
attgagattgtcctcatttctc

SEQ ID NO: 3495423 - DNA, 15 bp, Homo sapiens
attgaggataaattg

SEQ ID NO: 3495424 - DNA, 20 bp, Homo sapiens
attgaggataaattgccata

SEQ ID NO: 3495425 - DNA, 21 bp, Homo sapiens
attgaggataaattgccataa

SEQ ID NO: 3495426 - DNA, 23 bp, Homo sapiens
attgaggataaattgccataata

SEQ ID NO: 3495427 - DNA, 16 bp, Homo sapiens
attgagggtcattctt

SEQ ID NO: 3495428 - DNA, 23 bp, Homo sapiens
attgaggtgtatggagagaaaac

SEQ ID NO: 3495429 - DNA, 15 bp, Homo sapiens
attgagtcaaatggt

SEQ ID NO: 3495430 - DNA, 16 bp, Homo sapiens
attgagttttcagtgg

SEQ ID NO: 3495431 - DNA, 16 bp, Homo sapiens
attgataagagggcac

SEQ ID NO: 3495432 - DNA, 23 bp, Homo sapiens
attgataagagggcacacactgt

SEQ ID NO: 3495433 - DNA, 22 bp, Homo sapiens
attgatcctgcaaaatctgttg

SEQ ID NO: 3495434 - DNA, 16 bp, Homo sapiens
attgatttgaagaaca

SEQ ID NO: 3495435 - DNA, 20 bp, Homo sapiens
attgatttgcattgaacaca

SEQ ID NO: 3495436 - DNA, 12 bp, Homo sapiens
attgcaaatctt

SEQ ID NO: 3495437 - DNA, 16 bp, Homo sapiens
attgcaaatcttgaaa

SEQ ID NO: 3495438 - DNA, 16 bp, Homo sapiens
attgcaacaggctggg

SEQ ID NO: 3495439 - DNA, 19 bp, Homo sapiens
attgcacaactctactgtt

SEQ ID NO: 3495440 - DNA, 16 bp, Homo sapiens
attgcacatgtcttaa

SEQ ID NO: 3495441 - DNA, 21 bp, Homo sapiens
attgcacatgtcttaatgaag

SEQ ID NO: 3495442 - DNA, 13 bp, Homo sapiens
attgcacattgtt

SEQ ID NO: 3495443 - DNA, 14 bp, Homo sapiens
attgcagacctgtc

SEQ ID NO: 3495444 - DNA, 15 bp, Homo sapiens
attgcatctgtataa

SEQ ID NO: 3495445 - DNA, 15 bp, Homo sapiens
attgcatgtgactct

SEQ ID NO: 3495446 - DNA, 17 bp, Homo sapiens
attgcatgtgactctga

SEQ ID NO: 3495447 - DNA, 18 bp, Homo sapiens
attgcatgtgactctgaa

SEQ ID NO: 3495448 - DNA, 18 bp, Homo sapiens
attgcatttctgtatttt

SEQ ID NO: 3495449 - DNA, 16 bp, Homo sapiens
attgccaaaaaggata

SEQ ID NO: 3495450 - DNA, 19 bp, Homo sapiens
attgccataatatgatgca

SEQ ID NO: 3495451 - DNA, 22 bp, Homo sapiens
attgccataatatgatgcaaac

SEQ ID NO: 3495452 - DNA, 18 bp, Homo sapiens
attgccatattgcacatg

SEQ ID NO: 3495453 - DNA, 17 bp, Homo sapiens
attgcccacgctggagt

SEQ ID NO: 3495454 - DNA, 21 bp, Homo sapiens
attgcccacgctggagtgcag

SEQ ID NO: 3495455 - DNA, 14 bp, Homo sapiens
attgcccaggctgg

SEQ ID NO: 3495456 - DNA, 20 bp, Homo sapiens
attgcccaggctggtcttga

SEQ ID NO: 3495457 - DNA, 15 bp, Homo sapiens
attgcccagtctttc

SEQ ID NO: 3495458 - DNA, 18 bp, Homo sapiens
attgccttctcaccagct

SEQ ID NO: 3495459 - DNA, 19 bp, Homo sapiens
attgccttctcaccagctg

SEQ ID NO: 3495460 - DNA, 18 bp, Homo sapiens
atttttttaaccaaaggt

SEQ ID NO: 3495461 - DNA, 15 bp, Homo sapiens
atttttttctgcaca

SEQ ID NO: 3495462 - DNA, 18 bp, Homo sapiens
atttttttctgcacagct

SEQ ID NO: 3495463 - DNA, 15 bp, Homo sapiens
atttttttcttgtag

SEQ ID NO: 3495464 - DNA, 17 bp, Homo sapiens
attttttttaatgctta

SEQ ID NO: 3495465 - DNA, 15 bp, Homo sapiens
attttttttcatgtt

SEQ ID NO: 3495466 - DNA, 15 bp, Homo sapiens
caaaaaaagccttta

SEQ ID NO: 3495467 - DNA, 15 bp, Homo sapiens
caaaaacatgtatgt

SEQ ID NO: 3495468 - DNA, 22 bp, Homo sapiens
caaaaacatgtatgtgcatttc

SEQ ID NO: 3495469 - DNA, 15 bp, Homo sapiens
caaaaagtattatca

SEQ ID NO: 3495470 - DNA, 12 bp, Homo sapiens
caaaaataaatt

SEQ ID NO: 3495471 - DNA, 17 bp, Homo sapiens
caaaaattttgtgacat

SEQ ID NO: 3495472 - DNA, 16 bp, Homo sapiens
caaaacaaaacaacat

SEQ ID NO: 3495473 - DNA, 16 bp, Homo sapiens
caaaacaagcctggta

SEQ ID NO: 3495474 - DNA, 14 bp, Homo sapiens
caaaaccatgcctg

SEQ ID NO: 3495475 - DNA, 22 bp, Homo sapiens
caaaaccatgcctggtattttc

SEQ ID NO: 3495476 - DNA, 23 bp, Homo sapiens
caaaaccatgcctggtattttca

SEQ ID NO: 3495477 - DNA, 13 bp, Homo sapiens
caaaacccagacc

SEQ ID NO: 3495478 - DNA, 21 bp, Homo sapiens
caaaacctcatgacagccaga

SEQ ID NO: 3495479 - DNA, 21 bp, Homo sapiens
caaaactcatttcctatgtaa

SEQ ID NO: 3495480 - DNA, 15 bp, Homo sapiens
caaaactgcatttca

SEQ ID NO: 3495481 - DNA, 22 bp, Homo sapiens
caaaactgcctcaggaggcagg

SEQ ID NO: 3495482 - DNA, 16 bp, Homo sapiens
caaaagaacttacccc

SEQ ID NO: 3495483 - DNA, 22 bp, Homo sapiens
caaaagcgcttttccttggcat

SEQ ID NO: 3495484 - DNA, 12 bp, Homo sapiens
caaaagctgctc

SEQ ID NO: 3495485 - DNA, 14 bp, Homo sapiens
caaaagctgctcag

SEQ ID NO: 3495486 - DNA, 19 bp, Homo sapiens
caaaagctgggcaggttgg

SEQ ID NO: 3495487 - DNA, 21 bp, Homo sapiens
caaaaggataatgaatacttt

SEQ ID NO: 3495488 - DNA, 20 bp, Homo sapiens
caaaaggatctttgtggcca

SEQ ID NO: 3495489 - DNA, 19 bp, Homo sapiens
caaaaggttcactaaagca

SEQ ID NO: 3495490 - DNA, 14 bp, Homo sapiens
caaaagtttctctt

SEQ ID NO: 3495491 - DNA, 11 bp, Homo sapiens
caaaataaaaa

SEQ ID NO: 3495492 - DNA, 14 bp, Homo sapiens
caaaataaaacaaa

SEQ ID NO: 3495493 - DNA, 15 bp, Homo sapiens
caaaataaaacaaag

SEQ ID NO: 3495494 - DNA, 17 bp, Homo sapiens
caaaataaaacaaaggg

SEQ ID NO: 3495495 - DNA, 18 bp, Homo sapiens
caaaataaagctgttctc

SEQ ID NO: 3495496 - DNA, 16 bp, Homo sapiens
caaaatactccaaaga

SEQ ID NO: 3495497 - DNA, 17 bp, Homo sapiens
caaaatagaaaagttat

SEQ ID NO: 3495498 - DNA, 17 bp, Homo sapiens
caaaatcaagcaagcct

SEQ ID NO: 3495499 - DNA, 19 bp, Homo sapiens
caaaatcaagcaagcctct

SEQ ID NO: 3495500 - DNA, 16 bp, Homo sapiens
caaaatcattttaatg

SEQ ID NO: 3495501 - DNA, 17 bp, Homo sapiens
caaaatctgttctaaca

SEQ ID NO: 3495502 - DNA, 20 bp, Homo sapiens
caaaatgaggaatgtatatg

SEQ ID NO: 3495503 - DNA, 18 bp, Homo sapiens
caaaatgctctagtgcct

SEQ ID NO: 3495504 - DNA, 23 bp, Homo sapiens
caaaatgctttttatttctgcat

SEQ ID NO: 3495505 - DNA, 16 bp, Homo sapiens
caaaatggatacataa

SEQ ID NO: 3495506 - DNA, 18 bp, Homo sapiens
caaaatgtagaatattca

SEQ ID NO: 3495507 - DNA, 14 bp, Homo sapiens
caaaatgtgtattt

SEQ ID NO: 3495508 - DNA, 22 bp, Homo sapiens
caaaattagggagctcttgaca

SEQ ID NO: 3495509 - DNA, 18 bp, Homo sapiens
caaaattcatttctaatt

SEQ ID NO: 3495510 - DNA, 15 bp, Homo sapiens
caaaattgctgcacc

SEQ ID NO: 3495511 - DNA, 23 bp, Homo sapiens
caaaattgggaaaggagtagaaa

SEQ ID NO: 3495512 - DNA, 14 bp, Homo sapiens
caaaattgtgaagc

SEQ ID NO: 3495513 - DNA, 22 bp, Homo sapiens
caaaatttattttataagaaaa

SEQ ID NO: 3495514 - DNA, 13 bp, Homo sapiens
caaaatttgacta

SEQ ID NO: 3495515 - DNA, 13 bp, Homo sapiens
caaaattttattc

SEQ ID NO: 3495516 - DNA, 14 bp, Homo sapiens
caaaattttattcc

SEQ ID NO: 3495517 - DNA, 20 bp, Homo sapiens
caaaattttgtcccatctct

SEQ ID NO: 3495518 - DNA, 16 bp, Homo sapiens
caaacaaagccagaag

SEQ ID NO: 3495519 - DNA, 17 bp, Homo sapiens
caaacaaatatgcaaaa

SEQ ID NO: 3495520 - DNA, 16 bp, Homo sapiens
caaacacacacaaaag

SEQ ID NO: 3495521 - DNA, 20 bp, Homo sapiens
caaacagccaactagcccct

SEQ ID NO: 3495522 - DNA, 21 bp, Homo sapiens
caaacatatatatactattaa

SEQ ID NO: 3495523 - DNA, 15 bp, Homo sapiens
caaaccacactggac

SEQ ID NO: 3495524 - DNA, 14 bp, Homo sapiens
caaaccacagcagg

SEQ ID NO: 3495525 - DNA, 15 bp, Homo sapiens
caaaccacagcagga

SEQ ID NO: 3495526 - DNA, 17 bp, Homo sapiens
caaaccactttttgcag

SEQ ID NO: 3495527 - DNA, 20 bp, Homo sapiens
caaaccactttttgcagctt

SEQ ID NO: 3495528 - DNA, 14 bp, Homo sapiens
caaaccagcttcat

SEQ ID NO: 3495529 - DNA, 16 bp, Homo sapiens
caaacccagtctcctc

SEQ ID NO: 3495530 - DNA, 15 bp, Homo sapiens
caaacctctgttcag

SEQ ID NO: 3495531 - DNA, 12 bp, Homo sapiens
caaacgctgcct

SEQ ID NO: 3495532 - DNA, 18 bp, Homo sapiens
caaacgctgcctgcccac

SEQ ID NO: 3495533 - DNA, 14 bp, Homo sapiens
caaacgggagcttt

SEQ ID NO: 3495534 - DNA, 18 bp, Homo sapiens
caaactaaggtgctaaat

SEQ ID NO: 3495535 - DNA, 13 bp, Homo sapiens
caaactagggcca

SEQ ID NO: 3495536 - DNA, 12 bp, Homo sapiens
caaactcttcag

SEQ ID NO: 3495537 - DNA, 13 bp, Homo sapiens
caaactcttcagt

SEQ ID NO: 3495538 - DNA, 19 bp, Homo sapiens
caaactcttgacctcaggt

SEQ ID NO: 3495539 - DNA, 20 bp, Homo sapiens
caaactcttgacctcaggtg

SEQ ID NO: 3495540 - DNA, 17 bp, Homo sapiens
caaactgaagcagcctc

SEQ ID NO: 3495541 - DNA, 15 bp, Homo sapiens
caaactggggcctcc

SEQ ID NO: 3495542 - DNA, 16 bp, Homo sapiens
caaactggggcctcca

SEQ ID NO: 3495543 - DNA, 19 bp, Homo sapiens
caaactggggcctccagaa

SEQ ID NO: 3495544 - DNA, 19 bp, Homo sapiens
caaactggtattctgttct

SEQ ID NO: 3495545 - DNA, 20 bp, Homo sapiens
caaactgtaaataaaaagaa

SEQ ID NO: 3495546 - DNA, 13 bp, Homo sapiens
caaagaaaagtat

SEQ ID NO: 3495547 - DNA, 13 bp, Homo sapiens
caaagaaaattcc

SEQ ID NO: 3495548 - DNA, 19 bp, Homo sapiens
caaagaaaattcctataag

SEQ ID NO: 3495549 - DNA, 14 bp, Homo sapiens
caaagaagacaaca

SEQ ID NO: 3495550 - DNA, 13 bp, Homo sapiens
caaagaagtcatg

SEQ ID NO: 3495551 - DNA, 23 bp, Homo sapiens
caaagaatccctagactttaggc

SEQ ID NO: 3495552 - DNA, 21 bp, Homo sapiens
caaagacaaattctgtttctt

SEQ ID NO: 3495553 - DNA, 17 bp, Homo sapiens
caaagactgtgaacagc

SEQ ID NO: 3495554 - DNA, 21 bp, Homo sapiens
caaagactgtgaacagcttgc

SEQ ID NO: 3495555 - DNA, 22 bp, Homo sapiens
caaagactgtgaacagcttgct

SEQ ID NO: 3495556 - DNA, 17 bp, Homo sapiens
caaagagcctttccaaa

SEQ ID NO: 3495557 - DNA, 20 bp, Homo sapiens
caaagaggcaagaggctgga

SEQ ID NO: 3495558 - DNA, 22 bp, Homo sapiens
caaagaggctgaggctggcaca

SEQ ID NO: 3495559 - DNA, 23 bp, Homo sapiens
caaagagggtgagggccttctta

SEQ ID NO: 3495560 - DNA, 19 bp, Homo sapiens
caaagatgaccataaccac

SEQ ID NO: 3495561 - DNA, 22 bp, Homo sapiens
caaagatgacttcccctgcctc

SEQ ID NO: 3495562 - DNA, 22 bp, Homo sapiens
caaagatgacttgaaatgaggc

SEQ ID NO: 3495563 - DNA, 21 bp, Homo sapiens
caaagatgggtgaaggctggc

SEQ ID NO: 3495564 - DNA, 22 bp, Homo sapiens
caaagatgggtgaaggctggca

SEQ ID NO: 3495565 - DNA, 15 bp, Homo sapiens
caaagcaaaaccaga

SEQ ID NO: 3495566 - DNA, 15 bp, Homo sapiens
caaagcagacagctc

SEQ ID NO: 3495567 - DNA, 16 bp, Homo sapiens
caaagcagacagctcc

SEQ ID NO: 3495568 - DNA, 21 bp, Homo sapiens
caaagcaggggagtatgcaaa

SEQ ID NO: 3495569 - DNA, 16 bp, Homo sapiens
caaagccaagacctca

SEQ ID NO: 3495570 - DNA, 15 bp, Homo sapiens
caaagccaaggcagc

SEQ ID NO: 3495571 - DNA, 22 bp, Homo sapiens
caaagccaaggcagcgacccca

SEQ ID NO: 3495572 - DNA, 23 bp, Homo sapiens
caaagccaaggcagcgaccccag

SEQ ID NO: 3495573 - DNA, 13 bp, Homo sapiens
caaagccagaagc

SEQ ID NO: 3495574 - DNA, 14 bp, Homo sapiens
caaagccagaagct

SEQ ID NO: 3495575 - DNA, 16 bp, Homo sapiens
caaagccagaagctga

SEQ ID NO: 3495576 - DNA, 18 bp, Homo sapiens
caaagccagaagctgagc

SEQ ID NO: 3495577 - DNA, 20 bp, Homo sapiens
caaagccagcgtcctcctct

SEQ ID NO: 3495578 - DNA, 13 bp, Homo sapiens
caaagctaggcct

SEQ ID NO: 3495579 - DNA, 21 bp, Homo sapiens
caaagctcaagatgacagctc

SEQ ID NO: 3495580 - DNA, 23 bp, Homo sapiens
caaagctcaagatgacagctctt

SEQ ID NO: 3495581 - DNA, 23 bp, Homo sapiens
caaagctttatttcaaatctctt

SEQ ID NO: 3495582 - DNA, 23 bp, Homo sapiens
caaaggaaagagcagtctatcat

SEQ ID NO: 3495583 - DNA, 19 bp, Homo sapiens
caaaggaagtctaaatatt

SEQ ID NO: 3495584 - DNA, 19 bp, Homo sapiens
caaaggagctcgaaggata

SEQ ID NO: 3495585 - DNA, 11 bp, Homo sapiens
caaaggctggg

SEQ ID NO: 3495586 - DNA, 12 bp, Homo sapiens
caaaggctggga

SEQ ID NO: 3495587 - DNA, 15 bp, Homo sapiens
caaaggctggtggca

SEQ ID NO: 3495588 - DNA, 13 bp, Homo sapiens
caaaggggacagc

SEQ ID NO: 3495589 - DNA, 18 bp, Homo sapiens
caaagggtatcaggtgct

SEQ ID NO: 3495590 - DNA, 21 bp, Homo sapiens
caaagggtatcaggtgctgcc

SEQ ID NO: 3495591 - DNA, 23 bp, Homo sapiens
caaagggtatcaggtgctgccat

SEQ ID NO: 3495592 - DNA, 20 bp, Homo sapiens
cacaggccccccgcagcacc

SEQ ID NO: 3495593 - DNA, 15 bp, Homo sapiens
cacaggcctgagatt

SEQ ID NO: 3495594 - DNA, 20 bp, Homo sapiens
cacaggcctgagatttcatc

SEQ ID NO: 3495595 - DNA, 22 bp, Homo sapiens
cacaggcctgagatttcatctg

SEQ ID NO: 3495596 - DNA, 16 bp, Homo sapiens
cacagggacttgaagt

SEQ ID NO: 3495597 - DNA, 16 bp, Homo sapiens
cacagggtctgcctcc

SEQ ID NO: 3495598 - DNA, 17 bp, Homo sapiens
cacagggtctgcctcca

SEQ ID NO: 3495599 - DNA, 21 bp, Homo sapiens
cacagggtctgcctccagcca

SEQ ID NO: 3495600 - DNA, 18 bp, Homo sapiens
cacaggtgggcttcccag

SEQ ID NO: 3495601 - DNA, 14 bp, Homo sapiens
cacaggtgtcagcc

SEQ ID NO: 3495602 - DNA, 16 bp, Homo sapiens
cacagtagtcttgatg

SEQ ID NO: 3495603 - DNA, 15 bp, Homo sapiens
cacagtgaagtgctg

SEQ ID NO: 3495604 - DNA, 20 bp, Homo sapiens
cacagtgagtcgaggacagg

SEQ ID NO: 3495605 - DNA, 22 bp, Homo sapiens
cacagtggaaagacagcttctc

SEQ ID NO: 3495606 - DNA, 19 bp, Homo sapiens
cacagtgggatgaaccagc

SEQ ID NO: 3495607 - DNA, 19 bp, Homo sapiens
cacagtgttgcccaggctg

SEQ ID NO: 3495608 - DNA, 16 bp, Homo sapiens
cacagtgttggaggtt

SEQ ID NO: 3495609 - DNA, 17 bp, Homo sapiens
cacagtgtttcttattc

SEQ ID NO: 3495610 - DNA, 23 bp, Homo sapiens
cacagttcaaaattctaaatgta

SEQ ID NO: 3495611 - DNA, 21 bp, Homo sapiens
cacagttctttgggccagaca

SEQ ID NO: 3495612 - DNA, 23 bp, Homo sapiens
cacagttctttgggccagacatg

SEQ ID NO: 3495613 - DNA, 15 bp, Homo sapiens
cacagttgaccctat

SEQ ID NO: 3495614 - DNA, 20 bp, Homo sapiens
cacagttgaccctatttttt

SEQ ID NO: 3495615 - DNA, 21 bp, Homo sapiens
cacagttggtggggtcctgcc

SEQ ID NO: 3495616 - DNA, 19 bp, Homo sapiens
cacataccctcttcatgga

SEQ ID NO: 3495617 - DNA, 20 bp, Homo sapiens
cacatagtttttcagtctat

SEQ ID NO: 3495618 - DNA, 15 bp, Homo sapiens
cacatcgttttgggg

SEQ ID NO: 3495619 - DNA, 14 bp, Homo sapiens
cacatctaagcctg

SEQ ID NO: 3495620 - DNA, 11 bp, Homo sapiens
cacatctctgc

SEQ ID NO: 3495621 - DNA, 18 bp, Homo sapiens
cacatctgtgtcttgttt

SEQ ID NO: 3495622 - DNA, 21 bp, Homo sapiens
cacatcttgctctgctgacag

SEQ ID NO: 3495623 - DNA, 22 bp, Homo sapiens
cacatcttgctctgctgacaga

SEQ ID NO: 3495624 - DNA, 13 bp, Homo sapiens
cacatcttggcac

SEQ ID NO: 3495625 - DNA, 16 bp, Homo sapiens
cacatgagaagtgata

SEQ ID NO: 3495626 - DNA, 13 bp, Homo sapiens
cacatgctatgtt

SEQ ID NO: 3495627 - DNA, 13 bp, Homo sapiens
cacatgtcttaat

SEQ ID NO: 3495628 - DNA, 22 bp, Homo sapiens
cacatgtcttaatgaagtttga

SEQ ID NO: 3495629 - DNA, 17 bp, Homo sapiens
cacatgtgcacatgcac

SEQ ID NO: 3495630 - DNA, 17 bp, Homo sapiens
cacatgtggccatggcc

SEQ ID NO: 3495631 - DNA, 15 bp, Homo sapiens
cacatgttggaggag

SEQ ID NO: 3495632 - DNA, 15 bp, Homo sapiens
cacatgtttcctcta

SEQ ID NO: 3495633 - DNA, 19 bp, Homo sapiens
cacattaatatttgctgac

SEQ ID NO: 3495634 - DNA, 18 bp, Homo sapiens
cacattccttgcctgcac

SEQ ID NO: 3495635 - DNA, 12 bp, Homo sapiens
cacattcctttg

SEQ ID NO: 3495636 - DNA, 19 bp, Homo sapiens
cacatttaagagacagtca

SEQ ID NO: 3495637 - DNA, 16 bp, Homo sapiens
cacatttggaatactt

SEQ ID NO: 3495638 - DNA, 19 bp, Homo sapiens
cacatttggaatacttttt

SEQ ID NO: 3495639 - DNA, 15 bp, Homo sapiens
caccaacttacaaaa

SEQ ID NO: 3495640 - DNA, 15 bp, Homo sapiens
caccaagaaagcagg

SEQ ID NO: 3495641 - DNA, 18 bp, Homo sapiens
caccaagcacagcagcct

SEQ ID NO: 3495642 - DNA, 13 bp, Homo sapiens
caccaagcccagt

SEQ ID NO: 3495643 - DNA, 13 bp, Homo sapiens
caccaagctcaaa

SEQ ID NO: 3495644 - DNA, 16 bp, Homo sapiens
caccaagctcaaagcg

SEQ ID NO: 3495645 - DNA, 11 bp, Homo sapiens
caccaaggaaa

SEQ ID NO: 3495646 - DNA, 13 bp, Homo sapiens
caccacagccagc

SEQ ID NO: 3495647 - DNA, 19 bp, Homo sapiens
caccacagccagcacctgg

SEQ ID NO: 3495648 - DNA, 16 bp, Homo sapiens
caccaccccaacaaac

SEQ ID NO: 3495649 - DNA, 13 bp, Homo sapiens
caccaccctgtct

SEQ ID NO: 3495650 - DNA, 15 bp, Homo sapiens
caccaccctgtcttc

SEQ ID NO: 3495651 - DNA, 13 bp, Homo sapiens
caccacgcctggc

SEQ ID NO: 3495652 - DNA, 13 bp, Homo sapiens
caccactataaaa

SEQ ID NO: 3495653 - DNA, 15 bp, Homo sapiens
caccagacacccagg

SEQ ID NO: 3495654 - DNA, 17 bp, Homo sapiens
caccagacacccaggac

SEQ ID NO: 3495655 - DNA, 15 bp, Homo sapiens
caccagagcccacct

SEQ ID NO: 3495656 - DNA, 21 bp, Homo sapiens
caccagcccttagcagggaaa

SEQ ID NO: 3495657 - DNA, 20 bp, Homo sapiens
caccagcctaagaagctctg

SEQ ID NO: 3495658 - DNA, 10 bp, Homo sapiens
caccagctgc

SEQ ID NO: 3495659 - DNA, 17 bp, Homo sapiens
caccagctgcaaagtgt

SEQ ID NO: 3495660 - DNA, 15 bp, Homo sapiens
caccaggccacctcc

SEQ ID NO: 3495661 - DNA, 22 bp, Homo sapiens
caccaggccacctccccagcat

SEQ ID NO: 3495662 - DNA, 15 bp, Homo sapiens
caccaggggtttctc

SEQ ID NO: 3495663 - DNA, 23 bp, Homo sapiens
caccagggttgaccccagaggat

SEQ ID NO: 3495664 - DNA, 22 bp, Homo sapiens
caccaggtgcctttcaaattta

SEQ ID NO: 3495665 - DNA, 14 bp, Homo sapiens
caccagtccctgtc

SEQ ID NO: 3495666 - DNA, 14 bp, Homo sapiens
caccatatgaattg

SEQ ID NO: 3495667 - DNA, 15 bp, Homo sapiens
caccatatgaattgt

SEQ ID NO: 3495668 - DNA, 20 bp, Homo sapiens
caccatatgaattgtacaga

SEQ ID NO: 3495669 - DNA, 15 bp, Homo sapiens
caccatccctttttg

SEQ ID NO: 3495670 - DNA, 18 bp, Homo sapiens
caccatgatggggcccta

SEQ ID NO: 3495671 - DNA, 12 bp, Homo sapiens
caccatggccag

SEQ ID NO: 3495672 - DNA, 15 bp, Homo sapiens
caccattctgcattt

SEQ ID NO: 3495673 - DNA, 16 bp, Homo sapiens
caccattctgcattta

SEQ ID NO: 3495674 - DNA, 17 bp, Homo sapiens
caccatttggcaatgcc

SEQ ID NO: 3495675 - DNA, 20 bp, Homo sapiens
caccattttaagtccctgtc

SEQ ID NO: 3495676 - DNA, 16 bp, Homo sapiens
cacccaagagggctgc

SEQ ID NO: 3495677 - DNA, 21 bp, Homo sapiens
cacccaagtatacaataaagt

SEQ ID NO: 3495678 - DNA, 17 bp, Homo sapiens
cacccaattccactctg

SEQ ID NO: 3495679 - DNA, 12 bp, Homo sapiens
cacccacctcag

SEQ ID NO: 3495680 - DNA, 17 bp, Homo sapiens
cacccacctcagcctcc

SEQ ID NO: 3495681 - DNA, 13 bp, Homo sapiens
cacccactcagct

SEQ ID NO: 3495682 - DNA, 14 bp, Homo sapiens
cacccagctcagca

SEQ ID NO: 3495683 - DNA, 23 bp, Homo sapiens
cacccaggagccccgaggccttc

SEQ ID NO: 3495684 - DNA, 21 bp, Homo sapiens
cacccaggcctatgttgatcc

SEQ ID NO: 3495685 - DNA, 18 bp, Homo sapiens
cacccataataaaggttg

SEQ ID NO: 3495686 - DNA, 20 bp, Homo sapiens
caccccaggaaaagcacaag

SEQ ID NO: 3495687 - DNA, 12 bp, Homo sapiens
caccccaggccc

SEQ ID NO: 3495688 - DNA, 15 bp, Homo sapiens
caccccagggcctga

SEQ ID NO: 3495689 - DNA, 16 bp, Homo sapiens
caccccagggcctgag

SEQ ID NO: 3495690 - DNA, 17 bp, Homo sapiens
caccccagggcctgagc

SEQ ID NO: 3495691 - DNA, 21 bp, Homo sapiens
caccccatcccacaccctgga

SEQ ID NO: 3495692 - DNA, 12 bp, Homo sapiens
cacccccagttc

SEQ ID NO: 3495693 - DNA, 17 bp, Homo sapiens
cacccccatctctccct

SEQ ID NO: 3495694 - DNA, 13 bp, Homo sapiens
cacccccctgggc

SEQ ID NO: 3495695 - DNA, 18 bp, Homo sapiens
cacccctcagttgtgcag

SEQ ID NO: 3495696 - DNA, 22 bp, Homo sapiens
cacccctccagaacacggctca

SEQ ID NO: 3495697 - DNA, 18 bp, Homo sapiens
cacccctccctttctccc

SEQ ID NO: 3495698 - DNA, 19 bp, Homo sapiens
cacccctggaagagcccag

SEQ ID NO: 3495699 - DNA, 18 bp, Homo sapiens
cacccctggttctcatct

SEQ ID NO: 3495700 - DNA, 12 bp, Homo sapiens
caccccttagat

SEQ ID NO: 3495701 - DNA, 13 bp, Homo sapiens
cacccggcccctg

SEQ ID NO: 3495702 - DNA, 14 bp, Homo sapiens
cacccggcccctgc

SEQ ID NO: 3495703 - DNA, 16 bp, Homo sapiens
cacccggcccctgctg

SEQ ID NO: 3495704 - DNA, 17 bp, Homo sapiens
cacccggcccctgctgg

SEQ ID NO: 3495705 - DNA, 18 bp, Homo sapiens
cacccggcccctgctggt

SEQ ID NO: 3495706 - DNA, 22 bp, Homo sapiens
caccctgatttaggagaagcca

SEQ ID NO: 3495707 - DNA, 15 bp, Homo sapiens
caccctgcagagcac

SEQ ID NO: 3495708 - DNA, 17 bp, Homo sapiens
caccctgcagagcacac

SEQ ID NO: 3495709 - DNA, 15 bp, Homo sapiens
caccctggtgggcca

SEQ ID NO: 3495710 - DNA, 14 bp, Homo sapiens
cacccttcccctcc

SEQ ID NO: 3495711 - DNA, 23 bp, Homo sapiens
cacccttcccctccttctccctt

SEQ ID NO: 3495712 - DNA, 17 bp, Homo sapiens
cacccttttccagctgg

SEQ ID NO: 3495713 - DNA, 22 bp, Homo sapiens
caccggatcctgggtggtctgc

SEQ ID NO: 3495714 - DNA, 15 bp, Homo sapiens
caccgggcactcaga

SEQ ID NO: 3495715 - DNA, 22 bp, Homo sapiens
caccgggcactcagaagacact

SEQ ID NO: 3495716 - DNA, 18 bp, Homo sapiens
caccgggccacagagaaa

SEQ ID NO: 3495717 - DNA, 14 bp, Homo sapiens
caccgtactgtgga

SEQ ID NO: 3495718 - DNA, 15 bp, Homo sapiens
caccgtgggcaggga

SEQ ID NO: 3495719 - DNA, 20 bp, Homo sapiens
cacctaatccaggcagatcc

SEQ ID NO: 3495720 - DNA, 21 bp, Homo sapiens
cacctaatccaggcagatcca

SEQ ID NO: 3495721 - DNA, 19 bp, Homo sapiens
cacctacatccccaggtct

SEQ ID NO: 3495722 - DNA, 18 bp, Homo sapiens
cacctacatgttattcta

SEQ ID NO: 3495723 - DNA, 23 bp, Homo sapiens
cacctagagcttttttataacaa

SEQ ID NO: 3495724 - DNA, 12 bp, Homo sapiens
cacctagccagc

SEQ ID NO: 3495725 - DNA, 13 bp, Homo sapiens
cagccatcaaaat

SEQ ID NO: 3495726 - DNA, 23 bp, Homo sapiens
cagccatctcatgaggggagagg

SEQ ID NO: 3495727 - DNA, 15 bp, Homo sapiens
cagccattgcaccca

SEQ ID NO: 3495728 - DNA, 22 bp, Homo sapiens
cagcccagattcccctgtgtca

SEQ ID NO: 3495729 - DNA, 12 bp, Homo sapiens
cagccccagcct

SEQ ID NO: 3495730 - DNA, 13 bp, Homo sapiens
cagccccagcctg

SEQ ID NO: 3495731 - DNA, 14 bp, Homo sapiens
cagccccagcctgc

SEQ ID NO: 3495732 - DNA, 15 bp, Homo sapiens
cagccccagcctgct

SEQ ID NO: 3495733 - DNA, 17 bp, Homo sapiens
cagccccagcctgctag

SEQ ID NO: 3495734 - DNA, 18 bp, Homo sapiens
cagccccagcctgctagc

SEQ ID NO: 3495735 - DNA, 19 bp, Homo sapiens
cagccccagcctgctagct

SEQ ID NO: 3495736 - DNA, 16 bp, Homo sapiens
cagccccagtgcccac

SEQ ID NO: 3495737 - DNA, 17 bp, Homo sapiens
cagccccagtgcccaca

SEQ ID NO: 3495738 - DNA, 19 bp, Homo sapiens
cagccccattctgcctgcc

SEQ ID NO: 3495739 - DNA, 20 bp, Homo sapiens
cagccccattctgcctgccc

SEQ ID NO: 3495740 - DNA, 15 bp, Homo sapiens
cagccccgacttcct

SEQ ID NO: 3495741 - DNA, 22 bp, Homo sapiens
cagccccgacttcctgactctc

SEQ ID NO: 3495742 - DNA, 16 bp, Homo sapiens
cagcccctactgctgt

SEQ ID NO: 3495743 - DNA, 17 bp, Homo sapiens
cagcccctactgctgtg

SEQ ID NO: 3495744 - DNA, 21 bp, Homo sapiens
cagcccctctggtcgctcctg

SEQ ID NO: 3495745 - DNA, 13 bp, Homo sapiens
cagcccctggccc

SEQ ID NO: 3495746 - DNA, 15 bp, Homo sapiens
cagccccttctcaga

SEQ ID NO: 3495747 - DNA, 16 bp, Homo sapiens
cagccccttctcagaa

SEQ ID NO: 3495748 - DNA, 18 bp, Homo sapiens
cagccccttgagaaacct

SEQ ID NO: 3495749 - DNA, 15 bp, Homo sapiens
cagccctcacccctg

SEQ ID NO: 3495750 - DNA, 18 bp, Homo sapiens
cagccctcacccctggtt

SEQ ID NO: 3495751 - DNA, 14 bp, Homo sapiens
cagccctcatcccg

SEQ ID NO: 3495752 - DNA, 20 bp, Homo sapiens
cagccctgctgctgcctgcc

SEQ ID NO: 3495753 - DNA, 13 bp, Homo sapiens
cagcccttagcag

SEQ ID NO: 3495754 - DNA, 20 bp, Homo sapiens
cagccgctgagcgaggagat

SEQ ID NO: 3495755 - DNA, 17 bp, Homo sapiens
cagccgtgagcatgttt

SEQ ID NO: 3495756 - DNA, 20 bp, Homo sapiens
cagcctactccgctcactga

SEQ ID NO: 3495757 - DNA, 18 bp, Homo sapiens
cagcctcagcgcggccct

SEQ ID NO: 3495758 - DNA, 19 bp, Homo sapiens
cagcctcccaaagtgctgg

SEQ ID NO: 3495759 - DNA, 23 bp, Homo sapiens
cagcctcccaaagtgctgggatt

SEQ ID NO: 3495760 - DNA, 14 bp, Homo sapiens
cagcctcccatcca

SEQ ID NO: 3495761 - DNA, 18 bp, Homo sapiens
cagcctcccctgccaggg

SEQ ID NO: 3495762 - DNA, 22 bp, Homo sapiens
cagcctcccgaatagctgggac

SEQ ID NO: 3495763 - DNA, 23 bp, Homo sapiens
cagcctcccgaatagctgggact

SEQ ID NO: 3495764 - DNA, 19 bp, Homo sapiens
cagcctcccgagtagctgg

SEQ ID NO: 3495765 - DNA, 23 bp, Homo sapiens
cagcctcccgagtagctgggact

SEQ ID NO: 3495766 - DNA, 12 bp, Homo sapiens
cagcctccctga

SEQ ID NO: 3495767 - DNA, 14 bp, Homo sapiens
cagcctccctgaag

SEQ ID NO: 3495768 - DNA, 16 bp, Homo sapiens
cagcctctccccaggt

SEQ ID NO: 3495769 - DNA, 19 bp, Homo sapiens
cagcctctccccaggtcca

SEQ ID NO: 3495770 - DNA, 20 bp, Homo sapiens
cagcctctccccaggtccag

SEQ ID NO: 3495771 - DNA, 21 bp, Homo sapiens
cagcctctgcagtccgtgggc

SEQ ID NO: 3495772 - DNA, 16 bp, Homo sapiens
cagcctctttctgtcc

SEQ ID NO: 3495773 - DNA, 16 bp, Homo sapiens
cagcctgagcaactct

SEQ ID NO: 3495774 - DNA, 15 bp, Homo sapiens
cagcctgcctggcag

SEQ ID NO: 3495775 - DNA, 23 bp, Homo sapiens
cagcctgcgcctgctgcatgccc

SEQ ID NO: 3495776 - DNA, 19 bp, Homo sapiens
cagcctgctaattccccag

SEQ ID NO: 3495777 - DNA, 13 bp, Homo sapiens
cagcctgctagct

SEQ ID NO: 3495778 - DNA, 18 bp, Homo sapiens
cagcctgctagctagctc

SEQ ID NO: 3495779 - DNA, 15 bp, Homo sapiens
cagcctgctccagct

SEQ ID NO: 3495780 - DNA, 13 bp, Homo sapiens
cagcctggccaga

SEQ ID NO: 3495781 - DNA, 18 bp, Homo sapiens
cagcctggccagacacag

SEQ ID NO: 3495782 - DNA, 21 bp, Homo sapiens
cagcctggggctggcctccca

SEQ ID NO: 3495783 - DNA, 14 bp, Homo sapiens
cagccttgaactct

SEQ ID NO: 3495784 - DNA, 15 bp, Homo sapiens
cagccttgccagaga

SEQ ID NO: 3495785 - DNA, 16 bp, Homo sapiens
cagccttgccagagat

SEQ ID NO: 3495786 - DNA, 15 bp, Homo sapiens
cagcctttgaatgta

SEQ ID NO: 3495787 - DNA, 14 bp, Homo sapiens
cagcctttgggaaa

SEQ ID NO: 3495788 - DNA, 13 bp, Homo sapiens
cagcgacagcctg

SEQ ID NO: 3495789 - DNA, 13 bp, Homo sapiens
cagcgaccccagg

SEQ ID NO: 3495790 - DNA, 14 bp, Homo sapiens
cagcgaccccagga

SEQ ID NO: 3495791 - DNA, 21 bp, Homo sapiens
cagcgactccgttggccactc

SEQ ID NO: 3495792 - DNA, 22 bp, Homo sapiens
cagcgactccgttggccactcc

SEQ ID NO: 3495793 - DNA, 19 bp, Homo sapiens
cagcgagccctggtggcag

SEQ ID NO: 3495794 - DNA, 20 bp, Homo sapiens
cagcgagccctggtggcagt

SEQ ID NO: 3495795 - DNA, 17 bp, Homo sapiens
cagcgaggaggctccag

SEQ ID NO: 3495796 - DNA, 19 bp, Homo sapiens
cagcgccaggctgaccaca

SEQ ID NO: 3495797 - DNA, 12 bp, Homo sapiens
cagcgcctttcc

SEQ ID NO: 3495798 - DNA, 22 bp, Homo sapiens
cagcgcctttcccaactctagc

SEQ ID NO: 3495799 - DNA, 17 bp, Homo sapiens
cagcggagtctgtcctg

SEQ ID NO: 3495800 - DNA, 21 bp, Homo sapiens
cagcggagtctgtcctgtgac

SEQ ID NO: 3495801 - DNA, 23 bp, Homo sapiens
cagcgggaatggcagctgccacg

SEQ ID NO: 3495802 - DNA, 20 bp, Homo sapiens
cagcgggcaggttctgcctg

SEQ ID NO: 3495803 - DNA, 15 bp, Homo sapiens
cagcggggacagctc

SEQ ID NO: 3495804 - DNA, 16 bp, Homo sapiens
cagcggggacagctcc

SEQ ID NO: 3495805 - DNA, 18 bp, Homo sapiens
cagcgtcctcctctgtga

SEQ ID NO: 3495806 - DNA, 14 bp, Homo sapiens
cagcgtcctgtcca

SEQ ID NO: 3495807 - DNA, 15 bp, Homo sapiens
cagcgtcctgtccac

SEQ ID NO: 3495808 - DNA, 19 bp, Homo sapiens
cagcgtgctttaaaaaata

SEQ ID NO: 3495809 - DNA, 22 bp, Homo sapiens
cagctaaaccaaggactgagca

SEQ ID NO: 3495810 - DNA, 19 bp, Homo sapiens
cagctaaagcaatatgcat

SEQ ID NO: 3495811 - DNA, 20 bp, Homo sapiens
cagctaacacacagctccca

SEQ ID NO: 3495812 - DNA, 14 bp, Homo sapiens
cagctaagaacctg

SEQ ID NO: 3495813 - DNA, 15 bp, Homo sapiens
cagctaatgggacac

SEQ ID NO: 3495814 - DNA, 13 bp, Homo sapiens
cagctactctccc

SEQ ID NO: 3495815 - DNA, 16 bp, Homo sapiens
cagctacttgggaggc

SEQ ID NO: 3495816 - DNA, 21 bp, Homo sapiens
cagctaggaagagcaggactc

SEQ ID NO: 3495817 - DNA, 23 bp, Homo sapiens
cagctatctgcctgacaggctgt

SEQ ID NO: 3495818 - DNA, 20 bp, Homo sapiens
cagctcaaggaaaggcctga

SEQ ID NO: 3495819 - DNA, 20 bp, Homo sapiens
cagctcacagtgctgtgtgc

SEQ ID NO: 3495820 - DNA, 17 bp, Homo sapiens
cagctcaccagccccag

SEQ ID NO: 3495821 - DNA, 20 bp, Homo sapiens
cagctcaccagccccagtgc

SEQ ID NO: 3495822 - DNA, 14 bp, Homo sapiens
cagctcagcttccc

SEQ ID NO: 3495823 - DNA, 10 bp, Homo sapiens
cagctcagga

SEQ ID NO: 3495824 - DNA, 13 bp, Homo sapiens
cagctcaggacag

SEQ ID NO: 3495825 - DNA, 20 bp, Homo sapiens
cagctccaacctgcaaagat

SEQ ID NO: 3495826 - DNA, 14 bp, Homo sapiens
cagctccagctcac

SEQ ID NO: 3495827 - DNA, 13 bp, Homo sapiens
cagctccccagag

SEQ ID NO: 3495828 - DNA, 14 bp, Homo sapiens
cagctccccaggac

SEQ ID NO: 3495829 - DNA, 21 bp, Homo sapiens
cagctccccaggactcaccct

SEQ ID NO: 3495830 - DNA, 22 bp, Homo sapiens
cagctccccaggactcaccctc

SEQ ID NO: 3495831 - DNA, 12 bp, Homo sapiens
cagctccctggc

SEQ ID NO: 3495832 - DNA, 16 bp, Homo sapiens
cagctccggcctgtcc

SEQ ID NO: 3495833 - DNA, 21 bp, Homo sapiens
cagctccggcctgtcctccaa

SEQ ID NO: 3495834 - DNA, 12 bp, Homo sapiens
cagctcctcagc

SEQ ID NO: 3495835 - DNA, 17 bp, Homo sapiens
cagctcctgggcagctt

SEQ ID NO: 3495836 - DNA, 16 bp, Homo sapiens
cagctccttctgtcct

SEQ ID NO: 3495837 - DNA, 21 bp, Homo sapiens
cagctccttctgtcctactct

SEQ ID NO: 3495838 - DNA, 13 bp, Homo sapiens
cagctcggctcag

SEQ ID NO: 3495839 - DNA, 14 bp, Homo sapiens
cagctcggctcagc

SEQ ID NO: 3495840 - DNA, 12 bp, Homo sapiens
cagctctcccct

SEQ ID NO: 3495841 - DNA, 18 bp, Homo sapiens
cagctctggaggggaggg

SEQ ID NO: 3495842 - DNA, 22 bp, Homo sapiens
cagctctgggccattctccaca

SEQ ID NO: 3495843 - DNA, 23 bp, Homo sapiens
cagctctgggccattctccacag

SEQ ID NO: 3495844 - DNA, 20 bp, Homo sapiens
cagctctggtccaggccctg

SEQ ID NO: 3495845 - DNA, 23 bp, Homo sapiens
cagctctggtccaggccctgtgg

SEQ ID NO: 3495846 - DNA, 16 bp, Homo sapiens
cagctctgtcctggga

SEQ ID NO: 3495847 - DNA, 23 bp, Homo sapiens
cagctctgtcctgggagtgagct

SEQ ID NO: 3495848 - DNA, 19 bp, Homo sapiens
cagctcttcatctgcccaa

SEQ ID NO: 3495849 - DNA, 19 bp, Homo sapiens
cagctcttctccaggctgt

SEQ ID NO: 3495850 - DNA, 18 bp, Homo sapiens
cagctcttggctccactg

SEQ ID NO: 3495851 - DNA, 21 bp, Homo sapiens
cagctctttcctccttccatg

SEQ ID NO: 3495852 - DNA, 21 bp, Homo sapiens
cagctgacttttctgtccgag

SEQ ID NO: 3495853 - DNA, 15 bp, Homo sapiens
cagctgatacaaatt

SEQ ID NO: 3495854 - DNA, 23 bp, Homo sapiens
cagctgatacaaattgcagactg

SEQ ID NO: 3495855 - DNA, 14 bp, Homo sapiens
cagctgatgagtta

SEQ ID NO: 3495856 - DNA, 12 bp, Homo sapiens
cagctgcaaagt

SEQ ID NO: 3495857 - DNA, 22 bp, Homo sapiens
cagggtctcactctgtcgccca

SEQ ID NO: 3495858 - DNA, 15 bp, Homo sapiens
cagggtctctgctgc

SEQ ID NO: 3495859 - DNA, 16 bp, Homo sapiens
cagggtctctgctgcc

SEQ ID NO: 3495860 - DNA, 19 bp, Homo sapiens
cagggtctctgctgccgcc

SEQ ID NO: 3495861 - DNA, 15 bp, Homo sapiens
cagggtctgcctcca

SEQ ID NO: 3495862 - DNA, 18 bp, Homo sapiens
cagggtctgcctccagcc

SEQ ID NO: 3495863 - DNA, 19 bp, Homo sapiens
cagggtctgcctccagcca

SEQ ID NO: 3495864 - DNA, 18 bp, Homo sapiens
cagggtggagtgcagtgg

SEQ ID NO: 3495865 - DNA, 20 bp, Homo sapiens
cagggttgaccccagaggat

SEQ ID NO: 3495866 - DNA, 15 bp, Homo sapiens
cagggttggcccctg

SEQ ID NO: 3495867 - DNA, 20 bp, Homo sapiens
cagggtttggctgtgtctaa

SEQ ID NO: 3495868 - DNA, 16 bp, Homo sapiens
cagggttttgccatgt

SEQ ID NO: 3495869 - DNA, 17 bp, Homo sapiens
caggtaacaggcagata

SEQ ID NO: 3495870 - DNA, 20 bp, Homo sapiens
caggtaacaggcagatacag

SEQ ID NO: 3495871 - DNA, 21 bp, Homo sapiens
caggtaacaggcagatacagg

SEQ ID NO: 3495872 - DNA, 23 bp, Homo sapiens
caggtacagcaacaggaatctca

SEQ ID NO: 3495873 - DNA, 22 bp, Homo sapiens
caggtaccttgacctttgtaca

SEQ ID NO: 3495874 - DNA, 22 bp, Homo sapiens
caggtagaaggttgacacagtt

SEQ ID NO: 3495875 - DNA, 22 bp, Homo sapiens
caggtagctgcccctggctctg

SEQ ID NO: 3495876 - DNA, 17 bp, Homo sapiens
caggtccagctctggag

SEQ ID NO: 3495877 - DNA, 23 bp, Homo sapiens
caggtccagctctggaggggagg

SEQ ID NO: 3495878 - DNA, 15 bp, Homo sapiens
caggtctctccactg

SEQ ID NO: 3495879 - DNA, 22 bp, Homo sapiens
caggtcttgaactcctggcctc

SEQ ID NO: 3495880 - DNA, 20 bp, Homo sapiens
caggtgaagcaccaagctca

SEQ ID NO: 3495881 - DNA, 21 bp, Homo sapiens
caggtgagaagcagaggaagg

SEQ ID NO: 3495882 - DNA, 17 bp, Homo sapiens
caggtgagcagacagga

SEQ ID NO: 3495883 - DNA, 20 bp, Homo sapiens
caggtgagcccatggccctc

SEQ ID NO: 3495884 - DNA, 20 bp, Homo sapiens
caggtgatccacccacctca

SEQ ID NO: 3495885 - DNA, 21 bp, Homo sapiens
caggtgatccacccacctcag

SEQ ID NO: 3495886 - DNA, 14 bp, Homo sapiens
caggtgcagaggaa

SEQ ID NO: 3495887 - DNA, 19 bp, Homo sapiens
caggtgcagaggaagtaca

SEQ ID NO: 3495888 - DNA, 21 bp, Homo sapiens
caggtgcctttcaaatttaga

SEQ ID NO: 3495889 - DNA, 21 bp, Homo sapiens
caggtgctgacttcatctccc

SEQ ID NO: 3495890 - DNA, 13 bp, Homo sapiens
caggtgctgtcca

SEQ ID NO: 3495891 - DNA, 14 bp, Homo sapiens
caggtgctgtccat

SEQ ID NO: 3495892 - DNA, 19 bp, Homo sapiens
caggtggccatgcctcagc

SEQ ID NO: 3495893 - DNA, 18 bp, Homo sapiens
caggtggcctagcaggca

SEQ ID NO: 3495894 - DNA, 20 bp, Homo sapiens
caggtggcctagcaggcaca

SEQ ID NO: 3495895 - DNA, 22 bp, Homo sapiens
caggtgggcttcccagtggctg

SEQ ID NO: 3495896 - DNA, 20 bp, Homo sapiens
caggtggggagactgggctg

SEQ ID NO: 3495897 - DNA, 13 bp, Homo sapiens
caggtggggcagc

SEQ ID NO: 3495898 - DNA, 16 bp, Homo sapiens
caggtggggcagcttg

SEQ ID NO: 3495899 - DNA, 17 bp, Homo sapiens
caggtggggcagcttga

SEQ ID NO: 3495900 - DNA, 20 bp, Homo sapiens
caggtggttatggagagggt

SEQ ID NO: 3495901 - DNA, 13 bp, Homo sapiens
caggtggttttta

SEQ ID NO: 3495902 - DNA, 14 bp, Homo sapiens
caggtgtcagccat

SEQ ID NO: 3495903 - DNA, 17 bp, Homo sapiens
caggtgtcagccattgc

SEQ ID NO: 3495904 - DNA, 14 bp, Homo sapiens
caggtgtccctgca

SEQ ID NO: 3495905 - DNA, 19 bp, Homo sapiens
caggtgtccctgcacttgc

SEQ ID NO: 3495906 - DNA, 12 bp, Homo sapiens
caggtgtgaacc

SEQ ID NO: 3495907 - DNA, 19 bp, Homo sapiens
caggtgtgaaccaccacac

SEQ ID NO: 3495908 - DNA, 23 bp, Homo sapiens
caggtgtgagccaccacacctgg

SEQ ID NO: 3495909 - DNA, 16 bp, Homo sapiens
caggtgtgagtcacca

SEQ ID NO: 3495910 - DNA, 20 bp, Homo sapiens
caggtgtgagtcaccaagcc

SEQ ID NO: 3495911 - DNA, 23 bp, Homo sapiens
caggtgtgagtcaccaagcccag

SEQ ID NO: 3495912 - DNA, 14 bp, Homo sapiens
caggtgtttttcca

SEQ ID NO: 3495913 - DNA, 12 bp, Homo sapiens
caggttcagctt

SEQ ID NO: 3495914 - DNA, 23 bp, Homo sapiens
caggttctccgttagctcctgtg

SEQ ID NO: 3495915 - DNA, 17 bp, Homo sapiens
caggtttctggtctcta

SEQ ID NO: 3495916 - DNA, 15 bp, Homo sapiens
cagtaaaattgccat

SEQ ID NO: 3495917 - DNA, 16 bp, Homo sapiens
cagtaaaattgccata

SEQ ID NO: 3495918 - DNA, 18 bp, Homo sapiens
cagtaaagtatagaaata

SEQ ID NO: 3495919 - DNA, 20 bp, Homo sapiens
cagtaaatcttttacaactg

SEQ ID NO: 3495920 - DNA, 20 bp, Homo sapiens
cagtacaggcagcacagaga

SEQ ID NO: 3495921 - DNA, 20 bp, Homo sapiens
cagtacctcctgtctctggc

SEQ ID NO: 3495922 - DNA, 13 bp, Homo sapiens
cagtaccttgctt

SEQ ID NO: 3495923 - DNA, 12 bp, Homo sapiens
cagtacttgtca

SEQ ID NO: 3495924 - DNA, 13 bp, Homo sapiens
cagtacttgtcat

SEQ ID NO: 3495925 - DNA, 12 bp, Homo sapiens
cagtaggagccc

SEQ ID NO: 3495926 - DNA, 20 bp, Homo sapiens
cagtaggttatttagcttgg

SEQ ID NO: 3495927 - DNA, 19 bp, Homo sapiens
cagtagtagtatggcactt

SEQ ID NO: 3495928 - DNA, 23 bp, Homo sapiens
cagtagtcttgatgaccaaagtc

SEQ ID NO: 3495929 - DNA, 23 bp, Homo sapiens
cagtagtttgagaccagcctggc

SEQ ID NO: 3495930 - DNA, 19 bp, Homo sapiens
cagtataaacaaagttact

SEQ ID NO: 3495931 - DNA, 23 bp, Homo sapiens
cagtataattgagttttcagtgg

SEQ ID NO: 3495932 - DNA, 13 bp, Homo sapiens
cagtatctcaggg

SEQ ID NO: 3495933 - DNA, 13 bp, Homo sapiens
cagtatgacagag

SEQ ID NO: 3495934 - DNA, 16 bp, Homo sapiens
cagtatgacagaggag

SEQ ID NO: 3495935 - DNA, 20 bp, Homo sapiens
cagtatggtacatttttcaa

SEQ ID NO: 3495936 - DNA, 15 bp, Homo sapiens
cagtatgtgggggct

SEQ ID NO: 3495937 - DNA, 18 bp, Homo sapiens
cagtatgtgggggcttca

SEQ ID NO: 3495938 - DNA, 20 bp, Homo sapiens
cagtatgtgggggcttcatc

SEQ ID NO: 3495939 - DNA, 14 bp, Homo sapiens
cagtatttttgctg

SEQ ID NO: 3495940 - DNA, 14 bp, Homo sapiens
cagtcaacctgggc

SEQ ID NO: 3495941 - DNA, 22 bp, Homo sapiens
cagtcaagctgttgaagtctca

SEQ ID NO: 3495942 - DNA, 13 bp, Homo sapiens
cagtcacagccac

SEQ ID NO: 3495943 - DNA, 14 bp, Homo sapiens
cagtcacagccacc

SEQ ID NO: 3495944 - DNA, 16 bp, Homo sapiens
cagtcacagccacccc

SEQ ID NO: 3495945 - DNA, 15 bp, Homo sapiens
cagtcacgcctgaaa

SEQ ID NO: 3495946 - DNA, 16 bp, Homo sapiens
cagtcacgcctgaaac

SEQ ID NO: 3495947 - DNA, 18 bp, Homo sapiens
cagtcacgcctgaaactt

SEQ ID NO: 3495948 - DNA, 18 bp, Homo sapiens
cagtcacgtggaggagca

SEQ ID NO: 3495949 - DNA, 17 bp, Homo sapiens
cagtcagatttccagtc

SEQ ID NO: 3495950 - DNA, 15 bp, Homo sapiens
cagtcagctcttcat

SEQ ID NO: 3495951 - DNA, 22 bp, Homo sapiens
cagtcagctcttcatctgccca

SEQ ID NO: 3495952 - DNA, 23 bp, Homo sapiens
cagtcagtgctggagaaatcttg

SEQ ID NO: 3495953 - DNA, 18 bp, Homo sapiens
cagtcatcttgaccaagc

SEQ ID NO: 3495954 - DNA, 17 bp, Homo sapiens
cagtcattggctgtctc

SEQ ID NO: 3495955 - DNA, 13 bp, Homo sapiens
cagtccagccagc

SEQ ID NO: 3495956 - DNA, 17 bp, Homo sapiens
cagtccagcctggagat

SEQ ID NO: 3495957 - DNA, 16 bp, Homo sapiens
cagtccatagcagaga

SEQ ID NO: 3495958 - DNA, 16 bp, Homo sapiens
cagtcccaaatccttc

SEQ ID NO: 3495959 - DNA, 18 bp, Homo sapiens
cagtcccaaatccttccc

SEQ ID NO: 3495960 - DNA, 15 bp, Homo sapiens
cagtcccaccctgct

SEQ ID NO: 3495961 - DNA, 19 bp, Homo sapiens
cagtcccaccctgctgctg

SEQ ID NO: 3495962 - DNA, 21 bp, Homo sapiens
cagtccgcctggccggctcca

SEQ ID NO: 3495963 - DNA, 19 bp, Homo sapiens
cagtcctaggcccctgccc

SEQ ID NO: 3495964 - DNA, 21 bp, Homo sapiens
cagtcctaggcccctgccctg

SEQ ID NO: 3495965 - DNA, 14 bp, Homo sapiens
cagtcctgaagcag

SEQ ID NO: 3495966 - DNA, 22 bp, Homo sapiens
cagtcctgatcagagccgtggt

SEQ ID NO: 3495967 - DNA, 19 bp, Homo sapiens
cagtcctgccaccaccctg

SEQ ID NO: 3495968 - DNA, 13 bp, Homo sapiens
cagtcgtgcctgt

SEQ ID NO: 3495969 - DNA, 19 bp, Homo sapiens
cagtctcactgtgggaagg

SEQ ID NO: 3495970 - DNA, 18 bp, Homo sapiens
cagtctcctctccatttt

SEQ ID NO: 3495971 - DNA, 21 bp, Homo sapiens
cagtctgattcccaagctctg

SEQ ID NO: 3495972 - DNA, 17 bp, Homo sapiens
cagtctggaatgcagtg

SEQ ID NO: 3495973 - DNA, 20 bp, Homo sapiens
cagtctgggtaacagggaga

SEQ ID NO: 3495974 - DNA, 17 bp, Homo sapiens
cagtcttccatttgcaa

SEQ ID NO: 3495975 - DNA, 16 bp, Homo sapiens
cagtgaaagaaaataa

SEQ ID NO: 3495976 - DNA, 20 bp, Homo sapiens
cagtgaaagaaaataacaat

SEQ ID NO: 3495977 - DNA, 23 bp, Homo sapiens
cagtgacacgtctcgccaagcag

SEQ ID NO: 3495978 - DNA, 17 bp, Homo sapiens
cagtgacctgaggaagc

SEQ ID NO: 3495979 - DNA, 17 bp, Homo sapiens
cagtgagtcgaggacag

SEQ ID NO: 3495980 - DNA, 18 bp, Homo sapiens
cagtgagtcgaggacagg

SEQ ID NO: 3495981 - DNA, 19 bp, Homo sapiens
cagtgagtcgaggacaggg

SEQ ID NO: 3495982 - DNA, 20 bp, Homo sapiens
cagtgagtcgaggacaggga

SEQ ID NO: 3495983 - DNA, 22 bp, Homo sapiens
cagtgagtcgaggacagggagg

SEQ ID NO: 3495984 - DNA, 23 bp, Homo sapiens
cagtgatgtaccatgaaacaaag

SEQ ID NO: 3495985 - DNA, 19 bp, Homo sapiens
cagtgcaacctctgcttcc

SEQ ID NO: 3495986 - DNA, 12 bp, Homo sapiens
cagtgcaggcac

SEQ ID NO: 3495987 - DNA, 22 bp, Homo sapiens
cagtgcccacaggatcagtctg

SEQ ID NO: 3495988 - DNA, 22 bp, Homo sapiens
catgttggaggagagagccttg

SEQ ID NO: 3495989 - DNA, 15 bp, Homo sapiens
catgttggccaggct

SEQ ID NO: 3495990 - DNA, 16 bp, Homo sapiens
catgttggccaggctg

SEQ ID NO: 3495991 - DNA, 17 bp, Homo sapiens
catgttggccaggctgg

SEQ ID NO: 3495992 - DNA, 21 bp, Homo sapiens
catgttggccaggctggtctt

SEQ ID NO: 3495993 - DNA, 15 bp, Homo sapiens
catgttgggaaactt

SEQ ID NO: 3495994 - DNA, 22 bp, Homo sapiens
catgtttggaaggggtctgtag

SEQ ID NO: 3495995 - DNA, 15 bp, Homo sapiens
catgttttaacaaaa

SEQ ID NO: 3495996 - DNA, 20 bp, Homo sapiens
catgttttaacaaaaaccaa

SEQ ID NO: 3495997 - DNA, 15 bp, Homo sapiens
catgttttcaactgc

SEQ ID NO: 3495998 - DNA, 16 bp, Homo sapiens
catgttttcaactgcc

SEQ ID NO: 3495999 - DNA, 21 bp, Homo sapiens
cattaaaacaatattgtttct

SEQ ID NO: 3496000 - DNA, 22 bp, Homo sapiens
cattaaaacaatattgtttcta

SEQ ID NO: 3496001 - DNA, 14 bp, Homo sapiens
cattaaattcacaa

SEQ ID NO: 3496002 - DNA, 17 bp, Homo sapiens
cattaaattcacaaact

SEQ ID NO: 3496003 - DNA, 21 bp, Homo sapiens
cattaaattcacaaactttta

SEQ ID NO: 3496004 - DNA, 13 bp, Homo sapiens
cattaacacaaag

SEQ ID NO: 3496005 - DNA, 17 bp, Homo sapiens
cattacccttttctggg

SEQ ID NO: 3496006 - DNA, 17 bp, Homo sapiens
cattaccgcgttgtaaa

SEQ ID NO: 3496007 - DNA, 18 bp, Homo sapiens
cattaccgcgttgtaaaa

SEQ ID NO: 3496008 - DNA, 15 bp, Homo sapiens
cattactgcttcatt

SEQ ID NO: 3496009 - DNA, 14 bp, Homo sapiens
cattagagcaggcg

SEQ ID NO: 3496010 - DNA, 12 bp, Homo sapiens
cattagccaagg

SEQ ID NO: 3496011 - DNA, 14 bp, Homo sapiens
cattagccaaggat

SEQ ID NO: 3496012 - DNA, 19 bp, Homo sapiens
cattagcctgagtagaaag

SEQ ID NO: 3496013 - DNA, 13 bp, Homo sapiens
cattataaattct

SEQ ID NO: 3496014 - DNA, 21 bp, Homo sapiens
cattatccattcccaagatgc

SEQ ID NO: 3496015 - DNA, 22 bp, Homo sapiens
cattattcgtagatattggaca

SEQ ID NO: 3496016 - DNA, 14 bp, Homo sapiens
cattattctatgta

SEQ ID NO: 3496017 - DNA, 17 bp, Homo sapiens
cattattctatgtagtg

SEQ ID NO: 3496018 - DNA, 12 bp, Homo sapiens
cattatttgtca

SEQ ID NO: 3496019 - DNA, 16 bp, Homo sapiens
cattcaaaagttgaaa

SEQ ID NO: 3496020 - DNA, 14 bp, Homo sapiens
cattcaaattcttt

SEQ ID NO: 3496021 - DNA, 13 bp, Homo sapiens
cattcacagagcc

SEQ ID NO: 3496022 - DNA, 23 bp, Homo sapiens
cattcacagttctttgggccaga

SEQ ID NO: 3496023 - DNA, 16 bp, Homo sapiens
cattcacctgccccaa

SEQ ID NO: 3496024 - DNA, 20 bp, Homo sapiens
cattcagcagcaaattttca

SEQ ID NO: 3496025 - DNA, 20 bp, Homo sapiens
cattcagtgattactgtcaa

SEQ ID NO: 3496026 - DNA, 16 bp, Homo sapiens
cattcatgcctggctt

SEQ ID NO: 3496027 - DNA, 20 bp, Homo sapiens
cattcatttagctaaacgga

SEQ ID NO: 3496028 - DNA, 14 bp, Homo sapiens
cattccaagcctga

SEQ ID NO: 3496029 - DNA, 21 bp, Homo sapiens
cattcccaacgtgcaaagcca

SEQ ID NO: 3496030 - DNA, 19 bp, Homo sapiens
cattcccaagatgcctgat

SEQ ID NO: 3496031 - DNA, 21 bp, Homo sapiens
cattccctctcatctcaggta

SEQ ID NO: 3496032 - DNA, 14 bp, Homo sapiens
cattcccttcggcc

SEQ ID NO: 3496033 - DNA, 20 bp, Homo sapiens
cattcctgaagaaccagtcc

SEQ ID NO: 3496034 - DNA, 23 bp, Homo sapiens
cattcggtacttacccggagaag

SEQ ID NO: 3496035 - DNA, 16 bp, Homo sapiens
cattctaacctggagg

SEQ ID NO: 3496036 - DNA, 17 bp, Homo sapiens
cattctacacagagcag

SEQ ID NO: 3496037 - DNA, 22 bp, Homo sapiens
cattctacacagagcaggactg

SEQ ID NO: 3496038 - DNA, 21 bp, Homo sapiens
cattctagatgcaagtctctt

SEQ ID NO: 3496039 - DNA, 23 bp, Homo sapiens
cattctaggcctcctggcccagg

SEQ ID NO: 3496040 - DNA, 23 bp, Homo sapiens
cattctaggtaggggcccacttc

SEQ ID NO: 3496041 - DNA, 13 bp, Homo sapiens
cattctcactgct

SEQ ID NO: 3496042 - DNA, 14 bp, Homo sapiens
cattctccacagca

SEQ ID NO: 3496043 - DNA, 17 bp, Homo sapiens
cattctccacagcaacc

SEQ ID NO: 3496044 - DNA, 16 bp, Homo sapiens
cattctctctcctgta

SEQ ID NO: 3496045 - DNA, 13 bp, Homo sapiens
cattctcttttaa

SEQ ID NO: 3496046 - DNA, 16 bp, Homo sapiens
cattctgaaggagccc

SEQ ID NO: 3496047 - DNA, 21 bp, Homo sapiens
cattctgactcggtttctcca

SEQ ID NO: 3496048 - DNA, 23 bp, Homo sapiens
cattctgactcggtttctccaaa

SEQ ID NO: 3496049 - DNA, 18 bp, Homo sapiens
cattctgcaccttgccag

SEQ ID NO: 3496050 - DNA, 21 bp, Homo sapiens
cattctgcaccttgccaggga

SEQ ID NO: 3496051 - DNA, 15 bp, Homo sapiens
cattctgcatttagc

SEQ ID NO: 3496052 - DNA, 22 bp, Homo sapiens
cattctgccaggcccccaagcc

SEQ ID NO: 3496053 - DNA, 16 bp, Homo sapiens
cattctgcctgcccag

SEQ ID NO: 3496054 - DNA, 19 bp, Homo sapiens
cattctgcctgcccaggcc

SEQ ID NO: 3496055 - DNA, 20 bp, Homo sapiens
cattctgctttcatcttggt

SEQ ID NO: 3496056 - DNA, 13 bp, Homo sapiens
cattcttaaaaaa

SEQ ID NO: 3496057 - DNA, 20 bp, Homo sapiens
cattcttaacaaactcttca

SEQ ID NO: 3496058 - DNA, 23 bp, Homo sapiens
cattcttctgtacgtctgacagg

SEQ ID NO: 3496059 - DNA, 21 bp, Homo sapiens
cattcttgtaaggctttgatt

SEQ ID NO: 3496060 - DNA, 24 bp, Homo sapiens
cattctttataatcctctgtaaaa

SEQ ID NO: 3496061 - DNA, 14 bp, Homo sapiens
cattcttttgtaat

SEQ ID NO: 3496062 - DNA, 19 bp, Homo sapiens
cattcttttgtaatttaaa

SEQ ID NO: 3496063 - DNA, 18 bp, Homo sapiens
cattgaacacaaactgta

SEQ ID NO: 3496064 - DNA, 22 bp, Homo sapiens
cattgaattcttggttgaggaa

SEQ ID NO: 3496065 - DNA, 16 bp, Homo sapiens
cattgaggataaattg

SEQ ID NO: 3496066 - DNA, 17 bp, Homo sapiens
cattgatttcctgtgtc

SEQ ID NO: 3496067 - DNA, 18 bp, Homo sapiens
cattgatttcctgtgtca

SEQ ID NO: 3496068 - DNA, 15 bp, Homo sapiens
cattgccaaaaagga

SEQ ID NO: 3496069 - DNA, 20 bp, Homo sapiens
cattgcccagtctttcatgt

SEQ ID NO: 3496070 - DNA, 14 bp, Homo sapiens
cattgcctttgaat

SEQ ID NO: 3496071 - DNA, 14 bp, Homo sapiens
cattgcggacagcc

SEQ ID NO: 3496072 - DNA, 17 bp, Homo sapiens
cattgcggacagccacg

SEQ ID NO: 3496073 - DNA, 23 bp, Homo sapiens
cattgcgtttgaccttttatgta

SEQ ID NO: 3496074 - DNA, 18 bp, Homo sapiens
cattgctgggcttgtctg

SEQ ID NO: 3496075 - DNA, 14 bp, Homo sapiens
cattgctgtaggat

SEQ ID NO: 3496076 - DNA, 19 bp, Homo sapiens
cattgctgtctgcagcctt

SEQ ID NO: 3496077 - DNA, 20 bp, Homo sapiens
cattgctgtctgcagccttg

SEQ ID NO: 3496078 - DNA, 17 bp, Homo sapiens
cattggacccttccatg

SEQ ID NO: 3496079 - DNA, 14 bp, Homo sapiens
cattggttaatttt

SEQ ID NO: 3496080 - DNA, 21 bp, Homo sapiens
cattgtccaatcctatgtttt

SEQ ID NO: 3496081 - DNA, 19 bp, Homo sapiens
cattgtccctctgccccat

SEQ ID NO: 3496082 - DNA, 19 bp, Homo sapiens
cattgtctcctatatattt

SEQ ID NO: 3496083 - DNA, 21 bp, Homo sapiens
cattgtctcctatatatttct

SEQ ID NO: 3496084 - DNA, 20 bp, Homo sapiens
cattgtctttttagatgccc

SEQ ID NO: 3496085 - DNA, 15 bp, Homo sapiens
cattgtgaaccaatg

SEQ ID NO: 3496086 - DNA, 17 bp, Homo sapiens
cattgtgcttctttctt

SEQ ID NO: 3496087 - DNA, 19 bp, Homo sapiens
cattgttcacctttgtagc

SEQ ID NO: 3496088 - DNA, 17 bp, Homo sapiens
cattgttggccaaagcc

SEQ ID NO: 3496089 - DNA, 21 bp, Homo sapiens
cattgtttctgtgggcgggcc

SEQ ID NO: 3496090 - DNA, 14 bp, Homo sapiens
cattgtttgctgct

SEQ ID NO: 3496091 - DNA, 16 bp, Homo sapiens
cattgtttgctgctat

SEQ ID NO: 3496092 - DNA, 18 bp, Homo sapiens
cattgtttgtctgtcttc

SEQ ID NO: 3496093 - DNA, 17 bp, Homo sapiens
catttaaatacagtctt

SEQ ID NO: 3496094 - DNA, 17 bp, Homo sapiens
catttaagagacagtca

SEQ ID NO: 3496095 - DNA, 23 bp, Homo sapiens
catttaagagacagtcaccccag

SEQ ID NO: 3496096 - DNA, 13 bp, Homo sapiens
catttaataatat

SEQ ID NO: 3496097 - DNA, 22 bp, Homo sapiens
catttaataatatacttgtgga

SEQ ID NO: 3496098 - DNA, 15 bp, Homo sapiens
catttaatttagata

SEQ ID NO: 3496099 - DNA, 17 bp, Homo sapiens
catttactttgtgttca

SEQ ID NO: 3496100 - DNA, 17 bp, Homo sapiens
catttagtttgattatt

SEQ ID NO: 3496101 - DNA, 20 bp, Homo sapiens
catttatacaaattagaaaa

SEQ ID NO: 3496102 - DNA, 12 bp, Homo sapiens
catttatagatc

SEQ ID NO: 3496103 - DNA, 18 bp, Homo sapiens
catttatgtgtcagttca

SEQ ID NO: 3496104 - DNA, 13 bp, Homo sapiens
catttattgttta

SEQ ID NO: 3496105 - DNA, 18 bp, Homo sapiens
catttattgtttatgtaa

SEQ ID NO: 3496106 - DNA, 17 bp, Homo sapiens
catttattttttacatt

SEQ ID NO: 3496107 - DNA, 19 bp, Homo sapiens
catttattttttacattat

SEQ ID NO: 3496108 - DNA, 15 bp, Homo sapiens
catttcaagtttact

SEQ ID NO: 3496109 - DNA, 18 bp, Homo sapiens
catttcaattcctggccc

SEQ ID NO: 3496110 - DNA, 15 bp, Homo sapiens
catttcaccatggcc

SEQ ID NO: 3496111 - DNA, 17 bp, Homo sapiens
catttccaaattcacaa

SEQ ID NO: 3496112 - DNA, 21 bp, Homo sapiens
catttccatgtcccctcccag

SEQ ID NO: 3496113 - DNA, 17 bp, Homo sapiens
catttcctatgtaactg

SEQ ID NO: 3496114 - DNA, 19 bp, Homo sapiens
catttcctatgtaactgca

SEQ ID NO: 3496115 - DNA, 20 bp, Homo sapiens
catttcctcagcttatctct

SEQ ID NO: 3496116 - DNA, 13 bp, Homo sapiens
catttcctgctga

SEQ ID NO: 3496117 - DNA, 15 bp, Homo sapiens
catttcggtggctag

SEQ ID NO: 3496118 - DNA, 21 bp, Homo sapiens
catttcggtggctagtcaagc

SEQ ID NO: 3496119 - DNA, 20 bp, Homo sapiens
catttcgtgagccccatctt

SEQ ID NO: 3496120 - DNA, 20 bp, Homo sapiens
ccagtgccgagaaggaagcc

SEQ ID NO: 3496121 - DNA, 16 bp, Homo sapiens
ccagtggaggtttgtc

SEQ ID NO: 3496122 - DNA, 15 bp, Homo sapiens
ccagtggctgctgcc

SEQ ID NO: 3496123 - DNA, 17 bp, Homo sapiens
ccagtggctgctgccca

SEQ ID NO: 3496124 - DNA, 16 bp, Homo sapiens
ccagtgggagatgtta

SEQ ID NO: 3496125 - DNA, 13 bp, Homo sapiens
ccagtggtctcac

SEQ ID NO: 3496126 - DNA, 16 bp, Homo sapiens
ccagtgtccttagaac

SEQ ID NO: 3496127 - DNA, 20 bp, Homo sapiens
ccagtgtgcacccctcccca

SEQ ID NO: 3496128 - DNA, 15 bp, Homo sapiens
ccagtgtgctgatgg

SEQ ID NO: 3496129 - DNA, 20 bp, Homo sapiens
ccagtgttagggaagggcct

SEQ ID NO: 3496130 - DNA, 21 bp, Homo sapiens
ccagttaacgtattagttgcc

SEQ ID NO: 3496131 - DNA, 21 bp, Homo sapiens
ccagttcatctatggcagtcc

SEQ ID NO: 3496132 - DNA, 18 bp, Homo sapiens
ccagttcgcctggagccc

SEQ ID NO: 3496133 - DNA, 19 bp, Homo sapiens
ccagttcgcctggagccct

SEQ ID NO: 3496134 - DNA, 20 bp, Homo sapiens
ccagttgggtggatgcctgg

SEQ ID NO: 3496135 - DNA, 17 bp, Homo sapiens
ccagtttaacctgatgc

SEQ ID NO: 3496136 - DNA, 19 bp, Homo sapiens
ccataaaacattaagaaaa

SEQ ID NO: 3496137 - DNA, 21 bp, Homo sapiens
ccataaagacaatcactgcca

SEQ ID NO: 3496138 - DNA, 20 bp, Homo sapiens
ccataatgatggatttaaca

SEQ ID NO: 3496139 - DNA, 19 bp, Homo sapiens
ccatacaccccctcttctg

SEQ ID NO: 3496140 - DNA, 21 bp, Homo sapiens
ccatagcaagattgcttaaaa

SEQ ID NO: 3496141 - DNA, 14 bp, Homo sapiens
ccatagccaggagc

SEQ ID NO: 3496142 - DNA, 15 bp, Homo sapiens
ccatagccaggagcg

SEQ ID NO: 3496143 - DNA, 22 bp, Homo sapiens
ccatagccaggagcgcatctca

SEQ ID NO: 3496144 - DNA, 15 bp, Homo sapiens
ccatagtaccattta

SEQ ID NO: 3496145 - DNA, 19 bp, Homo sapiens
ccatatcagaactgtgcca

SEQ ID NO: 3496146 - DNA, 16 bp, Homo sapiens
ccatcaaaatgctttt

SEQ ID NO: 3496147 - DNA, 12 bp, Homo sapiens
ccatcagtgctc

SEQ ID NO: 3496148 - DNA, 13 bp, Homo sapiens
ccatcatcctact

SEQ ID NO: 3496149 - DNA, 12 bp, Homo sapiens
ccatcatgtctg

SEQ ID NO: 3496150 - DNA, 18 bp, Homo sapiens
ccatcattgctgtctgca

SEQ ID NO: 3496151 - DNA, 17 bp, Homo sapiens
ccatccacatgggagcc

SEQ ID NO: 3496152 - DNA, 13 bp, Homo sapiens
ccatccagcttgc

SEQ ID NO: 3496153 - DNA, 16 bp, Homo sapiens
ccatccagcttgccag

SEQ ID NO: 3496154 - DNA, 22 bp, Homo sapiens
ccatcccccactgccacaccct

SEQ ID NO: 3496155 - DNA, 14 bp, Homo sapiens
ccatccccgcagtg

SEQ ID NO: 3496156 - DNA, 19 bp, Homo sapiens
ccatccctttttgaagtgt

SEQ ID NO: 3496157 - DNA, 18 bp, Homo sapiens
ccatcctcaaacactgca

SEQ ID NO: 3496158 - DNA, 13 bp, Homo sapiens
ccatcctccagca

SEQ ID NO: 3496159 - DNA, 20 bp, Homo sapiens
ccatctatgtcccttgctgt

SEQ ID NO: 3496160 - DNA, 14 bp, Homo sapiens
ccatctcaggccag

SEQ ID NO: 3496161 - DNA, 13 bp, Homo sapiens
ccatctcccccat

SEQ ID NO: 3496162 - DNA, 18 bp, Homo sapiens
ccatctcgctccctccca

SEQ ID NO: 3496163 - DNA, 22 bp, Homo sapiens
ccatctcgctccctcccaggac

SEQ ID NO: 3496164 - DNA, 14 bp, Homo sapiens
ccatctcttccttg

SEQ ID NO: 3496165 - DNA, 21 bp, Homo sapiens
ccatctggctgtgacagcctc

SEQ ID NO: 3496166 - DNA, 16 bp, Homo sapiens
ccatctgggctcctcc

SEQ ID NO: 3496167 - DNA, 19 bp, Homo sapiens
ccatctgtctaaagataga

SEQ ID NO: 3496168 - DNA, 18 bp, Homo sapiens
ccatctgtcttgccagcc

SEQ ID NO: 3496169 - DNA, 13 bp, Homo sapiens
ccatctgtgcatt

SEQ ID NO: 3496170 - DNA, 18 bp, Homo sapiens
ccatcttcgggaccagga

SEQ ID NO: 3496171 - DNA, 13 bp, Homo sapiens
ccatgaaacaaag

SEQ ID NO: 3496172 - DNA, 15 bp, Homo sapiens
ccatgaaccaagacc

SEQ ID NO: 3496173 - DNA, 21 bp, Homo sapiens
ccatgaatgaacccctggctc

SEQ ID NO: 3496174 - DNA, 22 bp, Homo sapiens
ccatgaatgaacccctggctcc

SEQ ID NO: 3496175 - DNA, 23 bp, Homo sapiens
ccatgaatgaacccctggctcct

SEQ ID NO: 3496176 - DNA, 13 bp, Homo sapiens
ccatgagcctcag

SEQ ID NO: 3496177 - DNA, 18 bp, Homo sapiens
ccatgagcctcagcatcc

SEQ ID NO: 3496178 - DNA, 16 bp, Homo sapiens
ccatgatctgcagggg

SEQ ID NO: 3496179 - DNA, 14 bp, Homo sapiens
ccatgatgcctctg

SEQ ID NO: 3496180 - DNA, 19 bp, Homo sapiens
ccatgatggcaacagatct

SEQ ID NO: 3496181 - DNA, 13 bp, Homo sapiens
ccatgatggccag

SEQ ID NO: 3496182 - DNA, 23 bp, Homo sapiens
ccatgattctatttatatgtaca

SEQ ID NO: 3496183 - DNA, 22 bp, Homo sapiens
ccatgcaagaactcatcactgt

SEQ ID NO: 3496184 - DNA, 17 bp, Homo sapiens
ccatgcactgtgaagga

SEQ ID NO: 3496185 - DNA, 19 bp, Homo sapiens
ccatgcactgtgaaggacc

SEQ ID NO: 3496186 - DNA, 21 bp, Homo sapiens
ccatgcactgtgaaggaccct

SEQ ID NO: 3496187 - DNA, 15 bp, Homo sapiens
ccatgcctcagccct

SEQ ID NO: 3496188 - DNA, 16 bp, Homo sapiens
ccatgcctcagccctg

SEQ ID NO: 3496189 - DNA, 16 bp, Homo sapiens
ccatgctcatctgctg

SEQ ID NO: 3496190 - DNA, 17 bp, Homo sapiens
ccatgctcatctgctgg

SEQ ID NO: 3496191 - DNA, 20 bp, Homo sapiens
ccatgctcatctgctggtcc

SEQ ID NO: 3496192 - DNA, 13 bp, Homo sapiens
ccatgctcctggc

SEQ ID NO: 3496193 - DNA, 20 bp, Homo sapiens
ccatgctgaggcctgggccg

SEQ ID NO: 3496194 - DNA, 19 bp, Homo sapiens
ccatgcttacgtgatcctc

SEQ ID NO: 3496195 - DNA, 19 bp, Homo sapiens
ccatggaactgtttccttc

SEQ ID NO: 3496196 - DNA, 23 bp, Homo sapiens
ccatggaagaggctacagggcca

SEQ ID NO: 3496197 - DNA, 18 bp, Homo sapiens
ccatggacaggctggctc

SEQ ID NO: 3496198 - DNA, 22 bp, Homo sapiens
ccatggagagctggagcctggt

SEQ ID NO: 3496199 - DNA, 17 bp, Homo sapiens
ccatggctctatttctt

SEQ ID NO: 3496200 - DNA, 13 bp, Homo sapiens
ccatgggcctcct

SEQ ID NO: 3496201 - DNA, 18 bp, Homo sapiens
ccatggggagggattctg

SEQ ID NO: 3496202 - DNA, 20 bp, Homo sapiens
ccatggggagggattctggt

SEQ ID NO: 3496203 - DNA, 17 bp, Homo sapiens
ccatgtactagttttag

SEQ ID NO: 3496204 - DNA, 15 bp, Homo sapiens
ccatgtagaaaattt

SEQ ID NO: 3496205 - DNA, 19 bp, Homo sapiens
ccatgtagaagctgcatct

SEQ ID NO: 3496206 - DNA, 19 bp, Homo sapiens
ccatgtattcacacacccc

SEQ ID NO: 3496207 - DNA, 22 bp, Homo sapiens
ccatgtcaccggatcctgggtg

SEQ ID NO: 3496208 - DNA, 13 bp, Homo sapiens
ccatgtcccctcc

SEQ ID NO: 3496209 - DNA, 13 bp, Homo sapiens
ccatgtctgcatt

SEQ ID NO: 3496210 - DNA, 14 bp, Homo sapiens
ccatgttggccagg

SEQ ID NO: 3496211 - DNA, 15 bp, Homo sapiens
ccatgttggccaggc

SEQ ID NO: 3496212 - DNA, 16 bp, Homo sapiens
ccatgttggccaggct

SEQ ID NO: 3496213 - DNA, 18 bp, Homo sapiens
ccatgttttgtttacggt

SEQ ID NO: 3496214 - DNA, 15 bp, Homo sapiens
ccattatgtcctagt

SEQ ID NO: 3496215 - DNA, 14 bp, Homo sapiens
ccattcagaatatc

SEQ ID NO: 3496216 - DNA, 20 bp, Homo sapiens
ccattcagaatatcatcttt

SEQ ID NO: 3496217 - DNA, 20 bp, Homo sapiens
ccattcagtgattactgtca

SEQ ID NO: 3496218 - DNA, 23 bp, Homo sapiens
ccattcccaagatgcctgatcag

SEQ ID NO: 3496219 - DNA, 13 bp, Homo sapiens
ccattcctgaaga

SEQ ID NO: 3496220 - DNA, 22 bp, Homo sapiens
ccattcctgggaaatattccct

SEQ ID NO: 3496221 - DNA, 12 bp, Homo sapiens
ccattctgactc

SEQ ID NO: 3496222 - DNA, 16 bp, Homo sapiens
ccattcttttgtaatt

SEQ ID NO: 3496223 - DNA, 22 bp, Homo sapiens
ccattgaattcttggttgagga

SEQ ID NO: 3496224 - DNA, 19 bp, Homo sapiens
ccattgcactccagcctgg

SEQ ID NO: 3496225 - DNA, 20 bp, Homo sapiens
ccattgctgttctacttttt

SEQ ID NO: 3496226 - DNA, 17 bp, Homo sapiens
ccattgtccctctgccc

SEQ ID NO: 3496227 - DNA, 19 bp, Homo sapiens
ccattgtccctctgcccca

SEQ ID NO: 3496228 - DNA, 11 bp, Homo sapiens
ccattgtttaa

SEQ ID NO: 3496229 - DNA, 22 bp, Homo sapiens
ccattgtttaaaaatacacatg

SEQ ID NO: 3496230 - DNA, 11 bp, Homo sapiens
ccatttatata

SEQ ID NO: 3496231 - DNA, 21 bp, Homo sapiens
ccatttcgtgagccccatctt

SEQ ID NO: 3496232 - DNA, 13 bp, Homo sapiens
ccatttctattta

SEQ ID NO: 3496233 - DNA, 17 bp, Homo sapiens
ccatttctatttattta

SEQ ID NO: 3496234 - DNA, 19 bp, Homo sapiens
ccatttggcagagcttctt

SEQ ID NO: 3496235 - DNA, 21 bp, Homo sapiens
ccatttgtaaaacattccaaa

SEQ ID NO: 3496236 - DNA, 14 bp, Homo sapiens
ccatttgtaatttg

SEQ ID NO: 3496237 - DNA, 14 bp, Homo sapiens
ccattttaagtccc

SEQ ID NO: 3496238 - DNA, 16 bp, Homo sapiens
ccattttaagtccctg

SEQ ID NO: 3496239 - DNA, 23 bp, Homo sapiens
ccattttaagtccctgtcacctc

SEQ ID NO: 3496240 - DNA, 16 bp, Homo sapiens
ccatttttcaaagcaa

SEQ ID NO: 3496241 - DNA, 17 bp, Homo sapiens
ccatttttcaaagcaat

SEQ ID NO: 3496242 - DNA, 21 bp, Homo sapiens
ccatttttgagccaagcttca

SEQ ID NO: 3496243 - DNA, 16 bp, Homo sapiens
cccaaaacctcatgac

SEQ ID NO: 3496244 - DNA, 18 bp, Homo sapiens
cccaaaatttattttata

SEQ ID NO: 3496245 - DNA, 20 bp, Homo sapiens
cccaaacaaatatgcaaaag

SEQ ID NO: 3496246 - DNA, 22 bp, Homo sapiens
cccaaacgccctttcctcctca

SEQ ID NO: 3496247 - DNA, 23 bp, Homo sapiens
cccaaacgccctttcctcctcag

SEQ ID NO: 3496248 - DNA, 23 bp, Homo sapiens
cccaaaggatactgtaacacttt

SEQ ID NO: 3496249 - DNA, 23 bp, Homo sapiens
cccaaatccgaacctcctctgtg

SEQ ID NO: 3496250 - DNA, 18 bp, Homo sapiens
cccaaatgctctctcttc

SEQ ID NO: 3496251 - DNA, 17 bp, Homo sapiens
cccaacaaaccatccag

SEQ ID NO: 3496252 - DNA, 18 bp, Homo sapiens
ccggactggtgccctcct

SEQ ID NO: 3496253 - DNA, 15 bp, Homo sapiens
ccggacttttctgca

SEQ ID NO: 3496254 - DNA, 12 bp, Homo sapiens
ccggagaggaag

SEQ ID NO: 3496255 - DNA, 20 bp, Homo sapiens
ccggagaggaagagacactc

SEQ ID NO: 3496256 - DNA, 18 bp, Homo sapiens
ccggagctgcccctctct

SEQ ID NO: 3496257 - DNA, 19 bp, Homo sapiens
ccggaggatattaaaatgc

SEQ ID NO: 3496258 - DNA, 14 bp, Homo sapiens
ccggaggccagcta

SEQ ID NO: 3496259 - DNA, 12 bp, Homo sapiens
ccggcacagctg

SEQ ID NO: 3496260 - DNA, 13 bp, Homo sapiens
ccggcacagctgg

SEQ ID NO: 3496261 - DNA, 16 bp, Homo sapiens
ccggcagccccagcct

SEQ ID NO: 3496262 - DNA, 16 bp, Homo sapiens
ccggcagggcgggcag

SEQ ID NO: 3496263 - DNA, 18 bp, Homo sapiens
ccggcagggtcctagaaa

SEQ ID NO: 3496264 - DNA, 22 bp, Homo sapiens
ccggcagttctgggtgctccct

SEQ ID NO: 3496265 - DNA, 15 bp, Homo sapiens
ccggccagccatgtc

SEQ ID NO: 3496266 - DNA, 17 bp, Homo sapiens
ccggcccctccccctga

SEQ ID NO: 3496267 - DNA, 15 bp, Homo sapiens
ccggcccctgctggt

SEQ ID NO: 3496268 - DNA, 12 bp, Homo sapiens
ccggccctgggg

SEQ ID NO: 3496269 - DNA, 12 bp, Homo sapiens
ccggctccaggc

SEQ ID NO: 3496270 - DNA, 13 bp, Homo sapiens
ccggctcccagcc

SEQ ID NO: 3496271 - DNA, 14 bp, Homo sapiens
ccggctcccagcct

SEQ ID NO: 3496272 - DNA, 15 bp, Homo sapiens
ccggctgtgctggga

SEQ ID NO: 3496273 - DNA, 17 bp, Homo sapiens
ccggctgtgctgggaga

SEQ ID NO: 3496274 - DNA, 17 bp, Homo sapiens
ccgggaacctccccagc

SEQ ID NO: 3496275 - DNA, 19 bp, Homo sapiens
ccgggaacctccccagcct

SEQ ID NO: 3496276 - DNA, 22 bp, Homo sapiens
ccgggaacctccccagcctgcg

SEQ ID NO: 3496277 - DNA, 14 bp, Homo sapiens
ccgggagctggcgg

SEQ ID NO: 3496278 - DNA, 20 bp, Homo sapiens
ccgggcactcagaagacact

SEQ ID NO: 3496279 - DNA, 14 bp, Homo sapiens
ccgggcctcagtgc

SEQ ID NO: 3496280 - DNA, 20 bp, Homo sapiens
ccgggcgcggtggctcacgc

SEQ ID NO: 3496281 - DNA, 15 bp, Homo sapiens
ccgggctgagggcct

SEQ ID NO: 3496282 - DNA, 21 bp, Homo sapiens
ccgggctgagggcctgctgga

SEQ ID NO: 3496283 - DNA, 15 bp, Homo sapiens
ccggggccagcactt

SEQ ID NO: 3496284 - DNA, 11 bp, Homo sapiens
ccggggctgag

SEQ ID NO: 3496285 - DNA, 20 bp, Homo sapiens
ccggggtgcccacaggccgc

SEQ ID NO: 3496286 - DNA, 15 bp, Homo sapiens
ccgggtccccagctc

SEQ ID NO: 3496287 - DNA, 16 bp, Homo sapiens
ccgggtccccagctcc

SEQ ID NO: 3496288 - DNA, 17 bp, Homo sapiens
ccgggtccccagctccc

SEQ ID NO: 3496289 - DNA, 23 bp, Homo sapiens
ccggtctatgtcgagagctggcc

SEQ ID NO: 3496290 - DNA, 20 bp, Homo sapiens
ccgtatctccggctcccagc

SEQ ID NO: 3496291 - DNA, 22 bp, Homo sapiens
ccgtatctccggctcccagcct

SEQ ID NO: 3496292 - DNA, 14 bp, Homo sapiens
ccgtcaacgttgta

SEQ ID NO: 3496293 - DNA, 17 bp, Homo sapiens
ccgtcaacgttgtactg

SEQ ID NO: 3496294 - DNA, 19 bp, Homo sapiens
ccgtcaccacgactggcca

SEQ ID NO: 3496295 - DNA, 12 bp, Homo sapiens
ccgtcagtgctg

SEQ ID NO: 3496296 - DNA, 18 bp, Homo sapiens
ccgtccatatcagaactg

SEQ ID NO: 3496297 - DNA, 21 bp, Homo sapiens
ccgtccatatcagaactgtgc

SEQ ID NO: 3496298 - DNA, 16 bp, Homo sapiens
ccgtcctgcctgtggc

SEQ ID NO: 3496299 - DNA, 16 bp, Homo sapiens
ccgtgctcgccccagc

SEQ ID NO: 3496300 - DNA, 17 bp, Homo sapiens
ccgtgctgacagctgct

SEQ ID NO: 3496301 - DNA, 23 bp, Homo sapiens
ccgtggcatcaccttaggcaggg

SEQ ID NO: 3496302 - DNA, 20 bp, Homo sapiens
ccgtggggccgccgcctctt

SEQ ID NO: 3496303 - DNA, 15 bp, Homo sapiens
ccgtggtatgtctgc

SEQ ID NO: 3496304 - DNA, 18 bp, Homo sapiens
ccgtggtatgtctgccat

SEQ ID NO: 3496305 - DNA, 13 bp, Homo sapiens
ccgtggtccctga

SEQ ID NO: 3496306 - DNA, 14 bp, Homo sapiens
ccgtggtccctgag

SEQ ID NO: 3496307 - DNA, 13 bp, Homo sapiens
ccgttagctcctg

SEQ ID NO: 3496308 - DNA, 14 bp, Homo sapiens
ccgttagctcctgt

SEQ ID NO: 3496309 - DNA, 17 bp, Homo sapiens
ccgttagctcctgtggc

SEQ ID NO: 3496310 - DNA, 18 bp, Homo sapiens
ccgtttgaccaatttgca

SEQ ID NO: 3496311 - DNA, 14 bp, Homo sapiens
cctaaaaagagaag

SEQ ID NO: 3496312 - DNA, 13 bp, Homo sapiens
cctaaaacaaaag

SEQ ID NO: 3496313 - DNA, 12 bp, Homo sapiens
cctaaaacaaat

SEQ ID NO: 3496314 - DNA, 23 bp, Homo sapiens
cctaaaaggaaatctcaccccat

SEQ ID NO: 3496315 - DNA, 22 bp, Homo sapiens
cctaaaagtgggcttgattctg

SEQ ID NO: 3496316 - DNA, 14 bp, Homo sapiens
cctaaactccaggg

SEQ ID NO: 3496317 - DNA, 14 bp, Homo sapiens
cctaagaagctctg

SEQ ID NO: 3496318 - DNA, 23 bp, Homo sapiens
cctaagacctggggttgtcagct

SEQ ID NO: 3496319 - DNA, 21 bp, Homo sapiens
cctaagatctcggtttgccaa

SEQ ID NO: 3496320 - DNA, 15 bp, Homo sapiens
cctaagcctgtggct

SEQ ID NO: 3496321 - DNA, 23 bp, Homo sapiens
cctaagcttctagaggctcatgg

SEQ ID NO: 3496322 - DNA, 12 bp, Homo sapiens
cctaaggctgca

SEQ ID NO: 3496323 - DNA, 16 bp, Homo sapiens
cctaataaagttctgt

SEQ ID NO: 3496324 - DNA, 17 bp, Homo sapiens
cctaatatcaaatgcag

SEQ ID NO: 3496325 - DNA, 13 bp, Homo sapiens
cctaatccaggca

SEQ ID NO: 3496326 - DNA, 18 bp, Homo sapiens
cctaatccaggcagatcc

SEQ ID NO: 3496327 - DNA, 20 bp, Homo sapiens
cctaatccaggcagatccag

SEQ ID NO: 3496328 - DNA, 19 bp, Homo sapiens
cctaatgctccttgttcct

SEQ ID NO: 3496329 - DNA, 12 bp, Homo sapiens
cctaattcagcc

SEQ ID NO: 3496330 - DNA, 14 bp, Homo sapiens
cctacatccccagg

SEQ ID NO: 3496331 - DNA, 20 bp, Homo sapiens
cctacatccccaggtctctc

SEQ ID NO: 3496332 - DNA, 14 bp, Homo sapiens
cctacatgttattc

SEQ ID NO: 3496333 - DNA, 18 bp, Homo sapiens
cctaccacctccccagcc

SEQ ID NO: 3496334 - DNA, 20 bp, Homo sapiens
cctaccccgcagacaccttg

SEQ ID NO: 3496335 - DNA, 21 bp, Homo sapiens
cctaccccgcagacaccttgg

SEQ ID NO: 3496336 - DNA, 15 bp, Homo sapiens
cctaccctgcctccc

SEQ ID NO: 3496337 - DNA, 13 bp, Homo sapiens
cctaccttgcttt

SEQ ID NO: 3496338 - DNA, 18 bp, Homo sapiens
cctactccagtatgacag

SEQ ID NO: 3496339 - DNA, 13 bp, Homo sapiens
cctactgcccagg

SEQ ID NO: 3496340 - DNA, 16 bp, Homo sapiens
cctactgcccaggcac

SEQ ID NO: 3496341 - DNA, 12 bp, Homo sapiens
cctactgctgtg

SEQ ID NO: 3496342 - DNA, 22 bp, Homo sapiens
cctacttacccaggtgggtccc

SEQ ID NO: 3496343 - DNA, 21 bp, Homo sapiens
cctagaaattccccaccctga

SEQ ID NO: 3496344 - DNA, 23 bp, Homo sapiens
cctagactcggggtgcttccttg

SEQ ID NO: 3496345 - DNA, 18 bp, Homo sapiens
cctagagcttttttataa

SEQ ID NO: 3496346 - DNA, 17 bp, Homo sapiens
cctagaggccctttgct

SEQ ID NO: 3496347 - DNA, 13 bp, Homo sapiens
cctagagggaggg

SEQ ID NO: 3496348 - DNA, 15 bp, Homo sapiens
cctagagggaggggc

SEQ ID NO: 3496349 - DNA, 17 bp, Homo sapiens
cctagagggaggggcct

SEQ ID NO: 3496350 - DNA, 18 bp, Homo sapiens
cctagagggaggggccta

SEQ ID NO: 3496351 - DNA, 23 bp, Homo sapiens
cctagcagcaccgttctgtgcac

SEQ ID NO: 3496352 - DNA, 13 bp, Homo sapiens
cctagcaggcaca

SEQ ID NO: 3496353 - DNA, 19 bp, Homo sapiens
cctagccttagaagtcaca

SEQ ID NO: 3496354 - DNA, 13 bp, Homo sapiens
cctaggacctatg

SEQ ID NO: 3496355 - DNA, 21 bp, Homo sapiens
cctaggacctatgttgtaatt

SEQ ID NO: 3496356 - DNA, 23 bp, Homo sapiens
cctaggcaggacatgctgaagcc

SEQ ID NO: 3496357 - DNA, 19 bp, Homo sapiens
cctaggcagtaggccggtg

SEQ ID NO: 3496358 - DNA, 22 bp, Homo sapiens
cctaggcagtaggccggtgtgc

SEQ ID NO: 3496359 - DNA, 18 bp, Homo sapiens
cctagggaacagaaattg

SEQ ID NO: 3496360 - DNA, 17 bp, Homo sapiens
cctagggccactgaaga

SEQ ID NO: 3496361 - DNA, 13 bp, Homo sapiens
cctaggtgacaga

SEQ ID NO: 3496362 - DNA, 20 bp, Homo sapiens
cctaggtgcagctcctcagc

SEQ ID NO: 3496363 - DNA, 21 bp, Homo sapiens
cctaggtgcagctcctcagcg

SEQ ID NO: 3496364 - DNA, 19 bp, Homo sapiens
cctagtgaaggcttctctc

SEQ ID NO: 3496365 - DNA, 23 bp, Homo sapiens
cctagtgaaggcttctctctgtg

SEQ ID NO: 3496366 - DNA, 16 bp, Homo sapiens
cctagtggcttgtcct

SEQ ID NO: 3496367 - DNA, 18 bp, Homo sapiens
cctagttctgtagaaatg

SEQ ID NO: 3496368 - DNA, 16 bp, Homo sapiens
cctagttttctttcct

SEQ ID NO: 3496369 - DNA, 20 bp, Homo sapiens
cctataaaacaggtcaatac

SEQ ID NO: 3496370 - DNA, 23 bp, Homo sapiens
cctataaaacaggtcaatacagt

SEQ ID NO: 3496371 - DNA, 22 bp, Homo sapiens
cctatacgcagcgtgctttaaa

SEQ ID NO: 3496372 - DNA, 22 bp, Homo sapiens
cctatatgcttactgtgcacct

SEQ ID NO: 3496373 - DNA, 17 bp, Homo sapiens
cctatcacctatttcca

SEQ ID NO: 3496374 - DNA, 13 bp, Homo sapiens
cctatcctgctgt

SEQ ID NO: 3496375 - DNA, 13 bp, Homo sapiens
cctatgacacagt

SEQ ID NO: 3496376 - DNA, 16 bp, Homo sapiens
cctatgacacagttat

SEQ ID NO: 3496377 - DNA, 15 bp, Homo sapiens
cctatggctgcctgc

SEQ ID NO: 3496378 - DNA, 16 bp, Homo sapiens
cctatgtagtccgtgc

SEQ ID NO: 3496379 - DNA, 21 bp, Homo sapiens
cctatgttgtaattttacttt

SEQ ID NO: 3496380 - DNA, 16 bp, Homo sapiens
cctattgcttgggtct

SEQ ID NO: 3496381 - DNA, 21 bp, Homo sapiens
cctattgcttgggtctctctc

SEQ ID NO: 3496382 - DNA, 23 bp, Homo sapiens
cctatttcagtgttacctgtgtg

SEQ ID NO: 3496383 - DNA, 12 bp, Homo sapiens
cctatttgtgtg

SEQ ID NO: 3496384 - DNA, 19 bp, Homo sapiens
cctatttttctctcctgtc

SEQ ID NO: 3496385 - DNA, 21 bp, Homo sapiens
cctggtggttgctgttttcct

SEQ ID NO: 3496386 - DNA, 21 bp, Homo sapiens
cctggtttcataacttcctgt

SEQ ID NO: 3496387 - DNA, 16 bp, Homo sapiens
cctgtaacctcttcag

SEQ ID NO: 3496388 - DNA, 14 bp, Homo sapiens
cctgtacagtagat

SEQ ID NO: 3496389 - DNA, 12 bp, Homo sapiens
cctgtagcccac

SEQ ID NO: 3496390 - DNA, 23 bp, Homo sapiens
cctgtagcccactctgctcgcct

SEQ ID NO: 3496391 - DNA, 14 bp, Homo sapiens
cctgtagttaggcc

SEQ ID NO: 3496392 - DNA, 19 bp, Homo sapiens
cctgtagttaggcctggct

SEQ ID NO: 3496393 - DNA, 18 bp, Homo sapiens
cctgtataagtggaggca

SEQ ID NO: 3496394 - DNA, 23 bp, Homo sapiens
cctgtataagtggaggcacttta

SEQ ID NO: 3496395 - DNA, 13 bp, Homo sapiens
cctgtatatagcc

SEQ ID NO: 3496396 - DNA, 15 bp, Homo sapiens
cctgtatgtctgtca

SEQ ID NO: 3496397 - DNA, 18 bp, Homo sapiens
cctgtcaaacaaagccag

SEQ ID NO: 3496398 - DNA, 20 bp, Homo sapiens
cctgtcaaacaaagccagaa

SEQ ID NO: 3496399 - DNA, 18 bp, Homo sapiens
cctgtcaccctgcaggac

SEQ ID NO: 3496400 - DNA, 14 bp, Homo sapiens
cctgtcacctcttc

SEQ ID NO: 3496401 - DNA, 17 bp, Homo sapiens
cctgtcacctcttccga

SEQ ID NO: 3496402 - DNA, 13 bp, Homo sapiens
cctgtccagctcc

SEQ ID NO: 3496403 - DNA, 22 bp, Homo sapiens
cctgtcctgaaagcggctgcct

SEQ ID NO: 3496404 - DNA, 14 bp, Homo sapiens
cctgtctcagcctc

SEQ ID NO: 3496405 - DNA, 12 bp, Homo sapiens
cctgtctgcccc

SEQ ID NO: 3496406 - DNA, 14 bp, Homo sapiens
cctgtctgccccag

SEQ ID NO: 3496407 - DNA, 19 bp, Homo sapiens
cctgtctgccccagcccag

SEQ ID NO: 3496408 - DNA, 22 bp, Homo sapiens
cctgtctgtgacctgcatctaa

SEQ ID NO: 3496409 - DNA, 18 bp, Homo sapiens
cctgtcttcctctgcaag

SEQ ID NO: 3496410 - DNA, 16 bp, Homo sapiens
cctgtgaatgccactg

SEQ ID NO: 3496411 - DNA, 22 bp, Homo sapiens
cctgtgaatgccactgccttcg

SEQ ID NO: 3496412 - DNA, 17 bp, Homo sapiens
cctgtgagcccagctgg

SEQ ID NO: 3496413 - DNA, 21 bp, Homo sapiens
cctgtgaggagccccatctgt

SEQ ID NO: 3496414 - DNA, 19 bp, Homo sapiens
cctgtgccctccttcccaa

SEQ ID NO: 3496415 - DNA, 16 bp, Homo sapiens
cctgtgcctccatcag

SEQ ID NO: 3496416 - DNA, 16 bp, Homo sapiens
cctgtgctcatcctct

SEQ ID NO: 3496417 - DNA, 22 bp, Homo sapiens
cctgtgcttcgggcccttccca

SEQ ID NO: 3496418 - DNA, 20 bp, Homo sapiens
cctgtggatgataaaacaca

SEQ ID NO: 3496419 - DNA, 18 bp, Homo sapiens
cctgtggccctgtcctgc

SEQ ID NO: 3496420 - DNA, 21 bp, Homo sapiens
cctgtggccctgtcctgccat

SEQ ID NO: 3496421 - DNA, 21 bp, Homo sapiens
cctgtggggtcaacccttctg

SEQ ID NO: 3496422 - DNA, 16 bp, Homo sapiens
cctgtgtcaatccaga

SEQ ID NO: 3496423 - DNA, 23 bp, Homo sapiens
cctgtgtcttctccaccacgctg

SEQ ID NO: 3496424 - DNA, 17 bp, Homo sapiens
cctgtgtcttgcaatgg

SEQ ID NO: 3496425 - DNA, 22 bp, Homo sapiens
cctgtgtcttgcaatggcagcc

SEQ ID NO: 3496426 - DNA, 20 bp, Homo sapiens
cctgtgtctttttcgccaaa

SEQ ID NO: 3496427 - DNA, 19 bp, Homo sapiens
cctgtgtgattgacagctt

SEQ ID NO: 3496428 - DNA, 22 bp, Homo sapiens
cctgtgtgattgacagctttgc

SEQ ID NO: 3496429 - DNA, 15 bp, Homo sapiens
cctgtgtggccactt

SEQ ID NO: 3496430 - DNA, 13 bp, Homo sapiens
cctgtgtttctag

SEQ ID NO: 3496431 - DNA, 16 bp, Homo sapiens
cctgttagcagacagg

SEQ ID NO: 3496432 - DNA, 14 bp, Homo sapiens
cctgttcctggagg

SEQ ID NO: 3496433 - DNA, 12 bp, Homo sapiens
cctgttctgaaa

SEQ ID NO: 3496434 - DNA, 21 bp, Homo sapiens
cctgttgaattttgttctctg

SEQ ID NO: 3496435 - DNA, 17 bp, Homo sapiens
cctgttgacacaggtct

SEQ ID NO: 3496436 - DNA, 15 bp, Homo sapiens
cctgtttctacctat

SEQ ID NO: 3496437 - DNA, 13 bp, Homo sapiens
cctgtttctctgc

SEQ ID NO: 3496438 - DNA, 19 bp, Homo sapiens
cctgtttttaagctgtttc

SEQ ID NO: 3496439 - DNA, 23 bp, Homo sapiens
cctgtttttgtttcttgttttga

SEQ ID NO: 3496440 - DNA, 14 bp, Homo sapiens
cctgttttttttct

SEQ ID NO: 3496441 - DNA, 16 bp, Homo sapiens
ccttaagccctggccc

SEQ ID NO: 3496442 - DNA, 16 bp, Homo sapiens
ccttaatcttgctttc

SEQ ID NO: 3496443 - DNA, 17 bp, Homo sapiens
ccttaatgaagagccag

SEQ ID NO: 3496444 - DNA, 19 bp, Homo sapiens
ccttacacccatgactgag

SEQ ID NO: 3496445 - DNA, 20 bp, Homo sapiens
ccttacctcggtgccttcct

SEQ ID NO: 3496446 - DNA, 19 bp, Homo sapiens
ccttactatgatctcagga

SEQ ID NO: 3496447 - DNA, 18 bp, Homo sapiens
ccttagaagtcacacagt

SEQ ID NO: 3496448 - DNA, 14 bp, Homo sapiens
ccttagatctggca

SEQ ID NO: 3496449 - DNA, 20 bp, Homo sapiens
ccttagcactaccactcctg

SEQ ID NO: 3496450 - DNA, 12 bp, Homo sapiens
ccttagcttcag

SEQ ID NO: 3496451 - DNA, 17 bp, Homo sapiens
ccttagcttcaggaacc

SEQ ID NO: 3496452 - DNA, 16 bp, Homo sapiens
ccttaggcagggaagt

SEQ ID NO: 3496453 - DNA, 18 bp, Homo sapiens
ccttagttatcagtcctg

SEQ ID NO: 3496454 - DNA, 16 bp, Homo sapiens
ccttagtttcaagagt

SEQ ID NO: 3496455 - DNA, 16 bp, Homo sapiens
ccttatagtttgggct

SEQ ID NO: 3496456 - DNA, 19 bp, Homo sapiens
ccttatagtttgggcttca

SEQ ID NO: 3496457 - DNA, 20 bp, Homo sapiens
ccttatcacccccttgttgt

SEQ ID NO: 3496458 - DNA, 21 bp, Homo sapiens
ccttatcacccccttgttgta

SEQ ID NO: 3496459 - DNA, 20 bp, Homo sapiens
ccttatccttcctctccttc

SEQ ID NO: 3496460 - DNA, 15 bp, Homo sapiens
ccttatctgtgctca

SEQ ID NO: 3496461 - DNA, 17 bp, Homo sapiens
ccttcacagatgcctac

SEQ ID NO: 3496462 - DNA, 22 bp, Homo sapiens
ccttcacagatgcctacttttg

SEQ ID NO: 3496463 - DNA, 23 bp, Homo sapiens
ccttcagacacatgctatgttct

SEQ ID NO: 3496464 - DNA, 18 bp, Homo sapiens
ccttcagccctcacccct

SEQ ID NO: 3496465 - DNA, 16 bp, Homo sapiens
ccttcagtaaccccca

SEQ ID NO: 3496466 - DNA, 12 bp, Homo sapiens
ccttcagtttat

SEQ ID NO: 3496467 - DNA, 15 bp, Homo sapiens
ccttcatcttcctgt

SEQ ID NO: 3496468 - DNA, 18 bp, Homo sapiens
ccttcatcttcctgtgtc

SEQ ID NO: 3496469 - DNA, 20 bp, Homo sapiens
ccttcatcttcctgtgtcct

SEQ ID NO: 3496470 - DNA, 22 bp, Homo sapiens
ccttcattgatttcctgtgtca

SEQ ID NO: 3496471 - DNA, 17 bp, Homo sapiens
ccttccactgagggcag

SEQ ID NO: 3496472 - DNA, 14 bp, Homo sapiens
ccttccagaaaaca

SEQ ID NO: 3496473 - DNA, 10 bp, Homo sapiens
ccttccagat

SEQ ID NO: 3496474 - DNA, 12 bp, Homo sapiens
ccttccagatcc

SEQ ID NO: 3496475 - DNA, 19 bp, Homo sapiens
ccttccagatcctctctgg

SEQ ID NO: 3496476 - DNA, 21 bp, Homo sapiens
ccttcccaatcttctttttca

SEQ ID NO: 3496477 - DNA, 21 bp, Homo sapiens
ccttcccgccggaggccagct

SEQ ID NO: 3496478 - DNA, 23 bp, Homo sapiens
ccttccctcaccttggcaccaga

SEQ ID NO: 3496479 - DNA, 17 bp, Homo sapiens
ccttccctgtgtctttt

SEQ ID NO: 3496480 - DNA, 17 bp, Homo sapiens
ccttcctgttctgaact

SEQ ID NO: 3496481 - DNA, 14 bp, Homo sapiens
ccttcgaaaggcct

SEQ ID NO: 3496482 - DNA, 13 bp, Homo sapiens
ccttcgctcctgt

SEQ ID NO: 3496483 - DNA, 17 bp, Homo sapiens
ccttcgcttcttgcctc

SEQ ID NO: 3496484 - DNA, 18 bp, Homo sapiens
ccttcgcttcttgcctct

SEQ ID NO: 3496485 - DNA, 16 bp, Homo sapiens
ccttcgggctgtgccc

SEQ ID NO: 3496486 - DNA, 14 bp, Homo sapiens
ccttctaaaggtgt

SEQ ID NO: 3496487 - DNA, 22 bp, Homo sapiens
ccttctaaaggtgttgtccctt

SEQ ID NO: 3496488 - DNA, 12 bp, Homo sapiens
ccttctcaccag

SEQ ID NO: 3496489 - DNA, 14 bp, Homo sapiens
ccttctcaccagct

SEQ ID NO: 3496490 - DNA, 15 bp, Homo sapiens
ccttctcaccagctg

SEQ ID NO: 3496491 - DNA, 18 bp, Homo sapiens
ccttctcaccagctgcaa

SEQ ID NO: 3496492 - DNA, 20 bp, Homo sapiens
ccttctcaccagctgcaaag

SEQ ID NO: 3496493 - DNA, 22 bp, Homo sapiens
ccttctcaccagctgcaaagtg

SEQ ID NO: 3496494 - DNA, 14 bp, Homo sapiens
ccttctcagaatct

SEQ ID NO: 3496495 - DNA, 16 bp, Homo sapiens
ccttctccatccacat

SEQ ID NO: 3496496 - DNA, 19 bp, Homo sapiens
ccttctccatggccctgcc

SEQ ID NO: 3496497 - DNA, 18 bp, Homo sapiens
ccttctcccctcttctga

SEQ ID NO: 3496498 - DNA, 21 bp, Homo sapiens
ccttctcccctcttctgagct

SEQ ID NO: 3496499 - DNA, 15 bp, Homo sapiens
ccttctctcatctct

SEQ ID NO: 3496500 - DNA, 14 bp, Homo sapiens
ccttctctgaagga

SEQ ID NO: 3496501 - DNA, 16 bp, Homo sapiens
ccttctctgaaggaca

SEQ ID NO: 3496502 - DNA, 17 bp, Homo sapiens
ccttctgcctttgatgt

SEQ ID NO: 3496503 - DNA, 17 bp, Homo sapiens
ccttctgctcagctctg

SEQ ID NO: 3496504 - DNA, 18 bp, Homo sapiens
ccttctggcctcccacag

SEQ ID NO: 3496505 - DNA, 20 bp, Homo sapiens
ccttctgtcctactctgtgt

SEQ ID NO: 3496506 - DNA, 14 bp, Homo sapiens
ccttctgtggggac

SEQ ID NO: 3496507 - DNA, 20 bp, Homo sapiens
ccttctgtggggactccggc

SEQ ID NO: 3496508 - DNA, 22 bp, Homo sapiens
ccttcttaagatacaaatggtg

SEQ ID NO: 3496509 - DNA, 19 bp, Homo sapiens
ccttctttgggatagagaa

SEQ ID NO: 3496510 - DNA, 19 bp, Homo sapiens
ccttgaaaaacaagtcttt

SEQ ID NO: 3496511 - DNA, 21 bp, Homo sapiens
ccttgaaaataagaatagaaa

SEQ ID NO: 3496512 - DNA, 16 bp, Homo sapiens
ccttgaactgggtact

SEQ ID NO: 3496513 - DNA, 18 bp, Homo sapiens
ccttgaagaacctctcac

SEQ ID NO: 3496514 - DNA, 22 bp, Homo sapiens
ccttgaagaactgcaggccctg

SEQ ID NO: 3496515 - DNA, 13 bp, Homo sapiens
ccttgaataataa

SEQ ID NO: 3496516 - DNA, 12 bp, Homo sapiens
ccttgaatgtgg

SEQ ID NO: 3496517 - DNA, 16 bp, Homo sapiens
ctactgttgcaaagct

SEQ ID NO: 3496518 - DNA, 19 bp, Homo sapiens
ctacttcaggaacaccccc

SEQ ID NO: 3496519 - DNA, 12 bp, Homo sapiens
ctacttgggagg

SEQ ID NO: 3496520 - DNA, 15 bp, Homo sapiens
ctactttgattctga

SEQ ID NO: 3496521 - DNA, 16 bp, Homo sapiens
ctactttgattctgat

SEQ ID NO: 3496522 - DNA, 22 bp, Homo sapiens
ctactttgtcctttttgttatt

SEQ ID NO: 3496523 - DNA, 21 bp, Homo sapiens
ctactttttgaacttttcatt

SEQ ID NO: 3496524 - DNA, 13 bp, Homo sapiens
ctagaagtgccat

SEQ ID NO: 3496525 - DNA, 18 bp, Homo sapiens
ctagaagtgccatctcaa

SEQ ID NO: 3496526 - DNA, 16 bp, Homo sapiens
ctagaataatcttgct

SEQ ID NO: 3496527 - DNA, 12 bp, Homo sapiens
ctagaatttatt

SEQ ID NO: 3496528 - DNA, 23 bp, Homo sapiens
ctagaatttattcaattcctctg

SEQ ID NO: 3496529 - DNA, 13 bp, Homo sapiens
ctagacaagccag

SEQ ID NO: 3496530 - DNA, 18 bp, Homo sapiens
ctagactttaggctttca

SEQ ID NO: 3496531 - DNA, 19 bp, Homo sapiens
ctagagaatgttagaggat

SEQ ID NO: 3496532 - DNA, 13 bp, Homo sapiens
ctagagacaacaa

SEQ ID NO: 3496533 - DNA, 17 bp, Homo sapiens
ctagagacgctgatcca

SEQ ID NO: 3496534 - DNA, 14 bp, Homo sapiens
ctagagcactgcca

SEQ ID NO: 3496535 - DNA, 15 bp, Homo sapiens
ctagagcactgccac

SEQ ID NO: 3496536 - DNA, 19 bp, Homo sapiens
ctagagcttttttataaca

SEQ ID NO: 3496537 - DNA, 21 bp, Homo sapiens
ctagaggctcatggccctgta

SEQ ID NO: 3496538 - DNA, 14 bp, Homo sapiens
ctagagggacctct

SEQ ID NO: 3496539 - DNA, 16 bp, Homo sapiens
ctagagggacctctcc

SEQ ID NO: 3496540 - DNA, 17 bp, Homo sapiens
ctagagggacctctccc

SEQ ID NO: 3496541 - DNA, 19 bp, Homo sapiens
ctagagggacctctcccag

SEQ ID NO: 3496542 - DNA, 21 bp, Homo sapiens
ctagagggacctctcccaggg

SEQ ID NO: 3496543 - DNA, 19 bp, Homo sapiens
ctagagggaggggcctagg

SEQ ID NO: 3496544 - DNA, 21 bp, Homo sapiens
ctagaggttctgggttttctg

SEQ ID NO: 3496545 - DNA, 17 bp, Homo sapiens
ctagatacctaaaacat

SEQ ID NO: 3496546 - DNA, 15 bp, Homo sapiens
ctagatcaaggagcc

SEQ ID NO: 3496547 - DNA, 20 bp, Homo sapiens
ctagatcaaggagcccagaa

SEQ ID NO: 3496548 - DNA, 16 bp, Homo sapiens
ctagatggcagtcact

SEQ ID NO: 3496549 - DNA, 14 bp, Homo sapiens
ctagatggctcctc

SEQ ID NO: 3496550 - DNA, 15 bp, Homo sapiens
ctagatggtgctgag

SEQ ID NO: 3496551 - DNA, 19 bp, Homo sapiens
ctagatggtgctgagaagc

SEQ ID NO: 3496552 - DNA, 13 bp, Homo sapiens
ctagattttcact

SEQ ID NO: 3496553 - DNA, 20 bp, Homo sapiens
ctagcacatgcttcaatagt

SEQ ID NO: 3496554 - DNA, 19 bp, Homo sapiens
ctagcagcaccgttctgtg

SEQ ID NO: 3496555 - DNA, 21 bp, Homo sapiens
ctagcagcaccgttctgtgca

SEQ ID NO: 3496556 - DNA, 22 bp, Homo sapiens
ctagcagcaccgttctgtgcac

SEQ ID NO: 3496557 - DNA, 22 bp, Homo sapiens
ctagcagcagggagggcttctg

SEQ ID NO: 3496558 - DNA, 19 bp, Homo sapiens
ctagcagctgcagtcaaca

SEQ ID NO: 3496559 - DNA, 18 bp, Homo sapiens
ctagcatatctgccttta

SEQ ID NO: 3496560 - DNA, 14 bp, Homo sapiens
ctagccctctccct

SEQ ID NO: 3496561 - DNA, 16 bp, Homo sapiens
ctagccctgcggagcc

SEQ ID NO: 3496562 - DNA, 13 bp, Homo sapiens
ctagccctgggac

SEQ ID NO: 3496563 - DNA, 15 bp, Homo sapiens
ctagccggttcctgt

SEQ ID NO: 3496564 - DNA, 19 bp, Homo sapiens
ctagccggttcctgtccct

SEQ ID NO: 3496565 - DNA, 20 bp, Homo sapiens
ctagcctaggtcataaagag

SEQ ID NO: 3496566 - DNA, 12 bp, Homo sapiens
ctagctagctca

SEQ ID NO: 3496567 - DNA, 23 bp, Homo sapiens
ctagctctatgtttacaaatgga

SEQ ID NO: 3496568 - DNA, 21 bp, Homo sapiens
ctagctgggggtgggccaggc

SEQ ID NO: 3496569 - DNA, 21 bp, Homo sapiens
ctaggagaaccaaatctggaa

SEQ ID NO: 3496570 - DNA, 16 bp, Homo sapiens
ctaggagaagggctga

SEQ ID NO: 3496571 - DNA, 17 bp, Homo sapiens
ctaggcaaaattgtgaa

SEQ ID NO: 3496572 - DNA, 13 bp, Homo sapiens
ctaggcaacatag

SEQ ID NO: 3496573 - DNA, 13 bp, Homo sapiens
ctaggcagtggga

SEQ ID NO: 3496574 - DNA, 13 bp, Homo sapiens
ctaggcccccact

SEQ ID NO: 3496575 - DNA, 16 bp, Homo sapiens
ctaggcccccacttgc

SEQ ID NO: 3496576 - DNA, 17 bp, Homo sapiens
ctaggcccccacttgcc

SEQ ID NO: 3496577 - DNA, 20 bp, Homo sapiens
ctaggcccccacttgcctct

SEQ ID NO: 3496578 - DNA, 16 bp, Homo sapiens
ctaggcctcaactcct

SEQ ID NO: 3496579 - DNA, 20 bp, Homo sapiens
ctaggcctcaactcctccca

SEQ ID NO: 3496580 - DNA, 21 bp, Homo sapiens
ctaggcctcaactcctcccat

SEQ ID NO: 3496581 - DNA, 19 bp, Homo sapiens
ctaggcctggccagatgca

SEQ ID NO: 3496582 - DNA, 13 bp, Homo sapiens
ctaggctctgcct

SEQ ID NO: 3496583 - DNA, 17 bp, Homo sapiens
ctaggctggagcccagg

SEQ ID NO: 3496584 - DNA, 14 bp, Homo sapiens
ctagggaagggtgg

SEQ ID NO: 3496585 - DNA, 17 bp, Homo sapiens
ctagggccaagcccagc

SEQ ID NO: 3496586 - DNA, 18 bp, Homo sapiens
ctagggccaagcccagca

SEQ ID NO: 3496587 - DNA, 18 bp, Homo sapiens
ctaggtgcccttggaggc

SEQ ID NO: 3496588 - DNA, 19 bp, Homo sapiens
ctaggtggcaaggctgtgc

SEQ ID NO: 3496589 - DNA, 18 bp, Homo sapiens
ctagtaagcatctacttc

SEQ ID NO: 3496590 - DNA, 15 bp, Homo sapiens
ctagtactagaaact

SEQ ID NO: 3496591 - DNA, 15 bp, Homo sapiens
ctagtcaagctcctc

SEQ ID NO: 3496592 - DNA, 19 bp, Homo sapiens
ctagtcaagctcctcctcc

SEQ ID NO: 3496593 - DNA, 22 bp, Homo sapiens
ctagtcaagctcctcctccctg

SEQ ID NO: 3496594 - DNA, 21 bp, Homo sapiens
ctagtgaaggcttctctctgt

SEQ ID NO: 3496595 - DNA, 13 bp, Homo sapiens
ctagtgcaaatca

SEQ ID NO: 3496596 - DNA, 16 bp, Homo sapiens
ctagtgcaaatcatag

SEQ ID NO: 3496597 - DNA, 17 bp, Homo sapiens
ctagtggggtttcctgg

SEQ ID NO: 3496598 - DNA, 19 bp, Homo sapiens
ctagtgtaacactgcaaga

SEQ ID NO: 3496599 - DNA, 21 bp, Homo sapiens
ctagtgtaacactgcaagaag

SEQ ID NO: 3496600 - DNA, 17 bp, Homo sapiens
ctagttctgtagaaatg

SEQ ID NO: 3496601 - DNA, 23 bp, Homo sapiens
ctagttctgtagaaatggttgta

SEQ ID NO: 3496602 - DNA, 19 bp, Homo sapiens
ctagttttcagtttgtata

SEQ ID NO: 3496603 - DNA, 22 bp, Homo sapiens
ctagttttcagtttgtatatac

SEQ ID NO: 3496604 - DNA, 21 bp, Homo sapiens
ctagttttctttcctcctttc

SEQ ID NO: 3496605 - DNA, 13 bp, Homo sapiens
ctataaaacaggt

SEQ ID NO: 3496606 - DNA, 16 bp, Homo sapiens
ctataaaagctttctg

SEQ ID NO: 3496607 - DNA, 17 bp, Homo sapiens
ctataaattcctctttg

SEQ ID NO: 3496608 - DNA, 19 bp, Homo sapiens
ctataaattcctctttgct

SEQ ID NO: 3496609 - DNA, 17 bp, Homo sapiens
ctataagaactttgagc

SEQ ID NO: 3496610 - DNA, 16 bp, Homo sapiens
ctataaggcagccttg

SEQ ID NO: 3496611 - DNA, 15 bp, Homo sapiens
ctataataaagaagt

SEQ ID NO: 3496612 - DNA, 14 bp, Homo sapiens
ctatacatatcttt

SEQ ID NO: 3496613 - DNA, 12 bp, Homo sapiens
ctatactgcttg

SEQ ID NO: 3496614 - DNA, 18 bp, Homo sapiens
ctatagcctaggtgacag

SEQ ID NO: 3496615 - DNA, 12 bp, Homo sapiens
ctatagcctggg

SEQ ID NO: 3496616 - DNA, 13 bp, Homo sapiens
ctatagcctgggg

SEQ ID NO: 3496617 - DNA, 18 bp, Homo sapiens
ctatagcctggggtgggg

SEQ ID NO: 3496618 - DNA, 12 bp, Homo sapiens
ctatagtatttg

SEQ ID NO: 3496619 - DNA, 22 bp, Homo sapiens
ctatatttgggcctgctccaga

SEQ ID NO: 3496620 - DNA, 17 bp, Homo sapiens
ctatcacctatttccat

SEQ ID NO: 3496621 - DNA, 14 bp, Homo sapiens
ctatcatggtgaaa

SEQ ID NO: 3496622 - DNA, 21 bp, Homo sapiens
ctatcatttaataatatactt

SEQ ID NO: 3496623 - DNA, 19 bp, Homo sapiens
ctatcctggctctttggag

SEQ ID NO: 3496624 - DNA, 15 bp, Homo sapiens
ctatctactctcctc

SEQ ID NO: 3496625 - DNA, 17 bp, Homo sapiens
ctatctgtctggtggcc

SEQ ID NO: 3496626 - DNA, 18 bp, Homo sapiens
ctatctgtctggtggccc

SEQ ID NO: 3496627 - DNA, 21 bp, Homo sapiens
ctatctgtctggtggccccgt

SEQ ID NO: 3496628 - DNA, 17 bp, Homo sapiens
ctatcttgttccaaggc

SEQ ID NO: 3496629 - DNA, 18 bp, Homo sapiens
ctatcttttgtttccttt

SEQ ID NO: 3496630 - DNA, 19 bp, Homo sapiens
ctatcttttgtttcctttt

SEQ ID NO: 3496631 - DNA, 16 bp, Homo sapiens
ctatgagctaaatgtc

SEQ ID NO: 3496632 - DNA, 16 bp, Homo sapiens
ctatgagtggaaaaag

SEQ ID NO: 3496633 - DNA, 17 bp, Homo sapiens
ctatgataattacaata

SEQ ID NO: 3496634 - DNA, 13 bp, Homo sapiens
ctatgcatggtgc

SEQ ID NO: 3496635 - DNA, 22 bp, Homo sapiens
ctatgcatggtgccccaggacc

SEQ ID NO: 3496636 - DNA, 14 bp, Homo sapiens
ctatgcctgtgtct

SEQ ID NO: 3496637 - DNA, 17 bp, Homo sapiens
ctatgctattgacaata

SEQ ID NO: 3496638 - DNA, 17 bp, Homo sapiens
ctatgctttgaaacaga

SEQ ID NO: 3496639 - DNA, 19 bp, Homo sapiens
ctatgctttgaaacagaaa

SEQ ID NO: 3496640 - DNA, 18 bp, Homo sapiens
ctatggcagtccagccag

SEQ ID NO: 3496641 - DNA, 23 bp, Homo sapiens
ctatggcagtccagccagctcct

SEQ ID NO: 3496642 - DNA, 14 bp, Homo sapiens
ctatggtgctctgt

SEQ ID NO: 3496643 - DNA, 17 bp, Homo sapiens
ctatggtgctctgtcta

SEQ ID NO: 3496644 - DNA, 23 bp, Homo sapiens
ctatggtgctctgtctacttgct

SEQ ID NO: 3496645 - DNA, 21 bp, Homo sapiens
ctatgtaactgcattgagaac

SEQ ID NO: 3496646 - DNA, 14 bp, Homo sapiens
ctatgtaggaaaaa

SEQ ID NO: 3496647 - DNA, 16 bp, Homo sapiens
ctatgtgattttaact

SEQ ID NO: 3496648 - DNA, 21 bp, Homo sapiens
ctatgtgattttaactctgtc

SEQ ID NO: 3496649 - DNA, 15 bp, Homo sapiens
ctctgaaggacattg

SEQ ID NO: 3496650 - DNA, 17 bp, Homo sapiens
ctctgaagggcatcatg

SEQ ID NO: 3496651 - DNA, 14 bp, Homo sapiens
ctctgacacacagc

SEQ ID NO: 3496652 - DNA, 17 bp, Homo sapiens
ctctgaccgaaacagcg

SEQ ID NO: 3496653 - DNA, 19 bp, Homo sapiens
ctctgaccgaaacagcgct

SEQ ID NO: 3496654 - DNA, 22 bp, Homo sapiens
ctctgaccgaaacagcgctggg

SEQ ID NO: 3496655 - DNA, 14 bp, Homo sapiens
ctctgactcagggc

SEQ ID NO: 3496656 - DNA, 21 bp, Homo sapiens
ctctgactcagggctcctggg

SEQ ID NO: 3496657 - DNA, 19 bp, Homo sapiens
ctctgacttaagcaaaaga

SEQ ID NO: 3496658 - DNA, 22 bp, Homo sapiens
ctctgacttaagcaaaagaaaa

SEQ ID NO: 3496659 - DNA, 18 bp, Homo sapiens
ctctgagccacagtggga

SEQ ID NO: 3496660 - DNA, 14 bp, Homo sapiens
ctctgaggacacta

SEQ ID NO: 3496661 - DNA, 17 bp, Homo sapiens
ctctgagtatctcctcg

SEQ ID NO: 3496662 - DNA, 18 bp, Homo sapiens
ctctgagtcctggcccaa

SEQ ID NO: 3496663 - DNA, 19 bp, Homo sapiens
ctctgagtgttttatgaga

SEQ ID NO: 3496664 - DNA, 20 bp, Homo sapiens
ctctgataatatattttcaa

SEQ ID NO: 3496665 - DNA, 21 bp, Homo sapiens
ctctgatccctctacagagct

SEQ ID NO: 3496666 - DNA, 22 bp, Homo sapiens
ctctgatccctctacagagctt

SEQ ID NO: 3496667 - DNA, 15 bp, Homo sapiens
ctctgatccctctgg

SEQ ID NO: 3496668 - DNA, 14 bp, Homo sapiens
ctctgcaactgctc

SEQ ID NO: 3496669 - DNA, 17 bp, Homo sapiens
ctctgcaagtgctcagg

SEQ ID NO: 3496670 - DNA, 18 bp, Homo sapiens
ctctgcaagtgctcaggg

SEQ ID NO: 3496671 - DNA, 20 bp, Homo sapiens
ctctgcaagtgctcagggaa

SEQ ID NO: 3496672 - DNA, 13 bp, Homo sapiens
ctctgcacaagct

SEQ ID NO: 3496673 - DNA, 16 bp, Homo sapiens
ctctgcacaagctgca

SEQ ID NO: 3496674 - DNA, 18 bp, Homo sapiens
ctctgcacaagctgcacc

SEQ ID NO: 3496675 - DNA, 19 bp, Homo sapiens
ctctgcacaagctgcaccc

SEQ ID NO: 3496676 - DNA, 20 bp, Homo sapiens
ctctgcacaagctgcaccct

SEQ ID NO: 3496677 - DNA, 17 bp, Homo sapiens
ctctgcagacttcccag

SEQ ID NO: 3496678 - DNA, 13 bp, Homo sapiens
ctctgcagggccg

SEQ ID NO: 3496679 - DNA, 14 bp, Homo sapiens
ctctgcatccagag

SEQ ID NO: 3496680 - DNA, 19 bp, Homo sapiens
ctctgcatttttctgcaga

SEQ ID NO: 3496681 - DNA, 20 bp, Homo sapiens
ctctgcccaacccttccctc

SEQ ID NO: 3496682 - DNA, 17 bp, Homo sapiens
ctctgccccatcctcca

SEQ ID NO: 3496683 - DNA, 22 bp, Homo sapiens
ctctgccccatcctccagcagg

SEQ ID NO: 3496684 - DNA, 16 bp, Homo sapiens
ctctgccctctagagc

SEQ ID NO: 3496685 - DNA, 16 bp, Homo sapiens
ctctgcctctgacaca

SEQ ID NO: 3496686 - DNA, 23 bp, Homo sapiens
ctctgccttgcctttagcccctc

SEQ ID NO: 3496687 - DNA, 15 bp, Homo sapiens
ctctgctcacagaag

SEQ ID NO: 3496688 - DNA, 13 bp, Homo sapiens
ctctgctcgcctt

SEQ ID NO: 3496689 - DNA, 15 bp, Homo sapiens
ctctgctcgccttag

SEQ ID NO: 3496690 - DNA, 17 bp, Homo sapiens
ctctgctcgccttagca

SEQ ID NO: 3496691 - DNA, 14 bp, Homo sapiens
ctctgctgacagac

SEQ ID NO: 3496692 - DNA, 23 bp, Homo sapiens
ctctgctgacagacacaggcccg

SEQ ID NO: 3496693 - DNA, 13 bp, Homo sapiens
ctctgcttctctg

SEQ ID NO: 3496694 - DNA, 14 bp, Homo sapiens
ctctgcttctctga

SEQ ID NO: 3496695 - DNA, 17 bp, Homo sapiens
ctctgcttctctgactt

SEQ ID NO: 3496696 - DNA, 21 bp, Homo sapiens
ctctgcttctctgacttctgc

SEQ ID NO: 3496697 - DNA, 15 bp, Homo sapiens
ctctggaggggaggg

SEQ ID NO: 3496698 - DNA, 23 bp, Homo sapiens
ctctggatgcctgattgccaagc

SEQ ID NO: 3496699 - DNA, 13 bp, Homo sapiens
ctctggccaaggg

SEQ ID NO: 3496700 - DNA, 16 bp, Homo sapiens
ctctggccaagggcca

SEQ ID NO: 3496701 - DNA, 17 bp, Homo sapiens
ctctggccaagggccag

SEQ ID NO: 3496702 - DNA, 14 bp, Homo sapiens
ctctgggccacttg

SEQ ID NO: 3496703 - DNA, 18 bp, Homo sapiens
ctctgggccacttggagt

SEQ ID NO: 3496704 - DNA, 21 bp, Homo sapiens
ctctgggccgggcctggggct

SEQ ID NO: 3496705 - DNA, 13 bp, Homo sapiens
ctctgggggctct

SEQ ID NO: 3496706 - DNA, 21 bp, Homo sapiens
ctctgggggctctggccaagg

SEQ ID NO: 3496707 - DNA, 18 bp, Homo sapiens
ctctgggtccttcctgaa

SEQ ID NO: 3496708 - DNA, 21 bp, Homo sapiens
ctctgggtccttcctgaaact

SEQ ID NO: 3496709 - DNA, 16 bp, Homo sapiens
ctctggtcgctcctgc

SEQ ID NO: 3496710 - DNA, 20 bp, Homo sapiens
ctctggtcgctcctgcccac

SEQ ID NO: 3496711 - DNA, 17 bp, Homo sapiens
ctctggtggcacaggag

SEQ ID NO: 3496712 - DNA, 20 bp, Homo sapiens
ctctgtacttttcattctct

SEQ ID NO: 3496713 - DNA, 22 bp, Homo sapiens
ctctgtacttttcattctcttt

SEQ ID NO: 3496714 - DNA, 17 bp, Homo sapiens
ctctgtcagtcacagcc

SEQ ID NO: 3496715 - DNA, 20 bp, Homo sapiens
ctctgtcagtcacagccacc

SEQ ID NO: 3496716 - DNA, 23 bp, Homo sapiens
ctctgtccccttctctcatctct

SEQ ID NO: 3496717 - DNA, 15 bp, Homo sapiens
ctctgtcctgggagt

SEQ ID NO: 3496718 - DNA, 22 bp, Homo sapiens
ctctgtcctgggagtgagctgg

SEQ ID NO: 3496719 - DNA, 18 bp, Homo sapiens
ctctgtcgcccagtctgg

SEQ ID NO: 3496720 - DNA, 18 bp, Homo sapiens
ctctgtgaacgatttaga

SEQ ID NO: 3496721 - DNA, 14 bp, Homo sapiens
ctctgtgaccaatg

SEQ ID NO: 3496722 - DNA, 18 bp, Homo sapiens
ctctgtgagactcgagaa

SEQ ID NO: 3496723 - DNA, 15 bp, Homo sapiens
ctctgtgccttcttt

SEQ ID NO: 3496724 - DNA, 18 bp, Homo sapiens
ctctgtgggtctctggaa

SEQ ID NO: 3496725 - DNA, 19 bp, Homo sapiens
ctctgtgtatttgcttttt

SEQ ID NO: 3496726 - DNA, 20 bp, Homo sapiens
ctctgtgtcaggtggggcag

SEQ ID NO: 3496727 - DNA, 22 bp, Homo sapiens
ctctgttacccagggtggagtg

SEQ ID NO: 3496728 - DNA, 15 bp, Homo sapiens
ctctgttcagtgtaa

SEQ ID NO: 3496729 - DNA, 13 bp, Homo sapiens
ctctgttccatgt

SEQ ID NO: 3496730 - DNA, 16 bp, Homo sapiens
ctctgttccatgtctc

SEQ ID NO: 3496731 - DNA, 17 bp, Homo sapiens
ctctgttgactggctgt

SEQ ID NO: 3496732 - DNA, 14 bp, Homo sapiens
ctctgtttgtgggg

SEQ ID NO: 3496733 - DNA, 17 bp, Homo sapiens
ctcttacatgtataaag

SEQ ID NO: 3496734 - DNA, 18 bp, Homo sapiens
ctcttacatgtataaagt

SEQ ID NO: 3496735 - DNA, 21 bp, Homo sapiens
ctcttacatgtataaagtgat

SEQ ID NO: 3496736 - DNA, 14 bp, Homo sapiens
ctcttagatggatt

SEQ ID NO: 3496737 - DNA, 20 bp, Homo sapiens
ctcttatagaatatttatta

SEQ ID NO: 3496738 - DNA, 15 bp, Homo sapiens
ctcttattgcccacg

SEQ ID NO: 3496739 - DNA, 20 bp, Homo sapiens
ctcttattgcccacgctgga

SEQ ID NO: 3496740 - DNA, 15 bp, Homo sapiens
ctcttcaaatgcctg

SEQ ID NO: 3496741 - DNA, 21 bp, Homo sapiens
ctcttcagaaagtgtgcttta

SEQ ID NO: 3496742 - DNA, 14 bp, Homo sapiens
ctcttcatctaata

SEQ ID NO: 3496743 - DNA, 17 bp, Homo sapiens
ctcttcatgtctattcc

SEQ ID NO: 3496744 - DNA, 14 bp, Homo sapiens
ctcttccccccaaa

SEQ ID NO: 3496745 - DNA, 22 bp, Homo sapiens
ctcttccctgcgcctgtgatgc

SEQ ID NO: 3496746 - DNA, 16 bp, Homo sapiens
ctcttccgactctttc

SEQ ID NO: 3496747 - DNA, 23 bp, Homo sapiens
ctcttccttgaagaactgcaggc

SEQ ID NO: 3496748 - DNA, 11 bp, Homo sapiens
ctcttctcatt

SEQ ID NO: 3496749 - DNA, 14 bp, Homo sapiens
ctcttctccccaga

SEQ ID NO: 3496750 - DNA, 11 bp, Homo sapiens
ctcttctgagc

SEQ ID NO: 3496751 - DNA, 12 bp, Homo sapiens
ctcttctgagct

SEQ ID NO: 3496752 - DNA, 13 bp, Homo sapiens
ctcttctgagcta

SEQ ID NO: 3496753 - DNA, 21 bp, Homo sapiens
ctcttctgccggccctggggc

SEQ ID NO: 3496754 - DNA, 15 bp, Homo sapiens
ctcttctgggcctga

SEQ ID NO: 3496755 - DNA, 17 bp, Homo sapiens
ctcttcttattacccaa

SEQ ID NO: 3496756 - DNA, 14 bp, Homo sapiens
ctcttctttcccaa

SEQ ID NO: 3496757 - DNA, 22 bp, Homo sapiens
ctcttgaaccccaaatgctctc

SEQ ID NO: 3496758 - DNA, 23 bp, Homo sapiens
ctcttgaaccccaaatgctctct

SEQ ID NO: 3496759 - DNA, 17 bp, Homo sapiens
ctcttgacagaaagcag

SEQ ID NO: 3496760 - DNA, 23 bp, Homo sapiens
ctcttgacagaaagcagttctga

SEQ ID NO: 3496761 - DNA, 16 bp, Homo sapiens
ctcttgaccttgtaga

SEQ ID NO: 3496762 - DNA, 20 bp, Homo sapiens
ctcttgggccaagccagctg

SEQ ID NO: 3496763 - DNA, 22 bp, Homo sapiens
ctcttgggccaagccagctgcc

SEQ ID NO: 3496764 - DNA, 23 bp, Homo sapiens
ctcttgggccaagccagctgcct

SEQ ID NO: 3496765 - DNA, 12 bp, Homo sapiens
ctcttgtaaata

SEQ ID NO: 3496766 - DNA, 21 bp, Homo sapiens
ctctttaatgtcacaggcagg

SEQ ID NO: 3496767 - DNA, 15 bp, Homo sapiens
ctctttagagttaga

SEQ ID NO: 3496768 - DNA, 18 bp, Homo sapiens
ctctttagagttagactg

SEQ ID NO: 3496769 - DNA, 21 bp, Homo sapiens
ctctttagagttagactgttg

SEQ ID NO: 3496770 - DNA, 13 bp, Homo sapiens
ctctttcatccac

SEQ ID NO: 3496771 - DNA, 19 bp, Homo sapiens
ctctttcctatttcagtgt

SEQ ID NO: 3496772 - DNA, 20 bp, Homo sapiens
ctctttcctatttcagtgtt

SEQ ID NO: 3496773 - DNA, 16 bp, Homo sapiens
ctctttctgagtgcct

SEQ ID NO: 3496774 - DNA, 18 bp, Homo sapiens
ctctttctgagtgccttc

SEQ ID NO: 3496775 - DNA, 11 bp, Homo sapiens
ctctttctgta

SEQ ID NO: 3496776 - DNA, 12 bp, Homo sapiens
ctctttgctgca

SEQ ID NO: 3496777 - DNA, 13 bp, Homo sapiens
ctctttgctgcag

SEQ ID NO: 3496778 - DNA, 12 bp, Homo sapiens
ctctttgctttg

SEQ ID NO: 3496779 - DNA, 14 bp, Homo sapiens
ctctttgctttgct

SEQ ID NO: 3496780 - DNA, 20 bp, Homo sapiens
ctctttgctttgctttctgc

SEQ ID NO: 3496781 - DNA, 21 bp, Homo sapiens
ctggcttcaggcaattctcct

SEQ ID NO: 3496782 - DNA, 16 bp, Homo sapiens
ctggcttctgtggggc

SEQ ID NO: 3496783 - DNA, 11 bp, Homo sapiens
ctggctttggc

SEQ ID NO: 3496784 - DNA, 19 bp, Homo sapiens
ctggctttttattgtattt

SEQ ID NO: 3496785 - DNA, 16 bp, Homo sapiens
ctgggaaatattccct

SEQ ID NO: 3496786 - DNA, 18 bp, Homo sapiens
ctgggaaatattccctag

SEQ ID NO: 3496787 - DNA, 17 bp, Homo sapiens
ctgggaactcacctggg

SEQ ID NO: 3496788 - DNA, 19 bp, Homo sapiens
ctgggacatcaggagactg

SEQ ID NO: 3496789 - DNA, 21 bp, Homo sapiens
ctgggacatcaggagactggg

SEQ ID NO: 3496790 - DNA, 22 bp, Homo sapiens
ctgggaccacaggttcatgcca

SEQ ID NO: 3496791 - DNA, 16 bp, Homo sapiens
ctgggaccacgtgaga

SEQ ID NO: 3496792 - DNA, 18 bp, Homo sapiens
ctgggacgtggctcagcc

SEQ ID NO: 3496793 - DNA, 23 bp, Homo sapiens
ctgggacgtggctcagccagcac

SEQ ID NO: 3496794 - DNA, 13 bp, Homo sapiens
ctgggactacagg

SEQ ID NO: 3496795 - DNA, 17 bp, Homo sapiens
ctgggactacaggtgtg

SEQ ID NO: 3496796 - DNA, 15 bp, Homo sapiens
ctgggactcagcctt

SEQ ID NO: 3496797 - DNA, 17 bp, Homo sapiens
ctgggactcagccttca

SEQ ID NO: 3496798 - DNA, 14 bp, Homo sapiens
ctgggactccaggt

SEQ ID NO: 3496799 - DNA, 16 bp, Homo sapiens
ctgggactccaggtct

SEQ ID NO: 3496800 - DNA, 14 bp, Homo sapiens
ctgggacttccatg

SEQ ID NO: 3496801 - DNA, 19 bp, Homo sapiens
ctgggacttccatgcctta

SEQ ID NO: 3496802 - DNA, 18 bp, Homo sapiens
ctgggagaaaatcatcaa

SEQ ID NO: 3496803 - DNA, 21 bp, Homo sapiens
ctgggagaaatctggcttctg

SEQ ID NO: 3496804 - DNA, 19 bp, Homo sapiens
ctgggagattcaagggacc

SEQ ID NO: 3496805 - DNA, 17 bp, Homo sapiens
ctgggagctccactctg

SEQ ID NO: 3496806 - DNA, 16 bp, Homo sapiens
ctgggaggagcccctg

SEQ ID NO: 3496807 - DNA, 18 bp, Homo sapiens
ctgggaggagcccctgga

SEQ ID NO: 3496808 - DNA, 11 bp, Homo sapiens
ctgggagggca

SEQ ID NO: 3496809 - DNA, 17 bp, Homo sapiens
ctgggagggcagcaggg

SEQ ID NO: 3496810 - DNA, 17 bp, Homo sapiens
ctgggagtcacacagtg

SEQ ID NO: 3496811 - DNA, 22 bp, Homo sapiens
ctgggagtcacacagtgttgga

SEQ ID NO: 3496812 - DNA, 17 bp, Homo sapiens
ctgggagtcaggcccgg

SEQ ID NO: 3496813 - DNA, 12 bp, Homo sapiens
ctgggagtgagc

SEQ ID NO: 3496814 - DNA, 20 bp, Homo sapiens
ctgggatgggaggagaggac

SEQ ID NO: 3496815 - DNA, 16 bp, Homo sapiens
ctgggatggtgggctt

SEQ ID NO: 3496816 - DNA, 18 bp, Homo sapiens
ctgggatggtgggcttca

SEQ ID NO: 3496817 - DNA, 20 bp, Homo sapiens
ctgggatggtgggcttcagg

SEQ ID NO: 3496818 - DNA, 20 bp, Homo sapiens
ctgggattacaggtgtgaac

SEQ ID NO: 3496819 - DNA, 15 bp, Homo sapiens
ctgggcaaagcctag

SEQ ID NO: 3496820 - DNA, 12 bp, Homo sapiens
ctgggcacttcc

SEQ ID NO: 3496821 - DNA, 16 bp, Homo sapiens
ctgggcacttccctgc

SEQ ID NO: 3496822 - DNA, 18 bp, Homo sapiens
ctgggcacttccctgctg

SEQ ID NO: 3496823 - DNA, 22 bp, Homo sapiens
ctgggcacttccctgctgcctg

SEQ ID NO: 3496824 - DNA, 17 bp, Homo sapiens
ctgggcaggactcagct

SEQ ID NO: 3496825 - DNA, 16 bp, Homo sapiens
ctgggcatagatgcag

SEQ ID NO: 3496826 - DNA, 19 bp, Homo sapiens
ctgggccattctccacagc

SEQ ID NO: 3496827 - DNA, 21 bp, Homo sapiens
ctgggccattctccacagcaa

SEQ ID NO: 3496828 - DNA, 14 bp, Homo sapiens
ctgggccctctctg

SEQ ID NO: 3496829 - DNA, 18 bp, Homo sapiens
ctgggccctctctgctct

SEQ ID NO: 3496830 - DNA, 14 bp, Homo sapiens
ctgggccctctctt

SEQ ID NO: 3496831 - DNA, 15 bp, Homo sapiens
ctgggccctgagcca

SEQ ID NO: 3496832 - DNA, 17 bp, Homo sapiens
ctgggccctgagccaga

SEQ ID NO: 3496833 - DNA, 18 bp, Homo sapiens
ctgggccctgagccagag

SEQ ID NO: 3496834 - DNA, 16 bp, Homo sapiens
ctgggccctgggctgg

SEQ ID NO: 3496835 - DNA, 18 bp, Homo sapiens
ctgggccctgggctggaa

SEQ ID NO: 3496836 - DNA, 20 bp, Homo sapiens
ctgggcctcctcacaacatg

SEQ ID NO: 3496837 - DNA, 18 bp, Homo sapiens
ctgggcctggcagctcag

SEQ ID NO: 3496838 - DNA, 15 bp, Homo sapiens
ctgggctaccccacc

SEQ ID NO: 3496839 - DNA, 14 bp, Homo sapiens
ctgggctcctccag

SEQ ID NO: 3496840 - DNA, 17 bp, Homo sapiens
ctgggctcctccagggt

SEQ ID NO: 3496841 - DNA, 14 bp, Homo sapiens
ctgggctctggctc

SEQ ID NO: 3496842 - DNA, 16 bp, Homo sapiens
ctgggctgagggagcc

SEQ ID NO: 3496843 - DNA, 23 bp, Homo sapiens
ctgggctgagggagcctggcccc

SEQ ID NO: 3496844 - DNA, 18 bp, Homo sapiens
ctgggcttgtctgtagat

SEQ ID NO: 3496845 - DNA, 14 bp, Homo sapiens
ctggggaaagggga

SEQ ID NO: 3496846 - DNA, 16 bp, Homo sapiens
ctggggaaaggggaca

SEQ ID NO: 3496847 - DNA, 17 bp, Homo sapiens
ctggggaaataacagct

SEQ ID NO: 3496848 - DNA, 19 bp, Homo sapiens
ctggggaaataacagctgt

SEQ ID NO: 3496849 - DNA, 22 bp, Homo sapiens
ctggggaaataacagctgtggc

SEQ ID NO: 3496850 - DNA, 15 bp, Homo sapiens
ctggggaaggagcca

SEQ ID NO: 3496851 - DNA, 22 bp, Homo sapiens
ctggggcagcaccctataaatc

SEQ ID NO: 3496852 - DNA, 17 bp, Homo sapiens
ctggggcctccagaact

SEQ ID NO: 3496853 - DNA, 12 bp, Homo sapiens
ctggggcctgac

SEQ ID NO: 3496854 - DNA, 16 bp, Homo sapiens
ctggggcctgactgct

SEQ ID NO: 3496855 - DNA, 18 bp, Homo sapiens
ctggggcctgactgctca

SEQ ID NO: 3496856 - DNA, 19 bp, Homo sapiens
ctggggcctgactgctcag

SEQ ID NO: 3496857 - DNA, 18 bp, Homo sapiens
ctggggctagggggagcc

SEQ ID NO: 3496858 - DNA, 15 bp, Homo sapiens
ctggggctctgggat

SEQ ID NO: 3496859 - DNA, 12 bp, Homo sapiens
ctggggctgctg

SEQ ID NO: 3496860 - DNA, 16 bp, Homo sapiens
ctggggctgctggcct

SEQ ID NO: 3496861 - DNA, 18 bp, Homo sapiens
ctggggctggcctcccaa

SEQ ID NO: 3496862 - DNA, 17 bp, Homo sapiens
ctgggggacccctggct

SEQ ID NO: 3496863 - DNA, 16 bp, Homo sapiens
ctgggggctctggcca

SEQ ID NO: 3496864 - DNA, 16 bp, Homo sapiens
ctggggggcagtggtg

SEQ ID NO: 3496865 - DNA, 15 bp, Homo sapiens
ctgggggtgccagga

SEQ ID NO: 3496866 - DNA, 19 bp, Homo sapiens
ctgggggtgccaggaccag

SEQ ID NO: 3496867 - DNA, 16 bp, Homo sapiens
ctggggtaccaagaga

SEQ ID NO: 3496868 - DNA, 15 bp, Homo sapiens
ctggggtccagggag

SEQ ID NO: 3496869 - DNA, 16 bp, Homo sapiens
ctggggtggccaccag

SEQ ID NO: 3496870 - DNA, 21 bp, Homo sapiens
ctggggtggcctgtgtggcca

SEQ ID NO: 3496871 - DNA, 13 bp, Homo sapiens
ctggggtggggtc

SEQ ID NO: 3496872 - DNA, 16 bp, Homo sapiens
ctgggtaaatgcagcg

SEQ ID NO: 3496873 - DNA, 23 bp, Homo sapiens
ctgggtacttcttgaaggtgctg

SEQ ID NO: 3496874 - DNA, 18 bp, Homo sapiens
ctgggtacttgtggacac

SEQ ID NO: 3496875 - DNA, 19 bp, Homo sapiens
ctgggtacttgtggacaca

SEQ ID NO: 3496876 - DNA, 21 bp, Homo sapiens
ctgggtacttgtggacacagc

SEQ ID NO: 3496877 - DNA, 21 bp, Homo sapiens
ctgggtattaccatgtaaata

SEQ ID NO: 3496878 - DNA, 14 bp, Homo sapiens
ctgggtccttcctg

SEQ ID NO: 3496879 - DNA, 19 bp, Homo sapiens
ctgggtccttcctgaaact

SEQ ID NO: 3496880 - DNA, 22 bp, Homo sapiens
ctgggtctcgctttgttgccca

SEQ ID NO: 3496881 - DNA, 22 bp, Homo sapiens
ctgggtggcaccagcagcctgg

SEQ ID NO: 3496882 - DNA, 15 bp, Homo sapiens
ctgggtggcactgcc

SEQ ID NO: 3496883 - DNA, 20 bp, Homo sapiens
ctgggtggcactgccatgca

SEQ ID NO: 3496884 - DNA, 19 bp, Homo sapiens
ctgggtggtctgcaggcag

SEQ ID NO: 3496885 - DNA, 17 bp, Homo sapiens
ctgggtggtggcctggt

SEQ ID NO: 3496886 - DNA, 14 bp, Homo sapiens
ctgggttcactgca

SEQ ID NO: 3496887 - DNA, 15 bp, Homo sapiens
ctgggttcactgcaa

SEQ ID NO: 3496888 - DNA, 17 bp, Homo sapiens
ctgggttcttaaccaga

SEQ ID NO: 3496889 - DNA, 23 bp, Homo sapiens
ctgggttgctgctgtccagtgcc

SEQ ID NO: 3496890 - DNA, 14 bp, Homo sapiens
ctggtactcaagcc

SEQ ID NO: 3496891 - DNA, 18 bp, Homo sapiens
ctggtaggaaagggcaag

SEQ ID NO: 3496892 - DNA, 17 bp, Homo sapiens
ctggtaggaccaagcat

SEQ ID NO: 3496893 - DNA, 18 bp, Homo sapiens
ctggtattctgttctgga

SEQ ID NO: 3496894 - DNA, 19 bp, Homo sapiens
ctggtcagagccacagggt

SEQ ID NO: 3496895 - DNA, 19 bp, Homo sapiens
ctggtcccggggccagcac

SEQ ID NO: 3496896 - DNA, 13 bp, Homo sapiens
ctggtcctggcct

SEQ ID NO: 3496897 - DNA, 13 bp, Homo sapiens
ctggtcgctcctg

SEQ ID NO: 3496898 - DNA, 15 bp, Homo sapiens
ctggtcgctcctgcc

SEQ ID NO: 3496899 - DNA, 16 bp, Homo sapiens
ctggtcgctcctgccc

SEQ ID NO: 3496900 - DNA, 23 bp, Homo sapiens
ctggtcgctcctgcccacggagt

SEQ ID NO: 3496901 - DNA, 16 bp, Homo sapiens
ctggtcttcctttttg

SEQ ID NO: 3496902 - DNA, 18 bp, Homo sapiens
ctggtcttgaagtcctgg

SEQ ID NO: 3496903 - DNA, 22 bp, Homo sapiens
ctggtcttgaagtcctggcttc

SEQ ID NO: 3496904 - DNA, 16 bp, Homo sapiens
ctggtgataaggacat

SEQ ID NO: 3496905 - DNA, 20 bp, Homo sapiens
ctggtgccctaacctctgag

SEQ ID NO: 3496906 - DNA, 12 bp, Homo sapiens
ctggtgctgctg

SEQ ID NO: 3496907 - DNA, 12 bp, Homo sapiens
ctggtggcagct

SEQ ID NO: 3496908 - DNA, 15 bp, Homo sapiens
ctggtggcagctgcg

SEQ ID NO: 3496909 - DNA, 12 bp, Homo sapiens
ctggtggcccag

SEQ ID NO: 3496910 - DNA, 14 bp, Homo sapiens
ctggtggcccagga

SEQ ID NO: 3496911 - DNA, 17 bp, Homo sapiens
ctggtggctacccaata

SEQ ID NO: 3496912 - DNA, 18 bp, Homo sapiens
ctggtggtctgttggcag

SEQ ID NO: 3496913 - DNA, 20 bp, Homo sapiens
ctggttaacttgtttggcct

SEQ ID NO: 3496914 - DNA, 19 bp, Homo sapiens
cttcctaaatattatgaga

SEQ ID NO: 3496915 - DNA, 22 bp, Homo sapiens
cttcctagaatccccttctcca

SEQ ID NO: 3496916 - DNA, 17 bp, Homo sapiens
cttcctccgaggccagt

SEQ ID NO: 3496917 - DNA, 21 bp, Homo sapiens
cttcctccgaggccagtacct

SEQ ID NO: 3496918 - DNA, 22 bp, Homo sapiens
cttcctcctgggccctctctgc

SEQ ID NO: 3496919 - DNA, 17 bp, Homo sapiens
cttcctgaaactatatt

SEQ ID NO: 3496920 - DNA, 12 bp, Homo sapiens
cttcctgactct

SEQ ID NO: 3496921 - DNA, 14 bp, Homo sapiens
cttcctggagactg

SEQ ID NO: 3496922 - DNA, 16 bp, Homo sapiens
cttcctggagcccaga

SEQ ID NO: 3496923 - DNA, 14 bp, Homo sapiens
cttcctgtccccat

SEQ ID NO: 3496924 - DNA, 15 bp, Homo sapiens
cttcctgtgtgtcca

SEQ ID NO: 3496925 - DNA, 17 bp, Homo sapiens
cttccttatgcttcttt

SEQ ID NO: 3496926 - DNA, 21 bp, Homo sapiens
cttccttgaagaactgcaggc

SEQ ID NO: 3496927 - DNA, 18 bp, Homo sapiens
cttccttgagacacggag

SEQ ID NO: 3496928 - DNA, 16 bp, Homo sapiens
cttcctttaaaaaact

SEQ ID NO: 3496929 - DNA, 16 bp, Homo sapiens
cttcgaaaggccttca

SEQ ID NO: 3496930 - DNA, 18 bp, Homo sapiens
cttcgaaaggccttcaga

SEQ ID NO: 3496931 - DNA, 16 bp, Homo sapiens
cttcgctcctgtgtct

SEQ ID NO: 3496932 - DNA, 19 bp, Homo sapiens
cttcgctgtcccccaacac

SEQ ID NO: 3496933 - DNA, 14 bp, Homo sapiens
cttcgggaccagga

SEQ ID NO: 3496934 - DNA, 20 bp, Homo sapiens
cttcgggaggtcgaggcagg

SEQ ID NO: 3496935 - DNA, 15 bp, Homo sapiens
cttcgggctgtgccc

SEQ ID NO: 3496936 - DNA, 22 bp, Homo sapiens
cttcgtctttcccatggggagg

SEQ ID NO: 3496937 - DNA, 18 bp, Homo sapiens
cttcgttctttttaagtt

SEQ ID NO: 3496938 - DNA, 21 bp, Homo sapiens
cttcgtttactatgcctgtgt

SEQ ID NO: 3496939 - DNA, 19 bp, Homo sapiens
cttctaaacttccccatct

SEQ ID NO: 3496940 - DNA, 22 bp, Homo sapiens
cttctaaacttccccatcttct

SEQ ID NO: 3496941 - DNA, 23 bp, Homo sapiens
cttctaaatggcaaaggaaggtg

SEQ ID NO: 3496942 - DNA, 13 bp, Homo sapiens
cttctaaattaaa

SEQ ID NO: 3496943 - DNA, 13 bp, Homo sapiens
cttctaccagacc

SEQ ID NO: 3496944 - DNA, 17 bp, Homo sapiens
cttctagctgacttgca

SEQ ID NO: 3496945 - DNA, 19 bp, Homo sapiens
cttctaggacgccacccag

SEQ ID NO: 3496946 - DNA, 18 bp, Homo sapiens
cttctagggtatgggaaa

SEQ ID NO: 3496947 - DNA, 19 bp, Homo sapiens
cttctagggttattgcatt

SEQ ID NO: 3496948 - DNA, 21 bp, Homo sapiens
cttctagggttattgcatttg

SEQ ID NO: 3496949 - DNA, 20 bp, Homo sapiens
cttctaggtggcaaggctgt

SEQ ID NO: 3496950 - DNA, 22 bp, Homo sapiens
cttctaggtggcaaggctgtgc

SEQ ID NO: 3496951 - DNA, 15 bp, Homo sapiens
cttctcaagatactg

SEQ ID NO: 3496952 - DNA, 13 bp, Homo sapiens
cttctcaccagct

SEQ ID NO: 3496953 - DNA, 16 bp, Homo sapiens
cttctcaccagctgca

SEQ ID NO: 3496954 - DNA, 16 bp, Homo sapiens
cttctcactgccatgc

SEQ ID NO: 3496955 - DNA, 21 bp, Homo sapiens
cttctcactgccatgccagct

SEQ ID NO: 3496956 - DNA, 13 bp, Homo sapiens
cttctcagaatct

SEQ ID NO: 3496957 - DNA, 14 bp, Homo sapiens
cttctcagaatcta

SEQ ID NO: 3496958 - DNA, 18 bp, Homo sapiens
cttctcagaatctaccca

SEQ ID NO: 3496959 - DNA, 19 bp, Homo sapiens
cttctcataggtgtccagc

SEQ ID NO: 3496960 - DNA, 16 bp, Homo sapiens
cttctcatcctgcagg

SEQ ID NO: 3496961 - DNA, 17 bp, Homo sapiens
cttctcatttcacccct

SEQ ID NO: 3496962 - DNA, 22 bp, Homo sapiens
cttctcatttcacccctccctt

SEQ ID NO: 3496963 - DNA, 21 bp, Homo sapiens
cttctccaaaaatctgcctgg

SEQ ID NO: 3496964 - DNA, 17 bp, Homo sapiens
cttctccaccctgctct

SEQ ID NO: 3496965 - DNA, 21 bp, Homo sapiens
cttctccaccctgctctccga

SEQ ID NO: 3496966 - DNA, 12 bp, Homo sapiens
cttctccaggct

SEQ ID NO: 3496967 - DNA, 17 bp, Homo sapiens
cttctccaggctgtatc

SEQ ID NO: 3496968 - DNA, 17 bp, Homo sapiens
cttctccatggccctgc

SEQ ID NO: 3496969 - DNA, 20 bp, Homo sapiens
cttctcccatctcttccttg

SEQ ID NO: 3496970 - DNA, 16 bp, Homo sapiens
cttctcccctcttctg

SEQ ID NO: 3496971 - DNA, 14 bp, Homo sapiens
cttctcctatgtgt

SEQ ID NO: 3496972 - DNA, 14 bp, Homo sapiens
cttctcctcttgta

SEQ ID NO: 3496973 - DNA, 14 bp, Homo sapiens
cttctccttggagg

SEQ ID NO: 3496974 - DNA, 12 bp, Homo sapiens
cttctctaccca

SEQ ID NO: 3496975 - DNA, 15 bp, Homo sapiens
cttctctataaaaaa

SEQ ID NO: 3496976 - DNA, 18 bp, Homo sapiens
cttctctataaaaaatat

SEQ ID NO: 3496977 - DNA, 13 bp, Homo sapiens
cttctctcaacct

SEQ ID NO: 3496978 - DNA, 20 bp, Homo sapiens
cttctctcaaccttggcctt

SEQ ID NO: 3496979 - DNA, 22 bp, Homo sapiens
cttctctcaaccttggccttct

SEQ ID NO: 3496980 - DNA, 14 bp, Homo sapiens
cttctctcatctct

SEQ ID NO: 3496981 - DNA, 13 bp, Homo sapiens
cttctctgaagga

SEQ ID NO: 3496982 - DNA, 21 bp, Homo sapiens
cttctctgacttctgcctgga

SEQ ID NO: 3496983 - DNA, 15 bp, Homo sapiens
cttctgagcacagat

SEQ ID NO: 3496984 - DNA, 17 bp, Homo sapiens
cttctgccatattctgt

SEQ ID NO: 3496985 - DNA, 21 bp, Homo sapiens
cttctgccatattctgttggc

SEQ ID NO: 3496986 - DNA, 19 bp, Homo sapiens
cttctgccggccctggggc

SEQ ID NO: 3496987 - DNA, 14 bp, Homo sapiens
cttctgcctggaga

SEQ ID NO: 3496988 - DNA, 15 bp, Homo sapiens
cttctgcctggagac

SEQ ID NO: 3496989 - DNA, 18 bp, Homo sapiens
cttctgcctgtggaactg

SEQ ID NO: 3496990 - DNA, 14 bp, Homo sapiens
cttctgcggccaga

SEQ ID NO: 3496991 - DNA, 14 bp, Homo sapiens
cttctggaaactgt

SEQ ID NO: 3496992 - DNA, 18 bp, Homo sapiens
cttctggaaactgtgaag

SEQ ID NO: 3496993 - DNA, 19 bp, Homo sapiens
cttctggagatggaagctt

SEQ ID NO: 3496994 - DNA, 12 bp, Homo sapiens
cttctggccagg

SEQ ID NO: 3496995 - DNA, 15 bp, Homo sapiens
cttctggccaggaag

SEQ ID NO: 3496996 - DNA, 17 bp, Homo sapiens
cttctggccaggaagct

SEQ ID NO: 3496997 - DNA, 22 bp, Homo sapiens
cttctggccaggaagctttggt

SEQ ID NO: 3496998 - DNA, 16 bp, Homo sapiens
cttctggcctcccaca

SEQ ID NO: 3496999 - DNA, 13 bp, Homo sapiens
cttctggctgtgc

SEQ ID NO: 3497000 - DNA, 15 bp, Homo sapiens
cttctgggagggcag

SEQ ID NO: 3497001 - DNA, 22 bp, Homo sapiens
cttctgggagggcagcagggct

SEQ ID NO: 3497002 - DNA, 23 bp, Homo sapiens
cttctgggagggcagcagggcta

SEQ ID NO: 3497003 - DNA, 18 bp, Homo sapiens
cttctggtgccagatcct

SEQ ID NO: 3497004 - DNA, 15 bp, Homo sapiens
cttctgtccctcaca

SEQ ID NO: 3497005 - DNA, 10 bp, Homo sapiens
cttctgtctc

SEQ ID NO: 3497006 - DNA, 16 bp, Homo sapiens
cttctgttttgagttt

SEQ ID NO: 3497007 - DNA, 23 bp, Homo sapiens
cttcttatggaattgatttgcat

SEQ ID NO: 3497008 - DNA, 16 bp, Homo sapiens
cttcttattacccaaa

SEQ ID NO: 3497009 - DNA, 16 bp, Homo sapiens
cttcttcacatccatt

SEQ ID NO: 3497010 - DNA, 13 bp, Homo sapiens
cttcttcaccatt

SEQ ID NO: 3497011 - DNA, 16 bp, Homo sapiens
cttcttcacctcttcc

SEQ ID NO: 3497012 - DNA, 15 bp, Homo sapiens
cttcttcagggcctg

SEQ ID NO: 3497013 - DNA, 19 bp, Homo sapiens
cttcttcataattttagta

SEQ ID NO: 3497014 - DNA, 19 bp, Homo sapiens
cttcttccaggtgcccagc

SEQ ID NO: 3497015 - DNA, 12 bp, Homo sapiens
cttcttgccctg

SEQ ID NO: 3497016 - DNA, 16 bp, Homo sapiens
cttcttgcctctgtgc

SEQ ID NO: 3497017 - DNA, 13 bp, Homo sapiens
cttcttgttcccc

SEQ ID NO: 3497018 - DNA, 15 bp, Homo sapiens
cttcttgtttccttg

SEQ ID NO: 3497019 - DNA, 20 bp, Homo sapiens
cttctttttattttcttttg

SEQ ID NO: 3497020 - DNA, 12 bp, Homo sapiens
cttgaaaaatac

SEQ ID NO: 3497021 - DNA, 20 bp, Homo sapiens
cttgaaaaatacttttcctt

SEQ ID NO: 3497022 - DNA, 13 bp, Homo sapiens
cttgaaagctgtg

SEQ ID NO: 3497023 - DNA, 17 bp, Homo sapiens
cttgaactcctggcctc

SEQ ID NO: 3497024 - DNA, 18 bp, Homo sapiens
cttgaactcctggcctca

SEQ ID NO: 3497025 - DNA, 14 bp, Homo sapiens
cttgaacttgcctc

SEQ ID NO: 3497026 - DNA, 17 bp, Homo sapiens
cttgaaggccctgctga

SEQ ID NO: 3497027 - DNA, 18 bp, Homo sapiens
cttgaagggccagagcca

SEQ ID NO: 3497028 - DNA, 20 bp, Homo sapiens
cttgaagggccagagccagg

SEQ ID NO: 3497029 - DNA, 19 bp, Homo sapiens
cttgaagtcctggcttcag

SEQ ID NO: 3497030 - DNA, 20 bp, Homo sapiens
cttgaagtctaaaagcagaa

SEQ ID NO: 3497031 - DNA, 20 bp, Homo sapiens
cttgaatgtggcttgagaaa

SEQ ID NO: 3497032 - DNA, 22 bp, Homo sapiens
cttgaatgtggcttgagaaata

SEQ ID NO: 3497033 - DNA, 12 bp, Homo sapiens
cttgaattgtct

SEQ ID NO: 3497034 - DNA, 11 bp, Homo sapiens
cttgaattttt

SEQ ID NO: 3497035 - DNA, 19 bp, Homo sapiens
cttgacagaaagcagttct

SEQ ID NO: 3497036 - DNA, 22 bp, Homo sapiens
cttgacagaaagcagttctgat

SEQ ID NO: 3497037 - DNA, 12 bp, Homo sapiens
cttgaccaagca

SEQ ID NO: 3497038 - DNA, 17 bp, Homo sapiens
cttgaccaagcaggaag

SEQ ID NO: 3497039 - DNA, 13 bp, Homo sapiens
cttgacctcaggt

SEQ ID NO: 3497040 - DNA, 18 bp, Homo sapiens
cttgacctgcattgtaaa

SEQ ID NO: 3497041 - DNA, 18 bp, Homo sapiens
cttgacctgtttctctgc

SEQ ID NO: 3497042 - DNA, 14 bp, Homo sapiens
cttgacctttgtac

SEQ ID NO: 3497043 - DNA, 16 bp, Homo sapiens
cttgacctttgtacag

SEQ ID NO: 3497044 - DNA, 17 bp, Homo sapiens
cttgacctttgtacagc

SEQ ID NO: 3497045 - DNA, 19 bp, Homo sapiens
cttgacttcagttattggt

SEQ ID NO: 3497046 - DNA, 13 bp, Homo sapiens
cttgactttgctc

SEQ ID NO: 3497047 - DNA, 14 bp, Homo sapiens
gaactcagatccag

SEQ ID NO: 3497048 - DNA, 16 bp, Homo sapiens
gaactcagatccaggg

SEQ ID NO: 3497049 - DNA, 14 bp, Homo sapiens
gaactcatcactgt

SEQ ID NO: 3497050 - DNA, 13 bp, Homo sapiens
gaactcctggcct

SEQ ID NO: 3497051 - DNA, 13 bp, Homo sapiens
gaactctgggctc

SEQ ID NO: 3497052 - DNA, 12 bp, Homo sapiens
gaactgaactca

SEQ ID NO: 3497053 - DNA, 16 bp, Homo sapiens
gaactgcaggccctgg

SEQ ID NO: 3497054 - DNA, 23 bp, Homo sapiens
gaactgcaggccctggcctcccc

SEQ ID NO: 3497055 - DNA, 15 bp, Homo sapiens
gaactgcagggttca

SEQ ID NO: 3497056 - DNA, 19 bp, Homo sapiens
gaactgcgttatgaagagc

SEQ ID NO: 3497057 - DNA, 18 bp, Homo sapiens
gaactggaccctgttgct

SEQ ID NO: 3497058 - DNA, 20 bp, Homo sapiens
gaactggagggtgagaggaa

SEQ ID NO: 3497059 - DNA, 16 bp, Homo sapiens
gaactgtgccacaatg

SEQ ID NO: 3497060 - DNA, 14 bp, Homo sapiens
gaactgtgtgtaat

SEQ ID NO: 3497061 - DNA, 20 bp, Homo sapiens
gaacttactgtagcctcaga

SEQ ID NO: 3497062 - DNA, 13 bp, Homo sapiens
gaacttcatggat

SEQ ID NO: 3497063 - DNA, 15 bp, Homo sapiens
gaacttgctgctgtc

SEQ ID NO: 3497064 - DNA, 19 bp, Homo sapiens
gaacttggaaagaaatgcc

SEQ ID NO: 3497065 - DNA, 22 bp, Homo sapiens
gaacttgtaaaggaatttaaaa

SEQ ID NO: 3497066 - DNA, 22 bp, Homo sapiens
gaactttattttggattgtgga

SEQ ID NO: 3497067 - DNA, 20 bp, Homo sapiens
gaactttcctggatgtctga

SEQ ID NO: 3497068 - DNA, 11 bp, Homo sapiens
gaactttggga

SEQ ID NO: 3497069 - DNA, 15 bp, Homo sapiens
gaactttttcttttc

SEQ ID NO: 3497070 - DNA, 10 bp, Homo sapiens
gaagaaaaaa

SEQ ID NO: 3497071 - DNA, 19 bp, Homo sapiens
gaagaaaaaaggccttgaa

SEQ ID NO: 3497072 - DNA, 14 bp, Homo sapiens
gaagaaaacatcta

SEQ ID NO: 3497073 - DNA, 18 bp, Homo sapiens
gaagaacaccctctaaat

SEQ ID NO: 3497074 - DNA, 22 bp, Homo sapiens
gaagaaccagtccccccaccct

SEQ ID NO: 3497075 - DNA, 23 bp, Homo sapiens
gaagaacggggctcttctcattt

SEQ ID NO: 3497076 - DNA, 15 bp, Homo sapiens
gaagaactgcaggcc

SEQ ID NO: 3497077 - DNA, 14 bp, Homo sapiens
gaagaagctctctc

SEQ ID NO: 3497078 - DNA, 20 bp, Homo sapiens
gaagaagttcagaaatttaa

SEQ ID NO: 3497079 - DNA, 20 bp, Homo sapiens
gaagacaaaaagacaaacat

SEQ ID NO: 3497080 - DNA, 23 bp, Homo sapiens
gaagacaatgtgaaaagaaaaat

SEQ ID NO: 3497081 - DNA, 18 bp, Homo sapiens
gaagactcattcttctgt

SEQ ID NO: 3497082 - DNA, 21 bp, Homo sapiens
gaagactcattcttctgtacg

SEQ ID NO: 3497083 - DNA, 17 bp, Homo sapiens
gaagactggaagctaat

SEQ ID NO: 3497084 - DNA, 17 bp, Homo sapiens
gaagagaaaaaggctga

SEQ ID NO: 3497085 - DNA, 22 bp, Homo sapiens
gaagagaggaaataacagagag

SEQ ID NO: 3497086 - DNA, 23 bp, Homo sapiens
gaagagaggaaataacagagaga

SEQ ID NO: 3497087 - DNA, 14 bp, Homo sapiens
gaagagcccagtct

SEQ ID NO: 3497088 - DNA, 22 bp, Homo sapiens
gaagaggcctaagtcaaaactt

SEQ ID NO: 3497089 - DNA, 17 bp, Homo sapiens
gaagagggttttaggta

SEQ ID NO: 3497090 - DNA, 23 bp, Homo sapiens
gaagagtaagtcaacctgcctga

SEQ ID NO: 3497091 - DNA, 14 bp, Homo sapiens
gaagattctttccc

SEQ ID NO: 3497092 - DNA, 20 bp, Homo sapiens
gaagcacatgcacctaccca

SEQ ID NO: 3497093 - DNA, 15 bp, Homo sapiens
gaagcagagagcaca

SEQ ID NO: 3497094 - DNA, 15 bp, Homo sapiens
gaagcagaggaagga

SEQ ID NO: 3497095 - DNA, 12 bp, Homo sapiens
gaagcagcctct

SEQ ID NO: 3497096 - DNA, 23 bp, Homo sapiens
gaagcagctaaaccaaggactga

SEQ ID NO: 3497097 - DNA, 19 bp, Homo sapiens
gaagcaggctacactgaca

SEQ ID NO: 3497098 - DNA, 19 bp, Homo sapiens
gaagcaggttcccaagctc

SEQ ID NO: 3497099 - DNA, 17 bp, Homo sapiens
gaagcatttactttgtg

SEQ ID NO: 3497100 - DNA, 21 bp, Homo sapiens
gaagccaggaatttcccagga

SEQ ID NO: 3497101 - DNA, 20 bp, Homo sapiens
gaagcccccaccgtgggcag

SEQ ID NO: 3497102 - DNA, 17 bp, Homo sapiens
gaagcccccagctaaga

SEQ ID NO: 3497103 - DNA, 17 bp, Homo sapiens
gaagccgtgccctgccc

SEQ ID NO: 3497104 - DNA, 22 bp, Homo sapiens
gaagccttacaaggttatgtag

SEQ ID NO: 3497105 - DNA, 23 bp, Homo sapiens
gaagctactgtgtgtgtgaatga

SEQ ID NO: 3497106 - DNA, 19 bp, Homo sapiens
gaagctataaattcctctt

SEQ ID NO: 3497107 - DNA, 19 bp, Homo sapiens
gaagctccgctttctaccc

SEQ ID NO: 3497108 - DNA, 17 bp, Homo sapiens
gaagctcctctccccag

SEQ ID NO: 3497109 - DNA, 21 bp, Homo sapiens
gaagctcctctccccagccca

SEQ ID NO: 3497110 - DNA, 22 bp, Homo sapiens
gaagctctgtttataaaaacaa

SEQ ID NO: 3497111 - DNA, 20 bp, Homo sapiens
gaagctcttactctttccta

SEQ ID NO: 3497112 - DNA, 15 bp, Homo sapiens
gaagctgacctttaa

SEQ ID NO: 3497113 - DNA, 20 bp, Homo sapiens
gaagctgacctttaactgag

SEQ ID NO: 3497114 - DNA, 18 bp, Homo sapiens
gaagctgacgaacttcca

SEQ ID NO: 3497115 - DNA, 19 bp, Homo sapiens
gaagctgacgaacttccat

SEQ ID NO: 3497116 - DNA, 21 bp, Homo sapiens
gaagctgtcataaaaagacaa

SEQ ID NO: 3497117 - DNA, 15 bp, Homo sapiens
gaagcttctgtctcc

SEQ ID NO: 3497118 - DNA, 15 bp, Homo sapiens
gaaggaaaaatgtgt

SEQ ID NO: 3497119 - DNA, 16 bp, Homo sapiens
gaaggagacaggcaga

SEQ ID NO: 3497120 - DNA, 21 bp, Homo sapiens
gaaggagccccattcctggga

SEQ ID NO: 3497121 - DNA, 14 bp, Homo sapiens
gaaggaggctggct

SEQ ID NO: 3497122 - DNA, 16 bp, Homo sapiens
gaaggatgtacatttc

SEQ ID NO: 3497123 - DNA, 17 bp, Homo sapiens
gaaggatgtacatttcc

SEQ ID NO: 3497124 - DNA, 20 bp, Homo sapiens
gaaggatgtacatttccaaa

SEQ ID NO: 3497125 - DNA, 13 bp, Homo sapiens
gaaggcaatgcca

SEQ ID NO: 3497126 - DNA, 15 bp, Homo sapiens
gaaggcagagaaagg

SEQ ID NO: 3497127 - DNA, 17 bp, Homo sapiens
gaaggcatttgcagggt

SEQ ID NO: 3497128 - DNA, 23 bp, Homo sapiens
gaaggcatttgcagggtcctctt

SEQ ID NO: 3497129 - DNA, 22 bp, Homo sapiens
gaaggccagctgccccagccag

SEQ ID NO: 3497130 - DNA, 17 bp, Homo sapiens
gaaggctaaaaagcaac

SEQ ID NO: 3497131 - DNA, 18 bp, Homo sapiens
gaaggctcttctccccag

SEQ ID NO: 3497132 - DNA, 21 bp, Homo sapiens
gaaggctcttctccccagagt

SEQ ID NO: 3497133 - DNA, 17 bp, Homo sapiens
gaaggcttgttgtgctt

SEQ ID NO: 3497134 - DNA, 19 bp, Homo sapiens
gaaggcttgttgtgctttt

SEQ ID NO: 3497135 - DNA, 20 bp, Homo sapiens
gaaggcttgttgtgctttta

SEQ ID NO: 3497136 - DNA, 19 bp, Homo sapiens
gaagggaatcctcctccag

SEQ ID NO: 3497137 - DNA, 20 bp, Homo sapiens
gaagggaatcctcctccagg

SEQ ID NO: 3497138 - DNA, 17 bp, Homo sapiens
gaagggagctagccaga

SEQ ID NO: 3497139 - DNA, 16 bp, Homo sapiens
gaagggaggggctgtg

SEQ ID NO: 3497140 - DNA, 20 bp, Homo sapiens
gaagggattttagtcacacg

SEQ ID NO: 3497141 - DNA, 13 bp, Homo sapiens
gaagggccagagc

SEQ ID NO: 3497142 - DNA, 14 bp, Homo sapiens
gaagggccagagcc

SEQ ID NO: 3497143 - DNA, 15 bp, Homo sapiens
gaagggccagagcca

SEQ ID NO: 3497144 - DNA, 22 bp, Homo sapiens
gaagggctgcatgatgtttgcc

SEQ ID NO: 3497145 - DNA, 16 bp, Homo sapiens
gaaggggacccccgcc

SEQ ID NO: 3497146 - DNA, 21 bp, Homo sapiens
gaaggggacccccgccccctg

SEQ ID NO: 3497147 - DNA, 14 bp, Homo sapiens
gaaggggccagagg

SEQ ID NO: 3497148 - DNA, 17 bp, Homo sapiens
gaaggggccagaggctc

SEQ ID NO: 3497149 - DNA, 21 bp, Homo sapiens
gaaggggcgtctgttccccct

SEQ ID NO: 3497150 - DNA, 17 bp, Homo sapiens
gaagggtggtggagcca

SEQ ID NO: 3497151 - DNA, 18 bp, Homo sapiens
gaagggtttttagagaat

SEQ ID NO: 3497152 - DNA, 19 bp, Homo sapiens
gaagggtttttagagaatg

SEQ ID NO: 3497153 - DNA, 20 bp, Homo sapiens
gaaggtactgtcatgggcta

SEQ ID NO: 3497154 - DNA, 20 bp, Homo sapiens
gaaggtgcctgccatagcca

SEQ ID NO: 3497155 - DNA, 21 bp, Homo sapiens
gaaggtgcctgccatagccag

SEQ ID NO: 3497156 - DNA, 21 bp, Homo sapiens
gaaggtgctgacggccaggga

SEQ ID NO: 3497157 - DNA, 23 bp, Homo sapiens
gaaggtggtgggggtgcagatga

SEQ ID NO: 3497158 - DNA, 14 bp, Homo sapiens
gaagtaaactgcag

SEQ ID NO: 3497159 - DNA, 13 bp, Homo sapiens
gaagtcacacagt

SEQ ID NO: 3497160 - DNA, 17 bp, Homo sapiens
gaagtccaatgtggcaa

SEQ ID NO: 3497161 - DNA, 18 bp, Homo sapiens
gaagtcctgtatgtctgt

SEQ ID NO: 3497162 - DNA, 14 bp, Homo sapiens
gaagtctggtcaga

SEQ ID NO: 3497163 - DNA, 18 bp, Homo sapiens
gaagtctggtcagagcca

SEQ ID NO: 3497164 - DNA, 19 bp, Homo sapiens
gaagtctggtcagagccac

SEQ ID NO: 3497165 - DNA, 23 bp, Homo sapiens
gaagtctggtcagagccacaggg

SEQ ID NO: 3497166 - DNA, 14 bp, Homo sapiens
gaagtgaacatttc

SEQ ID NO: 3497167 - DNA, 15 bp, Homo sapiens
gaagtgaatgctggg

SEQ ID NO: 3497168 - DNA, 16 bp, Homo sapiens
gaagtgaatgctggga

SEQ ID NO: 3497169 - DNA, 20 bp, Homo sapiens
gaagtgctggcaaccactaa

SEQ ID NO: 3497170 - DNA, 15 bp, Homo sapiens
gaagttattttccag

SEQ ID NO: 3497171 - DNA, 16 bp, Homo sapiens
gaagttctaggaaatt

SEQ ID NO: 3497172 - DNA, 18 bp, Homo sapiens
gaagttgatatagaacag

SEQ ID NO: 3497173 - DNA, 21 bp, Homo sapiens
gaagtttccttggctggtgca

SEQ ID NO: 3497174 - DNA, 19 bp, Homo sapiens
gaagtttgaatgttaaata

SEQ ID NO: 3497175 - DNA, 11 bp, Homo sapiens
gaagttttcaa

SEQ ID NO: 3497176 - DNA, 13 bp, Homo sapiens
gaataaacaaaat

SEQ ID NO: 3497177 - DNA, 18 bp, Homo sapiens
gaataaagaatacttgaa

SEQ ID NO: 3497178 - DNA, 23 bp, Homo sapiens
gagaactgcatatgtttcgctga

SEQ ID NO: 3497179 - DNA, 19 bp, Homo sapiens
gagaactttattttggatt

SEQ ID NO: 3497180 - DNA, 15 bp, Homo sapiens
gagaactttcatttt

SEQ ID NO: 3497181 - DNA, 12 bp, Homo sapiens
gagaagagagga

SEQ ID NO: 3497182 - DNA, 13 bp, Homo sapiens
gagaagccacagg

SEQ ID NO: 3497183 - DNA, 22 bp, Homo sapiens
gagaagccaggaatttcccagg

SEQ ID NO: 3497184 - DNA, 23 bp, Homo sapiens
gagaagccaggaatttcccagga

SEQ ID NO: 3497185 - DNA, 22 bp, Homo sapiens
gagaagcttttgaataaaaact

SEQ ID NO: 3497186 - DNA, 14 bp, Homo sapiens
gagaaggccgctgc

SEQ ID NO: 3497187 - DNA, 16 bp, Homo sapiens
gagaagggctggggcc

SEQ ID NO: 3497188 - DNA, 17 bp, Homo sapiens
gagaaggtgcctgccat

SEQ ID NO: 3497189 - DNA, 23 bp, Homo sapiens
gagaaggtgggttttcatcaaga

SEQ ID NO: 3497190 - DNA, 18 bp, Homo sapiens
gagaataggcagccccca

SEQ ID NO: 3497191 - DNA, 21 bp, Homo sapiens
gagaatattttaagtattgca

SEQ ID NO: 3497192 - DNA, 18 bp, Homo sapiens
gagaatgagagcgacaca

SEQ ID NO: 3497193 - DNA, 16 bp, Homo sapiens
gagaatgtgtttcaaa

SEQ ID NO: 3497194 - DNA, 17 bp, Homo sapiens
gagaatgtgtttcaaaa

SEQ ID NO: 3497195 - DNA, 18 bp, Homo sapiens
gagaattcttacatgttt

SEQ ID NO: 3497196 - DNA, 22 bp, Homo sapiens
gagaattcttacatgttttctt

SEQ ID NO: 3497197 - DNA, 19 bp, Homo sapiens
gagaattgggcggctctga

SEQ ID NO: 3497198 - DNA, 23 bp, Homo sapiens
gagacaagagggaatagtataga

SEQ ID NO: 3497199 - DNA, 16 bp, Homo sapiens
gagacacggagcccag

SEQ ID NO: 3497200 - DNA, 21 bp, Homo sapiens
gagacactcagaccagagaag

SEQ ID NO: 3497201 - DNA, 12 bp, Homo sapiens
gagacagggttt

SEQ ID NO: 3497202 - DNA, 16 bp, Homo sapiens
gagacagtcaccccag

SEQ ID NO: 3497203 - DNA, 18 bp, Homo sapiens
gagacatacttgaagggc

SEQ ID NO: 3497204 - DNA, 18 bp, Homo sapiens
gagaccaggcaaagcaag

SEQ ID NO: 3497205 - DNA, 18 bp, Homo sapiens
gagaccaggccctggcta

SEQ ID NO: 3497206 - DNA, 17 bp, Homo sapiens
gagaccaggctgtgtcc

SEQ ID NO: 3497207 - DNA, 18 bp, Homo sapiens
gagacccagatctcatgg

SEQ ID NO: 3497208 - DNA, 22 bp, Homo sapiens
gagacccagatctcatggaaac

SEQ ID NO: 3497209 - DNA, 20 bp, Homo sapiens
gagaccggggtatcctgggg

SEQ ID NO: 3497210 - DNA, 19 bp, Homo sapiens
gagacggtgtcttgttctg

SEQ ID NO: 3497211 - DNA, 14 bp, Homo sapiens
gagactcgagaact

SEQ ID NO: 3497212 - DNA, 14 bp, Homo sapiens
gagactgggctctg

SEQ ID NO: 3497213 - DNA, 17 bp, Homo sapiens
gagactgggctctggct

SEQ ID NO: 3497214 - DNA, 20 bp, Homo sapiens
gagactgggctgagggagcc

SEQ ID NO: 3497215 - DNA, 12 bp, Homo sapiens
gagacttgcctt

SEQ ID NO: 3497216 - DNA, 18 bp, Homo sapiens
gagagaaaacagacctaa

SEQ ID NO: 3497217 - DNA, 22 bp, Homo sapiens
gagagaaaacagacctaatgct

SEQ ID NO: 3497218 - DNA, 23 bp, Homo sapiens
gagagaaaacagacctaatgctc

SEQ ID NO: 3497219 - DNA, 13 bp, Homo sapiens
gagagaaaatata

SEQ ID NO: 3497220 - DNA, 17 bp, Homo sapiens
gagagaaaatatatgta

SEQ ID NO: 3497221 - DNA, 12 bp, Homo sapiens
gagagagaggct

SEQ ID NO: 3497222 - DNA, 15 bp, Homo sapiens
gagagagcaaggaag

SEQ ID NO: 3497223 - DNA, 14 bp, Homo sapiens
gagagccaaacaga

SEQ ID NO: 3497224 - DNA, 13 bp, Homo sapiens
gagagcctggtgc

SEQ ID NO: 3497225 - DNA, 20 bp, Homo sapiens
gagagccttgggagccactg

SEQ ID NO: 3497226 - DNA, 16 bp, Homo sapiens
gagagcgcctgcccct

SEQ ID NO: 3497227 - DNA, 22 bp, Homo sapiens
gagagcgcctgcccctcccaga

SEQ ID NO: 3497228 - DNA, 15 bp, Homo sapiens
gagagctagcagcag

SEQ ID NO: 3497229 - DNA, 21 bp, Homo sapiens
gagagctggagcctggtgccc

SEQ ID NO: 3497230 - DNA, 13 bp, Homo sapiens
gagagctgggtgt

SEQ ID NO: 3497231 - DNA, 14 bp, Homo sapiens
gagaggaagggtgg

SEQ ID NO: 3497232 - DNA, 18 bp, Homo sapiens
gagaggggaacagactgg

SEQ ID NO: 3497233 - DNA, 15 bp, Homo sapiens
gagaggggacgcagg

SEQ ID NO: 3497234 - DNA, 20 bp, Homo sapiens
gagaggggacgcaggcccct

SEQ ID NO: 3497235 - DNA, 23 bp, Homo sapiens
gagagggggcctgggacttccat

SEQ ID NO: 3497236 - DNA, 14 bp, Homo sapiens
gagaggtgggccag

SEQ ID NO: 3497237 - DNA, 21 bp, Homo sapiens
gagagtcagctctctgccctg

SEQ ID NO: 3497238 - DNA, 13 bp, Homo sapiens
gagagtctggccc

SEQ ID NO: 3497239 - DNA, 15 bp, Homo sapiens
gagagtctggcccta

SEQ ID NO: 3497240 - DNA, 18 bp, Homo sapiens
gagagtctggccctagac

SEQ ID NO: 3497241 - DNA, 21 bp, Homo sapiens
gagagtgtcttcacggcagga

SEQ ID NO: 3497242 - DNA, 14 bp, Homo sapiens
gagagtttcctgaa

SEQ ID NO: 3497243 - DNA, 12 bp, Homo sapiens
gagataatacat

SEQ ID NO: 3497244 - DNA, 16 bp, Homo sapiens
gagataatacattccg

SEQ ID NO: 3497245 - DNA, 13 bp, Homo sapiens
gagatacatacag

SEQ ID NO: 3497246 - DNA, 16 bp, Homo sapiens
gagatacatacagaat

SEQ ID NO: 3497247 - DNA, 15 bp, Homo sapiens
gagataccagcgagg

SEQ ID NO: 3497248 - DNA, 14 bp, Homo sapiens
gagatagcctgtgg

SEQ ID NO: 3497249 - DNA, 17 bp, Homo sapiens
gagatagcctgtggccc

SEQ ID NO: 3497250 - DNA, 20 bp, Homo sapiens
gagatagcctgtggccctgt

SEQ ID NO: 3497251 - DNA, 20 bp, Homo sapiens
gagatcaaccccttcgctcc

SEQ ID NO: 3497252 - DNA, 12 bp, Homo sapiens
gagatcagaaaa

SEQ ID NO: 3497253 - DNA, 13 bp, Homo sapiens
gagatcagcctgg

SEQ ID NO: 3497254 - DNA, 22 bp, Homo sapiens
gagatccaaaagaagcccccag

SEQ ID NO: 3497255 - DNA, 17 bp, Homo sapiens
gagatcctcctgcagac

SEQ ID NO: 3497256 - DNA, 21 bp, Homo sapiens
gagatcgtgccattgcactcc

SEQ ID NO: 3497257 - DNA, 16 bp, Homo sapiens
gagatgctgagggtgt

SEQ ID NO: 3497258 - DNA, 19 bp, Homo sapiens
gagatgctggcttgggcag

SEQ ID NO: 3497259 - DNA, 22 bp, Homo sapiens
gagatggcgctattgcactcca

SEQ ID NO: 3497260 - DNA, 14 bp, Homo sapiens
gagattaagatgcc

SEQ ID NO: 3497261 - DNA, 17 bp, Homo sapiens
gagattcagttttcatt

SEQ ID NO: 3497262 - DNA, 23 bp, Homo sapiens
gagatttcatctgctctccttcc

SEQ ID NO: 3497263 - DNA, 13 bp, Homo sapiens
gagcaaaggctga

SEQ ID NO: 3497264 - DNA, 13 bp, Homo sapiens
gagcaacatttta

SEQ ID NO: 3497265 - DNA, 19 bp, Homo sapiens
gagcacaaaacctgtccta

SEQ ID NO: 3497266 - DNA, 21 bp, Homo sapiens
gagcacacaggtacagcaaca

SEQ ID NO: 3497267 - DNA, 13 bp, Homo sapiens
gagcacacccagc

SEQ ID NO: 3497268 - DNA, 15 bp, Homo sapiens
gagcacacccagccc

SEQ ID NO: 3497269 - DNA, 13 bp, Homo sapiens
gagcaccagggga

SEQ ID NO: 3497270 - DNA, 19 bp, Homo sapiens
gagcacccagatcagactc

SEQ ID NO: 3497271 - DNA, 15 bp, Homo sapiens
gagcaccctctggat

SEQ ID NO: 3497272 - DNA, 18 bp, Homo sapiens
gagcaccgtgtcaagctg

SEQ ID NO: 3497273 - DNA, 21 bp, Homo sapiens
gagcaccgtgtcaagctgctc

SEQ ID NO: 3497274 - DNA, 21 bp, Homo sapiens
gagcactaaggtgtgctctga

SEQ ID NO: 3497275 - DNA, 13 bp, Homo sapiens
gagcactgggttg

SEQ ID NO: 3497276 - DNA, 17 bp, Homo sapiens
gagcactgggttgactt

SEQ ID NO: 3497277 - DNA, 18 bp, Homo sapiens
gagcacttaagagaatat

SEQ ID NO: 3497278 - DNA, 19 bp, Homo sapiens
gagcacttaagagaatatt

SEQ ID NO: 3497279 - DNA, 15 bp, Homo sapiens
gagcagaggggctga

SEQ ID NO: 3497280 - DNA, 18 bp, Homo sapiens
gagcagatggcagatgca

SEQ ID NO: 3497281 - DNA, 15 bp, Homo sapiens
gagcaggactccagg

SEQ ID NO: 3497282 - DNA, 14 bp, Homo sapiens
gagcagggctcagc

SEQ ID NO: 3497283 - DNA, 20 bp, Homo sapiens
gagcagtcctgcctcagcct

SEQ ID NO: 3497284 - DNA, 15 bp, Homo sapiens
gagcagtgcaggcac

SEQ ID NO: 3497285 - DNA, 22 bp, Homo sapiens
gagcagtttctgtcctgctggt

SEQ ID NO: 3497286 - DNA, 15 bp, Homo sapiens
gagcatggagctggc

SEQ ID NO: 3497287 - DNA, 18 bp, Homo sapiens
gagcatttttttattcag

SEQ ID NO: 3497288 - DNA, 20 bp, Homo sapiens
gagccacagggtctgcctcc

SEQ ID NO: 3497289 - DNA, 21 bp, Homo sapiens
gagccacagggtctgcctcca

SEQ ID NO: 3497290 - DNA, 16 bp, Homo sapiens
gagccaccccaggaaa

SEQ ID NO: 3497291 - DNA, 12 bp, Homo sapiens
gagccacctcac

SEQ ID NO: 3497292 - DNA, 15 bp, Homo sapiens
gagccactccggccc

SEQ ID NO: 3497293 - DNA, 14 bp, Homo sapiens
gagccactcctctg

SEQ ID NO: 3497294 - DNA, 19 bp, Homo sapiens
gagccactgcaccgggcca

SEQ ID NO: 3497295 - DNA, 12 bp, Homo sapiens
gagccactgcca

SEQ ID NO: 3497296 - DNA, 17 bp, Homo sapiens
gagccactgccactcca

SEQ ID NO: 3497297 - DNA, 21 bp, Homo sapiens
gagccactgccactccagtcc

SEQ ID NO: 3497298 - DNA, 19 bp, Homo sapiens
gagccagggtctcactatg

SEQ ID NO: 3497299 - DNA, 17 bp, Homo sapiens
gagccagtttgccggat

SEQ ID NO: 3497300 - DNA, 17 bp, Homo sapiens
gagccatgcgccccctc

SEQ ID NO: 3497301 - DNA, 13 bp, Homo sapiens
gagccatttgaga

SEQ ID NO: 3497302 - DNA, 13 bp, Homo sapiens
gagcccaccttgg

SEQ ID NO: 3497303 - DNA, 24 bp, Homo sapiens
gagcccactgtcctgggcctgcag

SEQ ID NO: 3497304 - DNA, 22 bp, Homo sapiens
gagcccagaggagggcagcaga

SEQ ID NO: 3497305 - DNA, 21 bp, Homo sapiens
gagcccagctgggtcaggcag

SEQ ID NO: 3497306 - DNA, 21 bp, Homo sapiens
gagcccaggagtttgaatcca

SEQ ID NO: 3497307 - DNA, 19 bp, Homo sapiens
gagccccatcttcacccag

SEQ ID NO: 3497308 - DNA, 20 bp, Homo sapiens
gagccccatcttcacccagg

SEQ ID NO: 3497309 - DNA, 18 bp, Homo sapiens
gagccccattcctgggaa

SEQ ID NO: 3497310 - DNA, 12 bp, Homo sapiens
gatatagaacag

SEQ ID NO: 3497311 - DNA, 20 bp, Homo sapiens
gatatagacagtccttaaaa

SEQ ID NO: 3497312 - DNA, 18 bp, Homo sapiens
gatatattaaaaatataa

SEQ ID NO: 3497313 - DNA, 15 bp, Homo sapiens
gatatatttaaaaat

SEQ ID NO: 3497314 - DNA, 23 bp, Homo sapiens
gatatgttttatttcattggtta

SEQ ID NO: 3497315 - DNA, 16 bp, Homo sapiens
gatattatgtataaaa

SEQ ID NO: 3497316 - DNA, 17 bp, Homo sapiens
gatattttccatatatt

SEQ ID NO: 3497317 - DNA, 18 bp, Homo sapiens
gatcaaccagctaagaaa

SEQ ID NO: 3497318 - DNA, 13 bp, Homo sapiens
gatcaaggcctta

SEQ ID NO: 3497319 - DNA, 13 bp, Homo sapiens
gatcacaaaaaca

SEQ ID NO: 3497320 - DNA, 15 bp, Homo sapiens
gatcacaacgtgcat

SEQ ID NO: 3497321 - DNA, 18 bp, Homo sapiens
gatcacaacgtgcattgt

SEQ ID NO: 3497322 - DNA, 20 bp, Homo sapiens
gatcacaacgtgcattgtgc

SEQ ID NO: 3497323 - DNA, 23 bp, Homo sapiens
gatcacaacgtgcattgtgcttc

SEQ ID NO: 3497324 - DNA, 19 bp, Homo sapiens
gatcaccatgtattttgta

SEQ ID NO: 3497325 - DNA, 18 bp, Homo sapiens
gatcacgatgtaaattat

SEQ ID NO: 3497326 - DNA, 13 bp, Homo sapiens
gatcacgccactg

SEQ ID NO: 3497327 - DNA, 14 bp, Homo sapiens
gatcacgccactgc

SEQ ID NO: 3497328 - DNA, 16 bp, Homo sapiens
gatcagagccgtggtc

SEQ ID NO: 3497329 - DNA, 14 bp, Homo sapiens
gatcagatctgaca

SEQ ID NO: 3497330 - DNA, 15 bp, Homo sapiens
gatcagcctgggcaa

SEQ ID NO: 3497331 - DNA, 18 bp, Homo sapiens
gatcagggcattgcctgt

SEQ ID NO: 3497332 - DNA, 13 bp, Homo sapiens
gatcaggtgggga

SEQ ID NO: 3497333 - DNA, 14 bp, Homo sapiens
gatcaggtggggag

SEQ ID NO: 3497334 - DNA, 13 bp, Homo sapiens
gatcagtggacag

SEQ ID NO: 3497335 - DNA, 17 bp, Homo sapiens
gatcatccactgtgcca

SEQ ID NO: 3497336 - DNA, 16 bp, Homo sapiens
gatcatcgccagaggt

SEQ ID NO: 3497337 - DNA, 23 bp, Homo sapiens
gatcatcgtcatttgctgtgaac

SEQ ID NO: 3497338 - DNA, 20 bp, Homo sapiens
gatcatgtactttttagtaa

SEQ ID NO: 3497339 - DNA, 13 bp, Homo sapiens
gatccaaaagaag

SEQ ID NO: 3497340 - DNA, 17 bp, Homo sapiens
gatccaagctggtccca

SEQ ID NO: 3497341 - DNA, 12 bp, Homo sapiens
gatccagcctgg

SEQ ID NO: 3497342 - DNA, 12 bp, Homo sapiens
gatccaggacta

SEQ ID NO: 3497343 - DNA, 14 bp, Homo sapiens
gatccagggacaga

SEQ ID NO: 3497344 - DNA, 16 bp, Homo sapiens
gatccagggactgaag

SEQ ID NO: 3497345 - DNA, 23 bp, Homo sapiens
gatccataaagacaatcactgcc

SEQ ID NO: 3497346 - DNA, 15 bp, Homo sapiens
gatcccacacaggct

SEQ ID NO: 3497347 - DNA, 12 bp, Homo sapiens
gatccctcatct

SEQ ID NO: 3497348 - DNA, 14 bp, Homo sapiens
gatccctcatctgt

SEQ ID NO: 3497349 - DNA, 18 bp, Homo sapiens
gatccctcatctgtccct

SEQ ID NO: 3497350 - DNA, 21 bp, Homo sapiens
gatccctcccccccatgcact

SEQ ID NO: 3497351 - DNA, 23 bp, Homo sapiens
gatccctctacagagcttccctg

SEQ ID NO: 3497352 - DNA, 14 bp, Homo sapiens
gatccgtttgacca

SEQ ID NO: 3497353 - DNA, 19 bp, Homo sapiens
gatccgtttgaccaatttg

SEQ ID NO: 3497354 - DNA, 21 bp, Homo sapiens
gatccgtttgaccaatttgca

SEQ ID NO: 3497355 - DNA, 15 bp, Homo sapiens
gatcctcctgcagac

SEQ ID NO: 3497356 - DNA, 12 bp, Homo sapiens
gatcctctctgg

SEQ ID NO: 3497357 - DNA, 16 bp, Homo sapiens
gatcctctctggggct

SEQ ID NO: 3497358 - DNA, 18 bp, Homo sapiens
gatcctgcgggtggggct

SEQ ID NO: 3497359 - DNA, 12 bp, Homo sapiens
gatcctggaggc

SEQ ID NO: 3497360 - DNA, 17 bp, Homo sapiens
gatcctgggctgggtgg

SEQ ID NO: 3497361 - DNA, 23 bp, Homo sapiens
gatcctgggtggtctgcaggcag

SEQ ID NO: 3497362 - DNA, 22 bp, Homo sapiens
gatcctgtgaggagccccatct

SEQ ID NO: 3497363 - DNA, 15 bp, Homo sapiens
gatcgcatttcctaa

SEQ ID NO: 3497364 - DNA, 18 bp, Homo sapiens
gatcgtctgactggtgtt

SEQ ID NO: 3497365 - DNA, 22 bp, Homo sapiens
gatctcaggagcttgcaagaag

SEQ ID NO: 3497366 - DNA, 20 bp, Homo sapiens
gatctcatggaaactggcca

SEQ ID NO: 3497367 - DNA, 16 bp, Homo sapiens
gatctcggctcagtgc

SEQ ID NO: 3497368 - DNA, 14 bp, Homo sapiens
gatctcggtttgcc

SEQ ID NO: 3497369 - DNA, 20 bp, Homo sapiens
gatctcggtttgccaaaatt

SEQ ID NO: 3497370 - DNA, 15 bp, Homo sapiens
gatctctgcagggcc

SEQ ID NO: 3497371 - DNA, 16 bp, Homo sapiens
gatctctgcagggccg

SEQ ID NO: 3497372 - DNA, 17 bp, Homo sapiens
gatctcttgagcctggg

SEQ ID NO: 3497373 - DNA, 18 bp, Homo sapiens
gatctcttgagcctggga

SEQ ID NO: 3497374 - DNA, 19 bp, Homo sapiens
gatctgacatgattccttc

SEQ ID NO: 3497375 - DNA, 15 bp, Homo sapiens
gatctgagaatcttt

SEQ ID NO: 3497376 - DNA, 18 bp, Homo sapiens
gatctgagaatctttatt

SEQ ID NO: 3497377 - DNA, 12 bp, Homo sapiens
gatctggaacct

SEQ ID NO: 3497378 - DNA, 16 bp, Homo sapiens
gatctggaacctcagc

SEQ ID NO: 3497379 - DNA, 18 bp, Homo sapiens
gatctggaacctcagcct

SEQ ID NO: 3497380 - DNA, 17 bp, Homo sapiens
gatctggggctctggga

SEQ ID NO: 3497381 - DNA, 15 bp, Homo sapiens
gatctggtcctaccc

SEQ ID NO: 3497382 - DNA, 16 bp, Homo sapiens
gatctggtcctaccca

SEQ ID NO: 3497383 - DNA, 16 bp, Homo sapiens
gatctgtcctcagcct

SEQ ID NO: 3497384 - DNA, 17 bp, Homo sapiens
gatctgtcctcagcctt

SEQ ID NO: 3497385 - DNA, 18 bp, Homo sapiens
gatctgtcctcagccttg

SEQ ID NO: 3497386 - DNA, 22 bp, Homo sapiens
gatctttaactggaaggctgct

SEQ ID NO: 3497387 - DNA, 20 bp, Homo sapiens
gatctttattatggaaaaca

SEQ ID NO: 3497388 - DNA, 23 bp, Homo sapiens
gatctttattatggaaaacattt

SEQ ID NO: 3497389 - DNA, 21 bp, Homo sapiens
gatgaatagaagttttaaatt

SEQ ID NO: 3497390 - DNA, 13 bp, Homo sapiens
gatgaatgagaat

SEQ ID NO: 3497391 - DNA, 13 bp, Homo sapiens
gatgacagctctt

SEQ ID NO: 3497392 - DNA, 22 bp, Homo sapiens
gatgactatgcagaggcctggg

SEQ ID NO: 3497393 - DNA, 13 bp, Homo sapiens
gatgactgccttg

SEQ ID NO: 3497394 - DNA, 22 bp, Homo sapiens
gatgactgccttgcctcctcag

SEQ ID NO: 3497395 - DNA, 11 bp, Homo sapiens
gatgagaaagg

SEQ ID NO: 3497396 - DNA, 22 bp, Homo sapiens
gatgagaaaggttgaagcacca

SEQ ID NO: 3497397 - DNA, 18 bp, Homo sapiens
gatgagagttttggatgc

SEQ ID NO: 3497398 - DNA, 21 bp, Homo sapiens
gatgagagttttggatgcagt

SEQ ID NO: 3497399 - DNA, 16 bp, Homo sapiens
gatgagatttttaaaa

SEQ ID NO: 3497400 - DNA, 11 bp, Homo sapiens
gatgagctcta

SEQ ID NO: 3497401 - DNA, 20 bp, Homo sapiens
gatgagctctacccagggcc

SEQ ID NO: 3497402 - DNA, 16 bp, Homo sapiens
gatgaggtattttttc

SEQ ID NO: 3497403 - DNA, 14 bp, Homo sapiens
gatgatgtgcctgg

SEQ ID NO: 3497404 - DNA, 15 bp, Homo sapiens
gatgatgtgcctggg

SEQ ID NO: 3497405 - DNA, 13 bp, Homo sapiens
gatgatgtgtata

SEQ ID NO: 3497406 - DNA, 15 bp, Homo sapiens
gatgcagggcagtca

SEQ ID NO: 3497407 - DNA, 22 bp, Homo sapiens
gatgcaggtgagcccatggccc

SEQ ID NO: 3497408 - DNA, 18 bp, Homo sapiens
gatgccactcctccctcc

SEQ ID NO: 3497409 - DNA, 17 bp, Homo sapiens
gatgcccaaatccttag

SEQ ID NO: 3497410 - DNA, 12 bp, Homo sapiens
gatgccctggag

SEQ ID NO: 3497411 - DNA, 12 bp, Homo sapiens
gatgcctaagta

SEQ ID NO: 3497412 - DNA, 18 bp, Homo sapiens
gatgccttttttgtagtt

SEQ ID NO: 3497413 - DNA, 23 bp, Homo sapiens
gatgcgcattctaacctggaggt

SEQ ID NO: 3497414 - DNA, 16 bp, Homo sapiens
gatgcgttcagcagac

SEQ ID NO: 3497415 - DNA, 19 bp, Homo sapiens
gatgcgttcagcagactgg

SEQ ID NO: 3497416 - DNA, 20 bp, Homo sapiens
gatgctcaaaatctttccaa

SEQ ID NO: 3497417 - DNA, 13 bp, Homo sapiens
gatgctccttggg

SEQ ID NO: 3497418 - DNA, 21 bp, Homo sapiens
gatgctgacattcacctgccc

SEQ ID NO: 3497419 - DNA, 17 bp, Homo sapiens
gatgctgccggcacagc

SEQ ID NO: 3497420 - DNA, 19 bp, Homo sapiens
gatgctgccggcacagctg

SEQ ID NO: 3497421 - DNA, 14 bp, Homo sapiens
gatgctggatgctc

SEQ ID NO: 3497422 - DNA, 16 bp, Homo sapiens
gatgctggatgctcct

SEQ ID NO: 3497423 - DNA, 14 bp, Homo sapiens
gatgctggcccagg

SEQ ID NO: 3497424 - DNA, 16 bp, Homo sapiens
gatgctggcccagggc

SEQ ID NO: 3497425 - DNA, 19 bp, Homo sapiens
gatgctggcccagggccca

SEQ ID NO: 3497426 - DNA, 22 bp, Homo sapiens
gatgctggcccagggcccagag

SEQ ID NO: 3497427 - DNA, 11 bp, Homo sapiens
gatgctgggat

SEQ ID NO: 3497428 - DNA, 20 bp, Homo sapiens
gatgcttagagggatttctt

SEQ ID NO: 3497429 - DNA, 14 bp, Homo sapiens
gatgcttttaacag

SEQ ID NO: 3497430 - DNA, 17 bp, Homo sapiens
gatggaaccgcaggaag

SEQ ID NO: 3497431 - DNA, 18 bp, Homo sapiens
gatggaaccgcaggaagc

SEQ ID NO: 3497432 - DNA, 22 bp, Homo sapiens
gatggaaccgcaggaagctgct

SEQ ID NO: 3497433 - DNA, 21 bp, Homo sapiens
gatggaagttgcagtgagctg

SEQ ID NO: 3497434 - DNA, 15 bp, Homo sapiens
gatggagtgagccca

SEQ ID NO: 3497435 - DNA, 17 bp, Homo sapiens
gatggagtgagcccatg

SEQ ID NO: 3497436 - DNA, 22 bp, Homo sapiens
gatggatttccagccaaagcct

SEQ ID NO: 3497437 - DNA, 17 bp, Homo sapiens
gatggcaacagatctgg

SEQ ID NO: 3497438 - DNA, 13 bp, Homo sapiens
gatggcagatgca

SEQ ID NO: 3497439 - DNA, 15 bp, Homo sapiens
gatggcagatgcaca

SEQ ID NO: 3497440 - DNA, 16 bp, Homo sapiens
gatggcagatgcacat

SEQ ID NO: 3497441 - DNA, 15 bp, Homo sapiens
gatggcaggatggcc

SEQ ID NO: 3497442 - DNA, 17 bp, Homo sapiens
gatggcaggatggcctg

SEQ ID NO: 3497443 - DNA, 15 bp, Homo sapiens
gcagtgtgaggccag

SEQ ID NO: 3497444 - DNA, 19 bp, Homo sapiens
gcagtgtgaggccagggca

SEQ ID NO: 3497445 - DNA, 14 bp, Homo sapiens
gcagtgtgcccccc

SEQ ID NO: 3497446 - DNA, 22 bp, Homo sapiens
gcagtgtgccccccagccccgg

SEQ ID NO: 3497447 - DNA, 17 bp, Homo sapiens
gcagttattaacactaa

SEQ ID NO: 3497448 - DNA, 14 bp, Homo sapiens
gcagtttgaaattc

SEQ ID NO: 3497449 - DNA, 19 bp, Homo sapiens
gcagtttgaaattctgaat

SEQ ID NO: 3497450 - DNA, 17 bp, Homo sapiens
gcataacaattcctcta

SEQ ID NO: 3497451 - DNA, 14 bp, Homo sapiens
gcataatgtcttta

SEQ ID NO: 3497452 - DNA, 14 bp, Homo sapiens
gcatactttgtaaa

SEQ ID NO: 3497453 - DNA, 16 bp, Homo sapiens
gcatagatgcaggtga

SEQ ID NO: 3497454 - DNA, 15 bp, Homo sapiens
gcatagcagctgcta

SEQ ID NO: 3497455 - DNA, 18 bp, Homo sapiens
gcatagcccatgttaagt

SEQ ID NO: 3497456 - DNA, 13 bp, Homo sapiens
gcatatacaataa

SEQ ID NO: 3497457 - DNA, 16 bp, Homo sapiens
gcatatctgcctttat

SEQ ID NO: 3497458 - DNA, 18 bp, Homo sapiens
gcatatctgcctttattg

SEQ ID NO: 3497459 - DNA, 13 bp, Homo sapiens
gcatatgtgtgtg

SEQ ID NO: 3497460 - DNA, 17 bp, Homo sapiens
gcatatgttgaatactt

SEQ ID NO: 3497461 - DNA, 18 bp, Homo sapiens
gcatatgttgaatacttt

SEQ ID NO: 3497462 - DNA, 21 bp, Homo sapiens
gcatatgtttcgctgatatat

SEQ ID NO: 3497463 - DNA, 21 bp, Homo sapiens
gcatatttatccaaaatgtgt

SEQ ID NO: 3497464 - DNA, 12 bp, Homo sapiens
gcatcaagccac

SEQ ID NO: 3497465 - DNA, 17 bp, Homo sapiens
gcatcatagtagttttt

SEQ ID NO: 3497466 - DNA, 17 bp, Homo sapiens
gcatccatctgggctac

SEQ ID NO: 3497467 - DNA, 18 bp, Homo sapiens
gcatcccttgaccaggcc

SEQ ID NO: 3497468 - DNA, 13 bp, Homo sapiens
gcatcctctgact

SEQ ID NO: 3497469 - DNA, 15 bp, Homo sapiens
gcatcctctgactcc

SEQ ID NO: 3497470 - DNA, 20 bp, Homo sapiens
gcatcctctgactccactca

SEQ ID NO: 3497471 - DNA, 17 bp, Homo sapiens
gcatcctggcacccggc

SEQ ID NO: 3497472 - DNA, 21 bp, Homo sapiens
gcatcctggcacccggcccct

SEQ ID NO: 3497473 - DNA, 22 bp, Homo sapiens
gcatcctggcacccggcccctg

SEQ ID NO: 3497474 - DNA, 18 bp, Homo sapiens
gcatcgcaccattctgac

SEQ ID NO: 3497475 - DNA, 20 bp, Homo sapiens
gcatcgcaccattctgactc

SEQ ID NO: 3497476 - DNA, 22 bp, Homo sapiens
gcatcggacaagacccccagca

SEQ ID NO: 3497477 - DNA, 16 bp, Homo sapiens
gcatcggcctagggcc

SEQ ID NO: 3497478 - DNA, 20 bp, Homo sapiens
gcatcggcctagggccccca

SEQ ID NO: 3497479 - DNA, 20 bp, Homo sapiens
gcatctagcatgtcgtcaaa

SEQ ID NO: 3497480 - DNA, 14 bp, Homo sapiens
gcatctctgtactt

SEQ ID NO: 3497481 - DNA, 14 bp, Homo sapiens
gcatctgaccagca

SEQ ID NO: 3497482 - DNA, 15 bp, Homo sapiens
gcatctgaccagcag

SEQ ID NO: 3497483 - DNA, 18 bp, Homo sapiens
gcatctgaccagcagcgc

SEQ ID NO: 3497484 - DNA, 20 bp, Homo sapiens
gcatctgaccagcagcgcct

SEQ ID NO: 3497485 - DNA, 11 bp, Homo sapiens
gcatctgtata

SEQ ID NO: 3497486 - DNA, 21 bp, Homo sapiens
gcatctgtataagtaagaaaa

SEQ ID NO: 3497487 - DNA, 22 bp, Homo sapiens
gcatctgtataagtaagaaaat

SEQ ID NO: 3497488 - DNA, 16 bp, Homo sapiens
gcatctttcatatggt

SEQ ID NO: 3497489 - DNA, 19 bp, Homo sapiens
gcatgacaaaaattatttt

SEQ ID NO: 3497490 - DNA, 18 bp, Homo sapiens
gcatgacagcctgcagca

SEQ ID NO: 3497491 - DNA, 22 bp, Homo sapiens
gcatgatccaagcaagactgag

SEQ ID NO: 3497492 - DNA, 22 bp, Homo sapiens
gcatgcactgttccccctgtgc

SEQ ID NO: 3497493 - DNA, 23 bp, Homo sapiens
gcatgcactgttccccctgtgca

SEQ ID NO: 3497494 - DNA, 11 bp, Homo sapiens
gcatggaaggg

SEQ ID NO: 3497495 - DNA, 15 bp, Homo sapiens
gcatggtcacacact

SEQ ID NO: 3497496 - DNA, 15 bp, Homo sapiens
gcatggtgccccagg

SEQ ID NO: 3497497 - DNA, 19 bp, Homo sapiens
gcatggtgccccaggacca

SEQ ID NO: 3497498 - DNA, 20 bp, Homo sapiens
gcatggtgccccaggaccag

SEQ ID NO: 3497499 - DNA, 21 bp, Homo sapiens
gcatggtgccccaggaccagc

SEQ ID NO: 3497500 - DNA, 15 bp, Homo sapiens
gcatgtaaacacgcc

SEQ ID NO: 3497501 - DNA, 17 bp, Homo sapiens
gcatgtaaacacgcctg

SEQ ID NO: 3497502 - DNA, 17 bp, Homo sapiens
gcatgtaatcccagcta

SEQ ID NO: 3497503 - DNA, 15 bp, Homo sapiens
gcatgtgactctgaa

SEQ ID NO: 3497504 - DNA, 15 bp, Homo sapiens
gcatgttctctgagg

SEQ ID NO: 3497505 - DNA, 22 bp, Homo sapiens
gcatgttctctgaggacactaa

SEQ ID NO: 3497506 - DNA, 18 bp, Homo sapiens
gcatgttgaccatgtcta

SEQ ID NO: 3497507 - DNA, 15 bp, Homo sapiens
gcatgtttccagcag

SEQ ID NO: 3497508 - DNA, 19 bp, Homo sapiens
gcatgttttccagctcctc

SEQ ID NO: 3497509 - DNA, 13 bp, Homo sapiens
gcattaacacaaa

SEQ ID NO: 3497510 - DNA, 18 bp, Homo sapiens
gcattagatagtcatgct

SEQ ID NO: 3497511 - DNA, 19 bp, Homo sapiens
gcattagatagtcatgctg

SEQ ID NO: 3497512 - DNA, 20 bp, Homo sapiens
gcattagatagtcatgctgc

SEQ ID NO: 3497513 - DNA, 17 bp, Homo sapiens
gcattctaacctggagg

SEQ ID NO: 3497514 - DNA, 14 bp, Homo sapiens
gcattctctgaaga

SEQ ID NO: 3497515 - DNA, 12 bp, Homo sapiens
gcattgaacaca

SEQ ID NO: 3497516 - DNA, 19 bp, Homo sapiens
gcattgaacacaaactgta

SEQ ID NO: 3497517 - DNA, 22 bp, Homo sapiens
gcattgaccgcgactaatttca

SEQ ID NO: 3497518 - DNA, 22 bp, Homo sapiens
gcattgagaactgcatatgttt

SEQ ID NO: 3497519 - DNA, 16 bp, Homo sapiens
gcattgattcagtatt

SEQ ID NO: 3497520 - DNA, 11 bp, Homo sapiens
gcattgtaaat

SEQ ID NO: 3497521 - DNA, 12 bp, Homo sapiens
gcattgtaaata

SEQ ID NO: 3497522 - DNA, 14 bp, Homo sapiens
gcattgtttctgtg

SEQ ID NO: 3497523 - DNA, 14 bp, Homo sapiens
gcatttacaaggtt

SEQ ID NO: 3497524 - DNA, 18 bp, Homo sapiens
gcatttactttgtgttca

SEQ ID NO: 3497525 - DNA, 22 bp, Homo sapiens
gcatttcactttcccggtgttc

SEQ ID NO: 3497526 - DNA, 13 bp, Homo sapiens
gcatttcctgctg

SEQ ID NO: 3497527 - DNA, 14 bp, Homo sapiens
gcatttctgtattt

SEQ ID NO: 3497528 - DNA, 19 bp, Homo sapiens
gcatttctgtattttttgt

SEQ ID NO: 3497529 - DNA, 16 bp, Homo sapiens
gcatttgaatgcattt

SEQ ID NO: 3497530 - DNA, 21 bp, Homo sapiens
gcatttgatctgttgcaagcc

SEQ ID NO: 3497531 - DNA, 14 bp, Homo sapiens
gcatttgctgaata

SEQ ID NO: 3497532 - DNA, 20 bp, Homo sapiens
gcatttgggtaatttagatt

SEQ ID NO: 3497533 - DNA, 20 bp, Homo sapiens
gcattttcctccatcgcagt

SEQ ID NO: 3497534 - DNA, 22 bp, Homo sapiens
gcattttgctaaatgtgaatga

SEQ ID NO: 3497535 - DNA, 14 bp, Homo sapiens
gcattttgtatttg

SEQ ID NO: 3497536 - DNA, 14 bp, Homo sapiens
gcattttttatgat

SEQ ID NO: 3497537 - DNA, 13 bp, Homo sapiens
gccaaaaaggata

SEQ ID NO: 3497538 - DNA, 14 bp, Homo sapiens
gccaaaagctgctc

SEQ ID NO: 3497539 - DNA, 13 bp, Homo sapiens
gccaaacagacag

SEQ ID NO: 3497540 - DNA, 15 bp, Homo sapiens
gccaaacctctgttc

SEQ ID NO: 3497541 - DNA, 19 bp, Homo sapiens
gccaaagagcctttccaaa

SEQ ID NO: 3497542 - DNA, 16 bp, Homo sapiens
gccaaataatgtctct

SEQ ID NO: 3497543 - DNA, 14 bp, Homo sapiens
gccaaattttatct

SEQ ID NO: 3497544 - DNA, 17 bp, Homo sapiens
gccaacagaagcttcca

SEQ ID NO: 3497545 - DNA, 15 bp, Homo sapiens
gccaacctattttga

SEQ ID NO: 3497546 - DNA, 15 bp, Homo sapiens
gccaactagcccctg

SEQ ID NO: 3497547 - DNA, 16 bp, Homo sapiens
gccaactagcccctgg

SEQ ID NO: 3497548 - DNA, 20 bp, Homo sapiens
gccaactagcccctggggtg

SEQ ID NO: 3497549 - DNA, 17 bp, Homo sapiens
gccaactggtgtttgaa

SEQ ID NO: 3497550 - DNA, 19 bp, Homo sapiens
gccaacttcttcagagctg

SEQ ID NO: 3497551 - DNA, 21 bp, Homo sapiens
gccaagaaacgtcttctaaac

SEQ ID NO: 3497552 - DNA, 17 bp, Homo sapiens
gccaagccagctgccta

SEQ ID NO: 3497553 - DNA, 16 bp, Homo sapiens
gccaagctccaagccc

SEQ ID NO: 3497554 - DNA, 17 bp, Homo sapiens
gccaagctccttgggag

SEQ ID NO: 3497555 - DNA, 16 bp, Homo sapiens
gccaaggagctgctat

SEQ ID NO: 3497556 - DNA, 20 bp, Homo sapiens
gccaaggagggtgagtgcaa

SEQ ID NO: 3497557 - DNA, 18 bp, Homo sapiens
gccaaggcagcgacccca

SEQ ID NO: 3497558 - DNA, 17 bp, Homo sapiens
gccaagtttatatacaa

SEQ ID NO: 3497559 - DNA, 13 bp, Homo sapiens
gccaattcctata

SEQ ID NO: 3497560 - DNA, 21 bp, Homo sapiens
gccacaaggacttcctgtcca

SEQ ID NO: 3497561 - DNA, 21 bp, Homo sapiens
gccacaatgcagttctgagca

SEQ ID NO: 3497562 - DNA, 16 bp, Homo sapiens
gccacaccctccccat

SEQ ID NO: 3497563 - DNA, 17 bp, Homo sapiens
gccacaccctccccatt

SEQ ID NO: 3497564 - DNA, 13 bp, Homo sapiens
gccacactcagca

SEQ ID NO: 3497565 - DNA, 17 bp, Homo sapiens
gccacactcagcacaag

SEQ ID NO: 3497566 - DNA, 13 bp, Homo sapiens
gccacagagaaag

SEQ ID NO: 3497567 - DNA, 20 bp, Homo sapiens
gccacagagaaagtacttct

SEQ ID NO: 3497568 - DNA, 16 bp, Homo sapiens
gccacagcctcccctg

SEQ ID NO: 3497569 - DNA, 21 bp, Homo sapiens
gccacagcctgggaaggagcg

SEQ ID NO: 3497570 - DNA, 12 bp, Homo sapiens
gccacaggaccc

SEQ ID NO: 3497571 - DNA, 16 bp, Homo sapiens
gccacagggtctgcct

SEQ ID NO: 3497572 - DNA, 15 bp, Homo sapiens
gccacagtgggatga

SEQ ID NO: 3497573 - DNA, 14 bp, Homo sapiens
gccacatttggaat

SEQ ID NO: 3497574 - DNA, 16 bp, Homo sapiens
gccaccaccctgtctt

SEQ ID NO: 3497575 - DNA, 18 bp, Homo sapiens
gccaccaccctgtcttcc

SEQ ID NO: 3497576 - DNA, 13 bp, Homo sapiens
gcctcctgtgtgt

SEQ ID NO: 3497577 - DNA, 19 bp, Homo sapiens
gcctcctgtgtgtgcgcct

SEQ ID NO: 3497578 - DNA, 10 bp, Homo sapiens
gcctccttta

SEQ ID NO: 3497579 - DNA, 16 bp, Homo sapiens
gcctcgaactggctgc

SEQ ID NO: 3497580 - DNA, 20 bp, Homo sapiens
gcctctccccaggtccagct

SEQ ID NO: 3497581 - DNA, 23 bp, Homo sapiens
gcctctccccaggtccagctctg

SEQ ID NO: 3497582 - DNA, 21 bp, Homo sapiens
gcctctccttgtggcctgggc

SEQ ID NO: 3497583 - DNA, 22 bp, Homo sapiens
gcctctccttgtggcctgggcc

SEQ ID NO: 3497584 - DNA, 16 bp, Homo sapiens
gcctctgacacacagc

SEQ ID NO: 3497585 - DNA, 22 bp, Homo sapiens
gcctctgcaactgctcagctct

SEQ ID NO: 3497586 - DNA, 13 bp, Homo sapiens
gcctctgcctctg

SEQ ID NO: 3497587 - DNA, 22 bp, Homo sapiens
gcctctgggtcagtggtccaca

SEQ ID NO: 3497588 - DNA, 21 bp, Homo sapiens
gcctctgtccccttctctcat

SEQ ID NO: 3497589 - DNA, 17 bp, Homo sapiens
gcctctgtgctgtgtgt

SEQ ID NO: 3497590 - DNA, 16 bp, Homo sapiens
gcctcttctgtccctg

SEQ ID NO: 3497591 - DNA, 20 bp, Homo sapiens
gcctcttggggaaggggcac

SEQ ID NO: 3497592 - DNA, 17 bp, Homo sapiens
gcctctttctgtccctt

SEQ ID NO: 3497593 - DNA, 23 bp, Homo sapiens
gcctctttgtctaaaacaataaa

SEQ ID NO: 3497594 - DNA, 20 bp, Homo sapiens
gcctcttttacctgctgctt

SEQ ID NO: 3497595 - DNA, 23 bp, Homo sapiens
gcctgaaaggagcccttatctgt

SEQ ID NO: 3497596 - DNA, 15 bp, Homo sapiens
gcctgaacagaagct

SEQ ID NO: 3497597 - DNA, 20 bp, Homo sapiens
gcctgaagagtcctctgaat

SEQ ID NO: 3497598 - DNA, 15 bp, Homo sapiens
gcctgaagtcacaca

SEQ ID NO: 3497599 - DNA, 22 bp, Homo sapiens
gcctgaagtcacacagtgagtc

SEQ ID NO: 3497600 - DNA, 18 bp, Homo sapiens
gcctgaatcatgagcctg

SEQ ID NO: 3497601 - DNA, 21 bp, Homo sapiens
gcctgaatcatgagcctgctg

SEQ ID NO: 3497602 - DNA, 22 bp, Homo sapiens
gcctgaatgcttataggtggcc

SEQ ID NO: 3497603 - DNA, 15 bp, Homo sapiens
gcctgacaaggccag

SEQ ID NO: 3497604 - DNA, 18 bp, Homo sapiens
gcctgacaggctgtgact

SEQ ID NO: 3497605 - DNA, 22 bp, Homo sapiens
gcctgacagtgtgggacaggct

SEQ ID NO: 3497606 - DNA, 13 bp, Homo sapiens
gcctgactgctca

SEQ ID NO: 3497607 - DNA, 20 bp, Homo sapiens
gcctgagagtcagctctctg

SEQ ID NO: 3497608 - DNA, 16 bp, Homo sapiens
gcctgagcctggccag

SEQ ID NO: 3497609 - DNA, 17 bp, Homo sapiens
gcctgagcctggccagc

SEQ ID NO: 3497610 - DNA, 16 bp, Homo sapiens
gcctgatcagaccacg

SEQ ID NO: 3497611 - DNA, 20 bp, Homo sapiens
gcctgatcagaccacggctc

SEQ ID NO: 3497612 - DNA, 19 bp, Homo sapiens
gcctgatgagatttttaaa

SEQ ID NO: 3497613 - DNA, 17 bp, Homo sapiens
gcctgcaaacgctgcct

SEQ ID NO: 3497614 - DNA, 19 bp, Homo sapiens
gcctgcagaagtaagcctc

SEQ ID NO: 3497615 - DNA, 16 bp, Homo sapiens
gcctgcagaatttggg

SEQ ID NO: 3497616 - DNA, 18 bp, Homo sapiens
gcctgcaggacctgcctg

SEQ ID NO: 3497617 - DNA, 18 bp, Homo sapiens
gcctgccagctgcactga

SEQ ID NO: 3497618 - DNA, 20 bp, Homo sapiens
gcctgccatagccaggagcg

SEQ ID NO: 3497619 - DNA, 18 bp, Homo sapiens
gcctgcccaggcccctgc

SEQ ID NO: 3497620 - DNA, 20 bp, Homo sapiens
gcctgcccagtcgaccccaa

SEQ ID NO: 3497621 - DNA, 16 bp, Homo sapiens
gcctgcccgtaaacac

SEQ ID NO: 3497622 - DNA, 20 bp, Homo sapiens
gcctgccgggctgagggcct

SEQ ID NO: 3497623 - DNA, 16 bp, Homo sapiens
gcctgcctcttctcta

SEQ ID NO: 3497624 - DNA, 21 bp, Homo sapiens
gcctgcgccaccgcccagaga

SEQ ID NO: 3497625 - DNA, 14 bp, Homo sapiens
gcctgcgcctgctg

SEQ ID NO: 3497626 - DNA, 17 bp, Homo sapiens
gcctgctaattccccag

SEQ ID NO: 3497627 - DNA, 20 bp, Homo sapiens
gcctgctagctagctcaact

SEQ ID NO: 3497628 - DNA, 23 bp, Homo sapiens
gcctgctagctagctcaactagt

SEQ ID NO: 3497629 - DNA, 17 bp, Homo sapiens
gcctgctccagacctga

SEQ ID NO: 3497630 - DNA, 18 bp, Homo sapiens
gcctgctccagctgttca

SEQ ID NO: 3497631 - DNA, 14 bp, Homo sapiens
gcctgctgcatgcc

SEQ ID NO: 3497632 - DNA, 21 bp, Homo sapiens
gcctgctgcatgccctctcag

SEQ ID NO: 3497633 - DNA, 18 bp, Homo sapiens
gcctgctggaagcccagc

SEQ ID NO: 3497634 - DNA, 15 bp, Homo sapiens
gcctgctggaggcct

SEQ ID NO: 3497635 - DNA, 18 bp, Homo sapiens
gcctgctggaggcctcag

SEQ ID NO: 3497636 - DNA, 23 bp, Homo sapiens
gcctgctggaggcctcaggtgct

SEQ ID NO: 3497637 - DNA, 15 bp, Homo sapiens
gcctggaagacagag

SEQ ID NO: 3497638 - DNA, 14 bp, Homo sapiens
gcctggaccctgtg

SEQ ID NO: 3497639 - DNA, 17 bp, Homo sapiens
gcctggagacttagggc

SEQ ID NO: 3497640 - DNA, 23 bp, Homo sapiens
gcctggagacttagggcaccagg

SEQ ID NO: 3497641 - DNA, 19 bp, Homo sapiens
gcctggagatcctcctgca

SEQ ID NO: 3497642 - DNA, 12 bp, Homo sapiens
gcctggagccct

SEQ ID NO: 3497643 - DNA, 14 bp, Homo sapiens
gcctggagccctcc

SEQ ID NO: 3497644 - DNA, 20 bp, Homo sapiens
gcctggatgcggatggccgg

SEQ ID NO: 3497645 - DNA, 20 bp, Homo sapiens
gcctggccaacatggcgaaa

SEQ ID NO: 3497646 - DNA, 20 bp, Homo sapiens
gcctggccagacacaggccc

SEQ ID NO: 3497647 - DNA, 21 bp, Homo sapiens
gcctggccagatgcaccagcc

SEQ ID NO: 3497648 - DNA, 22 bp, Homo sapiens
gcctggccagatgcaccagccc

SEQ ID NO: 3497649 - DNA, 16 bp, Homo sapiens
gcctggccagcctaca

SEQ ID NO: 3497650 - DNA, 21 bp, Homo sapiens
gcctggccagcctacaatggg

SEQ ID NO: 3497651 - DNA, 17 bp, Homo sapiens
gcctggccagggcctgg

SEQ ID NO: 3497652 - DNA, 21 bp, Homo sapiens
gcctgggacttccatgcctta

SEQ ID NO: 3497653 - DNA, 22 bp, Homo sapiens
gcctgggaggtcaaggctgcag

SEQ ID NO: 3497654 - DNA, 21 bp, Homo sapiens
gcctgggcctcctcacaacat

SEQ ID NO: 3497655 - DNA, 21 bp, Homo sapiens
gcctgggggacccctggctct

SEQ ID NO: 3497656 - DNA, 22 bp, Homo sapiens
gcctggggtaccaagagactcc

SEQ ID NO: 3497657 - DNA, 22 bp, Homo sapiens
gcctggggtggggtcatgccct

SEQ ID NO: 3497658 - DNA, 20 bp, Homo sapiens
gcctgggtgacagagcaaga

SEQ ID NO: 3497659 - DNA, 15 bp, Homo sapiens
gcctggtattttcaa

SEQ ID NO: 3497660 - DNA, 13 bp, Homo sapiens
gcctggtgctgct

SEQ ID NO: 3497661 - DNA, 19 bp, Homo sapiens
gcctggtggcagctgcggt

SEQ ID NO: 3497662 - DNA, 13 bp, Homo sapiens
gcctggttgaaga

SEQ ID NO: 3497663 - DNA, 18 bp, Homo sapiens
gcctgtaatcccagcact

SEQ ID NO: 3497664 - DNA, 15 bp, Homo sapiens
gcctgtcatgcgcaa

SEQ ID NO: 3497665 - DNA, 16 bp, Homo sapiens
gcctgtgactgaggcg

SEQ ID NO: 3497666 - DNA, 10 bp, Homo sapiens
gcctgtggcc

SEQ ID NO: 3497667 - DNA, 15 bp, Homo sapiens
gcctgtgggcctggg

SEQ ID NO: 3497668 - DNA, 12 bp, Homo sapiens
gcctgtgtccat

SEQ ID NO: 3497669 - DNA, 14 bp, Homo sapiens
gcctgtgtccatgc

SEQ ID NO: 3497670 - DNA, 22 bp, Homo sapiens
gcctgtttggcgtttcccagag

SEQ ID NO: 3497671 - DNA, 18 bp, Homo sapiens
gccttaccgagagccaaa

SEQ ID NO: 3497672 - DNA, 19 bp, Homo sapiens
gccttaccgagagccaaac

SEQ ID NO: 3497673 - DNA, 16 bp, Homo sapiens
gccttagaactttgca

SEQ ID NO: 3497674 - DNA, 14 bp, Homo sapiens
gccttagccatgat

SEQ ID NO: 3497675 - DNA, 20 bp, Homo sapiens
gccttagccatgatctgcag

SEQ ID NO: 3497676 - DNA, 23 bp, Homo sapiens
gccttatgagggtcctctacttc

SEQ ID NO: 3497677 - DNA, 22 bp, Homo sapiens
gccttattggaaagcagtcccc

SEQ ID NO: 3497678 - DNA, 18 bp, Homo sapiens
gccttcagacacatgcta

SEQ ID NO: 3497679 - DNA, 16 bp, Homo sapiens
gccttccagatcctct

SEQ ID NO: 3497680 - DNA, 20 bp, Homo sapiens
gccttccagatcctctctgg

SEQ ID NO: 3497681 - DNA, 22 bp, Homo sapiens
gccttccagggatttgcctcac

SEQ ID NO: 3497682 - DNA, 21 bp, Homo sapiens
gccttcccgccggaggccagc

SEQ ID NO: 3497683 - DNA, 23 bp, Homo sapiens
gccttcccgccggaggccagcta

SEQ ID NO: 3497684 - DNA, 17 bp, Homo sapiens
gccttcctaagcctgtg

SEQ ID NO: 3497685 - DNA, 14 bp, Homo sapiens
gccttcctcctggg

SEQ ID NO: 3497686 - DNA, 16 bp, Homo sapiens
gccttcctcctgggcc

SEQ ID NO: 3497687 - DNA, 18 bp, Homo sapiens
gccttcctctctccagat

SEQ ID NO: 3497688 - DNA, 17 bp, Homo sapiens
gccttcgcttcttgcct

SEQ ID NO: 3497689 - DNA, 20 bp, Homo sapiens
gccttcgcttcttgcctctg

SEQ ID NO: 3497690 - DNA, 21 bp, Homo sapiens
gccttcgcttcttgcctctgt

SEQ ID NO: 3497691 - DNA, 19 bp, Homo sapiens
gccttcggacaactcagtc

SEQ ID NO: 3497692 - DNA, 15 bp, Homo sapiens
gccttctcaccagct

SEQ ID NO: 3497693 - DNA, 21 bp, Homo sapiens
gccttctcaccagctgcaaag

SEQ ID NO: 3497694 - DNA, 13 bp, Homo sapiens
gccttctcccctc

SEQ ID NO: 3497695 - DNA, 16 bp, Homo sapiens
gccttctcccctcttc

SEQ ID NO: 3497696 - DNA, 19 bp, Homo sapiens
gccttctcccctcttctga

SEQ ID NO: 3497697 - DNA, 13 bp, Homo sapiens
gccttctgtgggg

SEQ ID NO: 3497698 - DNA, 22 bp, Homo sapiens
gccttgatgactgccttgcctc

SEQ ID NO: 3497699 - DNA, 17 bp, Homo sapiens
gccttgccagagatcca

SEQ ID NO: 3497700 - DNA, 16 bp, Homo sapiens
gccttggctcagacat

SEQ ID NO: 3497701 - DNA, 14 bp, Homo sapiens
gccttgggagccac

SEQ ID NO: 3497702 - DNA, 20 bp, Homo sapiens
gccttgggagccactgccac

SEQ ID NO: 3497703 - DNA, 13 bp, Homo sapiens
gcctttaaaattt

SEQ ID NO: 3497704 - DNA, 21 bp, Homo sapiens
gcctttaaaatttttttagaa

SEQ ID NO: 3497705 - DNA, 16 bp, Homo sapiens
gcctttactgaccctg

SEQ ID NO: 3497706 - DNA, 14 bp, Homo sapiens
gcctttagaaaata

SEQ ID NO: 3497707 - DNA, 21 bp, Homo sapiens
gctgggcttcagtggcagctg

SEQ ID NO: 3497708 - DNA, 18 bp, Homo sapiens
gctggggccggggctgag

SEQ ID NO: 3497709 - DNA, 14 bp, Homo sapiens
gctgggggcctcag

SEQ ID NO: 3497710 - DNA, 15 bp, Homo sapiens
gctgggggcctcagt

SEQ ID NO: 3497711 - DNA, 20 bp, Homo sapiens
gctgggggcctcagtgccac

SEQ ID NO: 3497712 - DNA, 15 bp, Homo sapiens
gctgggggctatgta

SEQ ID NO: 3497713 - DNA, 18 bp, Homo sapiens
gctgggggtgggccaggc

SEQ ID NO: 3497714 - DNA, 19 bp, Homo sapiens
gctgggggtgggccaggct

SEQ ID NO: 3497715 - DNA, 15 bp, Homo sapiens
gctgggtcaggcagg

SEQ ID NO: 3497716 - DNA, 21 bp, Homo sapiens
gctgggtggcaccagcagcct

SEQ ID NO: 3497717 - DNA, 23 bp, Homo sapiens
gctgggtggcaccagcagcctgg

SEQ ID NO: 3497718 - DNA, 14 bp, Homo sapiens
gctgggtggcactg

SEQ ID NO: 3497719 - DNA, 15 bp, Homo sapiens
gctgggtggcactgc

SEQ ID NO: 3497720 - DNA, 20 bp, Homo sapiens
gctggtcccactcagtccat

SEQ ID NO: 3497721 - DNA, 14 bp, Homo sapiens
gctggtggcctctg

SEQ ID NO: 3497722 - DNA, 14 bp, Homo sapiens
gctggtgtcacctg

SEQ ID NO: 3497723 - DNA, 22 bp, Homo sapiens
gctggttcagggttggcccctg

SEQ ID NO: 3497724 - DNA, 22 bp, Homo sapiens
gctgtaatcatttgtttacatt

SEQ ID NO: 3497725 - DNA, 12 bp, Homo sapiens
gctgtacatcta

SEQ ID NO: 3497726 - DNA, 20 bp, Homo sapiens
gctgtacatctattttggat

SEQ ID NO: 3497727 - DNA, 18 bp, Homo sapiens
gctgtagtttggagacaa

SEQ ID NO: 3497728 - DNA, 20 bp, Homo sapiens
gctgtataaaatcagccaat

SEQ ID NO: 3497729 - DNA, 22 bp, Homo sapiens
gctgtataaaatcagccaatta

SEQ ID NO: 3497730 - DNA, 14 bp, Homo sapiens
gctgtataagttat

SEQ ID NO: 3497731 - DNA, 19 bp, Homo sapiens
gctgtattcatatattgca

SEQ ID NO: 3497732 - DNA, 17 bp, Homo sapiens
gctgtcaagtcccccag

SEQ ID NO: 3497733 - DNA, 21 bp, Homo sapiens
gctgtcacctctcccacggga

SEQ ID NO: 3497734 - DNA, 14 bp, Homo sapiens
gctgtcatctgtgc

SEQ ID NO: 3497735 - DNA, 21 bp, Homo sapiens
gctgtcccatagtccctgcca

SEQ ID NO: 3497736 - DNA, 22 bp, Homo sapiens
gctgtccttacccatctgcacc

SEQ ID NO: 3497737 - DNA, 14 bp, Homo sapiens
gctgtctgcagcct

SEQ ID NO: 3497738 - DNA, 19 bp, Homo sapiens
gctgtgaaccctggggcct

SEQ ID NO: 3497739 - DNA, 22 bp, Homo sapiens
gctgtgaaccctggggcctgac

SEQ ID NO: 3497740 - DNA, 15 bp, Homo sapiens
gctgtgctgggagaa

SEQ ID NO: 3497741 - DNA, 19 bp, Homo sapiens
gctgtgcttgaaggccctg

SEQ ID NO: 3497742 - DNA, 20 bp, Homo sapiens
gctgtgcttgaaggccctgc

SEQ ID NO: 3497743 - DNA, 19 bp, Homo sapiens
gctgtggagacaatgtctg

SEQ ID NO: 3497744 - DNA, 21 bp, Homo sapiens
gctgtggccgcacgcctctcc

SEQ ID NO: 3497745 - DNA, 19 bp, Homo sapiens
gctgtggggcagctgagca

SEQ ID NO: 3497746 - DNA, 22 bp, Homo sapiens
gctgtggggcagctgagcagct

SEQ ID NO: 3497747 - DNA, 23 bp, Homo sapiens
gctgtggtgtgtccccctctgtc

SEQ ID NO: 3497748 - DNA, 18 bp, Homo sapiens
gctgttaactttcatgct

SEQ ID NO: 3497749 - DNA, 14 bp, Homo sapiens
gctgttcagctggt

SEQ ID NO: 3497750 - DNA, 14 bp, Homo sapiens
gctgttctagcact

SEQ ID NO: 3497751 - DNA, 21 bp, Homo sapiens
gctgttctcattcctgttctt

SEQ ID NO: 3497752 - DNA, 14 bp, Homo sapiens
gctgttgacatatt

SEQ ID NO: 3497753 - DNA, 19 bp, Homo sapiens
gctgttgacatatttaatg

SEQ ID NO: 3497754 - DNA, 23 bp, Homo sapiens
gctgttgacatatttaatgtttt

SEQ ID NO: 3497755 - DNA, 15 bp, Homo sapiens
gctgttgctgaatag

SEQ ID NO: 3497756 - DNA, 20 bp, Homo sapiens
gctgttggctgggggcctca

SEQ ID NO: 3497757 - DNA, 13 bp, Homo sapiens
gctgtttccatag

SEQ ID NO: 3497758 - DNA, 14 bp, Homo sapiens
gctgtttgcttcac

SEQ ID NO: 3497759 - DNA, 17 bp, Homo sapiens
gctgttttccctgacct

SEQ ID NO: 3497760 - DNA, 18 bp, Homo sapiens
gctgttttcctcccttct

SEQ ID NO: 3497761 - DNA, 22 bp, Homo sapiens
gcttaaaatgtactctcctttt

SEQ ID NO: 3497762 - DNA, 23 bp, Homo sapiens
gcttaaaggcagtattttgtgtc

SEQ ID NO: 3497763 - DNA, 21 bp, Homo sapiens
gcttaatcattttcattccta

SEQ ID NO: 3497764 - DNA, 22 bp, Homo sapiens
gcttacatctggaatctgaggc

SEQ ID NO: 3497765 - DNA, 12 bp, Homo sapiens
gcttagtttgtg

SEQ ID NO: 3497766 - DNA, 21 bp, Homo sapiens
gcttagtttgtgtgttgtctc

SEQ ID NO: 3497767 - DNA, 17 bp, Homo sapiens
gcttataggtggcctct

SEQ ID NO: 3497768 - DNA, 13 bp, Homo sapiens
gcttatctcaggg

SEQ ID NO: 3497769 - DNA, 19 bp, Homo sapiens
gcttatctcaggggtgtgc

SEQ ID NO: 3497770 - DNA, 15 bp, Homo sapiens
gcttatctcttttat

SEQ ID NO: 3497771 - DNA, 21 bp, Homo sapiens
gcttatctcttttatatttgt

SEQ ID NO: 3497772 - DNA, 17 bp, Homo sapiens
gcttatgaatatattta

SEQ ID NO: 3497773 - DNA, 20 bp, Homo sapiens
gcttatgtgtaggtgaacag

SEQ ID NO: 3497774 - DNA, 18 bp, Homo sapiens
gcttcaaccctcagcctt

SEQ ID NO: 3497775 - DNA, 20 bp, Homo sapiens
gcttcaccccaatcccagct

SEQ ID NO: 3497776 - DNA, 17 bp, Homo sapiens
gcttcacggaagagcct

SEQ ID NO: 3497777 - DNA, 20 bp, Homo sapiens
gcttcacggaagagccttgc

SEQ ID NO: 3497778 - DNA, 13 bp, Homo sapiens
gcttcaggaacct

SEQ ID NO: 3497779 - DNA, 19 bp, Homo sapiens
gcttcagggcaggtggggt

SEQ ID NO: 3497780 - DNA, 21 bp, Homo sapiens
gcttcaggtccaggctgtgtt

SEQ ID NO: 3497781 - DNA, 15 bp, Homo sapiens
gcttcatctctttag

SEQ ID NO: 3497782 - DNA, 17 bp, Homo sapiens
gcttcatctctttagag

SEQ ID NO: 3497783 - DNA, 18 bp, Homo sapiens
gcttcatctctttagaga

SEQ ID NO: 3497784 - DNA, 19 bp, Homo sapiens
gcttcatctctttagagaa

SEQ ID NO: 3497785 - DNA, 17 bp, Homo sapiens
gcttcatgtggcttccc

SEQ ID NO: 3497786 - DNA, 18 bp, Homo sapiens
gcttcatttcctgtgtct

SEQ ID NO: 3497787 - DNA, 22 bp, Homo sapiens
gcttcatttttgtaataacatt

SEQ ID NO: 3497788 - DNA, 12 bp, Homo sapiens
gcttccattcca

SEQ ID NO: 3497789 - DNA, 22 bp, Homo sapiens
gcttcccagtggctgctgccca

SEQ ID NO: 3497790 - DNA, 14 bp, Homo sapiens
gcttccccacagaa

SEQ ID NO: 3497791 - DNA, 15 bp, Homo sapiens
gcttccccacagaac

SEQ ID NO: 3497792 - DNA, 24 bp, Homo sapiens
gcttccccacagaactgcttacta

SEQ ID NO: 3497793 - DNA, 14 bp, Homo sapiens
gcttccctgactca

SEQ ID NO: 3497794 - DNA, 18 bp, Homo sapiens
gcttccctgactcattct

SEQ ID NO: 3497795 - DNA, 12 bp, Homo sapiens
gcttcctcctgg

SEQ ID NO: 3497796 - DNA, 16 bp, Homo sapiens
gcttcctcctggaaat

SEQ ID NO: 3497797 - DNA, 20 bp, Homo sapiens
gcttcgggcccttcccacag

SEQ ID NO: 3497798 - DNA, 19 bp, Homo sapiens
gcttctagaggctcatggc

SEQ ID NO: 3497799 - DNA, 16 bp, Homo sapiens
gcttctagctgacttg

SEQ ID NO: 3497800 - DNA, 17 bp, Homo sapiens
gcttctcactgccatgc

SEQ ID NO: 3497801 - DNA, 22 bp, Homo sapiens
gcttctcatcctgcaggcagct

SEQ ID NO: 3497802 - DNA, 15 bp, Homo sapiens
gcttctcctgtgtga

SEQ ID NO: 3497803 - DNA, 14 bp, Homo sapiens
gcttctctctgtgg

SEQ ID NO: 3497804 - DNA, 16 bp, Homo sapiens
gcttctctctgtggga

SEQ ID NO: 3497805 - DNA, 13 bp, Homo sapiens
gcttctctgactt

SEQ ID NO: 3497806 - DNA, 14 bp, Homo sapiens
gcttctctgacttc

SEQ ID NO: 3497807 - DNA, 13 bp, Homo sapiens
gcttctgcctgca

SEQ ID NO: 3497808 - DNA, 23 bp, Homo sapiens
gcttctggaatttgttcaagttt

SEQ ID NO: 3497809 - DNA, 15 bp, Homo sapiens
gcttctggccaggaa

SEQ ID NO: 3497810 - DNA, 18 bp, Homo sapiens
gcttctggccaggaagct

SEQ ID NO: 3497811 - DNA, 12 bp, Homo sapiens
gcttctgtctcc

SEQ ID NO: 3497812 - DNA, 13 bp, Homo sapiens
gcttctgtctcca

SEQ ID NO: 3497813 - DNA, 12 bp, Homo sapiens
gcttcttgcctc

SEQ ID NO: 3497814 - DNA, 14 bp, Homo sapiens
gcttcttgcctctg

SEQ ID NO: 3497815 - DNA, 19 bp, Homo sapiens
gcttcttgcctctgtgctg

SEQ ID NO: 3497816 - DNA, 21 bp, Homo sapiens
gcttcttgcctctgtgctgtg

SEQ ID NO: 3497817 - DNA, 18 bp, Homo sapiens
gcttctttctttgggaat

SEQ ID NO: 3497818 - DNA, 23 bp, Homo sapiens
gcttctttctttgggaatatttg

SEQ ID NO: 3497819 - DNA, 19 bp, Homo sapiens
gcttgaaaagctagtgtac

SEQ ID NO: 3497820 - DNA, 15 bp, Homo sapiens
gcttgaaggccctgc

SEQ ID NO: 3497821 - DNA, 21 bp, Homo sapiens
gcttgagagggcaaacccaaa

SEQ ID NO: 3497822 - DNA, 14 bp, Homo sapiens
gcttgagctcagga

SEQ ID NO: 3497823 - DNA, 21 bp, Homo sapiens
gcttgccccactctgcctgcc

SEQ ID NO: 3497824 - DNA, 22 bp, Homo sapiens
gcttgccccactctgcctgcct

SEQ ID NO: 3497825 - DNA, 14 bp, Homo sapiens
gcttgcttatgtgt

SEQ ID NO: 3497826 - DNA, 14 bp, Homo sapiens
gcttggagctgagc

SEQ ID NO: 3497827 - DNA, 15 bp, Homo sapiens
gcttggagctgagca

SEQ ID NO: 3497828 - DNA, 23 bp, Homo sapiens
gcttggccctctttcctctgtgg

SEQ ID NO: 3497829 - DNA, 15 bp, Homo sapiens
gcttggggcaacatt

SEQ ID NO: 3497830 - DNA, 17 bp, Homo sapiens
gcttgtaaatagctcag

SEQ ID NO: 3497831 - DNA, 20 bp, Homo sapiens
gcttgtaaatagctcaggtg

SEQ ID NO: 3497832 - DNA, 19 bp, Homo sapiens
gcttgtcccctcctcactc

SEQ ID NO: 3497833 - DNA, 19 bp, Homo sapiens
gcttgtttgctcacctggg

SEQ ID NO: 3497834 - DNA, 13 bp, Homo sapiens
gcttgttttccaa

SEQ ID NO: 3497835 - DNA, 13 bp, Homo sapiens
gctttaataatgt

SEQ ID NO: 3497836 - DNA, 16 bp, Homo sapiens
gctttaccttcctgat

SEQ ID NO: 3497837 - DNA, 16 bp, Homo sapiens
gctttactgtttgtta

SEQ ID NO: 3497838 - DNA, 17 bp, Homo sapiens
gctttattccagaatgc

SEQ ID NO: 3497839 - DNA, 16 bp, Homo sapiens
ggacccagggaacagc

SEQ ID NO: 3497840 - DNA, 15 bp, Homo sapiens
ggacccccgccccct

SEQ ID NO: 3497841 - DNA, 13 bp, Homo sapiens
ggaccctgaaggg

SEQ ID NO: 3497842 - DNA, 22 bp, Homo sapiens
ggaccctgtgccctccttccca

SEQ ID NO: 3497843 - DNA, 20 bp, Homo sapiens
ggaccgggtggaagggatgg

SEQ ID NO: 3497844 - DNA, 17 bp, Homo sapiens
ggaccgtcccctgccca

SEQ ID NO: 3497845 - DNA, 15 bp, Homo sapiens
ggacctaggctcctc

SEQ ID NO: 3497846 - DNA, 12 bp, Homo sapiens
ggacctctccca

SEQ ID NO: 3497847 - DNA, 15 bp, Homo sapiens
ggacctctcccaggg

SEQ ID NO: 3497848 - DNA, 15 bp, Homo sapiens
ggacctgcctgtagc

SEQ ID NO: 3497849 - DNA, 14 bp, Homo sapiens
ggacctggctgcca

SEQ ID NO: 3497850 - DNA, 18 bp, Homo sapiens
ggaccttgaactgggtac

SEQ ID NO: 3497851 - DNA, 18 bp, Homo sapiens
ggacctttccaccacagc

SEQ ID NO: 3497852 - DNA, 17 bp, Homo sapiens
ggacgcaggcccctctc

SEQ ID NO: 3497853 - DNA, 22 bp, Homo sapiens
ggacgcaggcccctctcctccg

SEQ ID NO: 3497854 - DNA, 21 bp, Homo sapiens
ggacggtgcccaagccagagg

SEQ ID NO: 3497855 - DNA, 15 bp, Homo sapiens
ggactcaatgcactg

SEQ ID NO: 3497856 - DNA, 22 bp, Homo sapiens
ggactcaatgcactgacattgt

SEQ ID NO: 3497857 - DNA, 17 bp, Homo sapiens
ggactcagaagcctctg

SEQ ID NO: 3497858 - DNA, 13 bp, Homo sapiens
ggactcagggcag

SEQ ID NO: 3497859 - DNA, 22 bp, Homo sapiens
ggactccaggcccaaggctccc

SEQ ID NO: 3497860 - DNA, 13 bp, Homo sapiens
ggactccaggtct

SEQ ID NO: 3497861 - DNA, 17 bp, Homo sapiens
ggactcctgccaccagc

SEQ ID NO: 3497862 - DNA, 18 bp, Homo sapiens
ggactctcagtctctgag

SEQ ID NO: 3497863 - DNA, 21 bp, Homo sapiens
ggactctcagtctctgagcag

SEQ ID NO: 3497864 - DNA, 20 bp, Homo sapiens
ggactctgaaatatcccggg

SEQ ID NO: 3497865 - DNA, 17 bp, Homo sapiens
ggactgaaaacctctcc

SEQ ID NO: 3497866 - DNA, 23 bp, Homo sapiens
ggactgcacagcgtcctgtccac

SEQ ID NO: 3497867 - DNA, 23 bp, Homo sapiens
ggactgggccacttctgggtggg

SEQ ID NO: 3497868 - DNA, 9 bp, Homo sapiens
ggactggtg

SEQ ID NO: 3497869 - DNA, 11 bp, Homo sapiens
ggactggtgcc

SEQ ID NO: 3497870 - DNA, 14 bp, Homo sapiens
ggactggtgccctc

SEQ ID NO: 3497871 - DNA, 17 bp, Homo sapiens
ggactggtgccctcctc

SEQ ID NO: 3497872 - DNA, 20 bp, Homo sapiens
ggactgtagggagggcggca

SEQ ID NO: 3497873 - DNA, 15 bp, Homo sapiens
ggacttccatgcctt

SEQ ID NO: 3497874 - DNA, 19 bp, Homo sapiens
ggacttccccggagggctg

SEQ ID NO: 3497875 - DNA, 21 bp, Homo sapiens
ggacttcggggtagaggctgg

SEQ ID NO: 3497876 - DNA, 12 bp, Homo sapiens
ggacttgaagtt

SEQ ID NO: 3497877 - DNA, 14 bp, Homo sapiens
ggacttggaagctc

SEQ ID NO: 3497878 - DNA, 17 bp, Homo sapiens
ggacttggaagctccgc

SEQ ID NO: 3497879 - DNA, 13 bp, Homo sapiens
ggacttttctgca

SEQ ID NO: 3497880 - DNA, 20 bp, Homo sapiens
ggagaaaattcaattgtaaa

SEQ ID NO: 3497881 - DNA, 22 bp, Homo sapiens
ggagaaatacttgaacttgcct

SEQ ID NO: 3497882 - DNA, 18 bp, Homo sapiens
ggagaagccacaggcctg

SEQ ID NO: 3497883 - DNA, 15 bp, Homo sapiens
ggagaagccaggaat

SEQ ID NO: 3497884 - DNA, 12 bp, Homo sapiens
ggagaagctctg

SEQ ID NO: 3497885 - DNA, 14 bp, Homo sapiens
ggagacagcatcag

SEQ ID NO: 3497886 - DNA, 12 bp, Homo sapiens
ggagacaggcag

SEQ ID NO: 3497887 - DNA, 23 bp, Homo sapiens
ggagactgggctgagggagcctg

SEQ ID NO: 3497888 - DNA, 15 bp, Homo sapiens
ggagagaaaatatat

SEQ ID NO: 3497889 - DNA, 17 bp, Homo sapiens
ggagagagccttgggag

SEQ ID NO: 3497890 - DNA, 21 bp, Homo sapiens
ggagagagccttgggagccac

SEQ ID NO: 3497891 - DNA, 16 bp, Homo sapiens
ggagagatagcctgtg

SEQ ID NO: 3497892 - DNA, 19 bp, Homo sapiens
ggagagatagcctgtggcc

SEQ ID NO: 3497893 - DNA, 21 bp, Homo sapiens
ggagagctagcagcagggagg

SEQ ID NO: 3497894 - DNA, 18 bp, Homo sapiens
ggagagctggagcctggt

SEQ ID NO: 3497895 - DNA, 22 bp, Homo sapiens
ggagaggccctctggagtggcc

SEQ ID NO: 3497896 - DNA, 14 bp, Homo sapiens
ggagaggggacgca

SEQ ID NO: 3497897 - DNA, 15 bp, Homo sapiens
ggagaggggcacagg

SEQ ID NO: 3497898 - DNA, 15 bp, Homo sapiens
ggagatcctcctgca

SEQ ID NO: 3497899 - DNA, 23 bp, Homo sapiens
ggagatgaaatcttacagctggg

SEQ ID NO: 3497900 - DNA, 15 bp, Homo sapiens
ggagatgctccttgg

SEQ ID NO: 3497901 - DNA, 14 bp, Homo sapiens
ggagattaagatgc

SEQ ID NO: 3497902 - DNA, 21 bp, Homo sapiens
ggagcaattacggggtgacct

SEQ ID NO: 3497903 - DNA, 21 bp, Homo sapiens
ggagcaggcggtgggcaccca

SEQ ID NO: 3497904 - DNA, 16 bp, Homo sapiens
ggagcatcaagccact

SEQ ID NO: 3497905 - DNA, 18 bp, Homo sapiens
ggagcatttttttattca

SEQ ID NO: 3497906 - DNA, 23 bp, Homo sapiens
ggagccatgcgccccctccgccc

SEQ ID NO: 3497907 - DNA, 18 bp, Homo sapiens
ggagcccactgtcctggg

SEQ ID NO: 3497908 - DNA, 16 bp, Homo sapiens
ggagccccattcctgg

SEQ ID NO: 3497909 - DNA, 15 bp, Homo sapiens
ggagcccctggacat

SEQ ID NO: 3497910 - DNA, 20 bp, Homo sapiens
ggagcccttatctgtgctca

SEQ ID NO: 3497911 - DNA, 21 bp, Homo sapiens
ggagccgaggcctaccccgca

SEQ ID NO: 3497912 - DNA, 22 bp, Homo sapiens
ggagcctccgacgctgcctctc

SEQ ID NO: 3497913 - DNA, 14 bp, Homo sapiens
ggagcggaaagcag

SEQ ID NO: 3497914 - DNA, 15 bp, Homo sapiens
ggagcggaaagcagc

SEQ ID NO: 3497915 - DNA, 20 bp, Homo sapiens
ggagctcagagagggcaggc

SEQ ID NO: 3497916 - DNA, 17 bp, Homo sapiens
ggagctccggcctgctg

SEQ ID NO: 3497917 - DNA, 21 bp, Homo sapiens
ggagctctgtgggtctctgga

SEQ ID NO: 3497918 - DNA, 19 bp, Homo sapiens
ggagctcttgacagaaagc

SEQ ID NO: 3497919 - DNA, 21 bp, Homo sapiens
ggagctgcctgttcagctcca

SEQ ID NO: 3497920 - DNA, 17 bp, Homo sapiens
ggagctggggatccctc

SEQ ID NO: 3497921 - DNA, 18 bp, Homo sapiens
ggagctgtcaccaaggaa

SEQ ID NO: 3497922 - DNA, 20 bp, Homo sapiens
ggagcttcatggcagaaggc

SEQ ID NO: 3497923 - DNA, 19 bp, Homo sapiens
ggagcttcctgtcctccca

SEQ ID NO: 3497924 - DNA, 12 bp, Homo sapiens
ggaggaagaggc

SEQ ID NO: 3497925 - DNA, 11 bp, Homo sapiens
ggaggaagccc

SEQ ID NO: 3497926 - DNA, 14 bp, Homo sapiens
ggaggagagagcct

SEQ ID NO: 3497927 - DNA, 17 bp, Homo sapiens
ggaggagcaaaggctga

SEQ ID NO: 3497928 - DNA, 17 bp, Homo sapiens
ggaggagcagtgcaggc

SEQ ID NO: 3497929 - DNA, 13 bp, Homo sapiens
ggaggagcccctg

SEQ ID NO: 3497930 - DNA, 17 bp, Homo sapiens
ggaggagttagccaaac

SEQ ID NO: 3497931 - DNA, 13 bp, Homo sapiens
ggaggatattaaa

SEQ ID NO: 3497932 - DNA, 18 bp, Homo sapiens
ggaggatcagttttttgt

SEQ ID NO: 3497933 - DNA, 18 bp, Homo sapiens
ggaggatgtaaggcctta

SEQ ID NO: 3497934 - DNA, 15 bp, Homo sapiens
ggaggattgctgcca

SEQ ID NO: 3497935 - DNA, 20 bp, Homo sapiens
ggaggcaaatggcactgcag

SEQ ID NO: 3497936 - DNA, 17 bp, Homo sapiens
ggaggcaaatgggatgg

SEQ ID NO: 3497937 - DNA, 17 bp, Homo sapiens
ggaggcatcatggaaag

SEQ ID NO: 3497938 - DNA, 16 bp, Homo sapiens
ggaggccagccagtga

SEQ ID NO: 3497939 - DNA, 22 bp, Homo sapiens
ggaggccagctatctgcctgac

SEQ ID NO: 3497940 - DNA, 17 bp, Homo sapiens
ggaggccccactgggga

SEQ ID NO: 3497941 - DNA, 13 bp, Homo sapiens
ggaggcctcaggt

SEQ ID NO: 3497942 - DNA, 19 bp, Homo sapiens
ggaggcctcaggtgctgtc

SEQ ID NO: 3497943 - DNA, 16 bp, Homo sapiens
ggaggctgcctcccaa

SEQ ID NO: 3497944 - DNA, 22 bp, Homo sapiens
ggagggacaagtggactcaggg

SEQ ID NO: 3497945 - DNA, 15 bp, Homo sapiens
ggagggaggctcagg

SEQ ID NO: 3497946 - DNA, 16 bp, Homo sapiens
ggagggaggctcaggt

SEQ ID NO: 3497947 - DNA, 17 bp, Homo sapiens
ggagggattctggttcc

SEQ ID NO: 3497948 - DNA, 13 bp, Homo sapiens
ggagggcagcagg

SEQ ID NO: 3497949 - DNA, 22 bp, Homo sapiens
ggagggcgttcttaggctgctg

SEQ ID NO: 3497950 - DNA, 18 bp, Homo sapiens
ggaggggaaaaaaatgtt

SEQ ID NO: 3497951 - DNA, 17 bp, Homo sapiens
ggagggggcaaatgagc

SEQ ID NO: 3497952 - DNA, 14 bp, Homo sapiens
ggaggtgaccccag

SEQ ID NO: 3497953 - DNA, 18 bp, Homo sapiens
ggaggtgtggagccgagg

SEQ ID NO: 3497954 - DNA, 18 bp, Homo sapiens
ggaggttccagtgagccg

SEQ ID NO: 3497955 - DNA, 15 bp, Homo sapiens
ggagtcagccaggag

SEQ ID NO: 3497956 - DNA, 18 bp, Homo sapiens
ggagtcagccaggagctg

SEQ ID NO: 3497957 - DNA, 17 bp, Homo sapiens
ggagtcatctcaaccat

SEQ ID NO: 3497958 - DNA, 14 bp, Homo sapiens
ggagtctgaagcag

SEQ ID NO: 3497959 - DNA, 18 bp, Homo sapiens
ggagtgacagaggcagcc

SEQ ID NO: 3497960 - DNA, 21 bp, Homo sapiens
ggagtgacagaggcagcccca

SEQ ID NO: 3497961 - DNA, 14 bp, Homo sapiens
ggagtgagctggtt

SEQ ID NO: 3497962 - DNA, 20 bp, Homo sapiens
ggagtgtatgactgcacatg

SEQ ID NO: 3497963 - DNA, 15 bp, Homo sapiens
ggagttaagacctgg

SEQ ID NO: 3497964 - DNA, 18 bp, Homo sapiens
ggagttaagacctggcag

SEQ ID NO: 3497965 - DNA, 12 bp, Homo sapiens
ggagttagccaa

SEQ ID NO: 3497966 - DNA, 17 bp, Homo sapiens
ggagttccagcaaacaa

SEQ ID NO: 3497967 - DNA, 14 bp, Homo sapiens
ggagttgatctgga

SEQ ID NO: 3497968 - DNA, 17 bp, Homo sapiens
ggagttgatctggaacc

SEQ ID NO: 3497969 - DNA, 15 bp, Homo sapiens
ggataaattgccata

SEQ ID NO: 3497970 - DNA, 21 bp, Homo sapiens
ggatagatgctggcccagggc

SEQ ID NO: 3497971 - DNA, 18 bp, Homo sapiens
ggatagctaactgtaaat

SEQ ID NO: 3497972 - DNA, 15 bp, Homo sapiens
ggctggaagatcctg

SEQ ID NO: 3497973 - DNA, 16 bp, Homo sapiens
ggctggaatgcagtgg

SEQ ID NO: 3497974 - DNA, 14 bp, Homo sapiens
ggctggactgaggc

SEQ ID NO: 3497975 - DNA, 16 bp, Homo sapiens
ggctggactgaggcct

SEQ ID NO: 3497976 - DNA, 18 bp, Homo sapiens
ggctggactgaggcctga

SEQ ID NO: 3497977 - DNA, 13 bp, Homo sapiens
ggctggaggccca

SEQ ID NO: 3497978 - DNA, 15 bp, Homo sapiens
ggctggaggcccagg

SEQ ID NO: 3497979 - DNA, 20 bp, Homo sapiens
ggctggagtgcagtggcgca

SEQ ID NO: 3497980 - DNA, 20 bp, Homo sapiens
ggctggagtgcagtggtgtg

SEQ ID NO: 3497981 - DNA, 21 bp, Homo sapiens
ggctggattttgaattttctt

SEQ ID NO: 3497982 - DNA, 13 bp, Homo sapiens
ggctggcacagga

SEQ ID NO: 3497983 - DNA, 15 bp, Homo sapiens
ggctggcacaggaca

SEQ ID NO: 3497984 - DNA, 22 bp, Homo sapiens
ggctggcatgatccaagcaaga

SEQ ID NO: 3497985 - DNA, 20 bp, Homo sapiens
ggctggccagtccaggctgc

SEQ ID NO: 3497986 - DNA, 21 bp, Homo sapiens
ggctggccagtccaggctgcc

SEQ ID NO: 3497987 - DNA, 22 bp, Homo sapiens
ggctggccagtccaggctgccg

SEQ ID NO: 3497988 - DNA, 13 bp, Homo sapiens
ggctggctggcct

SEQ ID NO: 3497989 - DNA, 14 bp, Homo sapiens
ggctggcttttctg

SEQ ID NO: 3497990 - DNA, 23 bp, Homo sapiens
ggctggcttttctgtttcctgta

SEQ ID NO: 3497991 - DNA, 15 bp, Homo sapiens
ggctgggaggagccc

SEQ ID NO: 3497992 - DNA, 14 bp, Homo sapiens
ggctgggcagagct

SEQ ID NO: 3497993 - DNA, 17 bp, Homo sapiens
ggctgggcttcagtggc

SEQ ID NO: 3497994 - DNA, 17 bp, Homo sapiens
ggctggggaagtcctct

SEQ ID NO: 3497995 - DNA, 23 bp, Homo sapiens
ggctggtcttgaagtcctggctt

SEQ ID NO: 3497996 - DNA, 16 bp, Homo sapiens
ggctggtggcccagga

SEQ ID NO: 3497997 - DNA, 23 bp, Homo sapiens
ggctggttcggatttggggtgga

SEQ ID NO: 3497998 - DNA, 23 bp, Homo sapiens
ggctgtatcccatgagcctcagc

SEQ ID NO: 3497999 - DNA, 14 bp, Homo sapiens
ggctgtcatctgtg

SEQ ID NO: 3498000 - DNA, 17 bp, Homo sapiens
ggctgtcatctgtgcac

SEQ ID NO: 3498001 - DNA, 20 bp, Homo sapiens
ggctgtgctacctgagccaa

SEQ ID NO: 3498002 - DNA, 19 bp, Homo sapiens
ggctgtgcttgaaggccct

SEQ ID NO: 3498003 - DNA, 15 bp, Homo sapiens
ggctgtggtcacagc

SEQ ID NO: 3498004 - DNA, 18 bp, Homo sapiens
ggctgtgtaaccttgggt

SEQ ID NO: 3498005 - DNA, 14 bp, Homo sapiens
ggctgtgtctaaac

SEQ ID NO: 3498006 - DNA, 15 bp, Homo sapiens
ggctgtgtctaaact

SEQ ID NO: 3498007 - DNA, 15 bp, Homo sapiens
ggctgttggctgggg

SEQ ID NO: 3498008 - DNA, 15 bp, Homo sapiens
ggcttaaaacaacac

SEQ ID NO: 3498009 - DNA, 22 bp, Homo sapiens
ggcttagtttgtgtgttgtctc

SEQ ID NO: 3498010 - DNA, 11 bp, Homo sapiens
ggcttcagcct

SEQ ID NO: 3498011 - DNA, 13 bp, Homo sapiens
ggcttcagcctag

SEQ ID NO: 3498012 - DNA, 21 bp, Homo sapiens
ggcttcagcctagtggcttgt

SEQ ID NO: 3498013 - DNA, 18 bp, Homo sapiens
ggcttcagtctcatattt

SEQ ID NO: 3498014 - DNA, 16 bp, Homo sapiens
ggcttcagtggcagct

SEQ ID NO: 3498015 - DNA, 18 bp, Homo sapiens
ggcttcagtggcagctgc

SEQ ID NO: 3498016 - DNA, 13 bp, Homo sapiens
ggcttcatctctt

SEQ ID NO: 3498017 - DNA, 18 bp, Homo sapiens
ggcttcattagagcaggc

SEQ ID NO: 3498018 - DNA, 19 bp, Homo sapiens
ggcttcccagtggctgctg

SEQ ID NO: 3498019 - DNA, 16 bp, Homo sapiens
ggcttcctcatagtat

SEQ ID NO: 3498020 - DNA, 14 bp, Homo sapiens
ggcttctctctgtg

SEQ ID NO: 3498021 - DNA, 20 bp, Homo sapiens
ggcttctctgtgaattgcct

SEQ ID NO: 3498022 - DNA, 12 bp, Homo sapiens
ggcttctgtggg

SEQ ID NO: 3498023 - DNA, 22 bp, Homo sapiens
ggcttgagtttaaattgtaata

SEQ ID NO: 3498024 - DNA, 14 bp, Homo sapiens
ggcttgcctgcagg

SEQ ID NO: 3498025 - DNA, 14 bp, Homo sapiens
ggctttatcctctt

SEQ ID NO: 3498026 - DNA, 15 bp, Homo sapiens
ggctttatcctcttt

SEQ ID NO: 3498027 - DNA, 21 bp, Homo sapiens
ggctttatcctctttagagtt

SEQ ID NO: 3498028 - DNA, 12 bp, Homo sapiens
ggctttcagctt

SEQ ID NO: 3498029 - DNA, 13 bp, Homo sapiens
ggctttcagctta

SEQ ID NO: 3498030 - DNA, 23 bp, Homo sapiens
ggctttcgtccacagcttcctgt

SEQ ID NO: 3498031 - DNA, 20 bp, Homo sapiens
ggcttttactgaagcctttc

SEQ ID NO: 3498032 - DNA, 15 bp, Homo sapiens
ggcttttctcagctg

SEQ ID NO: 3498033 - DNA, 14 bp, Homo sapiens
ggcttttctctttg

SEQ ID NO: 3498034 - DNA, 13 bp, Homo sapiens
ggcttttctgttt

SEQ ID NO: 3498035 - DNA, 22 bp, Homo sapiens
gggaaaactgccaatatagaaa

SEQ ID NO: 3498036 - DNA, 13 bp, Homo sapiens
gggaaaatcagcc

SEQ ID NO: 3498037 - DNA, 23 bp, Homo sapiens
gggaaaatcagcctgctccagct

SEQ ID NO: 3498038 - DNA, 17 bp, Homo sapiens
gggaaaattatttgcat

SEQ ID NO: 3498039 - DNA, 18 bp, Homo sapiens
gggaaaattatttgcata

SEQ ID NO: 3498040 - DNA, 21 bp, Homo sapiens
gggaaacatcacacctgccct

SEQ ID NO: 3498041 - DNA, 17 bp, Homo sapiens
gggaaatggccttcccg

SEQ ID NO: 3498042 - DNA, 22 bp, Homo sapiens
gggaacagccactcccctccac

SEQ ID NO: 3498043 - DNA, 18 bp, Homo sapiens
gggaacctccccagcctg

SEQ ID NO: 3498044 - DNA, 19 bp, Homo sapiens
gggaacctccccagcctgc

SEQ ID NO: 3498045 - DNA, 21 bp, Homo sapiens
gggaagagtgactctccaggg

SEQ ID NO: 3498046 - DNA, 21 bp, Homo sapiens
gggaagcttctgtctccagct

SEQ ID NO: 3498047 - DNA, 13 bp, Homo sapiens
gggaaggagccag

SEQ ID NO: 3498048 - DNA, 14 bp, Homo sapiens
gggaaggggaggac

SEQ ID NO: 3498049 - DNA, 23 bp, Homo sapiens
gggaagtgaagactggaagctaa

SEQ ID NO: 3498050 - DNA, 13 bp, Homo sapiens
gggaatatttgaa

SEQ ID NO: 3498051 - DNA, 14 bp, Homo sapiens
gggaatatttgaat

SEQ ID NO: 3498052 - DNA, 19 bp, Homo sapiens
gggacaagtggactcaggg

SEQ ID NO: 3498053 - DNA, 18 bp, Homo sapiens
gggacagaggccccagcc

SEQ ID NO: 3498054 - DNA, 13 bp, Homo sapiens
gggacccccgccc

SEQ ID NO: 3498055 - DNA, 12 bp, Homo sapiens
gggacctctccc

SEQ ID NO: 3498056 - DNA, 16 bp, Homo sapiens
gggacctctcccaggg

SEQ ID NO: 3498057 - DNA, 23 bp, Homo sapiens
gggacctctcccagggtccctgg

SEQ ID NO: 3498058 - DNA, 13 bp, Homo sapiens
gggaccttttggg

SEQ ID NO: 3498059 - DNA, 18 bp, Homo sapiens
gggacgcaggcccctctc

SEQ ID NO: 3498060 - DNA, 21 bp, Homo sapiens
gggacgcaggcccctctcctc

SEQ ID NO: 3498061 - DNA, 17 bp, Homo sapiens
gggactacaggcaccca

SEQ ID NO: 3498062 - DNA, 20 bp, Homo sapiens
gggactccggctgtgctggg

SEQ ID NO: 3498063 - DNA, 23 bp, Homo sapiens
gggacttggaagctccgctttct

SEQ ID NO: 3498064 - DNA, 14 bp, Homo sapiens
gggagaaaatcatc

SEQ ID NO: 3498065 - DNA, 20 bp, Homo sapiens
gggagaaaatcatcaagaag

SEQ ID NO: 3498066 - DNA, 12 bp, Homo sapiens
gggagaaatact

SEQ ID NO: 3498067 - DNA, 19 bp, Homo sapiens
gggagacagttgagagcgg

SEQ ID NO: 3498068 - DNA, 17 bp, Homo sapiens
gggagattcaagggacc

SEQ ID NO: 3498069 - DNA, 24 bp, Homo sapiens
gggagcaggcggtgggcacccacc

SEQ ID NO: 3498070 - DNA, 19 bp, Homo sapiens
gggagcccactgtcctggg

SEQ ID NO: 3498071 - DNA, 12 bp, Homo sapiens
gggagctgaggc

SEQ ID NO: 3498072 - DNA, 21 bp, Homo sapiens
gggagctgcctgttcagctcc

SEQ ID NO: 3498073 - DNA, 12 bp, Homo sapiens
gggaggacaggc

SEQ ID NO: 3498074 - DNA, 20 bp, Homo sapiens
gggaggaccacaggtgtgag

SEQ ID NO: 3498075 - DNA, 23 bp, Homo sapiens
gggaggattgcttgagctcagga

SEQ ID NO: 3498076 - DNA, 17 bp, Homo sapiens
gggaggccagtgagcca

SEQ ID NO: 3498077 - DNA, 11 bp, Homo sapiens
gggaggcccca

SEQ ID NO: 3498078 - DNA, 13 bp, Homo sapiens
gggagggcagcag

SEQ ID NO: 3498079 - DNA, 14 bp, Homo sapiens
gggagggctgcgac

SEQ ID NO: 3498080 - DNA, 14 bp, Homo sapiens
gggaggggcctagg

SEQ ID NO: 3498081 - DNA, 21 bp, Homo sapiens
gggaggtatgggctgggggct

SEQ ID NO: 3498082 - DNA, 21 bp, Homo sapiens
gggagtcatctcaaccatccc

SEQ ID NO: 3498083 - DNA, 18 bp, Homo sapiens
gggagtgacagaggcagc

SEQ ID NO: 3498084 - DNA, 17 bp, Homo sapiens
gggagttaagacctggc

SEQ ID NO: 3498085 - DNA, 20 bp, Homo sapiens
gggagttaagacctggcagc

SEQ ID NO: 3498086 - DNA, 22 bp, Homo sapiens
gggatactttagaagtagaatt

SEQ ID NO: 3498087 - DNA, 13 bp, Homo sapiens
gggatagagagag

SEQ ID NO: 3498088 - DNA, 21 bp, Homo sapiens
gggatatgatttaaatcagcc

SEQ ID NO: 3498089 - DNA, 23 bp, Homo sapiens
gggatcaaagttctgctttctcc

SEQ ID NO: 3498090 - DNA, 22 bp, Homo sapiens
gggatcaaccagctaagaaaag

SEQ ID NO: 3498091 - DNA, 19 bp, Homo sapiens
gggatccctgtctttccta

SEQ ID NO: 3498092 - DNA, 19 bp, Homo sapiens
gggatctggtcctacccat

SEQ ID NO: 3498093 - DNA, 13 bp, Homo sapiens
gggatgagaaagg

SEQ ID NO: 3498094 - DNA, 15 bp, Homo sapiens
gggatgagagttttg

SEQ ID NO: 3498095 - DNA, 20 bp, Homo sapiens
gggatgagcatggagctggc

SEQ ID NO: 3498096 - DNA, 22 bp, Homo sapiens
gggatgtacaaggcgatcccat

SEQ ID NO: 3498097 - DNA, 20 bp, Homo sapiens
gggatttccagccagggctg

SEQ ID NO: 3498098 - DNA, 14 bp, Homo sapiens
gggatttctttgct

SEQ ID NO: 3498099 - DNA, 15 bp, Homo sapiens
gggatttgcctcacc

SEQ ID NO: 3498100 - DNA, 14 bp, Homo sapiens
gggcaaacaggcag

SEQ ID NO: 3498101 - DNA, 15 bp, Homo sapiens
gggcaaacaggcagt

SEQ ID NO: 3498102 - DNA, 22 bp, Homo sapiens
gggcaagtctttaggtctttgt

SEQ ID NO: 3498103 - DNA, 19 bp, Homo sapiens
gggcacacgcctcccactg

SEQ ID NO: 3498104 - DNA, 16 bp, Homo sapiens
gtaagaactaaagaag

SEQ ID NO: 3498105 - DNA, 18 bp, Homo sapiens
gtaagcatctacttcagg

SEQ ID NO: 3498106 - DNA, 22 bp, Homo sapiens
gtaaggccttagccatgatctg

SEQ ID NO: 3498107 - DNA, 12 bp, Homo sapiens
gtaataaactat

SEQ ID NO: 3498108 - DNA, 15 bp, Homo sapiens
gtaataaactttaat

SEQ ID NO: 3498109 - DNA, 15 bp, Homo sapiens
gtaataacatttaat

SEQ ID NO: 3498110 - DNA, 18 bp, Homo sapiens
gtaatattttactttgag

SEQ ID NO: 3498111 - DNA, 18 bp, Homo sapiens
gtaatcatttgtttacat

SEQ ID NO: 3498112 - DNA, 13 bp, Homo sapiens
gtaatcccagcta

SEQ ID NO: 3498113 - DNA, 22 bp, Homo sapiens
gtaatcctcaagaaataaaagg

SEQ ID NO: 3498114 - DNA, 20 bp, Homo sapiens
gtaatgttaatgttatatca

SEQ ID NO: 3498115 - DNA, 19 bp, Homo sapiens
gtaatgttttctttgcaaa

SEQ ID NO: 3498116 - DNA, 21 bp, Homo sapiens
gtaatgttttctttgcaaagt

SEQ ID NO: 3498117 - DNA, 15 bp, Homo sapiens
gtaattagtaacatg

SEQ ID NO: 3498118 - DNA, 19 bp, Homo sapiens
gtaatttagtctaacacag

SEQ ID NO: 3498119 - DNA, 15 bp, Homo sapiens
gtaattttacttttt

SEQ ID NO: 3498120 - DNA, 15 bp, Homo sapiens
gtaattttatatgaa

SEQ ID NO: 3498121 - DNA, 17 bp, Homo sapiens
gtacaaacccaaaaaag

SEQ ID NO: 3498122 - DNA, 13 bp, Homo sapiens
gtacaaatataag

SEQ ID NO: 3498123 - DNA, 17 bp, Homo sapiens
gtacaaatataagaata

SEQ ID NO: 3498124 - DNA, 17 bp, Homo sapiens
gtacaaggcgatcccat

SEQ ID NO: 3498125 - DNA, 14 bp, Homo sapiens
gtacaatcatgttc

SEQ ID NO: 3498126 - DNA, 16 bp, Homo sapiens
gtacagacatatttaa

SEQ ID NO: 3498127 - DNA, 16 bp, Homo sapiens
gtacagcccagaggcc

SEQ ID NO: 3498128 - DNA, 23 bp, Homo sapiens
gtacagcccagaggccaacactg

SEQ ID NO: 3498129 - DNA, 15 bp, Homo sapiens
gtacaggcagcacag

SEQ ID NO: 3498130 - DNA, 17 bp, Homo sapiens
gtacaggcagcacagag

SEQ ID NO: 3498131 - DNA, 21 bp, Homo sapiens
gtacatgttcgggtgtgggtt

SEQ ID NO: 3498132 - DNA, 20 bp, Homo sapiens
gtacatttttcaactttgaa

SEQ ID NO: 3498133 - DNA, 23 bp, Homo sapiens
gtacatttttcaactttgaataa

SEQ ID NO: 3498134 - DNA, 15 bp, Homo sapiens
gtaccaccaaaaaag

SEQ ID NO: 3498135 - DNA, 22 bp, Homo sapiens
gtaccagtgaatttttgcaata

SEQ ID NO: 3498136 - DNA, 20 bp, Homo sapiens
gtaccatagtaccatttata

SEQ ID NO: 3498137 - DNA, 21 bp, Homo sapiens
gtaccatttatacaaattaga

SEQ ID NO: 3498138 - DNA, 14 bp, Homo sapiens
gtacccactgctct

SEQ ID NO: 3498139 - DNA, 22 bp, Homo sapiens
gtaccccctcaaaccctgccct

SEQ ID NO: 3498140 - DNA, 17 bp, Homo sapiens
gtacccggggcccaggg

SEQ ID NO: 3498141 - DNA, 17 bp, Homo sapiens
gtacctatggctgcctg

SEQ ID NO: 3498142 - DNA, 17 bp, Homo sapiens
gtacctgcccccaatcc

SEQ ID NO: 3498143 - DNA, 20 bp, Homo sapiens
gtaccttgacctttgtacag

SEQ ID NO: 3498144 - DNA, 13 bp, Homo sapiens
gtaccttgcttct

SEQ ID NO: 3498145 - DNA, 17 bp, Homo sapiens
gtacctttcctacattt

SEQ ID NO: 3498146 - DNA, 19 bp, Homo sapiens
gtacctttcctacattttc

SEQ ID NO: 3498147 - DNA, 15 bp, Homo sapiens
gtacgtctgacaggc

SEQ ID NO: 3498148 - DNA, 19 bp, Homo sapiens
gtactagtcctctagaaat

SEQ ID NO: 3498149 - DNA, 17 bp, Homo sapiens
gtactagtgttctgttt

SEQ ID NO: 3498150 - DNA, 13 bp, Homo sapiens
gtactagttttag

SEQ ID NO: 3498151 - DNA, 15 bp, Homo sapiens
gtactctccttttat

SEQ ID NO: 3498152 - DNA, 14 bp, Homo sapiens
gtactggcatggta

SEQ ID NO: 3498153 - DNA, 20 bp, Homo sapiens
gtactgtgggcaatttagaa

SEQ ID NO: 3498154 - DNA, 10 bp, Homo sapiens
gtacttacaa

SEQ ID NO: 3498155 - DNA, 16 bp, Homo sapiens
gtacttacccggagaa

SEQ ID NO: 3498156 - DNA, 22 bp, Homo sapiens
gtacttgccttattagagtgtc

SEQ ID NO: 3498157 - DNA, 12 bp, Homo sapiens
gtacttgtttgc

SEQ ID NO: 3498158 - DNA, 23 bp, Homo sapiens
gtactttattttctataatttaa

SEQ ID NO: 3498159 - DNA, 20 bp, Homo sapiens
gtactttgtcccgtggcatt

SEQ ID NO: 3498160 - DNA, 23 bp, Homo sapiens
gtactttttagtaatttcttttt

SEQ ID NO: 3498161 - DNA, 15 bp, Homo sapiens
gtactttttgtgaag

SEQ ID NO: 3498162 - DNA, 19 bp, Homo sapiens
gtagaatagcctgtggcct

SEQ ID NO: 3498163 - DNA, 11 bp, Homo sapiens
gtagaatattc

SEQ ID NO: 3498164 - DNA, 13 bp, Homo sapiens
gtagaattccttc

SEQ ID NO: 3498165 - DNA, 23 bp, Homo sapiens
gtagaattccttcgaaaggcctt

SEQ ID NO: 3498166 - DNA, 11 bp, Homo sapiens
gtagagacagg

SEQ ID NO: 3498167 - DNA, 13 bp, Homo sapiens
gtagagacagggt

SEQ ID NO: 3498168 - DNA, 14 bp, Homo sapiens
gtagattttccaaa

SEQ ID NO: 3498169 - DNA, 20 bp, Homo sapiens
gtagcactactaaaagttta

SEQ ID NO: 3498170 - DNA, 14 bp, Homo sapiens
gtagcactcaggct

SEQ ID NO: 3498171 - DNA, 17 bp, Homo sapiens
gtagcactcaggctctc

SEQ ID NO: 3498172 - DNA, 13 bp, Homo sapiens
gtagcacttactg

SEQ ID NO: 3498173 - DNA, 23 bp, Homo sapiens
gtagcagaaaggaaaagattcct

SEQ ID NO: 3498174 - DNA, 18 bp, Homo sapiens
gtagccagcacacagggc

SEQ ID NO: 3498175 - DNA, 19 bp, Homo sapiens
gtagccagcacacagggca

SEQ ID NO: 3498176 - DNA, 16 bp, Homo sapiens
gtagcccactctgctc

SEQ ID NO: 3498177 - DNA, 17 bp, Homo sapiens
gtagcccatccttccct

SEQ ID NO: 3498178 - DNA, 12 bp, Homo sapiens
gtagcctgctgg

SEQ ID NO: 3498179 - DNA, 17 bp, Homo sapiens
gtagctagaggaaccaa

SEQ ID NO: 3498180 - DNA, 17 bp, Homo sapiens
gtagctgcaaaggacag

SEQ ID NO: 3498181 - DNA, 12 bp, Homo sapiens
gtagctgggact

SEQ ID NO: 3498182 - DNA, 19 bp, Homo sapiens
gtagctgggactacaggca

SEQ ID NO: 3498183 - DNA, 21 bp, Homo sapiens
gtagctgggattacaggtgtg

SEQ ID NO: 3498184 - DNA, 22 bp, Homo sapiens
gtaggaaccgtggtatgtctgc

SEQ ID NO: 3498185 - DNA, 14 bp, Homo sapiens
gtaggagctgcctt

SEQ ID NO: 3498186 - DNA, 13 bp, Homo sapiens
gtaggcagacaca

SEQ ID NO: 3498187 - DNA, 14 bp, Homo sapiens
gtaggcagaggctg

SEQ ID NO: 3498188 - DNA, 15 bp, Homo sapiens
gtaggcagaggctgc

SEQ ID NO: 3498189 - DNA, 16 bp, Homo sapiens
gtagggcgggaggatg

SEQ ID NO: 3498190 - DNA, 21 bp, Homo sapiens
gtagggcgggaggatgttctg

SEQ ID NO: 3498191 - DNA, 23 bp, Homo sapiens
gtagggcgggaggatgttctggg

SEQ ID NO: 3498192 - DNA, 22 bp, Homo sapiens
gtagggtaattagtaacatgtg

SEQ ID NO: 3498193 - DNA, 13 bp, Homo sapiens
gtaggtgaacagt

SEQ ID NO: 3498194 - DNA, 23 bp, Homo sapiens
gtaggtgaacagtcacgcctgaa

SEQ ID NO: 3498195 - DNA, 15 bp, Homo sapiens
gtaggttcagccaag

SEQ ID NO: 3498196 - DNA, 16 bp, Homo sapiens
gtaggttcagccaagg

SEQ ID NO: 3498197 - DNA, 15 bp, Homo sapiens
gtagtaattgacatg

SEQ ID NO: 3498198 - DNA, 14 bp, Homo sapiens
gtagtaatttcctt

SEQ ID NO: 3498199 - DNA, 15 bp, Homo sapiens
gtagtattcttccct

SEQ ID NO: 3498200 - DNA, 12 bp, Homo sapiens
gtagtcctgtga

SEQ ID NO: 3498201 - DNA, 15 bp, Homo sapiens
gtagttaggcctggc

SEQ ID NO: 3498202 - DNA, 17 bp, Homo sapiens
gtagttatataattgtt

SEQ ID NO: 3498203 - DNA, 18 bp, Homo sapiens
gtagttgacaattctgca

SEQ ID NO: 3498204 - DNA, 22 bp, Homo sapiens
gtagttgacaattctgcatgta

SEQ ID NO: 3498205 - DNA, 15 bp, Homo sapiens
gtataaaatcagcca

SEQ ID NO: 3498206 - DNA, 17 bp, Homo sapiens
gtataaaatcagccaat

SEQ ID NO: 3498207 - DNA, 23 bp, Homo sapiens
gtataaaatcagccaattatgtt

SEQ ID NO: 3498208 - DNA, 20 bp, Homo sapiens
gtataaaatgtaacactgat

SEQ ID NO: 3498209 - DNA, 21 bp, Homo sapiens
gtataacggtttaattctgtc

SEQ ID NO: 3498210 - DNA, 15 bp, Homo sapiens
gtataagtaagaaaa

SEQ ID NO: 3498211 - DNA, 17 bp, Homo sapiens
gtataagtaagaaaata

SEQ ID NO: 3498212 - DNA, 19 bp, Homo sapiens
gtataagtggaggcacttt

SEQ ID NO: 3498213 - DNA, 23 bp, Homo sapiens
gtataagttatttttgtacatgt

SEQ ID NO: 3498214 - DNA, 16 bp, Homo sapiens
gtatatatatgtatgt

SEQ ID NO: 3498215 - DNA, 19 bp, Homo sapiens
gtatattgtgtttgtgtat

SEQ ID NO: 3498216 - DNA, 20 bp, Homo sapiens
gtatattgtgtttgtgtatt

SEQ ID NO: 3498217 - DNA, 21 bp, Homo sapiens
gtatatttgtgatagcacttt

SEQ ID NO: 3498218 - DNA, 17 bp, Homo sapiens
gtatcactgtctttcct

SEQ ID NO: 3498219 - DNA, 20 bp, Homo sapiens
gtatcactgtctttcctaga

SEQ ID NO: 3498220 - DNA, 18 bp, Homo sapiens
gtatcaggacccagagga

SEQ ID NO: 3498221 - DNA, 21 bp, Homo sapiens
gtatcaggacccagaggaagg

SEQ ID NO: 3498222 - DNA, 16 bp, Homo sapiens
gtatcaggtgctgcca

SEQ ID NO: 3498223 - DNA, 14 bp, Homo sapiens
gtatccatgctctt

SEQ ID NO: 3498224 - DNA, 19 bp, Homo sapiens
gtatcccatgagcctcagc

SEQ ID NO: 3498225 - DNA, 18 bp, Homo sapiens
gtatctccggctcccagc

SEQ ID NO: 3498226 - DNA, 20 bp, Homo sapiens
gtatctctttcacattgttt

SEQ ID NO: 3498227 - DNA, 16 bp, Homo sapiens
gtatctgcaggcagac

SEQ ID NO: 3498228 - DNA, 22 bp, Homo sapiens
gtatcttgatgtttagaaaagt

SEQ ID NO: 3498229 - DNA, 23 bp, Homo sapiens
gtatcttgtttttccactactgc

SEQ ID NO: 3498230 - DNA, 13 bp, Homo sapiens
gtatgatgctgcc

SEQ ID NO: 3498231 - DNA, 13 bp, Homo sapiens
gtatggagctcag

SEQ ID NO: 3498232 - DNA, 15 bp, Homo sapiens
gtatggagctcagag

SEQ ID NO: 3498233 - DNA, 11 bp, Homo sapiens
gtatgggctgg

SEQ ID NO: 3498234 - DNA, 15 bp, Homo sapiens
gtatgggctgggggc

SEQ ID NO: 3498235 - DNA, 12 bp, Homo sapiens
gtatgtaacatg

SEQ ID NO: 3498236 - DNA, 16 bp, Homo sapiens
gtatgtaatggaactt

SEQ ID NO: 3498237 - DNA, 22 bp, Homo sapiens
gtgattctcctgcctcagcctc

SEQ ID NO: 3498238 - DNA, 23 bp, Homo sapiens
gtgattgtggaatggagattcag

SEQ ID NO: 3498239 - DNA, 14 bp, Homo sapiens
gtgattttaactct

SEQ ID NO: 3498240 - DNA, 16 bp, Homo sapiens
gtgattttaactctgt

SEQ ID NO: 3498241 - DNA, 17 bp, Homo sapiens
gtgattttaactctgtc

SEQ ID NO: 3498242 - DNA, 22 bp, Homo sapiens
gtgcaacaaggtcctctgtcag

SEQ ID NO: 3498243 - DNA, 14 bp, Homo sapiens
gtgcaacagggtat

SEQ ID NO: 3498244 - DNA, 24 bp, Homo sapiens
gtgcaacagggtatggactatctg

SEQ ID NO: 3498245 - DNA, 23 bp, Homo sapiens
gtgcaacctcttggcctgatcag

SEQ ID NO: 3498246 - DNA, 21 bp, Homo sapiens
gtgcaataaatctgacccagt

SEQ ID NO: 3498247 - DNA, 18 bp, Homo sapiens
gtgcacaaaacccagacc

SEQ ID NO: 3498248 - DNA, 12 bp, Homo sapiens
gtgcacacacca

SEQ ID NO: 3498249 - DNA, 17 bp, Homo sapiens
gtgcacacaccagagcc

SEQ ID NO: 3498250 - DNA, 18 bp, Homo sapiens
gtgcaccaccacacccgg

SEQ ID NO: 3498251 - DNA, 22 bp, Homo sapiens
gtgcacctagagcttttttata

SEQ ID NO: 3498252 - DNA, 12 bp, Homo sapiens
gtgcagccagag

SEQ ID NO: 3498253 - DNA, 13 bp, Homo sapiens
gtgcagccagagg

SEQ ID NO: 3498254 - DNA, 23 bp, Homo sapiens
gtgcagctcaaggaaaggcctga

SEQ ID NO: 3498255 - DNA, 15 bp, Homo sapiens
gtgcaggtggggaga

SEQ ID NO: 3498256 - DNA, 20 bp, Homo sapiens
gtgcagtggtgcgatctggg

SEQ ID NO: 3498257 - DNA, 23 bp, Homo sapiens
gtgcagtggtgcgatctgggttc

SEQ ID NO: 3498258 - DNA, 17 bp, Homo sapiens
gtgcatatgtacagaag

SEQ ID NO: 3498259 - DNA, 20 bp, Homo sapiens
gtgccaacaatcctagtgct

SEQ ID NO: 3498260 - DNA, 23 bp, Homo sapiens
gtgccaacactcaagaagcaggc

SEQ ID NO: 3498261 - DNA, 15 bp, Homo sapiens
gtgccagatcctctt

SEQ ID NO: 3498262 - DNA, 20 bp, Homo sapiens
gtgccaggtttttggtctga

SEQ ID NO: 3498263 - DNA, 14 bp, Homo sapiens
gtgccatgtgccag

SEQ ID NO: 3498264 - DNA, 20 bp, Homo sapiens
gtgcccaagccagaggctgg

SEQ ID NO: 3498265 - DNA, 21 bp, Homo sapiens
gtgcccacaccggggacaggc

SEQ ID NO: 3498266 - DNA, 13 bp, Homo sapiens
gtgcccacaggcc

SEQ ID NO: 3498267 - DNA, 20 bp, Homo sapiens
gtgcccagctatacctgtgc

SEQ ID NO: 3498268 - DNA, 22 bp, Homo sapiens
gtgcccagctatacctgtgcct

SEQ ID NO: 3498269 - DNA, 14 bp, Homo sapiens
gtgccctccttccc

SEQ ID NO: 3498270 - DNA, 17 bp, Homo sapiens
gtgccctccttcccaat

SEQ ID NO: 3498271 - DNA, 16 bp, Homo sapiens
gtgcccttggaggcca

SEQ ID NO: 3498272 - DNA, 19 bp, Homo sapiens
gtgcccttttccagcctca

SEQ ID NO: 3498273 - DNA, 22 bp, Homo sapiens
gtgccgagaaggaagcctccca

SEQ ID NO: 3498274 - DNA, 19 bp, Homo sapiens
gtgcctatttgtgtggaca

SEQ ID NO: 3498275 - DNA, 15 bp, Homo sapiens
gtgcctctgtcctta

SEQ ID NO: 3498276 - DNA, 22 bp, Homo sapiens
gtgcctgccatagccaggagcg

SEQ ID NO: 3498277 - DNA, 22 bp, Homo sapiens
gtgcctgtgtccatgcgctcag

SEQ ID NO: 3498278 - DNA, 17 bp, Homo sapiens
gtgccttctgtggggac

SEQ ID NO: 3498279 - DNA, 18 bp, Homo sapiens
gtgcctttcaaatttaga

SEQ ID NO: 3498280 - DNA, 22 bp, Homo sapiens
gtgccttttttcacggaagttt

SEQ ID NO: 3498281 - DNA, 19 bp, Homo sapiens
gtgcgctgggcacttccct

SEQ ID NO: 3498282 - DNA, 14 bp, Homo sapiens
gtgctaagtgtgaa

SEQ ID NO: 3498283 - DNA, 21 bp, Homo sapiens
gtgctacacccttttccagct

SEQ ID NO: 3498284 - DNA, 22 bp, Homo sapiens
gtgctcacgttaccttgacaca

SEQ ID NO: 3498285 - DNA, 23 bp, Homo sapiens
gtgctcacgttaccttgacacat

SEQ ID NO: 3498286 - DNA, 16 bp, Homo sapiens
gtgctcagggaaatgg

SEQ ID NO: 3498287 - DNA, 15 bp, Homo sapiens
gtgctcgctgttgct

SEQ ID NO: 3498288 - DNA, 18 bp, Homo sapiens
gtgctcgctgttgctgaa

SEQ ID NO: 3498289 - DNA, 16 bp, Homo sapiens
gtgctctaggctgccc

SEQ ID NO: 3498290 - DNA, 17 bp, Homo sapiens
gtgctctaggctgcccc

SEQ ID NO: 3498291 - DNA, 16 bp, Homo sapiens
gtgctctggacaggca

SEQ ID NO: 3498292 - DNA, 17 bp, Homo sapiens
gtgctctggacaggcat

SEQ ID NO: 3498293 - DNA, 18 bp, Homo sapiens
gtgctgacggccagggag

SEQ ID NO: 3498294 - DNA, 20 bp, Homo sapiens
gtgctgagtagatgcgcagc

SEQ ID NO: 3498295 - DNA, 14 bp, Homo sapiens
gtgctgcagctccc

SEQ ID NO: 3498296 - DNA, 11 bp, Homo sapiens
gtgctgcctct

SEQ ID NO: 3498297 - DNA, 15 bp, Homo sapiens
gtgctgctgctgctg

SEQ ID NO: 3498298 - DNA, 19 bp, Homo sapiens
gtgctggagaaatcttgaa

SEQ ID NO: 3498299 - DNA, 22 bp, Homo sapiens
gtgctggagcactgggctcccg

SEQ ID NO: 3498300 - DNA, 16 bp, Homo sapiens
gtgctgggagctccac

SEQ ID NO: 3498301 - DNA, 23 bp, Homo sapiens
gtgctgggagctccactctgctt

SEQ ID NO: 3498302 - DNA, 20 bp, Homo sapiens
gtgctggtcccggggccagc

SEQ ID NO: 3498303 - DNA, 12 bp, Homo sapiens
gtgctgtaattt

SEQ ID NO: 3498304 - DNA, 15 bp, Homo sapiens
gtgctgtataaaatc

SEQ ID NO: 3498305 - DNA, 12 bp, Homo sapiens
gtgctgtgtgcc

SEQ ID NO: 3498306 - DNA, 11 bp, Homo sapiens
gtgctgtgtgt

SEQ ID NO: 3498307 - DNA, 16 bp, Homo sapiens
gtgcttatggtaccag

SEQ ID NO: 3498308 - DNA, 13 bp, Homo sapiens
gtgcttctttctt

SEQ ID NO: 3498309 - DNA, 15 bp, Homo sapiens
gtgctttccctcttt

SEQ ID NO: 3498310 - DNA, 22 bp, Homo sapiens
gtgctttccgtggcactgcata

SEQ ID NO: 3498311 - DNA, 19 bp, Homo sapiens
gtgctttccttttttaaaa

SEQ ID NO: 3498312 - DNA, 20 bp, Homo sapiens
gtgctttccttttttaaaaa

SEQ ID NO: 3498313 - DNA, 18 bp, Homo sapiens
gtggaactgcgttatgaa

SEQ ID NO: 3498314 - DNA, 14 bp, Homo sapiens
gtggacacagctct

SEQ ID NO: 3498315 - DNA, 15 bp, Homo sapiens
gtggactcagggcag

SEQ ID NO: 3498316 - DNA, 13 bp, Homo sapiens
gtggactggaagg

SEQ ID NO: 3498317 - DNA, 15 bp, Homo sapiens
gtggacttgaacttt

SEQ ID NO: 3498318 - DNA, 16 bp, Homo sapiens
gtggacttgaactttc

SEQ ID NO: 3498319 - DNA, 20 bp, Homo sapiens
gtggagaagcggctggcagc

SEQ ID NO: 3498320 - DNA, 12 bp, Homo sapiens
gtggaggagcag

SEQ ID NO: 3498321 - DNA, 13 bp, Homo sapiens
gtggaggcacttt

SEQ ID NO: 3498322 - DNA, 14 bp, Homo sapiens
gtggagtgcagtgg

SEQ ID NO: 3498323 - DNA, 20 bp, Homo sapiens
gtggatgccgatttctgtaa

SEQ ID NO: 3498324 - DNA, 16 bp, Homo sapiens
gtggatgcctggtggc

SEQ ID NO: 3498325 - DNA, 18 bp, Homo sapiens
gtggatgcctggtggcag

SEQ ID NO: 3498326 - DNA, 20 bp, Homo sapiens
gtggatgcctggtggcagct

SEQ ID NO: 3498327 - DNA, 16 bp, Homo sapiens
gtggatggccccagca

SEQ ID NO: 3498328 - DNA, 19 bp, Homo sapiens
gtggatggccccagcacag

SEQ ID NO: 3498329 - DNA, 23 bp, Homo sapiens
gtggatgggttttatgagatgga

SEQ ID NO: 3498330 - DNA, 11 bp, Homo sapiens
gtggatgtgga

SEQ ID NO: 3498331 - DNA, 16 bp, Homo sapiens
gtggattctccctggg

SEQ ID NO: 3498332 - DNA, 14 bp, Homo sapiens
gtggcacattcctt

SEQ ID NO: 3498333 - DNA, 19 bp, Homo sapiens
gtggcaccagcagcctgga

SEQ ID NO: 3498334 - DNA, 14 bp, Homo sapiens
gtggcagctgcggt

SEQ ID NO: 3498335 - DNA, 23 bp, Homo sapiens
gtggcagctgcggtccacccagg

SEQ ID NO: 3498336 - DNA, 12 bp, Homo sapiens
gtggcagctgct

SEQ ID NO: 3498337 - DNA, 13 bp, Homo sapiens
gtggcagctgctt

SEQ ID NO: 3498338 - DNA, 19 bp, Homo sapiens
gtggcagctgcttttgtct

SEQ ID NO: 3498339 - DNA, 20 bp, Homo sapiens
gtggcatcaccttaggcagg

SEQ ID NO: 3498340 - DNA, 22 bp, Homo sapiens
gtggcatcaccttaggcaggga

SEQ ID NO: 3498341 - DNA, 23 bp, Homo sapiens
gtggcatttcaattcctggccct

SEQ ID NO: 3498342 - DNA, 16 bp, Homo sapiens
gtggccaaggagctgc

SEQ ID NO: 3498343 - DNA, 12 bp, Homo sapiens
gtggccatggcc

SEQ ID NO: 3498344 - DNA, 13 bp, Homo sapiens
gtggcccaggacc

SEQ ID NO: 3498345 - DNA, 17 bp, Homo sapiens
gtggccccgtttctggt

SEQ ID NO: 3498346 - DNA, 20 bp, Homo sapiens
gtggcccctgctgtctctct

SEQ ID NO: 3498347 - DNA, 18 bp, Homo sapiens
gtggccgcacgcctctcc

SEQ ID NO: 3498348 - DNA, 19 bp, Homo sapiens
gtggcctctttgtctaaaa

SEQ ID NO: 3498349 - DNA, 12 bp, Homo sapiens
gtggcctgggcc

SEQ ID NO: 3498350 - DNA, 15 bp, Homo sapiens
gtggcctgggcctcc

SEQ ID NO: 3498351 - DNA, 14 bp, Homo sapiens
gtggcctggtccct

SEQ ID NO: 3498352 - DNA, 12 bp, Homo sapiens
gtggcctgtgtg

SEQ ID NO: 3498353 - DNA, 15 bp, Homo sapiens
gtggcctgtgtggcc

SEQ ID NO: 3498354 - DNA, 17 bp, Homo sapiens
gtggcgccgtctccagg

SEQ ID NO: 3498355 - DNA, 18 bp, Homo sapiens
gtggctagtcaagctcct

SEQ ID NO: 3498356 - DNA, 14 bp, Homo sapiens
gtggctcacgcctg

SEQ ID NO: 3498357 - DNA, 16 bp, Homo sapiens
gtggctgcctcattta

SEQ ID NO: 3498358 - DNA, 19 bp, Homo sapiens
gtggctgcgtgcccctgct

SEQ ID NO: 3498359 - DNA, 20 bp, Homo sapiens
gtggctgcgtgcccctgctg

SEQ ID NO: 3498360 - DNA, 12 bp, Homo sapiens
gtggctgggcag

SEQ ID NO: 3498361 - DNA, 13 bp, Homo sapiens
gtggctgtctgga

SEQ ID NO: 3498362 - DNA, 22 bp, Homo sapiens
gtggcttaaaacaacactcaca

SEQ ID NO: 3498363 - DNA, 21 bp, Homo sapiens
gtggcttcattagagcaggcg

SEQ ID NO: 3498364 - DNA, 21 bp, Homo sapiens
gtggcttctctgtgaattgcc

SEQ ID NO: 3498365 - DNA, 12 bp, Homo sapiens
gtgggagctgag

SEQ ID NO: 3498366 - DNA, 15 bp, Homo sapiens
gtgggagctgcctgt

SEQ ID NO: 3498367 - DNA, 21 bp, Homo sapiens
gtgggatcagggcattgcctg

SEQ ID NO: 3498368 - DNA, 16 bp, Homo sapiens
gtgggatgaaccagcc

SEQ ID NO: 3498369 - DNA, 19 bp, Homo sapiens
taaaagatggggtctgtaa

SEQ ID NO: 3498370 - DNA, 22 bp, Homo sapiens
taaaagatggggtctgtaaaat

SEQ ID NO: 3498371 - DNA, 22 bp, Homo sapiens
taaaaggactctggaagatttt

SEQ ID NO: 3498372 - DNA, 15 bp, Homo sapiens
taaaaggccaaacct

SEQ ID NO: 3498373 - DNA, 17 bp, Homo sapiens
taaaaggtgcaggtgtg

SEQ ID NO: 3498374 - DNA, 19 bp, Homo sapiens
taaaagtgggcttgattct

SEQ ID NO: 3498375 - DNA, 16 bp, Homo sapiens
taaaagtttagaactt

SEQ ID NO: 3498376 - DNA, 16 bp, Homo sapiens
taaaataaactgtaaa

SEQ ID NO: 3498377 - DNA, 18 bp, Homo sapiens
taaaataaactgtaaact

SEQ ID NO: 3498378 - DNA, 23 bp, Homo sapiens
taaaataaactgtaaactaatag

SEQ ID NO: 3498379 - DNA, 24 bp, Homo sapiens
taaaataactagtgttgcttggac

SEQ ID NO: 3498380 - DNA, 18 bp, Homo sapiens
taaaatatagctgtacaa

SEQ ID NO: 3498381 - DNA, 15 bp, Homo sapiens
taaaatattattgaa

SEQ ID NO: 3498382 - DNA, 17 bp, Homo sapiens
taaaatgcctcagtgta

SEQ ID NO: 3498383 - DNA, 20 bp, Homo sapiens
taaaatgcctcagtgtattt

SEQ ID NO: 3498384 - DNA, 11 bp, Homo sapiens
taaaatgtaac

SEQ ID NO: 3498385 - DNA, 18 bp, Homo sapiens
taaaatgtaacactgatg

SEQ ID NO: 3498386 - DNA, 14 bp, Homo sapiens
taaaatgttaaaac

SEQ ID NO: 3498387 - DNA, 15 bp, Homo sapiens
taaaatgttgaaaag

SEQ ID NO: 3498388 - DNA, 11 bp, Homo sapiens
taaaattagat

SEQ ID NO: 3498389 - DNA, 13 bp, Homo sapiens
taaaattgccata

SEQ ID NO: 3498390 - DNA, 21 bp, Homo sapiens
taaaatttaacttcttcataa

SEQ ID NO: 3498391 - DNA, 17 bp, Homo sapiens
taaaatttttttagaaa

SEQ ID NO: 3498392 - DNA, 18 bp, Homo sapiens
taaaatttttttagaaag

SEQ ID NO: 3498393 - DNA, 19 bp, Homo sapiens
taaaatttttttagaaagc

SEQ ID NO: 3498394 - DNA, 19 bp, Homo sapiens
taaaattttttttcatgtt

SEQ ID NO: 3498395 - DNA, 18 bp, Homo sapiens
taaacaaaccacagcagg

SEQ ID NO: 3498396 - DNA, 17 bp, Homo sapiens
taaacaaagttactagg

SEQ ID NO: 3498397 - DNA, 14 bp, Homo sapiens
taaacacacagata

SEQ ID NO: 3498398 - DNA, 13 bp, Homo sapiens
taaacacattttg

SEQ ID NO: 3498399 - DNA, 16 bp, Homo sapiens
taaacatcacacacac

SEQ ID NO: 3498400 - DNA, 15 bp, Homo sapiens
taaacctcagttatt

SEQ ID NO: 3498401 - DNA, 13 bp, Homo sapiens
taaactaaacacg

SEQ ID NO: 3498402 - DNA, 17 bp, Homo sapiens
taaactagcatatctgc

SEQ ID NO: 3498403 - DNA, 21 bp, Homo sapiens
taaactctctttgggaatgtt

SEQ ID NO: 3498404 - DNA, 13 bp, Homo sapiens
taaactctgcatc

SEQ ID NO: 3498405 - DNA, 12 bp, Homo sapiens
taaactgtaaac

SEQ ID NO: 3498406 - DNA, 13 bp, Homo sapiens
taaactgtaaact

SEQ ID NO: 3498407 - DNA, 12 bp, Homo sapiens
taaactgtgcac

SEQ ID NO: 3498408 - DNA, 22 bp, Homo sapiens
taaacttggtttttaaaaaact

SEQ ID NO: 3498409 - DNA, 13 bp, Homo sapiens
taaagaatacttg

SEQ ID NO: 3498410 - DNA, 14 bp, Homo sapiens
taaagaatacttga

SEQ ID NO: 3498411 - DNA, 18 bp, Homo sapiens
taaagaatacttgaactt

SEQ ID NO: 3498412 - DNA, 20 bp, Homo sapiens
taaagacaatcactgccaac

SEQ ID NO: 3498413 - DNA, 14 bp, Homo sapiens
taaagcactgagca

SEQ ID NO: 3498414 - DNA, 15 bp, Homo sapiens
taaagctaaaataac

SEQ ID NO: 3498415 - DNA, 13 bp, Homo sapiens
taaagctgttctc

SEQ ID NO: 3498416 - DNA, 14 bp, Homo sapiens
taaagctgttctca

SEQ ID NO: 3498417 - DNA, 22 bp, Homo sapiens
taaaggagcatttttttattca

SEQ ID NO: 3498418 - DNA, 16 bp, Homo sapiens
taaaggatgtgattgt

SEQ ID NO: 3498419 - DNA, 22 bp, Homo sapiens
taaaggctcgattttgtatctg

SEQ ID NO: 3498420 - DNA, 16 bp, Homo sapiens
taaagtgaagaatcct

SEQ ID NO: 3498421 - DNA, 12 bp, Homo sapiens
taaagtgattga

SEQ ID NO: 3498422 - DNA, 16 bp, Homo sapiens
taaagtgtttagctgt

SEQ ID NO: 3498423 - DNA, 13 bp, Homo sapiens
taaagttgtaaca

SEQ ID NO: 3498424 - DNA, 17 bp, Homo sapiens
taaataaaaataatcct

SEQ ID NO: 3498425 - DNA, 14 bp, Homo sapiens
taaataaattgtat

SEQ ID NO: 3498426 - DNA, 18 bp, Homo sapiens
taaataaattgtatattc

SEQ ID NO: 3498427 - DNA, 19 bp, Homo sapiens
taaataaattgtatattca

SEQ ID NO: 3498428 - DNA, 21 bp, Homo sapiens
taaataaattgtatattcact

SEQ ID NO: 3498429 - DNA, 22 bp, Homo sapiens
taaataaattgtatattcactt

SEQ ID NO: 3498430 - DNA, 20 bp, Homo sapiens
taaataatcccattctttat

SEQ ID NO: 3498431 - DNA, 16 bp, Homo sapiens
taaataatcttactct

SEQ ID NO: 3498432 - DNA, 22 bp, Homo sapiens
taaatacctcaacctatggtat

SEQ ID NO: 3498433 - DNA, 13 bp, Homo sapiens
taaatatataaat

SEQ ID NO: 3498434 - DNA, 17 bp, Homo sapiens
taaatatataaatatat

SEQ ID NO: 3498435 - DNA, 21 bp, Homo sapiens
taaatatatatatatataaaa

SEQ ID NO: 3498436 - DNA, 21 bp, Homo sapiens
taaatatatattattctcatt

SEQ ID NO: 3498437 - DNA, 14 bp, Homo sapiens
taaatattttctat

SEQ ID NO: 3498438 - DNA, 22 bp, Homo sapiens
taaatcagtcaagctgttgaag

SEQ ID NO: 3498439 - DNA, 12 bp, Homo sapiens
taaatccaaaga

SEQ ID NO: 3498440 - DNA, 18 bp, Homo sapiens
taaatgaaaatcgtgaca

SEQ ID NO: 3498441 - DNA, 16 bp, Homo sapiens
taaatgattagaagta

SEQ ID NO: 3498442 - DNA, 12 bp, Homo sapiens
taaatggcctca

SEQ ID NO: 3498443 - DNA, 11 bp, Homo sapiens
taaatggctgc

SEQ ID NO: 3498444 - DNA, 21 bp, Homo sapiens
taaatgtacagacatatttaa

SEQ ID NO: 3498445 - DNA, 19 bp, Homo sapiens
taaatgtatcttattcaca

SEQ ID NO: 3498446 - DNA, 20 bp, Homo sapiens
taaatgtctagttgtaacac

SEQ ID NO: 3498447 - DNA, 16 bp, Homo sapiens
taaatgttaagaaaaa

SEQ ID NO: 3498448 - DNA, 14 bp, Homo sapiens
taaattacaatttt

SEQ ID NO: 3498449 - DNA, 16 bp, Homo sapiens
taaattacaattttat

SEQ ID NO: 3498450 - DNA, 17 bp, Homo sapiens
taaattacaattttatc

SEQ ID NO: 3498451 - DNA, 21 bp, Homo sapiens
taaattatatttgtgctatag

SEQ ID NO: 3498452 - DNA, 18 bp, Homo sapiens
taaattcctctttgcttt

SEQ ID NO: 3498453 - DNA, 19 bp, Homo sapiens
taaattcctctttgctttg

SEQ ID NO: 3498454 - DNA, 12 bp, Homo sapiens
taaattctgatt

SEQ ID NO: 3498455 - DNA, 13 bp, Homo sapiens
taaattctgattc

SEQ ID NO: 3498456 - DNA, 16 bp, Homo sapiens
taaattctgattcttc

SEQ ID NO: 3498457 - DNA, 19 bp, Homo sapiens
taaattgaatcagtataaa

SEQ ID NO: 3498458 - DNA, 18 bp, Homo sapiens
taaattgccataatatga

SEQ ID NO: 3498459 - DNA, 13 bp, Homo sapiens
taaattgtatatt

SEQ ID NO: 3498460 - DNA, 15 bp, Homo sapiens
taaattttctgaaac

SEQ ID NO: 3498461 - DNA, 15 bp, Homo sapiens
taaattttgtgtctc

SEQ ID NO: 3498462 - DNA, 13 bp, Homo sapiens
taacaattcctct

SEQ ID NO: 3498463 - DNA, 12 bp, Homo sapiens
taacacagttga

SEQ ID NO: 3498464 - DNA, 19 bp, Homo sapiens
taacacctgattaactgag

SEQ ID NO: 3498465 - DNA, 18 bp, Homo sapiens
taacagcatgacaaaaat

SEQ ID NO: 3498466 - DNA, 12 bp, Homo sapiens
taacagctgaat

SEQ ID NO: 3498467 - DNA, 12 bp, Homo sapiens
taacagctgtgg

SEQ ID NO: 3498468 - DNA, 22 bp, Homo sapiens
taacagggagactgcatctcaa

SEQ ID NO: 3498469 - DNA, 15 bp, Homo sapiens
taacagtaacgcagg

SEQ ID NO: 3498470 - DNA, 15 bp, Homo sapiens
taacataataaatta

SEQ ID NO: 3498471 - DNA, 23 bp, Homo sapiens
taacatagctgaggtaaaaactg

SEQ ID NO: 3498472 - DNA, 23 bp, Homo sapiens
taacatcttgaatactctgccct

SEQ ID NO: 3498473 - DNA, 20 bp, Homo sapiens
taacatgaggggacattttg

SEQ ID NO: 3498474 - DNA, 17 bp, Homo sapiens
taacatgatgtactaaa

SEQ ID NO: 3498475 - DNA, 15 bp, Homo sapiens
taacatgtaggaagt

SEQ ID NO: 3498476 - DNA, 22 bp, Homo sapiens
taacatgtgttaagtattttca

SEQ ID NO: 3498477 - DNA, 17 bp, Homo sapiens
taacatttaatttagat

SEQ ID NO: 3498478 - DNA, 22 bp, Homo sapiens
taacatttaatttagatatttt

SEQ ID NO: 3498479 - DNA, 21 bp, Homo sapiens
taaccaaaggtgaaggaatat

SEQ ID NO: 3498480 - DNA, 19 bp, Homo sapiens
taaccaatcctactaataa

SEQ ID NO: 3498481 - DNA, 15 bp, Homo sapiens
taaccactgaaggga

SEQ ID NO: 3498482 - DNA, 13 bp, Homo sapiens
taacccagatttt

SEQ ID NO: 3498483 - DNA, 20 bp, Homo sapiens
taacccttcatcttcctgtg

SEQ ID NO: 3498484 - DNA, 21 bp, Homo sapiens
taacccttcatcttcctgtgt

SEQ ID NO: 3498485 - DNA, 14 bp, Homo sapiens
taaccgctccaggt

SEQ ID NO: 3498486 - DNA, 21 bp, Homo sapiens
taaccggcatgtttccagcag

SEQ ID NO: 3498487 - DNA, 14 bp, Homo sapiens
taacctaggcagtg

SEQ ID NO: 3498488 - DNA, 19 bp, Homo sapiens
taacctcaagtgatcctcc

SEQ ID NO: 3498489 - DNA, 17 bp, Homo sapiens
taacctcttcagaggcc

SEQ ID NO: 3498490 - DNA, 16 bp, Homo sapiens
taacctgcaaaatctg

SEQ ID NO: 3498491 - DNA, 11 bp, Homo sapiens
taacctggagg

SEQ ID NO: 3498492 - DNA, 19 bp, Homo sapiens
taaccttactaattatact

SEQ ID NO: 3498493 - DNA, 13 bp, Homo sapiens
taacggatcagaa

SEQ ID NO: 3498494 - DNA, 19 bp, Homo sapiens
taacggatcagaaatacag

SEQ ID NO: 3498495 - DNA, 21 bp, Homo sapiens
taacggatcagaaatacagat

SEQ ID NO: 3498496 - DNA, 16 bp, Homo sapiens
taacgtcatctcaggg

SEQ ID NO: 3498497 - DNA, 14 bp, Homo sapiens
taactaaactctct

SEQ ID NO: 3498498 - DNA, 18 bp, Homo sapiens
taactagaatttattcaa

SEQ ID NO: 3498499 - DNA, 18 bp, Homo sapiens
taactagatggtgctgag

SEQ ID NO: 3498500 - DNA, 20 bp, Homo sapiens
taactagatggtgctgagaa

SEQ ID NO: 3498501 - DNA, 22 bp, Homo sapiens
taactccctttttacactttat

SEQ ID NO: 3498502 - DNA, 16 bp, Homo sapiens
tacttgtttctctgtt

SEQ ID NO: 3498503 - DNA, 22 bp, Homo sapiens
tactttggaacactactcttac

SEQ ID NO: 3498504 - DNA, 23 bp, Homo sapiens
tactttggaacactactcttaca

SEQ ID NO: 3498505 - DNA, 19 bp, Homo sapiens
tactttgttaggattttca

SEQ ID NO: 3498506 - DNA, 14 bp, Homo sapiens
tactttttctaatg

SEQ ID NO: 3498507 - DNA, 16 bp, Homo sapiens
tactttttctaatgag

SEQ ID NO: 3498508 - DNA, 20 bp, Homo sapiens
tactttttgaacttttcatt

SEQ ID NO: 3498509 - DNA, 13 bp, Homo sapiens
tactttttgtgaa

SEQ ID NO: 3498510 - DNA, 15 bp, Homo sapiens
tactttttgtgaaga

SEQ ID NO: 3498511 - DNA, 13 bp, Homo sapiens
tactttttgttat

SEQ ID NO: 3498512 - DNA, 18 bp, Homo sapiens
tacttttttaaatatttt

SEQ ID NO: 3498513 - DNA, 22 bp, Homo sapiens
tacttttttaaatattttctat

SEQ ID NO: 3498514 - DNA, 19 bp, Homo sapiens
tagaaaaagaacatgcagt

SEQ ID NO: 3498515 - DNA, 21 bp, Homo sapiens
tagaaaaagaacatgcagttt

SEQ ID NO: 3498516 - DNA, 23 bp, Homo sapiens
tagaaaaagaacatgcagtttga

SEQ ID NO: 3498517 - DNA, 12 bp, Homo sapiens
tagaaaagttat

SEQ ID NO: 3498518 - DNA, 22 bp, Homo sapiens
tagaaaatttgttattttgcaa

SEQ ID NO: 3498519 - DNA, 23 bp, Homo sapiens
tagaaaatttgttattttgcaac

SEQ ID NO: 3498520 - DNA, 18 bp, Homo sapiens
tagaaagctgacattgcc

SEQ ID NO: 3498521 - DNA, 19 bp, Homo sapiens
tagaaataaaggatgtgat

SEQ ID NO: 3498522 - DNA, 14 bp, Homo sapiens
tagaaatatattta

SEQ ID NO: 3498523 - DNA, 17 bp, Homo sapiens
tagaaatggaaattttg

SEQ ID NO: 3498524 - DNA, 23 bp, Homo sapiens
tagaaatggttgtattagatgtt

SEQ ID NO: 3498525 - DNA, 14 bp, Homo sapiens
tagaaattctttat

SEQ ID NO: 3498526 - DNA, 22 bp, Homo sapiens
tagaacagggaaaataggcagg

SEQ ID NO: 3498527 - DNA, 19 bp, Homo sapiens
tagaactcagttttaacta

SEQ ID NO: 3498528 - DNA, 21 bp, Homo sapiens
tagaacttcatggatcagatc

SEQ ID NO: 3498529 - DNA, 16 bp, Homo sapiens
tagaacttgaccccct

SEQ ID NO: 3498530 - DNA, 19 bp, Homo sapiens
tagaagattgttggtgaat

SEQ ID NO: 3498531 - DNA, 16 bp, Homo sapiens
tagaagtgccatctca

SEQ ID NO: 3498532 - DNA, 15 bp, Homo sapiens
tagaagttttaaatt

SEQ ID NO: 3498533 - DNA, 20 bp, Homo sapiens
tagaataacctttcagaatt

SEQ ID NO: 3498534 - DNA, 17 bp, Homo sapiens
tagaataatcttgctca

SEQ ID NO: 3498535 - DNA, 21 bp, Homo sapiens
tagaatagcctgtggcctttg

SEQ ID NO: 3498536 - DNA, 14 bp, Homo sapiens
tagaatatagcatc

SEQ ID NO: 3498537 - DNA, 12 bp, Homo sapiens
tagaatatttat

SEQ ID NO: 3498538 - DNA, 15 bp, Homo sapiens
tagaatccaaacttg

SEQ ID NO: 3498539 - DNA, 20 bp, Homo sapiens
tagaatgcatctcatcaact

SEQ ID NO: 3498540 - DNA, 19 bp, Homo sapiens
tagaattagctttttcatc

SEQ ID NO: 3498541 - DNA, 20 bp, Homo sapiens
tagaattatttcacaaataa

SEQ ID NO: 3498542 - DNA, 21 bp, Homo sapiens
tagaattccttcgaaaggcct

SEQ ID NO: 3498543 - DNA, 22 bp, Homo sapiens
tagaattccttcgaaaggcctt

SEQ ID NO: 3498544 - DNA, 15 bp, Homo sapiens
tagaattgcattgac

SEQ ID NO: 3498545 - DNA, 23 bp, Homo sapiens
tagaatttattcaattcctctgg

SEQ ID NO: 3498546 - DNA, 19 bp, Homo sapiens
tagacaagccagaacttga

SEQ ID NO: 3498547 - DNA, 22 bp, Homo sapiens
tagacaagtccagcctggcaag

SEQ ID NO: 3498548 - DNA, 19 bp, Homo sapiens
tagacacatatgaggggga

SEQ ID NO: 3498549 - DNA, 21 bp, Homo sapiens
tagactcatggtgtgttacac

SEQ ID NO: 3498550 - DNA, 20 bp, Homo sapiens
tagactcggggtgcttcctt

SEQ ID NO: 3498551 - DNA, 18 bp, Homo sapiens
tagacttaatagaaacat

SEQ ID NO: 3498552 - DNA, 16 bp, Homo sapiens
tagactttaggctttc

SEQ ID NO: 3498553 - DNA, 18 bp, Homo sapiens
tagagaatgtgtttcaaa

SEQ ID NO: 3498554 - DNA, 12 bp, Homo sapiens
tagagaatgttc

SEQ ID NO: 3498555 - DNA, 16 bp, Homo sapiens
tagagaatgttccaga

SEQ ID NO: 3498556 - DNA, 22 bp, Homo sapiens
tagagaatgttccagacattct

SEQ ID NO: 3498557 - DNA, 17 bp, Homo sapiens
tagagacaacaaaaatg

SEQ ID NO: 3498558 - DNA, 11 bp, Homo sapiens
tagagacaggg

SEQ ID NO: 3498559 - DNA, 14 bp, Homo sapiens
tagagactggaaca

SEQ ID NO: 3498560 - DNA, 17 bp, Homo sapiens
tagagattacctcctga

SEQ ID NO: 3498561 - DNA, 19 bp, Homo sapiens
tagagattacctcctgaga

SEQ ID NO: 3498562 - DNA, 21 bp, Homo sapiens
tagagattacctcctgagaaa

SEQ ID NO: 3498563 - DNA, 11 bp, Homo sapiens
tagagcactgc

SEQ ID NO: 3498564 - DNA, 11 bp, Homo sapiens
tagagcaggcg

SEQ ID NO: 3498565 - DNA, 20 bp, Homo sapiens
tagagcaggcgttcagctca

SEQ ID NO: 3498566 - DNA, 21 bp, Homo sapiens
tagagcctcttggggaagggg

SEQ ID NO: 3498567 - DNA, 22 bp, Homo sapiens
tagagcctttgggatcgtcctg

SEQ ID NO: 3498568 - DNA, 18 bp, Homo sapiens
tagaggctgagcaccttt

SEQ ID NO: 3498569 - DNA, 15 bp, Homo sapiens
tagagggacctctcc

SEQ ID NO: 3498570 - DNA, 22 bp, Homo sapiens
tagaggttctgggttttctgaa

SEQ ID NO: 3498571 - DNA, 14 bp, Homo sapiens
tagagtccagatct

SEQ ID NO: 3498572 - DNA, 15 bp, Homo sapiens
tagagttagactgtt

SEQ ID NO: 3498573 - DNA, 16 bp, Homo sapiens
tagagttagactgttg

SEQ ID NO: 3498574 - DNA, 12 bp, Homo sapiens
tagatacaataa

SEQ ID NO: 3498575 - DNA, 17 bp, Homo sapiens
tagatacaataaattgc

SEQ ID NO: 3498576 - DNA, 19 bp, Homo sapiens
tagatacactaaaaatctg

SEQ ID NO: 3498577 - DNA, 16 bp, Homo sapiens
tagatactctcttctt

SEQ ID NO: 3498578 - DNA, 17 bp, Homo sapiens
tagatagttagaacctg

SEQ ID NO: 3498579 - DNA, 23 bp, Homo sapiens
tagatatcgacttgtttttgcac

SEQ ID NO: 3498580 - DNA, 16 bp, Homo sapiens
tagatattttccatat

SEQ ID NO: 3498581 - DNA, 19 bp, Homo sapiens
tagatattttccatatatt

SEQ ID NO: 3498582 - DNA, 23 bp, Homo sapiens
tagatcaaggagcccagaaaacc

SEQ ID NO: 3498583 - DNA, 19 bp, Homo sapiens
tagatctttattatggaaa

SEQ ID NO: 3498584 - DNA, 17 bp, Homo sapiens
tagatgagctgggccgg

SEQ ID NO: 3498585 - DNA, 16 bp, Homo sapiens
tagatgctggcccagg

SEQ ID NO: 3498586 - DNA, 17 bp, Homo sapiens
tagatggaaaaacttgt

SEQ ID NO: 3498587 - DNA, 14 bp, Homo sapiens
tagatggctcctct

SEQ ID NO: 3498588 - DNA, 20 bp, Homo sapiens
tagatgtagataaactcaga

SEQ ID NO: 3498589 - DNA, 22 bp, Homo sapiens
tagatgttctctatcatttaat

SEQ ID NO: 3498590 - DNA, 12 bp, Homo sapiens
tagatgtttcct

SEQ ID NO: 3498591 - DNA, 16 bp, Homo sapiens
tagattaaaaattata

SEQ ID NO: 3498592 - DNA, 18 bp, Homo sapiens
tagcaaaaaaaacccatg

SEQ ID NO: 3498593 - DNA, 14 bp, Homo sapiens
tagcaaaaacatgt

SEQ ID NO: 3498594 - DNA, 22 bp, Homo sapiens
tagcaaaactaaatacttgctc

SEQ ID NO: 3498595 - DNA, 24 bp, Homo sapiens
tagcaagattgcttaaaatagcaa

SEQ ID NO: 3498596 - DNA, 18 bp, Homo sapiens
tagcaagtgaatttttct

SEQ ID NO: 3498597 - DNA, 20 bp, Homo sapiens
tagcactaccactcctgcca

SEQ ID NO: 3498598 - DNA, 19 bp, Homo sapiens
tagcactactaaaagttta

SEQ ID NO: 3498599 - DNA, 11 bp, Homo sapiens
tagcagacagg

SEQ ID NO: 3498600 - DNA, 12 bp, Homo sapiens
tagcagatggtt

SEQ ID NO: 3498601 - DNA, 14 bp, Homo sapiens
tagcagattttaat

SEQ ID NO: 3498602 - DNA, 20 bp, Homo sapiens
tagcagattttaattttgaa

SEQ ID NO: 3498603 - DNA, 19 bp, Homo sapiens
tagcagcaccgttctgtgc

SEQ ID NO: 3498604 - DNA, 20 bp, Homo sapiens
tagcagcaccgttctgtgca

SEQ ID NO: 3498605 - DNA, 15 bp, Homo sapiens
tagcaggcacaggac

SEQ ID NO: 3498606 - DNA, 22 bp, Homo sapiens
tagcagggggggaaatgcattt

SEQ ID NO: 3498607 - DNA, 23 bp, Homo sapiens
tagcagggggggaaatgcattta

SEQ ID NO: 3498608 - DNA, 19 bp, Homo sapiens
tagcagtgtacccacgctg

SEQ ID NO: 3498609 - DNA, 18 bp, Homo sapiens
tagcatctgcattgccca

SEQ ID NO: 3498610 - DNA, 12 bp, Homo sapiens
tagcatctttca

SEQ ID NO: 3498611 - DNA, 13 bp, Homo sapiens
tagcatctttcat

SEQ ID NO: 3498612 - DNA, 20 bp, Homo sapiens
tagcatctttcatatggtag

SEQ ID NO: 3498613 - DNA, 16 bp, Homo sapiens
tagcattttgctaaat

SEQ ID NO: 3498614 - DNA, 22 bp, Homo sapiens
tagcattttgctaaatgtgaat

SEQ ID NO: 3498615 - DNA, 20 bp, Homo sapiens
tagccaaatggtttaacttc

SEQ ID NO: 3498616 - DNA, 15 bp, Homo sapiens
tagccacaccaggat

SEQ ID NO: 3498617 - DNA, 15 bp, Homo sapiens
tagccagaatctcat

SEQ ID NO: 3498618 - DNA, 18 bp, Homo sapiens
tagccagaatctcattac

SEQ ID NO: 3498619 - DNA, 15 bp, Homo sapiens
tagccagctgctccc

SEQ ID NO: 3498620 - DNA, 19 bp, Homo sapiens
tagccaggagcgcatctca

SEQ ID NO: 3498621 - DNA, 20 bp, Homo sapiens
tagccatttttcaaagcaat

SEQ ID NO: 3498622 - DNA, 14 bp, Homo sapiens
tagcccagtgtttt

SEQ ID NO: 3498623 - DNA, 17 bp, Homo sapiens
tagccccctggcctctg

SEQ ID NO: 3498624 - DNA, 16 bp, Homo sapiens
tagccctcacattaga

SEQ ID NO: 3498625 - DNA, 21 bp, Homo sapiens
tagccgatatcagaatttgtg

SEQ ID NO: 3498626 - DNA, 20 bp, Homo sapiens
tagcctcagatgatttcccc

SEQ ID NO: 3498627 - DNA, 15 bp, Homo sapiens
tagcctgagtagaaa

SEQ ID NO: 3498628 - DNA, 14 bp, Homo sapiens
tagcctggggtggg

SEQ ID NO: 3498629 - DNA, 13 bp, Homo sapiens
tagcctgtggcct

SEQ ID NO: 3498630 - DNA, 13 bp, Homo sapiens
tagcgctgttttt

SEQ ID NO: 3498631 - DNA, 18 bp, Homo sapiens
tagctaaacggattccaa

SEQ ID NO: 3498632 - DNA, 23 bp, Homo sapiens
tagctaccttctctacccatctc

SEQ ID NO: 3498633 - DNA, 13 bp, Homo sapiens
tatttttaatcag

SEQ ID NO: 3498634 - DNA, 21 bp, Homo sapiens
tatttttatactcttcctatt

SEQ ID NO: 3498635 - DNA, 14 bp, Homo sapiens
tatttttctcatga

SEQ ID NO: 3498636 - DNA, 15 bp, Homo sapiens
tatttttctctcctg

SEQ ID NO: 3498637 - DNA, 23 bp, Homo sapiens
tatttttgtagtgacctgtttat

SEQ ID NO: 3498638 - DNA, 13 bp, Homo sapiens
tatttttttgcaa

SEQ ID NO: 3498639 - DNA, 13 bp, Homo sapiens
tatttttttttgg

SEQ ID NO: 3498640 - DNA, 14 bp, Homo sapiens
tcaaaaaaagaaaa

SEQ ID NO: 3498641 - DNA, 12 bp, Homo sapiens
tcaaaaagtatt

SEQ ID NO: 3498642 - DNA, 18 bp, Homo sapiens
tcaaaaccagtgaacttt

SEQ ID NO: 3498643 - DNA, 24 bp, Homo sapiens
tcaaaactggagtcccaaatgtca

SEQ ID NO: 3498644 - DNA, 16 bp, Homo sapiens
tcaaaagataatattt

SEQ ID NO: 3498645 - DNA, 16 bp, Homo sapiens
tcaaaagctgggcagg

SEQ ID NO: 3498646 - DNA, 13 bp, Homo sapiens
tcaaaataaaaac

SEQ ID NO: 3498647 - DNA, 19 bp, Homo sapiens
tcaaaatagaaaagttatt

SEQ ID NO: 3498648 - DNA, 12 bp, Homo sapiens
tcaaaatattta

SEQ ID NO: 3498649 - DNA, 13 bp, Homo sapiens
tcaaaatatttaa

SEQ ID NO: 3498650 - DNA, 19 bp, Homo sapiens
tcaaaatatttaaaaatgt

SEQ ID NO: 3498651 - DNA, 21 bp, Homo sapiens
tcaaaatatttaaaaatgtct

SEQ ID NO: 3498652 - DNA, 12 bp, Homo sapiens
tcaaaatctttc

SEQ ID NO: 3498653 - DNA, 17 bp, Homo sapiens
tcaaaatgctttttatt

SEQ ID NO: 3498654 - DNA, 17 bp, Homo sapiens
tcaaaattctaaatgta

SEQ ID NO: 3498655 - DNA, 13 bp, Homo sapiens
tcaaaatttgctg

SEQ ID NO: 3498656 - DNA, 19 bp, Homo sapiens
tcaaacaaactctctgaac

SEQ ID NO: 3498657 - DNA, 13 bp, Homo sapiens
tcaaactgctcca

SEQ ID NO: 3498658 - DNA, 15 bp, Homo sapiens
tcaaactgctccaag

SEQ ID NO: 3498659 - DNA, 20 bp, Homo sapiens
tcaaacttctggctccctct

SEQ ID NO: 3498660 - DNA, 21 bp, Homo sapiens
tcaaagaagtcatggcccaaa

SEQ ID NO: 3498661 - DNA, 15 bp, Homo sapiens
tcaaagcaaggaaac

SEQ ID NO: 3498662 - DNA, 12 bp, Homo sapiens
tcaaagcaattg

SEQ ID NO: 3498663 - DNA, 15 bp, Homo sapiens
tcaaagccacactct

SEQ ID NO: 3498664 - DNA, 19 bp, Homo sapiens
tcaaaggcacagtgaaggc

SEQ ID NO: 3498665 - DNA, 19 bp, Homo sapiens
tcaaagtaaaacttgctgc

SEQ ID NO: 3498666 - DNA, 14 bp, Homo sapiens
tcaaatctgggctc

SEQ ID NO: 3498667 - DNA, 20 bp, Homo sapiens
tcaaatgcagtatatttctt

SEQ ID NO: 3498668 - DNA, 19 bp, Homo sapiens
tcaaatgctcagaccagct

SEQ ID NO: 3498669 - DNA, 21 bp, Homo sapiens
tcaaatgctcagaccagctct

SEQ ID NO: 3498670 - DNA, 17 bp, Homo sapiens
tcaacaacaccagaact

SEQ ID NO: 3498671 - DNA, 22 bp, Homo sapiens
tcaacaccttaatatgctgcaa

SEQ ID NO: 3498672 - DNA, 18 bp, Homo sapiens
tcaacagtgaagacagaa

SEQ ID NO: 3498673 - DNA, 17 bp, Homo sapiens
tcaacagttcaaagaag

SEQ ID NO: 3498674 - DNA, 20 bp, Homo sapiens
tcaacagttttcctatgctt

SEQ ID NO: 3498675 - DNA, 22 bp, Homo sapiens
tcaacagttttcctatgctttg

SEQ ID NO: 3498676 - DNA, 15 bp, Homo sapiens
tcaaccataaaagaa

SEQ ID NO: 3498677 - DNA, 17 bp, Homo sapiens
tcaaccataaaagaagt

SEQ ID NO: 3498678 - DNA, 22 bp, Homo sapiens
tcaaccccaccatatgaattgt

SEQ ID NO: 3498679 - DNA, 23 bp, Homo sapiens
tcaaccccttcgctcctgtgtct

SEQ ID NO: 3498680 - DNA, 16 bp, Homo sapiens
tcaacctaagcaacag

SEQ ID NO: 3498681 - DNA, 19 bp, Homo sapiens
tcaacctaagcaacagaaa

SEQ ID NO: 3498682 - DNA, 15 bp, Homo sapiens
tcaacctcctgggct

SEQ ID NO: 3498683 - DNA, 16 bp, Homo sapiens
tcaacctcctgggcta

SEQ ID NO: 3498684 - DNA, 13 bp, Homo sapiens
tcaaccttggcct

SEQ ID NO: 3498685 - DNA, 16 bp, Homo sapiens
tcaaccttggccttct

SEQ ID NO: 3498686 - DNA, 14 bp, Homo sapiens
tcaacgttgtactg

SEQ ID NO: 3498687 - DNA, 20 bp, Homo sapiens
tcaacgttgtactgtatgtg

SEQ ID NO: 3498688 - DNA, 19 bp, Homo sapiens
tcaactaaaaaaaaaaaag

SEQ ID NO: 3498689 - DNA, 21 bp, Homo sapiens
tcaactagtggggtttcctgg

SEQ ID NO: 3498690 - DNA, 14 bp, Homo sapiens
tcaactcctcccat

SEQ ID NO: 3498691 - DNA, 19 bp, Homo sapiens
tcaactcctcgacatcact

SEQ ID NO: 3498692 - DNA, 19 bp, Homo sapiens
tcaactgccaaaatgctct

SEQ ID NO: 3498693 - DNA, 15 bp, Homo sapiens
tcaacttaaaagtca

SEQ ID NO: 3498694 - DNA, 15 bp, Homo sapiens
tcaacttaataagat

SEQ ID NO: 3498695 - DNA, 12 bp, Homo sapiens
tcaactttgaat

SEQ ID NO: 3498696 - DNA, 19 bp, Homo sapiens
tcaactttggttcctgtga

SEQ ID NO: 3498697 - DNA, 20 bp, Homo sapiens
tcaactttttattgccttct

SEQ ID NO: 3498698 - DNA, 21 bp, Homo sapiens
tcaactttttattgccttctc

SEQ ID NO: 3498699 - DNA, 23 bp, Homo sapiens
tcaactttttattgccttctcac

SEQ ID NO: 3498700 - DNA, 18 bp, Homo sapiens
tcaagaagaaaaaggttt

SEQ ID NO: 3498701 - DNA, 21 bp, Homo sapiens
tcaagatactgctactgtaat

SEQ ID NO: 3498702 - DNA, 15 bp, Homo sapiens
tcaagatgacagctc

SEQ ID NO: 3498703 - DNA, 20 bp, Homo sapiens
tcaagcaatcctctcacctc

SEQ ID NO: 3498704 - DNA, 17 bp, Homo sapiens
tcaagcagtcgtgcctg

SEQ ID NO: 3498705 - DNA, 20 bp, Homo sapiens
tcaagcagtcgtgcctgtgt

SEQ ID NO: 3498706 - DNA, 15 bp, Homo sapiens
tcaagccaagcagcc

SEQ ID NO: 3498707 - DNA, 17 bp, Homo sapiens
tcaagccaagcagccaa

SEQ ID NO: 3498708 - DNA, 15 bp, Homo sapiens
tcaagcctgtgcaaa

SEQ ID NO: 3498709 - DNA, 16 bp, Homo sapiens
tcaagccttccaggga

SEQ ID NO: 3498710 - DNA, 15 bp, Homo sapiens
tcaagcgattctcct

SEQ ID NO: 3498711 - DNA, 17 bp, Homo sapiens
tcaagcgattcttctgc

SEQ ID NO: 3498712 - DNA, 21 bp, Homo sapiens
tcaagcgattcttctgcttca

SEQ ID NO: 3498713 - DNA, 20 bp, Homo sapiens
tcaagctcctcctccctgca

SEQ ID NO: 3498714 - DNA, 14 bp, Homo sapiens
tcaagctgctctga

SEQ ID NO: 3498715 - DNA, 19 bp, Homo sapiens
tcaagctgttgaagtctca

SEQ ID NO: 3498716 - DNA, 16 bp, Homo sapiens
tcaaggatgtttttct

SEQ ID NO: 3498717 - DNA, 10 bp, Homo sapiens
tcaaggcctt

SEQ ID NO: 3498718 - DNA, 16 bp, Homo sapiens
tcaaggccttcagttt

SEQ ID NO: 3498719 - DNA, 14 bp, Homo sapiens
tcaaggcttcagtc

SEQ ID NO: 3498720 - DNA, 18 bp, Homo sapiens
tcaagtcctttgtgaata

SEQ ID NO: 3498721 - DNA, 19 bp, Homo sapiens
tcaagtcctttgtgaatat

SEQ ID NO: 3498722 - DNA, 19 bp, Homo sapiens
tcaagtctctgctggccca

SEQ ID NO: 3498723 - DNA, 22 bp, Homo sapiens
tcaagtgattctcctgcctcag

SEQ ID NO: 3498724 - DNA, 18 bp, Homo sapiens
tcaagtttactccttctg

SEQ ID NO: 3498725 - DNA, 18 bp, Homo sapiens
tcaataaagcactgagca

SEQ ID NO: 3498726 - DNA, 14 bp, Homo sapiens
tcaataaagtattt

SEQ ID NO: 3498727 - DNA, 18 bp, Homo sapiens
tcaatacagtacaggcag

SEQ ID NO: 3498728 - DNA, 19 bp, Homo sapiens
tcaatacagtacaggcagc

SEQ ID NO: 3498729 - DNA, 14 bp, Homo sapiens
tcaatatcctttgc

SEQ ID NO: 3498730 - DNA, 16 bp, Homo sapiens
tcaatatcctttgcct

SEQ ID NO: 3498731 - DNA, 13 bp, Homo sapiens
tcaatattggtgt

SEQ ID NO: 3498732 - DNA, 18 bp, Homo sapiens
tcaatccagatggtggga

SEQ ID NO: 3498733 - DNA, 23 bp, Homo sapiens
tcaatgaaatatgtgaagcccag

SEQ ID NO: 3498734 - DNA, 21 bp, Homo sapiens
tcaatgaagccagctcacagt

SEQ ID NO: 3498735 - DNA, 14 bp, Homo sapiens
tcaatgcactgaca

SEQ ID NO: 3498736 - DNA, 12 bp, Homo sapiens
tcaatgctcata

SEQ ID NO: 3498737 - DNA, 23 bp, Homo sapiens
tcaattctgtaggttaaaaaaat

SEQ ID NO: 3498738 - DNA, 18 bp, Homo sapiens
tcaattgcatctcccaga

SEQ ID NO: 3498739 - DNA, 22 bp, Homo sapiens
tcaattgcatctcccagataat

SEQ ID NO: 3498740 - DNA, 18 bp, Homo sapiens
tcaattgtaaattgaatc

SEQ ID NO: 3498741 - DNA, 15 bp, Homo sapiens
tcaatttctgtgttg

SEQ ID NO: 3498742 - DNA, 13 bp, Homo sapiens
tcaattttgactt

SEQ ID NO: 3498743 - DNA, 16 bp, Homo sapiens
tcacaaaacagccttt

SEQ ID NO: 3498744 - DNA, 15 bp, Homo sapiens
tcacaaacttttata

SEQ ID NO: 3498745 - DNA, 20 bp, Homo sapiens
tcacaaatcctaaaagaagc

SEQ ID NO: 3498746 - DNA, 14 bp, Homo sapiens
tcacaacctgaacc

SEQ ID NO: 3498747 - DNA, 19 bp, Homo sapiens
tcacaacctgaacctagga

SEQ ID NO: 3498748 - DNA, 17 bp, Homo sapiens
tcacaagcacaaagctc

SEQ ID NO: 3498749 - DNA, 16 bp, Homo sapiens
tcacaagtgaaaaaca

SEQ ID NO: 3498750 - DNA, 22 bp, Homo sapiens
tcacaagtgaaaaacatccaga

SEQ ID NO: 3498751 - DNA, 20 bp, Homo sapiens
tcacaagttgtgtttgatat

SEQ ID NO: 3498752 - DNA, 13 bp, Homo sapiens
tcacacacccctc

SEQ ID NO: 3498753 - DNA, 14 bp, Homo sapiens
tcacacacccctca

SEQ ID NO: 3498754 - DNA, 12 bp, Homo sapiens
tcacacacctgt

SEQ ID NO: 3498755 - DNA, 12 bp, Homo sapiens
tcacacactgat

SEQ ID NO: 3498756 - DNA, 21 bp, Homo sapiens
tcacacagtattacttctgct

SEQ ID NO: 3498757 - DNA, 22 bp, Homo sapiens
tcacacagtgagtcgaggacag

SEQ ID NO: 3498758 - DNA, 23 bp, Homo sapiens
tcacacagtgagtcgaggacagg

SEQ ID NO: 3498759 - DNA, 21 bp, Homo sapiens
tcacaccaggcttgcctgcag

SEQ ID NO: 3498760 - DNA, 22 bp, Homo sapiens
tcacaccaggcttgcctgcagg

SEQ ID NO: 3498761 - DNA, 23 bp, Homo sapiens
tcacaccaggcttgcctgcaggc

SEQ ID NO: 3498762 - DNA, 11 bp, Homo sapiens
tcacactgaga

SEQ ID NO: 3498763 - DNA, 20 bp, Homo sapiens
tcacactgagaatgtaagaa

SEQ ID NO: 3498764 - DNA, 23 bp, Homo sapiens
tcacactgagaatgtaagaacta

SEQ ID NO: 3498765 - DNA, 11 bp, Homo sapiens
tccaatacctc

SEQ ID NO: 3498766 - DNA, 20 bp, Homo sapiens
tccaatcagagaccaggccc

SEQ ID NO: 3498767 - DNA, 22 bp, Homo sapiens
tccaattataagaggatatgaa

SEQ ID NO: 3498768 - DNA, 19 bp, Homo sapiens
tccaattccttgcacatag

SEQ ID NO: 3498769 - DNA, 11 bp, Homo sapiens
tccaattctat

SEQ ID NO: 3498770 - DNA, 23 bp, Homo sapiens
tccaattttaatttagtaaatgt

SEQ ID NO: 3498771 - DNA, 20 bp, Homo sapiens
tccacaaaataaccaatcct

SEQ ID NO: 3498772 - DNA, 14 bp, Homo sapiens
tccacaaagaaaat

SEQ ID NO: 3498773 - DNA, 15 bp, Homo sapiens
tccacaccttttatt

SEQ ID NO: 3498774 - DNA, 20 bp, Homo sapiens
tccacagcaaccccaggctg

SEQ ID NO: 3498775 - DNA, 23 bp, Homo sapiens
tccacagcttcccctctctcctc

SEQ ID NO: 3498776 - DNA, 13 bp, Homo sapiens
tccacagcttcct

SEQ ID NO: 3498777 - DNA, 15 bp, Homo sapiens
tccacagcttcctgt

SEQ ID NO: 3498778 - DNA, 19 bp, Homo sapiens
tccacagtcctgaagcagc

SEQ ID NO: 3498779 - DNA, 12 bp, Homo sapiens
tccacatcctcc

SEQ ID NO: 3498780 - DNA, 15 bp, Homo sapiens
tccacatgggagccg

SEQ ID NO: 3498781 - DNA, 17 bp, Homo sapiens
tccacccacctcagcct

SEQ ID NO: 3498782 - DNA, 15 bp, Homo sapiens
tccacccaggagccc

SEQ ID NO: 3498783 - DNA, 13 bp, Homo sapiens
tccaccctgctct

SEQ ID NO: 3498784 - DNA, 21 bp, Homo sapiens
tccaccctgctctccgaccag

SEQ ID NO: 3498785 - DNA, 22 bp, Homo sapiens
tccaccctggccgagtccaagc

SEQ ID NO: 3498786 - DNA, 17 bp, Homo sapiens
tccacgactgtctccat

SEQ ID NO: 3498787 - DNA, 19 bp, Homo sapiens
tccacgactgtctccatgg

SEQ ID NO: 3498788 - DNA, 14 bp, Homo sapiens
tccacggagccact

SEQ ID NO: 3498789 - DNA, 22 bp, Homo sapiens
tccacggagccactcctctgac

SEQ ID NO: 3498790 - DNA, 18 bp, Homo sapiens
tccacgtattccccttcc

SEQ ID NO: 3498791 - DNA, 20 bp, Homo sapiens
tccacgtattccccttccca

SEQ ID NO: 3498792 - DNA, 14 bp, Homo sapiens
tccacgtgtgtgtg

SEQ ID NO: 3498793 - DNA, 20 bp, Homo sapiens
tccacgttctgctcatcatt

SEQ ID NO: 3498794 - DNA, 15 bp, Homo sapiens
tccactagtgcaaat

SEQ ID NO: 3498795 - DNA, 15 bp, Homo sapiens
tccactattttcaaa

SEQ ID NO: 3498796 - DNA, 15 bp, Homo sapiens
tccactccattgtcg

SEQ ID NO: 3498797 - DNA, 19 bp, Homo sapiens
tccactcccaggcagccct

SEQ ID NO: 3498798 - DNA, 18 bp, Homo sapiens
tccactctcccccacccc

SEQ ID NO: 3498799 - DNA, 15 bp, Homo sapiens
tccactctgcttctc

SEQ ID NO: 3498800 - DNA, 14 bp, Homo sapiens
tccactgctctcag

SEQ ID NO: 3498801 - DNA, 20 bp, Homo sapiens
tccactgctctcagcctccc

SEQ ID NO: 3498802 - DNA, 21 bp, Homo sapiens
tccactgtgccatgtgccagg

SEQ ID NO: 3498803 - DNA, 22 bp, Homo sapiens
tccactgtgccatgtgccaggt

SEQ ID NO: 3498804 - DNA, 17 bp, Homo sapiens
tccacttgtttgcactg

SEQ ID NO: 3498805 - DNA, 22 bp, Homo sapiens
tccactttgtttcgtggggagg

SEQ ID NO: 3498806 - DNA, 18 bp, Homo sapiens
tccagaatgctgtacatc

SEQ ID NO: 3498807 - DNA, 22 bp, Homo sapiens
tccagaattcattccccagctc

SEQ ID NO: 3498808 - DNA, 13 bp, Homo sapiens
tccagacactttt

SEQ ID NO: 3498809 - DNA, 22 bp, Homo sapiens
tccagaccctgaagatttcaga

SEQ ID NO: 3498810 - DNA, 11 bp, Homo sapiens
tccagacctga

SEQ ID NO: 3498811 - DNA, 16 bp, Homo sapiens
tccagatcccaggccc

SEQ ID NO: 3498812 - DNA, 19 bp, Homo sapiens
tccagatcccaggcccctg

SEQ ID NO: 3498813 - DNA, 15 bp, Homo sapiens
tccagatgcagggca

SEQ ID NO: 3498814 - DNA, 16 bp, Homo sapiens
tccagatgcagggcag

SEQ ID NO: 3498815 - DNA, 17 bp, Homo sapiens
tccagatgcagggcagt

SEQ ID NO: 3498816 - DNA, 14 bp, Homo sapiens
tccagatggtggga

SEQ ID NO: 3498817 - DNA, 19 bp, Homo sapiens
tccagatgtttccagactt

SEQ ID NO: 3498818 - DNA, 19 bp, Homo sapiens
tccagattatctatttgtg

SEQ ID NO: 3498819 - DNA, 20 bp, Homo sapiens
tccagcagtcacttcggcca

SEQ ID NO: 3498820 - DNA, 20 bp, Homo sapiens
tccagcagtctctgccttgc

SEQ ID NO: 3498821 - DNA, 14 bp, Homo sapiens
tccagcagttttca

SEQ ID NO: 3498822 - DNA, 18 bp, Homo sapiens
tccagccaaacgggagct

SEQ ID NO: 3498823 - DNA, 23 bp, Homo sapiens
tccagccaaacgggagcttttgg

SEQ ID NO: 3498824 - DNA, 14 bp, Homo sapiens
tccagccagctcct

SEQ ID NO: 3498825 - DNA, 13 bp, Homo sapiens
tccagccagggct

SEQ ID NO: 3498826 - DNA, 14 bp, Homo sapiens
tccagcccctctgg

SEQ ID NO: 3498827 - DNA, 15 bp, Homo sapiens
tccagcccctctggt

SEQ ID NO: 3498828 - DNA, 11 bp, Homo sapiens
tccagcctggg

SEQ ID NO: 3498829 - DNA, 17 bp, Homo sapiens
tccagcctggggtctgg

SEQ ID NO: 3498830 - DNA, 24 bp, Homo sapiens
tccagcctgggtgacagagcaagt

SEQ ID NO: 3498831 - DNA, 13 bp, Homo sapiens
tccagctaattca

SEQ ID NO: 3498832 - DNA, 14 bp, Homo sapiens
tccagctcaccagc

SEQ ID NO: 3498833 - DNA, 15 bp, Homo sapiens
tccagctcaccagcc

SEQ ID NO: 3498834 - DNA, 16 bp, Homo sapiens
tccagctcaccagccc

SEQ ID NO: 3498835 - DNA, 17 bp, Homo sapiens
tccagctcaccagcccc

SEQ ID NO: 3498836 - DNA, 12 bp, Homo sapiens
tccagctccaac

SEQ ID NO: 3498837 - DNA, 19 bp, Homo sapiens
tccagctccaacctgcaaa

SEQ ID NO: 3498838 - DNA, 12 bp, Homo sapiens
tccagctctgga

SEQ ID NO: 3498839 - DNA, 20 bp, Homo sapiens
tccagctctggaggggaggg

SEQ ID NO: 3498840 - DNA, 16 bp, Homo sapiens
tccagctgagcgccag

SEQ ID NO: 3498841 - DNA, 21 bp, Homo sapiens
tccagctgggctagaggctga

SEQ ID NO: 3498842 - DNA, 23 bp, Homo sapiens
tccaggagcttcttgtttccttg

SEQ ID NO: 3498843 - DNA, 16 bp, Homo sapiens
tccaggcactgagata

SEQ ID NO: 3498844 - DNA, 16 bp, Homo sapiens
tccaggcagatccagg

SEQ ID NO: 3498845 - DNA, 17 bp, Homo sapiens
tccaggcagatccagga

SEQ ID NO: 3498846 - DNA, 18 bp, Homo sapiens
tccaggcagatccaggac

SEQ ID NO: 3498847 - DNA, 11 bp, Homo sapiens
tccaggcccaa

SEQ ID NO: 3498848 - DNA, 15 bp, Homo sapiens
tccaggcccaaggct

SEQ ID NO: 3498849 - DNA, 18 bp, Homo sapiens
tccaggcccaaggctccc

SEQ ID NO: 3498850 - DNA, 17 bp, Homo sapiens
tccagggcccccatctc

SEQ ID NO: 3498851 - DNA, 22 bp, Homo sapiens
tccagggctggactgaggcctg

SEQ ID NO: 3498852 - DNA, 14 bp, Homo sapiens
tccaggggtcctag

SEQ ID NO: 3498853 - DNA, 16 bp, Homo sapiens
tccagggtccctctgt

SEQ ID NO: 3498854 - DNA, 23 bp, Homo sapiens
tccaggtaccttgacctttgtac

SEQ ID NO: 3498855 - DNA, 13 bp, Homo sapiens
tccagtactattt

SEQ ID NO: 3498856 - DNA, 18 bp, Homo sapiens
tccagtccccagaagcag

SEQ ID NO: 3498857 - DNA, 12 bp, Homo sapiens
tccagtcctgcc

SEQ ID NO: 3498858 - DNA, 15 bp, Homo sapiens
tccagtcctgccacc

SEQ ID NO: 3498859 - DNA, 16 bp, Homo sapiens
tccagtctccaccagg

SEQ ID NO: 3498860 - DNA, 12 bp, Homo sapiens
tccagtgagccg

SEQ ID NO: 3498861 - DNA, 19 bp, Homo sapiens
tccagtgccaacaatccta

SEQ ID NO: 3498862 - DNA, 11 bp, Homo sapiens
tccagtgccta

SEQ ID NO: 3498863 - DNA, 17 bp, Homo sapiens
tccagtggaggtttgtc

SEQ ID NO: 3498864 - DNA, 21 bp, Homo sapiens
tccagtgtccttagaacattt

SEQ ID NO: 3498865 - DNA, 16 bp, Homo sapiens
tccagtgtctcggagg

SEQ ID NO: 3498866 - DNA, 16 bp, Homo sapiens
tccagtgtgcacccct

SEQ ID NO: 3498867 - DNA, 22 bp, Homo sapiens
tccagtgtgcacccctccccat

SEQ ID NO: 3498868 - DNA, 22 bp, Homo sapiens
tccagttaaaaaaaattttaat

SEQ ID NO: 3498869 - DNA, 22 bp, Homo sapiens
tccataaagacaatcactgcca

SEQ ID NO: 3498870 - DNA, 21 bp, Homo sapiens
tccataatgatggatttaaca

SEQ ID NO: 3498871 - DNA, 15 bp, Homo sapiens
tccatagctgctgcc

SEQ ID NO: 3498872 - DNA, 12 bp, Homo sapiens
tccatatattgg

SEQ ID NO: 3498873 - DNA, 16 bp, Homo sapiens
tccatatattggcact

SEQ ID NO: 3498874 - DNA, 23 bp, Homo sapiens
tccatcctcatctctcttgggcc

SEQ ID NO: 3498875 - DNA, 14 bp, Homo sapiens
tccatctctcatcc

SEQ ID NO: 3498876 - DNA, 18 bp, Homo sapiens
tccatctctcatcctcca

SEQ ID NO: 3498877 - DNA, 14 bp, Homo sapiens
tccatctctgactt

SEQ ID NO: 3498878 - DNA, 12 bp, Homo sapiens
tccatgattcta

SEQ ID NO: 3498879 - DNA, 21 bp, Homo sapiens
tccatgccttaaacctacctc

SEQ ID NO: 3498880 - DNA, 15 bp, Homo sapiens
tccatgcgctcaggg

SEQ ID NO: 3498881 - DNA, 17 bp, Homo sapiens
tccatgggaaagatggt

SEQ ID NO: 3498882 - DNA, 17 bp, Homo sapiens
tccatgggcagagccca

SEQ ID NO: 3498883 - DNA, 18 bp, Homo sapiens
tccatgggcagagcccaa

SEQ ID NO: 3498884 - DNA, 16 bp, Homo sapiens
tccatgtcccctccca

SEQ ID NO: 3498885 - DNA, 17 bp, Homo sapiens
tccattatccattccca

SEQ ID NO: 3498886 - DNA, 21 bp, Homo sapiens
tccattcccaagatgcctgat

SEQ ID NO: 3498887 - DNA, 14 bp, Homo sapiens
tccattctttctga

SEQ ID NO: 3498888 - DNA, 22 bp, Homo sapiens
tccatttatatatctaagttca

SEQ ID NO: 3498889 - DNA, 20 bp, Homo sapiens
tccatttccagttcatctat

SEQ ID NO: 3498890 - DNA, 15 bp, Homo sapiens
tcccaaaattaggga

SEQ ID NO: 3498891 - DNA, 23 bp, Homo sapiens
tcccaaacccagtctcctctcca

SEQ ID NO: 3498892 - DNA, 21 bp, Homo sapiens
tcccaaacgcctcccctgccc

SEQ ID NO: 3498893 - DNA, 23 bp, Homo sapiens
tcccaaagtgctgggattacaga

SEQ ID NO: 3498894 - DNA, 19 bp, Homo sapiens
tcccaaccccagctactct

SEQ ID NO: 3498895 - DNA, 17 bp, Homo sapiens
tcccaactctagctggg

SEQ ID NO: 3498896 - DNA, 14 bp, Homo sapiens
tcccaagatgcctg

SEQ ID NO: 3498897 - DNA, 15 bp, Homo sapiens
tcccaagatgcctga

SEQ ID NO: 3498898 - DNA, 12 bp, Homo sapiens
tccttttgtaga

SEQ ID NO: 3498899 - DNA, 22 bp, Homo sapiens
tccttttttcccataagacaat

SEQ ID NO: 3498900 - DNA, 21 bp, Homo sapiens
tcctttttttccatctttaca

SEQ ID NO: 3498901 - DNA, 18 bp, Homo sapiens
tcgaaacacagaaacctt

SEQ ID NO: 3498902 - DNA, 15 bp, Homo sapiens
tcgaaccgttttgaa

SEQ ID NO: 3498903 - DNA, 18 bp, Homo sapiens
tcgaaccgttttgaagct

SEQ ID NO: 3498904 - DNA, 20 bp, Homo sapiens
tcgaagggtttttagagaat

SEQ ID NO: 3498905 - DNA, 17 bp, Homo sapiens
tcgacttcgggctggcc

SEQ ID NO: 3498906 - DNA, 17 bp, Homo sapiens
tcgagaccagcctggcc

SEQ ID NO: 3498907 - DNA, 19 bp, Homo sapiens
tcgagagctggccaaagag

SEQ ID NO: 3498908 - DNA, 13 bp, Homo sapiens
tcgagatggagct

SEQ ID NO: 3498909 - DNA, 14 bp, Homo sapiens
tcgagatggagcta

SEQ ID NO: 3498910 - DNA, 13 bp, Homo sapiens
tcgaggacaggga

SEQ ID NO: 3498911 - DNA, 17 bp, Homo sapiens
tcgaggacagggaggtg

SEQ ID NO: 3498912 - DNA, 14 bp, Homo sapiens
tcgaggtgccttct

SEQ ID NO: 3498913 - DNA, 17 bp, Homo sapiens
tcgaggtgccttcttca

SEQ ID NO: 3498914 - DNA, 20 bp, Homo sapiens
tcgaggtgccttcttcaggg

SEQ ID NO: 3498915 - DNA, 13 bp, Homo sapiens
tcgagtactgtgg

SEQ ID NO: 3498916 - DNA, 20 bp, Homo sapiens
tcgagtactgtgggcaattt

SEQ ID NO: 3498917 - DNA, 19 bp, Homo sapiens
tcgatactgcgactttctg

SEQ ID NO: 3498918 - DNA, 20 bp, Homo sapiens
tcgatactgcgactttctgc

SEQ ID NO: 3498919 - DNA, 16 bp, Homo sapiens
tcgattcaaactgctc

SEQ ID NO: 3498920 - DNA, 17 bp, Homo sapiens
tcgcaccattctgactc

SEQ ID NO: 3498921 - DNA, 19 bp, Homo sapiens
tcgcagagcttttcagatt

SEQ ID NO: 3498922 - DNA, 11 bp, Homo sapiens
tcgcagcctga

SEQ ID NO: 3498923 - DNA, 12 bp, Homo sapiens
tcgcatttccta

SEQ ID NO: 3498924 - DNA, 16 bp, Homo sapiens
tcgccaaggcctagga

SEQ ID NO: 3498925 - DNA, 19 bp, Homo sapiens
tcgcccttacttcttgccc

SEQ ID NO: 3498926 - DNA, 13 bp, Homo sapiens
tcgcctggagccc

SEQ ID NO: 3498927 - DNA, 14 bp, Homo sapiens
tcgcctggagccct

SEQ ID NO: 3498928 - DNA, 23 bp, Homo sapiens
tcgcctttcccaggtgctacacc

SEQ ID NO: 3498929 - DNA, 13 bp, Homo sapiens
tcgcctttcctct

SEQ ID NO: 3498930 - DNA, 15 bp, Homo sapiens
tcgcgctctgctcag

SEQ ID NO: 3498931 - DNA, 18 bp, Homo sapiens
tcgctcaatcaagaaaat

SEQ ID NO: 3498932 - DNA, 20 bp, Homo sapiens
tcgctcccgccagcagcata

SEQ ID NO: 3498933 - DNA, 13 bp, Homo sapiens
tcgctccctccca

SEQ ID NO: 3498934 - DNA, 14 bp, Homo sapiens
tcgctcctgcccac

SEQ ID NO: 3498935 - DNA, 14 bp, Homo sapiens
tcgctcctgtgtct

SEQ ID NO: 3498936 - DNA, 19 bp, Homo sapiens
tcgctctgttacccagggt

SEQ ID NO: 3498937 - DNA, 17 bp, Homo sapiens
tcgctgtcctttctaga

SEQ ID NO: 3498938 - DNA, 21 bp, Homo sapiens
tcgcttcttgcctctgtgctg

SEQ ID NO: 3498939 - DNA, 18 bp, Homo sapiens
tcggaactgcatgctgct

SEQ ID NO: 3498940 - DNA, 19 bp, Homo sapiens
tcggacaagacccccagca

SEQ ID NO: 3498941 - DNA, 20 bp, Homo sapiens
tcggatctggggctctggga

SEQ ID NO: 3498942 - DNA, 16 bp, Homo sapiens
tcggatttggggtgga

SEQ ID NO: 3498943 - DNA, 22 bp, Homo sapiens
tcggcctagggcccccacagtt

SEQ ID NO: 3498944 - DNA, 15 bp, Homo sapiens
tcggctgaccatgct

SEQ ID NO: 3498945 - DNA, 17 bp, Homo sapiens
tcggcttggatcctggg

SEQ ID NO: 3498946 - DNA, 17 bp, Homo sapiens
tcggcttttctcagctg

SEQ ID NO: 3498947 - DNA, 11 bp, Homo sapiens
tcgggaccagg

SEQ ID NO: 3498948 - DNA, 21 bp, Homo sapiens
tcgggagacagcatcagggtt

SEQ ID NO: 3498949 - DNA, 14 bp, Homo sapiens
tcgggaggctgagg

SEQ ID NO: 3498950 - DNA, 17 bp, Homo sapiens
tcgggcaccagccagcg

SEQ ID NO: 3498951 - DNA, 13 bp, Homo sapiens
tcgggcccttccc

SEQ ID NO: 3498952 - DNA, 20 bp, Homo sapiens
tcggtatccccccatcttgc

SEQ ID NO: 3498953 - DNA, 16 bp, Homo sapiens
tcgtccacagcttcct

SEQ ID NO: 3498954 - DNA, 15 bp, Homo sapiens
tcgtctttcccatgg

SEQ ID NO: 3498955 - DNA, 19 bp, Homo sapiens
tcgtgaagtatactgtatt

SEQ ID NO: 3498956 - DNA, 16 bp, Homo sapiens
tcgtgagctcttgtga

SEQ ID NO: 3498957 - DNA, 13 bp, Homo sapiens
tcgtgcctgtgtc

SEQ ID NO: 3498958 - DNA, 21 bp, Homo sapiens
tcgtgcctgtgtccatgcgct

SEQ ID NO: 3498959 - DNA, 18 bp, Homo sapiens
tcgtgcggaatcagcttc

SEQ ID NO: 3498960 - DNA, 20 bp, Homo sapiens
tcgtgtaattacttatccct

SEQ ID NO: 3498961 - DNA, 11 bp, Homo sapiens
tcgttctgtgg

SEQ ID NO: 3498962 - DNA, 18 bp, Homo sapiens
tcgttctttttaagttaa

SEQ ID NO: 3498963 - DNA, 17 bp, Homo sapiens
tcgtttggatctgtgac

SEQ ID NO: 3498964 - DNA, 13 bp, Homo sapiens
tctaaaagacttc

SEQ ID NO: 3498965 - DNA, 16 bp, Homo sapiens
tctaaaagcagaaaat

SEQ ID NO: 3498966 - DNA, 17 bp, Homo sapiens
tctaaaagcagaaaata

SEQ ID NO: 3498967 - DNA, 20 bp, Homo sapiens
tctaaacaatgctgatttgg

SEQ ID NO: 3498968 - DNA, 21 bp, Homo sapiens
tctaaaccatatgaacatata

SEQ ID NO: 3498969 - DNA, 16 bp, Homo sapiens
tctaaacccaatccaa

SEQ ID NO: 3498970 - DNA, 17 bp, Homo sapiens
tctaaacttccccatct

SEQ ID NO: 3498971 - DNA, 12 bp, Homo sapiens
tctaaagtgttt

SEQ ID NO: 3498972 - DNA, 20 bp, Homo sapiens
tctaaatcaccagagaccaa

SEQ ID NO: 3498973 - DNA, 23 bp, Homo sapiens
tctaaatgggaaagtattctgta

SEQ ID NO: 3498974 - DNA, 12 bp, Homo sapiens
tctaacacagtt

SEQ ID NO: 3498975 - DNA, 23 bp, Homo sapiens
tctaacacagttgaccctatttt

SEQ ID NO: 3498976 - DNA, 15 bp, Homo sapiens
tctaacagctcagga

SEQ ID NO: 3498977 - DNA, 17 bp, Homo sapiens
tctaacagctcaggatc

SEQ ID NO: 3498978 - DNA, 13 bp, Homo sapiens
tctaacctcatct

SEQ ID NO: 3498979 - DNA, 18 bp, Homo sapiens
tctaacctcgccctctcc

SEQ ID NO: 3498980 - DNA, 16 bp, Homo sapiens
tctaagaatacagctt

SEQ ID NO: 3498981 - DNA, 14 bp, Homo sapiens
tctaagcctgaagg

SEQ ID NO: 3498982 - DNA, 22 bp, Homo sapiens
tctaagtacctttcctacattt

SEQ ID NO: 3498983 - DNA, 22 bp, Homo sapiens
tctaataaacttggattctcta

SEQ ID NO: 3498984 - DNA, 22 bp, Homo sapiens
tctaatagaactcagttttaac

SEQ ID NO: 3498985 - DNA, 12 bp, Homo sapiens
tctaatagtctt

SEQ ID NO: 3498986 - DNA, 23 bp, Homo sapiens
tctaattaaccttactaattata

SEQ ID NO: 3498987 - DNA, 23 bp, Homo sapiens
tctaatttatcttgtctctgggc

SEQ ID NO: 3498988 - DNA, 21 bp, Homo sapiens
tctacaattcctctgataata

SEQ ID NO: 3498989 - DNA, 21 bp, Homo sapiens
tctacaccttgcttttttact

SEQ ID NO: 3498990 - DNA, 19 bp, Homo sapiens
tctacagagcttccctgac

SEQ ID NO: 3498991 - DNA, 16 bp, Homo sapiens
tctacagaggccatgg

SEQ ID NO: 3498992 - DNA, 21 bp, Homo sapiens
tctacagaggccatgggcctc

SEQ ID NO: 3498993 - DNA, 12 bp, Homo sapiens
tctacatcactc

SEQ ID NO: 3498994 - DNA, 21 bp, Homo sapiens
tctacatgtaactatttcttc

SEQ ID NO: 3498995 - DNA, 20 bp, Homo sapiens
tctaccaagctatcctggct

SEQ ID NO: 3498996 - DNA, 15 bp, Homo sapiens
tctaccttgcagtgt

SEQ ID NO: 3498997 - DNA, 15 bp, Homo sapiens
tctactaattccaca

SEQ ID NO: 3498998 - DNA, 20 bp, Homo sapiens
tctacttgccagaaccaaat

SEQ ID NO: 3498999 - DNA, 20 bp, Homo sapiens
tctacttgtccagttcaaat

SEQ ID NO: 3499000 - DNA, 14 bp, Homo sapiens
tctactttgattct

SEQ ID NO: 3499001 - DNA, 15 bp, Homo sapiens
tctactttgattctg

SEQ ID NO: 3499002 - DNA, 15 bp, Homo sapiens
tctactttttgaact

SEQ ID NO: 3499003 - DNA, 19 bp, Homo sapiens
tctagaacatccctgccag

SEQ ID NO: 3499004 - DNA, 13 bp, Homo sapiens
tctagagagggag

SEQ ID NO: 3499005 - DNA, 13 bp, Homo sapiens
tctagagccttca

SEQ ID NO: 3499006 - DNA, 20 bp, Homo sapiens
tctagaggctcatggccctg

SEQ ID NO: 3499007 - DNA, 20 bp, Homo sapiens
tctagatacaataaattgct

SEQ ID NO: 3499008 - DNA, 19 bp, Homo sapiens
tctagctgttgagctgttt

SEQ ID NO: 3499009 - DNA, 18 bp, Homo sapiens
tctaggcaaaattgtgaa

SEQ ID NO: 3499010 - DNA, 12 bp, Homo sapiens
tctaggctctgc

SEQ ID NO: 3499011 - DNA, 14 bp, Homo sapiens
tctaggctctgcct

SEQ ID NO: 3499012 - DNA, 22 bp, Homo sapiens
tctagggaaaaaccagcgtgtg

SEQ ID NO: 3499013 - DNA, 16 bp, Homo sapiens
tctagggtgttctgta

SEQ ID NO: 3499014 - DNA, 23 bp, Homo sapiens
tctaggtgcccttggaggccagc

SEQ ID NO: 3499015 - DNA, 20 bp, Homo sapiens
tctaggtggcaaggctgtgc

SEQ ID NO: 3499016 - DNA, 19 bp, Homo sapiens
tctagtagctgaaatgcaa

SEQ ID NO: 3499017 - DNA, 12 bp, Homo sapiens
tctagttttcag

SEQ ID NO: 3499018 - DNA, 17 bp, Homo sapiens
tctagttttcagtttgt

SEQ ID NO: 3499019 - DNA, 18 bp, Homo sapiens
tctagttttcagtttgta

SEQ ID NO: 3499020 - DNA, 20 bp, Homo sapiens
tctagttttcagtttgtata

SEQ ID NO: 3499021 - DNA, 16 bp, Homo sapiens
tctataaggccataaa

SEQ ID NO: 3499022 - DNA, 13 bp, Homo sapiens
tctataatttaaa

SEQ ID NO: 3499023 - DNA, 12 bp, Homo sapiens
tctatcatttaa

SEQ ID NO: 3499024 - DNA, 14 bp, Homo sapiens
tctatcatttaata

SEQ ID NO: 3499025 - DNA, 22 bp, Homo sapiens
tctatcatttaataatatactt

SEQ ID NO: 3499026 - DNA, 16 bp, Homo sapiens
tctatccttccagaaa

SEQ ID NO: 3499027 - DNA, 19 bp, Homo sapiens
tctatcttgttccaaggcc

SEQ ID NO: 3499028 - DNA, 22 bp, Homo sapiens
tctatcttgttccaaggccagg

SEQ ID NO: 3499029 - DNA, 18 bp, Homo sapiens
tctatgataattacaata

SEQ ID NO: 3499030 - DNA, 23 bp, Homo sapiens
tctatgctggtgaaaacaatttt

SEQ ID NO: 3499031 - DNA, 18 bp, Homo sapiens
tcttattacccaaaccca

SEQ ID NO: 3499032 - DNA, 22 bp, Homo sapiens
tcttattacccaaacccatggc

SEQ ID NO: 3499033 - DNA, 17 bp, Homo sapiens
tcttattagggagaaaa

SEQ ID NO: 3499034 - DNA, 16 bp, Homo sapiens
tcttattgcgctgcta

SEQ ID NO: 3499035 - DNA, 16 bp, Homo sapiens
tcttcaaggcttcagt

SEQ ID NO: 3499036 - DNA, 19 bp, Homo sapiens
tcttcacccaggcctatgt

SEQ ID NO: 3499037 - DNA, 15 bp, Homo sapiens
tcttcacctcttcca

SEQ ID NO: 3499038 - DNA, 13 bp, Homo sapiens
tcttcagagctga

SEQ ID NO: 3499039 - DNA, 14 bp, Homo sapiens
tcttcagaggccct

SEQ ID NO: 3499040 - DNA, 22 bp, Homo sapiens
tcttcagatttaagttaaataa

SEQ ID NO: 3499041 - DNA, 22 bp, Homo sapiens
tcttcagcctctttctgtccct

SEQ ID NO: 3499042 - DNA, 13 bp, Homo sapiens
tcttcagttaatt

SEQ ID NO: 3499043 - DNA, 14 bp, Homo sapiens
tcttcatctgccca

SEQ ID NO: 3499044 - DNA, 21 bp, Homo sapiens
tcttccactccttctctcact

SEQ ID NO: 3499045 - DNA, 18 bp, Homo sapiens
tcttccaggtgcccagct

SEQ ID NO: 3499046 - DNA, 14 bp, Homo sapiens
tcttccatttgcaa

SEQ ID NO: 3499047 - DNA, 18 bp, Homo sapiens
tcttcccgaaccccaagg

SEQ ID NO: 3499048 - DNA, 19 bp, Homo sapiens
tcttcccgaaccccaagga

SEQ ID NO: 3499049 - DNA, 21 bp, Homo sapiens
tcttcccttttacatactgct

SEQ ID NO: 3499050 - DNA, 15 bp, Homo sapiens
tcttccgactctttc

SEQ ID NO: 3499051 - DNA, 11 bp, Homo sapiens
tcttcctctgc

SEQ ID NO: 3499052 - DNA, 13 bp, Homo sapiens
tcttcctctgcaa

SEQ ID NO: 3499053 - DNA, 14 bp, Homo sapiens
tcttcctgtgtcct

SEQ ID NO: 3499054 - DNA, 22 bp, Homo sapiens
tcttccttgaagaactgcaggc

SEQ ID NO: 3499055 - DNA, 17 bp, Homo sapiens
tcttcgggaccaggatt

SEQ ID NO: 3499056 - DNA, 19 bp, Homo sapiens
tcttcgttctttttaagtt

SEQ ID NO: 3499057 - DNA, 15 bp, Homo sapiens
tcttctattttattc

SEQ ID NO: 3499058 - DNA, 16 bp, Homo sapiens
tcttctattttattcc

SEQ ID NO: 3499059 - DNA, 18 bp, Homo sapiens
tcttctcatttcacccct

SEQ ID NO: 3499060 - DNA, 19 bp, Homo sapiens
tcttctcatttcacccctc

SEQ ID NO: 3499061 - DNA, 20 bp, Homo sapiens
tcttctcatttcacccctcc

SEQ ID NO: 3499062 - DNA, 12 bp, Homo sapiens
tcttctccacca

SEQ ID NO: 3499063 - DNA, 13 bp, Homo sapiens
tcttctccaggct

SEQ ID NO: 3499064 - DNA, 17 bp, Homo sapiens
tcttctcctatgtgtaa

SEQ ID NO: 3499065 - DNA, 21 bp, Homo sapiens
tcttctcctggagttgcattg

SEQ ID NO: 3499066 - DNA, 14 bp, Homo sapiens
tcttctctcaacct

SEQ ID NO: 3499067 - DNA, 22 bp, Homo sapiens
tcttctctcaaccttggccttc

SEQ ID NO: 3499068 - DNA, 20 bp, Homo sapiens
tcttctggagatggaagctt

SEQ ID NO: 3499069 - DNA, 13 bp, Homo sapiens
tcttctggctcaa

SEQ ID NO: 3499070 - DNA, 22 bp, Homo sapiens
tcttctgggagggcagcagggc

SEQ ID NO: 3499071 - DNA, 23 bp, Homo sapiens
tcttctgggagggcagcagggct

SEQ ID NO: 3499072 - DNA, 18 bp, Homo sapiens
tcttctgtaccaaaaata

SEQ ID NO: 3499073 - DNA, 20 bp, Homo sapiens
tcttctgtacgtctgacagg

SEQ ID NO: 3499074 - DNA, 21 bp, Homo sapiens
tcttctgtacgtctgacaggc

SEQ ID NO: 3499075 - DNA, 13 bp, Homo sapiens
tcttctgtccctg

SEQ ID NO: 3499076 - DNA, 15 bp, Homo sapiens
tcttctgtccctgtt

SEQ ID NO: 3499077 - DNA, 17 bp, Homo sapiens
tcttcttattacccaaa

SEQ ID NO: 3499078 - DNA, 15 bp, Homo sapiens
tcttcttattttggt

SEQ ID NO: 3499079 - DNA, 15 bp, Homo sapiens
tcttcttcacatcca

SEQ ID NO: 3499080 - DNA, 15 bp, Homo sapiens
tcttcttcaccattt

SEQ ID NO: 3499081 - DNA, 14 bp, Homo sapiens
tcttctttcccaaa

SEQ ID NO: 3499082 - DNA, 14 bp, Homo sapiens
tcttgaaattaaga

SEQ ID NO: 3499083 - DNA, 15 bp, Homo sapiens
tcttgaactcctggc

SEQ ID NO: 3499084 - DNA, 17 bp, Homo sapiens
tcttgaactcctggcct

SEQ ID NO: 3499085 - DNA, 19 bp, Homo sapiens
tcttgaagtcctggcttca

SEQ ID NO: 3499086 - DNA, 23 bp, Homo sapiens
tcttgaagtcctggcttcaggca

SEQ ID NO: 3499087 - DNA, 18 bp, Homo sapiens
tcttgaatactctgccct

SEQ ID NO: 3499088 - DNA, 23 bp, Homo sapiens
tcttgaatttaataatctgtagg

SEQ ID NO: 3499089 - DNA, 19 bp, Homo sapiens
tcttgaatttttttctgca

SEQ ID NO: 3499090 - DNA, 22 bp, Homo sapiens
tcttgaatttttttctgcacag

SEQ ID NO: 3499091 - DNA, 15 bp, Homo sapiens
tcttgacagaaagca

SEQ ID NO: 3499092 - DNA, 17 bp, Homo sapiens
tcttgacagaaagcagt

SEQ ID NO: 3499093 - DNA, 20 bp, Homo sapiens
tcttgacgagtgtgaagctt

SEQ ID NO: 3499094 - DNA, 16 bp, Homo sapiens
tcttgactacagtcag

SEQ ID NO: 3499095 - DNA, 13 bp, Homo sapiens
tcttgagtttgtc

SEQ ID NO: 3499096 - DNA, 14 bp, Homo sapiens
tcttgataagacca

SEQ ID NO: 3499097 - DNA, 18 bp, Homo sapiens
tcttgatcaacatctttt

SEQ ID NO: 3499098 - DNA, 13 bp, Homo sapiens
tcttgatgcatgc

SEQ ID NO: 3499099 - DNA, 13 bp, Homo sapiens
tcttgatgtttag

SEQ ID NO: 3499100 - DNA, 19 bp, Homo sapiens
tcttgccaaatataaataa

SEQ ID NO: 3499101 - DNA, 17 bp, Homo sapiens
tcttgccctctcttttg

SEQ ID NO: 3499102 - DNA, 12 bp, Homo sapiens
tcttgcctctgt

SEQ ID NO: 3499103 - DNA, 21 bp, Homo sapiens
tcttgcctctgtccccttctc

SEQ ID NO: 3499104 - DNA, 14 bp, Homo sapiens
tcttgcctctgtgc

SEQ ID NO: 3499105 - DNA, 15 bp, Homo sapiens
tcttgcctctgtgct

SEQ ID NO: 3499106 - DNA, 16 bp, Homo sapiens
tcttgcctctgtgctg

SEQ ID NO: 3499107 - DNA, 23 bp, Homo sapiens
tcttgctctgctgacagacacag

SEQ ID NO: 3499108 - DNA, 19 bp, Homo sapiens
tcttgctgttgacatattt

SEQ ID NO: 3499109 - DNA, 21 bp, Homo sapiens
tcttggcacatttaagagaca

SEQ ID NO: 3499110 - DNA, 18 bp, Homo sapiens
tcttggcagcacctgtct

SEQ ID NO: 3499111 - DNA, 21 bp, Homo sapiens
tcttggcttaatcattttcat

SEQ ID NO: 3499112 - DNA, 14 bp, Homo sapiens
tcttgggaactgaa

SEQ ID NO: 3499113 - DNA, 20 bp, Homo sapiens
tcttgggcagagctggctct

SEQ ID NO: 3499114 - DNA, 17 bp, Homo sapiens
tcttgggccaagccagc

SEQ ID NO: 3499115 - DNA, 20 bp, Homo sapiens
tcttgggccaagccagctgc

SEQ ID NO: 3499116 - DNA, 21 bp, Homo sapiens
tcttgggccaagccagctgcc

SEQ ID NO: 3499117 - DNA, 19 bp, Homo sapiens
tcttgggggggtggccgct

SEQ ID NO: 3499118 - DNA, 20 bp, Homo sapiens
tcttgggggggtggccgctg

SEQ ID NO: 3499119 - DNA, 13 bp, Homo sapiens
tcttggttgagga

SEQ ID NO: 3499120 - DNA, 15 bp, Homo sapiens
tcttggttgaggaaa

SEQ ID NO: 3499121 - DNA, 20 bp, Homo sapiens
tcttggttttccctttgcct

SEQ ID NO: 3499122 - DNA, 18 bp, Homo sapiens
tcttgtctcaatgctcat

SEQ ID NO: 3499123 - DNA, 20 bp, Homo sapiens
tcttgtctcaatgctcataa

SEQ ID NO: 3499124 - DNA, 21 bp, Homo sapiens
tcttgtctcaatgctcataac

SEQ ID NO: 3499125 - DNA, 14 bp, Homo sapiens
tcttgtctctgggc

SEQ ID NO: 3499126 - DNA, 23 bp, Homo sapiens
tcttgtgaggaaagtcattggct

SEQ ID NO: 3499127 - DNA, 21 bp, Homo sapiens
tcttgttattgaagtgttctg

SEQ ID NO: 3499128 - DNA, 20 bp, Homo sapiens
tcttgtttttccactactgc

SEQ ID NO: 3499129 - DNA, 22 bp, Homo sapiens
tcttgtttttccactactgcta

SEQ ID NO: 3499130 - DNA, 13 bp, Homo sapiens
tctttaaatatat

SEQ ID NO: 3499131 - DNA, 15 bp, Homo sapiens
tctttaaatatatat

SEQ ID NO: 3499132 - DNA, 17 bp, Homo sapiens
tctttaaatatatatta

SEQ ID NO: 3499133 - DNA, 13 bp, Homo sapiens
tctttaatgcttt

SEQ ID NO: 3499134 - DNA, 20 bp, Homo sapiens
tctttaatgtcacaggcagg

SEQ ID NO: 3499135 - DNA, 22 bp, Homo sapiens
tctttaatgtcacaggcaggtc

SEQ ID NO: 3499136 - DNA, 17 bp, Homo sapiens
tctttagagttagactg

SEQ ID NO: 3499137 - DNA, 20 bp, Homo sapiens
tctttagatggtggcacatt

SEQ ID NO: 3499138 - DNA, 21 bp, Homo sapiens
tctttaggtctttgtaagaac

SEQ ID NO: 3499139 - DNA, 14 bp, Homo sapiens
tctttatgcttgca

SEQ ID NO: 3499140 - DNA, 16 bp, Homo sapiens
tctttattaatcacta

SEQ ID NO: 3499141 - DNA, 16 bp, Homo sapiens
tctttattctttacta

SEQ ID NO: 3499142 - DNA, 22 bp, Homo sapiens
tctttattttactagaaatggg

SEQ ID NO: 3499143 - DNA, 20 bp, Homo sapiens
tctttcaaaggtagccatca

SEQ ID NO: 3499144 - DNA, 17 bp, Homo sapiens
tctttcacatttaaata

SEQ ID NO: 3499145 - DNA, 18 bp, Homo sapiens
tctttcagacttgccatg

SEQ ID NO: 3499146 - DNA, 16 bp, Homo sapiens
tctttcagtacttttt

SEQ ID NO: 3499147 - DNA, 22 bp, Homo sapiens
tctttccacggagccactcctc

SEQ ID NO: 3499148 - DNA, 20 bp, Homo sapiens
tctttccattggatctcatt

SEQ ID NO: 3499149 - DNA, 18 bp, Homo sapiens
tctttcccatggggaggg

SEQ ID NO: 3499150 - DNA, 22 bp, Homo sapiens
tctttccgtttttttttctttt

SEQ ID NO: 3499151 - DNA, 14 bp, Homo sapiens
tctttcctatttca

SEQ ID NO: 3499152 - DNA, 14 bp, Homo sapiens
tctttcctccttcc

SEQ ID NO: 3499153 - DNA, 14 bp, Homo sapiens
tctttcggaatttt

SEQ ID NO: 3499154 - DNA, 22 bp, Homo sapiens
tctttcggaatttttaaaataa

SEQ ID NO: 3499155 - DNA, 20 bp, Homo sapiens
tctttctgataactagatgg

SEQ ID NO: 3499156 - DNA, 10 bp, Homo sapiens
tctttctgta

SEQ ID NO: 3499157 - DNA, 20 bp, Homo sapiens
tctttcttacaaggaaggtg

SEQ ID NO: 3499158 - DNA, 16 bp, Homo sapiens
tctttcttagaaattt

SEQ ID NO: 3499159 - DNA, 23 bp, Homo sapiens
tctttctttgggaatatttgaat

SEQ ID NO: 3499160 - DNA, 15 bp, Homo sapiens
tctttgattctcctt

SEQ ID NO: 3499161 - DNA, 12 bp, Homo sapiens
tctttgcaaagt

SEQ ID NO: 3499162 - DNA, 21 bp, Homo sapiens
tctttgcaaagtattgtaaat

SEQ ID NO: 3499163 - DNA, 18 bp, Homo sapiens
tgagctcttgtgaggaaa

SEQ ID NO: 3499164 - DNA, 14 bp, Homo sapiens
tgagctgaggcagc

SEQ ID NO: 3499165 - DNA, 15 bp, Homo sapiens
tgagcttctctgtga

SEQ ID NO: 3499166 - DNA, 15 bp, Homo sapiens
tgaggaaaggccagc

SEQ ID NO: 3499167 - DNA, 19 bp, Homo sapiens
tgaggaaaggccagctggc

SEQ ID NO: 3499168 - DNA, 22 bp, Homo sapiens
tgaggaagcgtgaaggccgaga

SEQ ID NO: 3499169 - DNA, 21 bp, Homo sapiens
tgaggaatccagacccggctg

SEQ ID NO: 3499170 - DNA, 14 bp, Homo sapiens
tgaggagaatgaaa

SEQ ID NO: 3499171 - DNA, 12 bp, Homo sapiens
tgaggagctggg

SEQ ID NO: 3499172 - DNA, 20 bp, Homo sapiens
tgaggagctggggatccctc

SEQ ID NO: 3499173 - DNA, 22 bp, Homo sapiens
tgaggaggggcccccctgccct

SEQ ID NO: 3499174 - DNA, 17 bp, Homo sapiens
tgaggataactttttaa

SEQ ID NO: 3499175 - DNA, 15 bp, Homo sapiens
tgaggcaagtgtggg

SEQ ID NO: 3499176 - DNA, 14 bp, Homo sapiens
tgaggcagggaagt

SEQ ID NO: 3499177 - DNA, 21 bp, Homo sapiens
tgaggcatcctctgactccac

SEQ ID NO: 3499178 - DNA, 19 bp, Homo sapiens
tgaggccacactcagcaca

SEQ ID NO: 3499179 - DNA, 20 bp, Homo sapiens
tgaggccacactcagcacaa

SEQ ID NO: 3499180 - DNA, 18 bp, Homo sapiens
tgaggccagcctgcggga

SEQ ID NO: 3499181 - DNA, 23 bp, Homo sapiens
tgaggccagcctgcgggaagctg

SEQ ID NO: 3499182 - DNA, 15 bp, Homo sapiens
tgaggccagggcaga

SEQ ID NO: 3499183 - DNA, 21 bp, Homo sapiens
tgaggccccttctaggtggca

SEQ ID NO: 3499184 - DNA, 23 bp, Homo sapiens
tgaggctgactggatgtccagag

SEQ ID NO: 3499185 - DNA, 17 bp, Homo sapiens
tgaggctggcacaggac

SEQ ID NO: 3499186 - DNA, 23 bp, Homo sapiens
tgaggcttagctttgctctgcca

SEQ ID NO: 3499187 - DNA, 23 bp, Homo sapiens
tgaggctttggatttgacattgc

SEQ ID NO: 3499188 - DNA, 14 bp, Homo sapiens
tgagggagcctggc

SEQ ID NO: 3499189 - DNA, 20 bp, Homo sapiens
tgagggcctgctggaggcct

SEQ ID NO: 3499190 - DNA, 21 bp, Homo sapiens
tgagggcctgctggaggcctc

SEQ ID NO: 3499191 - DNA, 19 bp, Homo sapiens
tgagggccttcttaagata

SEQ ID NO: 3499192 - DNA, 15 bp, Homo sapiens
tgaggtcactgctag

SEQ ID NO: 3499193 - DNA, 14 bp, Homo sapiens
tgaggtcagagcct

SEQ ID NO: 3499194 - DNA, 16 bp, Homo sapiens
tgaggtcagagcctgc

SEQ ID NO: 3499195 - DNA, 21 bp, Homo sapiens
tgaggtgggaggatctcttga

SEQ ID NO: 3499196 - DNA, 16 bp, Homo sapiens
tgaggttgctagagaa

SEQ ID NO: 3499197 - DNA, 15 bp, Homo sapiens
tgagtatctcctcgc

SEQ ID NO: 3499198 - DNA, 20 bp, Homo sapiens
tgagtcatctgttagggcct

SEQ ID NO: 3499199 - DNA, 21 bp, Homo sapiens
tgagtcatctgttagggcctt

SEQ ID NO: 3499200 - DNA, 19 bp, Homo sapiens
tgagtccagaagtttgaga

SEQ ID NO: 3499201 - DNA, 16 bp, Homo sapiens
tgagtcctagagctac

SEQ ID NO: 3499202 - DNA, 14 bp, Homo sapiens
tgagtcctggccca

SEQ ID NO: 3499203 - DNA, 15 bp, Homo sapiens
tgagtcctggcccaa

SEQ ID NO: 3499204 - DNA, 14 bp, Homo sapiens
tgagtctatgttca

SEQ ID NO: 3499205 - DNA, 23 bp, Homo sapiens
tgagtctatgttcaaagactgtg

SEQ ID NO: 3499206 - DNA, 18 bp, Homo sapiens
tgagtgccttctgtgggg

SEQ ID NO: 3499207 - DNA, 13 bp, Homo sapiens
tgagtgctctgat

SEQ ID NO: 3499208 - DNA, 19 bp, Homo sapiens
tgagtttaaaaatcaactt

SEQ ID NO: 3499209 - DNA, 13 bp, Homo sapiens
tgagttttccatg

SEQ ID NO: 3499210 - DNA, 15 bp, Homo sapiens
tgataaatcagtcaa

SEQ ID NO: 3499211 - DNA, 21 bp, Homo sapiens
tgataactagatggtgctgag

SEQ ID NO: 3499212 - DNA, 12 bp, Homo sapiens
tgataataaagg

SEQ ID NO: 3499213 - DNA, 19 bp, Homo sapiens
tgataataaaggaactgca

SEQ ID NO: 3499214 - DNA, 17 bp, Homo sapiens
tgataatatattttcaa

SEQ ID NO: 3499215 - DNA, 21 bp, Homo sapiens
tgataatgacactgtttcctg

SEQ ID NO: 3499216 - DNA, 23 bp, Homo sapiens
tgataatgacactgtttcctgat

SEQ ID NO: 3499217 - DNA, 18 bp, Homo sapiens
tgataccagaagggaaag

SEQ ID NO: 3499218 - DNA, 12 bp, Homo sapiens
tgatagcacttt

SEQ ID NO: 3499219 - DNA, 13 bp, Homo sapiens
tgatagcactttc

SEQ ID NO: 3499220 - DNA, 14 bp, Homo sapiens
tgatagcactttct

SEQ ID NO: 3499221 - DNA, 14 bp, Homo sapiens
tgatatatttaaaa

SEQ ID NO: 3499222 - DNA, 21 bp, Homo sapiens
tgatatccattctttctgata

SEQ ID NO: 3499223 - DNA, 23 bp, Homo sapiens
tgatatttccctcccctggggac

SEQ ID NO: 3499224 - DNA, 18 bp, Homo sapiens
tgatcaacatcttttctt

SEQ ID NO: 3499225 - DNA, 21 bp, Homo sapiens
tgatcaacatcttttcttgcc

SEQ ID NO: 3499226 - DNA, 23 bp, Homo sapiens
tgatcaacatcttttcttgcctc

SEQ ID NO: 3499227 - DNA, 21 bp, Homo sapiens
tgatcaagtcctttgtgaata

SEQ ID NO: 3499228 - DNA, 19 bp, Homo sapiens
tgatcacggctcactgcag

SEQ ID NO: 3499229 - DNA, 21 bp, Homo sapiens
tgatcacggctcactgcagcc

SEQ ID NO: 3499230 - DNA, 23 bp, Homo sapiens
tgatcagagccgtggtcctttgg

SEQ ID NO: 3499231 - DNA, 16 bp, Homo sapiens
tgatcagatctgacat

SEQ ID NO: 3499232 - DNA, 23 bp, Homo sapiens
tgatcagatctgacatgattcct

SEQ ID NO: 3499233 - DNA, 12 bp, Homo sapiens
tgatcaggacct

SEQ ID NO: 3499234 - DNA, 20 bp, Homo sapiens
tgatcaggacctccaagcca

SEQ ID NO: 3499235 - DNA, 15 bp, Homo sapiens
tgatcatcgccagag

SEQ ID NO: 3499236 - DNA, 18 bp, Homo sapiens
tgatcatcgccagaggtg

SEQ ID NO: 3499237 - DNA, 20 bp, Homo sapiens
tgatcatcgccagaggtgct

SEQ ID NO: 3499238 - DNA, 18 bp, Homo sapiens
tgatccaagcaagactga

SEQ ID NO: 3499239 - DNA, 16 bp, Homo sapiens
tgatccacccacctca

SEQ ID NO: 3499240 - DNA, 12 bp, Homo sapiens
tgatcctcccac

SEQ ID NO: 3499241 - DNA, 14 bp, Homo sapiens
tgatcctggaggcc

SEQ ID NO: 3499242 - DNA, 18 bp, Homo sapiens
tgatcctggaggcccagt

SEQ ID NO: 3499243 - DNA, 21 bp, Homo sapiens
tgatcgatgattcaggtgcag

SEQ ID NO: 3499244 - DNA, 17 bp, Homo sapiens
tgatcgcctttcccagg

SEQ ID NO: 3499245 - DNA, 23 bp, Homo sapiens
tgatctcaggagcttgcaagaag

SEQ ID NO: 3499246 - DNA, 15 bp, Homo sapiens
tgatctggaacccag

SEQ ID NO: 3499247 - DNA, 22 bp, Homo sapiens
tgatctttaactggaaggctgc

SEQ ID NO: 3499248 - DNA, 19 bp, Homo sapiens
tgatctttgcagacaggca

SEQ ID NO: 3499249 - DNA, 23 bp, Homo sapiens
tgatctttgcagacaggcaagca

SEQ ID NO: 3499250 - DNA, 22 bp, Homo sapiens
tgatgaaatgaggtcagagcct

SEQ ID NO: 3499251 - DNA, 23 bp, Homo sapiens
tgatgaaatgaggtcagagcctg

SEQ ID NO: 3499252 - DNA, 14 bp, Homo sapiens
tgatgaatactgta

SEQ ID NO: 3499253 - DNA, 22 bp, Homo sapiens
tgatgaggtattttttcctttt

SEQ ID NO: 3499254 - DNA, 14 bp, Homo sapiens
tgatgatcctaggc

SEQ ID NO: 3499255 - DNA, 17 bp, Homo sapiens
tgatgcatgcactgttc

SEQ ID NO: 3499256 - DNA, 18 bp, Homo sapiens
tgatgcatgcactgttcc

SEQ ID NO: 3499257 - DNA, 14 bp, Homo sapiens
tgatgcctctgtct

SEQ ID NO: 3499258 - DNA, 21 bp, Homo sapiens
tgatgctgccggcacagctgg

SEQ ID NO: 3499259 - DNA, 12 bp, Homo sapiens
tgatgctgggat

SEQ ID NO: 3499260 - DNA, 17 bp, Homo sapiens
tgatgcttacatctgga

SEQ ID NO: 3499261 - DNA, 20 bp, Homo sapiens
tgatgcttacatctggaatc

SEQ ID NO: 3499262 - DNA, 10 bp, Homo sapiens
tgatggagat

SEQ ID NO: 3499263 - DNA, 15 bp, Homo sapiens
tgatggagtgtgagc

SEQ ID NO: 3499264 - DNA, 19 bp, Homo sapiens
tgatggatttaacagcatg

SEQ ID NO: 3499265 - DNA, 18 bp, Homo sapiens
tgatggcaacagatctgg

SEQ ID NO: 3499266 - DNA, 19 bp, Homo sapiens
tgatggcaacagatctgga

SEQ ID NO: 3499267 - DNA, 13 bp, Homo sapiens
tgatggcttctcc

SEQ ID NO: 3499268 - DNA, 15 bp, Homo sapiens
tgatggcttctccag

SEQ ID NO: 3499269 - DNA, 13 bp, Homo sapiens
tgatgggaaaact

SEQ ID NO: 3499270 - DNA, 16 bp, Homo sapiens
tgatgggattctggac

SEQ ID NO: 3499271 - DNA, 16 bp, Homo sapiens
tgatgggcctgaactc

SEQ ID NO: 3499272 - DNA, 14 bp, Homo sapiens
tgatggggaaggag

SEQ ID NO: 3499273 - DNA, 15 bp, Homo sapiens
tgatggtctggtcta

SEQ ID NO: 3499274 - DNA, 16 bp, Homo sapiens
tgatggtcttcagcct

SEQ ID NO: 3499275 - DNA, 18 bp, Homo sapiens
tgatgtagtgcctctttc

SEQ ID NO: 3499276 - DNA, 15 bp, Homo sapiens
tgattaaatatttga

SEQ ID NO: 3499277 - DNA, 19 bp, Homo sapiens
tgattaaatatttgaagag

SEQ ID NO: 3499278 - DNA, 20 bp, Homo sapiens
tgattaaccacttcagctga

SEQ ID NO: 3499279 - DNA, 21 bp, Homo sapiens
tgattaattcaccttccagtg

SEQ ID NO: 3499280 - DNA, 13 bp, Homo sapiens
tgattactgtcaa

SEQ ID NO: 3499281 - DNA, 22 bp, Homo sapiens
tgattaggtatgtttgtaactt

SEQ ID NO: 3499282 - DNA, 19 bp, Homo sapiens
tgattagttttcttgttgc

SEQ ID NO: 3499283 - DNA, 13 bp, Homo sapiens
tgattcaaaatat

SEQ ID NO: 3499284 - DNA, 23 bp, Homo sapiens
tgattcaactaaaaaaaaaaaag

SEQ ID NO: 3499285 - DNA, 12 bp, Homo sapiens
tgattcaattca

SEQ ID NO: 3499286 - DNA, 22 bp, Homo sapiens
tgattcacccccaaacagtgac

SEQ ID NO: 3499287 - DNA, 21 bp, Homo sapiens
tgattcagtgttaaatgtgat

SEQ ID NO: 3499288 - DNA, 16 bp, Homo sapiens
tgattcatagtaactt

SEQ ID NO: 3499289 - DNA, 18 bp, Homo sapiens
tgattcccaagctctgct

SEQ ID NO: 3499290 - DNA, 22 bp, Homo sapiens
tgattcccaagctctgctcctc

SEQ ID NO: 3499291 - DNA, 23 bp, Homo sapiens
tgattcccaagctctgctcctct

SEQ ID NO: 3499292 - DNA, 18 bp, Homo sapiens
tgattccctcctgctact

SEQ ID NO: 3499293 - DNA, 12 bp, Homo sapiens
tgattccttcct

SEQ ID NO: 3499294 - DNA, 14 bp, Homo sapiens
tgccttcgcttctt

SEQ ID NO: 3499295 - DNA, 16 bp, Homo sapiens
tgccttcgcttcttgc

SEQ ID NO: 3499296 - DNA, 20 bp, Homo sapiens
tgccttcgcttcttgcctct

SEQ ID NO: 3499297 - DNA, 17 bp, Homo sapiens
tgccttctcaccagctg

SEQ ID NO: 3499298 - DNA, 21 bp, Homo sapiens
tgccttctcaccagctgcaaa

SEQ ID NO: 3499299 - DNA, 13 bp, Homo sapiens
tgccttcttcagg

SEQ ID NO: 3499300 - DNA, 15 bp, Homo sapiens
tgccttcttcagggc

SEQ ID NO: 3499301 - DNA, 18 bp, Homo sapiens
tgccttcttcagggcctg

SEQ ID NO: 3499302 - DNA, 20 bp, Homo sapiens
tgccttcttcagggcctggt

SEQ ID NO: 3499303 - DNA, 12 bp, Homo sapiens
tgccttgcctcc

SEQ ID NO: 3499304 - DNA, 18 bp, Homo sapiens
tgccttggaagttgcatg

SEQ ID NO: 3499305 - DNA, 17 bp, Homo sapiens
tgccttggctcagacat

SEQ ID NO: 3499306 - DNA, 11 bp, Homo sapiens
tgcctttagaa

SEQ ID NO: 3499307 - DNA, 16 bp, Homo sapiens
tgcctttagaaaatat

SEQ ID NO: 3499308 - DNA, 20 bp, Homo sapiens
tgcctttagcccctcccaag

SEQ ID NO: 3499309 - DNA, 21 bp, Homo sapiens
tgcctttagcccctcccaagc

SEQ ID NO: 3499310 - DNA, 17 bp, Homo sapiens
tgcctttcaaatttaga

SEQ ID NO: 3499311 - DNA, 16 bp, Homo sapiens
tgcctttcgaggcctg

SEQ ID NO: 3499312 - DNA, 16 bp, Homo sapiens
tgcctttgcctccaga

SEQ ID NO: 3499313 - DNA, 19 bp, Homo sapiens
tgccttttgcagaagaggg

SEQ ID NO: 3499314 - DNA, 17 bp, Homo sapiens
tgcgactttctgcctgg

SEQ ID NO: 3499315 - DNA, 18 bp, Homo sapiens
tgcgactttctgcctgga

SEQ ID NO: 3499316 - DNA, 19 bp, Homo sapiens
tgcgatctcggctcagtgc

SEQ ID NO: 3499317 - DNA, 15 bp, Homo sapiens
tgcgcagccccatct

SEQ ID NO: 3499318 - DNA, 14 bp, Homo sapiens
tgcgcagtgccttg

SEQ ID NO: 3499319 - DNA, 21 bp, Homo sapiens
tgcgcattctaacctggaggt

SEQ ID NO: 3499320 - DNA, 17 bp, Homo sapiens
tgcgcccagtccttcca

SEQ ID NO: 3499321 - DNA, 21 bp, Homo sapiens
tgcgccccctccgccctgcca

SEQ ID NO: 3499322 - DNA, 13 bp, Homo sapiens
tgcgctcagggcc

SEQ ID NO: 3499323 - DNA, 15 bp, Homo sapiens
tgcgctcagggccat

SEQ ID NO: 3499324 - DNA, 17 bp, Homo sapiens
tgcgctgggcacttccc

SEQ ID NO: 3499325 - DNA, 20 bp, Homo sapiens
tgcgctgggcacttccctgc

SEQ ID NO: 3499326 - DNA, 20 bp, Homo sapiens
tgcggacagccacggccagg

SEQ ID NO: 3499327 - DNA, 21 bp, Homo sapiens
tgcggacagccacggccaggc

SEQ ID NO: 3499328 - DNA, 15 bp, Homo sapiens
tgcggagaacaaatg

SEQ ID NO: 3499329 - DNA, 23 bp, Homo sapiens
tgcggaggctgctcagatggcct

SEQ ID NO: 3499330 - DNA, 13 bp, Homo sapiens
tgcggccaccacc

SEQ ID NO: 3499331 - DNA, 16 bp, Homo sapiens
tgcggcgtacaggctg

SEQ ID NO: 3499332 - DNA, 15 bp, Homo sapiens
tgcggtagccagcac

SEQ ID NO: 3499333 - DNA, 16 bp, Homo sapiens
tgcggtagccagcaca

SEQ ID NO: 3499334 - DNA, 18 bp, Homo sapiens
tgcggtagccagcacaca

SEQ ID NO: 3499335 - DNA, 18 bp, Homo sapiens
tgcggtccacccaggagc

SEQ ID NO: 3499336 - DNA, 20 bp, Homo sapiens
tgcgtatgccaccaacttac

SEQ ID NO: 3499337 - DNA, 17 bp, Homo sapiens
tgcgttccatgatgctg

SEQ ID NO: 3499338 - DNA, 17 bp, Homo sapiens
tgctaaaatagaatata

SEQ ID NO: 3499339 - DNA, 19 bp, Homo sapiens
tgctaagaatgcattattg

SEQ ID NO: 3499340 - DNA, 17 bp, Homo sapiens
tgctaatttaaagagac

SEQ ID NO: 3499341 - DNA, 20 bp, Homo sapiens
tgctacagatgatagaggat

SEQ ID NO: 3499342 - DNA, 18 bp, Homo sapiens
tgctaccgttgacttcca

SEQ ID NO: 3499343 - DNA, 16 bp, Homo sapiens
tgctacgcctgcatgt

SEQ ID NO: 3499344 - DNA, 22 bp, Homo sapiens
tgctactgtcctacccaccctc

SEQ ID NO: 3499345 - DNA, 14 bp, Homo sapiens
tgctatagcctggg

SEQ ID NO: 3499346 - DNA, 15 bp, Homo sapiens
tgctatagtatttga

SEQ ID NO: 3499347 - DNA, 16 bp, Homo sapiens
tgctatattgcccagg

SEQ ID NO: 3499348 - DNA, 19 bp, Homo sapiens
tgctatcaacaataaaatt

SEQ ID NO: 3499349 - DNA, 17 bp, Homo sapiens
tgctatcattattcgta

SEQ ID NO: 3499350 - DNA, 12 bp, Homo sapiens
tgctatgttctg

SEQ ID NO: 3499351 - DNA, 13 bp, Homo sapiens
tgctattgacaat

SEQ ID NO: 3499352 - DNA, 16 bp, Homo sapiens
tgctattgacaataaa

SEQ ID NO: 3499353 - DNA, 20 bp, Homo sapiens
tgctatttgaacaagtgggc

SEQ ID NO: 3499354 - DNA, 16 bp, Homo sapiens
tgctcacatatctgtc

SEQ ID NO: 3499355 - DNA, 12 bp, Homo sapiens
tgctcacctggg

SEQ ID NO: 3499356 - DNA, 22 bp, Homo sapiens
tgctcacgttaccttgacacat

SEQ ID NO: 3499357 - DNA, 17 bp, Homo sapiens
tgctcagaccagctctt

SEQ ID NO: 3499358 - DNA, 23 bp, Homo sapiens
tgctcaggactcagaagcctctg

SEQ ID NO: 3499359 - DNA, 22 bp, Homo sapiens
tgctcagggaaaagcagctctc

SEQ ID NO: 3499360 - DNA, 16 bp, Homo sapiens
tgctcagggaaatggc

SEQ ID NO: 3499361 - DNA, 22 bp, Homo sapiens
tgctcagggaaatggccttccc

SEQ ID NO: 3499362 - DNA, 13 bp, Homo sapiens
tgctcaggtactt

SEQ ID NO: 3499363 - DNA, 18 bp, Homo sapiens
tgctcagttcagaatcac

SEQ ID NO: 3499364 - DNA, 23 bp, Homo sapiens
tgctcagttcagaatcacttctg

SEQ ID NO: 3499365 - DNA, 22 bp, Homo sapiens
tgctcatcattccttgagaaaa

SEQ ID NO: 3499366 - DNA, 19 bp, Homo sapiens
tgctcatcattctctgtct

SEQ ID NO: 3499367 - DNA, 12 bp, Homo sapiens
tgctccagacct

SEQ ID NO: 3499368 - DNA, 21 bp, Homo sapiens
tgctccagacctgatcctgga

SEQ ID NO: 3499369 - DNA, 15 bp, Homo sapiens
tgctccctcacatgt

SEQ ID NO: 3499370 - DNA, 13 bp, Homo sapiens
tgctccgtgcttg

SEQ ID NO: 3499371 - DNA, 20 bp, Homo sapiens
tgctcctagagggaggggcc

SEQ ID NO: 3499372 - DNA, 17 bp, Homo sapiens
tgctcctctctttgtgg

SEQ ID NO: 3499373 - DNA, 21 bp, Homo sapiens
tgctccttccaacaggagctg

SEQ ID NO: 3499374 - DNA, 16 bp, Homo sapiens
tgctccttgggccctt

SEQ ID NO: 3499375 - DNA, 15 bp, Homo sapiens
tgctccttgttccta

SEQ ID NO: 3499376 - DNA, 18 bp, Homo sapiens
tgctcgagtcacattctg

SEQ ID NO: 3499377 - DNA, 20 bp, Homo sapiens
tgctcgagtcacattctgct

SEQ ID NO: 3499378 - DNA, 16 bp, Homo sapiens
tgctcgccccagcagg

SEQ ID NO: 3499379 - DNA, 19 bp, Homo sapiens
tgctcgctgttgctgaata

SEQ ID NO: 3499380 - DNA, 21 bp, Homo sapiens
tgctctagatgagctgggccg

SEQ ID NO: 3499381 - DNA, 13 bp, Homo sapiens
tgctctaggaaga

SEQ ID NO: 3499382 - DNA, 13 bp, Homo sapiens
tgctctagtgcct

SEQ ID NO: 3499383 - DNA, 16 bp, Homo sapiens
tgctctatgctttcca

SEQ ID NO: 3499384 - DNA, 13 bp, Homo sapiens
tgctctcagcctc

SEQ ID NO: 3499385 - DNA, 14 bp, Homo sapiens
tgctctgatccctc

SEQ ID NO: 3499386 - DNA, 19 bp, Homo sapiens
tgctctgatccctctacag

SEQ ID NO: 3499387 - DNA, 23 bp, Homo sapiens
tgctctgcgtgtcacctgtgctt

SEQ ID NO: 3499388 - DNA, 12 bp, Homo sapiens
tgctctgcttca

SEQ ID NO: 3499389 - DNA, 16 bp, Homo sapiens
tgctctgtttgtgggg

SEQ ID NO: 3499390 - DNA, 23 bp, Homo sapiens
tgctctttcccccttccatctct

SEQ ID NO: 3499391 - DNA, 15 bp, Homo sapiens
tgctgacagacacag

SEQ ID NO: 3499392 - DNA, 15 bp, Homo sapiens
tgctgacagctgctc

SEQ ID NO: 3499393 - DNA, 17 bp, Homo sapiens
tgctgacagctgctcct

SEQ ID NO: 3499394 - DNA, 18 bp, Homo sapiens
tgctgacagctgctccta

SEQ ID NO: 3499395 - DNA, 14 bp, Homo sapiens
tgctgacggccagg

SEQ ID NO: 3499396 - DNA, 20 bp, Homo sapiens
tgctgacggccagggagaag

SEQ ID NO: 3499397 - DNA, 13 bp, Homo sapiens
tgctgactgaaca

SEQ ID NO: 3499398 - DNA, 14 bp, Homo sapiens
tgctgactgaacat

SEQ ID NO: 3499399 - DNA, 16 bp, Homo sapiens
tgctgactgttttctc

SEQ ID NO: 3499400 - DNA, 17 bp, Homo sapiens
tgctgagaagcttttga

SEQ ID NO: 3499401 - DNA, 14 bp, Homo sapiens
tgctgagagaaata

SEQ ID NO: 3499402 - DNA, 23 bp, Homo sapiens
tgctgagagaaatatggaactta

SEQ ID NO: 3499403 - DNA, 18 bp, Homo sapiens
tgctgagatacatacaga

SEQ ID NO: 3499404 - DNA, 20 bp, Homo sapiens
tgctgagatacatacagaat

SEQ ID NO: 3499405 - DNA, 20 bp, Homo sapiens
tgctgagcctctgctcccca

SEQ ID NO: 3499406 - DNA, 13 bp, Homo sapiens
tgctgaggcctgg

SEQ ID NO: 3499407 - DNA, 15 bp, Homo sapiens
tgctgaggcctgggc

SEQ ID NO: 3499408 - DNA, 24 bp, Homo sapiens
tgctgagtagatgcgcagccccat

SEQ ID NO: 3499409 - DNA, 23 bp, Homo sapiens
tgctgatcatcgccagaggtgct

SEQ ID NO: 3499410 - DNA, 14 bp, Homo sapiens
tgctgatggtctgg

SEQ ID NO: 3499411 - DNA, 17 bp, Homo sapiens
tgctgatgtcctcacca

SEQ ID NO: 3499412 - DNA, 21 bp, Homo sapiens
tgctgcaaggacattcttgta

SEQ ID NO: 3499413 - DNA, 15 bp, Homo sapiens
tgctgcagctccctg

SEQ ID NO: 3499414 - DNA, 19 bp, Homo sapiens
tgctgcagctccctggctt

SEQ ID NO: 3499415 - DNA, 21 bp, Homo sapiens
tgctgcagctccctggcttct

SEQ ID NO: 3499416 - DNA, 16 bp, Homo sapiens
tgctgcatgccctctc

SEQ ID NO: 3499417 - DNA, 21 bp, Homo sapiens
tgctgccacactgtctcatct

SEQ ID NO: 3499418 - DNA, 24 bp, Homo sapiens
tgctgccagagaagtctggtcaga

SEQ ID NO: 3499419 - DNA, 13 bp, Homo sapiens
tgctgccatccag

SEQ ID NO: 3499420 - DNA, 15 bp, Homo sapiens
tgctgccatccaggt

SEQ ID NO: 3499421 - DNA, 21 bp, Homo sapiens
tgctgccatccaggttcagct

SEQ ID NO: 3499422 - DNA, 16 bp, Homo sapiens
tgctgcccaggcccag

SEQ ID NO: 3499423 - DNA, 22 bp, Homo sapiens
tgctgccccgcttccccacaga

SEQ ID NO: 3499424 - DNA, 23 bp, Homo sapiens
tgctgccccgcttccccacagaa

SEQ ID NO: 3499425 - DNA, 16 bp, Homo sapiens
tgctgccggcacagct

SEQ ID NO: 3499426 - DNA, 18 bp, Homo sapiens
tgggaggtcaaggctgca

SEQ ID NO: 3499427 - DNA, 22 bp, Homo sapiens
tgggagttgatcgcctttccca

SEQ ID NO: 3499428 - DNA, 12 bp, Homo sapiens
tgggatagagaa

SEQ ID NO: 3499429 - DNA, 21 bp, Homo sapiens
tgggatcagggcattgcctgt

SEQ ID NO: 3499430 - DNA, 22 bp, Homo sapiens
tgggatccctgtctttcctaag

SEQ ID NO: 3499431 - DNA, 19 bp, Homo sapiens
tgggatgagagttttggat

SEQ ID NO: 3499432 - DNA, 16 bp, Homo sapiens
tgggatggtgggcttc

SEQ ID NO: 3499433 - DNA, 16 bp, Homo sapiens
tgggattgagtctgtg

SEQ ID NO: 3499434 - DNA, 16 bp, Homo sapiens
tgggcaacccccagcc

SEQ ID NO: 3499435 - DNA, 17 bp, Homo sapiens
tgggcaacccccagcct

SEQ ID NO: 3499436 - DNA, 16 bp, Homo sapiens
tgggcaatatagcaag

SEQ ID NO: 3499437 - DNA, 15 bp, Homo sapiens
tgggcacttccctgc

SEQ ID NO: 3499438 - DNA, 12 bp, Homo sapiens
tgggcagagctg

SEQ ID NO: 3499439 - DNA, 14 bp, Homo sapiens
tgggcagagctggc

SEQ ID NO: 3499440 - DNA, 18 bp, Homo sapiens
tgggcagagctggctctg

SEQ ID NO: 3499441 - DNA, 10 bp, Homo sapiens
tgggcagctc

SEQ ID NO: 3499442 - DNA, 19 bp, Homo sapiens
tgggcagctcatctctgtc

SEQ ID NO: 3499443 - DNA, 16 bp, Homo sapiens
tgggcagcttgagagg

SEQ ID NO: 3499444 - DNA, 21 bp, Homo sapiens
tgggcagggtctgtttggact

SEQ ID NO: 3499445 - DNA, 15 bp, Homo sapiens
tgggcatgtgggctt

SEQ ID NO: 3499446 - DNA, 23 bp, Homo sapiens
tgggccaacaaagaacactaact

SEQ ID NO: 3499447 - DNA, 16 bp, Homo sapiens
tgggccaagccagctg

SEQ ID NO: 3499448 - DNA, 17 bp, Homo sapiens
tgggccaagccagctgc

SEQ ID NO: 3499449 - DNA, 19 bp, Homo sapiens
tgggccaagccagctgcct

SEQ ID NO: 3499450 - DNA, 14 bp, Homo sapiens
tgggcccctggccc

SEQ ID NO: 3499451 - DNA, 13 bp, Homo sapiens
tgggccctctctg

SEQ ID NO: 3499452 - DNA, 13 bp, Homo sapiens
tgggccctctctt

SEQ ID NO: 3499453 - DNA, 14 bp, Homo sapiens
tgggccctgggctg

SEQ ID NO: 3499454 - DNA, 13 bp, Homo sapiens
tgggccgctgcca

SEQ ID NO: 3499455 - DNA, 14 bp, Homo sapiens
tgggccgctgccac

SEQ ID NO: 3499456 - DNA, 19 bp, Homo sapiens
tgggccgggcctggggctc

SEQ ID NO: 3499457 - DNA, 20 bp, Homo sapiens
tgggccgtatctccggctcc

SEQ ID NO: 3499458 - DNA, 21 bp, Homo sapiens
tgggccgtatctccggctccc

SEQ ID NO: 3499459 - DNA, 14 bp, Homo sapiens
tgggcctcctgtgt

SEQ ID NO: 3499460 - DNA, 22 bp, Homo sapiens
tgggcctcctgtgtgtgcgcct

SEQ ID NO: 3499461 - DNA, 13 bp, Homo sapiens
tgggcctgaactc

SEQ ID NO: 3499462 - DNA, 15 bp, Homo sapiens
tgggcctgctccaga

SEQ ID NO: 3499463 - DNA, 19 bp, Homo sapiens
tgggcctgctccagacctg

SEQ ID NO: 3499464 - DNA, 19 bp, Homo sapiens
tgggcgtacgctggtgctg

SEQ ID NO: 3499465 - DNA, 19 bp, Homo sapiens
tgggctagagtttccttat

SEQ ID NO: 3499466 - DNA, 20 bp, Homo sapiens
tgggctcaagcaatcctctc

SEQ ID NO: 3499467 - DNA, 15 bp, Homo sapiens
tgggctcctccaggg

SEQ ID NO: 3499468 - DNA, 16 bp, Homo sapiens
tgggctgggcccacaa

SEQ ID NO: 3499469 - DNA, 19 bp, Homo sapiens
tgggctgggggctatgtat

SEQ ID NO: 3499470 - DNA, 13 bp, Homo sapiens
tgggcttcagcct

SEQ ID NO: 3499471 - DNA, 13 bp, Homo sapiens
tgggcttcagggc

SEQ ID NO: 3499472 - DNA, 15 bp, Homo sapiens
tgggcttcagggcag

SEQ ID NO: 3499473 - DNA, 22 bp, Homo sapiens
tgggcttcagtggcagctgctt

SEQ ID NO: 3499474 - DNA, 21 bp, Homo sapiens
tgggcttcccagtggctgctg

SEQ ID NO: 3499475 - DNA, 13 bp, Homo sapiens
tgggcttgattct

SEQ ID NO: 3499476 - DNA, 11 bp, Homo sapiens
tggggaaggag

SEQ ID NO: 3499477 - DNA, 16 bp, Homo sapiens
tggggaaggagccagt

SEQ ID NO: 3499478 - DNA, 12 bp, Homo sapiens
tggggagaaagt

SEQ ID NO: 3499479 - DNA, 16 bp, Homo sapiens
tggggagccaacagaa

SEQ ID NO: 3499480 - DNA, 18 bp, Homo sapiens
tggggagggattctggtt

SEQ ID NO: 3499481 - DNA, 18 bp, Homo sapiens
tggggagttaagacctgg

SEQ ID NO: 3499482 - DNA, 15 bp, Homo sapiens
tggggatataatact

SEQ ID NO: 3499483 - DNA, 20 bp, Homo sapiens
tggggatccctcccccccat

SEQ ID NO: 3499484 - DNA, 15 bp, Homo sapiens
tggggcagctgagca

SEQ ID NO: 3499485 - DNA, 16 bp, Homo sapiens
tggggcagcttgaggg

SEQ ID NO: 3499486 - DNA, 18 bp, Homo sapiens
tggggccaccctggcccg

SEQ ID NO: 3499487 - DNA, 15 bp, Homo sapiens
tggggccagatccag

SEQ ID NO: 3499488 - DNA, 18 bp, Homo sapiens
tggggccttgatgactgc

SEQ ID NO: 3499489 - DNA, 22 bp, Homo sapiens
tggggctctctgagtcctggcc

SEQ ID NO: 3499490 - DNA, 13 bp, Homo sapiens
tggggctgcggga

SEQ ID NO: 3499491 - DNA, 16 bp, Homo sapiens
tggggctggttctgta

SEQ ID NO: 3499492 - DNA, 23 bp, Homo sapiens
tggggctttcgtccacagcttcc

SEQ ID NO: 3499493 - DNA, 15 bp, Homo sapiens
tgggggaaagcacag

SEQ ID NO: 3499494 - DNA, 14 bp, Homo sapiens
tgggggagagccgt

SEQ ID NO: 3499495 - DNA, 11 bp, Homo sapiens
tgggggagggc

SEQ ID NO: 3499496 - DNA, 16 bp, Homo sapiens
tgggggagggctgcga

SEQ ID NO: 3499497 - DNA, 20 bp, Homo sapiens
tgggggatcacagcctctga

SEQ ID NO: 3499498 - DNA, 16 bp, Homo sapiens
tgggggcctcagtgcc

SEQ ID NO: 3499499 - DNA, 23 bp, Homo sapiens
tgggggctctggccaagggccag

SEQ ID NO: 3499500 - DNA, 14 bp, Homo sapiens
tgggggtgccagga

SEQ ID NO: 3499501 - DNA, 13 bp, Homo sapiens
tgggggtgggcca

SEQ ID NO: 3499502 - DNA, 13 bp, Homo sapiens
tgggggtgggtca

SEQ ID NO: 3499503 - DNA, 15 bp, Homo sapiens
tgggggtgggtcaga

SEQ ID NO: 3499504 - DNA, 16 bp, Homo sapiens
tgggggttcaggcccg

SEQ ID NO: 3499505 - DNA, 20 bp, Homo sapiens
tggggtcatgccctcctctc

SEQ ID NO: 3499506 - DNA, 12 bp, Homo sapiens
tggggtcctggc

SEQ ID NO: 3499507 - DNA, 23 bp, Homo sapiens
tggggtctgtttctggaaatgtt

SEQ ID NO: 3499508 - DNA, 17 bp, Homo sapiens
tggggtggcctgtgtgg

SEQ ID NO: 3499509 - DNA, 13 bp, Homo sapiens
tggggtgtgctgg

SEQ ID NO: 3499510 - DNA, 19 bp, Homo sapiens
tgggtaaaattagatgcat

SEQ ID NO: 3499511 - DNA, 15 bp, Homo sapiens
tgggtaaatgcagcg

SEQ ID NO: 3499512 - DNA, 20 bp, Homo sapiens
tgggtacttgtggacacagc

SEQ ID NO: 3499513 - DNA, 23 bp, Homo sapiens
tgggtacttgtggacacagctct

SEQ ID NO: 3499514 - DNA, 14 bp, Homo sapiens
tgggtataaaagat

SEQ ID NO: 3499515 - DNA, 15 bp, Homo sapiens
tgggtataaaagatg

SEQ ID NO: 3499516 - DNA, 20 bp, Homo sapiens
tgggtatagttcatgtctgc

SEQ ID NO: 3499517 - DNA, 17 bp, Homo sapiens
tgggtattaccatgtaa

SEQ ID NO: 3499518 - DNA, 21 bp, Homo sapiens
tgggtattaccatgtaaataa

SEQ ID NO: 3499519 - DNA, 9 bp, Homo sapiens
tgggtcaga

SEQ ID NO: 3499520 - DNA, 17 bp, Homo sapiens
tgggtcagaaccctgcc

SEQ ID NO: 3499521 - DNA, 19 bp, Homo sapiens
tgggtcagaaccctgccat

SEQ ID NO: 3499522 - DNA, 20 bp, Homo sapiens
tgggtccaggggatgggagg

SEQ ID NO: 3499523 - DNA, 21 bp, Homo sapiens
tgggtccaggggatgggaggt

SEQ ID NO: 3499524 - DNA, 19 bp, Homo sapiens
tgggtcccggctctgtggg

SEQ ID NO: 3499525 - DNA, 15 bp, Homo sapiens
tgggtccttcctgaa

SEQ ID NO: 3499526 - DNA, 13 bp, Homo sapiens
tgggtcgggagag

SEQ ID NO: 3499527 - DNA, 16 bp, Homo sapiens
tgggtcgggagagggg

SEQ ID NO: 3499528 - DNA, 21 bp, Homo sapiens
tgggtcgggagaggggacgca

SEQ ID NO: 3499529 - DNA, 15 bp, Homo sapiens
tgggtctctctccat

SEQ ID NO: 3499530 - DNA, 21 bp, Homo sapiens
tgggtctgggagtcacacagt

SEQ ID NO: 3499531 - DNA, 17 bp, Homo sapiens
tgggtgacagagcaaga

SEQ ID NO: 3499532 - DNA, 13 bp, Homo sapiens
tgggtgagaacaa

SEQ ID NO: 3499533 - DNA, 20 bp, Homo sapiens
tgggtggcaccagcagcctg

SEQ ID NO: 3499534 - DNA, 21 bp, Homo sapiens
tgggtggcaccagcagcctgg

SEQ ID NO: 3499535 - DNA, 21 bp, Homo sapiens
tgggtggcccctgctgtctct

SEQ ID NO: 3499536 - DNA, 16 bp, Homo sapiens
tgggtgggcaggaaaa

SEQ ID NO: 3499537 - DNA, 18 bp, Homo sapiens
tgggtgggcaggaaaagg

SEQ ID NO: 3499538 - DNA, 21 bp, Homo sapiens
tgggtgtcaagagggtctgag

SEQ ID NO: 3499539 - DNA, 23 bp, Homo sapiens
tgggtgtcctgcctgtctgcccc

SEQ ID NO: 3499540 - DNA, 19 bp, Homo sapiens
tgggtgttcctggcagttt

SEQ ID NO: 3499541 - DNA, 23 bp, Homo sapiens
tgggttacagtatgcttgctcta

SEQ ID NO: 3499542 - DNA, 16 bp, Homo sapiens
tgggttcactgcaacc

SEQ ID NO: 3499543 - DNA, 16 bp, Homo sapiens
tgggttctgcctgcca

SEQ ID NO: 3499544 - DNA, 21 bp, Homo sapiens
tgggttgcagacaggaatctt

SEQ ID NO: 3499545 - DNA, 23 bp, Homo sapiens
tgggttgctgctgtccagtgcct

SEQ ID NO: 3499546 - DNA, 22 bp, Homo sapiens
tgggtttcacaagtgaaaaaca

SEQ ID NO: 3499547 - DNA, 15 bp, Homo sapiens
tggtaatcttgctct

SEQ ID NO: 3499548 - DNA, 14 bp, Homo sapiens
tggtaatgttagca

SEQ ID NO: 3499549 - DNA, 18 bp, Homo sapiens
tggtacaaaaataaattt

SEQ ID NO: 3499550 - DNA, 15 bp, Homo sapiens
tggtacaggtatatt

SEQ ID NO: 3499551 - DNA, 18 bp, Homo sapiens
tggtacggagatgtttca

SEQ ID NO: 3499552 - DNA, 20 bp, Homo sapiens
tggtactataaaagctttct

SEQ ID NO: 3499553 - DNA, 22 bp, Homo sapiens
tggtaggtactttttgtgaaga

SEQ ID NO: 3499554 - DNA, 16 bp, Homo sapiens
tggtagtaatttcctt

SEQ ID NO: 3499555 - DNA, 22 bp, Homo sapiens
tggtatgatgctgccggcacag

SEQ ID NO: 3499556 - DNA, 18 bp, Homo sapiens
tggtatgtgagctaggag

SEQ ID NO: 3499557 - DNA, 19 bp, Homo sapiens
tggtattcaggattacatg

SEQ ID NO: 3499558 - DNA, 16 bp, Homo sapiens
tggtattcctgcctcc

SEQ ID NO: 3499559 - DNA, 17 bp, Homo sapiens
tgtacgtctgacaggca

SEQ ID NO: 3499560 - DNA, 18 bp, Homo sapiens
tgtactaaagccaaacat

SEQ ID NO: 3499561 - DNA, 21 bp, Homo sapiens
tgtacttagggcagctggcct

SEQ ID NO: 3499562 - DNA, 23 bp, Homo sapiens
tgtacttgaagtctaaaagcaga

SEQ ID NO: 3499563 - DNA, 13 bp, Homo sapiens
tgtactttgtgct

SEQ ID NO: 3499564 - DNA, 16 bp, Homo sapiens
tgtagagagataccat

SEQ ID NO: 3499565 - DNA, 15 bp, Homo sapiens
tgtagagccagggtc

SEQ ID NO: 3499566 - DNA, 16 bp, Homo sapiens
tgtagagccagggtct

SEQ ID NO: 3499567 - DNA, 13 bp, Homo sapiens
tgtagagtgggag

SEQ ID NO: 3499568 - DNA, 17 bp, Homo sapiens
tgtagataatacagttc

SEQ ID NO: 3499569 - DNA, 16 bp, Homo sapiens
tgtagcaaccatttgt

SEQ ID NO: 3499570 - DNA, 19 bp, Homo sapiens
tgtagcacttactggtagg

SEQ ID NO: 3499571 - DNA, 16 bp, Homo sapiens
tgtagcagtgtaccca

SEQ ID NO: 3499572 - DNA, 16 bp, Homo sapiens
tgtagccacaccagga

SEQ ID NO: 3499573 - DNA, 18 bp, Homo sapiens
tgtagccacaccaggata

SEQ ID NO: 3499574 - DNA, 17 bp, Homo sapiens
tgtagccccctggcctc

SEQ ID NO: 3499575 - DNA, 18 bp, Homo sapiens
tgtagccccctggcctct

SEQ ID NO: 3499576 - DNA, 20 bp, Homo sapiens
tgtagctgctagctattggc

SEQ ID NO: 3499577 - DNA, 16 bp, Homo sapiens
tgtagcttttcacctt

SEQ ID NO: 3499578 - DNA, 12 bp, Homo sapiens
tgtaggagctgc

SEQ ID NO: 3499579 - DNA, 15 bp, Homo sapiens
tgtaggcagacacag

SEQ ID NO: 3499580 - DNA, 16 bp, Homo sapiens
tgtagggttacagaga

SEQ ID NO: 3499581 - DNA, 16 bp, Homo sapiens
tgtaggtgaacagtca

SEQ ID NO: 3499582 - DNA, 18 bp, Homo sapiens
tgtagtaattgacatgtg

SEQ ID NO: 3499583 - DNA, 20 bp, Homo sapiens
tgtagtaggcatttttacca

SEQ ID NO: 3499584 - DNA, 22 bp, Homo sapiens
tgtagtggttttaggatactta

SEQ ID NO: 3499585 - DNA, 19 bp, Homo sapiens
tgtagttgacaattctgca

SEQ ID NO: 3499586 - DNA, 16 bp, Homo sapiens
tgtataaaatgtaaca

SEQ ID NO: 3499587 - DNA, 20 bp, Homo sapiens
tgtataaaatgtaacactga

SEQ ID NO: 3499588 - DNA, 12 bp, Homo sapiens
tgtataaagtga

SEQ ID NO: 3499589 - DNA, 16 bp, Homo sapiens
tgtataaagtgattga

SEQ ID NO: 3499590 - DNA, 14 bp, Homo sapiens
tgtataagtaagaa

SEQ ID NO: 3499591 - DNA, 18 bp, Homo sapiens
tgtataagtaagaaaata

SEQ ID NO: 3499592 - DNA, 20 bp, Homo sapiens
tgtataagtaagaaaatatt

SEQ ID NO: 3499593 - DNA, 21 bp, Homo sapiens
tgtataagtggaggcacttta

SEQ ID NO: 3499594 - DNA, 17 bp, Homo sapiens
tgtatagttttccctat

SEQ ID NO: 3499595 - DNA, 13 bp, Homo sapiens
tgtatatactttt

SEQ ID NO: 3499596 - DNA, 14 bp, Homo sapiens
tgtatatatatgtg

SEQ ID NO: 3499597 - DNA, 12 bp, Homo sapiens
tgtatattcact

SEQ ID NO: 3499598 - DNA, 13 bp, Homo sapiens
tgtatattccttt

SEQ ID NO: 3499599 - DNA, 14 bp, Homo sapiens
tgtatattcctttg

SEQ ID NO: 3499600 - DNA, 13 bp, Homo sapiens
tgtatcataatta

SEQ ID NO: 3499601 - DNA, 14 bp, Homo sapiens
tgtatctagctcta

SEQ ID NO: 3499602 - DNA, 16 bp, Homo sapiens
tgtatctctttcacat

SEQ ID NO: 3499603 - DNA, 21 bp, Homo sapiens
tgtatctgcaggcagacacgg

SEQ ID NO: 3499604 - DNA, 22 bp, Homo sapiens
tgtatctgcaggcagacacgga

SEQ ID NO: 3499605 - DNA, 18 bp, Homo sapiens
tgtatgaaattataatct

SEQ ID NO: 3499606 - DNA, 17 bp, Homo sapiens
tgtatgactgcacatga

SEQ ID NO: 3499607 - DNA, 15 bp, Homo sapiens
tgtatgatttataaa

SEQ ID NO: 3499608 - DNA, 13 bp, Homo sapiens
tgtatgtctgtca

SEQ ID NO: 3499609 - DNA, 21 bp, Homo sapiens
tgtatgttattatattccgta

SEQ ID NO: 3499610 - DNA, 17 bp, Homo sapiens
tgtattaaaaaaaacaa

SEQ ID NO: 3499611 - DNA, 19 bp, Homo sapiens
tgtattaaaaaaaacaaaa

SEQ ID NO: 3499612 - DNA, 22 bp, Homo sapiens
tgtattaaaaaaaacaaaaaga

SEQ ID NO: 3499613 - DNA, 14 bp, Homo sapiens
tgtattacagatgc

SEQ ID NO: 3499614 - DNA, 14 bp, Homo sapiens
tgtattagatgttc

SEQ ID NO: 3499615 - DNA, 16 bp, Homo sapiens
tgtattagatgttctc

SEQ ID NO: 3499616 - DNA, 14 bp, Homo sapiens
tgtattcagacaga

SEQ ID NO: 3499617 - DNA, 18 bp, Homo sapiens
tgtattcagacagatgag

SEQ ID NO: 3499618 - DNA, 20 bp, Homo sapiens
tgtattcatatattgcattt

SEQ ID NO: 3499619 - DNA, 19 bp, Homo sapiens
tgtattctctgagctgtgc

SEQ ID NO: 3499620 - DNA, 13 bp, Homo sapiens
tgtattgtaaaaa

SEQ ID NO: 3499621 - DNA, 22 bp, Homo sapiens
tgtatttattcaataaagtatt

SEQ ID NO: 3499622 - DNA, 13 bp, Homo sapiens
tgtatttcttata

SEQ ID NO: 3499623 - DNA, 19 bp, Homo sapiens
tgtattttgtaaataataa

SEQ ID NO: 3499624 - DNA, 17 bp, Homo sapiens
tgtatttttaaagcatg

SEQ ID NO: 3499625 - DNA, 20 bp, Homo sapiens
tgtcaagagtagttatataa

SEQ ID NO: 3499626 - DNA, 16 bp, Homo sapiens
tgtcaagcctgtgcaa

SEQ ID NO: 3499627 - DNA, 18 bp, Homo sapiens
tgtcaagcctgtgcaaaa

SEQ ID NO: 3499628 - DNA, 14 bp, Homo sapiens
tgtcaagctgctct

SEQ ID NO: 3499629 - DNA, 18 bp, Homo sapiens
tgtcaaggctgcttagaa

SEQ ID NO: 3499630 - DNA, 18 bp, Homo sapiens
tgtcaagggcagaatgaa

SEQ ID NO: 3499631 - DNA, 16 bp, Homo sapiens
tgtcaagtctctgctg

SEQ ID NO: 3499632 - DNA, 16 bp, Homo sapiens
tgtcaatttctgtgtt

SEQ ID NO: 3499633 - DNA, 13 bp, Homo sapiens
tgtcacacacttt

SEQ ID NO: 3499634 - DNA, 17 bp, Homo sapiens
tgtcacacactttggct

SEQ ID NO: 3499635 - DNA, 15 bp, Homo sapiens
tgtcacaggcaggtc

SEQ ID NO: 3499636 - DNA, 17 bp, Homo sapiens
tgtcacaggcaggtcca

SEQ ID NO: 3499637 - DNA, 21 bp, Homo sapiens
tgtcacaggcaggtccagggt

SEQ ID NO: 3499638 - DNA, 17 bp, Homo sapiens
tgtcacagggactgaaa

SEQ ID NO: 3499639 - DNA, 13 bp, Homo sapiens
tgtcacctgaaga

SEQ ID NO: 3499640 - DNA, 16 bp, Homo sapiens
tgtcacgattgtcatc

SEQ ID NO: 3499641 - DNA, 17 bp, Homo sapiens
tgtcactcaaggcggtg

SEQ ID NO: 3499642 - DNA, 22 bp, Homo sapiens
tgtcactcaaggcggtgcttga

SEQ ID NO: 3499643 - DNA, 15 bp, Homo sapiens
tgtcactcaggctgg

SEQ ID NO: 3499644 - DNA, 15 bp, Homo sapiens
tgtcactcattgctg

SEQ ID NO: 3499645 - DNA, 21 bp, Homo sapiens
tgtcactcattgctgagcctc

SEQ ID NO: 3499646 - DNA, 19 bp, Homo sapiens
tgtcactgcttttggcctg

SEQ ID NO: 3499647 - DNA, 14 bp, Homo sapiens
tgtcacttcttcac

SEQ ID NO: 3499648 - DNA, 21 bp, Homo sapiens
tgtcagatgcccgagggaggg

SEQ ID NO: 3499649 - DNA, 23 bp, Homo sapiens
tgtcagcaaaaagcaaaatcatt

SEQ ID NO: 3499650 - DNA, 15 bp, Homo sapiens
tgtcagcatagaagt

SEQ ID NO: 3499651 - DNA, 20 bp, Homo sapiens
tgtcagccattgcacccagc

SEQ ID NO: 3499652 - DNA, 17 bp, Homo sapiens
tgtcagctctcatctga

SEQ ID NO: 3499653 - DNA, 20 bp, Homo sapiens
tgtcagctctcatctgaggc

SEQ ID NO: 3499654 - DNA, 19 bp, Homo sapiens
tgtcagctgaggctggggg

SEQ ID NO: 3499655 - DNA, 18 bp, Homo sapiens
tgtcaggtggggcagctt

SEQ ID NO: 3499656 - DNA, 20 bp, Homo sapiens
tgtcaggtggggcagcttga

SEQ ID NO: 3499657 - DNA, 16 bp, Homo sapiens
tgtcagtcacagccac

SEQ ID NO: 3499658 - DNA, 20 bp, Homo sapiens
tgtcagtggggctctctgag

SEQ ID NO: 3499659 - DNA, 16 bp, Homo sapiens
tgtcatatactgccat

SEQ ID NO: 3499660 - DNA, 22 bp, Homo sapiens
tgtcatgcttcatcattccctc

SEQ ID NO: 3499661 - DNA, 13 bp, Homo sapiens
tgtcattagcctg

SEQ ID NO: 3499662 - DNA, 20 bp, Homo sapiens
tgtcattagcctgagtagaa

SEQ ID NO: 3499663 - DNA, 20 bp, Homo sapiens
tgtcatttagttcagcatcc

SEQ ID NO: 3499664 - DNA, 21 bp, Homo sapiens
tgtcatttgagcagggctcag

SEQ ID NO: 3499665 - DNA, 22 bp, Homo sapiens
tgtcatttgagcagggctcagc

SEQ ID NO: 3499666 - DNA, 16 bp, Homo sapiens
tgtcatttgttaaaat

SEQ ID NO: 3499667 - DNA, 14 bp, Homo sapiens
tgtcattttgcact

SEQ ID NO: 3499668 - DNA, 17 bp, Homo sapiens
tgtccaaagcagggtct

SEQ ID NO: 3499669 - DNA, 15 bp, Homo sapiens
tgtccagcagtcact

SEQ ID NO: 3499670 - DNA, 17 bp, Homo sapiens
tgtccagcattgctgga

SEQ ID NO: 3499671 - DNA, 17 bp, Homo sapiens
tgtccagtgcctacatc

SEQ ID NO: 3499672 - DNA, 23 bp, Homo sapiens
tgtcccaaaaagaaaggagggga

SEQ ID NO: 3499673 - DNA, 18 bp, Homo sapiens
tgtccccctctgtccagg

SEQ ID NO: 3499674 - DNA, 16 bp, Homo sapiens
tgtccccttctctcat

SEQ ID NO: 3499675 - DNA, 12 bp, Homo sapiens
tgtcccttgctg

SEQ ID NO: 3499676 - DNA, 17 bp, Homo sapiens
tgtccggaatgccaccc

SEQ ID NO: 3499677 - DNA, 18 bp, Homo sapiens
tgtccggaggatattaaa

SEQ ID NO: 3499678 - DNA, 17 bp, Homo sapiens
tgtcctactctgtgtca

SEQ ID NO: 3499679 - DNA, 20 bp, Homo sapiens
tgtcctaggagtatcctcat

SEQ ID NO: 3499680 - DNA, 13 bp, Homo sapiens
tgtcctatgaatg

SEQ ID NO: 3499681 - DNA, 20 bp, Homo sapiens
tgtcctcaccatgatggggc

SEQ ID NO: 3499682 - DNA, 16 bp, Homo sapiens
tgtcctcttccctctc

SEQ ID NO: 3499683 - DNA, 15 bp, Homo sapiens
tgtcctgaaagcggc

SEQ ID NO: 3499684 - DNA, 20 bp, Homo sapiens
tgtcctgaaagcggctgcct

SEQ ID NO: 3499685 - DNA, 14 bp, Homo sapiens
tgtcctgcctgtct

SEQ ID NO: 3499686 - DNA, 17 bp, Homo sapiens
tgtcctgcctgtctgcc

SEQ ID NO: 3499687 - DNA, 20 bp, Homo sapiens
tgtcctgggagtgagctggt

SEQ ID NO: 3499688 - DNA, 17 bp, Homo sapiens
tgtcctgggcctgcaga

SEQ ID NO: 3499689 - DNA, 18 bp, Homo sapiens
tgtcctttaaaaaagaaa

SEQ ID NO: 3499690 - DNA, 12 bp, Homo sapiens
tgtcctttcctt

SEQ ID NO: 3499691 - DNA, 13 bp, Homo sapiens
tgtcctttctaga

SEQ ID NO: 3499692 - DNA, 15 bp, Homo sapiens
tttaaaaatcaactt

SEQ ID NO: 3499693 - DNA, 16 bp, Homo sapiens
tttaaaaatcaacttt

SEQ ID NO: 3499694 - DNA, 13 bp, Homo sapiens
tttaaaaatgtct

SEQ ID NO: 3499695 - DNA, 17 bp, Homo sapiens
tttaaaagatgctttta

SEQ ID NO: 3499696 - DNA, 15 bp, Homo sapiens
tttaaaataaactgt

SEQ ID NO: 3499697 - DNA, 18 bp, Homo sapiens
tttaaaataaactgtaaa

SEQ ID NO: 3499698 - DNA, 20 bp, Homo sapiens
tttaaaataaactgtaaact

SEQ ID NO: 3499699 - DNA, 23 bp, Homo sapiens
tttaaaataaactgtaaactaat

SEQ ID NO: 3499700 - DNA, 20 bp, Homo sapiens
tttaaaatggtttgtcctga

SEQ ID NO: 3499701 - DNA, 17 bp, Homo sapiens
tttaaaatgtaaagcca

SEQ ID NO: 3499702 - DNA, 12 bp, Homo sapiens
tttaaaatgtct

SEQ ID NO: 3499703 - DNA, 23 bp, Homo sapiens
tttaaacacacagatacacacac

SEQ ID NO: 3499704 - DNA, 19 bp, Homo sapiens
tttaaactacatcttgaaa

SEQ ID NO: 3499705 - DNA, 21 bp, Homo sapiens
tttaaatatatgctaagtctt

SEQ ID NO: 3499706 - DNA, 15 bp, Homo sapiens
tttaacaaaaaccaa

SEQ ID NO: 3499707 - DNA, 18 bp, Homo sapiens
tttaacaaaaagtgcttc

SEQ ID NO: 3499708 - DNA, 18 bp, Homo sapiens
tttaacagcatgacaaaa

SEQ ID NO: 3499709 - DNA, 13 bp, Homo sapiens
tttaacctctttt

SEQ ID NO: 3499710 - DNA, 20 bp, Homo sapiens
tttaactccctttttacact

SEQ ID NO: 3499711 - DNA, 21 bp, Homo sapiens
tttaactccctttttacactt

SEQ ID NO: 3499712 - DNA, 12 bp, Homo sapiens
tttaactctgtc

SEQ ID NO: 3499713 - DNA, 20 bp, Homo sapiens
tttaactgagggctgatctt

SEQ ID NO: 3499714 - DNA, 21 bp, Homo sapiens
tttaactggaaggctgctttc

SEQ ID NO: 3499715 - DNA, 15 bp, Homo sapiens
tttaactggtgaaga

SEQ ID NO: 3499716 - DNA, 18 bp, Homo sapiens
tttaactggtgaagagaa

SEQ ID NO: 3499717 - DNA, 23 bp, Homo sapiens
tttaagactctcgcatcttccca

SEQ ID NO: 3499718 - DNA, 14 bp, Homo sapiens
tttaagaggcaggg

SEQ ID NO: 3499719 - DNA, 15 bp, Homo sapiens
tttaagcaacatctt

SEQ ID NO: 3499720 - DNA, 18 bp, Homo sapiens
tttaagctgtttccatag

SEQ ID NO: 3499721 - DNA, 21 bp, Homo sapiens
tttaagtattgcatctgtata

SEQ ID NO: 3499722 - DNA, 18 bp, Homo sapiens
tttaagtattgtttcctg

SEQ ID NO: 3499723 - DNA, 19 bp, Homo sapiens
tttaagtgaaagtgaggaa

SEQ ID NO: 3499724 - DNA, 15 bp, Homo sapiens
tttaatataaagcct

SEQ ID NO: 3499725 - DNA, 23 bp, Homo sapiens
tttaatataaagtagtcctgtga

SEQ ID NO: 3499726 - DNA, 19 bp, Homo sapiens
tttaatcagttgtttaata

SEQ ID NO: 3499727 - DNA, 22 bp, Homo sapiens
tttaatccccagtaaaattgcc

SEQ ID NO: 3499728 - DNA, 13 bp, Homo sapiens
tttaatgcttaag

SEQ ID NO: 3499729 - DNA, 17 bp, Homo sapiens
tttaatgcttaagattt

SEQ ID NO: 3499730 - DNA, 21 bp, Homo sapiens
tttaatgtttaaaacatcatt

SEQ ID NO: 3499731 - DNA, 18 bp, Homo sapiens
tttaatgttttaaatgta

SEQ ID NO: 3499732 - DNA, 19 bp, Homo sapiens
tttaattagtgctaagtgt

SEQ ID NO: 3499733 - DNA, 20 bp, Homo sapiens
tttaattagtgctaagtgtg

SEQ ID NO: 3499734 - DNA, 16 bp, Homo sapiens
tttaattcatgtttct

SEQ ID NO: 3499735 - DNA, 23 bp, Homo sapiens
tttaattcatgtttcttaaatgg

SEQ ID NO: 3499736 - DNA, 21 bp, Homo sapiens
tttaattctgtcttgttcatt

SEQ ID NO: 3499737 - DNA, 14 bp, Homo sapiens
tttaatttagatat

SEQ ID NO: 3499738 - DNA, 18 bp, Homo sapiens
tttaatttagtaaatgtt

SEQ ID NO: 3499739 - DNA, 14 bp, Homo sapiens
tttaatttatgtaa

SEQ ID NO: 3499740 - DNA, 21 bp, Homo sapiens
tttaatttattaattgctttg

SEQ ID NO: 3499741 - DNA, 12 bp, Homo sapiens
tttacaaagtgt

SEQ ID NO: 3499742 - DNA, 22 bp, Homo sapiens
tttacaactcattccagatccc

SEQ ID NO: 3499743 - DNA, 15 bp, Homo sapiens
tttacaagccccccc

SEQ ID NO: 3499744 - DNA, 16 bp, Homo sapiens
tttacaattgaaatga

SEQ ID NO: 3499745 - DNA, 17 bp, Homo sapiens
tttacagatgaatgtat

SEQ ID NO: 3499746 - DNA, 19 bp, Homo sapiens
tttacaggatattccaaaa

SEQ ID NO: 3499747 - DNA, 17 bp, Homo sapiens
tttacagtacttgtctt

SEQ ID NO: 3499748 - DNA, 16 bp, Homo sapiens
tttacattacagaata

SEQ ID NO: 3499749 - DNA, 16 bp, Homo sapiens
tttacattgttgagct

SEQ ID NO: 3499750 - DNA, 16 bp, Homo sapiens
tttaccctctttgctg

SEQ ID NO: 3499751 - DNA, 13 bp, Homo sapiens
tttacggacaccc

SEQ ID NO: 3499752 - DNA, 14 bp, Homo sapiens
tttactacagctat

SEQ ID NO: 3499753 - DNA, 21 bp, Homo sapiens
tttactacagctatgaagaaa

SEQ ID NO: 3499754 - DNA, 15 bp, Homo sapiens
tttactatgcctgtg

SEQ ID NO: 3499755 - DNA, 14 bp, Homo sapiens
tttactattaacat

SEQ ID NO: 3499756 - DNA, 19 bp, Homo sapiens
tttactattaacatgatgt

SEQ ID NO: 3499757 - DNA, 21 bp, Homo sapiens
tttactcctcacacttactgt

SEQ ID NO: 3499758 - DNA, 16 bp, Homo sapiens
tttactgcagctttgt

SEQ ID NO: 3499759 - DNA, 20 bp, Homo sapiens
tttactgttgtacaatcatg

SEQ ID NO: 3499760 - DNA, 11 bp, Homo sapiens
tttacttaaac

SEQ ID NO: 3499761 - DNA, 12 bp, Homo sapiens
tttactttggcc

SEQ ID NO: 3499762 - DNA, 17 bp, Homo sapiens
tttactttttatttcta

SEQ ID NO: 3499763 - DNA, 19 bp, Homo sapiens
tttagaaaaagaacatgca

SEQ ID NO: 3499764 - DNA, 14 bp, Homo sapiens
tttagaaagcattt

SEQ ID NO: 3499765 - DNA, 12 bp, Homo sapiens
tttagacagagt

SEQ ID NO: 3499766 - DNA, 20 bp, Homo sapiens
tttagacttaatagaaacat

SEQ ID NO: 3499767 - DNA, 20 bp, Homo sapiens
tttagatggtggcacattcc

SEQ ID NO: 3499768 - DNA, 21 bp, Homo sapiens
tttagatggtggcacattcct

SEQ ID NO: 3499769 - DNA, 22 bp, Homo sapiens
tttagcagcagcctttaatgca

SEQ ID NO: 3499770 - DNA, 14 bp, Homo sapiens
tttagcccagtgtt

SEQ ID NO: 3499771 - DNA, 13 bp, Homo sapiens
tttaggaagtgtt

SEQ ID NO: 3499772 - DNA, 16 bp, Homo sapiens
tttagtgaacttgaaa

SEQ ID NO: 3499773 - DNA, 13 bp, Homo sapiens
tttagtggcttca

SEQ ID NO: 3499774 - DNA, 16 bp, Homo sapiens
tttagttactttagat

SEQ ID NO: 3499775 - DNA, 15 bp, Homo sapiens
tttagttttctctta

SEQ ID NO: 3499776 - DNA, 13 bp, Homo sapiens
tttataaaacttc

SEQ ID NO: 3499777 - DNA, 23 bp, Homo sapiens
tttataacaacgtctttttgttt

SEQ ID NO: 3499778 - DNA, 17 bp, Homo sapiens
tttataagaaaaacttt

SEQ ID NO: 3499779 - DNA, 13 bp, Homo sapiens
tttatacaaatta

SEQ ID NO: 3499780 - DNA, 16 bp, Homo sapiens
tttatacaatatcatc

SEQ ID NO: 3499781 - DNA, 15 bp, Homo sapiens
tttatagatcatttc

SEQ ID NO: 3499782 - DNA, 16 bp, Homo sapiens
tttatagatcatttct

SEQ ID NO: 3499783 - DNA, 17 bp, Homo sapiens
tttatataatatctaaa

SEQ ID NO: 3499784 - DNA, 22 bp, Homo sapiens
tttatataatatctaaagttat

SEQ ID NO: 3499785 - DNA, 17 bp, Homo sapiens
tttatatcccattttta

SEQ ID NO: 3499786 - DNA, 13 bp, Homo sapiens
tttatatgtacat

SEQ ID NO: 3499787 - DNA, 14 bp, Homo sapiens
tttatatgtcaaag

SEQ ID NO: 3499788 - DNA, 17 bp, Homo sapiens
tttatcacctcattctg

SEQ ID NO: 3499789 - DNA, 14 bp, Homo sapiens
tttatcagcaaaaa

SEQ ID NO: 3499790 - DNA, 17 bp, Homo sapiens
tttatccaaaatgtgta

SEQ ID NO: 3499791 - DNA, 22 bp, Homo sapiens
tttatccaaaatgtgtatttct

SEQ ID NO: 3499792 - DNA, 14 bp, Homo sapiens
tttatcttgtctct

SEQ ID NO: 3499793 - DNA, 18 bp, Homo sapiens
tttatctttgattctcct

SEQ ID NO: 3499794 - DNA, 18 bp, Homo sapiens
tttatgaaaggtttacat

SEQ ID NO: 3499795 - DNA, 19 bp, Homo sapiens
tttatgaaaggtttacatt

SEQ ID NO: 3499796 - DNA, 20 bp, Homo sapiens
tttatgaatgaaaaaacagt

SEQ ID NO: 3499797 - DNA, 17 bp, Homo sapiens
tttatgagaaagccttc

SEQ ID NO: 3499798 - DNA, 20 bp, Homo sapiens
tttatgagatgctggttttc

SEQ ID NO: 3499799 - DNA, 15 bp, Homo sapiens
tttatgatcagtgtt

SEQ ID NO: 3499800 - DNA, 16 bp, Homo sapiens
tttatgtgatcaattt

SEQ ID NO: 3499801 - DNA, 15 bp, Homo sapiens
tttattaaacagata

SEQ ID NO: 3499802 - DNA, 14 bp, Homo sapiens
tttattacctctga

SEQ ID NO: 3499803 - DNA, 20 bp, Homo sapiens
tttattacctctgatacctc

SEQ ID NO: 3499804 - DNA, 17 bp, Homo sapiens
tttattattttcacctg

SEQ ID NO: 3499805 - DNA, 15 bp, Homo sapiens
tttattcagcagact

SEQ ID NO: 3499806 - DNA, 23 bp, Homo sapiens
tttattgccttttaatttttaat

SEQ ID NO: 3499807 - DNA, 19 bp, Homo sapiens
tttatttaaattacaattt

SEQ ID NO: 3499808 - DNA, 20 bp, Homo sapiens
tttatttccactattttcaa

SEQ ID NO: 3499809 - DNA, 16 bp, Homo sapiens
tttatttctgcatatg

SEQ ID NO: 3499810 - DNA, 15 bp, Homo sapiens
tttatttgattaggt

SEQ ID NO: 3499811 - DNA, 16 bp, Homo sapiens
tttattttactagaaa

SEQ ID NO: 3499812 - DNA, 18 bp, Homo sapiens
tttcaaaaccttttgaaa

SEQ ID NO: 3499813 - DNA, 20 bp, Homo sapiens
tttcaaaatagaaaagttat

SEQ ID NO: 3499814 - DNA, 22 bp, Homo sapiens
tttcaaagcaattgaaatgcat

SEQ ID NO: 3499815 - DNA, 21 bp, Homo sapiens
tttcaaattggagcttcatgg

SEQ ID NO: 3499816 - DNA, 19 bp, Homo sapiens
tttcaacagtgaagacaga

SEQ ID NO: 3499817 - DNA, 22 bp, Homo sapiens
tttcaagagtctaatagtcttt

SEQ ID NO: 3499818 - DNA, 22 bp, Homo sapiens
tttcaagcagtcgtgcctgtgt

SEQ ID NO: 3499819 - DNA, 18 bp, Homo sapiens
tttcaaggatgtttttct

SEQ ID NO: 3499820 - DNA, 13 bp, Homo sapiens
tttcaagtttact

SEQ ID NO: 3499821 - DNA, 14 bp, Homo sapiens
tttcaatgacattt

SEQ ID NO: 3499822 - DNA, 16 bp, Homo sapiens
tttcaattctgtaggt

SEQ ID NO: 3499823 - DNA, 17 bp, Homo sapiens
tttcacagcaacatttt

SEQ ID NO: 3499824 - DNA, 22 bp, Homo sapiens
aatttgctggaacacaaagacc

SEQ ID NO: 3499825 - DNA, 16 bp, Homo sapiens
aatttggttctaatag

SEQ ID NO: 3499826 - DNA, 18 bp, Homo sapiens
aatttgttattttgcaac

SEQ ID NO: 3499827 - DNA, 23 bp, Homo sapiens
aattttaccctgaggtcactgct

SEQ ID NO: 3499828 - DNA, 13 bp, Homo sapiens
aattttacttttt

SEQ ID NO: 3499829 - DNA, 19 bp, Homo sapiens
aattttatctgtttcctga

SEQ ID NO: 3499830 - DNA, 14 bp, Homo sapiens
aattttcaaggcct

SEQ ID NO: 3499831 - DNA, 15 bp, Homo sapiens
aattttcaaggcctt

SEQ ID NO: 3499832 - DNA, 22 bp, Homo sapiens
aattttcaaggccttcagttta

SEQ ID NO: 3499833 - DNA, 21 bp, Homo sapiens
aattttctttttaataaaaag

SEQ ID NO: 3499834 - DNA, 21 bp, Homo sapiens
aattttgaataaataaatgta

SEQ ID NO: 3499835 - DNA, 17 bp, Homo sapiens
aattttgacttaatgtg

SEQ ID NO: 3499836 - DNA, 20 bp, Homo sapiens
aattttgctggaattcctaa

SEQ ID NO: 3499837 - DNA, 24 bp, Homo sapiens
aattttgttctctgggagaaaatc

SEQ ID NO: 3499838 - DNA, 17 bp, Homo sapiens
aatttttaaaataaact

SEQ ID NO: 3499839 - DNA, 21 bp, Homo sapiens
aatttttaaaataaactgtaa

SEQ ID NO: 3499840 - DNA, 14 bp, Homo sapiens
aatttttaatgatg

SEQ ID NO: 3499841 - DNA, 15 bp, Homo sapiens
aatttttttcaatat

SEQ ID NO: 3499842 - DNA, 13 bp, Homo sapiens
aatttttttctgc

SEQ ID NO: 3499843 - DNA, 14 bp, Homo sapiens
aatttttttctgca

SEQ ID NO: 3499844 - DNA, 16 bp, Homo sapiens
aatttttttctgcaca

SEQ ID NO: 3499845 - DNA, 20 bp, Homo sapiens
aatttttttctgcacagctt

SEQ ID NO: 3499846 - DNA, 12 bp, Homo sapiens
acaaaaataaat

SEQ ID NO: 3499847 - DNA, 14 bp, Homo sapiens
acaaaaataaattt

SEQ ID NO: 3499848 - DNA, 22 bp, Homo sapiens
acaaaaattatttttttttttg

SEQ ID NO: 3499849 - DNA, 17 bp, Homo sapiens
acaaaacaaaacaacat

SEQ ID NO: 3499850 - DNA, 15 bp, Homo sapiens
acaaaaccagctgct

SEQ ID NO: 3499851 - DNA, 23 bp, Homo sapiens
acaaaactacatgagaacaaaca

SEQ ID NO: 3499852 - DNA, 14 bp, Homo sapiens
acaaaactgcattt

SEQ ID NO: 3499853 - DNA, 18 bp, Homo sapiens
acaaaaggataatgaata

SEQ ID NO: 3499854 - DNA, 20 bp, Homo sapiens
acaaaatttgactaatttta

SEQ ID NO: 3499855 - DNA, 18 bp, Homo sapiens
acaaacaaaatttctatt

SEQ ID NO: 3499856 - DNA, 14 bp, Homo sapiens
acaaacatgaccct

SEQ ID NO: 3499857 - DNA, 12 bp, Homo sapiens
acaaacctgcct

SEQ ID NO: 3499858 - DNA, 22 bp, Homo sapiens
acaaactctctgaacccctccc

SEQ ID NO: 3499859 - DNA, 14 bp, Homo sapiens
acaaactcttcagt

SEQ ID NO: 3499860 - DNA, 13 bp, Homo sapiens
acaaactgtaaat

SEQ ID NO: 3499861 - DNA, 16 bp, Homo sapiens
acaaactgtaatacaa

SEQ ID NO: 3499862 - DNA, 13 bp, Homo sapiens
acaaacttttata

SEQ ID NO: 3499863 - DNA, 18 bp, Homo sapiens
acaaagaagacaacatta

SEQ ID NO: 3499864 - DNA, 14 bp, Homo sapiens
acaaagaattccaa

SEQ ID NO: 3499865 - DNA, 21 bp, Homo sapiens
acaaagatgggtgaaggctgg

SEQ ID NO: 3499866 - DNA, 11 bp, Homo sapiens
acaaagccaga

SEQ ID NO: 3499867 - DNA, 21 bp, Homo sapiens
acaaaggttccattcagtgca

SEQ ID NO: 3499868 - DNA, 13 bp, Homo sapiens
acaaagtgtgtat

SEQ ID NO: 3499869 - DNA, 19 bp, Homo sapiens
acaaagtgtgtattaaaaa

SEQ ID NO: 3499870 - DNA, 15 bp, Homo sapiens
acaaagttgtatgtg

SEQ ID NO: 3499871 - DNA, 17 bp, Homo sapiens
acaaatactcttaggaa

SEQ ID NO: 3499872 - DNA, 19 bp, Homo sapiens
acaaatatgcaaaaggttc

SEQ ID NO: 3499873 - DNA, 20 bp, Homo sapiens
acaaatctatttaattagga

SEQ ID NO: 3499874 - DNA, 15 bp, Homo sapiens
acaaatggtggagga

SEQ ID NO: 3499875 - DNA, 14 bp, Homo sapiens
acaaatgtaaacat

SEQ ID NO: 3499876 - DNA, 18 bp, Homo sapiens
acaaatgtaaacattttc

SEQ ID NO: 3499877 - DNA, 18 bp, Homo sapiens
acaaattacaaaaggctc

SEQ ID NO: 3499878 - DNA, 22 bp, Homo sapiens
acaaattagaaaatgttattta

SEQ ID NO: 3499879 - DNA, 14 bp, Homo sapiens
acaaattatttttg

SEQ ID NO: 3499880 - DNA, 12 bp, Homo sapiens
acaaattctgtt

SEQ ID NO: 3499881 - DNA, 16 bp, Homo sapiens
acaaattctgtttctt

SEQ ID NO: 3499882 - DNA, 15 bp, Homo sapiens
acaacattttgagaa

SEQ ID NO: 3499883 - DNA, 18 bp, Homo sapiens
acaacattttgagaacaa

SEQ ID NO: 3499884 - DNA, 14 bp, Homo sapiens
acaacgaggaagcc

SEQ ID NO: 3499885 - DNA, 15 bp, Homo sapiens
acaacgtctttttgt

SEQ ID NO: 3499886 - DNA, 13 bp, Homo sapiens
acaacgtgcattg

SEQ ID NO: 3499887 - DNA, 14 bp, Homo sapiens
acaacgtgcattgt

SEQ ID NO: 3499888 - DNA, 24 bp, Homo sapiens
acaactctactgttgcaaagcttc

SEQ ID NO: 3499889 - DNA, 19 bp, Homo sapiens
acaactggcaggcaggctc

SEQ ID NO: 3499890 - DNA, 20 bp, Homo sapiens
acaagaaactcaatgcacaa

SEQ ID NO: 3499891 - DNA, 19 bp, Homo sapiens
acaagaccaccacttcgaa

SEQ ID NO: 3499892 - DNA, 22 bp, Homo sapiens
acaagacccaagtagctgctac

SEQ ID NO: 3499893 - DNA, 16 bp, Homo sapiens
acaagacttcagtatg

SEQ ID NO: 3499894 - DNA, 20 bp, Homo sapiens
acaagatgccccagggatgg

SEQ ID NO: 3499895 - DNA, 12 bp, Homo sapiens
acaagcacaaag

SEQ ID NO: 3499896 - DNA, 19 bp, Homo sapiens
acaagccctaacttctgta

SEQ ID NO: 3499897 - DNA, 14 bp, Homo sapiens
acaagctaagagtt

SEQ ID NO: 3499898 - DNA, 23 bp, Homo sapiens
acaaggaaactttcctttaactc

SEQ ID NO: 3499899 - DNA, 23 bp, Homo sapiens
acaaggaaggaaaagaaagaaga

SEQ ID NO: 3499900 - DNA, 22 bp, Homo sapiens
acaaggatagatgctggcccag

SEQ ID NO: 3499901 - DNA, 17 bp, Homo sapiens
acaaggattgctactgt

SEQ ID NO: 3499902 - DNA, 11 bp, Homo sapiens
aaaaaaaagag

SEQ ID NO: 3499903 - DNA, 13 bp, Homo sapiens
aaaaaaacacaaa

SEQ ID NO: 3499904 - DNA, 10 bp, Homo sapiens
aaaaaaagaa

SEQ ID NO: 3499905 - DNA, 12 bp, Homo sapiens
aaaaaaagcata

SEQ ID NO: 3499906 - DNA, 11 bp, Homo sapiens
aaaaaaatagt

SEQ ID NO: 3499907 - DNA, 14 bp, Homo sapiens
aaaaaaatctgcag

SEQ ID NO: 3499908 - DNA, 13 bp, Homo sapiens
aaaaaaatgttgt

SEQ ID NO: 3499909 - DNA, 17 bp, Homo sapiens
aaaaaaccctatatgct

SEQ ID NO: 3499910 - DNA, 23 bp, Homo sapiens
aaaaaagtcaccattctgcattt

SEQ ID NO: 3499911 - DNA, 9 bp, Homo sapiens
aaaaaatag

SEQ ID NO: 3499912 - DNA, 16 bp, Homo sapiens
aaaaaatgtatatgca

SEQ ID NO: 3499913 - DNA, 11 bp, Homo sapiens
aaaaaatgttg

SEQ ID NO: 3499914 - DNA, 11 bp, Homo sapiens
aaaaacaaaaa

SEQ ID NO: 3499915 - DNA, 14 bp, Homo sapiens
aaaaacacaaaagt

SEQ ID NO: 3499916 - DNA, 13 bp, Homo sapiens
aaaaacatgtatg

SEQ ID NO: 3499917 - DNA, 22 bp, Homo sapiens
aaaaaccctatatgcttactgt

SEQ ID NO: 3499918 - DNA, 12 bp, Homo sapiens
aaaaactattaa

SEQ ID NO: 3499919 - DNA, 21 bp, Homo sapiens
aaaaacttagtgacaaaatag

SEQ ID NO: 3499920 - DNA, 22 bp, Homo sapiens
aaaaacttgtgctataaagcta

SEQ ID NO: 3499921 - DNA, 11 bp, Homo sapiens
aaaaagaaatg

SEQ ID NO: 3499922 - DNA, 22 bp, Homo sapiens
aaaaagatatattaaaaatata

SEQ ID NO: 3499923 - DNA, 17 bp, Homo sapiens
aaaaagcataaaaacat

SEQ ID NO: 3499924 - DNA, 19 bp, Homo sapiens
aaaaagcttccatgattct

SEQ ID NO: 3499925 - DNA, 12 bp, Homo sapiens
aaaaaggcagga

SEQ ID NO: 3499926 - DNA, 19 bp, Homo sapiens
aaaaagtttggttctgtgt

SEQ ID NO: 3499927 - DNA, 14 bp, Homo sapiens
aaaaatactcagat

SEQ ID NO: 3499928 - DNA, 18 bp, Homo sapiens
aaaaatactttttctaat

SEQ ID NO: 3499929 - DNA, 14 bp, Homo sapiens
aaaaatataaaact

SEQ ID NO: 3499930 - DNA, 12 bp, Homo sapiens
aaaaatatgtat

SEQ ID NO: 3499931 - DNA, 22 bp, Homo sapiens
aaaaatattttctctgtacttt

SEQ ID NO: 3499932 - DNA, 20 bp, Homo sapiens
aaaaatgcaaatcctatgtg

SEQ ID NO: 3499933 - DNA, 21 bp, Homo sapiens
aaaaatgcacaaacaatgcaa

SEQ ID NO: 3499934 - DNA, 18 bp, Homo sapiens
aaaaatgcccttaaatca

SEQ ID NO: 3499935 - DNA, 21 bp, Homo sapiens
aaaaatgtcttgctgttgaca

SEQ ID NO: 3499936 - DNA, 12 bp, Homo sapiens
aaaaatgtgtaa

SEQ ID NO: 3499937 - DNA, 20 bp, Homo sapiens
aaaaatgttttttcatgtgt

SEQ ID NO: 3499938 - DNA, 22 bp, Homo sapiens
aaaaattcagcaaaccattttt

SEQ ID NO: 3499939 - DNA, 23 bp, Homo sapiens
aaaaattttgtgacattccttct

SEQ ID NO: 3499940 - DNA, 17 bp, Homo sapiens
aaaacaaaaagaacaaa

SEQ ID NO: 3499941 - DNA, 22 bp, Homo sapiens
aaaacaaaatttgactaatttt

SEQ ID NO: 3499942 - DNA, 22 bp, Homo sapiens
aaaacaactatggatcagaata

SEQ ID NO: 3499943 - DNA, 17 bp, Homo sapiens
aaaacaatattgtttct

SEQ ID NO: 3499944 - DNA, 23 bp, Homo sapiens
aaaacacagacattctgccaggc

SEQ ID NO: 3499945 - DNA, 18 bp, Homo sapiens
aaaacaggtcaatacagt

SEQ ID NO: 3499946 - DNA, 13 bp, Homo sapiens
aaaacagtatctc

SEQ ID NO: 3499947 - DNA, 15 bp, Homo sapiens
aaaacattaagaaaa

SEQ ID NO: 3499948 - DNA, 15 bp, Homo sapiens
aaaaccaatgttctc

SEQ ID NO: 3499949 - DNA, 12 bp, Homo sapiens
aaaaccacccct

SEQ ID NO: 3499950 - DNA, 22 bp, Homo sapiens
aaaaccagctgctactcataag

SEQ ID NO: 3499951 - DNA, 11 bp, Homo sapiens
aaaaccaggcc

SEQ ID NO: 3499952 - DNA, 21 bp, Homo sapiens
aaaacctcatgacagccagag

SEQ ID NO: 3499953 - DNA, 23 bp, Homo sapiens
aaaacgccctcaagaacatgatg

SEQ ID NO: 3499954 - DNA, 21 bp, Homo sapiens
aaaactacaaatcaagtattt

SEQ ID NO: 3499955 - DNA, 22 bp, Homo sapiens
aaaactacaaccaatggaatgt

SEQ ID NO: 3499956 - DNA, 15 bp, Homo sapiens
aaaactattaaggat

SEQ ID NO: 3499957 - DNA, 20 bp, Homo sapiens
aaaactattcatgctaccca

SEQ ID NO: 3499958 - DNA, 21 bp, Homo sapiens
aaaactctacttaatccaatg

SEQ ID NO: 3499959 - DNA, 20 bp, Homo sapiens
aaaactgctgactgttttct

SEQ ID NO: 3499960 - DNA, 20 bp, Homo sapiens
aaaagaaagaagttattttc

SEQ ID NO: 3499961 - DNA, 14 bp, Homo sapiens
aaaagaaggaatat

SEQ ID NO: 3499962 - DNA, 15 bp, Homo sapiens
aaaagacactgcaga

SEQ ID NO: 3499963 - DNA, 19 bp, Homo sapiens
aaaagagtagaataacctt

SEQ ID NO: 3499964 - DNA, 15 bp, Homo sapiens
aaaagataatatttt

SEQ ID NO: 3499965 - DNA, 15 bp, Homo sapiens
aaaagatataagtgc

SEQ ID NO: 3499966 - DNA, 19 bp, Homo sapiens
aaaagatataagtgctgta

SEQ ID NO: 3499967 - DNA, 11 bp, Homo sapiens
aaaagatatat

SEQ ID NO: 3499968 - DNA, 21 bp, Homo sapiens
aaaagatggggtctgtaaaat

SEQ ID NO: 3499969 - DNA, 21 bp, Homo sapiens
aaaagcacactcatcccctca

SEQ ID NO: 3499970 - DNA, 21 bp, Homo sapiens
aaaagcctcaactagtcattt

SEQ ID NO: 3499971 - DNA, 22 bp, Homo sapiens
aaaagctccatttttagtgaaa

SEQ ID NO: 3499972 - DNA, 18 bp, Homo sapiens
aaaaggaagccaaagagt

SEQ ID NO: 3499973 - DNA, 15 bp, Homo sapiens
aaaaggatacataat

SEQ ID NO: 3499974 - DNA, 14 bp, Homo sapiens
aaaaggccaaacct

SEQ ID NO: 3499975 - DNA, 22 bp, Homo sapiens
aaaaggccaaacctctgttcag

SEQ ID NO: 3499976 - DNA, 18 bp, Homo sapiens
aaaaggtttacagaattt

SEQ ID NO: 3499977 - DNA, 20 bp, Homo sapiens
aaaagtattattttccaaaa

SEQ ID NO: 3499978 - DNA, 20 bp, Homo sapiens
aaaagtcaccattctgcatt

SEQ ID NO: 3499979 - DNA, 18 bp, Homo sapiens
aaaagtccaattttaatt

SEQ ID NO: 3499980 - DNA, 18 bp, Homo sapiens
aaaagtgcttcattcttt

SEQ ID NO: 3499981 - DNA, 18 bp, Homo sapiens
aaaagtgggcttgattct

SEQ ID NO: 3499982 - DNA, 23 bp, Homo sapiens
aaaagttaatgcttaagagggaa

SEQ ID NO: 3499983 - DNA, 11 bp, Homo sapiens
aaaagttcttt

SEQ ID NO: 3499984 - DNA, 14 bp, Homo sapiens
aaaagtttagaact

SEQ ID NO: 3499985 - DNA, 17 bp, Homo sapiens
aaaagtttgaggaatat

SEQ ID NO: 3499986 - DNA, 17 bp, Homo sapiens
aaaataaaaaccttcca

SEQ ID NO: 3499987 - DNA, 14 bp, Homo sapiens
aaaataaaacaaag

SEQ ID NO: 3499988 - DNA, 13 bp, Homo sapiens
aaaataaaacagt

SEQ ID NO: 3499989 - DNA, 18 bp, Homo sapiens
aaaataaaacagtatctc

SEQ ID NO: 3499990 - DNA, 17 bp, Homo sapiens
aaaataaagctgttctc

SEQ ID NO: 3499991 - DNA, 12 bp, Homo sapiens
aaaataaattta

SEQ ID NO: 3499992 - DNA, 16 bp, Homo sapiens
aaaataacttcaagca

SEQ ID NO: 3499993 - DNA, 23 bp, Homo sapiens
aaaataatactgctgagatacat

SEQ ID NO: 3499994 - DNA, 12 bp, Homo sapiens
aaaataatgtaa

SEQ ID NO: 3499995 - DNA, 12 bp, Homo sapiens
aaaatacacatg

SEQ ID NO: 3499996 - DNA, 21 bp, Homo sapiens
aaaatacagtttgtcacatga

SEQ ID NO: 3499997 - DNA, 15 bp, Homo sapiens
aaaatactccaaaga

SEQ ID NO: 3499998 - DNA, 13 bp, Homo sapiens
aaagacatctttc

SEQ ID NO: 3499999 - DNA, 20 bp, Homo sapiens
aaagacattgattcagcctg

SEQ ID NO: 3500000 - DNA, 20 bp, Homo sapiens
aaagactccagtactatttt

SEQ ID NO: 3500001 - DNA, 23 bp, Homo sapiens
aaagactccagtactattttaat

SEQ ID NO: 3500002 - DNA, 18 bp, Homo sapiens
aaagagcacttaagagaa

SEQ ID NO: 3500003 - DNA, 20 bp, Homo sapiens
aaagagcacttaagagaata

SEQ ID NO: 3500004 - DNA, 22 bp, Homo sapiens
aaagagctttcttcccgaaccc

SEQ ID NO: 3500005 - DNA, 22 bp, Homo sapiens
aaagagggtgagggccttctta

SEQ ID NO: 3500006 - DNA, 11 bp, Homo sapiens
aaagaggtttt

SEQ ID NO: 3500007 - DNA, 17 bp, Homo sapiens
aaagatataagtgctgt

SEQ ID NO: 3500008 - DNA, 19 bp, Homo sapiens
aaagatatattaaaaatat

SEQ ID NO: 3500009 - DNA, 19 bp, Homo sapiens
aaagatctgtcctcagcct

SEQ ID NO: 3500010 - DNA, 12 bp, Homo sapiens
aaagatgattga

SEQ ID NO: 3500011 - DNA, 17 bp, Homo sapiens
aaagatgcttctcactg

SEQ ID NO: 3500012 - DNA, 13 bp, Homo sapiens
aaagatgctttta

SEQ ID NO: 3500013 - DNA, 19 bp, Homo sapiens
aaagatgcttttaacagag

SEQ ID NO: 3500014 - DNA, 21 bp, Homo sapiens
aaagatggagtttacaaagat

SEQ ID NO: 3500015 - DNA, 19 bp, Homo sapiens
aaagatggggtctgtaaaa

SEQ ID NO: 3500016 - DNA, 19 bp, Homo sapiens
aaagatgggtgaaggctgg

SEQ ID NO: 3500017 - DNA, 23 bp, Homo sapiens
aaagatggtgtgggtgtcctgcc

SEQ ID NO: 3500018 - DNA, 13 bp, Homo sapiens
aaagatgtatata

SEQ ID NO: 3500019 - DNA, 23 bp, Homo sapiens
aaagatgtctctgcaaaccaaca

SEQ ID NO: 3500020 - DNA, 14 bp, Homo sapiens
aaagattttaatca

SEQ ID NO: 3500021 - DNA, 14 bp, Homo sapiens
aaagcaaaacaaaa

SEQ ID NO: 3500022 - DNA, 20 bp, Homo sapiens
aaagcacactcatcccctca

SEQ ID NO: 3500023 - DNA, 17 bp, Homo sapiens
aaagcacagatttgcat

SEQ ID NO: 3500024 - DNA, 17 bp, Homo sapiens
aaagcacttgaagaata

SEQ ID NO: 3500025 - DNA, 21 bp, Homo sapiens
aaagcaggggagtatgcaaaa

SEQ ID NO: 3500026 - DNA, 17 bp, Homo sapiens
aaagcagtaactgacaa

SEQ ID NO: 3500027 - DNA, 14 bp, Homo sapiens
aaagcatgttgtga

SEQ ID NO: 3500028 - DNA, 14 bp, Homo sapiens
aaagcatttgaatg

SEQ ID NO: 3500029 - DNA, 22 bp, Homo sapiens
aaagcatttgaatgcattttgt

SEQ ID NO: 3500030 - DNA, 15 bp, Homo sapiens
aaagccaaagctagg

SEQ ID NO: 3500031 - DNA, 17 bp, Homo sapiens
aaagccaaggtgtcatt

SEQ ID NO: 3500032 - DNA, 23 bp, Homo sapiens
aaagccaagtttatatacaatta

SEQ ID NO: 3500033 - DNA, 21 bp, Homo sapiens
aaagccagcgtcctcctctgt

SEQ ID NO: 3500034 - DNA, 18 bp, Homo sapiens
aaagcccaagggatctgg

SEQ ID NO: 3500035 - DNA, 23 bp, Homo sapiens
aaagcccaagggatctggtccta

SEQ ID NO: 3500036 - DNA, 22 bp, Homo sapiens
aaagccctgtcgggctttgtgt

SEQ ID NO: 3500037 - DNA, 11 bp, Homo sapiens
aaagccttctt

SEQ ID NO: 3500038 - DNA, 16 bp, Homo sapiens
aaagcggctgcctcca

SEQ ID NO: 3500039 - DNA, 18 bp, Homo sapiens
aaagctaaagtatctgta

SEQ ID NO: 3500040 - DNA, 20 bp, Homo sapiens
aaagctagtgtacctcctct

SEQ ID NO: 3500041 - DNA, 23 bp, Homo sapiens
aaagctagtgtacctcctctcag

SEQ ID NO: 3500042 - DNA, 13 bp, Homo sapiens
aaagctcaagatg

SEQ ID NO: 3500043 - DNA, 13 bp, Homo sapiens
aaagctgctgaca

SEQ ID NO: 3500044 - DNA, 17 bp, Homo sapiens
aaagctgtattttgaaa

SEQ ID NO: 3500045 - DNA, 17 bp, Homo sapiens
aaaggaaatctcacccc

SEQ ID NO: 3500046 - DNA, 14 bp, Homo sapiens
aaaggaacactgac

SEQ ID NO: 3500047 - DNA, 13 bp, Homo sapiens
aaaggaacatttt

SEQ ID NO: 3500048 - DNA, 12 bp, Homo sapiens
aaaggaagccaa

SEQ ID NO: 3500049 - DNA, 21 bp, Homo sapiens
aaaggaatccactcccaggca

SEQ ID NO: 3500050 - DNA, 20 bp, Homo sapiens
aaaggagcatttttttattc

SEQ ID NO: 3500051 - DNA, 22 bp, Homo sapiens
aaaggagcatttttttattcag

SEQ ID NO: 3500052 - DNA, 23 bp, Homo sapiens
aaaggagcccttatctgtgctca

SEQ ID NO: 3500053 - DNA, 16 bp, Homo sapiens
aaaggagtcaaaacta

SEQ ID NO: 3500054 - DNA, 16 bp, Homo sapiens
aaaggatactgtaaca

SEQ ID NO: 3500055 - DNA, 18 bp, Homo sapiens
aaaggatctttgtggcca

SEQ ID NO: 3500056 - DNA, 14 bp, Homo sapiens
aaaggcaagcactt

SEQ ID NO: 3500057 - DNA, 20 bp, Homo sapiens
aaaggcacctataaaacagg

SEQ ID NO: 3500058 - DNA, 16 bp, Homo sapiens
aaaggcagtattttgt

SEQ ID NO: 3500059 - DNA, 20 bp, Homo sapiens
aaaggccaaacctctgttca

SEQ ID NO: 3500060 - DNA, 21 bp, Homo sapiens
aaaggccttcagacacatgct

SEQ ID NO: 3500061 - DNA, 12 bp, Homo sapiens
aaaggcctttaa

SEQ ID NO: 3500062 - DNA, 17 bp, Homo sapiens
aaaggcctttaaaattt

SEQ ID NO: 3500063 - DNA, 16 bp, Homo sapiens
aaaggctcgattttgt

SEQ ID NO: 3500064 - DNA, 18 bp, Homo sapiens
aaaggctcgattttgtat

SEQ ID NO: 3500065 - DNA, 23 bp, Homo sapiens
aaaggctcgattttgtatctgca

SEQ ID NO: 3500066 - DNA, 16 bp, Homo sapiens
aaaggctgaaaagaag

SEQ ID NO: 3500067 - DNA, 20 bp, Homo sapiens
aaagggcccagagagggtgg

SEQ ID NO: 3500068 - DNA, 22 bp, Homo sapiens
aaaggggatggagtgagcccat

SEQ ID NO: 3500069 - DNA, 23 bp, Homo sapiens
aaaggggtcggctgaccatgctc

SEQ ID NO: 3500070 - DNA, 15 bp, Homo sapiens
aaaggtaaaacaaaa

SEQ ID NO: 3500071 - DNA, 14 bp, Homo sapiens
aaaggtgatatcca

SEQ ID NO: 3500072 - DNA, 19 bp, Homo sapiens
aaaggtggactggaagggg

SEQ ID NO: 3500073 - DNA, 19 bp, Homo sapiens
aaaggtttgcattctcaca

SEQ ID NO: 3500074 - DNA, 14 bp, Homo sapiens
aaagtactagctaa

SEQ ID NO: 3500075 - DNA, 20 bp, Homo sapiens
aaagtacttctccaccctgc

SEQ ID NO: 3500076 - DNA, 16 bp, Homo sapiens
aaagtagtcctgtgaa

SEQ ID NO: 3500077 - DNA, 14 bp, Homo sapiens
aaagtatagaaata

SEQ ID NO: 3500078 - DNA, 17 bp, Homo sapiens
aaagtattattttccaa

SEQ ID NO: 3500079 - DNA, 14 bp, Homo sapiens
aaagtattgtaaat

SEQ ID NO: 3500080 - DNA, 16 bp, Homo sapiens
aaagtattgtaaatta

SEQ ID NO: 3500081 - DNA, 20 bp, Homo sapiens
aaagtattgtaaattatatt

SEQ ID NO: 3500082 - DNA, 21 bp, Homo sapiens
aaagtattgtaaattatattt

SEQ ID NO: 3500083 - DNA, 19 bp, Homo sapiens
aaagtatttaattagtgct

SEQ ID NO: 3500084 - DNA, 23 bp, Homo sapiens
aaagtatttaattagtgctaagt

SEQ ID NO: 3500085 - DNA, 22 bp, Homo sapiens
aaagtcaccattctgcatttag

SEQ ID NO: 3500086 - DNA, 14 bp, Homo sapiens
aaagtcattggctt

SEQ ID NO: 3500087 - DNA, 21 bp, Homo sapiens
aaagtcattggctttatcctc

SEQ ID NO: 3500088 - DNA, 19 bp, Homo sapiens
aaagtccaattttaattta

SEQ ID NO: 3500089 - DNA, 22 bp, Homo sapiens
aaagtcctttttttccatcttt

SEQ ID NO: 3500090 - DNA, 20 bp, Homo sapiens
aaagtgaaagtccagaaact

SEQ ID NO: 3500091 - DNA, 18 bp, Homo sapiens
aaagtgaattgttgacaa

SEQ ID NO: 3500092 - DNA, 22 bp, Homo sapiens
aaagtgacagagacccagatct

SEQ ID NO: 3500093 - DNA, 13 bp, Homo sapiens
aaagtggaaaaat

SEQ ID NO: 3500094 - DNA, 20 bp, Homo sapiens
aaagtggaaaacaaggaagt

SEQ ID NO: 3500095 - DNA, 16 bp, Homo sapiens
aaagtggcctctttgt

SEQ ID NO: 3500096 - DNA, 17 bp, Homo sapiens
aaagtgggcttgattct

SEQ ID NO: 3500097 - DNA, 23 bp, Homo sapiens
aaagtggtaggtactttttgtga

SEQ ID NO: 3500098 - DNA, 17 bp, Homo sapiens
aaagtgtcttttgacat

SEQ ID NO: 3500099 - DNA, 23 bp, Homo sapiens
aaagtgtgctttatgctgaaaca

SEQ ID NO: 3500100 - DNA, 13 bp, Homo sapiens
aaagtgtgtatta

SEQ ID NO: 3500101 - DNA, 15 bp, Homo sapiens
aaagtgtgtattaaa

SEQ ID NO: 3500102 - DNA, 22 bp, Homo sapiens
aaagtgtgtattaaaaaaaaca

SEQ ID NO: 3500103 - DNA, 23 bp, Homo sapiens
aaagtgtgtattaaaaaaaacaa

SEQ ID NO: 3500104 - DNA, 13 bp, Homo sapiens
aaagtgtttagct

SEQ ID NO: 3500105 - DNA, 16 bp, Homo sapiens
aaagtgttttgtacca

SEQ ID NO: 3500106 - DNA, 17 bp, Homo sapiens
aaagtgttttgtaccag

SEQ ID NO: 3500107 - DNA, 22 bp, Homo sapiens
aaagttaatgcttaagagggaa

SEQ ID NO: 3500108 - DNA, 21 bp, Homo sapiens
aaagttactaggtaacttcat

SEQ ID NO: 3500109 - DNA, 18 bp, Homo sapiens
aaagttagcctttgaatg

SEQ ID NO: 3500110 - DNA, 13 bp, Homo sapiens
aaagttatatttc

SEQ ID NO: 3500111 - DNA, 14 bp, Homo sapiens
aaagttatatttca

SEQ ID NO: 3500112 - DNA, 22 bp, Homo sapiens
aaagttatatttcagatgtaat

SEQ ID NO: 3500113 - DNA, 21 bp, Homo sapiens
aaagttctgtactcaaatgta

SEQ ID NO: 3500114 - DNA, 18 bp, Homo sapiens
aaagttgccattattcta

SEQ ID NO: 3500115 - DNA, 12 bp, Homo sapiens
aaagttgtacat

SEQ ID NO: 3500116 - DNA, 17 bp, Homo sapiens
aaagttgtacatgaaat

SEQ ID NO: 3500117 - DNA, 13 bp, Homo sapiens
aaataaaacaaag

SEQ ID NO: 3500118 - DNA, 13 bp, Homo sapiens
aaataaaattatg

SEQ ID NO: 3500119 - DNA, 17 bp, Homo sapiens
aaataaactgtaaacta

SEQ ID NO: 3500120 - DNA, 14 bp, Homo sapiens
aaataaagagagaa

SEQ ID NO: 3500121 - DNA, 12 bp, Homo sapiens
aaataaagccct

SEQ ID NO: 3500122 - DNA, 20 bp, Homo sapiens
aaataaagtttgcttagaaa

SEQ ID NO: 3500123 - DNA, 13 bp, Homo sapiens
aaataaattgtat

SEQ ID NO: 3500124 - DNA, 18 bp, Homo sapiens
aaataaattgtatattca

SEQ ID NO: 3500125 - DNA, 20 bp, Homo sapiens
aaataaattgtatattcact

SEQ ID NO: 3500126 - DNA, 21 bp, Homo sapiens
aaataacacacatataaacat

SEQ ID NO: 3500127 - DNA, 16 bp, Homo sapiens
aaataacttcaagcaa

SEQ ID NO: 3500128 - DNA, 24 bp, Homo sapiens
aaataagaaacaactctttgagaa

SEQ ID NO: 3500129 - DNA, 17 bp, Homo sapiens
aaataagaatagaaata

SEQ ID NO: 3500130 - DNA, 19 bp, Homo sapiens
aaataagttttttttctgg

SEQ ID NO: 3500131 - DNA, 15 bp, Homo sapiens
aaatacaaaaatact

SEQ ID NO: 3500132 - DNA, 15 bp, Homo sapiens
aaatacaaaacttcc

SEQ ID NO: 3500133 - DNA, 13 bp, Homo sapiens
aaatacatgacat

SEQ ID NO: 3500134 - DNA, 19 bp, Homo sapiens
aaatacttttccttacctt

SEQ ID NO: 3500135 - DNA, 16 bp, Homo sapiens
aaatactttttctaat

SEQ ID NO: 3500136 - DNA, 18 bp, Homo sapiens
aaatactttttctaatga

SEQ ID NO: 3500137 - DNA, 16 bp, Homo sapiens
aaatagaaaagttatt

SEQ ID NO: 3500138 - DNA, 17 bp, Homo sapiens
aaatagaaaagttatta

SEQ ID NO: 3500139 - DNA, 17 bp, Homo sapiens
aaatagagtatatgcac

SEQ ID NO: 3500140 - DNA, 13 bp, Homo sapiens
aaatagattaggt

SEQ ID NO: 3500141 - DNA, 21 bp, Homo sapiens
aaatagtgacataatatattc

SEQ ID NO: 3500142 - DNA, 14 bp, Homo sapiens
aaatataagaataa

SEQ ID NO: 3500143 - DNA, 15 bp, Homo sapiens
aaatatataaatata

SEQ ID NO: 3500144 - DNA, 10 bp, Homo sapiens
aaatatatat

SEQ ID NO: 3500145 - DNA, 14 bp, Homo sapiens
aaatatatataaac

SEQ ID NO: 3500146 - DNA, 15 bp, Homo sapiens
aaatatatatatgta

SEQ ID NO: 3500147 - DNA, 12 bp, Homo sapiens
aaatatatatta

SEQ ID NO: 3500148 - DNA, 15 bp, Homo sapiens
aaatatatattattc

SEQ ID NO: 3500149 - DNA, 18 bp, Homo sapiens
aaatatatattattctca

SEQ ID NO: 3500150 - DNA, 20 bp, Homo sapiens
aaatatatattattctcatt

SEQ ID NO: 3500151 - DNA, 21 bp, Homo sapiens
aaatatatattattctcattt

SEQ ID NO: 3500152 - DNA, 14 bp, Homo sapiens
aaatatatgtattt

SEQ ID NO: 3500153 - DNA, 10 bp, Homo sapiens
aaatatgcaa

SEQ ID NO: 3500154 - DNA, 20 bp, Homo sapiens
aaatatggacacttaatact

SEQ ID NO: 3500155 - DNA, 21 bp, Homo sapiens
aaatatgtatttaccaaaaat

SEQ ID NO: 3500156 - DNA, 13 bp, Homo sapiens
aaatattattgaa

SEQ ID NO: 3500157 - DNA, 13 bp, Homo sapiens
aaatattcttagg

SEQ ID NO: 3500158 - DNA, 20 bp, Homo sapiens
aaatattggtgttgtcagta

SEQ ID NO: 3500159 - DNA, 11 bp, Homo sapiens
aaatattttct

SEQ ID NO: 3500160 - DNA, 13 bp, Homo sapiens
aaatattttctat

SEQ ID NO: 3500161 - DNA, 17 bp, Homo sapiens
aaatattttctatttta

SEQ ID NO: 3500162 - DNA, 21 bp, Homo sapiens
aaatattttctctgtactttt

SEQ ID NO: 3500163 - DNA, 14 bp, Homo sapiens
aaatattttggatg

SEQ ID NO: 3500164 - DNA, 15 bp, Homo sapiens
aaatattttgtctaa

SEQ ID NO: 3500165 - DNA, 22 bp, Homo sapiens
aaatattttgtctaaaatgcct

SEQ ID NO: 3500166 - DNA, 12 bp, Homo sapiens
aaatatttttgg

SEQ ID NO: 3500167 - DNA, 18 bp, Homo sapiens
aaatcaacttgcttatca

SEQ ID NO: 3500168 - DNA, 12 bp, Homo sapiens
aaatcaactttt

SEQ ID NO: 3500169 - DNA, 23 bp, Homo sapiens
aaatcaactttttattgccttct

SEQ ID NO: 3500170 - DNA, 18 bp, Homo sapiens
aaatcacatccttatcct

SEQ ID NO: 3500171 - DNA, 20 bp, Homo sapiens
aaatcagccaattatgttaa

SEQ ID NO: 3500172 - DNA, 18 bp, Homo sapiens
aaatcagcctgctccagc

SEQ ID NO: 3500173 - DNA, 19 bp, Homo sapiens
aaatcagcctgctccagct

SEQ ID NO: 3500174 - DNA, 11 bp, Homo sapiens
aaatcatcaag

SEQ ID NO: 3500175 - DNA, 13 bp, Homo sapiens
aaatcatcaagaa

SEQ ID NO: 3500176 - DNA, 14 bp, Homo sapiens
aaatcatcaagaag

SEQ ID NO: 3500177 - DNA, 23 bp, Homo sapiens
aaatcatgttgatcatgtacttt

SEQ ID NO: 3500178 - DNA, 16 bp, Homo sapiens
aaatcattttatatgt

SEQ ID NO: 3500179 - DNA, 20 bp, Homo sapiens
aaatcattttatatgtcaaa

SEQ ID NO: 3500180 - DNA, 18 bp, Homo sapiens
aaatcccttacctcggtg

SEQ ID NO: 3500181 - DNA, 15 bp, Homo sapiens
aaatccgaacctcct

SEQ ID NO: 3500182 - DNA, 21 bp, Homo sapiens
aaatccgaacctcctctgtga

SEQ ID NO: 3500183 - DNA, 15 bp, Homo sapiens
aaatccttcccaagt

SEQ ID NO: 3500184 - DNA, 22 bp, Homo sapiens
aaatcggatctggggctctggg

SEQ ID NO: 3500185 - DNA, 23 bp, Homo sapiens
aaatcggatctggggctctggga

SEQ ID NO: 3500186 - DNA, 22 bp, Homo sapiens
aaatctatttaattaggaaaaa

SEQ ID NO: 3500187 - DNA, 18 bp, Homo sapiens
aaatctggcttctggcca

SEQ ID NO: 3500188 - DNA, 21 bp, Homo sapiens
aaatctggcttctggccagga

SEQ ID NO: 3500189 - DNA, 13 bp, Homo sapiens
aaatcttgaaatt

SEQ ID NO: 3500190 - DNA, 14 bp, Homo sapiens
aaatgaaggtcttt

SEQ ID NO: 3500191 - DNA, 19 bp, Homo sapiens
aaatgactaaaaaacaaag

SEQ ID NO: 3500192 - DNA, 13 bp, Homo sapiens
aaatgagcctggc

SEQ ID NO: 3500193 - DNA, 17 bp, Homo sapiens
aaatgaggtcagagcct

SEQ ID NO: 3500194 - DNA, 15 bp, Homo sapiens
aaatgattagaagta

SEQ ID NO: 3500195 - DNA, 14 bp, Homo sapiens
aaatgcaaatccta

SEQ ID NO: 3500196 - DNA, 13 bp, Homo sapiens
aaatgcatttata

SEQ ID NO: 3500197 - DNA, 14 bp, Homo sapiens
aaatgctttagaaa

SEQ ID NO: 3500198 - DNA, 18 bp, Homo sapiens
aaatgctttttatttctg

SEQ ID NO: 3500199 - DNA, 15 bp, Homo sapiens
aaatggaagacacat

SEQ ID NO: 3500200 - DNA, 18 bp, Homo sapiens
aaatggaagacacattga

SEQ ID NO: 3500201 - DNA, 15 bp, Homo sapiens
aaatggagaagctct

SEQ ID NO: 3500202 - DNA, 19 bp, Homo sapiens
aaatggagaagctctgttt

SEQ ID NO: 3500203 - DNA, 11 bp, Homo sapiens
aaatggcctca

SEQ ID NO: 3500204 - DNA, 21 bp, Homo sapiens
aaatggccttcccgccggagg

SEQ ID NO: 3500205 - DNA, 23 bp, Homo sapiens
aaatggctgcatcccccccacct

SEQ ID NO: 3500206 - DNA, 19 bp, Homo sapiens
aaatggttgtattagatgt

SEQ ID NO: 3500207 - DNA, 22 bp, Homo sapiens
aaatggttgtattagatgttct

SEQ ID NO: 3500208 - DNA, 15 bp, Homo sapiens
aaatgtaaacatttt

SEQ ID NO: 3500209 - DNA, 20 bp, Homo sapiens
aaatgtagaatattcagaca

SEQ ID NO: 3500210 - DNA, 15 bp, Homo sapiens
aaatgtatatgcact

SEQ ID NO: 3500211 - DNA, 17 bp, Homo sapiens
aaatgtcacagaagcag

SEQ ID NO: 3500212 - DNA, 19 bp, Homo sapiens
aaatgtctgggaagccctc

SEQ ID NO: 3500213 - DNA, 12 bp, Homo sapiens
aaatgtcttgct

SEQ ID NO: 3500214 - DNA, 22 bp, Homo sapiens
aaatgtcttgctgttgacatat

SEQ ID NO: 3500215 - DNA, 23 bp, Homo sapiens
aaatgtcttgctgttgacatatt

SEQ ID NO: 3500216 - DNA, 13 bp, Homo sapiens
aaatgtgatgaat

SEQ ID NO: 3500217 - DNA, 10 bp, Homo sapiens
aaatgtgtaa

SEQ ID NO: 3500218 - DNA, 13 bp, Homo sapiens
aaatgtgtatttt

SEQ ID NO: 3500219 - DNA, 21 bp, Homo sapiens
aaatgttatcttatactgtac

SEQ ID NO: 3500220 - DNA, 13 bp, Homo sapiens
aaatgttcacttt

SEQ ID NO: 3500221 - DNA, 16 bp, Homo sapiens
aaatgttctttagatg

SEQ ID NO: 3500222 - DNA, 21 bp, Homo sapiens
aaatgttgaaaagtcaaactg

SEQ ID NO: 3500223 - DNA, 19 bp, Homo sapiens
aaatgttgagaatcccaaa

SEQ ID NO: 3500224 - DNA, 17 bp, Homo sapiens
aaatgtttaaacatttt

SEQ ID NO: 3500225 - DNA, 21 bp, Homo sapiens
aaatgttttctggggaaaggg

SEQ ID NO: 3500226 - DNA, 17 bp, Homo sapiens
aaattacaaaaggctcg

SEQ ID NO: 3500227 - DNA, 14 bp, Homo sapiens
aaattacaatttta

SEQ ID NO: 3500228 - DNA, 20 bp, Homo sapiens
aaattactcaggaagaacac

SEQ ID NO: 3500229 - DNA, 11 bp, Homo sapiens
aaattagaaaa

SEQ ID NO: 3500230 - DNA, 16 bp, Homo sapiens
aaattagatgcatgtt

SEQ ID NO: 3500231 - DNA, 16 bp, Homo sapiens
aaattagggagctctt

SEQ ID NO: 3500232 - DNA, 18 bp, Homo sapiens
aaattaggtattttgtcc

SEQ ID NO: 3500233 - DNA, 18 bp, Homo sapiens
aaattattaatttatgca

SEQ ID NO: 3500234 - DNA, 13 bp, Homo sapiens
aaattatttgcat

SEQ ID NO: 3500235 - DNA, 19 bp, Homo sapiens
aaattatttttttttttgt

SEQ ID NO: 3500236 - DNA, 19 bp, Homo sapiens
aaattcaattgtaaattga

SEQ ID NO: 3500237 - DNA, 13 bp, Homo sapiens
aaattcactgttt

SEQ ID NO: 3500238 - DNA, 15 bp, Homo sapiens
aaattcactgtttgt

SEQ ID NO: 3500239 - DNA, 12 bp, Homo sapiens
aaattcatttct

SEQ ID NO: 3500240 - DNA, 16 bp, Homo sapiens
aaattcatttctaatt

SEQ ID NO: 3500241 - DNA, 21 bp, Homo sapiens
aaattctattctgatcttatt

SEQ ID NO: 3500242 - DNA, 13 bp, Homo sapiens
aaattctcctgga

SEQ ID NO: 3500243 - DNA, 12 bp, Homo sapiens
aaattctgaatt

SEQ ID NO: 3500244 - DNA, 18 bp, Homo sapiens
aaattctgaatttgcaaa

SEQ ID NO: 3500245 - DNA, 15 bp, Homo sapiens
aaattctgattcttc

SEQ ID NO: 3500246 - DNA, 17 bp, Homo sapiens
aaattctgattcttcta

SEQ ID NO: 3500247 - DNA, 15 bp, Homo sapiens
aaattctgtttcttg

SEQ ID NO: 3500248 - DNA, 23 bp, Homo sapiens
aaattgaaaggcattctctgaag

SEQ ID NO: 3500249 - DNA, 20 bp, Homo sapiens
aaattgacacaagtggacct

SEQ ID NO: 3500250 - DNA, 13 bp, Homo sapiens
aaattgcaaatct

SEQ ID NO: 3500251 - DNA, 20 bp, Homo sapiens
aaattgcacagaagtcctgt

SEQ ID NO: 3500252 - DNA, 16 bp, Homo sapiens
aaattggttctttatt

SEQ ID NO: 3500253 - DNA, 22 bp, Homo sapiens
aaattggttggagaatttaggt

SEQ ID NO: 3500254 - DNA, 15 bp, Homo sapiens
aaattgtaccttttt

SEQ ID NO: 3500255 - DNA, 14 bp, Homo sapiens
aaattgtatattca

SEQ ID NO: 3500256 - DNA, 16 bp, Homo sapiens
aaattgtatattcact

SEQ ID NO: 3500257 - DNA, 22 bp, Homo sapiens
aaattgtgaagctaatgaccaa

SEQ ID NO: 3500258 - DNA, 23 bp, Homo sapiens
aaattgtgaagctaatgaccaac

SEQ ID NO: 3500259 - DNA, 22 bp, Homo sapiens
aaattgtgtgtgctctgcttca

SEQ ID NO: 3500260 - DNA, 21 bp, Homo sapiens
aaattgtttcaaaataaaaac

SEQ ID NO: 3500261 - DNA, 19 bp, Homo sapiens
aaatttattttataagaaa

SEQ ID NO: 3500262 - DNA, 22 bp, Homo sapiens
aacccatggctctatttcttct

SEQ ID NO: 3500263 - DNA, 19 bp, Homo sapiens
aacccatttttgagccaag

SEQ ID NO: 3500264 - DNA, 18 bp, Homo sapiens
aaccccaaatgctctctc

SEQ ID NO: 3500265 - DNA, 19 bp, Homo sapiens
aaccccagctactctgatc

SEQ ID NO: 3500266 - DNA, 20 bp, Homo sapiens
aacccccactggactgacct

SEQ ID NO: 3500267 - DNA, 16 bp, Homo sapiens
aacccctggctccttc

SEQ ID NO: 3500268 - DNA, 16 bp, Homo sapiens
aacccgacagagggaa

SEQ ID NO: 3500269 - DNA, 20 bp, Homo sapiens
aacccgacagagggaagaaa

SEQ ID NO: 3500270 - DNA, 16 bp, Homo sapiens
aaccctcagccttgaa

SEQ ID NO: 3500271 - DNA, 13 bp, Homo sapiens
aaccctgccatgg

SEQ ID NO: 3500272 - DNA, 16 bp, Homo sapiens
aaccctggggaaggag

SEQ ID NO: 3500273 - DNA, 21 bp, Homo sapiens
aaccctggggaaggagccagt

SEQ ID NO: 3500274 - DNA, 18 bp, Homo sapiens
aaccctggggcctgactg

SEQ ID NO: 3500275 - DNA, 11 bp, Homo sapiens
aacccttctcc

SEQ ID NO: 3500276 - DNA, 18 bp, Homo sapiens
aacccttctcctcttgta

SEQ ID NO: 3500277 - DNA, 23 bp, Homo sapiens
aacccttctcctcttgtaaataa

SEQ ID NO: 3500278 - DNA, 13 bp, Homo sapiens
aaccgcaggaagc

SEQ ID NO: 3500279 - DNA, 17 bp, Homo sapiens
aaccgctttggcctgag

SEQ ID NO: 3500280 - DNA, 18 bp, Homo sapiens
aaccgtggtatgtctgcc

SEQ ID NO: 3500281 - DNA, 22 bp, Homo sapiens
aacctacctcccacactcccaa

SEQ ID NO: 3500282 - DNA, 20 bp, Homo sapiens
aacctcagcctggccagaca

SEQ ID NO: 3500283 - DNA, 19 bp, Homo sapiens
aacctcatgacagccagag

SEQ ID NO: 3500284 - DNA, 16 bp, Homo sapiens
aacctcattgttctgt

SEQ ID NO: 3500285 - DNA, 15 bp, Homo sapiens
aacctccccagcctg

SEQ ID NO: 3500286 - DNA, 15 bp, Homo sapiens
aacctcctctgtgaa

SEQ ID NO: 3500287 - DNA, 14 bp, Homo sapiens
aacctcctgggcta

SEQ ID NO: 3500288 - DNA, 15 bp, Homo sapiens
aacctcgagtactgt

SEQ ID NO: 3500289 - DNA, 20 bp, Homo sapiens
aacctcgccctctcctttgt

SEQ ID NO: 3500290 - DNA, 21 bp, Homo sapiens
aacctctcctcatgttctgct

SEQ ID NO: 3500291 - DNA, 20 bp, Homo sapiens
aacctctgcttcccaggttc

SEQ ID NO: 3500292 - DNA, 11 bp, Homo sapiens
aacctcttttt

SEQ ID NO: 3500293 - DNA, 19 bp, Homo sapiens
aacctctttttaaggacac

SEQ ID NO: 3500294 - DNA, 16 bp, Homo sapiens
aacctgcaaaatctgt

SEQ ID NO: 3500295 - DNA, 19 bp, Homo sapiens
aacctgcctgacatttgga

SEQ ID NO: 3500296 - DNA, 11 bp, Homo sapiens
aacctggaggt

SEQ ID NO: 3500297 - DNA, 17 bp, Homo sapiens
aacctgggattcaggaa

SEQ ID NO: 3500298 - DNA, 17 bp, Homo sapiens
aacctgtcattgtattc

SEQ ID NO: 3500299 - DNA, 20 bp, Homo sapiens
aacctgtttctacctatatg

SEQ ID NO: 3500300 - DNA, 18 bp, Homo sapiens
aacctgtttttttttcat

SEQ ID NO: 3500301 - DNA, 17 bp, Homo sapiens
aaccttaaacacccctc

SEQ ID NO: 3500302 - DNA, 18 bp, Homo sapiens
aaccttattgtacctctc

SEQ ID NO: 3500303 - DNA, 12 bp, Homo sapiens
aaccttctggcc

SEQ ID NO: 3500304 - DNA, 13 bp, Homo sapiens
aaccttggccttc

SEQ ID NO: 3500305 - DNA, 14 bp, Homo sapiens
aaccttggccttct

SEQ ID NO: 3500306 - DNA, 17 bp, Homo sapiens
aaccttggccttctccc

SEQ ID NO: 3500307 - DNA, 15 bp, Homo sapiens
aacctttattctttt

SEQ ID NO: 3500308 - DNA, 14 bp, Homo sapiens
aacctttttttgat

SEQ ID NO: 3500309 - DNA, 14 bp, Homo sapiens
aacgatgttgtgat

SEQ ID NO: 3500310 - DNA, 17 bp, Homo sapiens
aacgattaagtccaaat

SEQ ID NO: 3500311 - DNA, 17 bp, Homo sapiens
aacgcctcccctgcccc

SEQ ID NO: 3500312 - DNA, 15 bp, Homo sapiens
aacgctacctctctg

SEQ ID NO: 3500313 - DNA, 17 bp, Homo sapiens
aacggatcagaaataca

SEQ ID NO: 3500314 - DNA, 18 bp, Homo sapiens
aacggatcagaaatacag

SEQ ID NO: 3500315 - DNA, 19 bp, Homo sapiens
aacggtttaattctgtctt

SEQ ID NO: 3500316 - DNA, 18 bp, Homo sapiens
aacgtattagttgccaat

SEQ ID NO: 3500317 - DNA, 23 bp, Homo sapiens
aacgtattagttgccaatatgcc

SEQ ID NO: 3500318 - DNA, 13 bp, Homo sapiens
aacgtcatctcag

SEQ ID NO: 3500319 - DNA, 15 bp, Homo sapiens
aacgtcatctcaggg

SEQ ID NO: 3500320 - DNA, 15 bp, Homo sapiens
aacgtctttttgttt

SEQ ID NO: 3500321 - DNA, 18 bp, Homo sapiens
aacgtctttttgtttgtt

SEQ ID NO: 3500322 - DNA, 16 bp, Homo sapiens
aacgtgcattgtgctt

SEQ ID NO: 3500323 - DNA, 23 bp, Homo sapiens
aacgttttctgtttggaggagca

SEQ ID NO: 3500324 - DNA, 22 bp, Homo sapiens
aactaaggtgctaaatctgcga

SEQ ID NO: 3500325 - DNA, 15 bp, Homo sapiens
aactacaaacaaaat

SEQ ID NO: 3500326 - DNA, 19 bp, Homo sapiens
aactacaaacaaaatttct

SEQ ID NO: 3500327 - DNA, 13 bp, Homo sapiens
aactacaaatcaa

SEQ ID NO: 3500328 - DNA, 22 bp, Homo sapiens
aactacatgagaacaaacagat

SEQ ID NO: 3500329 - DNA, 21 bp, Homo sapiens
aactacccaaaacaagcctgg

SEQ ID NO: 3500330 - DNA, 19 bp, Homo sapiens
aactactccggagacaggg

SEQ ID NO: 3500331 - DNA, 19 bp, Homo sapiens
aactactgcctttagaaaa

SEQ ID NO: 3500332 - DNA, 20 bp, Homo sapiens
aactactgcctttagaaaat

SEQ ID NO: 3500333 - DNA, 14 bp, Homo sapiens
aactacttgatttt

SEQ ID NO: 3500334 - DNA, 19 bp, Homo sapiens
aactagaatttattcaatt

SEQ ID NO: 3500335 - DNA, 22 bp, Homo sapiens
aactagaatttattcaattcct

SEQ ID NO: 3500336 - DNA, 17 bp, Homo sapiens
aactagatcaaggagcc

SEQ ID NO: 3500337 - DNA, 23 bp, Homo sapiens
aactagatcaaggagcccagaaa

SEQ ID NO: 3500338 - DNA, 17 bp, Homo sapiens
aactagatggtgctgag

SEQ ID NO: 3500339 - DNA, 20 bp, Homo sapiens
aactagatggtgctgagaag

SEQ ID NO: 3500340 - DNA, 14 bp, Homo sapiens
aactagcatatctg

SEQ ID NO: 3500341 - DNA, 19 bp, Homo sapiens
aactagcatatctgccttt

SEQ ID NO: 3500342 - DNA, 17 bp, Homo sapiens
aactagggaagataata

SEQ ID NO: 3500343 - DNA, 17 bp, Homo sapiens
aactagggccaagccca

SEQ ID NO: 3500344 - DNA, 15 bp, Homo sapiens
aactagttttgttta

SEQ ID NO: 3500345 - DNA, 24 bp, Homo sapiens
aactattaaggatgtagcttttca

SEQ ID NO: 3500346 - DNA, 20 bp, Homo sapiens
aactattttcagatgtgaac

SEQ ID NO: 3500347 - DNA, 17 bp, Homo sapiens
aactcaaactcttaaaa

SEQ ID NO: 3500348 - DNA, 22 bp, Homo sapiens
aactcaaatggggccagatcca

SEQ ID NO: 3500349 - DNA, 23 bp, Homo sapiens
aactcaaatggggccagatccag

SEQ ID NO: 3500350 - DNA, 14 bp, Homo sapiens
aactcactttcctc

SEQ ID NO: 3500351 - DNA, 12 bp, Homo sapiens
aactcagaaggg

SEQ ID NO: 3500352 - DNA, 21 bp, Homo sapiens
aactcataatctataaacaat

SEQ ID NO: 3500353 - DNA, 16 bp, Homo sapiens
aactccctttttacac

SEQ ID NO: 3500354 - DNA, 12 bp, Homo sapiens
aactcctggcct

SEQ ID NO: 3500355 - DNA, 20 bp, Homo sapiens
aactccttcctggcctgaga

SEQ ID NO: 3500356 - DNA, 19 bp, Homo sapiens
aactcgtatagcatgcatc

SEQ ID NO: 3500357 - DNA, 21 bp, Homo sapiens
aactcgtatagcatgcatctg

SEQ ID NO: 3500358 - DNA, 14 bp, Homo sapiens
aactcttaaagcaa

SEQ ID NO: 3500359 - DNA, 17 bp, Homo sapiens
aactcttcactcttcaa

SEQ ID NO: 3500360 - DNA, 23 bp, Homo sapiens
aactcttcactcttcaaatgcct

SEQ ID NO: 3500361 - DNA, 20 bp, Homo sapiens
aactcttcagttaattctta

SEQ ID NO: 3500362 - DNA, 13 bp, Homo sapiens
aactctttcaaaa

SEQ ID NO: 3500363 - DNA, 17 bp, Homo sapiens
aactgaaattaaaacta

SEQ ID NO: 3500364 - DNA, 18 bp, Homo sapiens
aactgaaattaaaactat

SEQ ID NO: 3500365 - DNA, 20 bp, Homo sapiens
aactgaagcagcctctcccc

SEQ ID NO: 3500366 - DNA, 21 bp, Homo sapiens
aactgaagcagcctctcccca

SEQ ID NO: 3500367 - DNA, 15 bp, Homo sapiens
aactgagacaggcag

SEQ ID NO: 3500368 - DNA, 10 bp, Homo sapiens
aactgagcct

SEQ ID NO: 3500369 - DNA, 11 bp, Homo sapiens
aactgagccta

SEQ ID NO: 3500370 - DNA, 19 bp, Homo sapiens
aactgcaggccctggcctc

SEQ ID NO: 3500371 - DNA, 14 bp, Homo sapiens
aactgcagggaaaa

SEQ ID NO: 3500372 - DNA, 23 bp, Homo sapiens
aactgcagggaaaattatttgca

SEQ ID NO: 3500373 - DNA, 23 bp, Homo sapiens
aactgcattaccgcgttgtaaaa

SEQ ID NO: 3500374 - DNA, 18 bp, Homo sapiens
aactgccaaaatgctcta

SEQ ID NO: 3500375 - DNA, 17 bp, Homo sapiens
aactgcctaaggccctt

SEQ ID NO: 3500376 - DNA, 17 bp, Homo sapiens
aactgctcagctctggt

SEQ ID NO: 3500377 - DNA, 20 bp, Homo sapiens
aactgctgactgttttctct

SEQ ID NO: 3500378 - DNA, 21 bp, Homo sapiens
aactgctgactgttttctctt

SEQ ID NO: 3500379 - DNA, 18 bp, Homo sapiens
aactggaccctgttgcta

SEQ ID NO: 3500380 - DNA, 21 bp, Homo sapiens
aactggaccctgttgctaagc

SEQ ID NO: 3500381 - DNA, 14 bp, Homo sapiens
aactggcaggcagg

SEQ ID NO: 3500382 - DNA, 17 bp, Homo sapiens
aactggcagttttccat

SEQ ID NO: 3500383 - DNA, 16 bp, Homo sapiens
aactgggtacttgtgg

SEQ ID NO: 3500384 - DNA, 19 bp, Homo sapiens
aactggtcttcctttttgg

SEQ ID NO: 3500385 - DNA, 18 bp, Homo sapiens
aactggtgcactttgtaa

SEQ ID NO: 3500386 - DNA, 19 bp, Homo sapiens
aactgtctttaaaagagag

SEQ ID NO: 3500387 - DNA, 15 bp, Homo sapiens
aactgtgccacaatg

SEQ ID NO: 3500388 - DNA, 13 bp, Homo sapiens
aactgtgcttctc

SEQ ID NO: 3500389 - DNA, 21 bp, Homo sapiens
aactgtgtgtaattgttcctt

SEQ ID NO: 3500390 - DNA, 21 bp, Homo sapiens
aacttagccatttttcaaagc

SEQ ID NO: 3500391 - DNA, 20 bp, Homo sapiens
aacttagtgacaaaatagac

SEQ ID NO: 3500392 - DNA, 21 bp, Homo sapiens
aacttatagttaatattttgt

SEQ ID NO: 3500393 - DNA, 21 bp, Homo sapiens
aacttatgacctcttccttta

SEQ ID NO: 3500394 - DNA, 13 bp, Homo sapiens
aagcaatatgcat

SEQ ID NO: 3500395 - DNA, 20 bp, Homo sapiens
aagcaatcctctcacctcag

SEQ ID NO: 3500396 - DNA, 15 bp, Homo sapiens
aagcaattagacaag

SEQ ID NO: 3500397 - DNA, 21 bp, Homo sapiens
aagcacatattagtgcagcca

SEQ ID NO: 3500398 - DNA, 16 bp, Homo sapiens
aagcactaaacaaaga

SEQ ID NO: 3500399 - DNA, 20 bp, Homo sapiens
aagcagaaaataaaggaagc

SEQ ID NO: 3500400 - DNA, 16 bp, Homo sapiens
aagcagagaagctctc

SEQ ID NO: 3500401 - DNA, 14 bp, Homo sapiens
aagcagatgcaaag

SEQ ID NO: 3500402 - DNA, 21 bp, Homo sapiens
aagcagccaagctccttggga

SEQ ID NO: 3500403 - DNA, 18 bp, Homo sapiens
aagcagctcaaaggcaca

SEQ ID NO: 3500404 - DNA, 12 bp, Homo sapiens
aagcaggaagct

SEQ ID NO: 3500405 - DNA, 22 bp, Homo sapiens
aagcaggctacactgacactgg

SEQ ID NO: 3500406 - DNA, 21 bp, Homo sapiens
aagcagtagaaataatatgca

SEQ ID NO: 3500407 - DNA, 22 bp, Homo sapiens
aagcagtagaaataatatgcat

SEQ ID NO: 3500408 - DNA, 18 bp, Homo sapiens
aagcagtcgtgcctgtgt

SEQ ID NO: 3500409 - DNA, 19 bp, Homo sapiens
aagcagtcgtgcctgtgtc

SEQ ID NO: 3500410 - DNA, 14 bp, Homo sapiens
aagcagttctgatg

SEQ ID NO: 3500411 - DNA, 19 bp, Homo sapiens
aagcagttctgatgcttac

SEQ ID NO: 3500412 - DNA, 14 bp, Homo sapiens
aagcatactttgta

SEQ ID NO: 3500413 - DNA, 18 bp, Homo sapiens
aagcatatcgtaaagctg

SEQ ID NO: 3500414 - DNA, 14 bp, Homo sapiens
aagcatttgaatgc

SEQ ID NO: 3500415 - DNA, 16 bp, Homo sapiens
aagcatttgaatgcat

SEQ ID NO: 3500416 - DNA, 12 bp, Homo sapiens
aagccaaagagt

SEQ ID NO: 3500417 - DNA, 15 bp, Homo sapiens
aagccaagacctcac

SEQ ID NO: 3500418 - DNA, 21 bp, Homo sapiens
aagccaaggcagcgaccccag

SEQ ID NO: 3500419 - DNA, 21 bp, Homo sapiens
aagccaaggtgtcatttatgt

SEQ ID NO: 3500420 - DNA, 17 bp, Homo sapiens
aagccaattcagacagg

SEQ ID NO: 3500421 - DNA, 19 bp, Homo sapiens
aagccacaggcctgagatt

SEQ ID NO: 3500422 - DNA, 17 bp, Homo sapiens
aagccagaagctgagca

SEQ ID NO: 3500423 - DNA, 16 bp, Homo sapiens
aagccagaggctgggt

SEQ ID NO: 3500424 - DNA, 19 bp, Homo sapiens
aagccagcgtcctcctctg

SEQ ID NO: 3500425 - DNA, 15 bp, Homo sapiens
aagccagctgcccta

SEQ ID NO: 3500426 - DNA, 13 bp, Homo sapiens
aagccagctgcct

SEQ ID NO: 3500427 - DNA, 22 bp, Homo sapiens
aagccaggaatttcccaggacc

SEQ ID NO: 3500428 - DNA, 24 bp, Homo sapiens
aagccaggaatttcccaggaccct

SEQ ID NO: 3500429 - DNA, 15 bp, Homo sapiens
aagccatgctggaaa

SEQ ID NO: 3500430 - DNA, 21 bp, Homo sapiens
aagccatgctggaaaataata

SEQ ID NO: 3500431 - DNA, 14 bp, Homo sapiens
aagccattccaaag

SEQ ID NO: 3500432 - DNA, 20 bp, Homo sapiens
aagccattctaaggaaatta

SEQ ID NO: 3500433 - DNA, 23 bp, Homo sapiens
aagcccagcactgcttgaggaaa

SEQ ID NO: 3500434 - DNA, 14 bp, Homo sapiens
aagcccccaccgtg

SEQ ID NO: 3500435 - DNA, 20 bp, Homo sapiens
aagcccccaccgtgggcagg

SEQ ID NO: 3500436 - DNA, 23 bp, Homo sapiens
aagcccccagctaagaacctgga

SEQ ID NO: 3500437 - DNA, 23 bp, Homo sapiens
aagccctgattgtgtatattcat

SEQ ID NO: 3500438 - DNA, 15 bp, Homo sapiens
aagccgaccttagat

SEQ ID NO: 3500439 - DNA, 23 bp, Homo sapiens
aagcctaaaagtgggcttgattc

SEQ ID NO: 3500440 - DNA, 20 bp, Homo sapiens
aagcctaacttcatagaaac

SEQ ID NO: 3500441 - DNA, 18 bp, Homo sapiens
aagcctcatattttctgt

SEQ ID NO: 3500442 - DNA, 21 bp, Homo sapiens
aagcctcatcatcagagcctt

SEQ ID NO: 3500443 - DNA, 18 bp, Homo sapiens
aagcctcgaggtgccttc

SEQ ID NO: 3500444 - DNA, 19 bp, Homo sapiens
aagcctctgcctccctagc

SEQ ID NO: 3500445 - DNA, 24 bp, Homo sapiens
aagcctgaaggggcgtctgttccc

SEQ ID NO: 3500446 - DNA, 16 bp, Homo sapiens
aagcctgtgcaaaaaa

SEQ ID NO: 3500447 - DNA, 23 bp, Homo sapiens
aagcgcttttccttggcattccg

SEQ ID NO: 3500448 - DNA, 15 bp, Homo sapiens
aagcgtgagccactg

SEQ ID NO: 3500449 - DNA, 17 bp, Homo sapiens
aagcgtgagccactgca

SEQ ID NO: 3500450 - DNA, 20 bp, Homo sapiens
aagcgtgagccactgcaccg

SEQ ID NO: 3500451 - DNA, 21 bp, Homo sapiens
aagcgtgagccactgcaccgg

SEQ ID NO: 3500452 - DNA, 22 bp, Homo sapiens
aagctaatttgcattaaattca

SEQ ID NO: 3500453 - DNA, 22 bp, Homo sapiens
aagctactgtgtgtgtgaatga

SEQ ID NO: 3500454 - DNA, 22 bp, Homo sapiens
aagctaggcctggccagatgca

SEQ ID NO: 3500455 - DNA, 21 bp, Homo sapiens
aagctattccctcaaatctga

SEQ ID NO: 3500456 - DNA, 22 bp, Homo sapiens
aagctcattcccaacgtgcaaa

SEQ ID NO: 3500457 - DNA, 15 bp, Homo sapiens
aagctccatcaatga

SEQ ID NO: 3500458 - DNA, 17 bp, Homo sapiens
aagctcccaagggatgg

SEQ ID NO: 3500459 - DNA, 16 bp, Homo sapiens
aagctccgcaggactt

SEQ ID NO: 3500460 - DNA, 17 bp, Homo sapiens
aagctcctcctccctgc

SEQ ID NO: 3500461 - DNA, 18 bp, Homo sapiens
aagctctggccccaggct

SEQ ID NO: 3500462 - DNA, 16 bp, Homo sapiens
aagctcttactctttc

SEQ ID NO: 3500463 - DNA, 13 bp, Homo sapiens
aagctgaatacat

SEQ ID NO: 3500464 - DNA, 22 bp, Homo sapiens
aagctgacgaacttccatggcc

SEQ ID NO: 3500465 - DNA, 21 bp, Homo sapiens
aagctgcaccctcaggcaggt

SEQ ID NO: 3500466 - DNA, 21 bp, Homo sapiens
aagctgccgaaccaaaagaat

SEQ ID NO: 3500467 - DNA, 12 bp, Homo sapiens
aagctgctctga

SEQ ID NO: 3500468 - DNA, 16 bp, Homo sapiens
aagctgctctgagcca

SEQ ID NO: 3500469 - DNA, 19 bp, Homo sapiens
aagctgctctgagccacag

SEQ ID NO: 3500470 - DNA, 20 bp, Homo sapiens
aagctgctctgagccacagt

SEQ ID NO: 3500471 - DNA, 14 bp, Homo sapiens
aagctgctgacagt

SEQ ID NO: 3500472 - DNA, 13 bp, Homo sapiens
aagctgctgtctc

SEQ ID NO: 3500473 - DNA, 15 bp, Homo sapiens
aagctggctggggtg

SEQ ID NO: 3500474 - DNA, 13 bp, Homo sapiens
aagctgtggccag

SEQ ID NO: 3500475 - DNA, 18 bp, Homo sapiens
aagctgttctcattcctg

SEQ ID NO: 3500476 - DNA, 23 bp, Homo sapiens
aagctgtttccatagggtgacac

SEQ ID NO: 3500477 - DNA, 15 bp, Homo sapiens
aagcttcaaccctca

SEQ ID NO: 3500478 - DNA, 18 bp, Homo sapiens
aagcttccatagctgctg

SEQ ID NO: 3500479 - DNA, 15 bp, Homo sapiens
aagcttccatgattc

SEQ ID NO: 3500480 - DNA, 22 bp, Homo sapiens
aagctttcatgtaaactgtgca

SEQ ID NO: 3500481 - DNA, 13 bp, Homo sapiens
aagcttttagaaa

SEQ ID NO: 3500482 - DNA, 14 bp, Homo sapiens
aagcttttagaaat

SEQ ID NO: 3500483 - DNA, 16 bp, Homo sapiens
aaggaaaaaataacaa

SEQ ID NO: 3500484 - DNA, 17 bp, Homo sapiens
aaggaaaccacagctgc

SEQ ID NO: 3500485 - DNA, 18 bp, Homo sapiens
aaggaaaccacagctgct

SEQ ID NO: 3500486 - DNA, 14 bp, Homo sapiens
aaggaaactttcct

SEQ ID NO: 3500487 - DNA, 13 bp, Homo sapiens
aaggaaaggcaaa

SEQ ID NO: 3500488 - DNA, 22 bp, Homo sapiens
aaggaaatctcaccccatccca

SEQ ID NO: 3500489 - DNA, 13 bp, Homo sapiens
aaggaacactgac

SEQ ID NO: 3500490 - DNA, 23 bp, Homo sapiens
aaggaactaggtcaaaaatctgt

SEQ ID NO: 3500491 - DNA, 18 bp, Homo sapiens
aaggaacttgaaaaatac

SEQ ID NO: 3500492 - DNA, 21 bp, Homo sapiens
aaggaaggctcttctccccag

SEQ ID NO: 3500493 - DNA, 12 bp, Homo sapiens
aaggaaggtgga

SEQ ID NO: 3500494 - DNA, 15 bp, Homo sapiens
aaggaatatatggca

SEQ ID NO: 3500495 - DNA, 20 bp, Homo sapiens
aaggaatccactcccaggca

SEQ ID NO: 3500496 - DNA, 22 bp, Homo sapiens
aaggaatccactcccaggcagc

SEQ ID NO: 3500497 - DNA, 18 bp, Homo sapiens
aaggaattatagacctct

SEQ ID NO: 3500498 - DNA, 16 bp, Homo sapiens
aaggacatgatgcttt

SEQ ID NO: 3500499 - DNA, 21 bp, Homo sapiens
aaggaccctgtgccctccttc

SEQ ID NO: 3500500 - DNA, 22 bp, Homo sapiens
aaggactaatccaatacctctt

SEQ ID NO: 3500501 - DNA, 21 bp, Homo sapiens
aaggactgagcaccctctgga

SEQ ID NO: 3500502 - DNA, 12 bp, Homo sapiens
aaggagacacaa

SEQ ID NO: 3500503 - DNA, 18 bp, Homo sapiens
aaggaggaagagaaaaaa

SEQ ID NO: 3500504 - DNA, 20 bp, Homo sapiens
aaggaggaagagaaaaaata

SEQ ID NO: 3500505 - DNA, 15 bp, Homo sapiens
aaggagggagatgga

SEQ ID NO: 3500506 - DNA, 22 bp, Homo sapiens
aaggaggggaaaaaaatgttgt

SEQ ID NO: 3500507 - DNA, 20 bp, Homo sapiens
aaggaggggatagagagaga

SEQ ID NO: 3500508 - DNA, 13 bp, Homo sapiens
aaggagtagaaaa

SEQ ID NO: 3500509 - DNA, 13 bp, Homo sapiens
aaggataatgaat

SEQ ID NO: 3500510 - DNA, 14 bp, Homo sapiens
aaggatacataatg

SEQ ID NO: 3500511 - DNA, 15 bp, Homo sapiens
aaggatagatgctgg

SEQ ID NO: 3500512 - DNA, 20 bp, Homo sapiens
aaggatagatgctggcccag

SEQ ID NO: 3500513 - DNA, 20 bp, Homo sapiens
aaggatctttgtggccaagg

SEQ ID NO: 3500514 - DNA, 16 bp, Homo sapiens
aaggcaaatgcccaag

SEQ ID NO: 3500515 - DNA, 18 bp, Homo sapiens
aaggcaagcacttgtggg

SEQ ID NO: 3500516 - DNA, 17 bp, Homo sapiens
aaggcatacgagagcag

SEQ ID NO: 3500517 - DNA, 18 bp, Homo sapiens
aaggcatgtgtgaaacat

SEQ ID NO: 3500518 - DNA, 12 bp, Homo sapiens
aaggcattctct

SEQ ID NO: 3500519 - DNA, 21 bp, Homo sapiens
aaggccaattcctatacgcag

SEQ ID NO: 3500520 - DNA, 19 bp, Homo sapiens
aaggccagcacccaaaggg

SEQ ID NO: 3500521 - DNA, 14 bp, Homo sapiens
aaggccataaaaca

SEQ ID NO: 3500522 - DNA, 24 bp, Homo sapiens
aaggccataaaacaggtaatataa

SEQ ID NO: 3500523 - DNA, 22 bp, Homo sapiens
aaggccatccttccctgtctgc

SEQ ID NO: 3500524 - DNA, 21 bp, Homo sapiens
aaggcccacgagcttgttctt

SEQ ID NO: 3500525 - DNA, 19 bp, Homo sapiens
aagttgagggaaagagctt

SEQ ID NO: 3500526 - DNA, 22 bp, Homo sapiens
aagttgcagtgagctgatatca

SEQ ID NO: 3500527 - DNA, 21 bp, Homo sapiens
aagttgggttaataccagctt

SEQ ID NO: 3500528 - DNA, 16 bp, Homo sapiens
aagttggttggataag

SEQ ID NO: 3500529 - DNA, 21 bp, Homo sapiens
aagttgttactaactaaactc

SEQ ID NO: 3500530 - DNA, 20 bp, Homo sapiens
aagtttccttccagcccaga

SEQ ID NO: 3500531 - DNA, 16 bp, Homo sapiens
aagtttccttggctgg

SEQ ID NO: 3500532 - DNA, 18 bp, Homo sapiens
aagtttccttggctggtg

SEQ ID NO: 3500533 - DNA, 13 bp, Homo sapiens
aagtttgaatgtt

SEQ ID NO: 3500534 - DNA, 14 bp, Homo sapiens
aagtttgaatgtta

SEQ ID NO: 3500535 - DNA, 20 bp, Homo sapiens
aagtttgcactatctttcag

SEQ ID NO: 3500536 - DNA, 15 bp, Homo sapiens
aagtttgcttagaaa

SEQ ID NO: 3500537 - DNA, 15 bp, Homo sapiens
aagttttcaatgatg

SEQ ID NO: 3500538 - DNA, 22 bp, Homo sapiens
aagttttcccttgaggaaacaa

SEQ ID NO: 3500539 - DNA, 15 bp, Homo sapiens
aataaaaaccttcca

SEQ ID NO: 3500540 - DNA, 18 bp, Homo sapiens
aataaaaaggcacctata

SEQ ID NO: 3500541 - DNA, 12 bp, Homo sapiens
aataaaaataat

SEQ ID NO: 3500542 - DNA, 12 bp, Homo sapiens
aataaaacagta

SEQ ID NO: 3500543 - DNA, 15 bp, Homo sapiens
aataaaactggcttt

SEQ ID NO: 3500544 - DNA, 20 bp, Homo sapiens
aataaaaggaagccaaagag

SEQ ID NO: 3500545 - DNA, 16 bp, Homo sapiens
aataaaagtgaccttt

SEQ ID NO: 3500546 - DNA, 19 bp, Homo sapiens
aataaaagttttacaaagg

SEQ ID NO: 3500547 - DNA, 17 bp, Homo sapiens
aataaaatgttgaaaag

SEQ ID NO: 3500548 - DNA, 18 bp, Homo sapiens
aataaaattttttttcat

SEQ ID NO: 3500549 - DNA, 12 bp, Homo sapiens
aataaacaaaat

SEQ ID NO: 3500550 - DNA, 15 bp, Homo sapiens
aataaacactacaga

SEQ ID NO: 3500551 - DNA, 12 bp, Homo sapiens
aataaactgtaa

SEQ ID NO: 3500552 - DNA, 14 bp, Homo sapiens
aataaactgtaaac

SEQ ID NO: 3500553 - DNA, 17 bp, Homo sapiens
aataaactgtaaactaa

SEQ ID NO: 3500554 - DNA, 21 bp, Homo sapiens
aataaacttggattctctaac

SEQ ID NO: 3500555 - DNA, 13 bp, Homo sapiens
aataaactttaat

SEQ ID NO: 3500556 - DNA, 14 bp, Homo sapiens
aataaagaatactt

SEQ ID NO: 3500557 - DNA, 19 bp, Homo sapiens
aataaagaatacttgaact

SEQ ID NO: 3500558 - DNA, 12 bp, Homo sapiens
aataaagatgat

SEQ ID NO: 3500559 - DNA, 15 bp, Homo sapiens
aataaagcactgagc

SEQ ID NO: 3500560 - DNA, 11 bp, Homo sapiens
aataaagccct

SEQ ID NO: 3500561 - DNA, 15 bp, Homo sapiens
aataaagccctggga

SEQ ID NO: 3500562 - DNA, 18 bp, Homo sapiens
aataaagccttcaaactc

SEQ ID NO: 3500563 - DNA, 16 bp, Homo sapiens
aataaaggatgtgatt

SEQ ID NO: 3500564 - DNA, 13 bp, Homo sapiens
aataaaggttgtg

SEQ ID NO: 3500565 - DNA, 21 bp, Homo sapiens
aataaagtatttaattagtgc

SEQ ID NO: 3500566 - DNA, 22 bp, Homo sapiens
aataaagtatttaattagtgct

SEQ ID NO: 3500567 - DNA, 12 bp, Homo sapiens
aataaatatata

SEQ ID NO: 3500568 - DNA, 13 bp, Homo sapiens
aataaatatatat

SEQ ID NO: 3500569 - DNA, 15 bp, Homo sapiens
aataaatatatataa

SEQ ID NO: 3500570 - DNA, 22 bp, Homo sapiens
aataaatcctgtcttatttgtt

SEQ ID NO: 3500571 - DNA, 15 bp, Homo sapiens
aataaatctgaccca

SEQ ID NO: 3500572 - DNA, 20 bp, Homo sapiens
aataaatctgacccagtgcc

SEQ ID NO: 3500573 - DNA, 16 bp, Homo sapiens
aataaattgtatattc

SEQ ID NO: 3500574 - DNA, 15 bp, Homo sapiens
aataaatttatatga

SEQ ID NO: 3500575 - DNA, 18 bp, Homo sapiens
aataaatttggttctaat

SEQ ID NO: 3500576 - DNA, 21 bp, Homo sapiens
aataaatttggttctaataga

SEQ ID NO: 3500577 - DNA, 15 bp, Homo sapiens
aataacacacagcta

SEQ ID NO: 3500578 - DNA, 14 bp, Homo sapiens
aataacatttaatt

SEQ ID NO: 3500579 - DNA, 21 bp, Homo sapiens
aataacatttaatttagatat

SEQ ID NO: 3500580 - DNA, 17 bp, Homo sapiens
aataaccggatatatac

SEQ ID NO: 3500581 - DNA, 21 bp, Homo sapiens
aataactggaacaaattattt

SEQ ID NO: 3500582 - DNA, 18 bp, Homo sapiens
aataagaatagaaataaa

SEQ ID NO: 3500583 - DNA, 14 bp, Homo sapiens
aataagcaggatgt

SEQ ID NO: 3500584 - DNA, 21 bp, Homo sapiens
aataaggacaagcctaacttc

SEQ ID NO: 3500585 - DNA, 15 bp, Homo sapiens
aataagtgtctttct

SEQ ID NO: 3500586 - DNA, 16 bp, Homo sapiens
aataatatacttgtgg

SEQ ID NO: 3500587 - DNA, 13 bp, Homo sapiens
aataatatgcatt

SEQ ID NO: 3500588 - DNA, 22 bp, Homo sapiens
aataatgcagtatggtacattt

SEQ ID NO: 3500589 - DNA, 19 bp, Homo sapiens
aataatgggcttagagcag

SEQ ID NO: 3500590 - DNA, 20 bp, Homo sapiens
aataatgggcttagagcagt

SEQ ID NO: 3500591 - DNA, 19 bp, Homo sapiens
aataatgtacatctggcct

SEQ ID NO: 3500592 - DNA, 13 bp, Homo sapiens
aataatgtctctg

SEQ ID NO: 3500593 - DNA, 13 bp, Homo sapiens
aataatttatagt

SEQ ID NO: 3500594 - DNA, 16 bp, Homo sapiens
aataatttatagtaat

SEQ ID NO: 3500595 - DNA, 20 bp, Homo sapiens
aatacaaaaattagccgagc

SEQ ID NO: 3500596 - DNA, 20 bp, Homo sapiens
aatacaaaaattagccgggc

SEQ ID NO: 3500597 - DNA, 15 bp, Homo sapiens
aatacaaaggttcca

SEQ ID NO: 3500598 - DNA, 21 bp, Homo sapiens
aatacaaaggttccattcagt

SEQ ID NO: 3500599 - DNA, 18 bp, Homo sapiens
aatacacatggaaaaaaa

SEQ ID NO: 3500600 - DNA, 21 bp, Homo sapiens
aatacagattttgatagcaaa

SEQ ID NO: 3500601 - DNA, 23 bp, Homo sapiens
aatacagattttgatagcaaagc

SEQ ID NO: 3500602 - DNA, 16 bp, Homo sapiens
aatacagctttctgac

SEQ ID NO: 3500603 - DNA, 16 bp, Homo sapiens
aatacagtacaggcag

SEQ ID NO: 3500604 - DNA, 20 bp, Homo sapiens
aatacagtatctcagggcct

SEQ ID NO: 3500605 - DNA, 21 bp, Homo sapiens
aatacagtcttccatttgcaa

SEQ ID NO: 3500606 - DNA, 14 bp, Homo sapiens
aatacattcaaatt

SEQ ID NO: 3500607 - DNA, 18 bp, Homo sapiens
aatactaccttgaaaata

SEQ ID NO: 3500608 - DNA, 21 bp, Homo sapiens
aatactaccttgaaaataaga

SEQ ID NO: 3500609 - DNA, 15 bp, Homo sapiens
aatactccaaagatg

SEQ ID NO: 3500610 - DNA, 17 bp, Homo sapiens
aatactctgccctctag

SEQ ID NO: 3500611 - DNA, 15 bp, Homo sapiens
aatactgtacagggg

SEQ ID NO: 3500612 - DNA, 16 bp, Homo sapiens
aatactgtattttgta

SEQ ID NO: 3500613 - DNA, 13 bp, Homo sapiens
aatacttgaactt

SEQ ID NO: 3500614 - DNA, 10 bp, Homo sapiens
aatacttttt

SEQ ID NO: 3500615 - DNA, 17 bp, Homo sapiens
aatactttttctaatga

SEQ ID NO: 3500616 - DNA, 19 bp, Homo sapiens
aatagaaaagttattagtg

SEQ ID NO: 3500617 - DNA, 19 bp, Homo sapiens
aatagaagtgctcccctct

SEQ ID NO: 3500618 - DNA, 15 bp, Homo sapiens
aatagaatatagcat

SEQ ID NO: 3500619 - DNA, 16 bp, Homo sapiens
aatagaatatagcatc

SEQ ID NO: 3500620 - DNA, 22 bp, Homo sapiens
aatagacactccccgaagtctt

SEQ ID NO: 3500621 - DNA, 16 bp, Homo sapiens
aatagagcctgaggga

SEQ ID NO: 3500622 - DNA, 15 bp, Homo sapiens
aatagagtatatgca

SEQ ID NO: 3500623 - DNA, 17 bp, Homo sapiens
aatagagtatatgcact

SEQ ID NO: 3500624 - DNA, 23 bp, Homo sapiens
aatagccactgcataccaacctg

SEQ ID NO: 3500625 - DNA, 14 bp, Homo sapiens
aatagcctgtggcc

SEQ ID NO: 3500626 - DNA, 15 bp, Homo sapiens
aataggatttttaga

SEQ ID NO: 3500627 - DNA, 18 bp, Homo sapiens
aataggcgtaactaattt

SEQ ID NO: 3500628 - DNA, 21 bp, Homo sapiens
aatagtaatttgtaaagttgg

SEQ ID NO: 3500629 - DNA, 14 bp, Homo sapiens
aatagtacttacaa

SEQ ID NO: 3500630 - DNA, 22 bp, Homo sapiens
aatagttaagacatgatttcct

SEQ ID NO: 3500631 - DNA, 18 bp, Homo sapiens
aatataaaactgcgttaa

SEQ ID NO: 3500632 - DNA, 22 bp, Homo sapiens
aatataagaataaaatgttgaa

SEQ ID NO: 3500633 - DNA, 21 bp, Homo sapiens
aatataccttttttgttccac

SEQ ID NO: 3500634 - DNA, 22 bp, Homo sapiens
aatataccttttttgttccact

SEQ ID NO: 3500635 - DNA, 13 bp, Homo sapiens
aatatacttgtgg

SEQ ID NO: 3500636 - DNA, 14 bp, Homo sapiens
aatatagcatcttt

SEQ ID NO: 3500637 - DNA, 18 bp, Homo sapiens
aatatagcatctttcata

SEQ ID NO: 3500638 - DNA, 15 bp, Homo sapiens
aatatagctgagact

SEQ ID NO: 3500639 - DNA, 20 bp, Homo sapiens
aatatagctgtacaaatata

SEQ ID NO: 3500640 - DNA, 12 bp, Homo sapiens
aatatatataaa

SEQ ID NO: 3500641 - DNA, 21 bp, Homo sapiens
aatatatatatatataaaata

SEQ ID NO: 3500642 - DNA, 11 bp, Homo sapiens
aatatatatta

SEQ ID NO: 3500643 - DNA, 16 bp, Homo sapiens
aatatatgaacattag

SEQ ID NO: 3500644 - DNA, 19 bp, Homo sapiens
aatatatggcagagttgta

SEQ ID NO: 3500645 - DNA, 17 bp, Homo sapiens
aatatatgtgtgcctat

SEQ ID NO: 3500646 - DNA, 19 bp, Homo sapiens
aatatatttgtgtatttaa

SEQ ID NO: 3500647 - DNA, 13 bp, Homo sapiens
aatatcatctttt

SEQ ID NO: 3500648 - DNA, 13 bp, Homo sapiens
aatatcatttatt

SEQ ID NO: 3500649 - DNA, 23 bp, Homo sapiens
aatatcatttattttttacatta

SEQ ID NO: 3500650 - DNA, 12 bp, Homo sapiens
aatatcctttgc

SEQ ID NO: 3500651 - DNA, 12 bp, Homo sapiens
aatatctaaagt

SEQ ID NO: 3500652 - DNA, 20 bp, Homo sapiens
aatatctaaagttatatttc

SEQ ID NO: 3500653 - DNA, 20 bp, Homo sapiens
aatatgactttttataaaat

SEQ ID NO: 3500654 - DNA, 18 bp, Homo sapiens
aatatgctgcaacaaaat

SEQ ID NO: 3500655 - DNA, 21 bp, Homo sapiens
aatatgctgcaacaaaatgta

SEQ ID NO: 3500656 - DNA, 21 bp, Homo sapiens
aatatggacacttaatactac

SEQ ID NO: 3500657 - DNA, 21 bp, Homo sapiens
aatatgtgaaaggaacatttt

SEQ ID NO: 3500658 - DNA, 12 bp, Homo sapiens
aatgcattttgt

SEQ ID NO: 3500659 - DNA, 20 bp, Homo sapiens
aatgcattttgtttggtatt

SEQ ID NO: 3500660 - DNA, 22 bp, Homo sapiens
aatgccatcctcaaacactgca

SEQ ID NO: 3500661 - DNA, 22 bp, Homo sapiens
aatgccatgatgcctctgtctt

SEQ ID NO: 3500662 - DNA, 20 bp, Homo sapiens
aatgcctcagtgtatttgta

SEQ ID NO: 3500663 - DNA, 19 bp, Homo sapiens
aatgctaatttaaagagac

SEQ ID NO: 3500664 - DNA, 16 bp, Homo sapiens
aatgctcataacggat

SEQ ID NO: 3500665 - DNA, 21 bp, Homo sapiens
aatgctggctgttggctgggg

SEQ ID NO: 3500666 - DNA, 18 bp, Homo sapiens
aatgctttagaaaggttt

SEQ ID NO: 3500667 - DNA, 19 bp, Homo sapiens
aatgctttttatttctgca

SEQ ID NO: 3500668 - DNA, 15 bp, Homo sapiens
aatggaaattttgct

SEQ ID NO: 3500669 - DNA, 16 bp, Homo sapiens
aatggaaattttgcta

SEQ ID NO: 3500670 - DNA, 17 bp, Homo sapiens
aatggaaattttgctat

SEQ ID NO: 3500671 - DNA, 16 bp, Homo sapiens
aatggaaccaggcttg

SEQ ID NO: 3500672 - DNA, 13 bp, Homo sapiens
aatggaagacaca

SEQ ID NO: 3500673 - DNA, 21 bp, Homo sapiens
aatggaatgtgatgttcatgg

SEQ ID NO: 3500674 - DNA, 19 bp, Homo sapiens
aatggacataggactcaaa

SEQ ID NO: 3500675 - DNA, 15 bp, Homo sapiens
aatggagaagctctg

SEQ ID NO: 3500676 - DNA, 17 bp, Homo sapiens
aatggagcatcaagcca

SEQ ID NO: 3500677 - DNA, 19 bp, Homo sapiens
aatggagtcagtttgcagt

SEQ ID NO: 3500678 - DNA, 16 bp, Homo sapiens
aatggatacataaaga

SEQ ID NO: 3500679 - DNA, 16 bp, Homo sapiens
aatggcagccttggca

SEQ ID NO: 3500680 - DNA, 20 bp, Homo sapiens
aatggcctcatgtggctgga

SEQ ID NO: 3500681 - DNA, 22 bp, Homo sapiens
aatggcctcatgtggctggaag

SEQ ID NO: 3500682 - DNA, 14 bp, Homo sapiens
aatggccttcccgc

SEQ ID NO: 3500683 - DNA, 19 bp, Homo sapiens
aatggccttcccgccggag

SEQ ID NO: 3500684 - DNA, 21 bp, Homo sapiens
aatggccttcccgccggaggc

SEQ ID NO: 3500685 - DNA, 13 bp, Homo sapiens
aatggctccttca

SEQ ID NO: 3500686 - DNA, 22 bp, Homo sapiens
aatggcttatccagctggtgag

SEQ ID NO: 3500687 - DNA, 13 bp, Homo sapiens
aatggcttcagtg

SEQ ID NO: 3500688 - DNA, 17 bp, Homo sapiens
aatgggcttagagcagt

SEQ ID NO: 3500689 - DNA, 17 bp, Homo sapiens
aatggggccagatccag

SEQ ID NO: 3500690 - DNA, 22 bp, Homo sapiens
aatggggccagatccagcctgg

SEQ ID NO: 3500691 - DNA, 14 bp, Homo sapiens
aatggtccaggaga

SEQ ID NO: 3500692 - DNA, 12 bp, Homo sapiens
aatggtggagga

SEQ ID NO: 3500693 - DNA, 20 bp, Homo sapiens
aatggtggaggattgctgcc

SEQ ID NO: 3500694 - DNA, 17 bp, Homo sapiens
aatggtgttatttgaaa

SEQ ID NO: 3500695 - DNA, 12 bp, Homo sapiens
aatggttgtatt

SEQ ID NO: 3500696 - DNA, 15 bp, Homo sapiens
aatggttgtattaga

SEQ ID NO: 3500697 - DNA, 19 bp, Homo sapiens
aatggttgtattagatgtt

SEQ ID NO: 3500698 - DNA, 21 bp, Homo sapiens
aatggttgtattagatgttct

SEQ ID NO: 3500699 - DNA, 16 bp, Homo sapiens
aatggtttgtcctgat

SEQ ID NO: 3500700 - DNA, 21 bp, Homo sapiens
aatggtttttaaattttgtaa

SEQ ID NO: 3500701 - DNA, 23 bp, Homo sapiens
aatgtaaaggagtcaaaactaca

SEQ ID NO: 3500702 - DNA, 12 bp, Homo sapiens
aatgtaaccaat

SEQ ID NO: 3500703 - DNA, 13 bp, Homo sapiens
aatgtaattgtaa

SEQ ID NO: 3500704 - DNA, 17 bp, Homo sapiens
aatgtacagttgaaata

SEQ ID NO: 3500705 - DNA, 19 bp, Homo sapiens
aatgtattgaacttggaaa

SEQ ID NO: 3500706 - DNA, 15 bp, Homo sapiens
aatgtcacaggcagg

SEQ ID NO: 3500707 - DNA, 22 bp, Homo sapiens
aatgtctagttgtaacaccatg

SEQ ID NO: 3500708 - DNA, 20 bp, Homo sapiens
aatgtctctttaatgtcaca

SEQ ID NO: 3500709 - DNA, 15 bp, Homo sapiens
aatgtctgcagccct

SEQ ID NO: 3500710 - DNA, 17 bp, Homo sapiens
aatgtcttgctgttgac

SEQ ID NO: 3500711 - DNA, 23 bp, Homo sapiens
aatgtcttgctgttgacatattt

SEQ ID NO: 3500712 - DNA, 15 bp, Homo sapiens
aatgtgaaaagaaaa

SEQ ID NO: 3500713 - DNA, 15 bp, Homo sapiens
aatgtgaactttatt

SEQ ID NO: 3500714 - DNA, 19 bp, Homo sapiens
aatgtgacctttaattcag

SEQ ID NO: 3500715 - DNA, 20 bp, Homo sapiens
aatgtgatgaatactgtatt

SEQ ID NO: 3500716 - DNA, 22 bp, Homo sapiens
aatgtggcaaggaaaaacaggt

SEQ ID NO: 3500717 - DNA, 16 bp, Homo sapiens
aatgtggcttgagaaa

SEQ ID NO: 3500718 - DNA, 16 bp, Homo sapiens
aatgtgtaattttgtt

SEQ ID NO: 3500719 - DNA, 19 bp, Homo sapiens
aatgtgtaattttgttcta

SEQ ID NO: 3500720 - DNA, 19 bp, Homo sapiens
aatgtgtcaaattataaga

SEQ ID NO: 3500721 - DNA, 21 bp, Homo sapiens
aatgttaaataaattgtatat

SEQ ID NO: 3500722 - DNA, 15 bp, Homo sapiens
aatgttactgcctta

SEQ ID NO: 3500723 - DNA, 17 bp, Homo sapiens
aatgttactgccttaat

SEQ ID NO: 3500724 - DNA, 17 bp, Homo sapiens
aatgttccagacattct

SEQ ID NO: 3500725 - DNA, 18 bp, Homo sapiens
aatgttgagaatcccaaa

SEQ ID NO: 3500726 - DNA, 13 bp, Homo sapiens
aatgttggataag

SEQ ID NO: 3500727 - DNA, 18 bp, Homo sapiens
aatgttggataaggaatt

SEQ ID NO: 3500728 - DNA, 12 bp, Homo sapiens
aatgttgtttcc

SEQ ID NO: 3500729 - DNA, 15 bp, Homo sapiens
aatgtttaaacattt

SEQ ID NO: 3500730 - DNA, 15 bp, Homo sapiens
aatgttttaaatgta

SEQ ID NO: 3500731 - DNA, 16 bp, Homo sapiens
aatgttttctttgcaa

SEQ ID NO: 3500732 - DNA, 22 bp, Homo sapiens
aatgttttctttgcaaagtatt

SEQ ID NO: 3500733 - DNA, 14 bp, Homo sapiens
aattaaaacacttt

SEQ ID NO: 3500734 - DNA, 14 bp, Homo sapiens
aattaacagaaaaa

SEQ ID NO: 3500735 - DNA, 14 bp, Homo sapiens
aattaagaaggcaa

SEQ ID NO: 3500736 - DNA, 16 bp, Homo sapiens
aattaagaaggcaaaa

SEQ ID NO: 3500737 - DNA, 19 bp, Homo sapiens
aattaagaaggcaaaaatg

SEQ ID NO: 3500738 - DNA, 19 bp, Homo sapiens
aattagatgattatatatt

SEQ ID NO: 3500739 - DNA, 21 bp, Homo sapiens
aattagatgcatgttgaccat

SEQ ID NO: 3500740 - DNA, 22 bp, Homo sapiens
aattagatgcatgttgaccatg

SEQ ID NO: 3500741 - DNA, 13 bp, Homo sapiens
aattaggaaaaaa

SEQ ID NO: 3500742 - DNA, 17 bp, Homo sapiens
aattaggaagtgattat

SEQ ID NO: 3500743 - DNA, 21 bp, Homo sapiens
aattataagagacagacactt

SEQ ID NO: 3500744 - DNA, 22 bp, Homo sapiens
aattatagtgatgtaatcttga

SEQ ID NO: 3500745 - DNA, 23 bp, Homo sapiens
aattatgttaaactagcatatct

SEQ ID NO: 3500746 - DNA, 19 bp, Homo sapiens
aattatttcacaaataata

SEQ ID NO: 3500747 - DNA, 12 bp, Homo sapiens
aattatttgcat

SEQ ID NO: 3500748 - DNA, 23 bp, Homo sapiens
aattcaattgtaaattgaatcag

SEQ ID NO: 3500749 - DNA, 16 bp, Homo sapiens
aattcactttcatttt

SEQ ID NO: 3500750 - DNA, 15 bp, Homo sapiens
aattcagcaaaccat

SEQ ID NO: 3500751 - DNA, 16 bp, Homo sapiens
aattcagcaaaccatt

SEQ ID NO: 3500752 - DNA, 23 bp, Homo sapiens
aattcatcaaatggaagacacat

SEQ ID NO: 3500753 - DNA, 18 bp, Homo sapiens
aattcatcccaactgtct

SEQ ID NO: 3500754 - DNA, 14 bp, Homo sapiens
aattcatgtttctt

SEQ ID NO: 3500755 - DNA, 15 bp, Homo sapiens
aattccaaagcaaaa

SEQ ID NO: 3500756 - DNA, 16 bp, Homo sapiens
aattccacacctttta

SEQ ID NO: 3500757 - DNA, 12 bp, Homo sapiens
aattccccagat

SEQ ID NO: 3500758 - DNA, 14 bp, Homo sapiens
aattccctggggaa

SEQ ID NO: 3500759 - DNA, 13 bp, Homo sapiens
aattcctaacttt

SEQ ID NO: 3500760 - DNA, 15 bp, Homo sapiens
aattcctataaggaa

SEQ ID NO: 3500761 - DNA, 22 bp, Homo sapiens
aattcctatacgcagcgtgctt

SEQ ID NO: 3500762 - DNA, 14 bp, Homo sapiens
aattcctctgataa

SEQ ID NO: 3500763 - DNA, 13 bp, Homo sapiens
aattcctctggga

SEQ ID NO: 3500764 - DNA, 14 bp, Homo sapiens
aattcctctgggaa

SEQ ID NO: 3500765 - DNA, 18 bp, Homo sapiens
aattcctctttgctttgc

SEQ ID NO: 3500766 - DNA, 19 bp, Homo sapiens
aattcctctttgctttgct

SEQ ID NO: 3500767 - DNA, 21 bp, Homo sapiens
aattccttcgaaaggccttca

SEQ ID NO: 3500768 - DNA, 15 bp, Homo sapiens
aattctcctggaggt

SEQ ID NO: 3500769 - DNA, 15 bp, Homo sapiens
aattctgaatttgca

SEQ ID NO: 3500770 - DNA, 16 bp, Homo sapiens
aattctgaatttgcaa

SEQ ID NO: 3500771 - DNA, 16 bp, Homo sapiens
aattctgattcttcta

SEQ ID NO: 3500772 - DNA, 12 bp, Homo sapiens
aattctgtttct

SEQ ID NO: 3500773 - DNA, 13 bp, Homo sapiens
aattctgtttctt

SEQ ID NO: 3500774 - DNA, 22 bp, Homo sapiens
aattctgtttttaatgctattt

SEQ ID NO: 3500775 - DNA, 15 bp, Homo sapiens
aattcttctgtcctg

SEQ ID NO: 3500776 - DNA, 21 bp, Homo sapiens
aattcttgccaaatataaata

SEQ ID NO: 3500777 - DNA, 18 bp, Homo sapiens
aattcttgtaatttttat

SEQ ID NO: 3500778 - DNA, 23 bp, Homo sapiens
aattctttttttattattattta

SEQ ID NO: 3500779 - DNA, 17 bp, Homo sapiens
aattgaaaggcattctc

SEQ ID NO: 3500780 - DNA, 22 bp, Homo sapiens
aattgaaaggcattctctgaag

SEQ ID NO: 3500781 - DNA, 17 bp, Homo sapiens
aattgacaacccaaact

SEQ ID NO: 3500782 - DNA, 12 bp, Homo sapiens
aattgagcacaa

SEQ ID NO: 3500783 - DNA, 16 bp, Homo sapiens
aattgatttgcattga

SEQ ID NO: 3500784 - DNA, 23 bp, Homo sapiens
aattgatttgcattgaacacaaa

SEQ ID NO: 3500785 - DNA, 19 bp, Homo sapiens
aattgcacagaagtcctgt

SEQ ID NO: 3500786 - DNA, 20 bp, Homo sapiens
aattgcagataactttgact

SEQ ID NO: 3500787 - DNA, 11 bp, Homo sapiens
aattgcattga

SEQ ID NO: 3500788 - DNA, 15 bp, Homo sapiens
aattgccatattgca

SEQ ID NO: 3500789 - DNA, 16 bp, Homo sapiens
aattgccatattgcac

SEQ ID NO: 3500790 - DNA, 21 bp, Homo sapiens
acaagctgcaccctcaggcag

SEQ ID NO: 3500791 - DNA, 15 bp, Homo sapiens
acaaggacttcctgt

SEQ ID NO: 3500792 - DNA, 18 bp, Homo sapiens
acaaggatagatgctggc

SEQ ID NO: 3500793 - DNA, 21 bp, Homo sapiens
acaaggatagatgctggccca

SEQ ID NO: 3500794 - DNA, 16 bp, Homo sapiens
acaaggattgctactg

SEQ ID NO: 3500795 - DNA, 18 bp, Homo sapiens
acaaggccatctgggctc

SEQ ID NO: 3500796 - DNA, 19 bp, Homo sapiens
acaaggccttgcctggcct

SEQ ID NO: 3500797 - DNA, 13 bp, Homo sapiens
acaaggttcttcc

SEQ ID NO: 3500798 - DNA, 21 bp, Homo sapiens
acaagtcctggatgttgtgtg

SEQ ID NO: 3500799 - DNA, 18 bp, Homo sapiens
acaagtggactcagggca

SEQ ID NO: 3500800 - DNA, 12 bp, Homo sapiens
acaagtgtcttt

SEQ ID NO: 3500801 - DNA, 15 bp, Homo sapiens
acaataaaatattat

SEQ ID NO: 3500802 - DNA, 23 bp, Homo sapiens
acaataaaattttttttcatgtt

SEQ ID NO: 3500803 - DNA, 18 bp, Homo sapiens
acaataatgtaatttagt

SEQ ID NO: 3500804 - DNA, 19 bp, Homo sapiens
acaataatgtaatttagtc

SEQ ID NO: 3500805 - DNA, 22 bp, Homo sapiens
acaataatgtaatttagtctaa

SEQ ID NO: 3500806 - DNA, 13 bp, Homo sapiens
acaataatttcag

SEQ ID NO: 3500807 - DNA, 14 bp, Homo sapiens
acaatatgtgagtg

SEQ ID NO: 3500808 - DNA, 18 bp, Homo sapiens
acaatattgactttgtct

SEQ ID NO: 3500809 - DNA, 12 bp, Homo sapiens
acaatattttat

SEQ ID NO: 3500810 - DNA, 12 bp, Homo sapiens
acaatcatgttc

SEQ ID NO: 3500811 - DNA, 14 bp, Homo sapiens
acaatcatgttctg

SEQ ID NO: 3500812 - DNA, 17 bp, Homo sapiens
acaatcctagtgctttc

SEQ ID NO: 3500813 - DNA, 23 bp, Homo sapiens
acaatcctagtgctttccttttt

SEQ ID NO: 3500814 - DNA, 18 bp, Homo sapiens
acaatctggaagaaaaaa

SEQ ID NO: 3500815 - DNA, 15 bp, Homo sapiens
acaatgaatgtcttt

SEQ ID NO: 3500816 - DNA, 21 bp, Homo sapiens
acaatgacatacgcttttaat

SEQ ID NO: 3500817 - DNA, 18 bp, Homo sapiens
acaatggcagaacaggtg

SEQ ID NO: 3500818 - DNA, 11 bp, Homo sapiens
acaatgtctgc

SEQ ID NO: 3500819 - DNA, 19 bp, Homo sapiens
acaatgtctgcagccctga

SEQ ID NO: 3500820 - DNA, 12 bp, Homo sapiens
acaatgtgaact

SEQ ID NO: 3500821 - DNA, 21 bp, Homo sapiens
acaattaggcagactctttat

SEQ ID NO: 3500822 - DNA, 18 bp, Homo sapiens
acaattatatcagtcctc

SEQ ID NO: 3500823 - DNA, 17 bp, Homo sapiens
acaattccatttccagt

SEQ ID NO: 3500824 - DNA, 17 bp, Homo sapiens
acaattctgtttttaat

SEQ ID NO: 3500825 - DNA, 12 bp, Homo sapiens
acaattgaaatg

SEQ ID NO: 3500826 - DNA, 12 bp, Homo sapiens
acaattgtttgt

SEQ ID NO: 3500827 - DNA, 13 bp, Homo sapiens
acaatttacaaag

SEQ ID NO: 3500828 - DNA, 19 bp, Homo sapiens
acacaaaagtttctctttt

SEQ ID NO: 3500829 - DNA, 17 bp, Homo sapiens
acacaaacctgcctggg

SEQ ID NO: 3500830 - DNA, 18 bp, Homo sapiens
acacaaacgggctcagca

SEQ ID NO: 3500831 - DNA, 16 bp, Homo sapiens
acacaaactgtaaata

SEQ ID NO: 3500832 - DNA, 14 bp, Homo sapiens
acacaagagctgga

SEQ ID NO: 3500833 - DNA, 14 bp, Homo sapiens
acacacaacaatta

SEQ ID NO: 3500834 - DNA, 11 bp, Homo sapiens
acacacacaca

SEQ ID NO: 3500835 - DNA, 15 bp, Homo sapiens
acacacacacacaaa

SEQ ID NO: 3500836 - DNA, 15 bp, Homo sapiens
acacacagatacaca

SEQ ID NO: 3500837 - DNA, 12 bp, Homo sapiens
acacacagctcc

SEQ ID NO: 3500838 - DNA, 14 bp, Homo sapiens
acacaccagagccc

SEQ ID NO: 3500839 - DNA, 15 bp, Homo sapiens
acacaccagagccca

SEQ ID NO: 3500840 - DNA, 16 bp, Homo sapiens
acacacccctcaaaaa

SEQ ID NO: 3500841 - DNA, 19 bp, Homo sapiens
acacacccctcaaaaaaag

SEQ ID NO: 3500842 - DNA, 15 bp, Homo sapiens
acacactgaggcagg

SEQ ID NO: 3500843 - DNA, 22 bp, Homo sapiens
acacactgtcatgcttcatcat

SEQ ID NO: 3500844 - DNA, 18 bp, Homo sapiens
acacagaaaatgttgaga

SEQ ID NO: 3500845 - DNA, 19 bp, Homo sapiens
acacagaaaatgttgagaa

SEQ ID NO: 3500846 - DNA, 18 bp, Homo sapiens
acacagaaatgctgctgg

SEQ ID NO: 3500847 - DNA, 12 bp, Homo sapiens
acacagagaagg

SEQ ID NO: 3500848 - DNA, 23 bp, Homo sapiens
acacagccgattcacctgagcag

SEQ ID NO: 3500849 - DNA, 23 bp, Homo sapiens
acacagctaacacacagctccca

SEQ ID NO: 3500850 - DNA, 23 bp, Homo sapiens
acacagctactctccccacgagg

SEQ ID NO: 3500851 - DNA, 11 bp, Homo sapiens
acacagctctg

SEQ ID NO: 3500852 - DNA, 14 bp, Homo sapiens
acacagctctgtcc

SEQ ID NO: 3500853 - DNA, 16 bp, Homo sapiens
acacaggcccggctcc

SEQ ID NO: 3500854 - DNA, 17 bp, Homo sapiens
acacaggcccggctcca

SEQ ID NO: 3500855 - DNA, 19 bp, Homo sapiens
acacaggcccggctccagg

SEQ ID NO: 3500856 - DNA, 20 bp, Homo sapiens
acacaggcccggctccaggc

SEQ ID NO: 3500857 - DNA, 11 bp, Homo sapiens
acacagggcag

SEQ ID NO: 3500858 - DNA, 17 bp, Homo sapiens
acacaggtacagcaaca

SEQ ID NO: 3500859 - DNA, 16 bp, Homo sapiens
acacagtattacttct

SEQ ID NO: 3500860 - DNA, 22 bp, Homo sapiens
acacagtattacttctgctaca

SEQ ID NO: 3500861 - DNA, 19 bp, Homo sapiens
acacagttgaccctatttt

SEQ ID NO: 3500862 - DNA, 14 bp, Homo sapiens
acacatataaacat

SEQ ID NO: 3500863 - DNA, 19 bp, Homo sapiens
acaccaagcacagcagcct

SEQ ID NO: 3500864 - DNA, 13 bp, Homo sapiens
acaccaagcagca

SEQ ID NO: 3500865 - DNA, 16 bp, Homo sapiens
acaccaagcagcaaca

SEQ ID NO: 3500866 - DNA, 18 bp, Homo sapiens
acaccagagcccaccttg

SEQ ID NO: 3500867 - DNA, 23 bp, Homo sapiens
acaccagagcccaccttggctca

SEQ ID NO: 3500868 - DNA, 14 bp, Homo sapiens
acaccagcattcct

SEQ ID NO: 3500869 - DNA, 17 bp, Homo sapiens
acacccaagagggctgc

SEQ ID NO: 3500870 - DNA, 15 bp, Homo sapiens
acacccactcagctc

SEQ ID NO: 3500871 - DNA, 17 bp, Homo sapiens
acacccactcagctccg

SEQ ID NO: 3500872 - DNA, 13 bp, Homo sapiens
acacccagcccac

SEQ ID NO: 3500873 - DNA, 19 bp, Homo sapiens
acacccagcccacttctgc

SEQ ID NO: 3500874 - DNA, 18 bp, Homo sapiens
acaccctcaacctcttct

SEQ ID NO: 3500875 - DNA, 17 bp, Homo sapiens
acaccctccccattcag

SEQ ID NO: 3500876 - DNA, 22 bp, Homo sapiens
acacctagccagctgtcaaggg

SEQ ID NO: 3500877 - DNA, 21 bp, Homo sapiens
acacctctgcacaagctgcac

SEQ ID NO: 3500878 - DNA, 14 bp, Homo sapiens
acacctgccctaaa

SEQ ID NO: 3500879 - DNA, 22 bp, Homo sapiens
acacctttctcctttgtacttt

SEQ ID NO: 3500880 - DNA, 17 bp, Homo sapiens
acacgcacctgcctcag

SEQ ID NO: 3500881 - DNA, 15 bp, Homo sapiens
acacggacactcaaa

SEQ ID NO: 3500882 - DNA, 22 bp, Homo sapiens
acacggagcccagccctcccca

SEQ ID NO: 3500883 - DNA, 19 bp, Homo sapiens
acactactcttacatgtat

SEQ ID NO: 3500884 - DNA, 21 bp, Homo sapiens
acactactcttacatgtataa

SEQ ID NO: 3500885 - DNA, 22 bp, Homo sapiens
acactagctaatatcaatagaa

SEQ ID NO: 3500886 - DNA, 15 bp, Homo sapiens
acactcaaaagctgg

SEQ ID NO: 3500887 - DNA, 15 bp, Homo sapiens
acactcaagaagcag

SEQ ID NO: 3500888 - DNA, 17 bp, Homo sapiens
acactcaagaagcaggc

SEQ ID NO: 3500889 - DNA, 16 bp, Homo sapiens
acactcagcacaaggc

SEQ ID NO: 3500890 - DNA, 14 bp, Homo sapiens
acactccatcagct

SEQ ID NO: 3500891 - DNA, 16 bp, Homo sapiens
acactccatcagctta

SEQ ID NO: 3500892 - DNA, 14 bp, Homo sapiens
acactcccttgggc

SEQ ID NO: 3500893 - DNA, 20 bp, Homo sapiens
acactgagaatgtaagaact

SEQ ID NO: 3500894 - DNA, 14 bp, Homo sapiens
acactgaggcaggg

SEQ ID NO: 3500895 - DNA, 22 bp, Homo sapiens
acactgatgcttagatgttcca

SEQ ID NO: 3500896 - DNA, 15 bp, Homo sapiens
acactgcaagaagtc

SEQ ID NO: 3500897 - DNA, 21 bp, Homo sapiens
acactgcaggcatcacagcta

SEQ ID NO: 3500898 - DNA, 20 bp, Homo sapiens
acactgggtggtggcctggt

SEQ ID NO: 3500899 - DNA, 18 bp, Homo sapiens
acactgtgcacatctgtg

SEQ ID NO: 3500900 - DNA, 20 bp, Homo sapiens
acactgtgcacatctgtgtc

SEQ ID NO: 3500901 - DNA, 18 bp, Homo sapiens
acactgttttttggcttg

SEQ ID NO: 3500902 - DNA, 14 bp, Homo sapiens
acacttccattgtt

SEQ ID NO: 3500903 - DNA, 22 bp, Homo sapiens
acacttccattgtttaaaaata

SEQ ID NO: 3500904 - DNA, 23 bp, Homo sapiens
acacttgatggagtgtgagccac

SEQ ID NO: 3500905 - DNA, 19 bp, Homo sapiens
acactttgccatattttca

SEQ ID NO: 3500906 - DNA, 19 bp, Homo sapiens
acacttttcacctccttca

SEQ ID NO: 3500907 - DNA, 22 bp, Homo sapiens
acagaaagagacacacacacag

SEQ ID NO: 3500908 - DNA, 19 bp, Homo sapiens
acagaaatgctgctggcca

SEQ ID NO: 3500909 - DNA, 21 bp, Homo sapiens
acagaaatgctgctggccaaa

SEQ ID NO: 3500910 - DNA, 16 bp, Homo sapiens
acagaaccttgttatt

SEQ ID NO: 3500911 - DNA, 16 bp, Homo sapiens
acagaagattaagaca

SEQ ID NO: 3500912 - DNA, 21 bp, Homo sapiens
acagaagtcctgtatgtctgt

SEQ ID NO: 3500913 - DNA, 22 bp, Homo sapiens
acagaagtcctgtatgtctgtc

SEQ ID NO: 3500914 - DNA, 22 bp, Homo sapiens
acagaattactgtaactgatta

SEQ ID NO: 3500915 - DNA, 13 bp, Homo sapiens
acagacacacaca

SEQ ID NO: 3500916 - DNA, 13 bp, Homo sapiens
acagacacaggcc

SEQ ID NO: 3500917 - DNA, 14 bp, Homo sapiens
acagacacaggccc

SEQ ID NO: 3500918 - DNA, 14 bp, Homo sapiens
acagacatatttaa

SEQ ID NO: 3500919 - DNA, 23 bp, Homo sapiens
acagacgttaggcatttcctgct

SEQ ID NO: 3500920 - DNA, 22 bp, Homo sapiens
acagactcgattcatattgaat

SEQ ID NO: 3500921 - DNA, 19 bp, Homo sapiens
acagactggaagcacagct

SEQ ID NO: 3500922 - DNA, 22 bp, Homo sapiens
acataatgggccactgaaatct

SEQ ID NO: 3500923 - DNA, 17 bp, Homo sapiens
acataattcactctgag

SEQ ID NO: 3500924 - DNA, 13 bp, Homo sapiens
acatacaccagca

SEQ ID NO: 3500925 - DNA, 15 bp, Homo sapiens
acatacaccagcatt

SEQ ID NO: 3500926 - DNA, 20 bp, Homo sapiens
acatacagaattactgtaac

SEQ ID NO: 3500927 - DNA, 10 bp, Homo sapiens
acatacattg

SEQ ID NO: 3500928 - DNA, 18 bp, Homo sapiens
acatacttgaagggccag

SEQ ID NO: 3500929 - DNA, 23 bp, Homo sapiens
acatacttgaagggccagagcca

SEQ ID NO: 3500930 - DNA, 17 bp, Homo sapiens
acatagaaagttcatgg

SEQ ID NO: 3500931 - DNA, 18 bp, Homo sapiens
acatagcatgacatttct

SEQ ID NO: 3500932 - DNA, 17 bp, Homo sapiens
acatagccctaactcct

SEQ ID NO: 3500933 - DNA, 19 bp, Homo sapiens
acatagcgaatacaaaatt

SEQ ID NO: 3500934 - DNA, 16 bp, Homo sapiens
acataggactcaaagt

SEQ ID NO: 3500935 - DNA, 14 bp, Homo sapiens
acatagtattcatg

SEQ ID NO: 3500936 - DNA, 19 bp, Homo sapiens
acatagtattcatgactat

SEQ ID NO: 3500937 - DNA, 19 bp, Homo sapiens
acatagtgaaataaattct

SEQ ID NO: 3500938 - DNA, 15 bp, Homo sapiens
acatagtttttcagt

SEQ ID NO: 3500939 - DNA, 16 bp, Homo sapiens
acatatctttattaat

SEQ ID NO: 3500940 - DNA, 19 bp, Homo sapiens
acatatctttattaatcac

SEQ ID NO: 3500941 - DNA, 20 bp, Homo sapiens
acatattagtgcagccaagt

SEQ ID NO: 3500942 - DNA, 18 bp, Homo sapiens
acatatttaactggtgca

SEQ ID NO: 3500943 - DNA, 17 bp, Homo sapiens
acatatttaatgtttta

SEQ ID NO: 3500944 - DNA, 20 bp, Homo sapiens
acatatttaatgttttaaat

SEQ ID NO: 3500945 - DNA, 21 bp, Homo sapiens
acatatttaatgttttaaatg

SEQ ID NO: 3500946 - DNA, 17 bp, Homo sapiens
acatattttattaagaa

SEQ ID NO: 3500947 - DNA, 12 bp, Homo sapiens
acatcaaagagg

SEQ ID NO: 3500948 - DNA, 22 bp, Homo sapiens
acatcagctggtcaaacaaact

SEQ ID NO: 3500949 - DNA, 18 bp, Homo sapiens
acatcaggagactgggct

SEQ ID NO: 3500950 - DNA, 15 bp, Homo sapiens
acatcagtgtttgtt

SEQ ID NO: 3500951 - DNA, 19 bp, Homo sapiens
acatcagtgtttgttggat

SEQ ID NO: 3500952 - DNA, 15 bp, Homo sapiens
acatcagttactctg

SEQ ID NO: 3500953 - DNA, 19 bp, Homo sapiens
acatcatcaaggcactgcc

SEQ ID NO: 3500954 - DNA, 17 bp, Homo sapiens
acatccaaagcagacag

SEQ ID NO: 3500955 - DNA, 18 bp, Homo sapiens
acatccatcagcacccca

SEQ ID NO: 3500956 - DNA, 17 bp, Homo sapiens
acatcccgggcctcagt

SEQ ID NO: 3500957 - DNA, 13 bp, Homo sapiens
acatcctcctccc

SEQ ID NO: 3500958 - DNA, 13 bp, Homo sapiens
acatcctgcagct

SEQ ID NO: 3500959 - DNA, 16 bp, Homo sapiens
acatctaacctcatct

SEQ ID NO: 3500960 - DNA, 14 bp, Homo sapiens
acatctattctctc

SEQ ID NO: 3500961 - DNA, 18 bp, Homo sapiens
acatctggaatctgaggc

SEQ ID NO: 3500962 - DNA, 19 bp, Homo sapiens
acatctggaatctgaggca

SEQ ID NO: 3500963 - DNA, 15 bp, Homo sapiens
acatctgtgtcttgt

SEQ ID NO: 3500964 - DNA, 13 bp, Homo sapiens
acatcttcagatt

SEQ ID NO: 3500965 - DNA, 20 bp, Homo sapiens
acatcttgaatactctgccc

SEQ ID NO: 3500966 - DNA, 18 bp, Homo sapiens
acatcttgctctgctgac

SEQ ID NO: 3500967 - DNA, 21 bp, Homo sapiens
acatcttgctctgctgacaga

SEQ ID NO: 3500968 - DNA, 12 bp, Homo sapiens
acatcttgtagg

SEQ ID NO: 3500969 - DNA, 13 bp, Homo sapiens
acatctttcacat

SEQ ID NO: 3500970 - DNA, 18 bp, Homo sapiens
acatgaaacctacacact

SEQ ID NO: 3500971 - DNA, 17 bp, Homo sapiens
acatgaaatttttgtaa

SEQ ID NO: 3500972 - DNA, 19 bp, Homo sapiens
acatgaccctaaatcttga

SEQ ID NO: 3500973 - DNA, 17 bp, Homo sapiens
acatgaggggacatttt

SEQ ID NO: 3500974 - DNA, 12 bp, Homo sapiens
acatgatgcttt

SEQ ID NO: 3500975 - DNA, 15 bp, Homo sapiens
acatgattccttcct

SEQ ID NO: 3500976 - DNA, 22 bp, Homo sapiens
acatgattccttcctgttctga

SEQ ID NO: 3500977 - DNA, 18 bp, Homo sapiens
acatgcaagatacaggaa

SEQ ID NO: 3500978 - DNA, 10 bp, Homo sapiens
acatgcagtt

SEQ ID NO: 3500979 - DNA, 15 bp, Homo sapiens
acatgcagtttgaaa

SEQ ID NO: 3500980 - DNA, 14 bp, Homo sapiens
acatgccacaagga

SEQ ID NO: 3500981 - DNA, 15 bp, Homo sapiens
acatgcctgccccaa

SEQ ID NO: 3500982 - DNA, 14 bp, Homo sapiens
acatgcctgtcctg

SEQ ID NO: 3500983 - DNA, 23 bp, Homo sapiens
acatgcggagaacaaatgtgaag

SEQ ID NO: 3500984 - DNA, 18 bp, Homo sapiens
acatgcggtagccagcac

SEQ ID NO: 3500985 - DNA, 20 bp, Homo sapiens
acatgcggtagccagcacac

SEQ ID NO: 3500986 - DNA, 23 bp, Homo sapiens
acatgcggtagccagcacacagg

SEQ ID NO: 3500987 - DNA, 22 bp, Homo sapiens
acatgctatgttctgtcttccc

SEQ ID NO: 3500988 - DNA, 23 bp, Homo sapiens
acatgcttcaatagttcaaggaa

SEQ ID NO: 3500989 - DNA, 20 bp, Homo sapiens
acatgggagccgggtctgcc

SEQ ID NO: 3500990 - DNA, 21 bp, Homo sapiens
acatggtaaacgctgtcccta

SEQ ID NO: 3500991 - DNA, 23 bp, Homo sapiens
acatggtgctacgcctgcatgta

SEQ ID NO: 3500992 - DNA, 17 bp, Homo sapiens
acatgtaggaagtagga

SEQ ID NO: 3500993 - DNA, 20 bp, Homo sapiens
acatgtataaagtgattgac

SEQ ID NO: 3500994 - DNA, 18 bp, Homo sapiens
acatgtcagtaccttcaa

SEQ ID NO: 3500995 - DNA, 21 bp, Homo sapiens
acatgtcagtaccttcaaact

SEQ ID NO: 3500996 - DNA, 22 bp, Homo sapiens
acatgtcctaattcttctgtcc

SEQ ID NO: 3500997 - DNA, 21 bp, Homo sapiens
acatgtcttaatgaagtttga

SEQ ID NO: 3500998 - DNA, 22 bp, Homo sapiens
acatgtcttaatgaagtttgaa

SEQ ID NO: 3500999 - DNA, 23 bp, Homo sapiens
acatgtcttaatgaagtttgaat

SEQ ID NO: 3501000 - DNA, 19 bp, Homo sapiens
acatgttggaggagagagc

SEQ ID NO: 3501001 - DNA, 22 bp, Homo sapiens
acatgttggaggagagagcctt

SEQ ID NO: 3501002 - DNA, 20 bp, Homo sapiens
acatgttgggaaacttggct

SEQ ID NO: 3501003 - DNA, 15 bp, Homo sapiens
acattaaaacaatat

SEQ ID NO: 3501004 - DNA, 22 bp, Homo sapiens
acattaaaacaatattgtttct

SEQ ID NO: 3501005 - DNA, 21 bp, Homo sapiens
acattaagaaaatcatattgc

SEQ ID NO: 3501006 - DNA, 21 bp, Homo sapiens
acattcaaattctttttttat

SEQ ID NO: 3501007 - DNA, 14 bp, Homo sapiens
acattcacctgccc

SEQ ID NO: 3501008 - DNA, 17 bp, Homo sapiens
acattcagaggaagaca

SEQ ID NO: 3501009 - DNA, 22 bp, Homo sapiens
acattccaactcgtatagcatg

SEQ ID NO: 3501010 - DNA, 22 bp, Homo sapiens
acattccgaggggctcagttct

SEQ ID NO: 3501011 - DNA, 17 bp, Homo sapiens
acattccttgcctgcac

SEQ ID NO: 3501012 - DNA, 14 bp, Homo sapiens
acattctctaataa

SEQ ID NO: 3501013 - DNA, 16 bp, Homo sapiens
acattctgccaggccc

SEQ ID NO: 3501014 - DNA, 12 bp, Homo sapiens
acattctgcttt

SEQ ID NO: 3501015 - DNA, 13 bp, Homo sapiens
acattcttaaaaa

SEQ ID NO: 3501016 - DNA, 20 bp, Homo sapiens
acattcttggcttaatcatt

SEQ ID NO: 3501017 - DNA, 18 bp, Homo sapiens
acattgataattcaacat

SEQ ID NO: 3501018 - DNA, 16 bp, Homo sapiens
acattgattcagcctg

SEQ ID NO: 3501019 - DNA, 23 bp, Homo sapiens
acattgccaaaaaggatacataa

SEQ ID NO: 3501020 - DNA, 18 bp, Homo sapiens
acattgcctttgaatgtt

SEQ ID NO: 3501021 - DNA, 23 bp, Homo sapiens
acattgcgtttgaccttttatgt

SEQ ID NO: 3501022 - DNA, 15 bp, Homo sapiens
acattgggaagggga

SEQ ID NO: 3501023 - DNA, 23 bp, Homo sapiens
acattgggaaggggacccccgcc

SEQ ID NO: 3501024 - DNA, 21 bp, Homo sapiens
acatttaagggaatgtgagca

SEQ ID NO: 3501025 - DNA, 15 bp, Homo sapiens
acatttaatttagat

SEQ ID NO: 3501026 - DNA, 13 bp, Homo sapiens
acatttagatcct

SEQ ID NO: 3501027 - DNA, 15 bp, Homo sapiens
acatttattctgctc

SEQ ID NO: 3501028 - DNA, 21 bp, Homo sapiens
acatttattttgagaagctct

SEQ ID NO: 3501029 - DNA, 15 bp, Homo sapiens
acatttcaagtttac

SEQ ID NO: 3501030 - DNA, 23 bp, Homo sapiens
acatttcaagtttactccttctg

SEQ ID NO: 3501031 - DNA, 23 bp, Homo sapiens
acatttctctaagagaacaatgt

SEQ ID NO: 3501032 - DNA, 19 bp, Homo sapiens
acatttctttgtgctttgg

SEQ ID NO: 3501033 - DNA, 15 bp, Homo sapiens
acatttggaatactt

SEQ ID NO: 3501034 - DNA, 18 bp, Homo sapiens
acatttggaatacttttt

SEQ ID NO: 3501035 - DNA, 12 bp, Homo sapiens
acattttactgt

SEQ ID NO: 3501036 - DNA, 21 bp, Homo sapiens
acattttactgttgtacaatc

SEQ ID NO: 3501037 - DNA, 22 bp, Homo sapiens
acattttcagaaatattcatga

SEQ ID NO: 3501038 - DNA, 19 bp, Homo sapiens
acattttctttttttaact

SEQ ID NO: 3501039 - DNA, 15 bp, Homo sapiens
acatttttcaacttt

SEQ ID NO: 3501040 - DNA, 13 bp, Homo sapiens
accaaaaaaattg

SEQ ID NO: 3501041 - DNA, 17 bp, Homo sapiens
accaaaatactccaaag

SEQ ID NO: 3501042 - DNA, 11 bp, Homo sapiens
accaaaatgaa

SEQ ID NO: 3501043 - DNA, 12 bp, Homo sapiens
accaaaatgaaa

SEQ ID NO: 3501044 - DNA, 20 bp, Homo sapiens
accaaaggtgaaggaatata

SEQ ID NO: 3501045 - DNA, 19 bp, Homo sapiens
accaaagtgtcttttgaca

SEQ ID NO: 3501046 - DNA, 19 bp, Homo sapiens
accaacaaggaaactttcc

SEQ ID NO: 3501047 - DNA, 13 bp, Homo sapiens
accaacctgtttc

SEQ ID NO: 3501048 - DNA, 14 bp, Homo sapiens
accaacctgtttct

SEQ ID NO: 3501049 - DNA, 23 bp, Homo sapiens
accaactgtcactcattgctgag

SEQ ID NO: 3501050 - DNA, 12 bp, Homo sapiens
accaacttacaa

SEQ ID NO: 3501051 - DNA, 14 bp, Homo sapiens
accaagcacagcag

SEQ ID NO: 3501052 - DNA, 17 bp, Homo sapiens
accaagcacagcagcct

SEQ ID NO: 3501053 - DNA, 13 bp, Homo sapiens
accaagcaggaaa

SEQ ID NO: 3501054 - DNA, 11 bp, Homo sapiens
acctctcccac

SEQ ID NO: 3501055 - DNA, 15 bp, Homo sapiens
acctctcccacggga

SEQ ID NO: 3501056 - DNA, 14 bp, Homo sapiens
acctctctgtccct

SEQ ID NO: 3501057 - DNA, 23 bp, Homo sapiens
acctctcttatagaatatttatt

SEQ ID NO: 3501058 - DNA, 20 bp, Homo sapiens
acctctcttgaaccccaaat

SEQ ID NO: 3501059 - DNA, 13 bp, Homo sapiens
acctctgatacct

SEQ ID NO: 3501060 - DNA, 15 bp, Homo sapiens
acctctgatacctca

SEQ ID NO: 3501061 - DNA, 12 bp, Homo sapiens
acctctgcctga

SEQ ID NO: 3501062 - DNA, 20 bp, Homo sapiens
acctctgcctgaagtcacac

SEQ ID NO: 3501063 - DNA, 15 bp, Homo sapiens
acctctgcttcccag

SEQ ID NO: 3501064 - DNA, 21 bp, Homo sapiens
acctctggattaggtctctgt

SEQ ID NO: 3501065 - DNA, 14 bp, Homo sapiens
acctctgttcagtg

SEQ ID NO: 3501066 - DNA, 22 bp, Homo sapiens
acctctgttcagtgtaaatagt

SEQ ID NO: 3501067 - DNA, 12 bp, Homo sapiens
acctcttccgac

SEQ ID NO: 3501068 - DNA, 13 bp, Homo sapiens
acctcttctggag

SEQ ID NO: 3501069 - DNA, 14 bp, Homo sapiens
acctcttctggctc

SEQ ID NO: 3501070 - DNA, 12 bp, Homo sapiens
acctctttttaa

SEQ ID NO: 3501071 - DNA, 19 bp, Homo sapiens
acctgaaaacactgtgcac

SEQ ID NO: 3501072 - DNA, 21 bp, Homo sapiens
acctgaaaacactgtgcacat

SEQ ID NO: 3501073 - DNA, 19 bp, Homo sapiens
acctgacactcccttgggc

SEQ ID NO: 3501074 - DNA, 13 bp, Homo sapiens
acctgaggaagcg

SEQ ID NO: 3501075 - DNA, 14 bp, Homo sapiens
acctgaggctgtgg

SEQ ID NO: 3501076 - DNA, 20 bp, Homo sapiens
acctgatcctggaggcccag

SEQ ID NO: 3501077 - DNA, 22 bp, Homo sapiens
acctgatcctggaggcccagtt

SEQ ID NO: 3501078 - DNA, 11 bp, Homo sapiens
acctgattcaa

SEQ ID NO: 3501079 - DNA, 13 bp, Homo sapiens
acctgcaaaaaat

SEQ ID NO: 3501080 - DNA, 15 bp, Homo sapiens
acctgcaaagatctg

SEQ ID NO: 3501081 - DNA, 16 bp, Homo sapiens
acctgcaaagatctgt

SEQ ID NO: 3501082 - DNA, 18 bp, Homo sapiens
acctgcatctaagcccat

SEQ ID NO: 3501083 - DNA, 15 bp, Homo sapiens
acctgcattgtaaat

SEQ ID NO: 3501084 - DNA, 17 bp, Homo sapiens
acctgccccaactctcc

SEQ ID NO: 3501085 - DNA, 22 bp, Homo sapiens
acctgcccttttttctgcctcc

SEQ ID NO: 3501086 - DNA, 14 bp, Homo sapiens
acctgcctgtagcc

SEQ ID NO: 3501087 - DNA, 11 bp, Homo sapiens
acctgctgctt

SEQ ID NO: 3501088 - DNA, 17 bp, Homo sapiens
acctgctgcttctccaa

SEQ ID NO: 3501089 - DNA, 19 bp, Homo sapiens
acctggccgcctccaggag

SEQ ID NO: 3501090 - DNA, 21 bp, Homo sapiens
acctggctttttattgtattt

SEQ ID NO: 3501091 - DNA, 22 bp, Homo sapiens
acctgggagaaatctggcttct

SEQ ID NO: 3501092 - DNA, 13 bp, Homo sapiens
acctgggctgtga

SEQ ID NO: 3501093 - DNA, 20 bp, Homo sapiens
acctgggttgcagacaggaa

SEQ ID NO: 3501094 - DNA, 21 bp, Homo sapiens
acctgtataagtggaggcact

SEQ ID NO: 3501095 - DNA, 18 bp, Homo sapiens
acctgtcaccctgcagga

SEQ ID NO: 3501096 - DNA, 22 bp, Homo sapiens
acctgtctcctttcaccccagg

SEQ ID NO: 3501097 - DNA, 15 bp, Homo sapiens
acctgtgagcccagc

SEQ ID NO: 3501098 - DNA, 17 bp, Homo sapiens
acctgtgagcccagctg

SEQ ID NO: 3501099 - DNA, 14 bp, Homo sapiens
acctgtgcctcggc

SEQ ID NO: 3501100 - DNA, 19 bp, Homo sapiens
acctgttcagtactctaca

SEQ ID NO: 3501101 - DNA, 14 bp, Homo sapiens
acctgttgaagatt

SEQ ID NO: 3501102 - DNA, 21 bp, Homo sapiens
acctgtttatgagatgctggt

SEQ ID NO: 3501103 - DNA, 17 bp, Homo sapiens
acctgtttctacctata

SEQ ID NO: 3501104 - DNA, 22 bp, Homo sapiens
acctgtttctacctatatgcag

SEQ ID NO: 3501105 - DNA, 15 bp, Homo sapiens
acctgtttctctgcc

SEQ ID NO: 3501106 - DNA, 16 bp, Homo sapiens
acctgtttttaagctg

SEQ ID NO: 3501107 - DNA, 20 bp, Homo sapiens
acctgtttttaagctgtttc

SEQ ID NO: 3501108 - DNA, 13 bp, Homo sapiens
accttactaatta

SEQ ID NO: 3501109 - DNA, 16 bp, Homo sapiens
accttaggcagggaag

SEQ ID NO: 3501110 - DNA, 16 bp, Homo sapiens
accttaggccttcctc

SEQ ID NO: 3501111 - DNA, 18 bp, Homo sapiens
accttatgagaaactgca

SEQ ID NO: 3501112 - DNA, 12 bp, Homo sapiens
accttcagctca

SEQ ID NO: 3501113 - DNA, 22 bp, Homo sapiens
accttcagtaacccccactgga

SEQ ID NO: 3501114 - DNA, 15 bp, Homo sapiens
accttcatttcatgt

SEQ ID NO: 3501115 - DNA, 15 bp, Homo sapiens
accttcgggctgtgc

SEQ ID NO: 3501116 - DNA, 17 bp, Homo sapiens
accttcgggctgtgccc

SEQ ID NO: 3501117 - DNA, 21 bp, Homo sapiens
accttcgtttactatgcctgt

SEQ ID NO: 3501118 - DNA, 22 bp, Homo sapiens
accttctaggacgccacccagc

SEQ ID NO: 3501119 - DNA, 23 bp, Homo sapiens
accttctctatggggcatcctct

SEQ ID NO: 3501120 - DNA, 19 bp, Homo sapiens
accttctgcctttgatgtt

SEQ ID NO: 3501121 - DNA, 20 bp, Homo sapiens
accttctttggccccttgct

SEQ ID NO: 3501122 - DNA, 18 bp, Homo sapiens
accttggacatcctcctc

SEQ ID NO: 3501123 - DNA, 19 bp, Homo sapiens
accttggacatcctcctcc

SEQ ID NO: 3501124 - DNA, 18 bp, Homo sapiens
accttggcaccagacacc

SEQ ID NO: 3501125 - DNA, 14 bp, Homo sapiens
accttggcctgggc

SEQ ID NO: 3501126 - DNA, 12 bp, Homo sapiens
accttggccttc

SEQ ID NO: 3501127 - DNA, 18 bp, Homo sapiens
accttggccttctcccct

SEQ ID NO: 3501128 - DNA, 22 bp, Homo sapiens
accttggccttctcccctcttc

SEQ ID NO: 3501129 - DNA, 23 bp, Homo sapiens
accttggccttctcccctcttct

SEQ ID NO: 3501130 - DNA, 12 bp, Homo sapiens
accttggctgca

SEQ ID NO: 3501131 - DNA, 14 bp, Homo sapiens
accttggctgcagg

SEQ ID NO: 3501132 - DNA, 16 bp, Homo sapiens
accttgttacttctga

SEQ ID NO: 3501133 - DNA, 19 bp, Homo sapiens
acctttaactgagggctga

SEQ ID NO: 3501134 - DNA, 22 bp, Homo sapiens
acctttaagaattttaaatatt

SEQ ID NO: 3501135 - DNA, 14 bp, Homo sapiens
acctttactttaga

SEQ ID NO: 3501136 - DNA, 20 bp, Homo sapiens
acctttatcacctcattctg

SEQ ID NO: 3501137 - DNA, 20 bp, Homo sapiens
acctttcataatctttgctt

SEQ ID NO: 3501138 - DNA, 17 bp, Homo sapiens
acctttgtacagcccag

SEQ ID NO: 3501139 - DNA, 22 bp, Homo sapiens
acctttgtagcactcaggctct

SEQ ID NO: 3501140 - DNA, 16 bp, Homo sapiens
accttttattgacaca

SEQ ID NO: 3501141 - DNA, 14 bp, Homo sapiens
acgaatacttttgc

SEQ ID NO: 3501142 - DNA, 21 bp, Homo sapiens
acgaatttctgtgccctcctg

SEQ ID NO: 3501143 - DNA, 22 bp, Homo sapiens
acgaatttctgtgccctcctga

SEQ ID NO: 3501144 - DNA, 15 bp, Homo sapiens
acgactgcccggcag

SEQ ID NO: 3501145 - DNA, 17 bp, Homo sapiens
acgagagcagaggtctc

SEQ ID NO: 3501146 - DNA, 19 bp, Homo sapiens
acgagcacctccagcctga

SEQ ID NO: 3501147 - DNA, 11 bp, Homo sapiens
acgagggctgg

SEQ ID NO: 3501148 - DNA, 20 bp, Homo sapiens
acgaggggtgtcttgggcag

SEQ ID NO: 3501149 - DNA, 23 bp, Homo sapiens
acgatacgctactataaagagaa

SEQ ID NO: 3501150 - DNA, 20 bp, Homo sapiens
acgattggtatgatgctgcc

SEQ ID NO: 3501151 - DNA, 18 bp, Homo sapiens
acgcaaactttgagcctt

SEQ ID NO: 3501152 - DNA, 15 bp, Homo sapiens
acgcacctcccatcc

SEQ ID NO: 3501153 - DNA, 19 bp, Homo sapiens
acgcacctcccatcctaat

SEQ ID NO: 3501154 - DNA, 14 bp, Homo sapiens
acgcacctgcctca

SEQ ID NO: 3501155 - DNA, 15 bp, Homo sapiens
acgcaggcccctctc

SEQ ID NO: 3501156 - DNA, 18 bp, Homo sapiens
acgcaggcccctctcctc

SEQ ID NO: 3501157 - DNA, 20 bp, Homo sapiens
acgcaggcccctctcctccg

SEQ ID NO: 3501158 - DNA, 14 bp, Homo sapiens
acgcagtggccttc

SEQ ID NO: 3501159 - DNA, 18 bp, Homo sapiens
acgcccgtcctgcctgtg

SEQ ID NO: 3501160 - DNA, 14 bp, Homo sapiens
acgcctcccactgg

SEQ ID NO: 3501161 - DNA, 23 bp, Homo sapiens
acgcctcttctgtccctgttaga

SEQ ID NO: 3501162 - DNA, 13 bp, Homo sapiens
acgcctgaggaac

SEQ ID NO: 3501163 - DNA, 20 bp, Homo sapiens
acgcgtgcacacaccagagc

SEQ ID NO: 3501164 - DNA, 15 bp, Homo sapiens
acgctgagccacctg

SEQ ID NO: 3501165 - DNA, 22 bp, Homo sapiens
acgctgagccacctgccctttt

SEQ ID NO: 3501166 - DNA, 11 bp, Homo sapiens
acgctgcctct

SEQ ID NO: 3501167 - DNA, 12 bp, Homo sapiens
acgctgctctca

SEQ ID NO: 3501168 - DNA, 20 bp, Homo sapiens
acgctggaccttgaactggg

SEQ ID NO: 3501169 - DNA, 19 bp, Homo sapiens
acgctggagtgcagtgagc

SEQ ID NO: 3501170 - DNA, 23 bp, Homo sapiens
acgctgggtattaccatgtaaat

SEQ ID NO: 3501171 - DNA, 13 bp, Homo sapiens
acgcttcacagtg

SEQ ID NO: 3501172 - DNA, 16 bp, Homo sapiens
acgcttcacagtgatc

SEQ ID NO: 3501173 - DNA, 11 bp, Homo sapiens
acgctttgatt

SEQ ID NO: 3501174 - DNA, 13 bp, Homo sapiens
acgctttgattca

SEQ ID NO: 3501175 - DNA, 16 bp, Homo sapiens
acgctttgattcatag

SEQ ID NO: 3501176 - DNA, 15 bp, Homo sapiens
acggaagagccttgc

SEQ ID NO: 3501177 - DNA, 13 bp, Homo sapiens
acggaagttttca

SEQ ID NO: 3501178 - DNA, 14 bp, Homo sapiens
acggaagttttcaa

SEQ ID NO: 3501179 - DNA, 19 bp, Homo sapiens
acggaagttttcaatgatg

SEQ ID NO: 3501180 - DNA, 15 bp, Homo sapiens
acggacaccccctcg

SEQ ID NO: 3501181 - DNA, 19 bp, Homo sapiens
acggacactcaaaagctgg

SEQ ID NO: 3501182 - DNA, 19 bp, Homo sapiens
acggagagcgcctgcccct

SEQ ID NO: 3501183 - DNA, 20 bp, Homo sapiens
acggagcccagccctcccca

SEQ ID NO: 3501184 - DNA, 18 bp, Homo sapiens
acggaggggagtagagaa

SEQ ID NO: 3501185 - DNA, 17 bp, Homo sapiens
acggatctgagaatctt

SEQ ID NO: 3501186 - DNA, 16 bp, Homo sapiens
acggcaacattcctca

SEQ ID NO: 3501187 - DNA, 19 bp, Homo sapiens
actccatcagttagagctg

SEQ ID NO: 3501188 - DNA, 16 bp, Homo sapiens
actccatctctcatcc

SEQ ID NO: 3501189 - DNA, 13 bp, Homo sapiens
actcccaggcagc

SEQ ID NO: 3501190 - DNA, 13 bp, Homo sapiens
actcccattcctg

SEQ ID NO: 3501191 - DNA, 16 bp, Homo sapiens
actcccattcctgaag

SEQ ID NO: 3501192 - DNA, 16 bp, Homo sapiens
actccccgaagtcttt

SEQ ID NO: 3501193 - DNA, 15 bp, Homo sapiens
actcccttcccataa

SEQ ID NO: 3501194 - DNA, 20 bp, Homo sapiens
actccctttttacactttat

SEQ ID NO: 3501195 - DNA, 23 bp, Homo sapiens
actccgagaggtgggccagtctg

SEQ ID NO: 3501196 - DNA, 13 bp, Homo sapiens
actccggccctcc

SEQ ID NO: 3501197 - DNA, 15 bp, Homo sapiens
actccggctgtgctg

SEQ ID NO: 3501198 - DNA, 17 bp, Homo sapiens
actccggctgtgctggg

SEQ ID NO: 3501199 - DNA, 17 bp, Homo sapiens
actccgttggccactcc

SEQ ID NO: 3501200 - DNA, 13 bp, Homo sapiens
actcctaggcagg

SEQ ID NO: 3501201 - DNA, 16 bp, Homo sapiens
actcctaggcaggaca

SEQ ID NO: 3501202 - DNA, 20 bp, Homo sapiens
actcctctgactcagggctc

SEQ ID NO: 3501203 - DNA, 17 bp, Homo sapiens
actcctgccaaggagga

SEQ ID NO: 3501204 - DNA, 14 bp, Homo sapiens
actcctggcctcaa

SEQ ID NO: 3501205 - DNA, 14 bp, Homo sapiens
actccttctctcac

SEQ ID NO: 3501206 - DNA, 21 bp, Homo sapiens
actccttctgttttgagtttt

SEQ ID NO: 3501207 - DNA, 18 bp, Homo sapiens
actccttgagagaccagg

SEQ ID NO: 3501208 - DNA, 19 bp, Homo sapiens
actcgattcatattgaata

SEQ ID NO: 3501209 - DNA, 17 bp, Homo sapiens
actcgcttgctagaagt

SEQ ID NO: 3501210 - DNA, 16 bp, Homo sapiens
actcggggtgcttcct

SEQ ID NO: 3501211 - DNA, 21 bp, Homo sapiens
actctacaattcctctgataa

SEQ ID NO: 3501212 - DNA, 21 bp, Homo sapiens
actctacatgtaactatttct

SEQ ID NO: 3501213 - DNA, 15 bp, Homo sapiens
actctactgttgcaa

SEQ ID NO: 3501214 - DNA, 21 bp, Homo sapiens
actctagatgaagttttacat

SEQ ID NO: 3501215 - DNA, 17 bp, Homo sapiens
actctagggaaaaacca

SEQ ID NO: 3501216 - DNA, 17 bp, Homo sapiens
actctaggtgcccttgg

SEQ ID NO: 3501217 - DNA, 13 bp, Homo sapiens
actctcagtctct

SEQ ID NO: 3501218 - DNA, 14 bp, Homo sapiens
actctcagtctctg

SEQ ID NO: 3501219 - DNA, 20 bp, Homo sapiens
actctccccacgagggctgg

SEQ ID NO: 3501220 - DNA, 14 bp, Homo sapiens
actctctaccagat

SEQ ID NO: 3501221 - DNA, 21 bp, Homo sapiens
actctctgaacccctccctcc

SEQ ID NO: 3501222 - DNA, 23 bp, Homo sapiens
actctgaagctgacgaacttcca

SEQ ID NO: 3501223 - DNA, 20 bp, Homo sapiens
actctgccccccccccccat

SEQ ID NO: 3501224 - DNA, 18 bp, Homo sapiens
actctgctcgccttagca

SEQ ID NO: 3501225 - DNA, 14 bp, Homo sapiens
actctgcttctctg

SEQ ID NO: 3501226 - DNA, 20 bp, Homo sapiens
actctgcttctctgacttct

SEQ ID NO: 3501227 - DNA, 21 bp, Homo sapiens
actctgcttctctgacttctg

SEQ ID NO: 3501228 - DNA, 13 bp, Homo sapiens
actctgcttgtta

SEQ ID NO: 3501229 - DNA, 18 bp, Homo sapiens
actctggaagattttcat

SEQ ID NO: 3501230 - DNA, 21 bp, Homo sapiens
actctggaagattttcattga

SEQ ID NO: 3501231 - DNA, 23 bp, Homo sapiens
actctgggctcaagcaatcctct

SEQ ID NO: 3501232 - DNA, 15 bp, Homo sapiens
actctgggtccttcc

SEQ ID NO: 3501233 - DNA, 16 bp, Homo sapiens
actctgggtccttcct

SEQ ID NO: 3501234 - DNA, 18 bp, Homo sapiens
actctgggtccttcctga

SEQ ID NO: 3501235 - DNA, 17 bp, Homo sapiens
actctgtcttcacctga

SEQ ID NO: 3501236 - DNA, 21 bp, Homo sapiens
actcttaaaaatgttttttca

SEQ ID NO: 3501237 - DNA, 11 bp, Homo sapiens
actcttaaaac

SEQ ID NO: 3501238 - DNA, 18 bp, Homo sapiens
actcttaaaacccaagtg

SEQ ID NO: 3501239 - DNA, 17 bp, Homo sapiens
actcttacatgtataaa

SEQ ID NO: 3501240 - DNA, 21 bp, Homo sapiens
actcttattgcccacgctgga

SEQ ID NO: 3501241 - DNA, 17 bp, Homo sapiens
actcttcacaaaatctg

SEQ ID NO: 3501242 - DNA, 18 bp, Homo sapiens
actcttcagttaattctt

SEQ ID NO: 3501243 - DNA, 23 bp, Homo sapiens
actcttctctcaaccttggcctt

SEQ ID NO: 3501244 - DNA, 13 bp, Homo sapiens
actctttcaaaac

SEQ ID NO: 3501245 - DNA, 21 bp, Homo sapiens
actctttctgagtgccttctg

SEQ ID NO: 3501246 - DNA, 22 bp, Homo sapiens
actctttctgtatatacttttt

SEQ ID NO: 3501247 - DNA, 14 bp, Homo sapiens
actcttttgcttta

SEQ ID NO: 3501248 - DNA, 16 bp, Homo sapiens
actgaaaacctctcct

SEQ ID NO: 3501249 - DNA, 23 bp, Homo sapiens
actgaatattgacaagtgtcttt

SEQ ID NO: 3501250 - DNA, 23 bp, Homo sapiens
actgacattgttggccaaagcca

SEQ ID NO: 3501251 - DNA, 12 bp, Homo sapiens
actgaccagaac

SEQ ID NO: 3501252 - DNA, 21 bp, Homo sapiens
actgagcaccctctggattct

SEQ ID NO: 3501253 - DNA, 13 bp, Homo sapiens
actgaggaagaac

SEQ ID NO: 3501254 - DNA, 22 bp, Homo sapiens
actgaggaagaacggggctctt

SEQ ID NO: 3501255 - DNA, 12 bp, Homo sapiens
actgagggcagt

SEQ ID NO: 3501256 - DNA, 20 bp, Homo sapiens
actgagtagctctcctgact

SEQ ID NO: 3501257 - DNA, 14 bp, Homo sapiens
actgagtgaaggaa

SEQ ID NO: 3501258 - DNA, 18 bp, Homo sapiens
actgagttttccatggca

SEQ ID NO: 3501259 - DNA, 11 bp, Homo sapiens
actgatgctgc

SEQ ID NO: 3501260 - DNA, 12 bp, Homo sapiens
actgatgctgcc

SEQ ID NO: 3501261 - DNA, 14 bp, Homo sapiens
actgatgctgcccc

SEQ ID NO: 3501262 - DNA, 15 bp, Homo sapiens
actgatgctgcccct

SEQ ID NO: 3501263 - DNA, 15 bp, Homo sapiens
actgatgcttagatg

SEQ ID NO: 3501264 - DNA, 14 bp, Homo sapiens
actgatttagccat

SEQ ID NO: 3501265 - DNA, 19 bp, Homo sapiens
actgcaagtccttttgtaa

SEQ ID NO: 3501266 - DNA, 20 bp, Homo sapiens
actgcaagtccttttgtaaa

SEQ ID NO: 3501267 - DNA, 18 bp, Homo sapiens
actgcacagcgtcctgtc

SEQ ID NO: 3501268 - DNA, 14 bp, Homo sapiens
actgcaccgggcca

SEQ ID NO: 3501269 - DNA, 16 bp, Homo sapiens
actgcaccgggccaca

SEQ ID NO: 3501270 - DNA, 16 bp, Homo sapiens
actgcagagcagatgg

SEQ ID NO: 3501271 - DNA, 17 bp, Homo sapiens
actgcagagcagatggc

SEQ ID NO: 3501272 - DNA, 14 bp, Homo sapiens
actgcagccacagg

SEQ ID NO: 3501273 - DNA, 12 bp, Homo sapiens
actgcaggccct

SEQ ID NO: 3501274 - DNA, 13 bp, Homo sapiens
actgcaggccctg

SEQ ID NO: 3501275 - DNA, 15 bp, Homo sapiens
actgcaggccctggc

SEQ ID NO: 3501276 - DNA, 22 bp, Homo sapiens
actgcaggccctggcctcccct

SEQ ID NO: 3501277 - DNA, 23 bp, Homo sapiens
actgcagggaaaattatttgcat

SEQ ID NO: 3501278 - DNA, 17 bp, Homo sapiens
actgcagtcctggagca

SEQ ID NO: 3501279 - DNA, 16 bp, Homo sapiens
actgcatgctgctgga

SEQ ID NO: 3501280 - DNA, 17 bp, Homo sapiens
actgcatgctgctggac

SEQ ID NO: 3501281 - DNA, 21 bp, Homo sapiens
actgcattaccgcgttgtaaa

SEQ ID NO: 3501282 - DNA, 22 bp, Homo sapiens
actgcattaccgcgttgtaaaa

SEQ ID NO: 3501283 - DNA, 19 bp, Homo sapiens
actgccacaccctccccat

SEQ ID NO: 3501284 - DNA, 16 bp, Homo sapiens
actgccactccagtcc

SEQ ID NO: 3501285 - DNA, 13 bp, Homo sapiens
actgccataaaac

SEQ ID NO: 3501286 - DNA, 21 bp, Homo sapiens
actgccataaaacattaagaa

SEQ ID NO: 3501287 - DNA, 23 bp, Homo sapiens
actgccataaaacattaagaaaa

SEQ ID NO: 3501288 - DNA, 22 bp, Homo sapiens
actgcccggcacagatgctcca

SEQ ID NO: 3501289 - DNA, 23 bp, Homo sapiens
actgccctccagctctttcctcc

SEQ ID NO: 3501290 - DNA, 12 bp, Homo sapiens
actgccctggct

SEQ ID NO: 3501291 - DNA, 17 bp, Homo sapiens
actgcctcgaaacacag

SEQ ID NO: 3501292 - DNA, 19 bp, Homo sapiens
actgcctcgaaacacagaa

SEQ ID NO: 3501293 - DNA, 15 bp, Homo sapiens
actgccttcgcttct

SEQ ID NO: 3501294 - DNA, 21 bp, Homo sapiens
actgccttcgcttcttgcctc

SEQ ID NO: 3501295 - DNA, 15 bp, Homo sapiens
actgccttgcctcct

SEQ ID NO: 3501296 - DNA, 20 bp, Homo sapiens
actgccttgcctcctcagta

SEQ ID NO: 3501297 - DNA, 17 bp, Homo sapiens
actgcgactttctgcct

SEQ ID NO: 3501298 - DNA, 21 bp, Homo sapiens
actgcgactttctgcctggag

SEQ ID NO: 3501299 - DNA, 16 bp, Homo sapiens
actgctaccttcctag

SEQ ID NO: 3501300 - DNA, 13 bp, Homo sapiens
actgctactgtaa

SEQ ID NO: 3501301 - DNA, 18 bp, Homo sapiens
actgctactgtaatttta

SEQ ID NO: 3501302 - DNA, 22 bp, Homo sapiens
actgctactgtaattttatatg

SEQ ID NO: 3501303 - DNA, 18 bp, Homo sapiens
actgctagagacgctgat

SEQ ID NO: 3501304 - DNA, 22 bp, Homo sapiens
actgctcagaacttgctgctgt

SEQ ID NO: 3501305 - DNA, 23 bp, Homo sapiens
actgctcatcattccttgagaaa

SEQ ID NO: 3501306 - DNA, 12 bp, Homo sapiens
actgctccaagt

SEQ ID NO: 3501307 - DNA, 20 bp, Homo sapiens
actgctctcagcctcccaac

SEQ ID NO: 3501308 - DNA, 23 bp, Homo sapiens
actgctgtgaaccctggggcctg

SEQ ID NO: 3501309 - DNA, 21 bp, Homo sapiens
actgcttcatttttgtaataa

SEQ ID NO: 3501310 - DNA, 14 bp, Homo sapiens
actgcttgaggaaa

SEQ ID NO: 3501311 - DNA, 14 bp, Homo sapiens
actgcttttggtct

SEQ ID NO: 3501312 - DNA, 20 bp, Homo sapiens
actgcttttggtctgtgtga

SEQ ID NO: 3501313 - DNA, 16 bp, Homo sapiens
actggaccctgttgct

SEQ ID NO: 3501314 - DNA, 17 bp, Homo sapiens
actggaccctgttgcta

SEQ ID NO: 3501315 - DNA, 14 bp, Homo sapiens
actggactccggcc

SEQ ID NO: 3501316 - DNA, 19 bp, Homo sapiens
actggactccggccctcct

SEQ ID NO: 3501317 - DNA, 11 bp, Homo sapiens
actggccaggg

SEQ ID NO: 3501318 - DNA, 19 bp, Homo sapiens
actggcgacacgtagcagc

SEQ ID NO: 3501319 - DNA, 12 bp, Homo sapiens
acttggtttgtg

SEQ ID NO: 3501320 - DNA, 18 bp, Homo sapiens
acttgtaaaggaatttaa

SEQ ID NO: 3501321 - DNA, 15 bp, Homo sapiens
acttgtggacacagc

SEQ ID NO: 3501322 - DNA, 16 bp, Homo sapiens
acttgtggacacagct

SEQ ID NO: 3501323 - DNA, 17 bp, Homo sapiens
acttgtggacacagctc

SEQ ID NO: 3501324 - DNA, 18 bp, Homo sapiens
acttgtggactaaaagat

SEQ ID NO: 3501325 - DNA, 18 bp, Homo sapiens
actttaaggggaagataa

SEQ ID NO: 3501326 - DNA, 20 bp, Homo sapiens
actttacaatgttcatccca

SEQ ID NO: 3501327 - DNA, 17 bp, Homo sapiens
actttagaaagctgaca

SEQ ID NO: 3501328 - DNA, 18 bp, Homo sapiens
actttaggctttcagctt

SEQ ID NO: 3501329 - DNA, 19 bp, Homo sapiens
actttaggctttcagctta

SEQ ID NO: 3501330 - DNA, 21 bp, Homo sapiens
actttaggctttcagcttaca

SEQ ID NO: 3501331 - DNA, 22 bp, Homo sapiens
actttagggctgtaaaatgcat

SEQ ID NO: 3501332 - DNA, 17 bp, Homo sapiens
actttagtctgcaaaat

SEQ ID NO: 3501333 - DNA, 19 bp, Homo sapiens
actttatagttgttttata

SEQ ID NO: 3501334 - DNA, 15 bp, Homo sapiens
actttattaaataca

SEQ ID NO: 3501335 - DNA, 17 bp, Homo sapiens
actttcatgctacagaa

SEQ ID NO: 3501336 - DNA, 21 bp, Homo sapiens
actttcatttttttccaggct

SEQ ID NO: 3501337 - DNA, 23 bp, Homo sapiens
actttcatttttttccaggctgg

SEQ ID NO: 3501338 - DNA, 23 bp, Homo sapiens
actttcctggatgtctgaacttt

SEQ ID NO: 3501339 - DNA, 14 bp, Homo sapiens
actttcctttaact

SEQ ID NO: 3501340 - DNA, 22 bp, Homo sapiens
actttcctttaactcccttttt

SEQ ID NO: 3501341 - DNA, 13 bp, Homo sapiens
actttctgcctgg

SEQ ID NO: 3501342 - DNA, 14 bp, Homo sapiens
actttctgcctgga

SEQ ID NO: 3501343 - DNA, 18 bp, Homo sapiens
actttcttctgaatattt

SEQ ID NO: 3501344 - DNA, 20 bp, Homo sapiens
actttcttctgaatatttta

SEQ ID NO: 3501345 - DNA, 20 bp, Homo sapiens
actttgaataaagaatactt

SEQ ID NO: 3501346 - DNA, 21 bp, Homo sapiens
actttgaggataactttttaa

SEQ ID NO: 3501347 - DNA, 14 bp, Homo sapiens
actttgattctgat

SEQ ID NO: 3501348 - DNA, 13 bp, Homo sapiens
actttgtaaatag

SEQ ID NO: 3501349 - DNA, 10 bp, Homo sapiens
actttgtgct

SEQ ID NO: 3501350 - DNA, 16 bp, Homo sapiens
actttgtgttcacctt

SEQ ID NO: 3501351 - DNA, 22 bp, Homo sapiens
acttttcacctccttcaattcc

SEQ ID NO: 3501352 - DNA, 20 bp, Homo sapiens
acttttcataacctagcctt

SEQ ID NO: 3501353 - DNA, 14 bp, Homo sapiens
acttttcattccct

SEQ ID NO: 3501354 - DNA, 15 bp, Homo sapiens
acttttcattccctg

SEQ ID NO: 3501355 - DNA, 18 bp, Homo sapiens
acttttcattctctttta

SEQ ID NO: 3501356 - DNA, 20 bp, Homo sapiens
acttttcattctcttttaat

SEQ ID NO: 3501357 - DNA, 14 bp, Homo sapiens
acttttctttgtgg

SEQ ID NO: 3501358 - DNA, 12 bp, Homo sapiens
acttttgacaaa

SEQ ID NO: 3501359 - DNA, 21 bp, Homo sapiens
acttttggaaccatgccttcc

SEQ ID NO: 3501360 - DNA, 22 bp, Homo sapiens
acttttggcctcatctctgcct

SEQ ID NO: 3501361 - DNA, 22 bp, Homo sapiens
actttttaaaaaaataaaacag

SEQ ID NO: 3501362 - DNA, 15 bp, Homo sapiens
actttttagtaattt

SEQ ID NO: 3501363 - DNA, 13 bp, Homo sapiens
actttttattgcc

SEQ ID NO: 3501364 - DNA, 17 bp, Homo sapiens
actttttattgccttct

SEQ ID NO: 3501365 - DNA, 11 bp, Homo sapiens
actttttccag

SEQ ID NO: 3501366 - DNA, 14 bp, Homo sapiens
actttttcttgtat

SEQ ID NO: 3501367 - DNA, 13 bp, Homo sapiens
actttttgcagct

SEQ ID NO: 3501368 - DNA, 17 bp, Homo sapiens
actttttgcagctttct

SEQ ID NO: 3501369 - DNA, 18 bp, Homo sapiens
actttttgtgaagacggc

SEQ ID NO: 3501370 - DNA, 23 bp, Homo sapiens
actttttgtgaagacggcacggt

SEQ ID NO: 3501371 - DNA, 19 bp, Homo sapiens
acttttttaaatattttct

SEQ ID NO: 3501372 - DNA, 22 bp, Homo sapiens
acttttttgagtggatgatgtt

SEQ ID NO: 3501373 - DNA, 18 bp, Homo sapiens
acttttttgtacataaat

SEQ ID NO: 3501374 - DNA, 12 bp, Homo sapiens
agaaaaaaacaa

SEQ ID NO: 3501375 - DNA, 17 bp, Homo sapiens
agaaaaaaagatttatt

SEQ ID NO: 3501376 - DNA, 17 bp, Homo sapiens
agaaaaaatattttccc

SEQ ID NO: 3501377 - DNA, 17 bp, Homo sapiens
agaaaaaatattttcct

SEQ ID NO: 3501378 - DNA, 23 bp, Homo sapiens
agaaaaaccaaaatactccaaag

SEQ ID NO: 3501379 - DNA, 18 bp, Homo sapiens
agaaaaagaacatgcagt

SEQ ID NO: 3501380 - DNA, 21 bp, Homo sapiens
agaaaaaggctgaaaagaagg

SEQ ID NO: 3501381 - DNA, 16 bp, Homo sapiens
agaaaaatatgtacca

SEQ ID NO: 3501382 - DNA, 17 bp, Homo sapiens
agaaaaatgagcctggc

SEQ ID NO: 3501383 - DNA, 18 bp, Homo sapiens
agaaaaatgagcctggca

SEQ ID NO: 3501384 - DNA, 13 bp, Homo sapiens
agaaaacaaaact

SEQ ID NO: 3501385 - DNA, 21 bp, Homo sapiens
agaaaacaaaactgcatttca

SEQ ID NO: 3501386 - DNA, 13 bp, Homo sapiens
agaaaaccacccc

SEQ ID NO: 3501387 - DNA, 15 bp, Homo sapiens
agaaaaccacccctt

SEQ ID NO: 3501388 - DNA, 21 bp, Homo sapiens
agaaaacctaattaaggaagt

SEQ ID NO: 3501389 - DNA, 15 bp, Homo sapiens
agaaaagattttaat

SEQ ID NO: 3501390 - DNA, 11 bp, Homo sapiens
agaaaagttat

SEQ ID NO: 3501391 - DNA, 22 bp, Homo sapiens
agaaaagttgacacctgagaaa

SEQ ID NO: 3501392 - DNA, 17 bp, Homo sapiens
agaaaatatatgtattt

SEQ ID NO: 3501393 - DNA, 23 bp, Homo sapiens
agaaaatatatgtatttttatat

SEQ ID NO: 3501394 - DNA, 22 bp, Homo sapiens
agaaaatattttgtctaaaatg

SEQ ID NO: 3501395 - DNA, 12 bp, Homo sapiens
agaaaatcatca

SEQ ID NO: 3501396 - DNA, 22 bp, Homo sapiens
agaaaatggaaccaggcttgga

SEQ ID NO: 3501397 - DNA, 21 bp, Homo sapiens
agaaaatttaataacttttta

SEQ ID NO: 3501398 - DNA, 18 bp, Homo sapiens
agaaacaacaatttctac

SEQ ID NO: 3501399 - DNA, 15 bp, Homo sapiens
agaaacacactgagg

SEQ ID NO: 3501400 - DNA, 19 bp, Homo sapiens
agaaacacactgaggcagg

SEQ ID NO: 3501401 - DNA, 22 bp, Homo sapiens
agaaacacactgaggcagggaa

SEQ ID NO: 3501402 - DNA, 12 bp, Homo sapiens
agaaacagacag

SEQ ID NO: 3501403 - DNA, 21 bp, Homo sapiens
agaaacagacagaaagagaca

SEQ ID NO: 3501404 - DNA, 13 bp, Homo sapiens
agaaacaggaccg

SEQ ID NO: 3501405 - DNA, 21 bp, Homo sapiens
agaaacatcagttactctgaa

SEQ ID NO: 3501406 - DNA, 14 bp, Homo sapiens
agaaacattgaaga

SEQ ID NO: 3501407 - DNA, 16 bp, Homo sapiens
agaaacccgacagagg

SEQ ID NO: 3501408 - DNA, 21 bp, Homo sapiens
agaaacccgacagagggaaga

SEQ ID NO: 3501409 - DNA, 15 bp, Homo sapiens
agaaacctactgccc

SEQ ID NO: 3501410 - DNA, 23 bp, Homo sapiens
agaaacctactgcccaggcactg

SEQ ID NO: 3501411 - DNA, 20 bp, Homo sapiens
agaaaccttattgtacctct

SEQ ID NO: 3501412 - DNA, 18 bp, Homo sapiens
agaaacctttttaaaaat

SEQ ID NO: 3501413 - DNA, 21 bp, Homo sapiens
agaaactgttcccacctgctg

SEQ ID NO: 3501414 - DNA, 16 bp, Homo sapiens
agaaacttaagcaaag

SEQ ID NO: 3501415 - DNA, 19 bp, Homo sapiens
agaaacttccaaatcccct

SEQ ID NO: 3501416 - DNA, 20 bp, Homo sapiens
agaaagaaacccgacagagg

SEQ ID NO: 3501417 - DNA, 22 bp, Homo sapiens
agaaagaatgttactgccttaa

SEQ ID NO: 3501418 - DNA, 13 bp, Homo sapiens
agaaagagcactt

SEQ ID NO: 3501419 - DNA, 13 bp, Homo sapiens
agaaagcatttga

SEQ ID NO: 3501420 - DNA, 15 bp, Homo sapiens
agaaagcatttgaat

SEQ ID NO: 3501421 - DNA, 16 bp, Homo sapiens
agaaagcatttgaatg

SEQ ID NO: 3501422 - DNA, 17 bp, Homo sapiens
agaaagcatttgaatgc

SEQ ID NO: 3501423 - DNA, 21 bp, Homo sapiens
agaaagcatttgaatgcattt

SEQ ID NO: 3501424 - DNA, 15 bp, Homo sapiens
agaaagccttctttt

SEQ ID NO: 3501425 - DNA, 16 bp, Homo sapiens
agaaaggcctttaaaa

SEQ ID NO: 3501426 - DNA, 19 bp, Homo sapiens
agaaaggcctttaaaattt

SEQ ID NO: 3501427 - DNA, 20 bp, Homo sapiens
agaaagtggaaaacaaggaa

SEQ ID NO: 3501428 - DNA, 23 bp, Homo sapiens
agaaagtggaaaacaaggaagtc

SEQ ID NO: 3501429 - DNA, 16 bp, Homo sapiens
agaaagtgtgctttat

SEQ ID NO: 3501430 - DNA, 23 bp, Homo sapiens
agaaagtgtgctttatgctgaaa

SEQ ID NO: 3501431 - DNA, 20 bp, Homo sapiens
agaaagttgcacggctgctg

SEQ ID NO: 3501432 - DNA, 21 bp, Homo sapiens
agaaataaagtttgcttagaa

SEQ ID NO: 3501433 - DNA, 13 bp, Homo sapiens
agaaataagaatt

SEQ ID NO: 3501434 - DNA, 14 bp, Homo sapiens
agaaataatatgca

SEQ ID NO: 3501435 - DNA, 12 bp, Homo sapiens
agaaatacagtc

SEQ ID NO: 3501436 - DNA, 16 bp, Homo sapiens
agaaatatggaactta

SEQ ID NO: 3501437 - DNA, 17 bp, Homo sapiens
agaaatatggaacttac

SEQ ID NO: 3501438 - DNA, 22 bp, Homo sapiens
agaaatatggaacttacattgt

SEQ ID NO: 3501439 - DNA, 14 bp, Homo sapiens
agaaatatggacac

SEQ ID NO: 3501440 - DNA, 17 bp, Homo sapiens
agaaatatggacactta

SEQ ID NO: 3501441 - DNA, 14 bp, Homo sapiens
agaaatgccaagca

SEQ ID NO: 3501442 - DNA, 14 bp, Homo sapiens
agaaatgctgctgg

SEQ ID NO: 3501443 - DNA, 15 bp, Homo sapiens
agaaatgctgctggc

SEQ ID NO: 3501444 - DNA, 17 bp, Homo sapiens
agaaatgctgctggcca

SEQ ID NO: 3501445 - DNA, 17 bp, Homo sapiens
agaaatggttgtattag

SEQ ID NO: 3501446 - DNA, 23 bp, Homo sapiens
agaaatggttgtattagatgttc

SEQ ID NO: 3501447 - DNA, 20 bp, Homo sapiens
agaaattgcctatcctgctg

SEQ ID NO: 3501448 - DNA, 21 bp, Homo sapiens
agaaatttaaaagcagagcat

SEQ ID NO: 3501449 - DNA, 17 bp, Homo sapiens
agaaatttaattcatgt

SEQ ID NO: 3501450 - DNA, 22 bp, Homo sapiens
agaaatttaattcatgtttctt

SEQ ID NO: 3501451 - DNA, 21 bp, Homo sapiens
agaattggctgaactcatgag

SEQ ID NO: 3501452 - DNA, 22 bp, Homo sapiens
agaattggctgaactcatgaga

SEQ ID NO: 3501453 - DNA, 15 bp, Homo sapiens
agaatttaggttttt

SEQ ID NO: 3501454 - DNA, 18 bp, Homo sapiens
agaatttgagtgctctga

SEQ ID NO: 3501455 - DNA, 21 bp, Homo sapiens
agaatttgtgttgaaggaact

SEQ ID NO: 3501456 - DNA, 15 bp, Homo sapiens
agacaaaaagacaaa

SEQ ID NO: 3501457 - DNA, 16 bp, Homo sapiens
agacaaaatggataca

SEQ ID NO: 3501458 - DNA, 22 bp, Homo sapiens
agacaaaatggatacataaaga

SEQ ID NO: 3501459 - DNA, 18 bp, Homo sapiens
agacaaattcatattctt

SEQ ID NO: 3501460 - DNA, 18 bp, Homo sapiens
agacaaattctgtttctt

SEQ ID NO: 3501461 - DNA, 21 bp, Homo sapiens
agacaaattctgtttcttgag

SEQ ID NO: 3501462 - DNA, 15 bp, Homo sapiens
agacaagacttcagt

SEQ ID NO: 3501463 - DNA, 19 bp, Homo sapiens
agacaaggaaaaaataaca

SEQ ID NO: 3501464 - DNA, 14 bp, Homo sapiens
agacaatcactgcc

SEQ ID NO: 3501465 - DNA, 15 bp, Homo sapiens
agacaatcactgcca

SEQ ID NO: 3501466 - DNA, 13 bp, Homo sapiens
agacaatgtctgc

SEQ ID NO: 3501467 - DNA, 12 bp, Homo sapiens
agacaatgttgt

SEQ ID NO: 3501468 - DNA, 22 bp, Homo sapiens
agacacaggcccggctccaggc

SEQ ID NO: 3501469 - DNA, 23 bp, Homo sapiens
agacacaggcccggctccaggct

SEQ ID NO: 3501470 - DNA, 15 bp, Homo sapiens
agacacagggacttg

SEQ ID NO: 3501471 - DNA, 16 bp, Homo sapiens
agacacagggacttga

SEQ ID NO: 3501472 - DNA, 21 bp, Homo sapiens
agacacggagcccagccctcc

SEQ ID NO: 3501473 - DNA, 15 bp, Homo sapiens
agacacggatctgag

SEQ ID NO: 3501474 - DNA, 13 bp, Homo sapiens
agacacttcatgg

SEQ ID NO: 3501475 - DNA, 18 bp, Homo sapiens
agacagaaccttgttatt

SEQ ID NO: 3501476 - DNA, 14 bp, Homo sapiens
agacagacacacac

SEQ ID NO: 3501477 - DNA, 16 bp, Homo sapiens
agacagacacacacac

SEQ ID NO: 3501478 - DNA, 11 bp, Homo sapiens
agacagagtct

SEQ ID NO: 3501479 - DNA, 23 bp, Homo sapiens
agacagagtctcactgttgccca

SEQ ID NO: 3501480 - DNA, 21 bp, Homo sapiens
agacagctccaccctggccga

SEQ ID NO: 3501481 - DNA, 22 bp, Homo sapiens
agacaggcaagcacctcctgcc

SEQ ID NO: 3501482 - DNA, 23 bp, Homo sapiens
agacagggtttggctgtgtctaa

SEQ ID NO: 3501483 - DNA, 14 bp, Homo sapiens
agacaggtggaaaa

SEQ ID NO: 3501484 - DNA, 15 bp, Homo sapiens
agacagtccagcctg

SEQ ID NO: 3501485 - DNA, 20 bp, Homo sapiens
agacagttgggtgagaacaa

SEQ ID NO: 3501486 - DNA, 20 bp, Homo sapiens
agacagttttgagaacgtaa

SEQ ID NO: 3501487 - DNA, 14 bp, Homo sapiens
agacatatttaact

SEQ ID NO: 3501488 - DNA, 16 bp, Homo sapiens
agacatatttaactgg

SEQ ID NO: 3501489 - DNA, 13 bp, Homo sapiens
agacatcttcaga

SEQ ID NO: 3501490 - DNA, 15 bp, Homo sapiens
agacattctgccagg

SEQ ID NO: 3501491 - DNA, 22 bp, Homo sapiens
agacatttttccgtttgctttt

SEQ ID NO: 3501492 - DNA, 14 bp, Homo sapiens
agaccaaaatgaaa

SEQ ID NO: 3501493 - DNA, 23 bp, Homo sapiens
agaccacgcccgtcctgcctgtg

SEQ ID NO: 3501494 - DNA, 22 bp, Homo sapiens
agaccagcctggccaacatggc

SEQ ID NO: 3501495 - DNA, 16 bp, Homo sapiens
agaccaggcaaagcaa

SEQ ID NO: 3501496 - DNA, 13 bp, Homo sapiens
agaccaggccctg

SEQ ID NO: 3501497 - DNA, 20 bp, Homo sapiens
agaccatgtggagacttcat

SEQ ID NO: 3501498 - DNA, 14 bp, Homo sapiens
agacccccagcact

SEQ ID NO: 3501499 - DNA, 17 bp, Homo sapiens
agaccctgaagatttca

SEQ ID NO: 3501500 - DNA, 16 bp, Homo sapiens
agacctatgtaagaat

SEQ ID NO: 3501501 - DNA, 15 bp, Homo sapiens
agacctcagggcaca

SEQ ID NO: 3501502 - DNA, 16 bp, Homo sapiens
agacctgatcctggag

SEQ ID NO: 3501503 - DNA, 18 bp, Homo sapiens
agacctggacacaggcct

SEQ ID NO: 3501504 - DNA, 11 bp, Homo sapiens
agacctggcag

SEQ ID NO: 3501505 - DNA, 15 bp, Homo sapiens
agacctggcagctct

SEQ ID NO: 3501506 - DNA, 23 bp, Homo sapiens
agacctggcagctctggacagcc

SEQ ID NO: 3501507 - DNA, 18 bp, Homo sapiens
agacctgttagcagacag

SEQ ID NO: 3501508 - DNA, 23 bp, Homo sapiens
agacctgttggtataggaatgta

SEQ ID NO: 3501509 - DNA, 15 bp, Homo sapiens
agaccttcacagatg

SEQ ID NO: 3501510 - DNA, 22 bp, Homo sapiens
agaccttcacagatgcctactt

SEQ ID NO: 3501511 - DNA, 18 bp, Homo sapiens
agaccttgttacttctga

SEQ ID NO: 3501512 - DNA, 19 bp, Homo sapiens
agaccttgttacttctgag

SEQ ID NO: 3501513 - DNA, 22 bp, Homo sapiens
agaccttttttttttttccaat

SEQ ID NO: 3501514 - DNA, 15 bp, Homo sapiens
agacgagaggacgag

SEQ ID NO: 3501515 - DNA, 19 bp, Homo sapiens
agacggagtcccaccttgg

SEQ ID NO: 3501516 - DNA, 21 bp, Homo sapiens
agacggtgtcttgttctgtca

SEQ ID NO: 3501517 - DNA, 14 bp, Homo sapiens
agacgtatgtaaca

SEQ ID NO: 3501518 - DNA, 20 bp, Homo sapiens
agactcaggccaagaaacgt

SEQ ID NO: 3501519 - DNA, 18 bp, Homo sapiens
agactcattcttctgtac

SEQ ID NO: 3501520 - DNA, 19 bp, Homo sapiens
agactcgagaactttcatt

SEQ ID NO: 3501521 - DNA, 21 bp, Homo sapiens
agactctaggacataaattag

SEQ ID NO: 3501522 - DNA, 12 bp, Homo sapiens
agactgcatctc

SEQ ID NO: 3501523 - DNA, 14 bp, Homo sapiens
agactgcatctcaa

SEQ ID NO: 3501524 - DNA, 15 bp, Homo sapiens
agactggaacactag

SEQ ID NO: 3501525 - DNA, 14 bp, Homo sapiens
agactggaagctaa

SEQ ID NO: 3501526 - DNA, 23 bp, Homo sapiens
agactgttggggtgggtataaaa

SEQ ID NO: 3501527 - DNA, 16 bp, Homo sapiens
agacttagggcaccag

SEQ ID NO: 3501528 - DNA, 21 bp, Homo sapiens
agacttcagtatgttgtcaaa

SEQ ID NO: 3501529 - DNA, 22 bp, Homo sapiens
agacttcagtatgttgtcaaag

SEQ ID NO: 3501530 - DNA, 16 bp, Homo sapiens
agacttgccttcctaa

SEQ ID NO: 3501531 - DNA, 22 bp, Homo sapiens
agacttgccttcctaagcctgt

SEQ ID NO: 3501532 - DNA, 16 bp, Homo sapiens
agactttaggctttca

SEQ ID NO: 3501533 - DNA, 18 bp, Homo sapiens
agactttctctgtgtatg

SEQ ID NO: 3501534 - DNA, 14 bp, Homo sapiens
agactttggaaaat

SEQ ID NO: 3501535 - DNA, 19 bp, Homo sapiens
agagaaaatactatttcaa

SEQ ID NO: 3501536 - DNA, 14 bp, Homo sapiens
agagaaaatatatg

SEQ ID NO: 3501537 - DNA, 15 bp, Homo sapiens
agagaaacagacaga

SEQ ID NO: 3501538 - DNA, 18 bp, Homo sapiens
agagaaaggggagcccac

SEQ ID NO: 3501539 - DNA, 21 bp, Homo sapiens
agagaaaggggagcccactgt

SEQ ID NO: 3501540 - DNA, 16 bp, Homo sapiens
agagaacattttactg

SEQ ID NO: 3501541 - DNA, 20 bp, Homo sapiens
agagaacctcacgcacctcc

SEQ ID NO: 3501542 - DNA, 20 bp, Homo sapiens
agagaagtctggtcagagcc

SEQ ID NO: 3501543 - DNA, 12 bp, Homo sapiens
agagaatgagag

SEQ ID NO: 3501544 - DNA, 20 bp, Homo sapiens
agagaatgagagcgacacag

SEQ ID NO: 3501545 - DNA, 12 bp, Homo sapiens
agagacagagag

SEQ ID NO: 3501546 - DNA, 17 bp, Homo sapiens
agagacatacttgaagg

SEQ ID NO: 3501547 - DNA, 22 bp, Homo sapiens
agagacatacttgaagggccag

SEQ ID NO: 3501548 - DNA, 16 bp, Homo sapiens
agagaccaggccctgg

SEQ ID NO: 3501549 - DNA, 14 bp, Homo sapiens
agagacccagatct

SEQ ID NO: 3501550 - DNA, 21 bp, Homo sapiens
agagacccccggaacaagcct

SEQ ID NO: 3501551 - DNA, 19 bp, Homo sapiens
agagagaaaaaaaaaatag

SEQ ID NO: 3501552 - DNA, 14 bp, Homo sapiens
agagagaaaaacaa

SEQ ID NO: 3501553 - DNA, 16 bp, Homo sapiens
agagagaacaggacta

SEQ ID NO: 3501554 - DNA, 15 bp, Homo sapiens
agagagaatgagagc

SEQ ID NO: 3501555 - DNA, 16 bp, Homo sapiens
agagagaccacttttc

SEQ ID NO: 3501556 - DNA, 16 bp, Homo sapiens
agagaggccttgtccc

SEQ ID NO: 3501557 - DNA, 15 bp, Homo sapiens
agagagggctttaat

SEQ ID NO: 3501558 - DNA, 14 bp, Homo sapiens
agagatagcctgtg

SEQ ID NO: 3501559 - DNA, 18 bp, Homo sapiens
agagatccaaaagaagcc

SEQ ID NO: 3501560 - DNA, 16 bp, Homo sapiens
agagattacctcctga

SEQ ID NO: 3501561 - DNA, 19 bp, Homo sapiens
agagattacctcctgagaa

SEQ ID NO: 3501562 - DNA, 20 bp, Homo sapiens
agagattacctcctgagaaa

SEQ ID NO: 3501563 - DNA, 13 bp, Homo sapiens
agagattcatttt

SEQ ID NO: 3501564 - DNA, 16 bp, Homo sapiens
agagattcattttcta

SEQ ID NO: 3501565 - DNA, 18 bp, Homo sapiens
agagattcattttctaga

SEQ ID NO: 3501566 - DNA, 20 bp, Homo sapiens
agagattggaatgggcagct

SEQ ID NO: 3501567 - DNA, 16 bp, Homo sapiens
agagattgtggtttca

SEQ ID NO: 3501568 - DNA, 15 bp, Homo sapiens
agagcactgccacca

SEQ ID NO: 3501569 - DNA, 19 bp, Homo sapiens
agagcacttaagagaatat

SEQ ID NO: 3501570 - DNA, 12 bp, Homo sapiens
agagcagaggtc

SEQ ID NO: 3501571 - DNA, 20 bp, Homo sapiens
agagcagatttctatggtac

SEQ ID NO: 3501572 - DNA, 20 bp, Homo sapiens
agagcaggactccaggccca

SEQ ID NO: 3501573 - DNA, 19 bp, Homo sapiens
agagcaggcgttcagctca

SEQ ID NO: 3501574 - DNA, 21 bp, Homo sapiens
agagcagggggacctaggctc

SEQ ID NO: 3501575 - DNA, 23 bp, Homo sapiens
agagcagtttctgtcctgctggt

SEQ ID NO: 3501576 - DNA, 19 bp, Homo sapiens
agagcattttttatgatat

SEQ ID NO: 3501577 - DNA, 17 bp, Homo sapiens
agagccaaacagagccc

SEQ ID NO: 3501578 - DNA, 19 bp, Homo sapiens
agagccaccaagagggacg

SEQ ID NO: 3501579 - DNA, 23 bp, Homo sapiens
agagccaggggggtgaggagctg

SEQ ID NO: 3501580 - DNA, 13 bp, Homo sapiens
agagccagggtct

SEQ ID NO: 3501581 - DNA, 14 bp, Homo sapiens
agagcccagctcca

SEQ ID NO: 3501582 - DNA, 15 bp, Homo sapiens
agagcccagctccaa

SEQ ID NO: 3501583 - DNA, 20 bp, Homo sapiens
agatgacttcccctgcctcc

SEQ ID NO: 3501584 - DNA, 16 bp, Homo sapiens
agatgatacatccaaa

SEQ ID NO: 3501585 - DNA, 20 bp, Homo sapiens
agatgatacatccaaagcag

SEQ ID NO: 3501586 - DNA, 14 bp, Homo sapiens
agatgcaaagaggc

SEQ ID NO: 3501587 - DNA, 21 bp, Homo sapiens
agatgcaccaccaagccaagg

SEQ ID NO: 3501588 - DNA, 17 bp, Homo sapiens
agatgccccagggatgg

SEQ ID NO: 3501589 - DNA, 17 bp, Homo sapiens
agatgcctacttttggc

SEQ ID NO: 3501590 - DNA, 14 bp, Homo sapiens
agatgcctgatcag

SEQ ID NO: 3501591 - DNA, 20 bp, Homo sapiens
agatgctccttgggcccttt

SEQ ID NO: 3501592 - DNA, 14 bp, Homo sapiens
agatgctggcccag

SEQ ID NO: 3501593 - DNA, 17 bp, Homo sapiens
agatgctggcccagggc

SEQ ID NO: 3501594 - DNA, 20 bp, Homo sapiens
agatgctggcccagggccca

SEQ ID NO: 3501595 - DNA, 17 bp, Homo sapiens
agatgctggcttgggca

SEQ ID NO: 3501596 - DNA, 15 bp, Homo sapiens
agatgctggttttct

SEQ ID NO: 3501597 - DNA, 15 bp, Homo sapiens
agatgcttctcactg

SEQ ID NO: 3501598 - DNA, 16 bp, Homo sapiens
agatgcttctcactgc

SEQ ID NO: 3501599 - DNA, 17 bp, Homo sapiens
agatggaaaaacttgtg

SEQ ID NO: 3501600 - DNA, 18 bp, Homo sapiens
agatggcagatgcacatg

SEQ ID NO: 3501601 - DNA, 22 bp, Homo sapiens
agatgggctgaactgagcctag

SEQ ID NO: 3501602 - DNA, 15 bp, Homo sapiens
agatgggggaaagca

SEQ ID NO: 3501603 - DNA, 16 bp, Homo sapiens
agatgggggcagggct

SEQ ID NO: 3501604 - DNA, 18 bp, Homo sapiens
agatggtggcacattcct

SEQ ID NO: 3501605 - DNA, 12 bp, Homo sapiens
agatggtgggat

SEQ ID NO: 3501606 - DNA, 21 bp, Homo sapiens
agatggtgtgggtgtcctgcc

SEQ ID NO: 3501607 - DNA, 17 bp, Homo sapiens
agatgtaatgttttctt

SEQ ID NO: 3501608 - DNA, 22 bp, Homo sapiens
agatgtaattgtttgtctttaa

SEQ ID NO: 3501609 - DNA, 23 bp, Homo sapiens
agatgtcatttagttcagcatcc

SEQ ID NO: 3501610 - DNA, 22 bp, Homo sapiens
agatgtggggctgagctgggga

SEQ ID NO: 3501611 - DNA, 14 bp, Homo sapiens
agatgttcccccat

SEQ ID NO: 3501612 - DNA, 17 bp, Homo sapiens
agatgttctaagtcttt

SEQ ID NO: 3501613 - DNA, 20 bp, Homo sapiens
agatgttctaagtctttcca

SEQ ID NO: 3501614 - DNA, 23 bp, Homo sapiens
agatgtttcacaccggaaggttt

SEQ ID NO: 3501615 - DNA, 14 bp, Homo sapiens
agatgtttcacgaa

SEQ ID NO: 3501616 - DNA, 22 bp, Homo sapiens
agatgtttcttttgtatgtaaa

SEQ ID NO: 3501617 - DNA, 23 bp, Homo sapiens
agatgttttggtcaagtagtttg

SEQ ID NO: 3501618 - DNA, 15 bp, Homo sapiens
agattaaaaattata

SEQ ID NO: 3501619 - DNA, 13 bp, Homo sapiens
agattaagatgcc

SEQ ID NO: 3501620 - DNA, 14 bp, Homo sapiens
agattattgaaata

SEQ ID NO: 3501621 - DNA, 16 bp, Homo sapiens
agattatttcattcgt

SEQ ID NO: 3501622 - DNA, 23 bp, Homo sapiens
agattcaatattgaatttttcct

SEQ ID NO: 3501623 - DNA, 13 bp, Homo sapiens
agattcacactgt

SEQ ID NO: 3501624 - DNA, 22 bp, Homo sapiens
agattcctcgaagttctaggaa

SEQ ID NO: 3501625 - DNA, 14 bp, Homo sapiens
agattcctgtcctt

SEQ ID NO: 3501626 - DNA, 21 bp, Homo sapiens
agattctggacagtcagctct

SEQ ID NO: 3501627 - DNA, 12 bp, Homo sapiens
agattctttccc

SEQ ID NO: 3501628 - DNA, 19 bp, Homo sapiens
agattgaagtaaactgcag

SEQ ID NO: 3501629 - DNA, 16 bp, Homo sapiens
agattgcaccactgca

SEQ ID NO: 3501630 - DNA, 19 bp, Homo sapiens
agattggctcacactgaga

SEQ ID NO: 3501631 - DNA, 23 bp, Homo sapiens
agatttccagtctccaccaggaa

SEQ ID NO: 3501632 - DNA, 16 bp, Homo sapiens
agatttctaaataaaa

SEQ ID NO: 3501633 - DNA, 17 bp, Homo sapiens
agattttaattttgaat

SEQ ID NO: 3501634 - DNA, 13 bp, Homo sapiens
agattttcattga

SEQ ID NO: 3501635 - DNA, 19 bp, Homo sapiens
agatttttaaaaaatattt

SEQ ID NO: 3501636 - DNA, 16 bp, Homo sapiens
agattttttcagactt

SEQ ID NO: 3501637 - DNA, 19 bp, Homo sapiens
agcaaaaaaaacccatgtg

SEQ ID NO: 3501638 - DNA, 15 bp, Homo sapiens
agcaaaaagcaaaat

SEQ ID NO: 3501639 - DNA, 14 bp, Homo sapiens
agcaaaagaaaaag

SEQ ID NO: 3501640 - DNA, 15 bp, Homo sapiens
agcaaaatcatttta

SEQ ID NO: 3501641 - DNA, 13 bp, Homo sapiens
agcaaacccagac

SEQ ID NO: 3501642 - DNA, 15 bp, Homo sapiens
agcaaacccagacgg

SEQ ID NO: 3501643 - DNA, 17 bp, Homo sapiens
agcaaaggggacagctg

SEQ ID NO: 3501644 - DNA, 19 bp, Homo sapiens
agcaaataaactaggaaat

SEQ ID NO: 3501645 - DNA, 18 bp, Homo sapiens
agcaaatcaccacaaact

SEQ ID NO: 3501646 - DNA, 23 bp, Homo sapiens
agcaaatcaccacaaactgtaat

SEQ ID NO: 3501647 - DNA, 19 bp, Homo sapiens
agcaaattctgtttttcta

SEQ ID NO: 3501648 - DNA, 15 bp, Homo sapiens
agcaaattttcagca

SEQ ID NO: 3501649 - DNA, 17 bp, Homo sapiens
agcaacagcctttgaat

SEQ ID NO: 3501650 - DNA, 17 bp, Homo sapiens
agcaacaggaatctcag

SEQ ID NO: 3501651 - DNA, 15 bp, Homo sapiens
agcaaccatttgtaa

SEQ ID NO: 3501652 - DNA, 15 bp, Homo sapiens
agcaacctacccagc

SEQ ID NO: 3501653 - DNA, 12 bp, Homo sapiens
agcaagaaagaa

SEQ ID NO: 3501654 - DNA, 15 bp, Homo sapiens
agcaagaaagaaacc

SEQ ID NO: 3501655 - DNA, 16 bp, Homo sapiens
agcaagagatattttg

SEQ ID NO: 3501656 - DNA, 15 bp, Homo sapiens
agcaagctcccaagg

SEQ ID NO: 3501657 - DNA, 20 bp, Homo sapiens
agcaagctcccaagggatgg

SEQ ID NO: 3501658 - DNA, 14 bp, Homo sapiens
agcaaggcacagcc

SEQ ID NO: 3501659 - DNA, 16 bp, Homo sapiens
agcaagtgagaccctg

SEQ ID NO: 3501660 - DNA, 21 bp, Homo sapiens
agcaagtgattgggacagagg

SEQ ID NO: 3501661 - DNA, 19 bp, Homo sapiens
agcaataacattcccactg

SEQ ID NO: 3501662 - DNA, 22 bp, Homo sapiens
agcaataacattcccactgcca

SEQ ID NO: 3501663 - DNA, 13 bp, Homo sapiens
agcaattggcagc

SEQ ID NO: 3501664 - DNA, 21 bp, Homo sapiens
agcacaaggccttgcctggcc

SEQ ID NO: 3501665 - DNA, 20 bp, Homo sapiens
agcacacaggtacagcaaca

SEQ ID NO: 3501666 - DNA, 10 bp, Homo sapiens
agcacagcag

SEQ ID NO: 3501667 - DNA, 13 bp, Homo sapiens
agcacagcagcct

SEQ ID NO: 3501668 - DNA, 15 bp, Homo sapiens
agcacagcagcctgg

SEQ ID NO: 3501669 - DNA, 12 bp, Homo sapiens
agcacagccaac

SEQ ID NO: 3501670 - DNA, 18 bp, Homo sapiens
agcacatattagtgcagc

SEQ ID NO: 3501671 - DNA, 15 bp, Homo sapiens
agcacatctgcattt

SEQ ID NO: 3501672 - DNA, 23 bp, Homo sapiens
agcaccattttaagtccctgtca

SEQ ID NO: 3501673 - DNA, 20 bp, Homo sapiens
agcaccctgcagagcacaca

SEQ ID NO: 3501674 - DNA, 19 bp, Homo sapiens
agcaccgtgtcaagctgct

SEQ ID NO: 3501675 - DNA, 16 bp, Homo sapiens
agcaccgttctgtgca

SEQ ID NO: 3501676 - DNA, 18 bp, Homo sapiens
agcaccgttctgtgcaca

SEQ ID NO: 3501677 - DNA, 20 bp, Homo sapiens
agcacctccagcctgaacag

SEQ ID NO: 3501678 - DNA, 14 bp, Homo sapiens
agcacctcctgcct

SEQ ID NO: 3501679 - DNA, 16 bp, Homo sapiens
agcacctcctgcctcg

SEQ ID NO: 3501680 - DNA, 22 bp, Homo sapiens
agcacctgtctcctttcacccc

SEQ ID NO: 3501681 - DNA, 20 bp, Homo sapiens
agcacctttggaaacaacat

SEQ ID NO: 3501682 - DNA, 19 bp, Homo sapiens
agcactaaggtgtgctctg

SEQ ID NO: 3501683 - DNA, 20 bp, Homo sapiens
agcactaaggtgtgctctga

SEQ ID NO: 3501684 - DNA, 18 bp, Homo sapiens
agcactactaaaagttta

SEQ ID NO: 3501685 - DNA, 15 bp, Homo sapiens
agcactcaggctctc

SEQ ID NO: 3501686 - DNA, 18 bp, Homo sapiens
agcactcaggctctccat

SEQ ID NO: 3501687 - DNA, 12 bp, Homo sapiens
agcactgagcaa

SEQ ID NO: 3501688 - DNA, 17 bp, Homo sapiens
agcactgagcaagttga

SEQ ID NO: 3501689 - DNA, 11 bp, Homo sapiens
agcactgagga

SEQ ID NO: 3501690 - DNA, 15 bp, Homo sapiens
agcactgtgctcagg

SEQ ID NO: 3501691 - DNA, 19 bp, Homo sapiens
agcactgtgctcagggcta

SEQ ID NO: 3501692 - DNA, 18 bp, Homo sapiens
agcactgttctgggactc

SEQ ID NO: 3501693 - DNA, 23 bp, Homo sapiens
agcactgttctgggactccaggt

SEQ ID NO: 3501694 - DNA, 13 bp, Homo sapiens
agcacttgaagaa

SEQ ID NO: 3501695 - DNA, 22 bp, Homo sapiens
agcacttgggggttcaggcccg

SEQ ID NO: 3501696 - DNA, 16 bp, Homo sapiens
agcacttgtccagctg

SEQ ID NO: 3501697 - DNA, 23 bp, Homo sapiens
agcactttgggaggccaaggtgg

SEQ ID NO: 3501698 - DNA, 16 bp, Homo sapiens
agcactttgggaggct

SEQ ID NO: 3501699 - DNA, 18 bp, Homo sapiens
agcagaaaataaaggaag

SEQ ID NO: 3501700 - DNA, 20 bp, Homo sapiens
agcagaacagatcttttact

SEQ ID NO: 3501701 - DNA, 13 bp, Homo sapiens
agcagaagacaaa

SEQ ID NO: 3501702 - DNA, 16 bp, Homo sapiens
agcagaagggggtggt

SEQ ID NO: 3501703 - DNA, 18 bp, Homo sapiens
agcagactgatcaggacc

SEQ ID NO: 3501704 - DNA, 19 bp, Homo sapiens
agcagactgatcaggacct

SEQ ID NO: 3501705 - DNA, 14 bp, Homo sapiens
agcagagcattttt

SEQ ID NO: 3501706 - DNA, 19 bp, Homo sapiens
agcagaggaggggccgctg

SEQ ID NO: 3501707 - DNA, 21 bp, Homo sapiens
agcagaggaggggccgctgcc

SEQ ID NO: 3501708 - DNA, 13 bp, Homo sapiens
agcagaggtctcc

SEQ ID NO: 3501709 - DNA, 19 bp, Homo sapiens
agcagatgcaatgactcag

SEQ ID NO: 3501710 - DNA, 20 bp, Homo sapiens
agcagcaaattttcagcatt

SEQ ID NO: 3501711 - DNA, 21 bp, Homo sapiens
agcagcagcccaagcttccct

SEQ ID NO: 3501712 - DNA, 20 bp, Homo sapiens
agcagccaagctccttggga

SEQ ID NO: 3501713 - DNA, 21 bp, Homo sapiens
agcagccaagctccttgggag

SEQ ID NO: 3501714 - DNA, 13 bp, Homo sapiens
agcagccacgagg

SEQ ID NO: 3501715 - DNA, 12 bp, Homo sapiens
agcccagcccct

SEQ ID NO: 3501716 - DNA, 20 bp, Homo sapiens
agcccagcccctactgctgt

SEQ ID NO: 3501717 - DNA, 14 bp, Homo sapiens
agcccagctctgaa

SEQ ID NO: 3501718 - DNA, 15 bp, Homo sapiens
agcccagctgggtca

SEQ ID NO: 3501719 - DNA, 20 bp, Homo sapiens
agcccagctgggtcaggcag

SEQ ID NO: 3501720 - DNA, 19 bp, Homo sapiens
agcccagggagcggaaagc

SEQ ID NO: 3501721 - DNA, 20 bp, Homo sapiens
agcccagggagcggaaagca

SEQ ID NO: 3501722 - DNA, 23 bp, Homo sapiens
agcccagggagcggaaagcagct

SEQ ID NO: 3501723 - DNA, 23 bp, Homo sapiens
agcccagggcatcttgctggcta

SEQ ID NO: 3501724 - DNA, 14 bp, Homo sapiens
agcccagggctcct

SEQ ID NO: 3501725 - DNA, 15 bp, Homo sapiens
agcccagggctcctg

SEQ ID NO: 3501726 - DNA, 15 bp, Homo sapiens
agcccagtagacctt

SEQ ID NO: 3501727 - DNA, 14 bp, Homo sapiens
agcccagtgttttc

SEQ ID NO: 3501728 - DNA, 14 bp, Homo sapiens
agcccataaccagt

SEQ ID NO: 3501729 - DNA, 18 bp, Homo sapiens
agcccatccttccctttg

SEQ ID NO: 3501730 - DNA, 12 bp, Homo sapiens
agccccagcctg

SEQ ID NO: 3501731 - DNA, 14 bp, Homo sapiens
agccccagcctgct

SEQ ID NO: 3501732 - DNA, 13 bp, Homo sapiens
agccccagtgccc

SEQ ID NO: 3501733 - DNA, 12 bp, Homo sapiens
agccccatctgt

SEQ ID NO: 3501734 - DNA, 14 bp, Homo sapiens
agccccatctgtgc

SEQ ID NO: 3501735 - DNA, 17 bp, Homo sapiens
agccccatctgtgcatt

SEQ ID NO: 3501736 - DNA, 13 bp, Homo sapiens
agccccattcctg

SEQ ID NO: 3501737 - DNA, 19 bp, Homo sapiens
agccccattctgcctgccc

SEQ ID NO: 3501738 - DNA, 21 bp, Homo sapiens
agccccattctgcctgcccag

SEQ ID NO: 3501739 - DNA, 13 bp, Homo sapiens
agcccccccttcc

SEQ ID NO: 3501740 - DNA, 15 bp, Homo sapiens
agcccccccttccac

SEQ ID NO: 3501741 - DNA, 14 bp, Homo sapiens
agccccgacttcct

SEQ ID NO: 3501742 - DNA, 23 bp, Homo sapiens
agcccctactgctgtgaaccctg

SEQ ID NO: 3501743 - DNA, 13 bp, Homo sapiens
agcccctcccaag

SEQ ID NO: 3501744 - DNA, 18 bp, Homo sapiens
agcccctcggctctggag

SEQ ID NO: 3501745 - DNA, 16 bp, Homo sapiens
agcccctctggtcgct

SEQ ID NO: 3501746 - DNA, 22 bp, Homo sapiens
agcccctctttctgtcccctct

SEQ ID NO: 3501747 - DNA, 18 bp, Homo sapiens
agcccctggacatgcctg

SEQ ID NO: 3501748 - DNA, 21 bp, Homo sapiens
agcccctggacatgcctgtcc

SEQ ID NO: 3501749 - DNA, 21 bp, Homo sapiens
agcccctgtctagagagggag

SEQ ID NO: 3501750 - DNA, 15 bp, Homo sapiens
agccccttctcagaa

SEQ ID NO: 3501751 - DNA, 20 bp, Homo sapiens
agcccgcggggacattggga

SEQ ID NO: 3501752 - DNA, 17 bp, Homo sapiens
agccctaacttctgtaa

SEQ ID NO: 3501753 - DNA, 14 bp, Homo sapiens
agccctcagaaccc

SEQ ID NO: 3501754 - DNA, 18 bp, Homo sapiens
agccctcagaacccttgg

SEQ ID NO: 3501755 - DNA, 21 bp, Homo sapiens
agccctccccatggagccagc

SEQ ID NO: 3501756 - DNA, 16 bp, Homo sapiens
agccctccgccttcac

SEQ ID NO: 3501757 - DNA, 12 bp, Homo sapiens
agccctctccct

SEQ ID NO: 3501758 - DNA, 19 bp, Homo sapiens
agccctgagaaagccctgt

SEQ ID NO: 3501759 - DNA, 17 bp, Homo sapiens
agccctgcggagccggc

SEQ ID NO: 3501760 - DNA, 21 bp, Homo sapiens
agccctggtggcagtgggagc

SEQ ID NO: 3501761 - DNA, 22 bp, Homo sapiens
agccctgtcgggctttgtgtga

SEQ ID NO: 3501762 - DNA, 19 bp, Homo sapiens
agccctgtggatgagccct

SEQ ID NO: 3501763 - DNA, 23 bp, Homo sapiens
agccctgtggatgagccctcaga

SEQ ID NO: 3501764 - DNA, 18 bp, Homo sapiens
agccctgttgacacaggt

SEQ ID NO: 3501765 - DNA, 16 bp, Homo sapiens
agcccttagcagggaa

SEQ ID NO: 3501766 - DNA, 20 bp, Homo sapiens
agccgagatcacgccactgc

SEQ ID NO: 3501767 - DNA, 23 bp, Homo sapiens
agccggggccttatcgggctcca

SEQ ID NO: 3501768 - DNA, 20 bp, Homo sapiens
agccgggtctgcctcttctg

SEQ ID NO: 3501769 - DNA, 21 bp, Homo sapiens
agccgggtctgcctcttctgg

SEQ ID NO: 3501770 - DNA, 22 bp, Homo sapiens
agccgggtctgcctcttctggg

SEQ ID NO: 3501771 - DNA, 13 bp, Homo sapiens
agccggttcctgt

SEQ ID NO: 3501772 - DNA, 16 bp, Homo sapiens
agccgtgccctgcccc

SEQ ID NO: 3501773 - DNA, 16 bp, Homo sapiens
agcctaagaagctctg

SEQ ID NO: 3501774 - DNA, 13 bp, Homo sapiens
agcctaccccctg

SEQ ID NO: 3501775 - DNA, 16 bp, Homo sapiens
agcctagccctgggac

SEQ ID NO: 3501776 - DNA, 17 bp, Homo sapiens
agcctaggtgacagagt

SEQ ID NO: 3501777 - DNA, 14 bp, Homo sapiens
agcctagtgaaggc

SEQ ID NO: 3501778 - DNA, 20 bp, Homo sapiens
agcctagtgaaggcttctct

SEQ ID NO: 3501779 - DNA, 15 bp, Homo sapiens
agcctagtggcttgt

SEQ ID NO: 3501780 - DNA, 18 bp, Homo sapiens
agcctagtggcttgtcct

SEQ ID NO: 3501781 - DNA, 19 bp, Homo sapiens
agcctcaaaaacgccctca

SEQ ID NO: 3501782 - DNA, 17 bp, Homo sapiens
agcctcagcatcctggc

SEQ ID NO: 3501783 - DNA, 20 bp, Homo sapiens
agcctcagcatcctggcacc

SEQ ID NO: 3501784 - DNA, 15 bp, Homo sapiens
agcctcagcctactc

SEQ ID NO: 3501785 - DNA, 19 bp, Homo sapiens
agcctcagcgcggccctcc

SEQ ID NO: 3501786 - DNA, 22 bp, Homo sapiens
agcctccagtccaaggaaacca

SEQ ID NO: 3501787 - DNA, 16 bp, Homo sapiens
agcctcccaaagtgct

SEQ ID NO: 3501788 - DNA, 18 bp, Homo sapiens
agcctcccaaagtgctgg

SEQ ID NO: 3501789 - DNA, 22 bp, Homo sapiens
agcctcccacgactgcccggca

SEQ ID NO: 3501790 - DNA, 17 bp, Homo sapiens
agcctcccatccagggc

SEQ ID NO: 3501791 - DNA, 17 bp, Homo sapiens
agcctcccctgccaggg

SEQ ID NO: 3501792 - DNA, 20 bp, Homo sapiens
agcctcccctgccagggcag

SEQ ID NO: 3501793 - DNA, 22 bp, Homo sapiens
agcctcccctgccagggcaggg

SEQ ID NO: 3501794 - DNA, 17 bp, Homo sapiens
agcctcccgagtagctg

SEQ ID NO: 3501795 - DNA, 22 bp, Homo sapiens
agcctcccgagtagctgggact

SEQ ID NO: 3501796 - DNA, 13 bp, Homo sapiens
agcctccctgaag

SEQ ID NO: 3501797 - DNA, 14 bp, Homo sapiens
agcctcctccagcc

SEQ ID NO: 3501798 - DNA, 13 bp, Homo sapiens
agcctctcctgta

SEQ ID NO: 3501799 - DNA, 23 bp, Homo sapiens
agcctctgaaaaccaatgttctc

SEQ ID NO: 3501800 - DNA, 15 bp, Homo sapiens
agcctctgctcccca

SEQ ID NO: 3501801 - DNA, 16 bp, Homo sapiens
agcctctgctccccag

SEQ ID NO: 3501802 - DNA, 23 bp, Homo sapiens
agcctctgggtcagtggtccaca

SEQ ID NO: 3501803 - DNA, 16 bp, Homo sapiens
agcctctttttgatac

SEQ ID NO: 3501804 - DNA, 16 bp, Homo sapiens
agcctgaacagaagct

SEQ ID NO: 3501805 - DNA, 16 bp, Homo sapiens
agcctgagtcacctgc

SEQ ID NO: 3501806 - DNA, 23 bp, Homo sapiens
agcctgagtccacgacctaggca

SEQ ID NO: 3501807 - DNA, 15 bp, Homo sapiens
agcctgcattcttaa

SEQ ID NO: 3501808 - DNA, 14 bp, Homo sapiens
agcctgcctggcag

SEQ ID NO: 3501809 - DNA, 14 bp, Homo sapiens
agcctgcgcctgct

SEQ ID NO: 3501810 - DNA, 16 bp, Homo sapiens
agcctgcgcctgctgc

SEQ ID NO: 3501811 - DNA, 18 bp, Homo sapiens
agcctgcgcctgctgcat

SEQ ID NO: 3501812 - DNA, 20 bp, Homo sapiens
agcctgcgcctgctgcatgc

SEQ ID NO: 3501813 - DNA, 22 bp, Homo sapiens
agcctgcgggaagctgaccttt

SEQ ID NO: 3501814 - DNA, 9 bp, Homo sapiens
agcctgcta

SEQ ID NO: 3501815 - DNA, 13 bp, Homo sapiens
agcctgctagcta

SEQ ID NO: 3501816 - DNA, 14 bp, Homo sapiens
agcctgctccagct

SEQ ID NO: 3501817 - DNA, 19 bp, Homo sapiens
agcctgctccagctgttca

SEQ ID NO: 3501818 - DNA, 11 bp, Homo sapiens
agcctgctgga

SEQ ID NO: 3501819 - DNA, 19 bp, Homo sapiens
agcctggaacatcatcaag

SEQ ID NO: 3501820 - DNA, 21 bp, Homo sapiens
agcctggaacatcatcaaggc

SEQ ID NO: 3501821 - DNA, 16 bp, Homo sapiens
agcctggccagacaca

SEQ ID NO: 3501822 - DNA, 18 bp, Homo sapiens
agcctggccagacacagg

SEQ ID NO: 3501823 - DNA, 22 bp, Homo sapiens
agcctggccagacacaggccct

SEQ ID NO: 3501824 - DNA, 15 bp, Homo sapiens
agcctggggtctgga

SEQ ID NO: 3501825 - DNA, 22 bp, Homo sapiens
agcctgggtgacagagcaagtg

SEQ ID NO: 3501826 - DNA, 20 bp, Homo sapiens
agcctggtaggaaagggcaa

SEQ ID NO: 3501827 - DNA, 21 bp, Homo sapiens
agcctgtgcaaaaaaattaaa

SEQ ID NO: 3501828 - DNA, 14 bp, Homo sapiens
agcctgtggccctg

SEQ ID NO: 3501829 - DNA, 14 bp, Homo sapiens
agcctgtggctgtg

SEQ ID NO: 3501830 - DNA, 16 bp, Homo sapiens
agcctgtggctgtgga

SEQ ID NO: 3501831 - DNA, 22 bp, Homo sapiens
agcctgtggctgtggagacaat

SEQ ID NO: 3501832 - DNA, 23 bp, Homo sapiens
agcctgtggctgtggagacaatg

SEQ ID NO: 3501833 - DNA, 20 bp, Homo sapiens
agccttagaagtcacacagt

SEQ ID NO: 3501834 - DNA, 23 bp, Homo sapiens
agccttccagggatttgcctcac

SEQ ID NO: 3501835 - DNA, 18 bp, Homo sapiens
agccttgaaaaacaagtc

SEQ ID NO: 3501836 - DNA, 17 bp, Homo sapiens
agccttgccagagatcc

SEQ ID NO: 3501837 - DNA, 19 bp, Homo sapiens
agccttgcggaaggttcta

SEQ ID NO: 3501838 - DNA, 14 bp, Homo sapiens
agccttgggagcca

SEQ ID NO: 3501839 - DNA, 15 bp, Homo sapiens
agccttgtccccctc

SEQ ID NO: 3501840 - DNA, 15 bp, Homo sapiens
agcctttgaatgtaa

SEQ ID NO: 3501841 - DNA, 17 bp, Homo sapiens
agcctttgaatgtaacc

SEQ ID NO: 3501842 - DNA, 16 bp, Homo sapiens
agcctttgcctccccg

SEQ ID NO: 3501843 - DNA, 17 bp, Homo sapiens
agcctttgggaaatgct

SEQ ID NO: 3501844 - DNA, 18 bp, Homo sapiens
agcctttggttctggcca

SEQ ID NO: 3501845 - DNA, 19 bp, Homo sapiens
agcctttggttctggccag

SEQ ID NO: 3501846 - DNA, 14 bp, Homo sapiens
agcgaccccaggac

SEQ ID NO: 3501847 - DNA, 22 bp, Homo sapiens
agctgcactgatgctgcccctc

SEQ ID NO: 3501848 - DNA, 20 bp, Homo sapiens
agctgcatcatccttgcagg

SEQ ID NO: 3501849 - DNA, 23 bp, Homo sapiens
agctgcatcatccttgcaggtgg

SEQ ID NO: 3501850 - DNA, 15 bp, Homo sapiens
agctgccccagccag

SEQ ID NO: 3501851 - DNA, 21 bp, Homo sapiens
agctgcctaggtcccccaagc

SEQ ID NO: 3501852 - DNA, 20 bp, Homo sapiens
agctgcctcccctctccttc

SEQ ID NO: 3501853 - DNA, 16 bp, Homo sapiens
agctgcctgttcagct

SEQ ID NO: 3501854 - DNA, 16 bp, Homo sapiens
agctgccttagcttca

SEQ ID NO: 3501855 - DNA, 17 bp, Homo sapiens
agctgccttagcttcag

SEQ ID NO: 3501856 - DNA, 16 bp, Homo sapiens
agctgccttggctcag

SEQ ID NO: 3501857 - DNA, 19 bp, Homo sapiens
agctgccttggctcagaca

SEQ ID NO: 3501858 - DNA, 13 bp, Homo sapiens
agctgcggtccac

SEQ ID NO: 3501859 - DNA, 19 bp, Homo sapiens
agctgcggtccacccagga

SEQ ID NO: 3501860 - DNA, 20 bp, Homo sapiens
agctgctactagctctttga

SEQ ID NO: 3501861 - DNA, 21 bp, Homo sapiens
agctgctcagggaaaagcagc

SEQ ID NO: 3501862 - DNA, 18 bp, Homo sapiens
agctgctcctagagggag

SEQ ID NO: 3501863 - DNA, 19 bp, Homo sapiens
agctgctcctagagggagg

SEQ ID NO: 3501864 - DNA, 22 bp, Homo sapiens
agctgctcctagagggaggggc

SEQ ID NO: 3501865 - DNA, 12 bp, Homo sapiens
agctgctgacag

SEQ ID NO: 3501866 - DNA, 23 bp, Homo sapiens
agctgctggagactcctaggcag

SEQ ID NO: 3501867 - DNA, 18 bp, Homo sapiens
agctgcttcactagggaa

SEQ ID NO: 3501868 - DNA, 19 bp, Homo sapiens
agctgcttgccattctctt

SEQ ID NO: 3501869 - DNA, 21 bp, Homo sapiens
agctgcttttgtctatgggac

SEQ ID NO: 3501870 - DNA, 22 bp, Homo sapiens
agctgcttttgtctatgggact

SEQ ID NO: 3501871 - DNA, 23 bp, Homo sapiens
agctgcttttgtctatgggactc

SEQ ID NO: 3501872 - DNA, 23 bp, Homo sapiens
agctggagcccgtgccctaccac

SEQ ID NO: 3501873 - DNA, 22 bp, Homo sapiens
agctggccgcgccaaataatgt

SEQ ID NO: 3501874 - DNA, 17 bp, Homo sapiens
agctggccgtgggcctg

SEQ ID NO: 3501875 - DNA, 21 bp, Homo sapiens
agctggcgtcatgcaaagtca

SEQ ID NO: 3501876 - DNA, 22 bp, Homo sapiens
agctggctctataaggcagcct

SEQ ID NO: 3501877 - DNA, 23 bp, Homo sapiens
agctggctctgagcgcctccatc

SEQ ID NO: 3501878 - DNA, 19 bp, Homo sapiens
agctggctggggtggcctg

SEQ ID NO: 3501879 - DNA, 23 bp, Homo sapiens
agctggctggggtggcctgtgtg

SEQ ID NO: 3501880 - DNA, 16 bp, Homo sapiens
agctgggactacaggc

SEQ ID NO: 3501881 - DNA, 20 bp, Homo sapiens
agctgggactacaggcaccc

SEQ ID NO: 3501882 - DNA, 23 bp, Homo sapiens
agctgggactacaggcacccacc

SEQ ID NO: 3501883 - DNA, 14 bp, Homo sapiens
agctgggatacaca

SEQ ID NO: 3501884 - DNA, 19 bp, Homo sapiens
agctgggatacacacggct

SEQ ID NO: 3501885 - DNA, 22 bp, Homo sapiens
agctggggatccctccccccca

SEQ ID NO: 3501886 - DNA, 23 bp, Homo sapiens
agctggggccaccctggcccggc

SEQ ID NO: 3501887 - DNA, 17 bp, Homo sapiens
agctgggtcaggcaggg

SEQ ID NO: 3501888 - DNA, 18 bp, Homo sapiens
agctgggtggcactgcca

SEQ ID NO: 3501889 - DNA, 22 bp, Homo sapiens
agctgggtgtcaagagggtctg

SEQ ID NO: 3501890 - DNA, 15 bp, Homo sapiens
agctggtcccactca

SEQ ID NO: 3501891 - DNA, 21 bp, Homo sapiens
agctggtcccactcagtccat

SEQ ID NO: 3501892 - DNA, 15 bp, Homo sapiens
agctggtggacccag

SEQ ID NO: 3501893 - DNA, 16 bp, Homo sapiens
agctggtggcagagtc

SEQ ID NO: 3501894 - DNA, 18 bp, Homo sapiens
agctggtggcctctgcag

SEQ ID NO: 3501895 - DNA, 16 bp, Homo sapiens
agctggttgaggtttc

SEQ ID NO: 3501896 - DNA, 20 bp, Homo sapiens
agctggtttgtcaaacaaca

SEQ ID NO: 3501897 - DNA, 23 bp, Homo sapiens
agctgtatcttgatgtttagaaa

SEQ ID NO: 3501898 - DNA, 17 bp, Homo sapiens
agctgtattcatatatt

SEQ ID NO: 3501899 - DNA, 21 bp, Homo sapiens
agctgtattcatatattgcat

SEQ ID NO: 3501900 - DNA, 18 bp, Homo sapiens
agctgtgcaggtggggag

SEQ ID NO: 3501901 - DNA, 20 bp, Homo sapiens
agctgtgctctggacaggca

SEQ ID NO: 3501902 - DNA, 23 bp, Homo sapiens
agctgtgctctggacaggcatgt

SEQ ID NO: 3501903 - DNA, 19 bp, Homo sapiens
agctgtgcttatggtacca

SEQ ID NO: 3501904 - DNA, 18 bp, Homo sapiens
agctgttactgtcttcag

SEQ ID NO: 3501905 - DNA, 19 bp, Homo sapiens
agctgttactgtcttcagt

SEQ ID NO: 3501906 - DNA, 14 bp, Homo sapiens
agctgttcagctgg

SEQ ID NO: 3501907 - DNA, 18 bp, Homo sapiens
agctgttcctgttcagta

SEQ ID NO: 3501908 - DNA, 22 bp, Homo sapiens
agctgttgaagtctcaggagtc

SEQ ID NO: 3501909 - DNA, 13 bp, Homo sapiens
agctgttgagctg

SEQ ID NO: 3501910 - DNA, 14 bp, Homo sapiens
agctgttgagctgt

SEQ ID NO: 3501911 - DNA, 15 bp, Homo sapiens
agctgttgagctgtt

SEQ ID NO: 3501912 - DNA, 18 bp, Homo sapiens
agctgttttccctgacct

SEQ ID NO: 3501913 - DNA, 20 bp, Homo sapiens
agcttaaaggggctagagtg

SEQ ID NO: 3501914 - DNA, 12 bp, Homo sapiens
agcttatctcag

SEQ ID NO: 3501915 - DNA, 15 bp, Homo sapiens
agcttatctcagggg

SEQ ID NO: 3501916 - DNA, 14 bp, Homo sapiens
agcttatctctttt

SEQ ID NO: 3501917 - DNA, 19 bp, Homo sapiens
agcttatctcttttatatt

SEQ ID NO: 3501918 - DNA, 23 bp, Homo sapiens
agcttatctcttttatatttgta

SEQ ID NO: 3501919 - DNA, 16 bp, Homo sapiens
agcttcatgtggcttc

SEQ ID NO: 3501920 - DNA, 23 bp, Homo sapiens
agcttccatagctgctgccctag

SEQ ID NO: 3501921 - DNA, 22 bp, Homo sapiens
agcttccatgattctatttata

SEQ ID NO: 3501922 - DNA, 13 bp, Homo sapiens
agcttccctccat

SEQ ID NO: 3501923 - DNA, 15 bp, Homo sapiens
agcttccttggcttt

SEQ ID NO: 3501924 - DNA, 19 bp, Homo sapiens
agcttctagaggctcatgg

SEQ ID NO: 3501925 - DNA, 19 bp, Homo sapiens
agcttctcatcctgcaggc

SEQ ID NO: 3501926 - DNA, 12 bp, Homo sapiens
agcttctcctgt

SEQ ID NO: 3501927 - DNA, 21 bp, Homo sapiens
agcttctggaatttgttcaag

SEQ ID NO: 3501928 - DNA, 13 bp, Homo sapiens
agcttctgtctcc

SEQ ID NO: 3501929 - DNA, 22 bp, Homo sapiens
agcttcttccaggtgcccagct

SEQ ID NO: 3501930 - DNA, 20 bp, Homo sapiens
agcttgacctgaggctgtgg

SEQ ID NO: 3501931 - DNA, 21 bp, Homo sapiens
agcttgcaagaagcaggaagg

SEQ ID NO: 3501932 - DNA, 19 bp, Homo sapiens
agcttgccagatgctgcag

SEQ ID NO: 3501933 - DNA, 15 bp, Homo sapiens
agcttgctcacatct

SEQ ID NO: 3501934 - DNA, 19 bp, Homo sapiens
agcttgctgtcacttcttc

SEQ ID NO: 3501935 - DNA, 18 bp, Homo sapiens
agcttggacatcagtgtt

SEQ ID NO: 3501936 - DNA, 18 bp, Homo sapiens
agcttgtaaatagctcag

SEQ ID NO: 3501937 - DNA, 19 bp, Homo sapiens
agcttgtaaatagctcagg

SEQ ID NO: 3501938 - DNA, 20 bp, Homo sapiens
agcttgtaaatagctcaggt

SEQ ID NO: 3501939 - DNA, 11 bp, Homo sapiens
agcttgttgaa

SEQ ID NO: 3501940 - DNA, 17 bp, Homo sapiens
agcttgttgaaaaccca

SEQ ID NO: 3501941 - DNA, 23 bp, Homo sapiens
agcttgttgaaaacccagactgt

SEQ ID NO: 3501942 - DNA, 13 bp, Homo sapiens
agctttaaaagaa

SEQ ID NO: 3501943 - DNA, 17 bp, Homo sapiens
agctttaagatatcttt

SEQ ID NO: 3501944 - DNA, 22 bp, Homo sapiens
agctttcatgtaaactgtgcac

SEQ ID NO: 3501945 - DNA, 12 bp, Homo sapiens
agctttgaaaat

SEQ ID NO: 3501946 - DNA, 16 bp, Homo sapiens
agctttgaaaattcag

SEQ ID NO: 3501947 - DNA, 23 bp, Homo sapiens
agctttgtttgttgtcagctgaa

SEQ ID NO: 3501948 - DNA, 18 bp, Homo sapiens
agcttttggtgagaaggt

SEQ ID NO: 3501949 - DNA, 21 bp, Homo sapiens
agcttttttccttaatccagc

SEQ ID NO: 3501950 - DNA, 21 bp, Homo sapiens
aggaaaaaaatcgtccaggga

SEQ ID NO: 3501951 - DNA, 14 bp, Homo sapiens
aggaaaaagaaatg

SEQ ID NO: 3501952 - DNA, 13 bp, Homo sapiens
aggaaaaatgtgt

SEQ ID NO: 3501953 - DNA, 14 bp, Homo sapiens
aggaaaaatgtgta

SEQ ID NO: 3501954 - DNA, 15 bp, Homo sapiens
aggaaaaatgtgtaa

SEQ ID NO: 3501955 - DNA, 19 bp, Homo sapiens
aggaaaaatgtgtaatttt

SEQ ID NO: 3501956 - DNA, 18 bp, Homo sapiens
aggaaaagcacaaggact

SEQ ID NO: 3501957 - DNA, 20 bp, Homo sapiens
aggaaaagcggacatcagct

SEQ ID NO: 3501958 - DNA, 14 bp, Homo sapiens
aggaaaagctgctg

SEQ ID NO: 3501959 - DNA, 16 bp, Homo sapiens
aggaaaagctgctgac

SEQ ID NO: 3501960 - DNA, 13 bp, Homo sapiens
aggaaaatttcac

SEQ ID NO: 3501961 - DNA, 14 bp, Homo sapiens
aggaaacaacagct

SEQ ID NO: 3501962 - DNA, 17 bp, Homo sapiens
aggaaactttcctttaa

SEQ ID NO: 3501963 - DNA, 13 bp, Homo sapiens
aggaaaggccagc

SEQ ID NO: 3501964 - DNA, 15 bp, Homo sapiens
aggaaaggccagctg

SEQ ID NO: 3501965 - DNA, 22 bp, Homo sapiens
aggaaagggaggagtggaggtg

SEQ ID NO: 3501966 - DNA, 18 bp, Homo sapiens
aggaaaggggagaaggga

SEQ ID NO: 3501967 - DNA, 16 bp, Homo sapiens
aggaaagtcattggct

SEQ ID NO: 3501968 - DNA, 20 bp, Homo sapiens
aggaaagtcattggctttat

SEQ ID NO: 3501969 - DNA, 22 bp, Homo sapiens
aggaaagtcattggctttatcc

SEQ ID NO: 3501970 - DNA, 16 bp, Homo sapiens
aggaaataacagagag

SEQ ID NO: 3501971 - DNA, 20 bp, Homo sapiens
aggaaataacagagagaatg

SEQ ID NO: 3501972 - DNA, 21 bp, Homo sapiens
aggaaatcaacttgcttatca

SEQ ID NO: 3501973 - DNA, 16 bp, Homo sapiens
aggaaatctcacccca

SEQ ID NO: 3501974 - DNA, 19 bp, Homo sapiens
aggaaatgaaaatgtcttg

SEQ ID NO: 3501975 - DNA, 12 bp, Homo sapiens
aggaacactgac

SEQ ID NO: 3501976 - DNA, 13 bp, Homo sapiens
aggaacactgaca

SEQ ID NO: 3501977 - DNA, 12 bp, Homo sapiens
aggcaagccctg

SEQ ID NO: 3501978 - DNA, 14 bp, Homo sapiens
aggcaatgaagaat

SEQ ID NO: 3501979 - DNA, 15 bp, Homo sapiens
aggcaatgctggctg

SEQ ID NO: 3501980 - DNA, 23 bp, Homo sapiens
aggcacacaccaccacgcctggc

SEQ ID NO: 3501981 - DNA, 17 bp, Homo sapiens
aggcacagtgaaggctg

SEQ ID NO: 3501982 - DNA, 15 bp, Homo sapiens
aggcaccagtccctg

SEQ ID NO: 3501983 - DNA, 15 bp, Homo sapiens
aggcacccaccatca

SEQ ID NO: 3501984 - DNA, 20 bp, Homo sapiens
aggcacccaccatcatgtct

SEQ ID NO: 3501985 - DNA, 21 bp, Homo sapiens
aggcacccaccatcatgtctg

SEQ ID NO: 3501986 - DNA, 18 bp, Homo sapiens
aggcacctcaagaagaag

SEQ ID NO: 3501987 - DNA, 20 bp, Homo sapiens
aggcacctcacaggccccag

SEQ ID NO: 3501988 - DNA, 20 bp, Homo sapiens
aggcactttagggctgtaaa

SEQ ID NO: 3501989 - DNA, 16 bp, Homo sapiens
aggcagaatgtaactg

SEQ ID NO: 3501990 - DNA, 15 bp, Homo sapiens
aggcagacacaggga

SEQ ID NO: 3501991 - DNA, 21 bp, Homo sapiens
aggcagactctttatgcttgc

SEQ ID NO: 3501992 - DNA, 18 bp, Homo sapiens
aggcagatgtggggctga

SEQ ID NO: 3501993 - DNA, 23 bp, Homo sapiens
aggcagcagtgtgaggccagggc

SEQ ID NO: 3501994 - DNA, 16 bp, Homo sapiens
aggcagccccattctg

SEQ ID NO: 3501995 - DNA, 19 bp, Homo sapiens
aggcagccccattctgcct

SEQ ID NO: 3501996 - DNA, 20 bp, Homo sapiens
aggcagccccattctgcctg

SEQ ID NO: 3501997 - DNA, 13 bp, Homo sapiens
aggcagcgacccc

SEQ ID NO: 3501998 - DNA, 20 bp, Homo sapiens
aggcagctttttctctccca

SEQ ID NO: 3501999 - DNA, 14 bp, Homo sapiens
aggcaggacatgct

SEQ ID NO: 3502000 - DNA, 21 bp, Homo sapiens
aggcaggacatgctgaagcca

SEQ ID NO: 3502001 - DNA, 21 bp, Homo sapiens
aggcaggaccttcgggctgtg

SEQ ID NO: 3502002 - DNA, 12 bp, Homo sapiens
aggcagggaagt

SEQ ID NO: 3502003 - DNA, 19 bp, Homo sapiens
aggcagggaagtccccagg

SEQ ID NO: 3502004 - DNA, 20 bp, Homo sapiens
aggcagggtctcactctgtc

SEQ ID NO: 3502005 - DNA, 14 bp, Homo sapiens
aggcagggtgcagt

SEQ ID NO: 3502006 - DNA, 19 bp, Homo sapiens
aggcagtgatgctggatgc

SEQ ID NO: 3502007 - DNA, 18 bp, Homo sapiens
aggcagtttcagagatgg

SEQ ID NO: 3502008 - DNA, 13 bp, Homo sapiens
aggcatcctctga

SEQ ID NO: 3502009 - DNA, 15 bp, Homo sapiens
aggcatcctctgact

SEQ ID NO: 3502010 - DNA, 20 bp, Homo sapiens
aggcatgttctctgaggaca

SEQ ID NO: 3502011 - DNA, 13 bp, Homo sapiens
aggcattctctga

SEQ ID NO: 3502012 - DNA, 13 bp, Homo sapiens
aggcattgccaag

SEQ ID NO: 3502013 - DNA, 18 bp, Homo sapiens
aggcattgccaagggctt

SEQ ID NO: 3502014 - DNA, 15 bp, Homo sapiens
aggcatttcctgctg

SEQ ID NO: 3502015 - DNA, 22 bp, Homo sapiens
aggcatttcctgctgaacgttt

SEQ ID NO: 3502016 - DNA, 21 bp, Homo sapiens
aggcatttgcagggtcctctt

SEQ ID NO: 3502017 - DNA, 16 bp, Homo sapiens
aggcatttgctgaata

SEQ ID NO: 3502018 - DNA, 15 bp, Homo sapiens
aggcatttttaccat

SEQ ID NO: 3502019 - DNA, 15 bp, Homo sapiens
aggccaaacctctgt

SEQ ID NO: 3502020 - DNA, 16 bp, Homo sapiens
aggccaaacctctgtt

SEQ ID NO: 3502021 - DNA, 16 bp, Homo sapiens
aggccaaaggctggtg

SEQ ID NO: 3502022 - DNA, 14 bp, Homo sapiens
aggccaagaaacgt

SEQ ID NO: 3502023 - DNA, 21 bp, Homo sapiens
aggccaagaaacgtcttctaa

SEQ ID NO: 3502024 - DNA, 19 bp, Homo sapiens
aggccaagcagtgcctgcc

SEQ ID NO: 3502025 - DNA, 16 bp, Homo sapiens
aggccaaggtgggagg

SEQ ID NO: 3502026 - DNA, 18 bp, Homo sapiens
aggccaaggtgggaggat

SEQ ID NO: 3502027 - DNA, 17 bp, Homo sapiens
aggccacactcagcaca

SEQ ID NO: 3502028 - DNA, 18 bp, Homo sapiens
aggccacactcagcacaa

SEQ ID NO: 3502029 - DNA, 16 bp, Homo sapiens
aggccactgggccctg

SEQ ID NO: 3502030 - DNA, 14 bp, Homo sapiens
aggccagagggagt

SEQ ID NO: 3502031 - DNA, 17 bp, Homo sapiens
aggccagcacccaaagg

SEQ ID NO: 3502032 - DNA, 21 bp, Homo sapiens
aggccagcacccaaagggtta

SEQ ID NO: 3502033 - DNA, 13 bp, Homo sapiens
aggccagccagtg

SEQ ID NO: 3502034 - DNA, 22 bp, Homo sapiens
aggccagcctgcgggaagctga

SEQ ID NO: 3502035 - DNA, 17 bp, Homo sapiens
aggccagctatctgcct

SEQ ID NO: 3502036 - DNA, 18 bp, Homo sapiens
aggccagctatctgcctg

SEQ ID NO: 3502037 - DNA, 19 bp, Homo sapiens
aggccagctgccccagcca

SEQ ID NO: 3502038 - DNA, 13 bp, Homo sapiens
aggccagctgcct

SEQ ID NO: 3502039 - DNA, 14 bp, Homo sapiens
aggccagctggcag

SEQ ID NO: 3502040 - DNA, 15 bp, Homo sapiens
aggccagctggcagc

SEQ ID NO: 3502041 - DNA, 17 bp, Homo sapiens
aggccagctggcagcag

SEQ ID NO: 3502042 - DNA, 13 bp, Homo sapiens
aggccagggcaga

SEQ ID NO: 3502043 - DNA, 16 bp, Homo sapiens
aggccataaaacaggt

SEQ ID NO: 3502044 - DNA, 15 bp, Homo sapiens
aggccatatttccat

SEQ ID NO: 3502045 - DNA, 21 bp, Homo sapiens
aggccatctgggctcctccag

SEQ ID NO: 3502046 - DNA, 17 bp, Homo sapiens
aggccatggagagctgg

SEQ ID NO: 3502047 - DNA, 21 bp, Homo sapiens
aggccatggagagctggagcc

SEQ ID NO: 3502048 - DNA, 14 bp, Homo sapiens
aggccatgggcctc

SEQ ID NO: 3502049 - DNA, 17 bp, Homo sapiens
aggccatgggcctcctg

SEQ ID NO: 3502050 - DNA, 20 bp, Homo sapiens
aggccattgtgaaccaatgc

SEQ ID NO: 3502051 - DNA, 15 bp, Homo sapiens
aggcccaaggctccc

SEQ ID NO: 3502052 - DNA, 17 bp, Homo sapiens
aggcccaaggctcccgg

SEQ ID NO: 3502053 - DNA, 15 bp, Homo sapiens
aggccccactgggga

SEQ ID NO: 3502054 - DNA, 17 bp, Homo sapiens
aggccccactggggaaa

SEQ ID NO: 3502055 - DNA, 15 bp, Homo sapiens
aggccccaggaagcc

SEQ ID NO: 3502056 - DNA, 22 bp, Homo sapiens
aggcccccagcccagggctcct

SEQ ID NO: 3502057 - DNA, 23 bp, Homo sapiens
aggcccccagcccagggctcctg

SEQ ID NO: 3502058 - DNA, 14 bp, Homo sapiens
aggccccccgcagc

SEQ ID NO: 3502059 - DNA, 16 bp, Homo sapiens
aggccccccgcagcac

SEQ ID NO: 3502060 - DNA, 22 bp, Homo sapiens
aggccccccgcagcaccctgca

SEQ ID NO: 3502061 - DNA, 11 bp, Homo sapiens
aggcccctctc

SEQ ID NO: 3502062 - DNA, 13 bp, Homo sapiens
aggcccctctcct

SEQ ID NO: 3502063 - DNA, 14 bp, Homo sapiens
aggcccctctcctc

SEQ ID NO: 3502064 - DNA, 13 bp, Homo sapiens
aggcccctgccac

SEQ ID NO: 3502065 - DNA, 18 bp, Homo sapiens
aggcccctgccaccctgg

SEQ ID NO: 3502066 - DNA, 14 bp, Homo sapiens
aggcccctggaggc

SEQ ID NO: 3502067 - DNA, 15 bp, Homo sapiens
aggcccggctccagg

SEQ ID NO: 3502068 - DNA, 15 bp, Homo sapiens
aggcccgtccggcag

SEQ ID NO: 3502069 - DNA, 15 bp, Homo sapiens
aggccctcgctgcca

SEQ ID NO: 3502070 - DNA, 17 bp, Homo sapiens
aggccctcgctgccagc

SEQ ID NO: 3502071 - DNA, 21 bp, Homo sapiens
aggccctctggagtggccact

SEQ ID NO: 3502072 - DNA, 22 bp, Homo sapiens
aggccctctggagtggccacta

SEQ ID NO: 3502073 - DNA, 17 bp, Homo sapiens
aggccctgccagagcag

SEQ ID NO: 3502074 - DNA, 18 bp, Homo sapiens
aggccctggtcctggcct

SEQ ID NO: 3502075 - DNA, 20 bp, Homo sapiens
aggccctggtcctggcctcc

SEQ ID NO: 3502076 - DNA, 13 bp, Homo sapiens
aggccctgtgccc

SEQ ID NO: 3502077 - DNA, 16 bp, Homo sapiens
aggccggcagccccag

SEQ ID NO: 3502078 - DNA, 21 bp, Homo sapiens
aggccggcagccccagcctgc

SEQ ID NO: 3502079 - DNA, 16 bp, Homo sapiens
aggcctaccccgcaga

SEQ ID NO: 3502080 - DNA, 17 bp, Homo sapiens
aggcctaggtgcagctc

SEQ ID NO: 3502081 - DNA, 18 bp, Homo sapiens
aggcctaggtgcagctcc

SEQ ID NO: 3502082 - DNA, 14 bp, Homo sapiens
aggcctatcaacct

SEQ ID NO: 3502083 - DNA, 15 bp, Homo sapiens
aggcctcaactcctc

SEQ ID NO: 3502084 - DNA, 18 bp, Homo sapiens
aggcctcaactcctccca

SEQ ID NO: 3502085 - DNA, 19 bp, Homo sapiens
aggcctcaactcctcccat

SEQ ID NO: 3502086 - DNA, 16 bp, Homo sapiens
aggcctcagccagaga

SEQ ID NO: 3502087 - DNA, 15 bp, Homo sapiens
aggcctcaggtgctg

SEQ ID NO: 3502088 - DNA, 19 bp, Homo sapiens
aggcctcaggtgctgtcca

SEQ ID NO: 3502089 - DNA, 13 bp, Homo sapiens
aggcctgaagcca

SEQ ID NO: 3502090 - DNA, 20 bp, Homo sapiens
aggcctgagatttcatctgc

SEQ ID NO: 3502091 - DNA, 21 bp, Homo sapiens
aggcctgagatttcatctgct

SEQ ID NO: 3502092 - DNA, 19 bp, Homo sapiens
aggcctgagcgctcctgcc

SEQ ID NO: 3502093 - DNA, 22 bp, Homo sapiens
aggcctgagcgctcctgccgca

SEQ ID NO: 3502094 - DNA, 13 bp, Homo sapiens
aggcctggccaga

SEQ ID NO: 3502095 - DNA, 15 bp, Homo sapiens
aggcctggccagatg

SEQ ID NO: 3502096 - DNA, 17 bp, Homo sapiens
aggcctggccagatgca

SEQ ID NO: 3502097 - DNA, 22 bp, Homo sapiens
aggcctggccagatgcaccagc

SEQ ID NO: 3502098 - DNA, 23 bp, Homo sapiens
aggcctggccagatgcaccagcc

SEQ ID NO: 3502099 - DNA, 12 bp, Homo sapiens
aggcctggctca

SEQ ID NO: 3502100 - DNA, 20 bp, Homo sapiens
aggcctggctcattctgcac

SEQ ID NO: 3502101 - DNA, 19 bp, Homo sapiens
aggcctgggccgctgccac

SEQ ID NO: 3502102 - DNA, 20 bp, Homo sapiens
aggcctgggccgctgccacg

SEQ ID NO: 3502103 - DNA, 22 bp, Homo sapiens
aggcctgggggacccctggctc

SEQ ID NO: 3502104 - DNA, 23 bp, Homo sapiens
aggcctgggggacccctggctct

SEQ ID NO: 3502105 - DNA, 19 bp, Homo sapiens
aggccttagccatgatctg

SEQ ID NO: 3502106 - DNA, 11 bp, Homo sapiens
aggccttcagt

SEQ ID NO: 3502107 - DNA, 18 bp, Homo sapiens
aggccttcctctctccag

SEQ ID NO: 3502108 - DNA, 15 bp, Homo sapiens
aggccttgcctggcc

SEQ ID NO: 3502109 - DNA, 14 bp, Homo sapiens
aggcctttaaaatt

SEQ ID NO: 3502110 - DNA, 17 bp, Homo sapiens
agggccacgctccagct

SEQ ID NO: 3502111 - DNA, 11 bp, Homo sapiens
agggccagagc

SEQ ID NO: 3502112 - DNA, 14 bp, Homo sapiens
agggccagagccag

SEQ ID NO: 3502113 - DNA, 12 bp, Homo sapiens
agggcccagagc

SEQ ID NO: 3502114 - DNA, 14 bp, Homo sapiens
agggcccagagccc

SEQ ID NO: 3502115 - DNA, 19 bp, Homo sapiens
agggcccagagcccagctc

SEQ ID NO: 3502116 - DNA, 20 bp, Homo sapiens
agggccgccagggagacctg

SEQ ID NO: 3502117 - DNA, 12 bp, Homo sapiens
agggcctgctgg

SEQ ID NO: 3502118 - DNA, 14 bp, Homo sapiens
agggcctgctggag

SEQ ID NO: 3502119 - DNA, 17 bp, Homo sapiens
agggcctgctggaggcc

SEQ ID NO: 3502120 - DNA, 19 bp, Homo sapiens
agggcctgctggaggcctc

SEQ ID NO: 3502121 - DNA, 21 bp, Homo sapiens
agggcctgctggaggcctcag

SEQ ID NO: 3502122 - DNA, 23 bp, Homo sapiens
agggcctgctggaggcctcaggt

SEQ ID NO: 3502123 - DNA, 12 bp, Homo sapiens
agggcctggttg

SEQ ID NO: 3502124 - DNA, 19 bp, Homo sapiens
agggcgggaggatgttctg

SEQ ID NO: 3502125 - DNA, 17 bp, Homo sapiens
agggcgggcagagggct

SEQ ID NO: 3502126 - DNA, 21 bp, Homo sapiens
agggcgttcttaggctgctgg

SEQ ID NO: 3502127 - DNA, 15 bp, Homo sapiens
agggctaccctgagc

SEQ ID NO: 3502128 - DNA, 17 bp, Homo sapiens
agggctaccctgagctg

SEQ ID NO: 3502129 - DNA, 22 bp, Homo sapiens
agggctaccctgagctgaggca

SEQ ID NO: 3502130 - DNA, 19 bp, Homo sapiens
agggctcagcggggacagc

SEQ ID NO: 3502131 - DNA, 20 bp, Homo sapiens
agggctcagcggggacagct

SEQ ID NO: 3502132 - DNA, 22 bp, Homo sapiens
agggctcagcggggacagctcc

SEQ ID NO: 3502133 - DNA, 23 bp, Homo sapiens
agggctcagcggggacagctcct

SEQ ID NO: 3502134 - DNA, 23 bp, Homo sapiens
agggctctaaaaaaagccccaaa

SEQ ID NO: 3502135 - DNA, 21 bp, Homo sapiens
agggctgaaccctcagccttg

SEQ ID NO: 3502136 - DNA, 22 bp, Homo sapiens
agggctgcatgatgtttgccca

SEQ ID NO: 3502137 - DNA, 21 bp, Homo sapiens
agggctgcccctaatctctgt

SEQ ID NO: 3502138 - DNA, 23 bp, Homo sapiens
agggctgcggcgtacaggctggc

SEQ ID NO: 3502139 - DNA, 16 bp, Homo sapiens
agggctggaggcccag

SEQ ID NO: 3502140 - DNA, 18 bp, Homo sapiens
agggctggaggcccaggc

SEQ ID NO: 3502141 - DNA, 18 bp, Homo sapiens
agggctgtcatctgtgca

SEQ ID NO: 3502142 - DNA, 18 bp, Homo sapiens
agggctttgttttgcaca

SEQ ID NO: 3502143 - DNA, 18 bp, Homo sapiens
aggggaaaatcagcctgc

SEQ ID NO: 3502144 - DNA, 16 bp, Homo sapiens
aggggaatcagaactc

SEQ ID NO: 3502145 - DNA, 14 bp, Homo sapiens
aggggacaaggaag

SEQ ID NO: 3502146 - DNA, 15 bp, Homo sapiens
aggggacccccgccc

SEQ ID NO: 3502147 - DNA, 19 bp, Homo sapiens
aggggacccccgccccctg

SEQ ID NO: 3502148 - DNA, 16 bp, Homo sapiens
aggggacgcaggcccc

SEQ ID NO: 3502149 - DNA, 20 bp, Homo sapiens
aggggacgcaggcccctctc

SEQ ID NO: 3502150 - DNA, 24 bp, Homo sapiens
aggggacgcaggcccctctcctcc

SEQ ID NO: 3502151 - DNA, 17 bp, Homo sapiens
aggggagcccactgtcc

SEQ ID NO: 3502152 - DNA, 21 bp, Homo sapiens
aggggagcccactgtcctggg

SEQ ID NO: 3502153 - DNA, 24 bp, Homo sapiens
aggggagcccactgtcctgggcct

SEQ ID NO: 3502154 - DNA, 22 bp, Homo sapiens
aggggagggtgtatctagctct

SEQ ID NO: 3502155 - DNA, 21 bp, Homo sapiens
aggggatagagagagaccact

SEQ ID NO: 3502156 - DNA, 14 bp, Homo sapiens
aggggatggagtga

SEQ ID NO: 3502157 - DNA, 19 bp, Homo sapiens
aggggatggagtgagccca

SEQ ID NO: 3502158 - DNA, 22 bp, Homo sapiens
aggggcacctctcttgaacccc

SEQ ID NO: 3502159 - DNA, 15 bp, Homo sapiens
aggggcattgctgac

SEQ ID NO: 3502160 - DNA, 17 bp, Homo sapiens
aggggccagaggctcgt

SEQ ID NO: 3502161 - DNA, 21 bp, Homo sapiens
aggggcccccctgccctgtgg

SEQ ID NO: 3502162 - DNA, 23 bp, Homo sapiens
aggggcccggccagccatgtctg

SEQ ID NO: 3502163 - DNA, 14 bp, Homo sapiens
aggggcccgtggga

SEQ ID NO: 3502164 - DNA, 17 bp, Homo sapiens
aggggccgctgccaccc

SEQ ID NO: 3502165 - DNA, 22 bp, Homo sapiens
aggggccgctgccacccacctc

SEQ ID NO: 3502166 - DNA, 23 bp, Homo sapiens
aggggcctaggcctcagccagag

SEQ ID NO: 3502167 - DNA, 13 bp, Homo sapiens
aggggcctggaga

SEQ ID NO: 3502168 - DNA, 16 bp, Homo sapiens
aggggcgtctgttccc

SEQ ID NO: 3502169 - DNA, 22 bp, Homo sapiens
aggggctgctgacctccacagc

SEQ ID NO: 3502170 - DNA, 18 bp, Homo sapiens
aggggctgcttcctcctg

SEQ ID NO: 3502171 - DNA, 21 bp, Homo sapiens
aggggctgcttcctcctggaa

SEQ ID NO: 3502172 - DNA, 16 bp, Homo sapiens
aggggcttcaggtcca

SEQ ID NO: 3502173 - DNA, 21 bp, Homo sapiens
agggggagccccttctgctca

SEQ ID NO: 3502174 - DNA, 20 bp, Homo sapiens
agggggatccgactgctttg

SEQ ID NO: 3502175 - DNA, 23 bp, Homo sapiens
agggggatgccactcctccctcc

SEQ ID NO: 3502176 - DNA, 21 bp, Homo sapiens
aggggtcggctgaccatgctc

SEQ ID NO: 3502177 - DNA, 20 bp, Homo sapiens
aggggttcttgagccagcca

SEQ ID NO: 3502178 - DNA, 18 bp, Homo sapiens
agggtatcaaataaaatt

SEQ ID NO: 3502179 - DNA, 21 bp, Homo sapiens
agggtatggactatctgtctg

SEQ ID NO: 3502180 - DNA, 15 bp, Homo sapiens
agggtcagaaacagg

SEQ ID NO: 3502181 - DNA, 19 bp, Homo sapiens
agggtccagaaggagacag

SEQ ID NO: 3502182 - DNA, 17 bp, Homo sapiens
agggtcggaacccaagc

SEQ ID NO: 3502183 - DNA, 22 bp, Homo sapiens
agggtcggaacccaagcttaga

SEQ ID NO: 3502184 - DNA, 21 bp, Homo sapiens
agggtctcactatgttgccca

SEQ ID NO: 3502185 - DNA, 22 bp, Homo sapiens
agggtctcactatgttgcccag

SEQ ID NO: 3502186 - DNA, 14 bp, Homo sapiens
agggtctcactctg

SEQ ID NO: 3502187 - DNA, 16 bp, Homo sapiens
agggtctcactctgtc

SEQ ID NO: 3502188 - DNA, 14 bp, Homo sapiens
agggtctctgctgc

SEQ ID NO: 3502189 - DNA, 14 bp, Homo sapiens
agggtctgcctcca

SEQ ID NO: 3502190 - DNA, 17 bp, Homo sapiens
agggtctgcctccagcc

SEQ ID NO: 3502191 - DNA, 18 bp, Homo sapiens
agggtctgcctccagcca

SEQ ID NO: 3502192 - DNA, 17 bp, Homo sapiens
agggtctgggcaggact

SEQ ID NO: 3502193 - DNA, 19 bp, Homo sapiens
agggtctgtttggactgca

SEQ ID NO: 3502194 - DNA, 18 bp, Homo sapiens
agggtgagaggaagggtg

SEQ ID NO: 3502195 - DNA, 19 bp, Homo sapiens
agggtgagggccttcttaa

SEQ ID NO: 3502196 - DNA, 20 bp, Homo sapiens
agggtgcagtatcatgccct

SEQ ID NO: 3502197 - DNA, 18 bp, Homo sapiens
agggtgcccttttccagc

SEQ ID NO: 3502198 - DNA, 21 bp, Homo sapiens
agggtggctgggtccagggga

SEQ ID NO: 3502199 - DNA, 16 bp, Homo sapiens
agggtgtggcatttgg

SEQ ID NO: 3502200 - DNA, 18 bp, Homo sapiens
agggtgtggcatttggaa

SEQ ID NO: 3502201 - DNA, 20 bp, Homo sapiens
agggttctgcctctccaggc

SEQ ID NO: 3502202 - DNA, 15 bp, Homo sapiens
agggttgggctggtg

SEQ ID NO: 3502203 - DNA, 22 bp, Homo sapiens
agggtttaatccccagtaaaat

SEQ ID NO: 3502204 - DNA, 23 bp, Homo sapiens
agggtttggctgtgtctaaactg

SEQ ID NO: 3502205 - DNA, 22 bp, Homo sapiens
agggttttgccatgttggccag

SEQ ID NO: 3502206 - DNA, 14 bp, Homo sapiens
aggtaaaatgccat

SEQ ID NO: 3502207 - DNA, 14 bp, Homo sapiens
aggtaacaggcaga

SEQ ID NO: 3502208 - DNA, 20 bp, Homo sapiens
aggtacccaatagctgccca

SEQ ID NO: 3502209 - DNA, 22 bp, Homo sapiens
aggtactgtcatgggctaggca

SEQ ID NO: 3502210 - DNA, 20 bp, Homo sapiens
aggtactttttgtgaagacg

SEQ ID NO: 3502211 - DNA, 12 bp, Homo sapiens
aggtagggttta

SEQ ID NO: 3502212 - DNA, 21 bp, Homo sapiens
aggtcaaggctgcagtgagcc

SEQ ID NO: 3502213 - DNA, 21 bp, Homo sapiens
aggtcaatacagtacaggcag

SEQ ID NO: 3502214 - DNA, 22 bp, Homo sapiens
aggtcaatacagtacaggcagc

SEQ ID NO: 3502215 - DNA, 12 bp, Homo sapiens
aggtcagagatg

SEQ ID NO: 3502216 - DNA, 15 bp, Homo sapiens
aggtcagtgcaaata

SEQ ID NO: 3502217 - DNA, 22 bp, Homo sapiens
aggtcatactatctactctcct

SEQ ID NO: 3502218 - DNA, 14 bp, Homo sapiens
aggtccaattctcg

SEQ ID NO: 3502219 - DNA, 14 bp, Homo sapiens
aggtccagctctgg

SEQ ID NO: 3502220 - DNA, 19 bp, Homo sapiens
aggtcctctgtcagtcaca

SEQ ID NO: 3502221 - DNA, 14 bp, Homo sapiens
aggtcgaggcagga

SEQ ID NO: 3502222 - DNA, 20 bp, Homo sapiens
aggtcttgaactcctggcct

SEQ ID NO: 3502223 - DNA, 22 bp, Homo sapiens
aggtcttgaactcctggcctca

SEQ ID NO: 3502224 - DNA, 18 bp, Homo sapiens
aggtctttcagtactttt

SEQ ID NO: 3502225 - DNA, 21 bp, Homo sapiens
aggtctttgtaagaactaaag

SEQ ID NO: 3502226 - DNA, 18 bp, Homo sapiens
aggtcttttctagtctga

SEQ ID NO: 3502227 - DNA, 14 bp, Homo sapiens
aggtctttttttaa

SEQ ID NO: 3502228 - DNA, 16 bp, Homo sapiens
aggtgaaatgaagcaa

SEQ ID NO: 3502229 - DNA, 14 bp, Homo sapiens
aggtgaaggaatat

SEQ ID NO: 3502230 - DNA, 16 bp, Homo sapiens
aggtgaaggaatatat

SEQ ID NO: 3502231 - DNA, 13 bp, Homo sapiens
aggtgaccccagg

SEQ ID NO: 3502232 - DNA, 13 bp, Homo sapiens
aggtgagaaaaaa

SEQ ID NO: 3502233 - DNA, 21 bp, Homo sapiens
aggtgagaagcagaggaagga

SEQ ID NO: 3502234 - DNA, 20 bp, Homo sapiens
aggtgagcccatggccctcc

SEQ ID NO: 3502235 - DNA, 20 bp, Homo sapiens
aggtgataaatgtcagtagt

SEQ ID NO: 3502236 - DNA, 16 bp, Homo sapiens
aggtgatatatttaaa

SEQ ID NO: 3502237 - DNA, 18 bp, Homo sapiens
aggtgatatccattcttt

SEQ ID NO: 3502238 - DNA, 20 bp, Homo sapiens
aggtgatccacccacctcag

SEQ ID NO: 3502239 - DNA, 13 bp, Homo sapiens
aggtgcagccaga

SEQ ID NO: 3502240 - DNA, 16 bp, Homo sapiens
agtatttcaaattgga

SEQ ID NO: 3502241 - DNA, 20 bp, Homo sapiens
agtatttcaaattggagctt

SEQ ID NO: 3502242 - DNA, 17 bp, Homo sapiens
agtatttgattcaaaat

SEQ ID NO: 3502243 - DNA, 18 bp, Homo sapiens
agtattttagtgaacttg

SEQ ID NO: 3502244 - DNA, 17 bp, Homo sapiens
agtcaaatctgggctca

SEQ ID NO: 3502245 - DNA, 22 bp, Homo sapiens
agtcaaatggtaggcatttcct

SEQ ID NO: 3502246 - DNA, 23 bp, Homo sapiens
agtcaaatggtaggcatttccta

SEQ ID NO: 3502247 - DNA, 20 bp, Homo sapiens
agtcaaattaataatcttat

SEQ ID NO: 3502248 - DNA, 14 bp, Homo sapiens
agtcaacaagcctg

SEQ ID NO: 3502249 - DNA, 15 bp, Homo sapiens
agtcaacagttcaaa

SEQ ID NO: 3502250 - DNA, 14 bp, Homo sapiens
agtcaacctgggca

SEQ ID NO: 3502251 - DNA, 15 bp, Homo sapiens
agtcaacctgggcaa

SEQ ID NO: 3502252 - DNA, 14 bp, Homo sapiens
agtcaagaagaaaa

SEQ ID NO: 3502253 - DNA, 13 bp, Homo sapiens
agtcaagctcctc

SEQ ID NO: 3502254 - DNA, 16 bp, Homo sapiens
agtcaagctcctcctc

SEQ ID NO: 3502255 - DNA, 20 bp, Homo sapiens
agtcaagtgaaaaaggagga

SEQ ID NO: 3502256 - DNA, 20 bp, Homo sapiens
agtcaagtgcgtccacgagc

SEQ ID NO: 3502257 - DNA, 11 bp, Homo sapiens
agtcacacagt

SEQ ID NO: 3502258 - DNA, 17 bp, Homo sapiens
agtcacacagtgttgga

SEQ ID NO: 3502259 - DNA, 14 bp, Homo sapiens
agtcacatctcttc

SEQ ID NO: 3502260 - DNA, 22 bp, Homo sapiens
agtcaccaaaagacactgcaga

SEQ ID NO: 3502261 - DNA, 13 bp, Homo sapiens
agtcaccccagga

SEQ ID NO: 3502262 - DNA, 15 bp, Homo sapiens
agtcaccctagccct

SEQ ID NO: 3502263 - DNA, 23 bp, Homo sapiens
agtcaccctagccctctccctct

SEQ ID NO: 3502264 - DNA, 24 bp, Homo sapiens
agtcacccttccaccattgtccta

SEQ ID NO: 3502265 - DNA, 15 bp, Homo sapiens
agtcacgcctgaaac

SEQ ID NO: 3502266 - DNA, 18 bp, Homo sapiens
agtcacgtggaggagcag

SEQ ID NO: 3502267 - DNA, 20 bp, Homo sapiens
agtcacttcggccagagctg

SEQ ID NO: 3502268 - DNA, 18 bp, Homo sapiens
agtcagccaggagctgtc

SEQ ID NO: 3502269 - DNA, 21 bp, Homo sapiens
agtcagccccgacttcctgac

SEQ ID NO: 3502270 - DNA, 21 bp, Homo sapiens
agtcagccgacaactatttcg

SEQ ID NO: 3502271 - DNA, 19 bp, Homo sapiens
agtcagggacccctgccct

SEQ ID NO: 3502272 - DNA, 20 bp, Homo sapiens
agtcagtgcccaactgttat

SEQ ID NO: 3502273 - DNA, 17 bp, Homo sapiens
agtcagtgctggagaaa

SEQ ID NO: 3502274 - DNA, 18 bp, Homo sapiens
agtcagtgctggagaaat

SEQ ID NO: 3502275 - DNA, 21 bp, Homo sapiens
agtcataatcattagggggaa

SEQ ID NO: 3502276 - DNA, 17 bp, Homo sapiens
agtcataccaatgaaaa

SEQ ID NO: 3502277 - DNA, 15 bp, Homo sapiens
agtcatctcaaccat

SEQ ID NO: 3502278 - DNA, 17 bp, Homo sapiens
agtcatgcaaaggctgg

SEQ ID NO: 3502279 - DNA, 14 bp, Homo sapiens
agtcatgtgcctct

SEQ ID NO: 3502280 - DNA, 13 bp, Homo sapiens
agtcattgctgta

SEQ ID NO: 3502281 - DNA, 15 bp, Homo sapiens
agtcattggctgtct

SEQ ID NO: 3502282 - DNA, 20 bp, Homo sapiens
agtcattggctttatcctct

SEQ ID NO: 3502283 - DNA, 18 bp, Homo sapiens
agtccaaggaaaccacag

SEQ ID NO: 3502284 - DNA, 14 bp, Homo sapiens
agtccaattttaat

SEQ ID NO: 3502285 - DNA, 15 bp, Homo sapiens
agtccaattttaatt

SEQ ID NO: 3502286 - DNA, 15 bp, Homo sapiens
agtccagccagctcc

SEQ ID NO: 3502287 - DNA, 14 bp, Homo sapiens
agtccaggctgccg

SEQ ID NO: 3502288 - DNA, 17 bp, Homo sapiens
agtcccaaccccagcta

SEQ ID NO: 3502289 - DNA, 19 bp, Homo sapiens
agtcccaccctgctgctgc

SEQ ID NO: 3502290 - DNA, 19 bp, Homo sapiens
agtcccaccttggctgcag

SEQ ID NO: 3502291 - DNA, 13 bp, Homo sapiens
agtccccaggccc

SEQ ID NO: 3502292 - DNA, 22 bp, Homo sapiens
agtcccccagcagaaccagcct

SEQ ID NO: 3502293 - DNA, 14 bp, Homo sapiens
agtccctgtcacct

SEQ ID NO: 3502294 - DNA, 17 bp, Homo sapiens
agtccctgtcacctctt

SEQ ID NO: 3502295 - DNA, 21 bp, Homo sapiens
agtccgtgctgacagctgctc

SEQ ID NO: 3502296 - DNA, 16 bp, Homo sapiens
agtcctagttttccta

SEQ ID NO: 3502297 - DNA, 19 bp, Homo sapiens
agtcctattcaaattccta

SEQ ID NO: 3502298 - DNA, 17 bp, Homo sapiens
agtcctcataaaaagca

SEQ ID NO: 3502299 - DNA, 18 bp, Homo sapiens
agtcctcataaaaagcaa

SEQ ID NO: 3502300 - DNA, 22 bp, Homo sapiens
agtcctccctgacttttctgtg

SEQ ID NO: 3502301 - DNA, 20 bp, Homo sapiens
agtcctctgggtaggaatca

SEQ ID NO: 3502302 - DNA, 20 bp, Homo sapiens
agtcctgatcagagccgtgg

SEQ ID NO: 3502303 - DNA, 15 bp, Homo sapiens
agtcctgctacctcc

SEQ ID NO: 3502304 - DNA, 22 bp, Homo sapiens
agtcctggagcaatcacagatg

SEQ ID NO: 3502305 - DNA, 18 bp, Homo sapiens
agtcctggatgttgtgtg

SEQ ID NO: 3502306 - DNA, 12 bp, Homo sapiens
agtcctgtaatg

SEQ ID NO: 3502307 - DNA, 16 bp, Homo sapiens
agtcctgtatgtctgt

SEQ ID NO: 3502308 - DNA, 23 bp, Homo sapiens
agtccttatgttaagccctggca

SEQ ID NO: 3502309 - DNA, 23 bp, Homo sapiens
agtccttttactacagctatgaa

SEQ ID NO: 3502310 - DNA, 15 bp, Homo sapiens
agtccttttgtaaag

SEQ ID NO: 3502311 - DNA, 16 bp, Homo sapiens
agtccttttgtaaagt

SEQ ID NO: 3502312 - DNA, 22 bp, Homo sapiens
agtccttttgtaaagtgaagaa

SEQ ID NO: 3502313 - DNA, 23 bp, Homo sapiens
agtccttttgtaaagtgaagaat

SEQ ID NO: 3502314 - DNA, 21 bp, Homo sapiens
agtcctttttttccatcttta

SEQ ID NO: 3502315 - DNA, 12 bp, Homo sapiens
agtcgaccccaa

SEQ ID NO: 3502316 - DNA, 16 bp, Homo sapiens
agtcgaggacagggag

SEQ ID NO: 3502317 - DNA, 19 bp, Homo sapiens
agtcgcatctcagtgcagg

SEQ ID NO: 3502318 - DNA, 18 bp, Homo sapiens
agtcgtggggtgtgctgg

SEQ ID NO: 3502319 - DNA, 13 bp, Homo sapiens
agtctatgttcaa

SEQ ID NO: 3502320 - DNA, 18 bp, Homo sapiens
agtctcactgttgcccag

SEQ ID NO: 3502321 - DNA, 11 bp, Homo sapiens
agtctcctctc

SEQ ID NO: 3502322 - DNA, 11 bp, Homo sapiens
agtctctgagc

SEQ ID NO: 3502323 - DNA, 16 bp, Homo sapiens
agtctctgagcagtga

SEQ ID NO: 3502324 - DNA, 17 bp, Homo sapiens
agtctcttgtattaaac

SEQ ID NO: 3502325 - DNA, 14 bp, Homo sapiens
agtctgaagcagat

SEQ ID NO: 3502326 - DNA, 22 bp, Homo sapiens
agtctgcaaaatgaggaatgta

SEQ ID NO: 3502327 - DNA, 23 bp, Homo sapiens
agtctgctctagatgagctgggc

SEQ ID NO: 3502328 - DNA, 16 bp, Homo sapiens
agtctggtcagagcca

SEQ ID NO: 3502329 - DNA, 18 bp, Homo sapiens
agtctggtcagagccaca

SEQ ID NO: 3502330 - DNA, 15 bp, Homo sapiens
agtctgtccaggctc

SEQ ID NO: 3502331 - DNA, 16 bp, Homo sapiens
agtctgtcctgtgacg

SEQ ID NO: 3502332 - DNA, 17 bp, Homo sapiens
agtctgtttactgcaag

SEQ ID NO: 3502333 - DNA, 16 bp, Homo sapiens
agtcttatcaagcagc

SEQ ID NO: 3502334 - DNA, 19 bp, Homo sapiens
agtcttccacaaagaaaat

SEQ ID NO: 3502335 - DNA, 17 bp, Homo sapiens
agtcttccatttgcaag

SEQ ID NO: 3502336 - DNA, 15 bp, Homo sapiens
agtctttaggtcttt

SEQ ID NO: 3502337 - DNA, 16 bp, Homo sapiens
agtctttcacatttaa

SEQ ID NO: 3502338 - DNA, 15 bp, Homo sapiens
agtctttcatgtgtg

SEQ ID NO: 3502339 - DNA, 20 bp, Homo sapiens
agtctttcatgtgtgccaag

SEQ ID NO: 3502340 - DNA, 14 bp, Homo sapiens
agtcttttgctttt

SEQ ID NO: 3502341 - DNA, 22 bp, Homo sapiens
agtcttttgttcgcatggtcac

SEQ ID NO: 3502342 - DNA, 20 bp, Homo sapiens
agtgaaaaaggaggaagaga

SEQ ID NO: 3502343 - DNA, 15 bp, Homo sapiens
agtgaaagaaaataa

SEQ ID NO: 3502344 - DNA, 17 bp, Homo sapiens
agtgaaagaaaataaca

SEQ ID NO: 3502345 - DNA, 21 bp, Homo sapiens
agtgaaagtgaggaaataaag

SEQ ID NO: 3502346 - DNA, 21 bp, Homo sapiens
agtgaaggcttctctctgtgg

SEQ ID NO: 3502347 - DNA, 13 bp, Homo sapiens
agtgaatgattca

SEQ ID NO: 3502348 - DNA, 17 bp, Homo sapiens
agtgaatgattcagtgt

SEQ ID NO: 3502349 - DNA, 16 bp, Homo sapiens
agtgaatttttctcta

SEQ ID NO: 3502350 - DNA, 16 bp, Homo sapiens
agtgaatttttgcaat

SEQ ID NO: 3502351 - DNA, 24 bp, Homo sapiens
agtgaatttttgcaataatgcagt

SEQ ID NO: 3502352 - DNA, 19 bp, Homo sapiens
agtgacacccaagagggct

SEQ ID NO: 3502353 - DNA, 21 bp, Homo sapiens
agtgacacccaagagggctgc

SEQ ID NO: 3502354 - DNA, 14 bp, Homo sapiens
agtgacagaggcag

SEQ ID NO: 3502355 - DNA, 16 bp, Homo sapiens
agtgacctgaggaagc

SEQ ID NO: 3502356 - DNA, 20 bp, Homo sapiens
agtgactgttcaagagcaca

SEQ ID NO: 3502357 - DNA, 21 bp, Homo sapiens
agtgagacagtccagcctgga

SEQ ID NO: 3502358 - DNA, 17 bp, Homo sapiens
agtgagaccctgtctca

SEQ ID NO: 3502359 - DNA, 21 bp, Homo sapiens
agtgagaccctgtctcaaaaa

SEQ ID NO: 3502360 - DNA, 22 bp, Homo sapiens
agtgagactctgtctcaaaaaa

SEQ ID NO: 3502361 - DNA, 12 bp, Homo sapiens
agtgagctggtt

SEQ ID NO: 3502362 - DNA, 16 bp, Homo sapiens
agtgagtgtttctatg

SEQ ID NO: 3502363 - DNA, 15 bp, Homo sapiens
agtgatatggagcaa

SEQ ID NO: 3502364 - DNA, 19 bp, Homo sapiens
agtgatcctcccacctcag

SEQ ID NO: 3502365 - DNA, 14 bp, Homo sapiens
agtgattactgtca

SEQ ID NO: 3502366 - DNA, 14 bp, Homo sapiens
agtgattctcctgc

SEQ ID NO: 3502367 - DNA, 18 bp, Homo sapiens
agtgattctcctgcctca

SEQ ID NO: 3502368 - DNA, 22 bp, Homo sapiens
agtgattctcctgcctcagcct

SEQ ID NO: 3502369 - DNA, 24 bp, Homo sapiens
agtgattctcctgcctcagcctcc

SEQ ID NO: 3502370 - DNA, 18 bp, Homo sapiens
agtgcaaatcatagctgg

SEQ ID NO: 3502371 - DNA, 15 bp, Homo sapiens
agtgcaacctctgct

SEQ ID NO: 3502372 - DNA, 15 bp, Homo sapiens
agtgcaactgttttg

SEQ ID NO: 3502373 - DNA, 21 bp, Homo sapiens
agtgcaataaatctgacccag

SEQ ID NO: 3502374 - DNA, 17 bp, Homo sapiens
agtgcagccgtttgaga

SEQ ID NO: 3502375 - DNA, 16 bp, Homo sapiens
agtgcattgtttctgt

SEQ ID NO: 3502376 - DNA, 16 bp, Homo sapiens
agtgccaacaatccta

SEQ ID NO: 3502377 - DNA, 21 bp, Homo sapiens
agtgccaacaatcctagtgct

SEQ ID NO: 3502378 - DNA, 14 bp, Homo sapiens
agtgcccaactgtt

SEQ ID NO: 3502379 - DNA, 20 bp, Homo sapiens
agtgccccattctcactgct

SEQ ID NO: 3502380 - DNA, 19 bp, Homo sapiens
agtgccccattcttttgta

SEQ ID NO: 3502381 - DNA, 16 bp, Homo sapiens
agtgcccccactgacc

SEQ ID NO: 3502382 - DNA, 18 bp, Homo sapiens
agtgcctctttcatccac

SEQ ID NO: 3502383 - DNA, 20 bp, Homo sapiens
agtgccttttgcagaagagg

SEQ ID NO: 3502384 - DNA, 15 bp, Homo sapiens
agtgcgtccacgagc

SEQ ID NO: 3502385 - DNA, 13 bp, Homo sapiens
agtgctaagtgtg

SEQ ID NO: 3502386 - DNA, 17 bp, Homo sapiens
agtgctaagtgtgaact

SEQ ID NO: 3502387 - DNA, 22 bp, Homo sapiens
agtgctaagtgtgaactggacc

SEQ ID NO: 3502388 - DNA, 12 bp, Homo sapiens
agtgctcaggga

SEQ ID NO: 3502389 - DNA, 13 bp, Homo sapiens
agtgctcagggaa

SEQ ID NO: 3502390 - DNA, 14 bp, Homo sapiens
agtgctcagggaaa

SEQ ID NO: 3502391 - DNA, 18 bp, Homo sapiens
agtgctcagggaaatggc

SEQ ID NO: 3502392 - DNA, 21 bp, Homo sapiens
agtgctcagggaaatggcctt

SEQ ID NO: 3502393 - DNA, 22 bp, Homo sapiens
agtgctcagggaaatggccttc

SEQ ID NO: 3502394 - DNA, 14 bp, Homo sapiens
agtgctcccctctg

SEQ ID NO: 3502395 - DNA, 17 bp, Homo sapiens
agtgctccctcacatgt

SEQ ID NO: 3502396 - DNA, 15 bp, Homo sapiens
agtgctcgctgttgc

SEQ ID NO: 3502397 - DNA, 21 bp, Homo sapiens
agtgctctgatccctctacag

SEQ ID NO: 3502398 - DNA, 20 bp, Homo sapiens
agtgctgggattacaagcgt

SEQ ID NO: 3502399 - DNA, 19 bp, Homo sapiens
agtgctgggattacaggct

SEQ ID NO: 3502400 - DNA, 19 bp, Homo sapiens
agtgctgggattacaggtg

SEQ ID NO: 3502401 - DNA, 13 bp, Homo sapiens
agtgctgtataaa

SEQ ID NO: 3502402 - DNA, 12 bp, Homo sapiens
agtgctgtgctg

SEQ ID NO: 3502403 - DNA, 19 bp, Homo sapiens
agtgcttgccacagagcgg

SEQ ID NO: 3502404 - DNA, 19 bp, Homo sapiens
agtgctttccttttttaaa

SEQ ID NO: 3502405 - DNA, 11 bp, Homo sapiens
agtggaaaaat

SEQ ID NO: 3502406 - DNA, 23 bp, Homo sapiens
agtggaccttaggccttcctctc

SEQ ID NO: 3502407 - DNA, 15 bp, Homo sapiens
agtggatgatgtttc

SEQ ID NO: 3502408 - DNA, 11 bp, Homo sapiens
agtggcagctg

SEQ ID NO: 3502409 - DNA, 20 bp, Homo sapiens
agtggcagctgcttttgtct

SEQ ID NO: 3502410 - DNA, 20 bp, Homo sapiens
agtggccactaagcagagga

SEQ ID NO: 3502411 - DNA, 16 bp, Homo sapiens
agtggctgctgcccag

SEQ ID NO: 3502412 - DNA, 14 bp, Homo sapiens
agtggcttgtcctc

SEQ ID NO: 3502413 - DNA, 14 bp, Homo sapiens
agtgggagctgcct

SEQ ID NO: 3502414 - DNA, 12 bp, Homo sapiens
agtggggaagag

SEQ ID NO: 3502415 - DNA, 13 bp, Homo sapiens
agtggggaagagt

SEQ ID NO: 3502416 - DNA, 19 bp, Homo sapiens
agtggggaaggaggccaag

SEQ ID NO: 3502417 - DNA, 15 bp, Homo sapiens
agtggggctctctga

SEQ ID NO: 3502418 - DNA, 16 bp, Homo sapiens
agtggtgcgatctggg

SEQ ID NO: 3502419 - DNA, 15 bp, Homo sapiens
agtggtgcttagaaa

SEQ ID NO: 3502420 - DNA, 19 bp, Homo sapiens
agtggtggtaaccctggtg

SEQ ID NO: 3502421 - DNA, 14 bp, Homo sapiens
agtggttttaggat

SEQ ID NO: 3502422 - DNA, 19 bp, Homo sapiens
agtgtaacactgcaagaag

SEQ ID NO: 3502423 - DNA, 17 bp, Homo sapiens
agtgtaagctagaagaa

SEQ ID NO: 3502424 - DNA, 16 bp, Homo sapiens
agtgtaccatttgcct

SEQ ID NO: 3502425 - DNA, 17 bp, Homo sapiens
agtgtacctcctctcag

SEQ ID NO: 3502426 - DNA, 21 bp, Homo sapiens
agtgtacctcctctcagtgtt

SEQ ID NO: 3502427 - DNA, 15 bp, Homo sapiens
agtgtaggcagacac

SEQ ID NO: 3502428 - DNA, 16 bp, Homo sapiens
agtgtaggcagacaca

SEQ ID NO: 3502429 - DNA, 20 bp, Homo sapiens
agtgtaggcagacacaggga

SEQ ID NO: 3502430 - DNA, 16 bp, Homo sapiens
agtgtcactcaaggcg

SEQ ID NO: 3502431 - DNA, 20 bp, Homo sapiens
agtgtccaaagcagggtctg

SEQ ID NO: 3502432 - DNA, 22 bp, Homo sapiens
agtgtctcggagggattcccct

SEQ ID NO: 3502433 - DNA, 20 bp, Homo sapiens
agtgtctttcggaattttta

SEQ ID NO: 3502434 - DNA, 15 bp, Homo sapiens
agtgtctttctggtg

SEQ ID NO: 3502435 - DNA, 16 bp, Homo sapiens
agtgtcttttgacatt

SEQ ID NO: 3502436 - DNA, 22 bp, Homo sapiens
agtgtgcacccctccccattca

SEQ ID NO: 3502437 - DNA, 23 bp, Homo sapiens
agtgtggtgtttcctgcaggcca

SEQ ID NO: 3502438 - DNA, 22 bp, Homo sapiens
agtgtggttatgaactttatag

SEQ ID NO: 3502439 - DNA, 14 bp, Homo sapiens
agtgtgtattaaaa

SEQ ID NO: 3502440 - DNA, 21 bp, Homo sapiens
agtgtgtgattttttgcattc

SEQ ID NO: 3502441 - DNA, 15 bp, Homo sapiens
agtgttaaatgtgat

SEQ ID NO: 3502442 - DNA, 18 bp, Homo sapiens
agtgttagggaagggcct

SEQ ID NO: 3502443 - DNA, 14 bp, Homo sapiens
agtgttatgtattt

SEQ ID NO: 3502444 - DNA, 15 bp, Homo sapiens
agtgttatgtatttc

SEQ ID NO: 3502445 - DNA, 23 bp, Homo sapiens
agtgttcacaacctggaagtgct

SEQ ID NO: 3502446 - DNA, 22 bp, Homo sapiens
agtgttctgtttgttattgttt

SEQ ID NO: 3502447 - DNA, 21 bp, Homo sapiens
agtgtttctaataaacttgga

SEQ ID NO: 3502448 - DNA, 21 bp, Homo sapiens
agtgttttggactccatctct

SEQ ID NO: 3502449 - DNA, 22 bp, Homo sapiens
agtgttttggactccatctctc

SEQ ID NO: 3502450 - DNA, 14 bp, Homo sapiens
agtgttttgtacca

SEQ ID NO: 3502451 - DNA, 16 bp, Homo sapiens
agtgttttgtaccagt

SEQ ID NO: 3502452 - DNA, 22 bp, Homo sapiens
agtgttttgtaccagtgaattt

SEQ ID NO: 3502453 - DNA, 13 bp, Homo sapiens
agttaagacctgg

SEQ ID NO: 3502454 - DNA, 14 bp, Homo sapiens
agttaatattttgt

SEQ ID NO: 3502455 - DNA, 21 bp, Homo sapiens
agttaatattttgttcttatt

SEQ ID NO: 3502456 - DNA, 21 bp, Homo sapiens
agttacacagaaatgctgctg

SEQ ID NO: 3502457 - DNA, 20 bp, Homo sapiens
agttacagcctgttagtaac

SEQ ID NO: 3502458 - DNA, 22 bp, Homo sapiens
agttacagcctgttagtaacat

SEQ ID NO: 3502459 - DNA, 17 bp, Homo sapiens
agttactaggtaacttc

SEQ ID NO: 3502460 - DNA, 22 bp, Homo sapiens
agttactaggtaacttcatatt

SEQ ID NO: 3502461 - DNA, 16 bp, Homo sapiens
agttactctgaagggc

SEQ ID NO: 3502462 - DNA, 14 bp, Homo sapiens
agttactttagatg

SEQ ID NO: 3502463 - DNA, 15 bp, Homo sapiens
agttactttagatgg

SEQ ID NO: 3502464 - DNA, 19 bp, Homo sapiens
agttactttggaacactac

SEQ ID NO: 3502465 - DNA, 13 bp, Homo sapiens
agttagactgttg

SEQ ID NO: 3502466 - DNA, 12 bp, Homo sapiens
agttagccaaac

SEQ ID NO: 3502467 - DNA, 15 bp, Homo sapiens
agttaggaatgagaa

SEQ ID NO: 3502468 - DNA, 22 bp, Homo sapiens
agttatatttcagatgtaatgt

SEQ ID NO: 3502469 - DNA, 15 bp, Homo sapiens
agttatcaaaaagta

SEQ ID NO: 3502470 - DNA, 16 bp, Homo sapiens
agttatctaaaagaaa

SEQ ID NO: 3502471 - DNA, 17 bp, Homo sapiens
agttatctaagaataca

SEQ ID NO: 3502472 - DNA, 20 bp, Homo sapiens
agttcaaaattctaaatgta

SEQ ID NO: 3502473 - DNA, 15 bp, Homo sapiens
agttcaaagaagtca

SEQ ID NO: 3502474 - DNA, 22 bp, Homo sapiens
agttcaaggaacttgaaaaata

SEQ ID NO: 3502475 - DNA, 20 bp, Homo sapiens
agttcagaaatttaaaagca

SEQ ID NO: 3502476 - DNA, 21 bp, Homo sapiens
agttcagaaatttaaaagcag

SEQ ID NO: 3502477 - DNA, 16 bp, Homo sapiens
agttcagatcttaata

SEQ ID NO: 3502478 - DNA, 18 bp, Homo sapiens
agttcaggtaacaggcag

SEQ ID NO: 3502479 - DNA, 19 bp, Homo sapiens
agttcaggtaacaggcaga

SEQ ID NO: 3502480 - DNA, 19 bp, Homo sapiens
agttcaggtagctgcccct

SEQ ID NO: 3502481 - DNA, 16 bp, Homo sapiens
agttcatgtctgctat

SEQ ID NO: 3502482 - DNA, 17 bp, Homo sapiens
agttcatgtctgctatc

SEQ ID NO: 3502483 - DNA, 17 bp, Homo sapiens
agttccccatgcagaca

SEQ ID NO: 3502484 - DNA, 23 bp, Homo sapiens
agttcctcattagcattttgcta

SEQ ID NO: 3502485 - DNA, 19 bp, Homo sapiens
agttcctttccttttcttt

SEQ ID NO: 3502486 - DNA, 17 bp, Homo sapiens
agttcgagaccagcctg

SEQ ID NO: 3502487 - DNA, 18 bp, Homo sapiens
agttcgcctggagccctc

SEQ ID NO: 3502488 - DNA, 14 bp, Homo sapiens
agttctgatgctta

SEQ ID NO: 3502489 - DNA, 23 bp, Homo sapiens
agttctgtactcaaatgtagcca

SEQ ID NO: 3502490 - DNA, 13 bp, Homo sapiens
agttctgtagaaa

SEQ ID NO: 3502491 - DNA, 17 bp, Homo sapiens
agttctttgggccagac

SEQ ID NO: 3502492 - DNA, 21 bp, Homo sapiens
agttctttgggccagacatgc

SEQ ID NO: 3502493 - DNA, 21 bp, Homo sapiens
agttctttgttcatagcccag

SEQ ID NO: 3502494 - DNA, 22 bp, Homo sapiens
agttctttgttcatagcccagt

SEQ ID NO: 3502495 - DNA, 16 bp, Homo sapiens
agttgaaccttacagt

SEQ ID NO: 3502496 - DNA, 20 bp, Homo sapiens
agttgacaattctgcatgta

SEQ ID NO: 3502497 - DNA, 19 bp, Homo sapiens
agttgaccctattttttga

SEQ ID NO: 3502498 - DNA, 16 bp, Homo sapiens
agttgagaaggtgcct

SEQ ID NO: 3502499 - DNA, 19 bp, Homo sapiens
agttgagaaggtgcctgcc

SEQ ID NO: 3502500 - DNA, 21 bp, Homo sapiens
agttgagaaggtgcctgccat

SEQ ID NO: 3502501 - DNA, 22 bp, Homo sapiens
agttgagaaggtgcctgccata

SEQ ID NO: 3502502 - DNA, 19 bp, Homo sapiens
agttgatatagaacagtgc

SEQ ID NO: 3502503 - DNA, 21 bp, Homo sapiens
agttgatcgcctttcccaggt

SEQ ID NO: 3502504 - DNA, 19 bp, Homo sapiens
ataaggccataaaacaggt

SEQ ID NO: 3502505 - DNA, 21 bp, Homo sapiens
ataaggggtcaaaatttgctg

SEQ ID NO: 3502506 - DNA, 12 bp, Homo sapiens
ataagtaagaaa

SEQ ID NO: 3502507 - DNA, 18 bp, Homo sapiens
ataagtaagaaaatattt

SEQ ID NO: 3502508 - DNA, 14 bp, Homo sapiens
ataagtaagaaatt

SEQ ID NO: 3502509 - DNA, 19 bp, Homo sapiens
ataagtacctcagcattta

SEQ ID NO: 3502510 - DNA, 18 bp, Homo sapiens
ataagtatttcaaattgg

SEQ ID NO: 3502511 - DNA, 14 bp, Homo sapiens
ataagtgctgtata

SEQ ID NO: 3502512 - DNA, 16 bp, Homo sapiens
ataagtgctgtataaa

SEQ ID NO: 3502513 - DNA, 22 bp, Homo sapiens
ataagttatttttgtacatgtt

SEQ ID NO: 3502514 - DNA, 19 bp, Homo sapiens
ataagttgagaaggtgcct

SEQ ID NO: 3502515 - DNA, 22 bp, Homo sapiens
ataagttgagaaggtgcctgcc

SEQ ID NO: 3502516 - DNA, 21 bp, Homo sapiens
ataataaacgatgttgtgatg

SEQ ID NO: 3502517 - DNA, 21 bp, Homo sapiens
ataataagtgatgtgctgaat

SEQ ID NO: 3502518 - DNA, 14 bp, Homo sapiens
ataatatacttgtg

SEQ ID NO: 3502519 - DNA, 14 bp, Homo sapiens
ataatatattttca

SEQ ID NO: 3502520 - DNA, 20 bp, Homo sapiens
ataatatctaaagttatatt

SEQ ID NO: 3502521 - DNA, 15 bp, Homo sapiens
ataatatgagaatca

SEQ ID NO: 3502522 - DNA, 15 bp, Homo sapiens
ataatatgatgcaaa

SEQ ID NO: 3502523 - DNA, 17 bp, Homo sapiens
ataatatgatgcaaact

SEQ ID NO: 3502524 - DNA, 19 bp, Homo sapiens
ataatattttacatacact

SEQ ID NO: 3502525 - DNA, 23 bp, Homo sapiens
ataatcttattagggagaaaatt

SEQ ID NO: 3502526 - DNA, 14 bp, Homo sapiens
ataatgaatacttt

SEQ ID NO: 3502527 - DNA, 19 bp, Homo sapiens
ataatgcagtatggtacat

SEQ ID NO: 3502528 - DNA, 19 bp, Homo sapiens
ataatggacagattaatat

SEQ ID NO: 3502529 - DNA, 19 bp, Homo sapiens
ataatggggtcctggccat

SEQ ID NO: 3502530 - DNA, 17 bp, Homo sapiens
ataatgtaattgtaatt

SEQ ID NO: 3502531 - DNA, 13 bp, Homo sapiens
ataatgtgaaaat

SEQ ID NO: 3502532 - DNA, 17 bp, Homo sapiens
ataatgtttttaatatt

SEQ ID NO: 3502533 - DNA, 12 bp, Homo sapiens
ataattacaata

SEQ ID NO: 3502534 - DNA, 19 bp, Homo sapiens
ataattgggtcatagaaat

SEQ ID NO: 3502535 - DNA, 14 bp, Homo sapiens
ataattttagtaat

SEQ ID NO: 3502536 - DNA, 21 bp, Homo sapiens
ataatttttttcaatatttat

SEQ ID NO: 3502537 - DNA, 18 bp, Homo sapiens
atacaaaaatactcagat

SEQ ID NO: 3502538 - DNA, 17 bp, Homo sapiens
atacaaactggtattct

SEQ ID NO: 3502539 - DNA, 23 bp, Homo sapiens
atacaaattggttggttttgact

SEQ ID NO: 3502540 - DNA, 14 bp, Homo sapiens
atacaataaattgc

SEQ ID NO: 3502541 - DNA, 14 bp, Homo sapiens
atacaataacataa

SEQ ID NO: 3502542 - DNA, 14 bp, Homo sapiens
atacaatagcattg

SEQ ID NO: 3502543 - DNA, 15 bp, Homo sapiens
atacaatatcatcca

SEQ ID NO: 3502544 - DNA, 18 bp, Homo sapiens
atacacacggctccccca

SEQ ID NO: 3502545 - DNA, 14 bp, Homo sapiens
atacacatggaaaa

SEQ ID NO: 3502546 - DNA, 17 bp, Homo sapiens
atacaccagcattcctt

SEQ ID NO: 3502547 - DNA, 16 bp, Homo sapiens
atacagaactctttca

SEQ ID NO: 3502548 - DNA, 23 bp, Homo sapiens
atacagaactctttcaaaacctt

SEQ ID NO: 3502549 - DNA, 20 bp, Homo sapiens
atacagaattactgtaactg

SEQ ID NO: 3502550 - DNA, 14 bp, Homo sapiens
atacagattttgat

SEQ ID NO: 3502551 - DNA, 16 bp, Homo sapiens
atacagattttgatag

SEQ ID NO: 3502552 - DNA, 18 bp, Homo sapiens
atacagattttgatagca

SEQ ID NO: 3502553 - DNA, 12 bp, Homo sapiens
atacagctttct

SEQ ID NO: 3502554 - DNA, 19 bp, Homo sapiens
atacagctttctgaccttc

SEQ ID NO: 3502555 - DNA, 22 bp, Homo sapiens
atacaggaaaagctgctgacag

SEQ ID NO: 3502556 - DNA, 17 bp, Homo sapiens
atacagtcttccacaaa

SEQ ID NO: 3502557 - DNA, 21 bp, Homo sapiens
atacagtcttccacaaagaaa

SEQ ID NO: 3502558 - DNA, 21 bp, Homo sapiens
atacagttcggtgagctacaa

SEQ ID NO: 3502559 - DNA, 14 bp, Homo sapiens
atacataaagacta

SEQ ID NO: 3502560 - DNA, 15 bp, Homo sapiens
atacatacaccagca

SEQ ID NO: 3502561 - DNA, 23 bp, Homo sapiens
atacatacaccagcattcctttt

SEQ ID NO: 3502562 - DNA, 13 bp, Homo sapiens
atacatatcttta

SEQ ID NO: 3502563 - DNA, 14 bp, Homo sapiens
atacatatctttat

SEQ ID NO: 3502564 - DNA, 16 bp, Homo sapiens
atacatatctttatta

SEQ ID NO: 3502565 - DNA, 19 bp, Homo sapiens
ataccaatgaaaaaatgta

SEQ ID NO: 3502566 - DNA, 21 bp, Homo sapiens
ataccaatgaaaaaatgtata

SEQ ID NO: 3502567 - DNA, 18 bp, Homo sapiens
ataccatagagtccagat

SEQ ID NO: 3502568 - DNA, 20 bp, Homo sapiens
ataccatagagtccagatct

SEQ ID NO: 3502569 - DNA, 22 bp, Homo sapiens
ataccatctgctgccccgcttc

SEQ ID NO: 3502570 - DNA, 13 bp, Homo sapiens
atacctaaaacat

SEQ ID NO: 3502571 - DNA, 20 bp, Homo sapiens
ataccttttttgttccactt

SEQ ID NO: 3502572 - DNA, 19 bp, Homo sapiens
atacgagagcagaggtctc

SEQ ID NO: 3502573 - DNA, 20 bp, Homo sapiens
atacgctactataaagagaa

SEQ ID NO: 3502574 - DNA, 15 bp, Homo sapiens
atacgcttttctttg

SEQ ID NO: 3502575 - DNA, 14 bp, Homo sapiens
atactaccttgaaa

SEQ ID NO: 3502576 - DNA, 20 bp, Homo sapiens
atactagggagccatttgag

SEQ ID NO: 3502577 - DNA, 19 bp, Homo sapiens
atactcatgaccattagaa

SEQ ID NO: 3502578 - DNA, 23 bp, Homo sapiens
atactctagatgaagttttacat

SEQ ID NO: 3502579 - DNA, 22 bp, Homo sapiens
atactcttaggaagagaaacca

SEQ ID NO: 3502580 - DNA, 22 bp, Homo sapiens
atactcttcctatttttgtagt

SEQ ID NO: 3502581 - DNA, 14 bp, Homo sapiens
atactctttctgta

SEQ ID NO: 3502582 - DNA, 15 bp, Homo sapiens
atactctttctgtat

SEQ ID NO: 3502583 - DNA, 16 bp, Homo sapiens
atactctttctgtata

SEQ ID NO: 3502584 - DNA, 20 bp, Homo sapiens
atactgcgactttctgcctg

SEQ ID NO: 3502585 - DNA, 22 bp, Homo sapiens
atactgcgactttctgcctgga

SEQ ID NO: 3502586 - DNA, 19 bp, Homo sapiens
atactgctgagatacatac

SEQ ID NO: 3502587 - DNA, 15 bp, Homo sapiens
atactgcttggagct

SEQ ID NO: 3502588 - DNA, 20 bp, Homo sapiens
atacttaacaaatacattca

SEQ ID NO: 3502589 - DNA, 13 bp, Homo sapiens
atacttacattct

SEQ ID NO: 3502590 - DNA, 23 bp, Homo sapiens
atacttgaagggccagagccagg

SEQ ID NO: 3502591 - DNA, 14 bp, Homo sapiens
atacttgtggacta

SEQ ID NO: 3502592 - DNA, 23 bp, Homo sapiens
atactttagaagtagaattgaca

SEQ ID NO: 3502593 - DNA, 14 bp, Homo sapiens
atactttgtaaata

SEQ ID NO: 3502594 - DNA, 12 bp, Homo sapiens
atacttttcctt

SEQ ID NO: 3502595 - DNA, 19 bp, Homo sapiens
atacttttccttaccttta

SEQ ID NO: 3502596 - DNA, 17 bp, Homo sapiens
atactttttctaatgag

SEQ ID NO: 3502597 - DNA, 23 bp, Homo sapiens
atagaaaaattcagcaaaccatt

SEQ ID NO: 3502598 - DNA, 15 bp, Homo sapiens
atagaaaagcacttg

SEQ ID NO: 3502599 - DNA, 15 bp, Homo sapiens
atagaaaagttatta

SEQ ID NO: 3502600 - DNA, 22 bp, Homo sapiens
atagaaataaaggatgtgattg

SEQ ID NO: 3502601 - DNA, 20 bp, Homo sapiens
atagaaatggaaattttgct

SEQ ID NO: 3502602 - DNA, 23 bp, Homo sapiens
atagaaatggaaattttgctatc

SEQ ID NO: 3502603 - DNA, 14 bp, Homo sapiens
atagaagattgttg

SEQ ID NO: 3502604 - DNA, 20 bp, Homo sapiens
atagaatatagcatctttca

SEQ ID NO: 3502605 - DNA, 15 bp, Homo sapiens
atagaattagctttt

SEQ ID NO: 3502606 - DNA, 20 bp, Homo sapiens
atagaattagctttttcatc

SEQ ID NO: 3502607 - DNA, 20 bp, Homo sapiens
atagacaatttgcacatctt

SEQ ID NO: 3502608 - DNA, 22 bp, Homo sapiens
atagacactccccgaagtcttt

SEQ ID NO: 3502609 - DNA, 22 bp, Homo sapiens
atagaccttttttttttttcca

SEQ ID NO: 3502610 - DNA, 13 bp, Homo sapiens
atagagaatgttc

SEQ ID NO: 3502611 - DNA, 13 bp, Homo sapiens
atagagctgtatt

SEQ ID NO: 3502612 - DNA, 15 bp, Homo sapiens
atagagtatatgcac

SEQ ID NO: 3502613 - DNA, 14 bp, Homo sapiens
atagatcatttcta

SEQ ID NO: 3502614 - DNA, 16 bp, Homo sapiens
atagatgctggcccag

SEQ ID NO: 3502615 - DNA, 22 bp, Homo sapiens
atagatgtagataaactcagaa

SEQ ID NO: 3502616 - DNA, 15 bp, Homo sapiens
atagattaggtttgc

SEQ ID NO: 3502617 - DNA, 16 bp, Homo sapiens
atagattaggtttgcg

SEQ ID NO: 3502618 - DNA, 14 bp, Homo sapiens
atagcatctttcat

SEQ ID NO: 3502619 - DNA, 20 bp, Homo sapiens
atagccaggagcgcatctca

SEQ ID NO: 3502620 - DNA, 12 bp, Homo sapiens
atagcctgtggc

SEQ ID NO: 3502621 - DNA, 17 bp, Homo sapiens
atagctaactgtaaatc

SEQ ID NO: 3502622 - DNA, 14 bp, Homo sapiens
atagctactaattt

SEQ ID NO: 3502623 - DNA, 17 bp, Homo sapiens
atagctactaattttaa

SEQ ID NO: 3502624 - DNA, 19 bp, Homo sapiens
atagctcaggtgtccctgc

SEQ ID NO: 3502625 - DNA, 17 bp, Homo sapiens
atagctgggactacagg

SEQ ID NO: 3502626 - DNA, 18 bp, Homo sapiens
atagctgtacaaatataa

SEQ ID NO: 3502627 - DNA, 21 bp, Homo sapiens
atagcttcaccccaatcccag

SEQ ID NO: 3502628 - DNA, 21 bp, Homo sapiens
ataggaccaggatccagcctc

SEQ ID NO: 3502629 - DNA, 23 bp, Homo sapiens
ataggacctttccaccacagcca

SEQ ID NO: 3502630 - DNA, 20 bp, Homo sapiens
ataggcaggaagcccaattg

SEQ ID NO: 3502631 - DNA, 21 bp, Homo sapiens
ataggcgatcacaacgtgcat

SEQ ID NO: 3502632 - DNA, 17 bp, Homo sapiens
ataggtcagagatgggc

SEQ ID NO: 3502633 - DNA, 13 bp, Homo sapiens
ataggtggcctct

SEQ ID NO: 3502634 - DNA, 19 bp, Homo sapiens
ataggttaaactgaagcaa

SEQ ID NO: 3502635 - DNA, 15 bp, Homo sapiens
ataggtttaataatt

SEQ ID NO: 3502636 - DNA, 12 bp, Homo sapiens
atcaacttttta

SEQ ID NO: 3502637 - DNA, 16 bp, Homo sapiens
atcaagaagggctgca

SEQ ID NO: 3502638 - DNA, 15 bp, Homo sapiens
atcaagactggaagg

SEQ ID NO: 3502639 - DNA, 13 bp, Homo sapiens
atcaaggcactgc

SEQ ID NO: 3502640 - DNA, 22 bp, Homo sapiens
atcaaggccttattggaaagca

SEQ ID NO: 3502641 - DNA, 16 bp, Homo sapiens
atcaagtcctttgtga

SEQ ID NO: 3502642 - DNA, 11 bp, Homo sapiens
atcaagtttta

SEQ ID NO: 3502643 - DNA, 20 bp, Homo sapiens
atcaatgaggtatcttcttt

SEQ ID NO: 3502644 - DNA, 22 bp, Homo sapiens
atcaattttgacttaatgtgat

SEQ ID NO: 3502645 - DNA, 15 bp, Homo sapiens
atcacaacgtgcatt

SEQ ID NO: 3502646 - DNA, 19 bp, Homo sapiens
atcacagatcgcatttcct

SEQ ID NO: 3502647 - DNA, 20 bp, Homo sapiens
atcacagatcgcatttccta

SEQ ID NO: 3502648 - DNA, 13 bp, Homo sapiens
atcacagcctctg

SEQ ID NO: 3502649 - DNA, 19 bp, Homo sapiens
atcacatcttttaagacaa

SEQ ID NO: 3502650 - DNA, 13 bp, Homo sapiens
atcaccagacagg

SEQ ID NO: 3502651 - DNA, 15 bp, Homo sapiens
atcacctatttccat

SEQ ID NO: 3502652 - DNA, 15 bp, Homo sapiens
atcaccttaggcagg

SEQ ID NO: 3502653 - DNA, 18 bp, Homo sapiens
atcacgatgtaaattatt

SEQ ID NO: 3502654 - DNA, 13 bp, Homo sapiens
atcacgccactgc

SEQ ID NO: 3502655 - DNA, 16 bp, Homo sapiens
atcactgagttttcca

SEQ ID NO: 3502656 - DNA, 11 bp, Homo sapiens
atcactgccaa

SEQ ID NO: 3502657 - DNA, 21 bp, Homo sapiens
atcactgccagagataaacta

SEQ ID NO: 3502658 - DNA, 18 bp, Homo sapiens
atcactgtctttcctaga

SEQ ID NO: 3502659 - DNA, 21 bp, Homo sapiens
atcactgtctttcctagatgg

SEQ ID NO: 3502660 - DNA, 15 bp, Homo sapiens
atcactgtggctgtc

SEQ ID NO: 3502661 - DNA, 18 bp, Homo sapiens
atcacttctgagaactca

SEQ ID NO: 3502662 - DNA, 19 bp, Homo sapiens
atcacttgaggtcaggagt

SEQ ID NO: 3502663 - DNA, 17 bp, Homo sapiens
atcagaaaaatggagca

SEQ ID NO: 3502664 - DNA, 15 bp, Homo sapiens
atcagaaatacagat

SEQ ID NO: 3502665 - DNA, 19 bp, Homo sapiens
atcagaaatacagattttg

SEQ ID NO: 3502666 - DNA, 19 bp, Homo sapiens
atcagaatagccacatttg

SEQ ID NO: 3502667 - DNA, 14 bp, Homo sapiens
atcagaatttgtgt

SEQ ID NO: 3502668 - DNA, 19 bp, Homo sapiens
atcagagaccaggccctgg

SEQ ID NO: 3502669 - DNA, 22 bp, Homo sapiens
atcagagatgcaccaccaagcc

SEQ ID NO: 3502670 - DNA, 18 bp, Homo sapiens
atcagatcatttcaaaac

SEQ ID NO: 3502671 - DNA, 23 bp, Homo sapiens
atcagcaacaaccagcatccctt

SEQ ID NO: 3502672 - DNA, 19 bp, Homo sapiens
atcagccaattatgttaaa

SEQ ID NO: 3502673 - DNA, 20 bp, Homo sapiens
atcagcctgggcaatgtgat

SEQ ID NO: 3502674 - DNA, 21 bp, Homo sapiens
atcagcctgggcaatgtgata

SEQ ID NO: 3502675 - DNA, 14 bp, Homo sapiens
atcagctatttact

SEQ ID NO: 3502676 - DNA, 13 bp, Homo sapiens
atcagctccttcc

SEQ ID NO: 3502677 - DNA, 21 bp, Homo sapiens
atcagcttctatccttgactt

SEQ ID NO: 3502678 - DNA, 19 bp, Homo sapiens
atcaggaatattttccaaa

SEQ ID NO: 3502679 - DNA, 13 bp, Homo sapiens
atcaggagaaaaa

SEQ ID NO: 3502680 - DNA, 21 bp, Homo sapiens
atcagggcaatcccaacacat

SEQ ID NO: 3502681 - DNA, 21 bp, Homo sapiens
atcagggtaaaaggtgcaggt

SEQ ID NO: 3502682 - DNA, 19 bp, Homo sapiens
atcaggtgctgccatccag

SEQ ID NO: 3502683 - DNA, 16 bp, Homo sapiens
atcagtggacagtctg

SEQ ID NO: 3502684 - DNA, 21 bp, Homo sapiens
atcagtggacagtctgctcta

SEQ ID NO: 3502685 - DNA, 21 bp, Homo sapiens
atcagtgttgttgctctagga

SEQ ID NO: 3502686 - DNA, 14 bp, Homo sapiens
atcagtgtttgttg

SEQ ID NO: 3502687 - DNA, 14 bp, Homo sapiens
atcataaccacccc

SEQ ID NO: 3502688 - DNA, 18 bp, Homo sapiens
atcataattaccaagtga

SEQ ID NO: 3502689 - DNA, 14 bp, Homo sapiens
atcatagaaaaact

SEQ ID NO: 3502690 - DNA, 14 bp, Homo sapiens
atcatattattatc

SEQ ID NO: 3502691 - DNA, 17 bp, Homo sapiens
atcatcaagaagggctg

SEQ ID NO: 3502692 - DNA, 18 bp, Homo sapiens
atcatcaagaagggctgc

SEQ ID NO: 3502693 - DNA, 20 bp, Homo sapiens
atcatcaagaagggctgcat

SEQ ID NO: 3502694 - DNA, 13 bp, Homo sapiens
atcatcaaggcac

SEQ ID NO: 3502695 - DNA, 18 bp, Homo sapiens
atcatcaaggcactgcct

SEQ ID NO: 3502696 - DNA, 19 bp, Homo sapiens
atcatcaaggcactgcctg

SEQ ID NO: 3502697 - DNA, 21 bp, Homo sapiens
atcatccactgtgccatgtgc

SEQ ID NO: 3502698 - DNA, 18 bp, Homo sapiens
atcatctgtggaacccat

SEQ ID NO: 3502699 - DNA, 16 bp, Homo sapiens
atcatgaaatatgcat

SEQ ID NO: 3502700 - DNA, 17 bp, Homo sapiens
atcatgagcctgctgga

SEQ ID NO: 3502701 - DNA, 22 bp, Homo sapiens
atcatgcatcttactgaaggta

SEQ ID NO: 3502702 - DNA, 12 bp, Homo sapiens
atcatgccctgt

SEQ ID NO: 3502703 - DNA, 14 bp, Homo sapiens
atcatgttttggtg

SEQ ID NO: 3502704 - DNA, 13 bp, Homo sapiens
atcattactataa

SEQ ID NO: 3502705 - DNA, 17 bp, Homo sapiens
atcattgctcccctgat

SEQ ID NO: 3502706 - DNA, 12 bp, Homo sapiens
atcatttaataa

SEQ ID NO: 3502707 - DNA, 17 bp, Homo sapiens
atcatttaataatatac

SEQ ID NO: 3502708 - DNA, 19 bp, Homo sapiens
atcattttatatgtcaaag

SEQ ID NO: 3502709 - DNA, 13 bp, Homo sapiens
atccaaaagaagc

SEQ ID NO: 3502710 - DNA, 19 bp, Homo sapiens
atccaaaagaagcccccag

SEQ ID NO: 3502711 - DNA, 22 bp, Homo sapiens
atccaaaagaagcccccagcta

SEQ ID NO: 3502712 - DNA, 17 bp, Homo sapiens
atccaaaatgtgtattt

SEQ ID NO: 3502713 - DNA, 16 bp, Homo sapiens
atccaagcaagactga

SEQ ID NO: 3502714 - DNA, 16 bp, Homo sapiens
atccaatcagagacca

SEQ ID NO: 3502715 - DNA, 17 bp, Homo sapiens
atccaatcagagaccag

SEQ ID NO: 3502716 - DNA, 22 bp, Homo sapiens
atccaatcagagaccaggccct

SEQ ID NO: 3502717 - DNA, 15 bp, Homo sapiens
atccacccacctcag

SEQ ID NO: 3502718 - DNA, 23 bp, Homo sapiens
atccagagattcattttctagat

SEQ ID NO: 3502719 - DNA, 20 bp, Homo sapiens
atccagatacacccaaagta

SEQ ID NO: 3502720 - DNA, 16 bp, Homo sapiens
atccagcagtctctgc

SEQ ID NO: 3502721 - DNA, 20 bp, Homo sapiens
atccagcttgccagatgctg

SEQ ID NO: 3502722 - DNA, 22 bp, Homo sapiens
atccaggactatatttgggcct

SEQ ID NO: 3502723 - DNA, 23 bp, Homo sapiens
atccaggactatatttgggcctg

SEQ ID NO: 3502724 - DNA, 14 bp, Homo sapiens
atccaggcagatcc

SEQ ID NO: 3502725 - DNA, 13 bp, Homo sapiens
atccattcccaag

SEQ ID NO: 3502726 - DNA, 19 bp, Homo sapiens
atccattcccaagatgcct

SEQ ID NO: 3502727 - DNA, 21 bp, Homo sapiens
atccattcccaagatgcctga

SEQ ID NO: 3502728 - DNA, 22 bp, Homo sapiens
atccattcccaagatgcctgat

SEQ ID NO: 3502729 - DNA, 16 bp, Homo sapiens
atccattgtctcttca

SEQ ID NO: 3502730 - DNA, 14 bp, Homo sapiens
atcccaaactgtga

SEQ ID NO: 3502731 - DNA, 24 bp, Homo sapiens
atcccaaactgtgatgaagccgac

SEQ ID NO: 3502732 - DNA, 12 bp, Homo sapiens
atcccacacagg

SEQ ID NO: 3502733 - DNA, 17 bp, Homo sapiens
atcccatcattttccat

SEQ ID NO: 3502734 - DNA, 19 bp, Homo sapiens
atccccaataattgcagaa

SEQ ID NO: 3502735 - DNA, 21 bp, Homo sapiens
atccccaataattgcagaact

SEQ ID NO: 3502736 - DNA, 22 bp, Homo sapiens
atccccaataattgcagaacta

SEQ ID NO: 3502737 - DNA, 19 bp, Homo sapiens
atccccactgggaccaacc

SEQ ID NO: 3502738 - DNA, 15 bp, Homo sapiens
atccccagtaaaatt

SEQ ID NO: 3502739 - DNA, 22 bp, Homo sapiens
atccccagttcgcctggagccc

SEQ ID NO: 3502740 - DNA, 14 bp, Homo sapiens
atcccccactgcca

SEQ ID NO: 3502741 - DNA, 16 bp, Homo sapiens
atcccccactgccaca

SEQ ID NO: 3502742 - DNA, 22 bp, Homo sapiens
atcccccactgccacaccctcc

SEQ ID NO: 3502743 - DNA, 23 bp, Homo sapiens
atccccttacccttagaatccac

SEQ ID NO: 3502744 - DNA, 12 bp, Homo sapiens
atccccttgaac

SEQ ID NO: 3502745 - DNA, 13 bp, Homo sapiens
atcccgggcctca

SEQ ID NO: 3502746 - DNA, 14 bp, Homo sapiens
atcccgggggtggg

SEQ ID NO: 3502747 - DNA, 21 bp, Homo sapiens
atccctagactttaggctttc

SEQ ID NO: 3502748 - DNA, 11 bp, Homo sapiens
atccctcatct

SEQ ID NO: 3502749 - DNA, 18 bp, Homo sapiens
atccctcccccccatgca

SEQ ID NO: 3502750 - DNA, 17 bp, Homo sapiens
atccctctacagagctt

SEQ ID NO: 3502751 - DNA, 20 bp, Homo sapiens
atccctctacagagcttccc

SEQ ID NO: 3502752 - DNA, 23 bp, Homo sapiens
atccctctacagagcttccctga

SEQ ID NO: 3502753 - DNA, 21 bp, Homo sapiens
atccctctgggggctctggcc

SEQ ID NO: 3502754 - DNA, 22 bp, Homo sapiens
atccctctgggggctctggcca

SEQ ID NO: 3502755 - DNA, 15 bp, Homo sapiens
atccctgccagctct

SEQ ID NO: 3502756 - DNA, 22 bp, Homo sapiens
atcccttgtacctatggctgcc

SEQ ID NO: 3502757 - DNA, 18 bp, Homo sapiens
atccctttttgaagtgta

SEQ ID NO: 3502758 - DNA, 13 bp, Homo sapiens
atccgtgttgcag

SEQ ID NO: 3502759 - DNA, 17 bp, Homo sapiens
atccgtttgaccaattt

SEQ ID NO: 3502760 - DNA, 23 bp, Homo sapiens
atcctaaaacaaaagctcatcca

SEQ ID NO: 3502761 - DNA, 14 bp, Homo sapiens
atcctaaaacaaat

SEQ ID NO: 3502762 - DNA, 22 bp, Homo sapiens
atcctaccttgcttttgcttct

SEQ ID NO: 3502763 - DNA, 18 bp, Homo sapiens
atcctactaataaaccag

SEQ ID NO: 3502764 - DNA, 20 bp, Homo sapiens
atcctaggtagggtttaatc

SEQ ID NO: 3502765 - DNA, 16 bp, Homo sapiens
atcctatgtgatttta

SEQ ID NO: 3502766 - DNA, 21 bp, Homo sapiens
atcctattacatagtttgaaa

SEQ ID NO: 3502767 - DNA, 13 bp, Homo sapiens
atcctattctttc

SEQ ID NO: 3502768 - DNA, 16 bp, Homo sapiens
atctgttagggccttg

SEQ ID NO: 3502769 - DNA, 17 bp, Homo sapiens
atctgttagggccttgg

SEQ ID NO: 3502770 - DNA, 16 bp, Homo sapiens
atctgttccttggcag

SEQ ID NO: 3502771 - DNA, 16 bp, Homo sapiens
atctgttctaacatgt

SEQ ID NO: 3502772 - DNA, 18 bp, Homo sapiens
atctgttttgaaggcaaa

SEQ ID NO: 3502773 - DNA, 19 bp, Homo sapiens
atctgttttgaaggcaaaa

SEQ ID NO: 3502774 - DNA, 12 bp, Homo sapiens
atcttaatataa

SEQ ID NO: 3502775 - DNA, 13 bp, Homo sapiens
atcttaatataaa

SEQ ID NO: 3502776 - DNA, 15 bp, Homo sapiens
atcttacttggcttt

SEQ ID NO: 3502777 - DNA, 13 bp, Homo sapiens
atcttatactgta

SEQ ID NO: 3502778 - DNA, 19 bp, Homo sapiens
atcttatactgtacaataa

SEQ ID NO: 3502779 - DNA, 18 bp, Homo sapiens
atcttatcatggtctcag

SEQ ID NO: 3502780 - DNA, 21 bp, Homo sapiens
atcttattagggagaaaattc

SEQ ID NO: 3502781 - DNA, 22 bp, Homo sapiens
atcttattagggagaaaattca

SEQ ID NO: 3502782 - DNA, 19 bp, Homo sapiens
atcttcacccaggcctatg

SEQ ID NO: 3502783 - DNA, 23 bp, Homo sapiens
atcttcagatttaagttaaataa

SEQ ID NO: 3502784 - DNA, 17 bp, Homo sapiens
atcttcagtttaatgca

SEQ ID NO: 3502785 - DNA, 14 bp, Homo sapiens
atcttccctctccc

SEQ ID NO: 3502786 - DNA, 13 bp, Homo sapiens
atcttcctgtgtc

SEQ ID NO: 3502787 - DNA, 15 bp, Homo sapiens
atcttcgggaccagg

SEQ ID NO: 3502788 - DNA, 21 bp, Homo sapiens
atcttctaaacccaatccaaa

SEQ ID NO: 3502789 - DNA, 14 bp, Homo sapiens
atcttctctggcga

SEQ ID NO: 3502790 - DNA, 19 bp, Homo sapiens
atcttgaaaatattgaaga

SEQ ID NO: 3502791 - DNA, 21 bp, Homo sapiens
atcttgaaattaagaaggcaa

SEQ ID NO: 3502792 - DNA, 21 bp, Homo sapiens
atcttgaatactctgccctct

SEQ ID NO: 3502793 - DNA, 23 bp, Homo sapiens
atcttgaatagcttatgtacaaa

SEQ ID NO: 3502794 - DNA, 13 bp, Homo sapiens
atcttgctctgct

SEQ ID NO: 3502795 - DNA, 16 bp, Homo sapiens
atcttgctctgctgac

SEQ ID NO: 3502796 - DNA, 17 bp, Homo sapiens
atcttgctctgctgaca

SEQ ID NO: 3502797 - DNA, 12 bp, Homo sapiens
atcttgctggct

SEQ ID NO: 3502798 - DNA, 23 bp, Homo sapiens
atcttgcttccctaatctatggt

SEQ ID NO: 3502799 - DNA, 13 bp, Homo sapiens
atcttgctttctt

SEQ ID NO: 3502800 - DNA, 14 bp, Homo sapiens
atcttgctttcttt

SEQ ID NO: 3502801 - DNA, 23 bp, Homo sapiens
atcttgggggggtggccgctgag

SEQ ID NO: 3502802 - DNA, 20 bp, Homo sapiens
atcttggtttgccttccaga

SEQ ID NO: 3502803 - DNA, 15 bp, Homo sapiens
atcttgtttttccac

SEQ ID NO: 3502804 - DNA, 20 bp, Homo sapiens
atctttaaaagatgctttta

SEQ ID NO: 3502805 - DNA, 21 bp, Homo sapiens
atctttaaaagatgcttttaa

SEQ ID NO: 3502806 - DNA, 21 bp, Homo sapiens
atctttacaaaactacatgag

SEQ ID NO: 3502807 - DNA, 18 bp, Homo sapiens
atctttattgagaaagag

SEQ ID NO: 3502808 - DNA, 18 bp, Homo sapiens
atctttcaaaccagcttc

SEQ ID NO: 3502809 - DNA, 16 bp, Homo sapiens
atctttcatatggtag

SEQ ID NO: 3502810 - DNA, 23 bp, Homo sapiens
atctttcatatggtaggaaccaa

SEQ ID NO: 3502811 - DNA, 11 bp, Homo sapiens
atctttcttct

SEQ ID NO: 3502812 - DNA, 19 bp, Homo sapiens
atctttcttctattttatt

SEQ ID NO: 3502813 - DNA, 17 bp, Homo sapiens
atctttgattctccttc

SEQ ID NO: 3502814 - DNA, 19 bp, Homo sapiens
atctttgattctccttcag

SEQ ID NO: 3502815 - DNA, 20 bp, Homo sapiens
atctttgattctccttcagc

SEQ ID NO: 3502816 - DNA, 13 bp, Homo sapiens
atctttgtggcca

SEQ ID NO: 3502817 - DNA, 14 bp, Homo sapiens
atctttgtggccaa

SEQ ID NO: 3502818 - DNA, 19 bp, Homo sapiens
atctttgtggccaaggagc

SEQ ID NO: 3502819 - DNA, 16 bp, Homo sapiens
atcttttattttggaa

SEQ ID NO: 3502820 - DNA, 20 bp, Homo sapiens
atcttttattttggaactat

SEQ ID NO: 3502821 - DNA, 23 bp, Homo sapiens
atcttttcttgcctctgtcccct

SEQ ID NO: 3502822 - DNA, 11 bp, Homo sapiens
atcttttgaac

SEQ ID NO: 3502823 - DNA, 16 bp, Homo sapiens
atcttttgtttccttt

SEQ ID NO: 3502824 - DNA, 23 bp, Homo sapiens
atcttttgtttccttttttccca

SEQ ID NO: 3502825 - DNA, 13 bp, Homo sapiens
atgaaaatgtctt

SEQ ID NO: 3502826 - DNA, 15 bp, Homo sapiens
atgaaaatgtcttgt

SEQ ID NO: 3502827 - DNA, 20 bp, Homo sapiens
atgaaagtctagaaataaaa

SEQ ID NO: 3502828 - DNA, 14 bp, Homo sapiens
atgaaataaaatta

SEQ ID NO: 3502829 - DNA, 13 bp, Homo sapiens
atgaaatattgct

SEQ ID NO: 3502830 - DNA, 14 bp, Homo sapiens
atgaaatgaggtca

SEQ ID NO: 3502831 - DNA, 14 bp, Homo sapiens
atgaaatttttgta

SEQ ID NO: 3502832 - DNA, 18 bp, Homo sapiens
atgaacacttaaattatg

SEQ ID NO: 3502833 - DNA, 17 bp, Homo sapiens
atgaacatatatttttt

SEQ ID NO: 3502834 - DNA, 20 bp, Homo sapiens
atgaaccacatcttgctctg

SEQ ID NO: 3502835 - DNA, 14 bp, Homo sapiens
atgaacccctggct

SEQ ID NO: 3502836 - DNA, 22 bp, Homo sapiens
atgaacccctggctccttcacc

SEQ ID NO: 3502837 - DNA, 21 bp, Homo sapiens
atgaagaatataccatttcaa

SEQ ID NO: 3502838 - DNA, 13 bp, Homo sapiens
atgaagacttaaa

SEQ ID NO: 3502839 - DNA, 16 bp, Homo sapiens
atgaagacttaaaaga

SEQ ID NO: 3502840 - DNA, 15 bp, Homo sapiens
atgaagagccagccc

SEQ ID NO: 3502841 - DNA, 18 bp, Homo sapiens
atgaagccgaccttagat

SEQ ID NO: 3502842 - DNA, 23 bp, Homo sapiens
atgaagccgaccttagatttagt

SEQ ID NO: 3502843 - DNA, 15 bp, Homo sapiens
atgaagttgtaggta

SEQ ID NO: 3502844 - DNA, 19 bp, Homo sapiens
atgaagtttccttggctgg

SEQ ID NO: 3502845 - DNA, 15 bp, Homo sapiens
atgaagtttgaatgt

SEQ ID NO: 3502846 - DNA, 20 bp, Homo sapiens
atgaagtttgaatgttaaat

SEQ ID NO: 3502847 - DNA, 16 bp, Homo sapiens
atgaatataatgaatg

SEQ ID NO: 3502848 - DNA, 14 bp, Homo sapiens
atgaatctgctcac

SEQ ID NO: 3502849 - DNA, 16 bp, Homo sapiens
atgaatctgctcactt

SEQ ID NO: 3502850 - DNA, 18 bp, Homo sapiens
atgaatctgctcacttta

SEQ ID NO: 3502851 - DNA, 15 bp, Homo sapiens
atgaatgatttgcat

SEQ ID NO: 3502852 - DNA, 20 bp, Homo sapiens
atgaatgtatttatttggga

SEQ ID NO: 3502853 - DNA, 21 bp, Homo sapiens
atgaattgcgttggtctctgc

SEQ ID NO: 3502854 - DNA, 14 bp, Homo sapiens
atgaattgtacaga

SEQ ID NO: 3502855 - DNA, 22 bp, Homo sapiens
atgaatttattgcacattgttc

SEQ ID NO: 3502856 - DNA, 23 bp, Homo sapiens
atgaatttttttcatcttctctg

SEQ ID NO: 3502857 - DNA, 16 bp, Homo sapiens
atgacactgtttcctg

SEQ ID NO: 3502858 - DNA, 22 bp, Homo sapiens
atgacacttgtccccaaatccg

SEQ ID NO: 3502859 - DNA, 19 bp, Homo sapiens
atgacagctcttctaagga

SEQ ID NO: 3502860 - DNA, 14 bp, Homo sapiens
atgacatagcagtt

SEQ ID NO: 3502861 - DNA, 22 bp, Homo sapiens
atgacatgaggaaaataatgta

SEQ ID NO: 3502862 - DNA, 20 bp, Homo sapiens
atgacatggaggcactgaag

SEQ ID NO: 3502863 - DNA, 21 bp, Homo sapiens
atgacattttttttaactact

SEQ ID NO: 3502864 - DNA, 17 bp, Homo sapiens
atgactcacatgatgca

SEQ ID NO: 3502865 - DNA, 12 bp, Homo sapiens
atgactgccttg

SEQ ID NO: 3502866 - DNA, 18 bp, Homo sapiens
atgactgccttgcctcct

SEQ ID NO: 3502867 - DNA, 14 bp, Homo sapiens
atgacttacctgtt

SEQ ID NO: 3502868 - DNA, 23 bp, Homo sapiens
atgacttcccctgcctcctactc

SEQ ID NO: 3502869 - DNA, 15 bp, Homo sapiens
atgactttttataaa

SEQ ID NO: 3502870 - DNA, 18 bp, Homo sapiens
atgactttttataaaatg

SEQ ID NO: 3502871 - DNA, 14 bp, Homo sapiens
atgagaaactgcat

SEQ ID NO: 3502872 - DNA, 13 bp, Homo sapiens
atgagaacaaaca

SEQ ID NO: 3502873 - DNA, 21 bp, Homo sapiens
atgagaagaaaatggaaccag

SEQ ID NO: 3502874 - DNA, 21 bp, Homo sapiens
atgagaatttgagtgctctga

SEQ ID NO: 3502875 - DNA, 14 bp, Homo sapiens
atgagacttgcctt

SEQ ID NO: 3502876 - DNA, 17 bp, Homo sapiens
atgagagcgacacagac

SEQ ID NO: 3502877 - DNA, 18 bp, Homo sapiens
atgagagcgacacagacg

SEQ ID NO: 3502878 - DNA, 17 bp, Homo sapiens
atgagagttttggatgc

SEQ ID NO: 3502879 - DNA, 21 bp, Homo sapiens
atgagagttttggatgcagtg

SEQ ID NO: 3502880 - DNA, 15 bp, Homo sapiens
atgagcatcccagga

SEQ ID NO: 3502881 - DNA, 15 bp, Homo sapiens
atgagcatggagctg

SEQ ID NO: 3502882 - DNA, 17 bp, Homo sapiens
atgagcatggagctggc

SEQ ID NO: 3502883 - DNA, 18 bp, Homo sapiens
atgagcctcagcatcctg

SEQ ID NO: 3502884 - DNA, 19 bp, Homo sapiens
atgagcctcagcatcctgg

SEQ ID NO: 3502885 - DNA, 21 bp, Homo sapiens
atgagcctcagcatcctggca

SEQ ID NO: 3502886 - DNA, 12 bp, Homo sapiens
atgagcctgctg

SEQ ID NO: 3502887 - DNA, 17 bp, Homo sapiens
atgagcctgctggaagc

SEQ ID NO: 3502888 - DNA, 14 bp, Homo sapiens
atgagccttaagaa

SEQ ID NO: 3502889 - DNA, 22 bp, Homo sapiens
atgagctctacccagggcctgc

SEQ ID NO: 3502890 - DNA, 12 bp, Homo sapiens
atgaggaatgta

SEQ ID NO: 3502891 - DNA, 17 bp, Homo sapiens
atgaggaatgtatatgt

SEQ ID NO: 3502892 - DNA, 18 bp, Homo sapiens
atgaggagagaaaatata

SEQ ID NO: 3502893 - DNA, 17 bp, Homo sapiens
atgagtgcgtgctcagt

SEQ ID NO: 3502894 - DNA, 16 bp, Homo sapiens
atgagttatctaagaa

SEQ ID NO: 3502895 - DNA, 13 bp, Homo sapiens
atgagtttaaaaa

SEQ ID NO: 3502896 - DNA, 15 bp, Homo sapiens
atgagtttaaaaatc

SEQ ID NO: 3502897 - DNA, 22 bp, Homo sapiens
atgagtttaaaaatcaactttt

SEQ ID NO: 3502898 - DNA, 15 bp, Homo sapiens
atgataattacaata

SEQ ID NO: 3502899 - DNA, 20 bp, Homo sapiens
atgataattacaatacaaag

SEQ ID NO: 3502900 - DNA, 17 bp, Homo sapiens
atggagtttacaaagat

SEQ ID NO: 3502901 - DNA, 13 bp, Homo sapiens
atggatacataaa

SEQ ID NO: 3502902 - DNA, 19 bp, Homo sapiens
atggattacttctctataa

SEQ ID NO: 3502903 - DNA, 17 bp, Homo sapiens
atggcaacagatctgga

SEQ ID NO: 3502904 - DNA, 21 bp, Homo sapiens
atggcaggacgtgggctgggc

SEQ ID NO: 3502905 - DNA, 14 bp, Homo sapiens
atggcagtccagcc

SEQ ID NO: 3502906 - DNA, 16 bp, Homo sapiens
atggcagtccagccag

SEQ ID NO: 3502907 - DNA, 17 bp, Homo sapiens
atggcatgagaaataca

SEQ ID NO: 3502908 - DNA, 14 bp, Homo sapiens
atggccaaacccaa

SEQ ID NO: 3502909 - DNA, 22 bp, Homo sapiens
atggccacagtagtcttgatga

SEQ ID NO: 3502910 - DNA, 14 bp, Homo sapiens
atggccccagcaca

SEQ ID NO: 3502911 - DNA, 17 bp, Homo sapiens
atggccccagcacagct

SEQ ID NO: 3502912 - DNA, 14 bp, Homo sapiens
atggccgtggatgc

SEQ ID NO: 3502913 - DNA, 16 bp, Homo sapiens
atggccgtggatggcc

SEQ ID NO: 3502914 - DNA, 13 bp, Homo sapiens
atggcctcatgtg

SEQ ID NO: 3502915 - DNA, 17 bp, Homo sapiens
atggcctcttgaagaga

SEQ ID NO: 3502916 - DNA, 13 bp, Homo sapiens
atggccttcccgc

SEQ ID NO: 3502917 - DNA, 16 bp, Homo sapiens
atggctctatttcttc

SEQ ID NO: 3502918 - DNA, 22 bp, Homo sapiens
atggctctatttcttcttcaca

SEQ ID NO: 3502919 - DNA, 22 bp, Homo sapiens
atgggaatcatggcctcttgaa

SEQ ID NO: 3502920 - DNA, 17 bp, Homo sapiens
atgggagccgggtctgc

SEQ ID NO: 3502921 - DNA, 23 bp, Homo sapiens
atgggaggctcacccccttctcc

SEQ ID NO: 3502922 - DNA, 18 bp, Homo sapiens
atgggagggaggctcagg

SEQ ID NO: 3502923 - DNA, 14 bp, Homo sapiens
atgggattctggac

SEQ ID NO: 3502924 - DNA, 16 bp, Homo sapiens
atgggccactgaaatc

SEQ ID NO: 3502925 - DNA, 15 bp, Homo sapiens
atgggcctcctgtgt

SEQ ID NO: 3502926 - DNA, 17 bp, Homo sapiens
atgggcctttgagcctg

SEQ ID NO: 3502927 - DNA, 18 bp, Homo sapiens
atgggcgtacgctggtgc

SEQ ID NO: 3502928 - DNA, 20 bp, Homo sapiens
atgggctgggggctatgtat

SEQ ID NO: 3502929 - DNA, 16 bp, Homo sapiens
atggggaaggaggctg

SEQ ID NO: 3502930 - DNA, 21 bp, Homo sapiens
atggggcatcctctttttcca

SEQ ID NO: 3502931 - DNA, 20 bp, Homo sapiens
atggggccctaattcagcca

SEQ ID NO: 3502932 - DNA, 22 bp, Homo sapiens
atgggggaaagcacaggtgggc

SEQ ID NO: 3502933 - DNA, 18 bp, Homo sapiens
atgggggaactcagatcc

SEQ ID NO: 3502934 - DNA, 17 bp, Homo sapiens
atgggggaccccttccc

SEQ ID NO: 3502935 - DNA, 19 bp, Homo sapiens
atgggggagtctgaagcag

SEQ ID NO: 3502936 - DNA, 20 bp, Homo sapiens
atgggggagtctgaagcaga

SEQ ID NO: 3502937 - DNA, 16 bp, Homo sapiens
atggggtcctggccat

SEQ ID NO: 3502938 - DNA, 13 bp, Homo sapiens
atgggtcagagct

SEQ ID NO: 3502939 - DNA, 18 bp, Homo sapiens
atgggtcgggagagggga

SEQ ID NO: 3502940 - DNA, 20 bp, Homo sapiens
atgggtcgggagaggggacg

SEQ ID NO: 3502941 - DNA, 22 bp, Homo sapiens
atgggttttatgagatggatca

SEQ ID NO: 3502942 - DNA, 22 bp, Homo sapiens
atgggtttttccctgtacagta

SEQ ID NO: 3502943 - DNA, 14 bp, Homo sapiens
atggtaagacctct

SEQ ID NO: 3502944 - DNA, 22 bp, Homo sapiens
atggtacaacctttattctttt

SEQ ID NO: 3502945 - DNA, 12 bp, Homo sapiens
atggtacatttt

SEQ ID NO: 3502946 - DNA, 16 bp, Homo sapiens
atggtacatttttcaa

SEQ ID NO: 3502947 - DNA, 20 bp, Homo sapiens
atggtatgtgagctaggaga

SEQ ID NO: 3502948 - DNA, 16 bp, Homo sapiens
atggtcacacactgat

SEQ ID NO: 3502949 - DNA, 18 bp, Homo sapiens
atggtcagccctagggtg

SEQ ID NO: 3502950 - DNA, 17 bp, Homo sapiens
atggtcattgcagttta

SEQ ID NO: 3502951 - DNA, 13 bp, Homo sapiens
atggtccaggaga

SEQ ID NO: 3502952 - DNA, 14 bp, Homo sapiens
atggtctggtctat

SEQ ID NO: 3502953 - DNA, 15 bp, Homo sapiens
atggtcttcagcctc

SEQ ID NO: 3502954 - DNA, 16 bp, Homo sapiens
atggtgccccaggacc

SEQ ID NO: 3502955 - DNA, 19 bp, Homo sapiens
atggtgccccaggaccagc

SEQ ID NO: 3502956 - DNA, 19 bp, Homo sapiens
atggtggaaaacgaagctc

SEQ ID NO: 3502957 - DNA, 13 bp, Homo sapiens
atggtggcacatt

SEQ ID NO: 3502958 - DNA, 12 bp, Homo sapiens
atggtggctggg

SEQ ID NO: 3502959 - DNA, 23 bp, Homo sapiens
atggtgtggactgaatgggatca

SEQ ID NO: 3502960 - DNA, 18 bp, Homo sapiens
atggtgtgggtgtcctgc

SEQ ID NO: 3502961 - DNA, 12 bp, Homo sapiens
atggttgtatta

SEQ ID NO: 3502962 - DNA, 22 bp, Homo sapiens
atgtaaaagacttttttcccaa

SEQ ID NO: 3502963 - DNA, 22 bp, Homo sapiens
atgtaaaaggccaaacctctgt

SEQ ID NO: 3502964 - DNA, 12 bp, Homo sapiens
atgtaaacattt

SEQ ID NO: 3502965 - DNA, 14 bp, Homo sapiens
atgtaaatgtgcat

SEQ ID NO: 3502966 - DNA, 11 bp, Homo sapiens
atgtaaccaat

SEQ ID NO: 3502967 - DNA, 12 bp, Homo sapiens
atgtaacttgaa

SEQ ID NO: 3502968 - DNA, 19 bp, Homo sapiens
atgtaagaattcagaagac

SEQ ID NO: 3502969 - DNA, 12 bp, Homo sapiens
atgtaatgtttt

SEQ ID NO: 3502970 - DNA, 13 bp, Homo sapiens
atgtacaaaactt

SEQ ID NO: 3502971 - DNA, 14 bp, Homo sapiens
atgtacaagatgaa

SEQ ID NO: 3502972 - DNA, 13 bp, Homo sapiens
atgtacacatttt

SEQ ID NO: 3502973 - DNA, 13 bp, Homo sapiens
atgtacagacaga

SEQ ID NO: 3502974 - DNA, 15 bp, Homo sapiens
atgtacatgagaagg

SEQ ID NO: 3502975 - DNA, 20 bp, Homo sapiens
atgtacatttccaaattcac

SEQ ID NO: 3502976 - DNA, 20 bp, Homo sapiens
atgtactagtgttctgtttg

SEQ ID NO: 3502977 - DNA, 21 bp, Homo sapiens
atgtactagttttagttttct

SEQ ID NO: 3502978 - DNA, 17 bp, Homo sapiens
atgtactcctctttaca

SEQ ID NO: 3502979 - DNA, 13 bp, Homo sapiens
atgtagaagctgc

SEQ ID NO: 3502980 - DNA, 18 bp, Homo sapiens
atgtagaagtctttcaga

SEQ ID NO: 3502981 - DNA, 18 bp, Homo sapiens
atgtagataaactcagaa

SEQ ID NO: 3502982 - DNA, 16 bp, Homo sapiens
atgtagcccatccttc

SEQ ID NO: 3502983 - DNA, 19 bp, Homo sapiens
atgtagccccctggcctct

SEQ ID NO: 3502984 - DNA, 23 bp, Homo sapiens
atgtaggagctgccttggctcag

SEQ ID NO: 3502985 - DNA, 14 bp, Homo sapiens
atgtaggtaaattc

SEQ ID NO: 3502986 - DNA, 13 bp, Homo sapiens
atgtagtaattga

SEQ ID NO: 3502987 - DNA, 16 bp, Homo sapiens
atgtagtgcctctttc

SEQ ID NO: 3502988 - DNA, 14 bp, Homo sapiens
atgtataaaatgta

SEQ ID NO: 3502989 - DNA, 17 bp, Homo sapiens
atgtataaagtgattga

SEQ ID NO: 3502990 - DNA, 18 bp, Homo sapiens
atgtatgtttttttccaa

SEQ ID NO: 3502991 - DNA, 14 bp, Homo sapiens
atgtattataactt

SEQ ID NO: 3502992 - DNA, 17 bp, Homo sapiens
atgtattcacacacccc

SEQ ID NO: 3502993 - DNA, 17 bp, Homo sapiens
atgtcacaggcaggtcc

SEQ ID NO: 3502994 - DNA, 13 bp, Homo sapiens
atgtcagcaaaaa

SEQ ID NO: 3502995 - DNA, 15 bp, Homo sapiens
atgtcagcaaaaagc

SEQ ID NO: 3502996 - DNA, 23 bp, Homo sapiens
atgtcaggggcggggagggtgac

SEQ ID NO: 3502997 - DNA, 15 bp, Homo sapiens
atgtcagtattttaa

SEQ ID NO: 3502998 - DNA, 22 bp, Homo sapiens
atgtcatatactgccatgtact

SEQ ID NO: 3502999 - DNA, 17 bp, Homo sapiens
atgtccacgtgtgtgtg

SEQ ID NO: 3503000 - DNA, 20 bp, Homo sapiens
atgtccagagctggccaggc

SEQ ID NO: 3503001 - DNA, 14 bp, Homo sapiens
atgtcccttgctgt

SEQ ID NO: 3503002 - DNA, 17 bp, Homo sapiens
atgtcctcaccacatgc

SEQ ID NO: 3503003 - DNA, 17 bp, Homo sapiens
atgtctattccattccc

SEQ ID NO: 3503004 - DNA, 16 bp, Homo sapiens
atgtctgagtgaacct

SEQ ID NO: 3503005 - DNA, 11 bp, Homo sapiens
atgtctgcagc

SEQ ID NO: 3503006 - DNA, 15 bp, Homo sapiens
atgtctgcagccctg

SEQ ID NO: 3503007 - DNA, 19 bp, Homo sapiens
atgtctgcagccctgagaa

SEQ ID NO: 3503008 - DNA, 19 bp, Homo sapiens
atgtctgcagtgtgccccc

SEQ ID NO: 3503009 - DNA, 15 bp, Homo sapiens
atgtctgccatgttg

SEQ ID NO: 3503010 - DNA, 14 bp, Homo sapiens
atgtctgtttgctg

SEQ ID NO: 3503011 - DNA, 12 bp, Homo sapiens
atgtcttaatga

SEQ ID NO: 3503012 - DNA, 16 bp, Homo sapiens
atgtcttaatgaagtt

SEQ ID NO: 3503013 - DNA, 18 bp, Homo sapiens
atgtcttaatgaagtttg

SEQ ID NO: 3503014 - DNA, 23 bp, Homo sapiens
atgtcttaatgaagtttgaatgt

SEQ ID NO: 3503015 - DNA, 17 bp, Homo sapiens
atgtcttcaaggcttca

SEQ ID NO: 3503016 - DNA, 23 bp, Homo sapiens
atgtcttgatgcatgcactgttc

SEQ ID NO: 3503017 - DNA, 21 bp, Homo sapiens
atgtcttttttcaaactttat

SEQ ID NO: 3503018 - DNA, 17 bp, Homo sapiens
atgtgaactttattaaa

SEQ ID NO: 3503019 - DNA, 18 bp, Homo sapiens
atgtgactctgaagctga

SEQ ID NO: 3503020 - DNA, 22 bp, Homo sapiens
atgtgactctggcttggcctat

SEQ ID NO: 3503021 - DNA, 16 bp, Homo sapiens
atgtgagaggtttgac

SEQ ID NO: 3503022 - DNA, 18 bp, Homo sapiens
atgtgataaggaaatcaa

SEQ ID NO: 3503023 - DNA, 16 bp, Homo sapiens
atgtgattttaactct

SEQ ID NO: 3503024 - DNA, 18 bp, Homo sapiens
atgtgattttaactctgt

SEQ ID NO: 3503025 - DNA, 20 bp, Homo sapiens
atgtgattttaactctgtct

SEQ ID NO: 3503026 - DNA, 20 bp, Homo sapiens
atgtgcattcttttaaaaga

SEQ ID NO: 3503027 - DNA, 21 bp, Homo sapiens
atgtgccagggcaatgatgaa

SEQ ID NO: 3503028 - DNA, 20 bp, Homo sapiens
atgtgccatgtataattttt

SEQ ID NO: 3503029 - DNA, 14 bp, Homo sapiens
atgtgcctctgtcc

SEQ ID NO: 3503030 - DNA, 18 bp, Homo sapiens
atgtggcaaggaaaaaca

SEQ ID NO: 3503031 - DNA, 18 bp, Homo sapiens
atgtggggctgagctggg

SEQ ID NO: 3503032 - DNA, 18 bp, Homo sapiens
atgtgggggcttcatctc

SEQ ID NO: 3503033 - DNA, 15 bp, Homo sapiens
attataatttaatgc

SEQ ID NO: 3503034 - DNA, 22 bp, Homo sapiens
attataatttttttcaatattt

SEQ ID NO: 3503035 - DNA, 20 bp, Homo sapiens
attatatggcttgagtttaa

SEQ ID NO: 3503036 - DNA, 16 bp, Homo sapiens
attatatttacaaatg

SEQ ID NO: 3503037 - DNA, 19 bp, Homo sapiens
attatctatacatatcttt

SEQ ID NO: 3503038 - DNA, 19 bp, Homo sapiens
attatctatttgtgtgtgt

SEQ ID NO: 3503039 - DNA, 17 bp, Homo sapiens
attatctcacttgtgcc

SEQ ID NO: 3503040 - DNA, 15 bp, Homo sapiens
attatgtataaaatg

SEQ ID NO: 3503041 - DNA, 20 bp, Homo sapiens
attatgtataaaatgtaaca

SEQ ID NO: 3503042 - DNA, 22 bp, Homo sapiens
attatgttaaactagcatatct

SEQ ID NO: 3503043 - DNA, 16 bp, Homo sapiens
attattaatttatgca

SEQ ID NO: 3503044 - DNA, 15 bp, Homo sapiens
attattcagtgtcac

SEQ ID NO: 3503045 - DNA, 16 bp, Homo sapiens
attattccttcttcta

SEQ ID NO: 3503046 - DNA, 13 bp, Homo sapiens
attattctcattt

SEQ ID NO: 3503047 - DNA, 14 bp, Homo sapiens
attattctcattta

SEQ ID NO: 3503048 - DNA, 18 bp, Homo sapiens
attattctcatttagtgc

SEQ ID NO: 3503049 - DNA, 15 bp, Homo sapiens
attattgaaatatta

SEQ ID NO: 3503050 - DNA, 12 bp, Homo sapiens
attattgcatta

SEQ ID NO: 3503051 - DNA, 15 bp, Homo sapiens
attatttatttattt

SEQ ID NO: 3503052 - DNA, 19 bp, Homo sapiens
attatttatttgattaggt

SEQ ID NO: 3503053 - DNA, 14 bp, Homo sapiens
attatttttgtaga

SEQ ID NO: 3503054 - DNA, 23 bp, Homo sapiens
attatttttttttttgttcttga

SEQ ID NO: 3503055 - DNA, 16 bp, Homo sapiens
attcaaaagttgaaat

SEQ ID NO: 3503056 - DNA, 15 bp, Homo sapiens
attcaaaatatttaa

SEQ ID NO: 3503057 - DNA, 15 bp, Homo sapiens
attcaaactgctcca

SEQ ID NO: 3503058 - DNA, 14 bp, Homo sapiens
attcaactaaaaaa

SEQ ID NO: 3503059 - DNA, 21 bp, Homo sapiens
attcaagccattccaaagttc

SEQ ID NO: 3503060 - DNA, 12 bp, Homo sapiens
attcaataaagt

SEQ ID NO: 3503061 - DNA, 13 bp, Homo sapiens
attcaataaagta

SEQ ID NO: 3503062 - DNA, 18 bp, Homo sapiens
attcaataaagtatttaa

SEQ ID NO: 3503063 - DNA, 22 bp, Homo sapiens
attcaataaagtatttaattag

SEQ ID NO: 3503064 - DNA, 19 bp, Homo sapiens
attcaatatcctttgcctc

SEQ ID NO: 3503065 - DNA, 14 bp, Homo sapiens
attcaattgtaaat

SEQ ID NO: 3503066 - DNA, 16 bp, Homo sapiens
attcacccccaaacag

SEQ ID NO: 3503067 - DNA, 13 bp, Homo sapiens
attcacctgagca

SEQ ID NO: 3503068 - DNA, 21 bp, Homo sapiens
attcactcatacatctggccg

SEQ ID NO: 3503069 - DNA, 18 bp, Homo sapiens
attcacttagcagaacct

SEQ ID NO: 3503070 - DNA, 15 bp, Homo sapiens
attcagacaaaatgg

SEQ ID NO: 3503071 - DNA, 17 bp, Homo sapiens
attcagacaaaatggat

SEQ ID NO: 3503072 - DNA, 13 bp, Homo sapiens
attcagacagatg

SEQ ID NO: 3503073 - DNA, 14 bp, Homo sapiens
attcagacagatga

SEQ ID NO: 3503074 - DNA, 19 bp, Homo sapiens
attcagcagcaaattttca

SEQ ID NO: 3503075 - DNA, 18 bp, Homo sapiens
attcaggtgcagaggaag

SEQ ID NO: 3503076 - DNA, 17 bp, Homo sapiens
attcagtgattactgtc

SEQ ID NO: 3503077 - DNA, 19 bp, Homo sapiens
attcagtggcgagaaataa

SEQ ID NO: 3503078 - DNA, 13 bp, Homo sapiens
attcatattgaat

SEQ ID NO: 3503079 - DNA, 12 bp, Homo sapiens
attcatttctaa

SEQ ID NO: 3503080 - DNA, 21 bp, Homo sapiens
attcattttctagatacaata

SEQ ID NO: 3503081 - DNA, 17 bp, Homo sapiens
attccaaaaagcacata

SEQ ID NO: 3503082 - DNA, 15 bp, Homo sapiens
attccagaatgctgt

SEQ ID NO: 3503083 - DNA, 14 bp, Homo sapiens
attccagatcccag

SEQ ID NO: 3503084 - DNA, 20 bp, Homo sapiens
attccagtcaaatctgggct

SEQ ID NO: 3503085 - DNA, 16 bp, Homo sapiens
attccatttccagttc

SEQ ID NO: 3503086 - DNA, 17 bp, Homo sapiens
attcccaagatgcctga

SEQ ID NO: 3503087 - DNA, 18 bp, Homo sapiens
attcccaagatgcctgat

SEQ ID NO: 3503088 - DNA, 16 bp, Homo sapiens
attcccaagctctgct

SEQ ID NO: 3503089 - DNA, 17 bp, Homo sapiens
attcccaagctctgctc

SEQ ID NO: 3503090 - DNA, 13 bp, Homo sapiens
attccccagctcc

SEQ ID NO: 3503091 - DNA, 16 bp, Homo sapiens
attccccatctcaggc

SEQ ID NO: 3503092 - DNA, 18 bp, Homo sapiens
attccccatctcaggcca

SEQ ID NO: 3503093 - DNA, 14 bp, Homo sapiens
attccctcctgcta

SEQ ID NO: 3503094 - DNA, 21 bp, Homo sapiens
attccctcctgctactctgtt

SEQ ID NO: 3503095 - DNA, 14 bp, Homo sapiens
attccgcatcccta

SEQ ID NO: 3503096 - DNA, 18 bp, Homo sapiens
attcctaaagaaaaatat

SEQ ID NO: 3503097 - DNA, 18 bp, Homo sapiens
attcctaacttttcaatg

SEQ ID NO: 3503098 - DNA, 21 bp, Homo sapiens
attcctagaattaaaccagat

SEQ ID NO: 3503099 - DNA, 23 bp, Homo sapiens
attcctaggaggaaaaagaaatg

SEQ ID NO: 3503100 - DNA, 21 bp, Homo sapiens
attcctatacgcagcgtgctt

SEQ ID NO: 3503101 - DNA, 13 bp, Homo sapiens
attcctctgggaa

SEQ ID NO: 3503102 - DNA, 13 bp, Homo sapiens
attcctctttgct

SEQ ID NO: 3503103 - DNA, 17 bp, Homo sapiens
attcctctttgctttgc

SEQ ID NO: 3503104 - DNA, 16 bp, Homo sapiens
attcctgaagaaccag

SEQ ID NO: 3503105 - DNA, 17 bp, Homo sapiens
attcctgggaaatattc

SEQ ID NO: 3503106 - DNA, 15 bp, Homo sapiens
attcctgtccttcac

SEQ ID NO: 3503107 - DNA, 14 bp, Homo sapiens
attccttcctgttc

SEQ ID NO: 3503108 - DNA, 16 bp, Homo sapiens
attccttcctgttctg

SEQ ID NO: 3503109 - DNA, 20 bp, Homo sapiens
attccttcgaaaggccttca

SEQ ID NO: 3503110 - DNA, 22 bp, Homo sapiens
attccttcgaaaggccttcaga

SEQ ID NO: 3503111 - DNA, 21 bp, Homo sapiens
attccttctcccatctcttcc

SEQ ID NO: 3503112 - DNA, 15 bp, Homo sapiens
attctaacctggagg

SEQ ID NO: 3503113 - DNA, 13 bp, Homo sapiens
attctacacagag

SEQ ID NO: 3503114 - DNA, 18 bp, Homo sapiens
attctaggcctcctggcc

SEQ ID NO: 3503115 - DNA, 15 bp, Homo sapiens
attctataaggccat

SEQ ID NO: 3503116 - DNA, 21 bp, Homo sapiens
attctatcttttgtttccttt

SEQ ID NO: 3503117 - DNA, 13 bp, Homo sapiens
attctatgtagtg

SEQ ID NO: 3503118 - DNA, 12 bp, Homo sapiens
attctcacaata

SEQ ID NO: 3503119 - DNA, 13 bp, Homo sapiens
attctcacaatag

SEQ ID NO: 3503120 - DNA, 12 bp, Homo sapiens
attctcactgct

SEQ ID NO: 3503121 - DNA, 13 bp, Homo sapiens
attctcactgcta

SEQ ID NO: 3503122 - DNA, 13 bp, Homo sapiens
attctcaggcacc

SEQ ID NO: 3503123 - DNA, 13 bp, Homo sapiens
attctcatttagt

SEQ ID NO: 3503124 - DNA, 14 bp, Homo sapiens
attctcatttagtg

SEQ ID NO: 3503125 - DNA, 14 bp, Homo sapiens
attctccacagcaa

SEQ ID NO: 3503126 - DNA, 12 bp, Homo sapiens
attctccctggg

SEQ ID NO: 3503127 - DNA, 15 bp, Homo sapiens
attctcctgcctcag

SEQ ID NO: 3503128 - DNA, 16 bp, Homo sapiens
attctccttcagccct

SEQ ID NO: 3503129 - DNA, 17 bp, Homo sapiens
attctccttcagccctc

SEQ ID NO: 3503130 - DNA, 17 bp, Homo sapiens
attctctaataagaaaa

SEQ ID NO: 3503131 - DNA, 14 bp, Homo sapiens
attctctccaaaaa

SEQ ID NO: 3503132 - DNA, 15 bp, Homo sapiens
attctctctcctgta

SEQ ID NO: 3503133 - DNA, 11 bp, Homo sapiens
attctctgagc

SEQ ID NO: 3503134 - DNA, 18 bp, Homo sapiens
attctctgagctgtgcag

SEQ ID NO: 3503135 - DNA, 18 bp, Homo sapiens
attctctgtctcatccat

SEQ ID NO: 3503136 - DNA, 15 bp, Homo sapiens
attctcttgcattgt

SEQ ID NO: 3503137 - DNA, 12 bp, Homo sapiens
attctcttttaa

SEQ ID NO: 3503138 - DNA, 16 bp, Homo sapiens
attctgaaggagcccc

SEQ ID NO: 3503139 - DNA, 17 bp, Homo sapiens
attctgaatttgcaaag

SEQ ID NO: 3503140 - DNA, 18 bp, Homo sapiens
attctgaatttgcaaagt

SEQ ID NO: 3503141 - DNA, 19 bp, Homo sapiens
attctgaatttgcaaagta

SEQ ID NO: 3503142 - DNA, 22 bp, Homo sapiens
attctgaatttgcaaagtactg

SEQ ID NO: 3503143 - DNA, 23 bp, Homo sapiens
attctgaatttgcaaagtactgt

SEQ ID NO: 3503144 - DNA, 12 bp, Homo sapiens
attctgattctt

SEQ ID NO: 3503145 - DNA, 22 bp, Homo sapiens
attctgcaagcacatctgcatt

SEQ ID NO: 3503146 - DNA, 18 bp, Homo sapiens
attctgcagtaaatcttt

SEQ ID NO: 3503147 - DNA, 14 bp, Homo sapiens
attctgccaggccc

SEQ ID NO: 3503148 - DNA, 15 bp, Homo sapiens
attctgcctgcccag

SEQ ID NO: 3503149 - DNA, 22 bp, Homo sapiens
attctgcgtcatgcttgtgtta

SEQ ID NO: 3503150 - DNA, 19 bp, Homo sapiens
attctgctcacatatctgt

SEQ ID NO: 3503151 - DNA, 17 bp, Homo sapiens
attctgctctattatat

SEQ ID NO: 3503152 - DNA, 22 bp, Homo sapiens
attctgcttaaagttgtaacaa

SEQ ID NO: 3503153 - DNA, 15 bp, Homo sapiens
attctggacaggatg

SEQ ID NO: 3503154 - DNA, 16 bp, Homo sapiens
attctggttccagggt

SEQ ID NO: 3503155 - DNA, 14 bp, Homo sapiens
attctgtactctta

SEQ ID NO: 3503156 - DNA, 15 bp, Homo sapiens
attctgtatccttaa

SEQ ID NO: 3503157 - DNA, 19 bp, Homo sapiens
attctgttggccagtgtga

SEQ ID NO: 3503158 - DNA, 21 bp, Homo sapiens
attctgttggccagtgtgaca

SEQ ID NO: 3503159 - DNA, 18 bp, Homo sapiens
attcttaatgttcacata

SEQ ID NO: 3503160 - DNA, 15 bp, Homo sapiens
attcttacatgtttt

SEQ ID NO: 3503161 - DNA, 19 bp, Homo sapiens
attcttctgcttcagcctc

SEQ ID NO: 3503162 - DNA, 13 bp, Homo sapiens
attcttctgtcct

SEQ ID NO: 3503163 - DNA, 21 bp, Homo sapiens
attcttgatttatttgcttct

SEQ ID NO: 3503164 - DNA, 17 bp, Homo sapiens
attcttggttgaggaaa

SEQ ID NO: 3503165 - DNA, 12 bp, Homo sapiens
attcttgtgctt

SEQ ID NO: 3503166 - DNA, 17 bp, Homo sapiens
attctttcgaaagaaga

SEQ ID NO: 3503167 - DNA, 18 bp, Homo sapiens
atttaattagtgctaagt

SEQ ID NO: 3503168 - DNA, 20 bp, Homo sapiens
atttaattagtgctaagtgt

SEQ ID NO: 3503169 - DNA, 22 bp, Homo sapiens
atttaattagtgctaagtgtga

SEQ ID NO: 3503170 - DNA, 23 bp, Homo sapiens
atttaattagtgctaagtgtgaa

SEQ ID NO: 3503171 - DNA, 15 bp, Homo sapiens
atttaattcatgttt

SEQ ID NO: 3503172 - DNA, 20 bp, Homo sapiens
atttaatttagatattttcc

SEQ ID NO: 3503173 - DNA, 21 bp, Homo sapiens
atttaatttagatattttcca

SEQ ID NO: 3503174 - DNA, 22 bp, Homo sapiens
atttaatttagatattttccat

SEQ ID NO: 3503175 - DNA, 19 bp, Homo sapiens
atttaatttttttgagaca

SEQ ID NO: 3503176 - DNA, 15 bp, Homo sapiens
atttacaaagtgtgt

SEQ ID NO: 3503177 - DNA, 19 bp, Homo sapiens
atttacccaactctgtaca

SEQ ID NO: 3503178 - DNA, 15 bp, Homo sapiens
atttacgctttgatt

SEQ ID NO: 3503179 - DNA, 18 bp, Homo sapiens
atttagaaactaattgac

SEQ ID NO: 3503180 - DNA, 22 bp, Homo sapiens
atttagaaactaattgacttta

SEQ ID NO: 3503181 - DNA, 22 bp, Homo sapiens
atttagaaagaagcccaatatt

SEQ ID NO: 3503182 - DNA, 12 bp, Homo sapiens
atttagatattt

SEQ ID NO: 3503183 - DNA, 18 bp, Homo sapiens
atttagatattttccata

SEQ ID NO: 3503184 - DNA, 19 bp, Homo sapiens
atttagatattttccatat

SEQ ID NO: 3503185 - DNA, 14 bp, Homo sapiens
atttagattgtaaa

SEQ ID NO: 3503186 - DNA, 15 bp, Homo sapiens
atttagattgtaaac

SEQ ID NO: 3503187 - DNA, 16 bp, Homo sapiens
atttagccctcacatt

SEQ ID NO: 3503188 - DNA, 19 bp, Homo sapiens
atttagctgtattcatata

SEQ ID NO: 3503189 - DNA, 21 bp, Homo sapiens
atttagctgtattcatatatt

SEQ ID NO: 3503190 - DNA, 14 bp, Homo sapiens
atttaggagaagcc

SEQ ID NO: 3503191 - DNA, 14 bp, Homo sapiens
atttagtaaatgtt

SEQ ID NO: 3503192 - DNA, 15 bp, Homo sapiens
atttagtaaatgtta

SEQ ID NO: 3503193 - DNA, 16 bp, Homo sapiens
atttagtctaacacag

SEQ ID NO: 3503194 - DNA, 15 bp, Homo sapiens
atttataaaacttct

SEQ ID NO: 3503195 - DNA, 15 bp, Homo sapiens
atttataaacagaca

SEQ ID NO: 3503196 - DNA, 21 bp, Homo sapiens
atttatagtaatgagtttaaa

SEQ ID NO: 3503197 - DNA, 19 bp, Homo sapiens
atttatatatctaagttca

SEQ ID NO: 3503198 - DNA, 11 bp, Homo sapiens
atttatatgaa

SEQ ID NO: 3503199 - DNA, 22 bp, Homo sapiens
atttatgtttgcacttgtgatt

SEQ ID NO: 3503200 - DNA, 12 bp, Homo sapiens
atttattaaata

SEQ ID NO: 3503201 - DNA, 11 bp, Homo sapiens
atttattattt

SEQ ID NO: 3503202 - DNA, 13 bp, Homo sapiens
atttattatttat

SEQ ID NO: 3503203 - DNA, 16 bp, Homo sapiens
atttattcaataaagt

SEQ ID NO: 3503204 - DNA, 19 bp, Homo sapiens
atttattcaattcctctgg

SEQ ID NO: 3503205 - DNA, 16 bp, Homo sapiens
atttattgcacattgt

SEQ ID NO: 3503206 - DNA, 22 bp, Homo sapiens
atttattgcagaggatgttcat

SEQ ID NO: 3503207 - DNA, 16 bp, Homo sapiens
atttattgtttatgta

SEQ ID NO: 3503208 - DNA, 21 bp, Homo sapiens
atttattgtttatgtaaatgt

SEQ ID NO: 3503209 - DNA, 14 bp, Homo sapiens
atttatttatttaa

SEQ ID NO: 3503210 - DNA, 23 bp, Homo sapiens
atttatttcctagttctgtagaa

SEQ ID NO: 3503211 - DNA, 15 bp, Homo sapiens
atttatttgcttctt

SEQ ID NO: 3503212 - DNA, 16 bp, Homo sapiens
atttattttataagaa

SEQ ID NO: 3503213 - DNA, 20 bp, Homo sapiens
atttattttataagaaaaac

SEQ ID NO: 3503214 - DNA, 15 bp, Homo sapiens
atttattttgagaag

SEQ ID NO: 3503215 - DNA, 14 bp, Homo sapiens
atttattttttaca

SEQ ID NO: 3503216 - DNA, 18 bp, Homo sapiens
atttattttttacattat

SEQ ID NO: 3503217 - DNA, 19 bp, Homo sapiens
atttattttttacattatt

SEQ ID NO: 3503218 - DNA, 14 bp, Homo sapiens
atttcaaaactcat

SEQ ID NO: 3503219 - DNA, 14 bp, Homo sapiens
atttcaaaatgctt

SEQ ID NO: 3503220 - DNA, 21 bp, Homo sapiens
atttcaaaatgctttttatta

SEQ ID NO: 3503221 - DNA, 12 bp, Homo sapiens
atttcaaatctc

SEQ ID NO: 3503222 - DNA, 17 bp, Homo sapiens
atttcaattcctggccc

SEQ ID NO: 3503223 - DNA, 10 bp, Homo sapiens
atttcacaag

SEQ ID NO: 3503224 - DNA, 22 bp, Homo sapiens
atttcacattaatatttgctga

SEQ ID NO: 3503225 - DNA, 23 bp, Homo sapiens
atttcagactcccattcctgaag

SEQ ID NO: 3503226 - DNA, 17 bp, Homo sapiens
atttcagaggctgcagg

SEQ ID NO: 3503227 - DNA, 15 bp, Homo sapiens
atttcagatgtaatg

SEQ ID NO: 3503228 - DNA, 17 bp, Homo sapiens
atttcagatgtaatgtt

SEQ ID NO: 3503229 - DNA, 18 bp, Homo sapiens
atttcagatgtaatgttt

SEQ ID NO: 3503230 - DNA, 16 bp, Homo sapiens
atttcagcagctgcag

SEQ ID NO: 3503231 - DNA, 20 bp, Homo sapiens
atttcaggttttgtaaagat

SEQ ID NO: 3503232 - DNA, 21 bp, Homo sapiens
atttcagtgttacctgtgtgc

SEQ ID NO: 3503233 - DNA, 15 bp, Homo sapiens
atttcatattctttc

SEQ ID NO: 3503234 - DNA, 14 bp, Homo sapiens
atttcatctgctct

SEQ ID NO: 3503235 - DNA, 17 bp, Homo sapiens
atttcatctgctctcct

SEQ ID NO: 3503236 - DNA, 18 bp, Homo sapiens
atttcatctgctctcctt

SEQ ID NO: 3503237 - DNA, 14 bp, Homo sapiens
atttcattggttaa

SEQ ID NO: 3503238 - DNA, 14 bp, Homo sapiens
atttccagccaggg

SEQ ID NO: 3503239 - DNA, 17 bp, Homo sapiens
atttccagccagggctg

SEQ ID NO: 3503240 - DNA, 12 bp, Homo sapiens
atttccatattt

SEQ ID NO: 3503241 - DNA, 13 bp, Homo sapiens
atttcccaggacc

SEQ ID NO: 3503242 - DNA, 14 bp, Homo sapiens
atttcccaggaccc

SEQ ID NO: 3503243 - DNA, 15 bp, Homo sapiens
atttcctagttctgt

SEQ ID NO: 3503244 - DNA, 13 bp, Homo sapiens
atttcctgctgaa

SEQ ID NO: 3503245 - DNA, 14 bp, Homo sapiens
atttccttgaatgt

SEQ ID NO: 3503246 - DNA, 20 bp, Homo sapiens
atttcctttattattctgta

SEQ ID NO: 3503247 - DNA, 15 bp, Homo sapiens
atttctaaataaaag

SEQ ID NO: 3503248 - DNA, 17 bp, Homo sapiens
atttctaggcaaaattg

SEQ ID NO: 3503249 - DNA, 12 bp, Homo sapiens
atttctatttat

SEQ ID NO: 3503250 - DNA, 20 bp, Homo sapiens
atttctatttctcctccatg

SEQ ID NO: 3503251 - DNA, 18 bp, Homo sapiens
atttctcagactttggaa

SEQ ID NO: 3503252 - DNA, 22 bp, Homo sapiens
atttctgcatatgttgaatact

SEQ ID NO: 3503253 - DNA, 23 bp, Homo sapiens
atttctgcatatgttgaatactt

SEQ ID NO: 3503254 - DNA, 11 bp, Homo sapiens
atttctgtgcc

SEQ ID NO: 3503255 - DNA, 17 bp, Homo sapiens
atttcttcgttcttttt

SEQ ID NO: 3503256 - DNA, 15 bp, Homo sapiens
atttcttcttcacat

SEQ ID NO: 3503257 - DNA, 21 bp, Homo sapiens
atttctttgctgtaagatgtc

SEQ ID NO: 3503258 - DNA, 19 bp, Homo sapiens
atttctttgtgctttggct

SEQ ID NO: 3503259 - DNA, 16 bp, Homo sapiens
atttgaagaacatgtg

SEQ ID NO: 3503260 - DNA, 15 bp, Homo sapiens
atttgactaatttta

SEQ ID NO: 3503261 - DNA, 18 bp, Homo sapiens
atttgactttaatttatg

SEQ ID NO: 3503262 - DNA, 15 bp, Homo sapiens
atttgagcagggctc

SEQ ID NO: 3503263 - DNA, 17 bp, Homo sapiens
atttgagcagggctcag

SEQ ID NO: 3503264 - DNA, 15 bp, Homo sapiens
atttgattaggtatg

SEQ ID NO: 3503265 - DNA, 11 bp, Homo sapiens
atttgcaaagt

SEQ ID NO: 3503266 - DNA, 18 bp, Homo sapiens
atttgcaaagtactgtaa

SEQ ID NO: 3503267 - DNA, 15 bp, Homo sapiens
atttgcaccagtttt

SEQ ID NO: 3503268 - DNA, 21 bp, Homo sapiens
atttgcataacaattcctcta

SEQ ID NO: 3503269 - DNA, 22 bp, Homo sapiens
atttgcataacaattcctctac

SEQ ID NO: 3503270 - DNA, 14 bp, Homo sapiens
atttgctgccaaat

SEQ ID NO: 3503271 - DNA, 15 bp, Homo sapiens
atttgctgccaaatg

SEQ ID NO: 3503272 - DNA, 19 bp, Homo sapiens
atttgctgccaaatgcgta

SEQ ID NO: 3503273 - DNA, 14 bp, Homo sapiens
atttggaatacttt

SEQ ID NO: 3503274 - DNA, 19 bp, Homo sapiens
atttggcaatgccatcatc

SEQ ID NO: 3503275 - DNA, 18 bp, Homo sapiens
atttgggaagtgaagact

SEQ ID NO: 3503276 - DNA, 23 bp, Homo sapiens
atttgggcctgctccagacctga

SEQ ID NO: 3503277 - DNA, 12 bp, Homo sapiens
atttggggtgga

SEQ ID NO: 3503278 - DNA, 20 bp, Homo sapiens
atttggtttggccatctctg

SEQ ID NO: 3503279 - DNA, 13 bp, Homo sapiens
atttgtaaagttg

SEQ ID NO: 3503280 - DNA, 19 bp, Homo sapiens
atttgtacatatgtaaaat

SEQ ID NO: 3503281 - DNA, 21 bp, Homo sapiens
atttgtacatatgtaaaataa

SEQ ID NO: 3503282 - DNA, 14 bp, Homo sapiens
atttgtctttttgt

SEQ ID NO: 3503283 - DNA, 17 bp, Homo sapiens
atttgtgatagcacttt

SEQ ID NO: 3503284 - DNA, 20 bp, Homo sapiens
atttgtgctagaaattttca

SEQ ID NO: 3503285 - DNA, 14 bp, Homo sapiens
atttgtgtatttaa

SEQ ID NO: 3503286 - DNA, 15 bp, Homo sapiens
atttgtgttgaagga

SEQ ID NO: 3503287 - DNA, 19 bp, Homo sapiens
atttgtgttgaaggaactt

SEQ ID NO: 3503288 - DNA, 22 bp, Homo sapiens
atttgttaaaatacagttctgt

SEQ ID NO: 3503289 - DNA, 12 bp, Homo sapiens
atttgttcaagt

SEQ ID NO: 3503290 - DNA, 16 bp, Homo sapiens
attttaaaaacataga

SEQ ID NO: 3503291 - DNA, 14 bp, Homo sapiens
attttaactctgtc

SEQ ID NO: 3503292 - DNA, 21 bp, Homo sapiens
attttaagacgtgtttgtgtt

SEQ ID NO: 3503293 - DNA, 16 bp, Homo sapiens
attttaagtattgcat

SEQ ID NO: 3503294 - DNA, 22 bp, Homo sapiens
attttaagtattgcatctgtat

SEQ ID NO: 3503295 - DNA, 15 bp, Homo sapiens
attttaagtccctgt

SEQ ID NO: 3503296 - DNA, 20 bp, Homo sapiens
attttaagtccctgtcacct

SEQ ID NO: 3503297 - DNA, 22 bp, Homo sapiens
attttaagtccctgtcacctct

SEQ ID NO: 3503298 - DNA, 18 bp, Homo sapiens
attttaatcaagttgaat

SEQ ID NO: 3503299 - DNA, 12 bp, Homo sapiens
attttaattcat

SEQ ID NO: 3503300 - DNA, 20 bp, Homo sapiens
caaccctggggaaggagcca

SEQ ID NO: 3503301 - DNA, 22 bp, Homo sapiens
caaccctggggaaggagccagt

SEQ ID NO: 3503302 - DNA, 23 bp, Homo sapiens
caaccctggggaaggagccagtt

SEQ ID NO: 3503303 - DNA, 20 bp, Homo sapiens
caacccttctcctcttgtaa

SEQ ID NO: 3503304 - DNA, 15 bp, Homo sapiens
caacctaagcaacag

SEQ ID NO: 3503305 - DNA, 14 bp, Homo sapiens
caacctcctgggct

SEQ ID NO: 3503306 - DNA, 17 bp, Homo sapiens
caacctctgcttcccag

SEQ ID NO: 3503307 - DNA, 16 bp, Homo sapiens
caacctcttctggctc

SEQ ID NO: 3503308 - DNA, 12 bp, Homo sapiens
caacctgaacct

SEQ ID NO: 3503309 - DNA, 16 bp, Homo sapiens
caacctgaacctagga

SEQ ID NO: 3503310 - DNA, 13 bp, Homo sapiens
caaccttggcctt

SEQ ID NO: 3503311 - DNA, 18 bp, Homo sapiens
caacgtgcaaagccaagg

SEQ ID NO: 3503312 - DNA, 13 bp, Homo sapiens
caacgtgcattgt

SEQ ID NO: 3503313 - DNA, 20 bp, Homo sapiens
caactacccaaaacaagcct

SEQ ID NO: 3503314 - DNA, 20 bp, Homo sapiens
caactacccccagctgtgct

SEQ ID NO: 3503315 - DNA, 19 bp, Homo sapiens
caactagatcaaggagccc

SEQ ID NO: 3503316 - DNA, 18 bp, Homo sapiens
caactatattatcatgca

SEQ ID NO: 3503317 - DNA, 14 bp, Homo sapiens
caactattttcaga

SEQ ID NO: 3503318 - DNA, 17 bp, Homo sapiens
caactattttcagatgt

SEQ ID NO: 3503319 - DNA, 13 bp, Homo sapiens
caactcctcccat

SEQ ID NO: 3503320 - DNA, 12 bp, Homo sapiens
caactcttgatt

SEQ ID NO: 3503321 - DNA, 22 bp, Homo sapiens
caactgaaggctaaaaagcaac

SEQ ID NO: 3503322 - DNA, 21 bp, Homo sapiens
caactgcctaaggccctttgt

SEQ ID NO: 3503323 - DNA, 12 bp, Homo sapiens
caactggcaggc

SEQ ID NO: 3503324 - DNA, 19 bp, Homo sapiens
caactgttttgatactgaa

SEQ ID NO: 3503325 - DNA, 19 bp, Homo sapiens
caacttctacttctgccct

SEQ ID NO: 3503326 - DNA, 14 bp, Homo sapiens
caacttcttcagag

SEQ ID NO: 3503327 - DNA, 18 bp, Homo sapiens
caacttcttcagagctga

SEQ ID NO: 3503328 - DNA, 16 bp, Homo sapiens
caacttggctgcagga

SEQ ID NO: 3503329 - DNA, 14 bp, Homo sapiens
caactttgaataaa

SEQ ID NO: 3503330 - DNA, 17 bp, Homo sapiens
caactttgaataaagaa

SEQ ID NO: 3503331 - DNA, 20 bp, Homo sapiens
caagaactcatcactgtggc

SEQ ID NO: 3503332 - DNA, 12 bp, Homo sapiens
caagaagggctg

SEQ ID NO: 3503333 - DNA, 13 bp, Homo sapiens
caagaagggctgc

SEQ ID NO: 3503334 - DNA, 19 bp, Homo sapiens
caagaagggctgcatgatg

SEQ ID NO: 3503335 - DNA, 19 bp, Homo sapiens
caagaatagcatctgtaca

SEQ ID NO: 3503336 - DNA, 23 bp, Homo sapiens
caagaattgttacctgtcatttt

SEQ ID NO: 3503337 - DNA, 13 bp, Homo sapiens
caagacacagcag

SEQ ID NO: 3503338 - DNA, 15 bp, Homo sapiens
caagacacagcaggg

SEQ ID NO: 3503339 - DNA, 14 bp, Homo sapiens
caagacccccagca

SEQ ID NO: 3503340 - DNA, 16 bp, Homo sapiens
caagacccccagcact

SEQ ID NO: 3503341 - DNA, 16 bp, Homo sapiens
caagacctcacacaca

SEQ ID NO: 3503342 - DNA, 16 bp, Homo sapiens
caagacctcagggcac

SEQ ID NO: 3503343 - DNA, 24 bp, Homo sapiens
caagacctcagggcacaaagatgg

SEQ ID NO: 3503344 - DNA, 15 bp, Homo sapiens
caagactctgtctca

SEQ ID NO: 3503345 - DNA, 22 bp, Homo sapiens
caagactggaaggtggggacag

SEQ ID NO: 3503346 - DNA, 15 bp, Homo sapiens
caagagaacatttta

SEQ ID NO: 3503347 - DNA, 22 bp, Homo sapiens
caagagaattgcttgaacccag

SEQ ID NO: 3503348 - DNA, 14 bp, Homo sapiens
caagagcacacttg

SEQ ID NO: 3503349 - DNA, 20 bp, Homo sapiens
caagaggaagttcagatctt

SEQ ID NO: 3503350 - DNA, 21 bp, Homo sapiens
caagagggaatagtatagaca

SEQ ID NO: 3503351 - DNA, 17 bp, Homo sapiens
caagagggctgcttccc

SEQ ID NO: 3503352 - DNA, 20 bp, Homo sapiens
caagagtctaatagtctttg

SEQ ID NO: 3503353 - DNA, 23 bp, Homo sapiens
caagatattttaaaatctgtcac

SEQ ID NO: 3503354 - DNA, 14 bp, Homo sapiens
caagatgacagctc

SEQ ID NO: 3503355 - DNA, 20 bp, Homo sapiens
caagatgccccagggatggg

SEQ ID NO: 3503356 - DNA, 13 bp, Homo sapiens
caagatgcctgat

SEQ ID NO: 3503357 - DNA, 15 bp, Homo sapiens
caagatgcctgatca

SEQ ID NO: 3503358 - DNA, 16 bp, Homo sapiens
caagatgcctgatcag

SEQ ID NO: 3503359 - DNA, 20 bp, Homo sapiens
caagatgggggcagggctgt

SEQ ID NO: 3503360 - DNA, 14 bp, Homo sapiens
caagcaaacccaga

SEQ ID NO: 3503361 - DNA, 22 bp, Homo sapiens
caagcaacagcctttgaatgta

SEQ ID NO: 3503362 - DNA, 14 bp, Homo sapiens
caagcaagactgag

SEQ ID NO: 3503363 - DNA, 14 bp, Homo sapiens
caagcacagcagcc

SEQ ID NO: 3503364 - DNA, 17 bp, Homo sapiens
caagcacatctgcattt

SEQ ID NO: 3503365 - DNA, 16 bp, Homo sapiens
caagcacctcctgcct

SEQ ID NO: 3503366 - DNA, 13 bp, Homo sapiens
caagcactgtgct

SEQ ID NO: 3503367 - DNA, 17 bp, Homo sapiens
caagcactgtgctcagg

SEQ ID NO: 3503368 - DNA, 14 bp, Homo sapiens
caagcagccaagct

SEQ ID NO: 3503369 - DNA, 22 bp, Homo sapiens
caagcagccaagctccttggga

SEQ ID NO: 3503370 - DNA, 12 bp, Homo sapiens
caagcaggaagc

SEQ ID NO: 3503371 - DNA, 21 bp, Homo sapiens
caagcatcttgggggggtggc

SEQ ID NO: 3503372 - DNA, 18 bp, Homo sapiens
caagcatgggggacccct

SEQ ID NO: 3503373 - DNA, 19 bp, Homo sapiens
caagcatgggggacccctt

SEQ ID NO: 3503374 - DNA, 23 bp, Homo sapiens
caagcatgggggaccccttccca

SEQ ID NO: 3503375 - DNA, 13 bp, Homo sapiens
caagcatgtaact

SEQ ID NO: 3503376 - DNA, 14 bp, Homo sapiens
caagccaagcagcc

SEQ ID NO: 3503377 - DNA, 22 bp, Homo sapiens
caagccaagggaacctgtgtcc

SEQ ID NO: 3503378 - DNA, 13 bp, Homo sapiens
caagccagaactt

SEQ ID NO: 3503379 - DNA, 13 bp, Homo sapiens
caagccagaggct

SEQ ID NO: 3503380 - DNA, 15 bp, Homo sapiens
caagccagaggctgg

SEQ ID NO: 3503381 - DNA, 16 bp, Homo sapiens
caagccagaggctggg

SEQ ID NO: 3503382 - DNA, 22 bp, Homo sapiens
caagccagcgggaatggcagct

SEQ ID NO: 3503383 - DNA, 11 bp, Homo sapiens
caagccagctg

SEQ ID NO: 3503384 - DNA, 16 bp, Homo sapiens
caagccagctgcctag

SEQ ID NO: 3503385 - DNA, 16 bp, Homo sapiens
caagcccccccttcca

SEQ ID NO: 3503386 - DNA, 17 bp, Homo sapiens
caagcccccccttccac

SEQ ID NO: 3503387 - DNA, 14 bp, Homo sapiens
caagcctagcctga

SEQ ID NO: 3503388 - DNA, 21 bp, Homo sapiens
caagcctgaccacgctttcta

SEQ ID NO: 3503389 - DNA, 19 bp, Homo sapiens
caagcctgtgcaaaaaaat

SEQ ID NO: 3503390 - DNA, 16 bp, Homo sapiens
caagcgattctcctgc

SEQ ID NO: 3503391 - DNA, 15 bp, Homo sapiens
caagcgattcttctg

SEQ ID NO: 3503392 - DNA, 18 bp, Homo sapiens
caagcgtgagccactgca

SEQ ID NO: 3503393 - DNA, 16 bp, Homo sapiens
caagctatcctggctc

SEQ ID NO: 3503394 - DNA, 18 bp, Homo sapiens
caagctcaggaccaggca

SEQ ID NO: 3503395 - DNA, 19 bp, Homo sapiens
caagctccaagccccatct

SEQ ID NO: 3503396 - DNA, 16 bp, Homo sapiens
caagctccgcaggact

SEQ ID NO: 3503397 - DNA, 22 bp, Homo sapiens
caagctcctcctccctgcatct

SEQ ID NO: 3503398 - DNA, 17 bp, Homo sapiens
caagctccttgggaggc

SEQ ID NO: 3503399 - DNA, 16 bp, Homo sapiens
caagctctgctcctct

SEQ ID NO: 3503400 - DNA, 18 bp, Homo sapiens
caagctgcaccctcaggc

SEQ ID NO: 3503401 - DNA, 20 bp, Homo sapiens
caagctgcaccctcaggcag

SEQ ID NO: 3503402 - DNA, 22 bp, Homo sapiens
caagctgcaccctcaggcaggt

SEQ ID NO: 3503403 - DNA, 21 bp, Homo sapiens
caagctgctctgagccacagt

SEQ ID NO: 3503404 - DNA, 12 bp, Homo sapiens
caagctggctgg

SEQ ID NO: 3503405 - DNA, 17 bp, Homo sapiens
caagctggtcccactca

SEQ ID NO: 3503406 - DNA, 22 bp, Homo sapiens
caagctggtcccactcagtcca

SEQ ID NO: 3503407 - DNA, 20 bp, Homo sapiens
caagcttcaaccctcagcct

SEQ ID NO: 3503408 - DNA, 19 bp, Homo sapiens
caagcttccctccatcccc

SEQ ID NO: 3503409 - DNA, 20 bp, Homo sapiens
caagctttcaaacatgttga

SEQ ID NO: 3503410 - DNA, 14 bp, Homo sapiens
caaggaaaccacag

SEQ ID NO: 3503411 - DNA, 13 bp, Homo sapiens
caaggagaggagg

SEQ ID NO: 3503412 - DNA, 17 bp, Homo sapiens
caaggatagatgctggc

SEQ ID NO: 3503413 - DNA, 20 bp, Homo sapiens
caaggatagatgctggccca

SEQ ID NO: 3503414 - DNA, 13 bp, Homo sapiens
caaggatgttttt

SEQ ID NO: 3503415 - DNA, 21 bp, Homo sapiens
caaggccagcacccaaagggt

SEQ ID NO: 3503416 - DNA, 18 bp, Homo sapiens
caaggcctaggacctatg

SEQ ID NO: 3503417 - DNA, 22 bp, Homo sapiens
caaggccttcagtttatttcca

SEQ ID NO: 3503418 - DNA, 18 bp, Homo sapiens
caaggccttgcctggcct

SEQ ID NO: 3503419 - DNA, 13 bp, Homo sapiens
caaggcggtgctt

SEQ ID NO: 3503420 - DNA, 15 bp, Homo sapiens
caaggctgcagtgag

SEQ ID NO: 3503421 - DNA, 18 bp, Homo sapiens
caaggctgggggaagaag

SEQ ID NO: 3503422 - DNA, 15 bp, Homo sapiens
caagggaaaagtctc

SEQ ID NO: 3503423 - DNA, 21 bp, Homo sapiens
caagggcagaatgaatctatg

SEQ ID NO: 3503424 - DNA, 23 bp, Homo sapiens
caaggggaatgtttgcctctgcc

SEQ ID NO: 3503425 - DNA, 13 bp, Homo sapiens
caagggtctcctt

SEQ ID NO: 3503426 - DNA, 22 bp, Homo sapiens
caaggtaatttcttgtgcctct

SEQ ID NO: 3503427 - DNA, 20 bp, Homo sapiens
caaggtcctctgtcagtcac

SEQ ID NO: 3503428 - DNA, 22 bp, Homo sapiens
caaggtcctctgtcagtcacag

SEQ ID NO: 3503429 - DNA, 17 bp, Homo sapiens
caaggtgaaatgaagca

SEQ ID NO: 3503430 - DNA, 17 bp, Homo sapiens
caaggtgtcatttatgt

SEQ ID NO: 3503431 - DNA, 17 bp, Homo sapiens
caaggttatatgaatat

SEQ ID NO: 3503432 - DNA, 14 bp, Homo sapiens
cacacagctctgtc

SEQ ID NO: 3503433 - DNA, 18 bp, Homo sapiens
cacacagtgagtcgagga

SEQ ID NO: 3503434 - DNA, 16 bp, Homo sapiens
cacaccacatctaagc

SEQ ID NO: 3503435 - DNA, 13 bp, Homo sapiens
cacaccagagccc

SEQ ID NO: 3503436 - DNA, 21 bp, Homo sapiens
cacaccaggcttgcctgcagg

SEQ ID NO: 3503437 - DNA, 14 bp, Homo sapiens
cacacccagcccac

SEQ ID NO: 3503438 - DNA, 20 bp, Homo sapiens
cacacggctcccccaggcct

SEQ ID NO: 3503439 - DNA, 15 bp, Homo sapiens
cacactccatcagct

SEQ ID NO: 3503440 - DNA, 14 bp, Homo sapiens
cacactcccaaggt

SEQ ID NO: 3503441 - DNA, 13 bp, Homo sapiens
cacactgaggcag

SEQ ID NO: 3503442 - DNA, 15 bp, Homo sapiens
cacactgaggcaggg

SEQ ID NO: 3503443 - DNA, 14 bp, Homo sapiens
cacactgatgctta

SEQ ID NO: 3503444 - DNA, 13 bp, Homo sapiens
cacactggactcc

SEQ ID NO: 3503445 - DNA, 19 bp, Homo sapiens
cacactggactccggccct

SEQ ID NO: 3503446 - DNA, 15 bp, Homo sapiens
cacactgtaaatatg

SEQ ID NO: 3503447 - DNA, 22 bp, Homo sapiens
cacactgtcatgcttcatcatt

SEQ ID NO: 3503448 - DNA, 13 bp, Homo sapiens
cacagaaatgctg

SEQ ID NO: 3503449 - DNA, 17 bp, Homo sapiens
cacagaaatgctgctgg

SEQ ID NO: 3503450 - DNA, 16 bp, Homo sapiens
cacagaagcacatgca

SEQ ID NO: 3503451 - DNA, 12 bp, Homo sapiens
cacagagaaagt

SEQ ID NO: 3503452 - DNA, 11 bp, Homo sapiens
cacagagaagg

SEQ ID NO: 3503453 - DNA, 23 bp, Homo sapiens
cacagagacccccggaacaagcc

SEQ ID NO: 3503454 - DNA, 13 bp, Homo sapiens
cacagatgctcca

SEQ ID NO: 3503455 - DNA, 16 bp, Homo sapiens
cacagcaacattttct

SEQ ID NO: 3503456 - DNA, 12 bp, Homo sapiens
cacagcaggatc

SEQ ID NO: 3503457 - DNA, 13 bp, Homo sapiens
cacagccacccct

SEQ ID NO: 3503458 - DNA, 22 bp, Homo sapiens
cacagccagggggatgccactc

SEQ ID NO: 3503459 - DNA, 20 bp, Homo sapiens
cacagccgattcacctgagc

SEQ ID NO: 3503460 - DNA, 14 bp, Homo sapiens
cacagcctcccctg

SEQ ID NO: 3503461 - DNA, 19 bp, Homo sapiens
cacagcctcccctgccagg

SEQ ID NO: 3503462 - DNA, 23 bp, Homo sapiens
cacagcctcccctgccagggcag

SEQ ID NO: 3503463 - DNA, 21 bp, Homo sapiens
cacagcggagtctgtcctgtg

SEQ ID NO: 3503464 - DNA, 20 bp, Homo sapiens
cacagctaacaattgtgaag

SEQ ID NO: 3503465 - DNA, 16 bp, Homo sapiens
cacagctctgtcctgg

SEQ ID NO: 3503466 - DNA, 20 bp, Homo sapiens
cacagctctgtcctgggagt

SEQ ID NO: 3503467 - DNA, 23 bp, Homo sapiens
cacagctctgtcctgggagtgag

SEQ ID NO: 3503468 - DNA, 14 bp, Homo sapiens
cacagctcttctcc

SEQ ID NO: 3503469 - DNA, 15 bp, Homo sapiens
cacagctcttctcca

SEQ ID NO: 3503470 - DNA, 14 bp, Homo sapiens
cacagctgtagtgg

SEQ ID NO: 3503471 - DNA, 21 bp, Homo sapiens
cacagcttcatttcctgtgtc

SEQ ID NO: 3503472 - DNA, 15 bp, Homo sapiens
cacagcttcccctct

SEQ ID NO: 3503473 - DNA, 16 bp, Homo sapiens
cacagcttcccctctc

SEQ ID NO: 3503474 - DNA, 11 bp, Homo sapiens
cacagcttcct

SEQ ID NO: 3503475 - DNA, 15 bp, Homo sapiens
cacagcttcctgtcc

SEQ ID NO: 3503476 - DNA, 20 bp, Homo sapiens
cacagcttgacctgaggctg

SEQ ID NO: 3503477 - DNA, 15 bp, Homo sapiens
cacagcttttccaaa

SEQ ID NO: 3503478 - DNA, 17 bp, Homo sapiens
cacaggacacagtcaga

SEQ ID NO: 3503479 - DNA, 19 bp, Homo sapiens
cacaggacacagtcagatt

SEQ ID NO: 3503480 - DNA, 23 bp, Homo sapiens
cacaggacatgcggtagccagca

SEQ ID NO: 3503481 - DNA, 12 bp, Homo sapiens
cacaggatcagt

SEQ ID NO: 3503482 - DNA, 15 bp, Homo sapiens
cacaggatcagtctg

SEQ ID NO: 3503483 - DNA, 10 bp, Homo sapiens
cacaggcagg

SEQ ID NO: 3503484 - DNA, 14 bp, Homo sapiens
cacaggcaggtcca

SEQ ID NO: 3503485 - DNA, 19 bp, Homo sapiens
cacaggccccccgcagcac

SEQ ID NO: 3503486 - DNA, 17 bp, Homo sapiens
cacaggcccggctccag

SEQ ID NO: 3503487 - DNA, 20 bp, Homo sapiens
cacaggcccggctccaggct

SEQ ID NO: 3503488 - DNA, 23 bp, Homo sapiens
cacaggcccggctccaggctcct

SEQ ID NO: 3503489 - DNA, 13 bp, Homo sapiens
cacaggccctccc

SEQ ID NO: 3503490 - DNA, 20 bp, Homo sapiens
cacagggattctcacaatag

SEQ ID NO: 3503491 - DNA, 13 bp, Homo sapiens
cacagggtctgcc

SEQ ID NO: 3503492 - DNA, 18 bp, Homo sapiens
cacaggtacagcaacagg

SEQ ID NO: 3503493 - DNA, 21 bp, Homo sapiens
cacaggtacagcaacaggaat

SEQ ID NO: 3503494 - DNA, 18 bp, Homo sapiens
cacaggtctttcctaagg

SEQ ID NO: 3503495 - DNA, 13 bp, Homo sapiens
cacaggtgtcagc

SEQ ID NO: 3503496 - DNA, 17 bp, Homo sapiens
cacaggtgtcagccatt

SEQ ID NO: 3503497 - DNA, 20 bp, Homo sapiens
cacaggttcacgtgcagctc

SEQ ID NO: 3503498 - DNA, 13 bp, Homo sapiens
cacagtaaatatc

SEQ ID NO: 3503499 - DNA, 18 bp, Homo sapiens
cacagtattacttctgct

SEQ ID NO: 3503500 - DNA, 21 bp, Homo sapiens
cacagtattacttctgctaca

SEQ ID NO: 3503501 - DNA, 16 bp, Homo sapiens
cacagtcctgaagcag

SEQ ID NO: 3503502 - DNA, 17 bp, Homo sapiens
cacagtgaaggctgtcc

SEQ ID NO: 3503503 - DNA, 22 bp, Homo sapiens
cacagtgaaggctgtccttacc

SEQ ID NO: 3503504 - DNA, 18 bp, Homo sapiens
cacagtgagtcgaggaca

SEQ ID NO: 3503505 - DNA, 17 bp, Homo sapiens
cacagttcaattctcat

SEQ ID NO: 3503506 - DNA, 18 bp, Homo sapiens
cacagttgctctatgctt

SEQ ID NO: 3503507 - DNA, 22 bp, Homo sapiens
cacataataaacgatgttgtga

SEQ ID NO: 3503508 - DNA, 17 bp, Homo sapiens
cacatacacacacacgc

SEQ ID NO: 3503509 - DNA, 22 bp, Homo sapiens
cacataccctcttcatggatgg

SEQ ID NO: 3503510 - DNA, 22 bp, Homo sapiens
cacatataagttgagaaggtgc

SEQ ID NO: 3503511 - DNA, 12 bp, Homo sapiens
cacatatctgtc

SEQ ID NO: 3503512 - DNA, 13 bp, Homo sapiens
cacatatgagggg

SEQ ID NO: 3503513 - DNA, 21 bp, Homo sapiens
cacatattagtgcagccaagt

SEQ ID NO: 3503514 - DNA, 13 bp, Homo sapiens
cacatcaaagagg

SEQ ID NO: 3503515 - DNA, 13 bp, Homo sapiens
cacatctgcattt

SEQ ID NO: 3503516 - DNA, 21 bp, Homo sapiens
cacatctgtggagatgcccag

SEQ ID NO: 3503517 - DNA, 15 bp, Homo sapiens
cacatcttgctctgc

SEQ ID NO: 3503518 - DNA, 20 bp, Homo sapiens
cacatcttgctctgctgaca

SEQ ID NO: 3503519 - DNA, 21 bp, Homo sapiens
cacatcttggctatgtaattc

SEQ ID NO: 3503520 - DNA, 20 bp, Homo sapiens
cacatgactcgggggtgggg

SEQ ID NO: 3503521 - DNA, 18 bp, Homo sapiens
cacatgcacgtgtgtgca

SEQ ID NO: 3503522 - DNA, 18 bp, Homo sapiens
cacatgcggagaacaaat

SEQ ID NO: 3503523 - DNA, 21 bp, Homo sapiens
cacatgctatgttctgtcttc

SEQ ID NO: 3503524 - DNA, 12 bp, Homo sapiens
cacatgcttcaa

SEQ ID NO: 3503525 - DNA, 11 bp, Homo sapiens
cacatggaaaa

SEQ ID NO: 3503526 - DNA, 13 bp, Homo sapiens
cacatggaaaaaa

SEQ ID NO: 3503527 - DNA, 20 bp, Homo sapiens
cacatgtcagtaccttcaaa

SEQ ID NO: 3503528 - DNA, 12 bp, Homo sapiens
cacatgtcttaa

SEQ ID NO: 3503529 - DNA, 14 bp, Homo sapiens
cacatgtgcacatg

SEQ ID NO: 3503530 - DNA, 14 bp, Homo sapiens
cacatgttggagga

SEQ ID NO: 3503531 - DNA, 13 bp, Homo sapiens
caccaagccaagg

SEQ ID NO: 3503532 - DNA, 12 bp, Homo sapiens
caccaagcccag

SEQ ID NO: 3503533 - DNA, 15 bp, Homo sapiens
caccaagcccagtta

SEQ ID NO: 3503534 - DNA, 15 bp, Homo sapiens
caccacacccagccc

SEQ ID NO: 3503535 - DNA, 15 bp, Homo sapiens
caccacatgtgcaca

SEQ ID NO: 3503536 - DNA, 19 bp, Homo sapiens
caccacatgtgcacatgca

SEQ ID NO: 3503537 - DNA, 18 bp, Homo sapiens
caccaccccaacaaacca

SEQ ID NO: 3503538 - DNA, 19 bp, Homo sapiens
caccaccctgtcttcctct

SEQ ID NO: 3503539 - DNA, 21 bp, Homo sapiens
caccaccctgtcttcctctgc

SEQ ID NO: 3503540 - DNA, 22 bp, Homo sapiens
caccaccctgtcttcctctgca

SEQ ID NO: 3503541 - DNA, 19 bp, Homo sapiens
caccacgctggggtctggg

SEQ ID NO: 3503542 - DNA, 22 bp, Homo sapiens
caccacggcgttgtacctgtag

SEQ ID NO: 3503543 - DNA, 15 bp, Homo sapiens
caccacgtccagctg

SEQ ID NO: 3503544 - DNA, 21 bp, Homo sapiens
caccactataaaatgtcttca

SEQ ID NO: 3503545 - DNA, 14 bp, Homo sapiens
caccagacacccag

SEQ ID NO: 3503546 - DNA, 20 bp, Homo sapiens
caccagacacccaggactta

SEQ ID NO: 3503547 - DNA, 17 bp, Homo sapiens
caccagagcccaccttg

SEQ ID NO: 3503548 - DNA, 18 bp, Homo sapiens
caccagagcccaccttgg

SEQ ID NO: 3503549 - DNA, 20 bp, Homo sapiens
caccagagcccaccttggct

SEQ ID NO: 3503550 - DNA, 12 bp, Homo sapiens
caccagcagcct

SEQ ID NO: 3503551 - DNA, 16 bp, Homo sapiens
caccagccccagtgcc

SEQ ID NO: 3503552 - DNA, 17 bp, Homo sapiens
caccagccccagtgccc

SEQ ID NO: 3503553 - DNA, 19 bp, Homo sapiens
caccagcccttagcaggga

SEQ ID NO: 3503554 - DNA, 14 bp, Homo sapiens
caccagcctaagaa

SEQ ID NO: 3503555 - DNA, 12 bp, Homo sapiens
caccagctgcaa

SEQ ID NO: 3503556 - DNA, 18 bp, Homo sapiens
caccagctgcaaagtgtt

SEQ ID NO: 3503557 - DNA, 13 bp, Homo sapiens
caccaggccacct

SEQ ID NO: 3503558 - DNA, 19 bp, Homo sapiens
caccaggccacctccccag

SEQ ID NO: 3503559 - DNA, 22 bp, Homo sapiens
caccagggttgaccccagagga

SEQ ID NO: 3503560 - DNA, 19 bp, Homo sapiens
caccaggtgcctttcaaat

SEQ ID NO: 3503561 - DNA, 13 bp, Homo sapiens
caccatatgaatt

SEQ ID NO: 3503562 - DNA, 19 bp, Homo sapiens
caccatatgaattgtacag

SEQ ID NO: 3503563 - DNA, 15 bp, Homo sapiens
caccatcatgtctgg

SEQ ID NO: 3503564 - DNA, 17 bp, Homo sapiens
caccatcatgtctggct

SEQ ID NO: 3503565 - DNA, 12 bp, Homo sapiens
cacttgtttgca

SEQ ID NO: 3503566 - DNA, 13 bp, Homo sapiens
cacttgtttgcac

SEQ ID NO: 3503567 - DNA, 15 bp, Homo sapiens
cacttgtttgcactg

SEQ ID NO: 3503568 - DNA, 18 bp, Homo sapiens
cacttgtttgcactgtgt

SEQ ID NO: 3503569 - DNA, 15 bp, Homo sapiens
cactttagggctgta

SEQ ID NO: 3503570 - DNA, 18 bp, Homo sapiens
cactttataagtcattgt

SEQ ID NO: 3503571 - DNA, 12 bp, Homo sapiens
cactttcatttt

SEQ ID NO: 3503572 - DNA, 23 bp, Homo sapiens
cactttgggaggccaaggagggc

SEQ ID NO: 3503573 - DNA, 20 bp, Homo sapiens
cactttgtcgcccaggctgg

SEQ ID NO: 3503574 - DNA, 20 bp, Homo sapiens
cactttgtttcgtggggagg

SEQ ID NO: 3503575 - DNA, 18 bp, Homo sapiens
cacttttcacctccttca

SEQ ID NO: 3503576 - DNA, 23 bp, Homo sapiens
cacttttggaaggtgacttttca

SEQ ID NO: 3503577 - DNA, 14 bp, Homo sapiens
cactttttgcagct

SEQ ID NO: 3503578 - DNA, 21 bp, Homo sapiens
cagaaaaataacttcaagcaa

SEQ ID NO: 3503579 - DNA, 18 bp, Homo sapiens
cagaaaaatggagcaaag

SEQ ID NO: 3503580 - DNA, 14 bp, Homo sapiens
cagaaaacaaaact

SEQ ID NO: 3503581 - DNA, 15 bp, Homo sapiens
cagaaaacaaaactg

SEQ ID NO: 3503582 - DNA, 15 bp, Homo sapiens
cagaaaacctccagt

SEQ ID NO: 3503583 - DNA, 23 bp, Homo sapiens
cagaaaatgttgagaatcccaaa

SEQ ID NO: 3503584 - DNA, 17 bp, Homo sapiens
cagaaacatcagttact

SEQ ID NO: 3503585 - DNA, 16 bp, Homo sapiens
cagaaagcagttctga

SEQ ID NO: 3503586 - DNA, 23 bp, Homo sapiens
cagaaagcagttctgatgcttac

SEQ ID NO: 3503587 - DNA, 20 bp, Homo sapiens
cagaaaggaaaagattcctg

SEQ ID NO: 3503588 - DNA, 22 bp, Homo sapiens
cagaaagtgtgctttatgctga

SEQ ID NO: 3503589 - DNA, 23 bp, Homo sapiens
cagaaagtgtgctttatgctgaa

SEQ ID NO: 3503590 - DNA, 14 bp, Homo sapiens
cagaaatgctgctg

SEQ ID NO: 3503591 - DNA, 17 bp, Homo sapiens
cagaaccttgttatttc

SEQ ID NO: 3503592 - DNA, 20 bp, Homo sapiens
cagaactcaaatggggccag

SEQ ID NO: 3503593 - DNA, 21 bp, Homo sapiens
cagaactcaaatggggccaga

SEQ ID NO: 3503594 - DNA, 22 bp, Homo sapiens
cagaactcaaatggggccagat

SEQ ID NO: 3503595 - DNA, 15 bp, Homo sapiens
cagaactcactgggg

SEQ ID NO: 3503596 - DNA, 18 bp, Homo sapiens
cagaactcactggggcct

SEQ ID NO: 3503597 - DNA, 19 bp, Homo sapiens
cagaactcttaaaaatgtt

SEQ ID NO: 3503598 - DNA, 23 bp, Homo sapiens
cagaagagggtgtgtttgaaatc

SEQ ID NO: 3503599 - DNA, 20 bp, Homo sapiens
cagaagatagcttcacccca

SEQ ID NO: 3503600 - DNA, 20 bp, Homo sapiens
cagaagattaagacagagaa

SEQ ID NO: 3503601 - DNA, 22 bp, Homo sapiens
cagaagcaagggggtgatgtag

SEQ ID NO: 3503602 - DNA, 16 bp, Homo sapiens
cagaagcctctgggtc

SEQ ID NO: 3503603 - DNA, 18 bp, Homo sapiens
cagaagcctgatgctgac

SEQ ID NO: 3503604 - DNA, 20 bp, Homo sapiens
cagaagctcttactctttcc

SEQ ID NO: 3503605 - DNA, 21 bp, Homo sapiens
cagaagctcttactctttcct

SEQ ID NO: 3503606 - DNA, 19 bp, Homo sapiens
cagaagctgagcaccaggg

SEQ ID NO: 3503607 - DNA, 17 bp, Homo sapiens
cagaaggaaaaatgtgt

SEQ ID NO: 3503608 - DNA, 20 bp, Homo sapiens
cagaaggaaaaatgtgtaat

SEQ ID NO: 3503609 - DNA, 13 bp, Homo sapiens
cagaaggagacag

SEQ ID NO: 3503610 - DNA, 19 bp, Homo sapiens
cagaagggagctagccaga

SEQ ID NO: 3503611 - DNA, 21 bp, Homo sapiens
cagaagggggtggtgtctcca

SEQ ID NO: 3503612 - DNA, 22 bp, Homo sapiens
cagaagtttgagatcagcctgg

SEQ ID NO: 3503613 - DNA, 18 bp, Homo sapiens
cagaagtttgcactatct

SEQ ID NO: 3503614 - DNA, 16 bp, Homo sapiens
cagaatatcatctttt

SEQ ID NO: 3503615 - DNA, 13 bp, Homo sapiens
cagaatattagcc

SEQ ID NO: 3503616 - DNA, 16 bp, Homo sapiens
cagaatctcattactg

SEQ ID NO: 3503617 - DNA, 11 bp, Homo sapiens
cagaatgctgt

SEQ ID NO: 3503618 - DNA, 18 bp, Homo sapiens
cagaatgctgtacatcta

SEQ ID NO: 3503619 - DNA, 16 bp, Homo sapiens
cagaatgttgattaca

SEQ ID NO: 3503620 - DNA, 20 bp, Homo sapiens
cagacaaaagcgcttttcct

SEQ ID NO: 3503621 - DNA, 13 bp, Homo sapiens
cagacacaggccc

SEQ ID NO: 3503622 - DNA, 17 bp, Homo sapiens
cagacacaggcccggct

SEQ ID NO: 3503623 - DNA, 18 bp, Homo sapiens
cagacacaggccctccct

SEQ ID NO: 3503624 - DNA, 14 bp, Homo sapiens
cagacacccaggac

SEQ ID NO: 3503625 - DNA, 15 bp, Homo sapiens
cagacacccaggact

SEQ ID NO: 3503626 - DNA, 17 bp, Homo sapiens
cagacacccaggactta

SEQ ID NO: 3503627 - DNA, 19 bp, Homo sapiens
cagacaccttgacagggca

SEQ ID NO: 3503628 - DNA, 18 bp, Homo sapiens
cagacaccttggacatcc

SEQ ID NO: 3503629 - DNA, 19 bp, Homo sapiens
cagacacgagccacctcac

SEQ ID NO: 3503630 - DNA, 17 bp, Homo sapiens
cagacacggatctgaga

SEQ ID NO: 3503631 - DNA, 21 bp, Homo sapiens
cagacacttttttgagtggat

SEQ ID NO: 3503632 - DNA, 14 bp, Homo sapiens
cagacagacacaca

SEQ ID NO: 3503633 - DNA, 15 bp, Homo sapiens
cagacagacacacac

SEQ ID NO: 3503634 - DNA, 18 bp, Homo sapiens
cagacagatgaggctttc

SEQ ID NO: 3503635 - DNA, 13 bp, Homo sapiens
cagacaggcaagc

SEQ ID NO: 3503636 - DNA, 23 bp, Homo sapiens
cagacaggcaagcacctcctgcc

SEQ ID NO: 3503637 - DNA, 15 bp, Homo sapiens
cagacaggccccgtg

SEQ ID NO: 3503638 - DNA, 14 bp, Homo sapiens
cagacatatttaac

SEQ ID NO: 3503639 - DNA, 22 bp, Homo sapiens
cagacatgttttccgtgaaaac

SEQ ID NO: 3503640 - DNA, 15 bp, Homo sapiens
cagacctaatgctcc

SEQ ID NO: 3503641 - DNA, 12 bp, Homo sapiens
cagacctctgga

SEQ ID NO: 3503642 - DNA, 13 bp, Homo sapiens
cagacctgtcacc

SEQ ID NO: 3503643 - DNA, 17 bp, Homo sapiens
cagaccttcacagatgc

SEQ ID NO: 3503644 - DNA, 22 bp, Homo sapiens
cagacgttaggcatttcctgct

SEQ ID NO: 3503645 - DNA, 23 bp, Homo sapiens
cagacgttaggcatttcctgctg

SEQ ID NO: 3503646 - DNA, 21 bp, Homo sapiens
cagactcacaacctgaaccta

SEQ ID NO: 3503647 - DNA, 20 bp, Homo sapiens
cagactcccattcctgaaga

SEQ ID NO: 3503648 - DNA, 19 bp, Homo sapiens
cagactctacagaggccat

SEQ ID NO: 3503649 - DNA, 15 bp, Homo sapiens
cagactctttatgct

SEQ ID NO: 3503650 - DNA, 16 bp, Homo sapiens
cagactgatcaggacc

SEQ ID NO: 3503651 - DNA, 17 bp, Homo sapiens
cagactgtctccacggc

SEQ ID NO: 3503652 - DNA, 14 bp, Homo sapiens
cagactgtgtaaaa

SEQ ID NO: 3503653 - DNA, 22 bp, Homo sapiens
cagactgtgtaaaaagagagct

SEQ ID NO: 3503654 - DNA, 20 bp, Homo sapiens
cagacttcccagctaggaag

SEQ ID NO: 3503655 - DNA, 24 bp, Homo sapiens
cagacttccttgagacacggagcc

SEQ ID NO: 3503656 - DNA, 19 bp, Homo sapiens
cagacttgccatgtgactc

SEQ ID NO: 3503657 - DNA, 21 bp, Homo sapiens
cagacttgccatgtgactctg

SEQ ID NO: 3503658 - DNA, 23 bp, Homo sapiens
cagactttggaaaatgcattgta

SEQ ID NO: 3503659 - DNA, 15 bp, Homo sapiens
cagagaaacagacag

SEQ ID NO: 3503660 - DNA, 19 bp, Homo sapiens
cagagaaacttaagcaaag

SEQ ID NO: 3503661 - DNA, 15 bp, Homo sapiens
cagagaaagggacaa

SEQ ID NO: 3503662 - DNA, 19 bp, Homo sapiens
cagagaaagtacttctcca

SEQ ID NO: 3503663 - DNA, 23 bp, Homo sapiens
cagagaaagtacttctccaccct

SEQ ID NO: 3503664 - DNA, 15 bp, Homo sapiens
cagagaactttattt

SEQ ID NO: 3503665 - DNA, 23 bp, Homo sapiens
cagagaagctataaattcctctt

SEQ ID NO: 3503666 - DNA, 19 bp, Homo sapiens
cagagaagctctcgggcta

SEQ ID NO: 3503667 - DNA, 21 bp, Homo sapiens
cagagaagtctggtcagagcc

SEQ ID NO: 3503668 - DNA, 19 bp, Homo sapiens
cagagaatgaaagggccca

SEQ ID NO: 3503669 - DNA, 20 bp, Homo sapiens
cagagaatgaaagggcccag

SEQ ID NO: 3503670 - DNA, 20 bp, Homo sapiens
cagagacaaggtcacctggg

SEQ ID NO: 3503671 - DNA, 14 bp, Homo sapiens
cagagacaggtggc

SEQ ID NO: 3503672 - DNA, 19 bp, Homo sapiens
cagagacatacttgaaggg

SEQ ID NO: 3503673 - DNA, 21 bp, Homo sapiens
cagagacatacttgaagggcc

SEQ ID NO: 3503674 - DNA, 22 bp, Homo sapiens
cagagaccaggccctggctaag

SEQ ID NO: 3503675 - DNA, 16 bp, Homo sapiens
cagagaccaggctgtg

SEQ ID NO: 3503676 - DNA, 14 bp, Homo sapiens
cagagaccattgca

SEQ ID NO: 3503677 - DNA, 22 bp, Homo sapiens
cagagagaatgagagcgacaca

SEQ ID NO: 3503678 - DNA, 19 bp, Homo sapiens
cagagagcctggtgctgct

SEQ ID NO: 3503679 - DNA, 13 bp, Homo sapiens
cagagagggcagg

SEQ ID NO: 3503680 - DNA, 16 bp, Homo sapiens
cagagagggcaggcat

SEQ ID NO: 3503681 - DNA, 18 bp, Homo sapiens
cagagatggacagagaac

SEQ ID NO: 3503682 - DNA, 14 bp, Homo sapiens
cagagattcatttt

SEQ ID NO: 3503683 - DNA, 17 bp, Homo sapiens
cagagcacacaggtaca

SEQ ID NO: 3503684 - DNA, 20 bp, Homo sapiens
cagagcacacaggtacagca

SEQ ID NO: 3503685 - DNA, 23 bp, Homo sapiens
cagagcacacaggtacagcaaca

SEQ ID NO: 3503686 - DNA, 19 bp, Homo sapiens
cagagcagatggcagatgc

SEQ ID NO: 3503687 - DNA, 20 bp, Homo sapiens
cagagcagatggcagatgca

SEQ ID NO: 3503688 - DNA, 21 bp, Homo sapiens
cagagccaaggggcttcaggt

SEQ ID NO: 3503689 - DNA, 20 bp, Homo sapiens
cagagccacagggtctgcct

SEQ ID NO: 3503690 - DNA, 22 bp, Homo sapiens
cagagccacagggtctgcctcc

SEQ ID NO: 3503691 - DNA, 16 bp, Homo sapiens
cagagcctcgctctgt

SEQ ID NO: 3503692 - DNA, 22 bp, Homo sapiens
cagagcctgtctttcagcattc

SEQ ID NO: 3503693 - DNA, 20 bp, Homo sapiens
cagagctaaactccttcctg

SEQ ID NO: 3503694 - DNA, 21 bp, Homo sapiens
cagagctaaactccttcctgg

SEQ ID NO: 3503695 - DNA, 19 bp, Homo sapiens
cagcatccccttgaactct

SEQ ID NO: 3503696 - DNA, 17 bp, Homo sapiens
cagcatccgcaggtgct

SEQ ID NO: 3503697 - DNA, 20 bp, Homo sapiens
cagcatccgcaggtgctggt

SEQ ID NO: 3503698 - DNA, 17 bp, Homo sapiens
cagcatcctggcacccg

SEQ ID NO: 3503699 - DNA, 21 bp, Homo sapiens
cagcatcctggcacccggccc

SEQ ID NO: 3503700 - DNA, 20 bp, Homo sapiens
cagcatgacaaaaattattt

SEQ ID NO: 3503701 - DNA, 12 bp, Homo sapiens
cagcattagata

SEQ ID NO: 3503702 - DNA, 18 bp, Homo sapiens
cagcattctcaggcacca

SEQ ID NO: 3503703 - DNA, 19 bp, Homo sapiens
cagcattgctggactctga

SEQ ID NO: 3503704 - DNA, 18 bp, Homo sapiens
cagcattttactgattca

SEQ ID NO: 3503705 - DNA, 18 bp, Homo sapiens
cagccaaagcctcctcca

SEQ ID NO: 3503706 - DNA, 21 bp, Homo sapiens
cagccaaagcctcctccagcc

SEQ ID NO: 3503707 - DNA, 20 bp, Homo sapiens
cagccaacacgcacctgcct

SEQ ID NO: 3503708 - DNA, 23 bp, Homo sapiens
cagccaacacgcacctgcctcag

SEQ ID NO: 3503709 - DNA, 20 bp, Homo sapiens
cagccaactagcccctgggg

SEQ ID NO: 3503710 - DNA, 15 bp, Homo sapiens
cagccacggccaggc

SEQ ID NO: 3503711 - DNA, 16 bp, Homo sapiens
cagccacggccaggcc

SEQ ID NO: 3503712 - DNA, 15 bp, Homo sapiens
cagccaggagtgggt

SEQ ID NO: 3503713 - DNA, 15 bp, Homo sapiens
cagccaggccccagg

SEQ ID NO: 3503714 - DNA, 19 bp, Homo sapiens
cagccagtgacctgaggaa

SEQ ID NO: 3503715 - DNA, 20 bp, Homo sapiens
cagccagtgacctgaggaag

SEQ ID NO: 3503716 - DNA, 16 bp, Homo sapiens
cagccatcaaaatgct

SEQ ID NO: 3503717 - DNA, 17 bp, Homo sapiens
cagccatgtctgcattt

SEQ ID NO: 3503718 - DNA, 22 bp, Homo sapiens
cagccattgcacccagcccaga

SEQ ID NO: 3503719 - DNA, 15 bp, Homo sapiens
cagcccacccctcaa

SEQ ID NO: 3503720 - DNA, 11 bp, Homo sapiens
cagcccagaga

SEQ ID NO: 3503721 - DNA, 13 bp, Homo sapiens
cagcccagagaca

SEQ ID NO: 3503722 - DNA, 22 bp, Homo sapiens
cagcccagagacatacttgaag

SEQ ID NO: 3503723 - DNA, 20 bp, Homo sapiens
cagcccagaggccaacactg

SEQ ID NO: 3503724 - DNA, 17 bp, Homo sapiens
cagcccagggctcctgc

SEQ ID NO: 3503725 - DNA, 21 bp, Homo sapiens
cagcccagggctcctgcactt

SEQ ID NO: 3503726 - DNA, 16 bp, Homo sapiens
cagccccagcctgcta

SEQ ID NO: 3503727 - DNA, 13 bp, Homo sapiens
cagccccagtgcc

SEQ ID NO: 3503728 - DNA, 14 bp, Homo sapiens
cagccccagtgccc

SEQ ID NO: 3503729 - DNA, 13 bp, Homo sapiens
cagccccatctgt

SEQ ID NO: 3503730 - DNA, 20 bp, Homo sapiens
cagccccatctgtgcattct

SEQ ID NO: 3503731 - DNA, 14 bp, Homo sapiens
cagccccattctgc

SEQ ID NO: 3503732 - DNA, 16 bp, Homo sapiens
cagccccattctgcct

SEQ ID NO: 3503733 - DNA, 23 bp, Homo sapiens
cagccccattctgcctgcccagg

SEQ ID NO: 3503734 - DNA, 24 bp, Homo sapiens
cagccccattctgcctgcccaggc

SEQ ID NO: 3503735 - DNA, 18 bp, Homo sapiens
cagccccgacttcctgac

SEQ ID NO: 3503736 - DNA, 19 bp, Homo sapiens
cagccccgacttcctgact

SEQ ID NO: 3503737 - DNA, 14 bp, Homo sapiens
cagcccctgatcct

SEQ ID NO: 3503738 - DNA, 19 bp, Homo sapiens
cagcccctgatcctgtgaa

SEQ ID NO: 3503739 - DNA, 14 bp, Homo sapiens
cagcccgcacacct

SEQ ID NO: 3503740 - DNA, 15 bp, Homo sapiens
cagcccgcacacctg

SEQ ID NO: 3503741 - DNA, 14 bp, Homo sapiens
cagccctcacccct

SEQ ID NO: 3503742 - DNA, 20 bp, Homo sapiens
cagccctccccatggagcca

SEQ ID NO: 3503743 - DNA, 21 bp, Homo sapiens
cagccctccccatggagccag

SEQ ID NO: 3503744 - DNA, 16 bp, Homo sapiens
cagccctgaccctgtg

SEQ ID NO: 3503745 - DNA, 16 bp, Homo sapiens
cagcccttagcaggga

SEQ ID NO: 3503746 - DNA, 23 bp, Homo sapiens
cagcctaagaagctctggcccca

SEQ ID NO: 3503747 - DNA, 17 bp, Homo sapiens
cagcctcaacctcctgg

SEQ ID NO: 3503748 - DNA, 19 bp, Homo sapiens
cagcctcaacctcctgggc

SEQ ID NO: 3503749 - DNA, 17 bp, Homo sapiens
cagcctcagcgcggccc

SEQ ID NO: 3503750 - DNA, 20 bp, Homo sapiens
cagcctcccaaagtgctggg

SEQ ID NO: 3503751 - DNA, 21 bp, Homo sapiens
cagcctcccaaagtgctggga

SEQ ID NO: 3503752 - DNA, 16 bp, Homo sapiens
cagcctcccaccccca

SEQ ID NO: 3503753 - DNA, 18 bp, Homo sapiens
cagcctcccacccccatc

SEQ ID NO: 3503754 - DNA, 18 bp, Homo sapiens
cagcctcccatccagggc

SEQ ID NO: 3503755 - DNA, 19 bp, Homo sapiens
cagcctcccatccagggcc

SEQ ID NO: 3503756 - DNA, 19 bp, Homo sapiens
cagcctcccctgccagggc

SEQ ID NO: 3503757 - DNA, 22 bp, Homo sapiens
cagcctcccctgccagggcagg

SEQ ID NO: 3503758 - DNA, 20 bp, Homo sapiens
cagcctcccgaatagctggg

SEQ ID NO: 3503759 - DNA, 21 bp, Homo sapiens
cagcctcccgaatagctggga

SEQ ID NO: 3503760 - DNA, 18 bp, Homo sapiens
cagcctcccgagtagctg

SEQ ID NO: 3503761 - DNA, 14 bp, Homo sapiens
cagcctctccccag

SEQ ID NO: 3503762 - DNA, 13 bp, Homo sapiens
cagcctgcgcctg

SEQ ID NO: 3503763 - DNA, 18 bp, Homo sapiens
cagcctgcgcctgctgca

SEQ ID NO: 3503764 - DNA, 21 bp, Homo sapiens
cagcctgcgcctgctgcatgc

SEQ ID NO: 3503765 - DNA, 21 bp, Homo sapiens
cagcctgcgggaagctgacct

SEQ ID NO: 3503766 - DNA, 23 bp, Homo sapiens
cagcctgcgggaagctgaccttt

SEQ ID NO: 3503767 - DNA, 22 bp, Homo sapiens
cagcctgctagctagctcaact

SEQ ID NO: 3503768 - DNA, 16 bp, Homo sapiens
cagcctgctccagctg

SEQ ID NO: 3503769 - DNA, 17 bp, Homo sapiens
cagcctgctccagctgt

SEQ ID NO: 3503770 - DNA, 15 bp, Homo sapiens
cagcctggccagaca

SEQ ID NO: 3503771 - DNA, 15 bp, Homo sapiens
cagcctggggtctgg

SEQ ID NO: 3503772 - DNA, 23 bp, Homo sapiens
cagccttcagacagagaggactg

SEQ ID NO: 3503773 - DNA, 19 bp, Homo sapiens
cagccttgaactctgggct

SEQ ID NO: 3503774 - DNA, 13 bp, Homo sapiens
cagccttgccaga

SEQ ID NO: 3503775 - DNA, 19 bp, Homo sapiens
cagcctttgatcaggtggg

SEQ ID NO: 3503776 - DNA, 21 bp, Homo sapiens
cagcgagccctggtggcagtg

SEQ ID NO: 3503777 - DNA, 18 bp, Homo sapiens
cagcgccaggctgaccac

SEQ ID NO: 3503778 - DNA, 20 bp, Homo sapiens
cagcgccaggctgaccacag

SEQ ID NO: 3503779 - DNA, 13 bp, Homo sapiens
cagcgcctttccc

SEQ ID NO: 3503780 - DNA, 14 bp, Homo sapiens
cagcgcctttccca

SEQ ID NO: 3503781 - DNA, 17 bp, Homo sapiens
cagcgcggccctcccga

SEQ ID NO: 3503782 - DNA, 22 bp, Homo sapiens
cagcggaggtgtggagccgagg

SEQ ID NO: 3503783 - DNA, 16 bp, Homo sapiens
cagcggctccagctca

SEQ ID NO: 3503784 - DNA, 16 bp, Homo sapiens
cagcgggaatggcagc

SEQ ID NO: 3503785 - DNA, 13 bp, Homo sapiens
cagcgggcaggtt

SEQ ID NO: 3503786 - DNA, 14 bp, Homo sapiens
cagcggggacagct

SEQ ID NO: 3503787 - DNA, 17 bp, Homo sapiens
cagcggggacagctcct

SEQ ID NO: 3503788 - DNA, 23 bp, Homo sapiens
cagcgtatatataagaaagacat

SEQ ID NO: 3503789 - DNA, 15 bp, Homo sapiens
cagcgtcctcctctg

SEQ ID NO: 3503790 - DNA, 23 bp, Homo sapiens
cagctaagaaaagattttaatca

SEQ ID NO: 3503791 - DNA, 13 bp, Homo sapiens
cagctaagaacct

SEQ ID NO: 3503792 - DNA, 16 bp, Homo sapiens
cagctaagaacctgga

SEQ ID NO: 3503793 - DNA, 19 bp, Homo sapiens
cagctaagaacctggaact

SEQ ID NO: 3503794 - DNA, 21 bp, Homo sapiens
cagctaaggaggggaaaaaaa

SEQ ID NO: 3503795 - DNA, 16 bp, Homo sapiens
cagctaatgggacact

SEQ ID NO: 3503796 - DNA, 21 bp, Homo sapiens
cagctacctcaaccaatgcca

SEQ ID NO: 3503797 - DNA, 19 bp, Homo sapiens
cagctacttggtttgtgtt

SEQ ID NO: 3503798 - DNA, 16 bp, Homo sapiens
cagctaggaagagcag

SEQ ID NO: 3503799 - DNA, 15 bp, Homo sapiens
cagctatacctgtgc

SEQ ID NO: 3503800 - DNA, 16 bp, Homo sapiens
cagctatacctgtgcc

SEQ ID NO: 3503801 - DNA, 17 bp, Homo sapiens
cagctatacctgtgcct

SEQ ID NO: 3503802 - DNA, 19 bp, Homo sapiens
cagctatacctgtgcctcg

SEQ ID NO: 3503803 - DNA, 20 bp, Homo sapiens
cagctatgttatattgaaaa

SEQ ID NO: 3503804 - DNA, 19 bp, Homo sapiens
cagctcaaaggcacagtga

SEQ ID NO: 3503805 - DNA, 22 bp, Homo sapiens
cagctcaagagatcccaagtag

SEQ ID NO: 3503806 - DNA, 14 bp, Homo sapiens
cagctcaccagccc

SEQ ID NO: 3503807 - DNA, 15 bp, Homo sapiens
cagctcaccagcccc

SEQ ID NO: 3503808 - DNA, 16 bp, Homo sapiens
cagctcaccagcccca

SEQ ID NO: 3503809 - DNA, 13 bp, Homo sapiens
cagctcagcttcc

SEQ ID NO: 3503810 - DNA, 18 bp, Homo sapiens
cagctcaggacagatgcc

SEQ ID NO: 3503811 - DNA, 23 bp, Homo sapiens
cagctcatatgctgacagctctt

SEQ ID NO: 3503812 - DNA, 13 bp, Homo sapiens
cagctccaccctg

SEQ ID NO: 3503813 - DNA, 15 bp, Homo sapiens
cagctccaccctggc

SEQ ID NO: 3503814 - DNA, 13 bp, Homo sapiens
cagctccagctca

SEQ ID NO: 3503815 - DNA, 16 bp, Homo sapiens
cagctccagttggagt

SEQ ID NO: 3503816 - DNA, 14 bp, Homo sapiens
cagctccattttct

SEQ ID NO: 3503817 - DNA, 23 bp, Homo sapiens
cagctcccataaccgctgattct

SEQ ID NO: 3503818 - DNA, 20 bp, Homo sapiens
cagctccccaggactcaccc

SEQ ID NO: 3503819 - DNA, 23 bp, Homo sapiens
cagctccccaggactcaccctca

SEQ ID NO: 3503820 - DNA, 15 bp, Homo sapiens
cagctcccgctgtgg

SEQ ID NO: 3503821 - DNA, 20 bp, Homo sapiens
cagctcccgctgtggccgca

SEQ ID NO: 3503822 - DNA, 15 bp, Homo sapiens
cagctcctcatccag

SEQ ID NO: 3503823 - DNA, 17 bp, Homo sapiens
cagctccttctgtccta

SEQ ID NO: 3503824 - DNA, 15 bp, Homo sapiens
cagctcggctcagct

SEQ ID NO: 3503825 - DNA, 16 bp, Homo sapiens
cagctcggtacccggg

SEQ ID NO: 3503826 - DNA, 17 bp, Homo sapiens
cagctctcatctgaggc

SEQ ID NO: 3503827 - DNA, 24 bp, Homo sapiens
caggatggcctggccagggcctgg

SEQ ID NO: 3503828 - DNA, 22 bp, Homo sapiens
caggatttgcacagaagcacat

SEQ ID NO: 3503829 - DNA, 19 bp, Homo sapiens
caggatttgttctctgtcc

SEQ ID NO: 3503830 - DNA, 15 bp, Homo sapiens
caggcaagcacctcc

SEQ ID NO: 3503831 - DNA, 17 bp, Homo sapiens
caggcaatgctggctgt

SEQ ID NO: 3503832 - DNA, 19 bp, Homo sapiens
caggcaatgctggctgttg

SEQ ID NO: 3503833 - DNA, 24 bp, Homo sapiens
caggcaattctcctgcctttgcct

SEQ ID NO: 3503834 - DNA, 14 bp, Homo sapiens
caggcacacagcta

SEQ ID NO: 3503835 - DNA, 23 bp, Homo sapiens
caggcacccaccatcatgtctgg

SEQ ID NO: 3503836 - DNA, 23 bp, Homo sapiens
caggcactgagataccagcgagg

SEQ ID NO: 3503837 - DNA, 21 bp, Homo sapiens
caggcactgcaaaccgccacc

SEQ ID NO: 3503838 - DNA, 12 bp, Homo sapiens
caggcagacacg

SEQ ID NO: 3503839 - DNA, 16 bp, Homo sapiens
caggcagacacggatc

SEQ ID NO: 3503840 - DNA, 22 bp, Homo sapiens
caggcagacacggatctgagaa

SEQ ID NO: 3503841 - DNA, 14 bp, Homo sapiens
caggcagatccagg

SEQ ID NO: 3503842 - DNA, 15 bp, Homo sapiens
caggcagatccagga

SEQ ID NO: 3503843 - DNA, 12 bp, Homo sapiens
caggcagcccta

SEQ ID NO: 3503844 - DNA, 22 bp, Homo sapiens
caggcagctttttctctcccac

SEQ ID NO: 3503845 - DNA, 17 bp, Homo sapiens
caggcagggctgactct

SEQ ID NO: 3503846 - DNA, 13 bp, Homo sapiens
caggcaggtccag

SEQ ID NO: 3503847 - DNA, 14 bp, Homo sapiens
caggcaggtccagg

SEQ ID NO: 3503848 - DNA, 12 bp, Homo sapiens
caggcaggtctt

SEQ ID NO: 3503849 - DNA, 13 bp, Homo sapiens
caggcaggtcttg

SEQ ID NO: 3503850 - DNA, 23 bp, Homo sapiens
caggcaggtcttgaactcctggc

SEQ ID NO: 3503851 - DNA, 17 bp, Homo sapiens
caggcagttggccagag

SEQ ID NO: 3503852 - DNA, 18 bp, Homo sapiens
caggcagtttcagagatg

SEQ ID NO: 3503853 - DNA, 15 bp, Homo sapiens
caggcatcacagcta

SEQ ID NO: 3503854 - DNA, 12 bp, Homo sapiens
caggcatgaagt

SEQ ID NO: 3503855 - DNA, 23 bp, Homo sapiens
caggcatgggtgcaaggaaaatt

SEQ ID NO: 3503856 - DNA, 20 bp, Homo sapiens
caggcatgttctctgaggac

SEQ ID NO: 3503857 - DNA, 16 bp, Homo sapiens
caggcatttagccctc

SEQ ID NO: 3503858 - DNA, 20 bp, Homo sapiens
caggccacctccccagcatt

SEQ ID NO: 3503859 - DNA, 16 bp, Homo sapiens
caggccagagggagtg

SEQ ID NO: 3503860 - DNA, 15 bp, Homo sapiens
caggccagctgcctc

SEQ ID NO: 3503861 - DNA, 14 bp, Homo sapiens
caggccaggccagc

SEQ ID NO: 3503862 - DNA, 15 bp, Homo sapiens
caggccccaggaagc

SEQ ID NO: 3503863 - DNA, 18 bp, Homo sapiens
caggccccaggcagggcc

SEQ ID NO: 3503864 - DNA, 13 bp, Homo sapiens
caggcccccaagc

SEQ ID NO: 3503865 - DNA, 17 bp, Homo sapiens
caggcccccaagcctgc

SEQ ID NO: 3503866 - DNA, 19 bp, Homo sapiens
caggcccccaagcctgcag

SEQ ID NO: 3503867 - DNA, 19 bp, Homo sapiens
caggccccccgcagcaccc

SEQ ID NO: 3503868 - DNA, 14 bp, Homo sapiens
caggcccctctcct

SEQ ID NO: 3503869 - DNA, 17 bp, Homo sapiens
caggcccctctcctccg

SEQ ID NO: 3503870 - DNA, 13 bp, Homo sapiens
caggcccctggag

SEQ ID NO: 3503871 - DNA, 22 bp, Homo sapiens
caggcccctggaggctgcctcc

SEQ ID NO: 3503872 - DNA, 22 bp, Homo sapiens
caggccctccctgttccccaga

SEQ ID NO: 3503873 - DNA, 18 bp, Homo sapiens
caggccctggcctcccct

SEQ ID NO: 3503874 - DNA, 20 bp, Homo sapiens
caggccctggctaagaccca

SEQ ID NO: 3503875 - DNA, 17 bp, Homo sapiens
caggccctgtggcagga

SEQ ID NO: 3503876 - DNA, 14 bp, Homo sapiens
caggccgaggcagg

SEQ ID NO: 3503877 - DNA, 16 bp, Homo sapiens
caggccgaggcaggtg

SEQ ID NO: 3503878 - DNA, 14 bp, Homo sapiens
caggccgccctgcg

SEQ ID NO: 3503879 - DNA, 13 bp, Homo sapiens
caggccggcagcc

SEQ ID NO: 3503880 - DNA, 19 bp, Homo sapiens
caggcctcttggcagtcac

SEQ ID NO: 3503881 - DNA, 14 bp, Homo sapiens
caggcctgagattt

SEQ ID NO: 3503882 - DNA, 16 bp, Homo sapiens
caggcctgagctgctt

SEQ ID NO: 3503883 - DNA, 16 bp, Homo sapiens
caggcgggaggaggtg

SEQ ID NO: 3503884 - DNA, 16 bp, Homo sapiens
caggctcccagggaca

SEQ ID NO: 3503885 - DNA, 17 bp, Homo sapiens
caggctcgccaaggcct

SEQ ID NO: 3503886 - DNA, 18 bp, Homo sapiens
caggctcgccaaggccta

SEQ ID NO: 3503887 - DNA, 19 bp, Homo sapiens
caggctcgccaaggcctag

SEQ ID NO: 3503888 - DNA, 14 bp, Homo sapiens
caggctctcaacag

SEQ ID NO: 3503889 - DNA, 14 bp, Homo sapiens
caggctgaccacag

SEQ ID NO: 3503890 - DNA, 15 bp, Homo sapiens
caggctgaccacagc

SEQ ID NO: 3503891 - DNA, 17 bp, Homo sapiens
caggctgaccacagcac

SEQ ID NO: 3503892 - DNA, 21 bp, Homo sapiens
caggctgaccacagcacagcc

SEQ ID NO: 3503893 - DNA, 18 bp, Homo sapiens
caggctggaatgcagtgg

SEQ ID NO: 3503894 - DNA, 14 bp, Homo sapiens
caggctggccagtc

SEQ ID NO: 3503895 - DNA, 17 bp, Homo sapiens
caggctggcgtgcagtg

SEQ ID NO: 3503896 - DNA, 18 bp, Homo sapiens
caggctgggaactcatct

SEQ ID NO: 3503897 - DNA, 22 bp, Homo sapiens
caggctgggcttcagtggcagc

SEQ ID NO: 3503898 - DNA, 12 bp, Homo sapiens
caggctggtctc

SEQ ID NO: 3503899 - DNA, 13 bp, Homo sapiens
caggctggtctca

SEQ ID NO: 3503900 - DNA, 14 bp, Homo sapiens
caggctgtatccca

SEQ ID NO: 3503901 - DNA, 23 bp, Homo sapiens
caggctgtatcccatgagcctca

SEQ ID NO: 3503902 - DNA, 16 bp, Homo sapiens
caggctgtctggccag

SEQ ID NO: 3503903 - DNA, 17 bp, Homo sapiens
caggctgtctggccagg

SEQ ID NO: 3503904 - DNA, 15 bp, Homo sapiens
caggcttgcctgcag

SEQ ID NO: 3503905 - DNA, 15 bp, Homo sapiens
cagggaaaagcagct

SEQ ID NO: 3503906 - DNA, 15 bp, Homo sapiens
cagggaaaataggca

SEQ ID NO: 3503907 - DNA, 18 bp, Homo sapiens
cagggaaaataggcagga

SEQ ID NO: 3503908 - DNA, 16 bp, Homo sapiens
cagggaaacagctaat

SEQ ID NO: 3503909 - DNA, 22 bp, Homo sapiens
cagggaaacagctaatgggaca

SEQ ID NO: 3503910 - DNA, 15 bp, Homo sapiens
cagggaaatggcctt

SEQ ID NO: 3503911 - DNA, 22 bp, Homo sapiens
cagggacacctgggagaaatct

SEQ ID NO: 3503912 - DNA, 14 bp, Homo sapiens
cagggacccctgcc

SEQ ID NO: 3503913 - DNA, 21 bp, Homo sapiens
cagggactgaaaacctctcct

SEQ ID NO: 3503914 - DNA, 23 bp, Homo sapiens
cagggactgaaaacctctcctca

SEQ ID NO: 3503915 - DNA, 14 bp, Homo sapiens
cagggagacaagag

SEQ ID NO: 3503916 - DNA, 19 bp, Homo sapiens
cagggagacccgtccattt

SEQ ID NO: 3503917 - DNA, 19 bp, Homo sapiens
cagggagcattttcctcca

SEQ ID NO: 3503918 - DNA, 22 bp, Homo sapiens
cagggagcggaaagcagctcaa

SEQ ID NO: 3503919 - DNA, 17 bp, Homo sapiens
cagggaggccctgtgcc

SEQ ID NO: 3503920 - DNA, 16 bp, Homo sapiens
cagggaggggaagagg

SEQ ID NO: 3503921 - DNA, 18 bp, Homo sapiens
cagggaggtgaccccagg

SEQ ID NO: 3503922 - DNA, 23 bp, Homo sapiens
cagggaggtggaaggaccctgtg

SEQ ID NO: 3503923 - DNA, 22 bp, Homo sapiens
cagggagtccgaaagggacttg

SEQ ID NO: 3503924 - DNA, 20 bp, Homo sapiens
cagggatgagcatggagctg

SEQ ID NO: 3503925 - DNA, 21 bp, Homo sapiens
cagggatgagcatggagctgg

SEQ ID NO: 3503926 - DNA, 14 bp, Homo sapiens
cagggatgccctgg

SEQ ID NO: 3503927 - DNA, 23 bp, Homo sapiens
cagggatgccctggaggtggctg

SEQ ID NO: 3503928 - DNA, 18 bp, Homo sapiens
cagggatgtacaaggcga

SEQ ID NO: 3503929 - DNA, 16 bp, Homo sapiens
cagggatttgcctcac

SEQ ID NO: 3503930 - DNA, 21 bp, Homo sapiens
cagggatttgcctcaccttgg

SEQ ID NO: 3503931 - DNA, 22 bp, Homo sapiens
cagggcaagggttaaggcctga

SEQ ID NO: 3503932 - DNA, 23 bp, Homo sapiens
cagggcaagggttaaggcctgaa

SEQ ID NO: 3503933 - DNA, 18 bp, Homo sapiens
cagggcagcgccaggctg

SEQ ID NO: 3503934 - DNA, 23 bp, Homo sapiens
cagggccacgctccagctgcccc

SEQ ID NO: 3503935 - DNA, 14 bp, Homo sapiens
cagggcccagagcc

SEQ ID NO: 3503936 - DNA, 22 bp, Homo sapiens
cagggcccagagcccagctcca

SEQ ID NO: 3503937 - DNA, 16 bp, Homo sapiens
cagggcccccacaggc

SEQ ID NO: 3503938 - DNA, 15 bp, Homo sapiens
cagggcccccatctc

SEQ ID NO: 3503939 - DNA, 14 bp, Homo sapiens
cagggccgccaggg

SEQ ID NO: 3503940 - DNA, 16 bp, Homo sapiens
cagggccgccagggag

SEQ ID NO: 3503941 - DNA, 16 bp, Homo sapiens
cagggcctcacacggt

SEQ ID NO: 3503942 - DNA, 22 bp, Homo sapiens
cagggcctgacagtgtgggaca

SEQ ID NO: 3503943 - DNA, 17 bp, Homo sapiens
cagggcctgagcctggc

SEQ ID NO: 3503944 - DNA, 20 bp, Homo sapiens
cagggcctgagcctggccag

SEQ ID NO: 3503945 - DNA, 22 bp, Homo sapiens
cagggcctgagcctggccagcc

SEQ ID NO: 3503946 - DNA, 12 bp, Homo sapiens
cagggcctggaa

SEQ ID NO: 3503947 - DNA, 17 bp, Homo sapiens
cagggcctggaagacag

SEQ ID NO: 3503948 - DNA, 22 bp, Homo sapiens
cagggcgggcagagggctggag

SEQ ID NO: 3503949 - DNA, 14 bp, Homo sapiens
cagggctaccctga

SEQ ID NO: 3503950 - DNA, 19 bp, Homo sapiens
cagggctaccctgagctga

SEQ ID NO: 3503951 - DNA, 24 bp, Homo sapiens
cagggctaccctgagctgaggcag

SEQ ID NO: 3503952 - DNA, 21 bp, Homo sapiens
cagggctcagcggggacagct

SEQ ID NO: 3503953 - DNA, 14 bp, Homo sapiens
cagggctgctagac

SEQ ID NO: 3503954 - DNA, 17 bp, Homo sapiens
cagggctggactgaggc

SEQ ID NO: 3503955 - DNA, 18 bp, Homo sapiens
cagggctggactgaggcc

SEQ ID NO: 3503956 - DNA, 20 bp, Homo sapiens
caggggaaaatcagcctgct

SEQ ID NO: 3503957 - DNA, 14 bp, Homo sapiens
caggggcctggaga

SEQ ID NO: 3503958 - DNA, 23 bp, Homo sapiens
caggggcctggagatcctcctgc

SEQ ID NO: 3503959 - DNA, 15 bp, Homo sapiens
catagatgcaggtga

SEQ ID NO: 3503960 - DNA, 22 bp, Homo sapiens
catagcagagaatgaaagggcc

SEQ ID NO: 3503961 - DNA, 16 bp, Homo sapiens
catagcagattttaat

SEQ ID NO: 3503962 - DNA, 13 bp, Homo sapiens
catagccaggagc

SEQ ID NO: 3503963 - DNA, 17 bp, Homo sapiens
cataggaggcttctgtt

SEQ ID NO: 3503964 - DNA, 24 bp, Homo sapiens
catagtaacttcttatggaattga

SEQ ID NO: 3503965 - DNA, 20 bp, Homo sapiens
catagtagtttttacagctg

SEQ ID NO: 3503966 - DNA, 15 bp, Homo sapiens
catagtatggtggct

SEQ ID NO: 3503967 - DNA, 17 bp, Homo sapiens
catagtatggtggctgg

SEQ ID NO: 3503968 - DNA, 22 bp, Homo sapiens
catagtggcttaaaacaacact

SEQ ID NO: 3503969 - DNA, 20 bp, Homo sapiens
catataaacatcacacacac

SEQ ID NO: 3503970 - DNA, 14 bp, Homo sapiens
catatacaataatg

SEQ ID NO: 3503971 - DNA, 23 bp, Homo sapiens
catatacaataatgtaatttagt

SEQ ID NO: 3503972 - DNA, 13 bp, Homo sapiens
catatattgcatt

SEQ ID NO: 3503973 - DNA, 16 bp, Homo sapiens
catatattgcatttct

SEQ ID NO: 3503974 - DNA, 15 bp, Homo sapiens
catatcatgtacagt

SEQ ID NO: 3503975 - DNA, 17 bp, Homo sapiens
catatctttattaatca

SEQ ID NO: 3503976 - DNA, 19 bp, Homo sapiens
catatgacattcatgcctg

SEQ ID NO: 3503977 - DNA, 22 bp, Homo sapiens
catatgacattcatgcctggct

SEQ ID NO: 3503978 - DNA, 20 bp, Homo sapiens
catatgactcacatgatgca

SEQ ID NO: 3503979 - DNA, 18 bp, Homo sapiens
catatgcagtgttctaca

SEQ ID NO: 3503980 - DNA, 22 bp, Homo sapiens
catatgtttcgctgatatatgt

SEQ ID NO: 3503981 - DNA, 17 bp, Homo sapiens
catattctgttggccag

SEQ ID NO: 3503982 - DNA, 18 bp, Homo sapiens
catattctgttggccagt

SEQ ID NO: 3503983 - DNA, 23 bp, Homo sapiens
catattgcacaactctactgttg

SEQ ID NO: 3503984 - DNA, 18 bp, Homo sapiens
catattgcacatgtctta

SEQ ID NO: 3503985 - DNA, 21 bp, Homo sapiens
catattgcacatgtcttaatg

SEQ ID NO: 3503986 - DNA, 23 bp, Homo sapiens
catattgcacatgtcttaatgaa

SEQ ID NO: 3503987 - DNA, 16 bp, Homo sapiens
catattgctgagagaa

SEQ ID NO: 3503988 - DNA, 21 bp, Homo sapiens
catattgctgagagaaatatg

SEQ ID NO: 3503989 - DNA, 10 bp, Homo sapiens
catatttaat

SEQ ID NO: 3503990 - DNA, 15 bp, Homo sapiens
catatttaatgtttt

SEQ ID NO: 3503991 - DNA, 21 bp, Homo sapiens
catatttaatgttttaaatgt

SEQ ID NO: 3503992 - DNA, 23 bp, Homo sapiens
catatttaatgttttaaatgtac

SEQ ID NO: 3503993 - DNA, 21 bp, Homo sapiens
catatttatccaaaatgtgta

SEQ ID NO: 3503994 - DNA, 22 bp, Homo sapiens
catatttatccaaaatgtgtat

SEQ ID NO: 3503995 - DNA, 18 bp, Homo sapiens
catattttcaccatttga

SEQ ID NO: 3503996 - DNA, 11 bp, Homo sapiens
catcaaagagg

SEQ ID NO: 3503997 - DNA, 15 bp, Homo sapiens
catcaacaaaaattg

SEQ ID NO: 3503998 - DNA, 14 bp, Homo sapiens
catcaacttaaaag

SEQ ID NO: 3503999 - DNA, 17 bp, Homo sapiens
catcaaggcactgcctg

SEQ ID NO: 3504000 - DNA, 17 bp, Homo sapiens
catcacacctgccctaa

SEQ ID NO: 3504001 - DNA, 17 bp, Homo sapiens
catcaccttaggcaggg

SEQ ID NO: 3504002 - DNA, 18 bp, Homo sapiens
catcaccttaggcaggga

SEQ ID NO: 3504003 - DNA, 17 bp, Homo sapiens
catcactgtggctgtct

SEQ ID NO: 3504004 - DNA, 19 bp, Homo sapiens
catcaggagaaaaagcctc

SEQ ID NO: 3504005 - DNA, 13 bp, Homo sapiens
catcagtgtttgt

SEQ ID NO: 3504006 - DNA, 14 bp, Homo sapiens
catcagtgtttgtt

SEQ ID NO: 3504007 - DNA, 12 bp, Homo sapiens
catcatcagagc

SEQ ID NO: 3504008 - DNA, 17 bp, Homo sapiens
catcatcagtggagcca

SEQ ID NO: 3504009 - DNA, 21 bp, Homo sapiens
catcatggaaagactgggaca

SEQ ID NO: 3504010 - DNA, 16 bp, Homo sapiens
catcattccctctcat

SEQ ID NO: 3504011 - DNA, 23 bp, Homo sapiens
catcattccctctcatctcaggt

SEQ ID NO: 3504012 - DNA, 22 bp, Homo sapiens
catcattccttgagaaaaacaa

SEQ ID NO: 3504013 - DNA, 15 bp, Homo sapiens
catcattctctgtct

SEQ ID NO: 3504014 - DNA, 16 bp, Homo sapiens
catcattctctgtctc

SEQ ID NO: 3504015 - DNA, 22 bp, Homo sapiens
catcattctctgtctcatccat

SEQ ID NO: 3504016 - DNA, 24 bp, Homo sapiens
catcattctctgtctcatccatca

SEQ ID NO: 3504017 - DNA, 18 bp, Homo sapiens
catcattgctgtctgcag

SEQ ID NO: 3504018 - DNA, 22 bp, Homo sapiens
catccactagtgcaaatcatag

SEQ ID NO: 3504019 - DNA, 14 bp, Homo sapiens
catccactgtgcca

SEQ ID NO: 3504020 - DNA, 20 bp, Homo sapiens
catccagagattcattttct

SEQ ID NO: 3504021 - DNA, 15 bp, Homo sapiens
catccagcagtctct

SEQ ID NO: 3504022 - DNA, 20 bp, Homo sapiens
catccagcagtctctgcctt

SEQ ID NO: 3504023 - DNA, 21 bp, Homo sapiens
catccagcagtctctgccttg

SEQ ID NO: 3504024 - DNA, 21 bp, Homo sapiens
catccagggcccccatctcat

SEQ ID NO: 3504025 - DNA, 19 bp, Homo sapiens
catccagggctctgaccag

SEQ ID NO: 3504026 - DNA, 19 bp, Homo sapiens
catccattgtctcttcatg

SEQ ID NO: 3504027 - DNA, 13 bp, Homo sapiens
catcccaactgtc

SEQ ID NO: 3504028 - DNA, 19 bp, Homo sapiens
catccccgcagtgtgcact

SEQ ID NO: 3504029 - DNA, 21 bp, Homo sapiens
catcccctgtagagtgggagc

SEQ ID NO: 3504030 - DNA, 20 bp, Homo sapiens
catccccttacccttagaat

SEQ ID NO: 3504031 - DNA, 22 bp, Homo sapiens
catccccttacccttagaatcc

SEQ ID NO: 3504032 - DNA, 21 bp, Homo sapiens
catcccgggacgcagcaggag

SEQ ID NO: 3504033 - DNA, 18 bp, Homo sapiens
catccctaatgctgcaga

SEQ ID NO: 3504034 - DNA, 19 bp, Homo sapiens
catccctaccgacccaggg

SEQ ID NO: 3504035 - DNA, 13 bp, Homo sapiens
catccgcactgta

SEQ ID NO: 3504036 - DNA, 14 bp, Homo sapiens
catccgcaggtgct

SEQ ID NO: 3504037 - DNA, 13 bp, Homo sapiens
catccgtttttta

SEQ ID NO: 3504038 - DNA, 20 bp, Homo sapiens
catcctaatcatccaatgct

SEQ ID NO: 3504039 - DNA, 19 bp, Homo sapiens
catcctccagtaccttgct

SEQ ID NO: 3504040 - DNA, 14 bp, Homo sapiens
catcctctgactcc

SEQ ID NO: 3504041 - DNA, 15 bp, Homo sapiens
catcctctgactcca

SEQ ID NO: 3504042 - DNA, 23 bp, Homo sapiens
catcctctgactccactcaaaga

SEQ ID NO: 3504043 - DNA, 15 bp, Homo sapiens
catcctgctgggccc

SEQ ID NO: 3504044 - DNA, 15 bp, Homo sapiens
catcctggcacccgg

SEQ ID NO: 3504045 - DNA, 11 bp, Homo sapiens
catcctggctg

SEQ ID NO: 3504046 - DNA, 22 bp, Homo sapiens
catcctgtgtttctagggaaat

SEQ ID NO: 3504047 - DNA, 15 bp, Homo sapiens
catccttatccttca

SEQ ID NO: 3504048 - DNA, 15 bp, Homo sapiens
catcctttacgtgtt

SEQ ID NO: 3504049 - DNA, 15 bp, Homo sapiens
catcgagatggagct

SEQ ID NO: 3504050 - DNA, 21 bp, Homo sapiens
catcgattcaaactgctccaa

SEQ ID NO: 3504051 - DNA, 20 bp, Homo sapiens
catcggacaagacccccagc

SEQ ID NO: 3504052 - DNA, 18 bp, Homo sapiens
catctaacctcatcttct

SEQ ID NO: 3504053 - DNA, 19 bp, Homo sapiens
catctaacctcatcttctt

SEQ ID NO: 3504054 - DNA, 12 bp, Homo sapiens
catctaagcctg

SEQ ID NO: 3504055 - DNA, 19 bp, Homo sapiens
catctatgtcccttgctgt

SEQ ID NO: 3504056 - DNA, 13 bp, Homo sapiens
catctattctctc

SEQ ID NO: 3504057 - DNA, 16 bp, Homo sapiens
catctcaaccatcccc

SEQ ID NO: 3504058 - DNA, 22 bp, Homo sapiens
catctcaatggaaacatcactg

SEQ ID NO: 3504059 - DNA, 20 bp, Homo sapiens
catctcaattgtgctttgta

SEQ ID NO: 3504060 - DNA, 18 bp, Homo sapiens
catctcagggtccagacc

SEQ ID NO: 3504061 - DNA, 19 bp, Homo sapiens
catctcattacccttttct

SEQ ID NO: 3504062 - DNA, 16 bp, Homo sapiens
catctcctgccttcct

SEQ ID NO: 3504063 - DNA, 19 bp, Homo sapiens
catctcctgccttcctcct

SEQ ID NO: 3504064 - DNA, 22 bp, Homo sapiens
catctcctgccttcctcctggg

SEQ ID NO: 3504065 - DNA, 23 bp, Homo sapiens
catctctaacagctcaggatctc

SEQ ID NO: 3504066 - DNA, 15 bp, Homo sapiens
catctctccctcccc

SEQ ID NO: 3504067 - DNA, 16 bp, Homo sapiens
catctctccctcccct

SEQ ID NO: 3504068 - DNA, 23 bp, Homo sapiens
catctctccctcccctgccattt

SEQ ID NO: 3504069 - DNA, 13 bp, Homo sapiens
catctctctgccc

SEQ ID NO: 3504070 - DNA, 15 bp, Homo sapiens
catctctgcctgaca

SEQ ID NO: 3504071 - DNA, 18 bp, Homo sapiens
catctctgcctgacaagg

SEQ ID NO: 3504072 - DNA, 22 bp, Homo sapiens
catctctgcctgacaaggccag

SEQ ID NO: 3504073 - DNA, 13 bp, Homo sapiens
catctctgcttga

SEQ ID NO: 3504074 - DNA, 16 bp, Homo sapiens
catctcttagctcccc

SEQ ID NO: 3504075 - DNA, 18 bp, Homo sapiens
catctcttagctcccctc

SEQ ID NO: 3504076 - DNA, 21 bp, Homo sapiens
catctcttagctcccctccaa

SEQ ID NO: 3504077 - DNA, 14 bp, Homo sapiens
catctctttagaga

SEQ ID NO: 3504078 - DNA, 18 bp, Homo sapiens
catctgcattgcccagtc

SEQ ID NO: 3504079 - DNA, 19 bp, Homo sapiens
catctgcattttcacccca

SEQ ID NO: 3504080 - DNA, 20 bp, Homo sapiens
catctgcattttcaccccac

SEQ ID NO: 3504081 - DNA, 13 bp, Homo sapiens
catctgctctcct

SEQ ID NO: 3504082 - DNA, 20 bp, Homo sapiens
catctgctctccttcctgga

SEQ ID NO: 3504083 - DNA, 14 bp, Homo sapiens
catctgctggtccg

SEQ ID NO: 3504084 - DNA, 14 bp, Homo sapiens
catctggaaagggg

SEQ ID NO: 3504085 - DNA, 17 bp, Homo sapiens
catctggaatctgaggc

SEQ ID NO: 3504086 - DNA, 22 bp, Homo sapiens
catctggaatctgaggcatcct

SEQ ID NO: 3504087 - DNA, 16 bp, Homo sapiens
catctgggctcctcca

SEQ ID NO: 3504088 - DNA, 17 bp, Homo sapiens
catctggttaggatggc

SEQ ID NO: 3504089 - DNA, 12 bp, Homo sapiens
catctgtacaaa

SEQ ID NO: 3504090 - DNA, 16 bp, Homo sapiens
catgtactagtcctct

SEQ ID NO: 3504091 - DNA, 21 bp, Homo sapiens
catgtactagtcctctagaaa

SEQ ID NO: 3504092 - DNA, 22 bp, Homo sapiens
catgtactagttttagttttct

SEQ ID NO: 3504093 - DNA, 13 bp, Homo sapiens
catgtacttgttt

SEQ ID NO: 3504094 - DNA, 17 bp, Homo sapiens
catgtagccccctggcc

SEQ ID NO: 3504095 - DNA, 22 bp, Homo sapiens
catgtagccccctggcctctgt

SEQ ID NO: 3504096 - DNA, 15 bp, Homo sapiens
catgtataaagtgat

SEQ ID NO: 3504097 - DNA, 19 bp, Homo sapiens
catgtatagttttccctat

SEQ ID NO: 3504098 - DNA, 21 bp, Homo sapiens
catgtattcacacacccctca

SEQ ID NO: 3504099 - DNA, 17 bp, Homo sapiens
catgtcagcaaaaagca

SEQ ID NO: 3504100 - DNA, 18 bp, Homo sapiens
catgtcagcaaaaagcaa

SEQ ID NO: 3504101 - DNA, 22 bp, Homo sapiens
catgtcagcaaaaagcaaaatc

SEQ ID NO: 3504102 - DNA, 19 bp, Homo sapiens
catgtcctttgcgcctgtg

SEQ ID NO: 3504103 - DNA, 17 bp, Homo sapiens
catgtctattccattcc

SEQ ID NO: 3504104 - DNA, 23 bp, Homo sapiens
catgtctgcatttcggtggctag

SEQ ID NO: 3504105 - DNA, 12 bp, Homo sapiens
catgtctggcta

SEQ ID NO: 3504106 - DNA, 13 bp, Homo sapiens
catgtcttaatga

SEQ ID NO: 3504107 - DNA, 16 bp, Homo sapiens
catgtcttaatgaagt

SEQ ID NO: 3504108 - DNA, 15 bp, Homo sapiens
catgtcttttaaaat

SEQ ID NO: 3504109 - DNA, 13 bp, Homo sapiens
catgtgaaactca

SEQ ID NO: 3504110 - DNA, 17 bp, Homo sapiens
catgtgaaactcatctc

SEQ ID NO: 3504111 - DNA, 15 bp, Homo sapiens
catgtgcacatgcac

SEQ ID NO: 3504112 - DNA, 16 bp, Homo sapiens
catgtgcctctgtcct

SEQ ID NO: 3504113 - DNA, 17 bp, Homo sapiens
catgtgcctctgtcctt

SEQ ID NO: 3504114 - DNA, 15 bp, Homo sapiens
catgtggccatggcc

SEQ ID NO: 3504115 - DNA, 14 bp, Homo sapiens
catgtggtgatgat

SEQ ID NO: 3504116 - DNA, 18 bp, Homo sapiens
catgtgtgcaacagggta

SEQ ID NO: 3504117 - DNA, 20 bp, Homo sapiens
catgtgtgcgtgtctccatg

SEQ ID NO: 3504118 - DNA, 13 bp, Homo sapiens
catgtgtgtgtgt

SEQ ID NO: 3504119 - DNA, 19 bp, Homo sapiens
catgttaagtcctccctga

SEQ ID NO: 3504120 - DNA, 14 bp, Homo sapiens
catgttaggaaaat

SEQ ID NO: 3504121 - DNA, 18 bp, Homo sapiens
catgttaggaaaatttca

SEQ ID NO: 3504122 - DNA, 23 bp, Homo sapiens
catgttctggtggtttgattgtt

SEQ ID NO: 3504123 - DNA, 20 bp, Homo sapiens
catgttgatcatgtactttt

SEQ ID NO: 3504124 - DNA, 21 bp, Homo sapiens
catgttgatcatgtacttttt

SEQ ID NO: 3504125 - DNA, 23 bp, Homo sapiens
catgttgcacacccactcagctc

SEQ ID NO: 3504126 - DNA, 20 bp, Homo sapiens
catgttgggaaacttggctc

SEQ ID NO: 3504127 - DNA, 14 bp, Homo sapiens
catgtttaaacctg

SEQ ID NO: 3504128 - DNA, 13 bp, Homo sapiens
catgtttataaat

SEQ ID NO: 3504129 - DNA, 13 bp, Homo sapiens
catgtttcctcta

SEQ ID NO: 3504130 - DNA, 10 bp, Homo sapiens
catgtttctt

SEQ ID NO: 3504131 - DNA, 13 bp, Homo sapiens
catgttttaacaa

SEQ ID NO: 3504132 - DNA, 17 bp, Homo sapiens
catgttttaacaaaaac

SEQ ID NO: 3504133 - DNA, 15 bp, Homo sapiens
cattaagaaaatcat

SEQ ID NO: 3504134 - DNA, 17 bp, Homo sapiens
cattaagaaaatcatat

SEQ ID NO: 3504135 - DNA, 23 bp, Homo sapiens
cattaagtggtagtaatttcctt

SEQ ID NO: 3504136 - DNA, 12 bp, Homo sapiens
cattaattctat

SEQ ID NO: 3504137 - DNA, 23 bp, Homo sapiens
cattactataagaactttgagct

SEQ ID NO: 3504138 - DNA, 19 bp, Homo sapiens
cattagaaaaatagcaact

SEQ ID NO: 3504139 - DNA, 11 bp, Homo sapiens
cattagagcag

SEQ ID NO: 3504140 - DNA, 18 bp, Homo sapiens
cattagccagatttgtct

SEQ ID NO: 3504141 - DNA, 18 bp, Homo sapiens
cattagcctgagtagaaa

SEQ ID NO: 3504142 - DNA, 23 bp, Homo sapiens
cattagcctgagtagaaaggcct

SEQ ID NO: 3504143 - DNA, 14 bp, Homo sapiens
cattagttgcacta

SEQ ID NO: 3504144 - DNA, 15 bp, Homo sapiens
cattatccattccca

SEQ ID NO: 3504145 - DNA, 12 bp, Homo sapiens
cattattctatg

SEQ ID NO: 3504146 - DNA, 16 bp, Homo sapiens
cattattctatgtagt

SEQ ID NO: 3504147 - DNA, 18 bp, Homo sapiens
cattcaaaagttgaaatt

SEQ ID NO: 3504148 - DNA, 21 bp, Homo sapiens
cattcaatttcaggctcccca

SEQ ID NO: 3504149 - DNA, 22 bp, Homo sapiens
cattcacagttctttgggccag

SEQ ID NO: 3504150 - DNA, 19 bp, Homo sapiens
cattcacctgccccaactc

SEQ ID NO: 3504151 - DNA, 15 bp, Homo sapiens
cattcacttgcattt

SEQ ID NO: 3504152 - DNA, 15 bp, Homo sapiens
cattcagacacttca

SEQ ID NO: 3504153 - DNA, 19 bp, Homo sapiens
cattcagcagcaaattttc

SEQ ID NO: 3504154 - DNA, 21 bp, Homo sapiens
cattcagtgattactgtcaag

SEQ ID NO: 3504155 - DNA, 14 bp, Homo sapiens
cattcatgcctggc

SEQ ID NO: 3504156 - DNA, 21 bp, Homo sapiens
cattccaagaatagcatctgt

SEQ ID NO: 3504157 - DNA, 17 bp, Homo sapiens
cattccagatcccaggc

SEQ ID NO: 3504158 - DNA, 13 bp, Homo sapiens
cattccagcccct

SEQ ID NO: 3504159 - DNA, 18 bp, Homo sapiens
cattccagcccctctggt

SEQ ID NO: 3504160 - DNA, 23 bp, Homo sapiens
cattccagtcaaatctgggctca

SEQ ID NO: 3504161 - DNA, 18 bp, Homo sapiens
cattcccaagatgcctga

SEQ ID NO: 3504162 - DNA, 14 bp, Homo sapiens
cattcccactgcca

SEQ ID NO: 3504163 - DNA, 15 bp, Homo sapiens
cattcccttcggcca

SEQ ID NO: 3504164 - DNA, 22 bp, Homo sapiens
cattcctaaagaaaaatatctt

SEQ ID NO: 3504165 - DNA, 13 bp, Homo sapiens
cattcctgaagaa

SEQ ID NO: 3504166 - DNA, 16 bp, Homo sapiens
cattcctgttctttct

SEQ ID NO: 3504167 - DNA, 12 bp, Homo sapiens
cattcctttggg

SEQ ID NO: 3504168 - DNA, 16 bp, Homo sapiens
cattcggtgtggtgca

SEQ ID NO: 3504169 - DNA, 15 bp, Homo sapiens
cattctactgaaaag

SEQ ID NO: 3504170 - DNA, 14 bp, Homo sapiens
cattctcaggcacc

SEQ ID NO: 3504171 - DNA, 17 bp, Homo sapiens
cattctcaggcaccagt

SEQ ID NO: 3504172 - DNA, 15 bp, Homo sapiens
cattctccacagcaa

SEQ ID NO: 3504173 - DNA, 15 bp, Homo sapiens
cattctccttgttgt

SEQ ID NO: 3504174 - DNA, 12 bp, Homo sapiens
cattctctgaag

SEQ ID NO: 3504175 - DNA, 14 bp, Homo sapiens
cattctcttttaat

SEQ ID NO: 3504176 - DNA, 19 bp, Homo sapiens
cattctgactcggtttctc

SEQ ID NO: 3504177 - DNA, 11 bp, Homo sapiens
cattctgcaag

SEQ ID NO: 3504178 - DNA, 23 bp, Homo sapiens
cattctgcatttagctgtattca

SEQ ID NO: 3504179 - DNA, 15 bp, Homo sapiens
cattctgcctgccca

SEQ ID NO: 3504180 - DNA, 20 bp, Homo sapiens
cattctgcctgcccaggccc

SEQ ID NO: 3504181 - DNA, 17 bp, Homo sapiens
cattcttgaaagctgtg

SEQ ID NO: 3504182 - DNA, 21 bp, Homo sapiens
cattctttataatcctctgta

SEQ ID NO: 3504183 - DNA, 13 bp, Homo sapiens
cattctttgcagg

SEQ ID NO: 3504184 - DNA, 19 bp, Homo sapiens
cattcttttaaaagacaag

SEQ ID NO: 3504185 - DNA, 15 bp, Homo sapiens
cattcttttgtaatt

SEQ ID NO: 3504186 - DNA, 14 bp, Homo sapiens
cattgaacacaaac

SEQ ID NO: 3504187 - DNA, 15 bp, Homo sapiens
cattgaacacaaact

SEQ ID NO: 3504188 - DNA, 16 bp, Homo sapiens
cattgaacacaaactg

SEQ ID NO: 3504189 - DNA, 17 bp, Homo sapiens
cattgaacacaaactgt

SEQ ID NO: 3504190 - DNA, 22 bp, Homo sapiens
cattgaacacaaactgtaaata

SEQ ID NO: 3504191 - DNA, 23 bp, Homo sapiens
cattgaattcttggttgaggaaa

SEQ ID NO: 3504192 - DNA, 18 bp, Homo sapiens
cattgagaactgcatatg

SEQ ID NO: 3504193 - DNA, 18 bp, Homo sapiens
cattgaggataaattgcc

SEQ ID NO: 3504194 - DNA, 19 bp, Homo sapiens
cattgaggataaattgcca

SEQ ID NO: 3504195 - DNA, 21 bp, Homo sapiens
cattgaggataaattgccata

SEQ ID NO: 3504196 - DNA, 14 bp, Homo sapiens
cattgatggggaag

SEQ ID NO: 3504197 - DNA, 12 bp, Homo sapiens
cattgcacccag

SEQ ID NO: 3504198 - DNA, 18 bp, Homo sapiens
cattgcacccagcccaga

SEQ ID NO: 3504199 - DNA, 17 bp, Homo sapiens
cattgcactccagcctg

SEQ ID NO: 3504200 - DNA, 17 bp, Homo sapiens
cattgcctttgaatgtt

SEQ ID NO: 3504201 - DNA, 14 bp, Homo sapiens
cattgctgagcctc

SEQ ID NO: 3504202 - DNA, 15 bp, Homo sapiens
cattgctgagcctct

SEQ ID NO: 3504203 - DNA, 16 bp, Homo sapiens
cattgctgagcctctg

SEQ ID NO: 3504204 - DNA, 22 bp, Homo sapiens
cattgctgtaggatctaaggct

SEQ ID NO: 3504205 - DNA, 17 bp, Homo sapiens
cattgctgttctacttt

SEQ ID NO: 3504206 - DNA, 21 bp, Homo sapiens
cattgctgttgtccaactatt

SEQ ID NO: 3504207 - DNA, 13 bp, Homo sapiens
cattggctttatc

SEQ ID NO: 3504208 - DNA, 15 bp, Homo sapiens
cattggttaattttt

SEQ ID NO: 3504209 - DNA, 21 bp, Homo sapiens
cattgtatcgatgttatgtaa

SEQ ID NO: 3504210 - DNA, 13 bp, Homo sapiens
cattgtccctctg

SEQ ID NO: 3504211 - DNA, 14 bp, Homo sapiens
cattgtccctctgc

SEQ ID NO: 3504212 - DNA, 22 bp, Homo sapiens
cattgtcgtataggcatgtaaa

SEQ ID NO: 3504213 - DNA, 17 bp, Homo sapiens
cattgtgaaccaatgca

SEQ ID NO: 3504214 - DNA, 16 bp, Homo sapiens
cattgttcaaaaggaa

SEQ ID NO: 3504215 - DNA, 17 bp, Homo sapiens
cattgttggtgttaatt

SEQ ID NO: 3504216 - DNA, 20 bp, Homo sapiens
cattgttggtgttaattgaa

SEQ ID NO: 3504217 - DNA, 22 bp, Homo sapiens
cattgtttgtctgtcttcatag

SEQ ID NO: 3504218 - DNA, 17 bp, Homo sapiens
catttaataatatactt

SEQ ID NO: 3504219 - DNA, 16 bp, Homo sapiens
catttaatttagatat

SEQ ID NO: 3504220 - DNA, 21 bp, Homo sapiens
catttagagaggaaaagtaac

SEQ ID NO: 3504221 - DNA, 22 bp, Homo sapiens
catttagatcctggtttcataa

SEQ ID NO: 3504222 - DNA, 18 bp, Homo sapiens
catttagctgtattcata

SEQ ID NO: 3504223 - DNA, 13 bp, Homo sapiens
ccaagcaggaagc

SEQ ID NO: 3504224 - DNA, 18 bp, Homo sapiens
ccaagcaggaagctcaga

SEQ ID NO: 3504225 - DNA, 18 bp, Homo sapiens
ccaagcaggacagtgctt

SEQ ID NO: 3504226 - DNA, 18 bp, Homo sapiens
ccaagcagtgcctgccta

SEQ ID NO: 3504227 - DNA, 20 bp, Homo sapiens
ccaagcagtgcctgcctatg

SEQ ID NO: 3504228 - DNA, 13 bp, Homo sapiens
ccaagcatcttgg

SEQ ID NO: 3504229 - DNA, 11 bp, Homo sapiens
ccaagccagct

SEQ ID NO: 3504230 - DNA, 15 bp, Homo sapiens
ccaagccagctgcct

SEQ ID NO: 3504231 - DNA, 13 bp, Homo sapiens
ccaagcctgacca

SEQ ID NO: 3504232 - DNA, 16 bp, Homo sapiens
ccaagctatcctggct

SEQ ID NO: 3504233 - DNA, 17 bp, Homo sapiens
ccaagctcaaagcgtgg

SEQ ID NO: 3504234 - DNA, 18 bp, Homo sapiens
ccaagctcaaagcgtgga

SEQ ID NO: 3504235 - DNA, 13 bp, Homo sapiens
ccaagctccaagc

SEQ ID NO: 3504236 - DNA, 17 bp, Homo sapiens
ccaagctccaagcccca

SEQ ID NO: 3504237 - DNA, 14 bp, Homo sapiens
ccaagctccttggg

SEQ ID NO: 3504238 - DNA, 19 bp, Homo sapiens
ccaagctccttgggaggcc

SEQ ID NO: 3504239 - DNA, 15 bp, Homo sapiens
ccaagctctgctcct

SEQ ID NO: 3504240 - DNA, 16 bp, Homo sapiens
ccaagctctgctcctc

SEQ ID NO: 3504241 - DNA, 13 bp, Homo sapiens
ccaagctggctgg

SEQ ID NO: 3504242 - DNA, 23 bp, Homo sapiens
ccaagctggctggggtggcctgt

SEQ ID NO: 3504243 - DNA, 17 bp, Homo sapiens
ccaagcttcaaccctca

SEQ ID NO: 3504244 - DNA, 19 bp, Homo sapiens
ccaagcttcaaccctcagc

SEQ ID NO: 3504245 - DNA, 21 bp, Homo sapiens
ccaagcttccatagctgctgc

SEQ ID NO: 3504246 - DNA, 11 bp, Homo sapiens
ccaagcttccc

SEQ ID NO: 3504247 - DNA, 12 bp, Homo sapiens
ccaagcttccct

SEQ ID NO: 3504248 - DNA, 20 bp, Homo sapiens
ccaaggaaaccacagctgct

SEQ ID NO: 3504249 - DNA, 21 bp, Homo sapiens
ccaaggaaaccacagctgctg

SEQ ID NO: 3504250 - DNA, 15 bp, Homo sapiens
ccaaggagctgctat

SEQ ID NO: 3504251 - DNA, 20 bp, Homo sapiens
ccaaggagggtgagtgcaag

SEQ ID NO: 3504252 - DNA, 15 bp, Homo sapiens
ccaaggcagcgaccc

SEQ ID NO: 3504253 - DNA, 19 bp, Homo sapiens
ccaaggcagcgaccccagg

SEQ ID NO: 3504254 - DNA, 20 bp, Homo sapiens
ccaaggcagcgaccccagga

SEQ ID NO: 3504255 - DNA, 16 bp, Homo sapiens
ccaaggccagggacag

SEQ ID NO: 3504256 - DNA, 21 bp, Homo sapiens
ccaagggaaagaaaaggaagg

SEQ ID NO: 3504257 - DNA, 18 bp, Homo sapiens
ccaagggaacctgtgtcc

SEQ ID NO: 3504258 - DNA, 19 bp, Homo sapiens
ccaagggaacctgtgtccg

SEQ ID NO: 3504259 - DNA, 16 bp, Homo sapiens
ccaagggccagacaga

SEQ ID NO: 3504260 - DNA, 18 bp, Homo sapiens
ccaaggtgaaatgaagca

SEQ ID NO: 3504261 - DNA, 22 bp, Homo sapiens
ccaaggttggagcccagggcat

SEQ ID NO: 3504262 - DNA, 21 bp, Homo sapiens
ccaaggttttataaggctgat

SEQ ID NO: 3504263 - DNA, 17 bp, Homo sapiens
ccaagtaagaggctgga

SEQ ID NO: 3504264 - DNA, 21 bp, Homo sapiens
ccaagtaagaggctggagttg

SEQ ID NO: 3504265 - DNA, 22 bp, Homo sapiens
ccaagtagaatctcagttgatt

SEQ ID NO: 3504266 - DNA, 15 bp, Homo sapiens
ccaagtggcagagct

SEQ ID NO: 3504267 - DNA, 15 bp, Homo sapiens
ccaatagctgcccat

SEQ ID NO: 3504268 - DNA, 15 bp, Homo sapiens
ccaatattaaatctg

SEQ ID NO: 3504269 - DNA, 15 bp, Homo sapiens
ccaatcagagaccag

SEQ ID NO: 3504270 - DNA, 18 bp, Homo sapiens
ccaatcccagctacctca

SEQ ID NO: 3504271 - DNA, 13 bp, Homo sapiens
ccaatcttctttt

SEQ ID NO: 3504272 - DNA, 23 bp, Homo sapiens
ccaatgaaaaaatgtatatgcac

SEQ ID NO: 3504273 - DNA, 13 bp, Homo sapiens
ccaatgccaaaaa

SEQ ID NO: 3504274 - DNA, 22 bp, Homo sapiens
ccaatggaatgtgatgttcatg

SEQ ID NO: 3504275 - DNA, 20 bp, Homo sapiens
ccaatgggtttttccctgta

SEQ ID NO: 3504276 - DNA, 22 bp, Homo sapiens
ccaattatttgactttaattta

SEQ ID NO: 3504277 - DNA, 20 bp, Homo sapiens
ccaattccttgcacatagta

SEQ ID NO: 3504278 - DNA, 22 bp, Homo sapiens
ccaattttaatttagtaaatgt

SEQ ID NO: 3504279 - DNA, 15 bp, Homo sapiens
ccacaactattttca

SEQ ID NO: 3504280 - DNA, 20 bp, Homo sapiens
ccacacaaggatagatgctg

SEQ ID NO: 3504281 - DNA, 24 bp, Homo sapiens
ccacacactgttttttggcttgct

SEQ ID NO: 3504282 - DNA, 14 bp, Homo sapiens
ccacacccagccca

SEQ ID NO: 3504283 - DNA, 14 bp, Homo sapiens
ccacactcagcaca

SEQ ID NO: 3504284 - DNA, 13 bp, Homo sapiens
ccacactggactc

SEQ ID NO: 3504285 - DNA, 14 bp, Homo sapiens
ccacagcaggatcg

SEQ ID NO: 3504286 - DNA, 21 bp, Homo sapiens
ccacagcaggatcgaagggtt

SEQ ID NO: 3504287 - DNA, 15 bp, Homo sapiens
ccacagccagcacct

SEQ ID NO: 3504288 - DNA, 13 bp, Homo sapiens
ccacagctgctgg

SEQ ID NO: 3504289 - DNA, 16 bp, Homo sapiens
ccacagctgctggaga

SEQ ID NO: 3504290 - DNA, 17 bp, Homo sapiens
ccacaggaccctcgccg

SEQ ID NO: 3504291 - DNA, 15 bp, Homo sapiens
ccacagggtctgcct

SEQ ID NO: 3504292 - DNA, 17 bp, Homo sapiens
ccacagggtctgcctcc

SEQ ID NO: 3504293 - DNA, 22 bp, Homo sapiens
ccacaggttcatgccaccatgg

SEQ ID NO: 3504294 - DNA, 14 bp, Homo sapiens
ccacagttgctcta

SEQ ID NO: 3504295 - DNA, 22 bp, Homo sapiens
ccacatataagttgagaaggtg

SEQ ID NO: 3504296 - DNA, 13 bp, Homo sapiens
ccacatcctccac

SEQ ID NO: 3504297 - DNA, 17 bp, Homo sapiens
ccacatcttgctctgct

SEQ ID NO: 3504298 - DNA, 20 bp, Homo sapiens
ccacatcttgctctgctgac

SEQ ID NO: 3504299 - DNA, 17 bp, Homo sapiens
ccacatgcggagaacaa

SEQ ID NO: 3504300 - DNA, 13 bp, Homo sapiens
ccacatttggaat

SEQ ID NO: 3504301 - DNA, 22 bp, Homo sapiens
ccacatttggaatactttttgt

SEQ ID NO: 3504302 - DNA, 17 bp, Homo sapiens
ccaccaagagggacgcc

SEQ ID NO: 3504303 - DNA, 14 bp, Homo sapiens
ccaccacagccagc

SEQ ID NO: 3504304 - DNA, 20 bp, Homo sapiens
ccaccacagccagcacctgg

SEQ ID NO: 3504305 - DNA, 21 bp, Homo sapiens
ccaccaccctgtcttcctctg

SEQ ID NO: 3504306 - DNA, 13 bp, Homo sapiens
ccaccactataaa

SEQ ID NO: 3504307 - DNA, 13 bp, Homo sapiens
ccaccagcctaag

SEQ ID NO: 3504308 - DNA, 18 bp, Homo sapiens
ccaccaggaacctcttca

SEQ ID NO: 3504309 - DNA, 19 bp, Homo sapiens
ccaccaggtgcctttcaaa

SEQ ID NO: 3504310 - DNA, 17 bp, Homo sapiens
ccaccatatgaattgta

SEQ ID NO: 3504311 - DNA, 16 bp, Homo sapiens
ccaccatgcctcacta

SEQ ID NO: 3504312 - DNA, 16 bp, Homo sapiens
ccaccatggccagcca

SEQ ID NO: 3504313 - DNA, 17 bp, Homo sapiens
ccaccatggccagccaa

SEQ ID NO: 3504314 - DNA, 21 bp, Homo sapiens
ccaccatggccagccaacttt

SEQ ID NO: 3504315 - DNA, 17 bp, Homo sapiens
ccacccacctccctgcc

SEQ ID NO: 3504316 - DNA, 14 bp, Homo sapiens
ccacccaggagccc

SEQ ID NO: 3504317 - DNA, 23 bp, Homo sapiens
ccacccaggagccccgaggcctt

SEQ ID NO: 3504318 - DNA, 13 bp, Homo sapiens
ccacccccagttc

SEQ ID NO: 3504319 - DNA, 15 bp, Homo sapiens
ccacccccagttcct

SEQ ID NO: 3504320 - DNA, 19 bp, Homo sapiens
ccaccccctccttccctgt

SEQ ID NO: 3504321 - DNA, 14 bp, Homo sapiens
ccacccctccccat

SEQ ID NO: 3504322 - DNA, 23 bp, Homo sapiens
ccaccccttagattgaagtaaac

SEQ ID NO: 3504323 - DNA, 23 bp, Homo sapiens
ccaccctacttcattttcagagt

SEQ ID NO: 3504324 - DNA, 14 bp, Homo sapiens
ccaccctcctttca

SEQ ID NO: 3504325 - DNA, 16 bp, Homo sapiens
ccaccctgaaagccct

SEQ ID NO: 3504326 - DNA, 13 bp, Homo sapiens
ccaccctgctctc

SEQ ID NO: 3504327 - DNA, 14 bp, Homo sapiens
ccaccctgctgctg

SEQ ID NO: 3504328 - DNA, 16 bp, Homo sapiens
ccaccctgctgctgct

SEQ ID NO: 3504329 - DNA, 13 bp, Homo sapiens
ccaccctgggacc

SEQ ID NO: 3504330 - DNA, 13 bp, Homo sapiens
ccaccctgggccc

SEQ ID NO: 3504331 - DNA, 17 bp, Homo sapiens
ccaccctgggccctggg

SEQ ID NO: 3504332 - DNA, 20 bp, Homo sapiens
ccaccctgggccctgggctg

SEQ ID NO: 3504333 - DNA, 18 bp, Homo sapiens
ccaccctgtcttcctctg

SEQ ID NO: 3504334 - DNA, 13 bp, Homo sapiens
ccacctagcagca

SEQ ID NO: 3504335 - DNA, 23 bp, Homo sapiens
ccacctagcagcaccgttctgtg

SEQ ID NO: 3504336 - DNA, 19 bp, Homo sapiens
ccacctcacctagcctgat

SEQ ID NO: 3504337 - DNA, 16 bp, Homo sapiens
ccacctccctgcctcc

SEQ ID NO: 3504338 - DNA, 17 bp, Homo sapiens
ccacctctccctgaccc

SEQ ID NO: 3504339 - DNA, 18 bp, Homo sapiens
ccacctgcatctggggcc

SEQ ID NO: 3504340 - DNA, 12 bp, Homo sapiens
ccacctgtctca

SEQ ID NO: 3504341 - DNA, 16 bp, Homo sapiens
ccacctgtctcagcct

SEQ ID NO: 3504342 - DNA, 14 bp, Homo sapiens
ccaccttggctcaa

SEQ ID NO: 3504343 - DNA, 15 bp, Homo sapiens
ccaccttggctcaag

SEQ ID NO: 3504344 - DNA, 16 bp, Homo sapiens
ccaccttggctgcagg

SEQ ID NO: 3504345 - DNA, 18 bp, Homo sapiens
ccacgaatttctgtgccc

SEQ ID NO: 3504346 - DNA, 21 bp, Homo sapiens
ccacgaatttctgtgccctcc

SEQ ID NO: 3504347 - DNA, 15 bp, Homo sapiens
ccacgactggccagg

SEQ ID NO: 3504348 - DNA, 18 bp, Homo sapiens
ccacgactggccagggcc

SEQ ID NO: 3504349 - DNA, 16 bp, Homo sapiens
ccacgactgtctccat

SEQ ID NO: 3504350 - DNA, 12 bp, Homo sapiens
ccacgagggctg

SEQ ID NO: 3504351 - DNA, 18 bp, Homo sapiens
ccacgcccgtcctgcctg

SEQ ID NO: 3504352 - DNA, 20 bp, Homo sapiens
ccacgcccgtcctgcctgtg

SEQ ID NO: 3504353 - DNA, 13 bp, Homo sapiens
ccacgctccagct

SEQ ID NO: 3504354 - DNA, 16 bp, Homo sapiens
ccacgctccagctgcc

SEQ ID NO: 3504355 - DNA, 18 bp, Homo sapiens
ccacgctggaccttgaac

SEQ ID NO: 3504356 - DNA, 20 bp, Homo sapiens
ccagggatgattcaagccat

SEQ ID NO: 3504357 - DNA, 21 bp, Homo sapiens
ccagggatgattcaagccatt

SEQ ID NO: 3504358 - DNA, 14 bp, Homo sapiens
ccagggatgggagg

SEQ ID NO: 3504359 - DNA, 19 bp, Homo sapiens
ccagggcatcttgctggct

SEQ ID NO: 3504360 - DNA, 14 bp, Homo sapiens
ccagggccacgctc

SEQ ID NO: 3504361 - DNA, 16 bp, Homo sapiens
ccagggccacgctcca

SEQ ID NO: 3504362 - DNA, 21 bp, Homo sapiens
ccagggcccagagcccagctc

SEQ ID NO: 3504363 - DNA, 23 bp, Homo sapiens
ccagggcccagagcccagctcca

SEQ ID NO: 3504364 - DNA, 18 bp, Homo sapiens
ccagggcccccacaggcc

SEQ ID NO: 3504365 - DNA, 17 bp, Homo sapiens
ccagggcctgagcctgg

SEQ ID NO: 3504366 - DNA, 13 bp, Homo sapiens
ccagggctcctgc

SEQ ID NO: 3504367 - DNA, 20 bp, Homo sapiens
ccagggcttcctcttccggg

SEQ ID NO: 3504368 - DNA, 21 bp, Homo sapiens
ccaggggaaaatcagcctgct

SEQ ID NO: 3504369 - DNA, 18 bp, Homo sapiens
ccagggggatgccactcc

SEQ ID NO: 3504370 - DNA, 19 bp, Homo sapiens
ccaggggggtgaggagctg

SEQ ID NO: 3504371 - DNA, 20 bp, Homo sapiens
ccaggggggtgaggagctgg

SEQ ID NO: 3504372 - DNA, 10 bp, Homo sapiens
ccagggtcag

SEQ ID NO: 3504373 - DNA, 19 bp, Homo sapiens
ccagggtcagaaacaggac

SEQ ID NO: 3504374 - DNA, 14 bp, Homo sapiens
ccagggtgtgtgct

SEQ ID NO: 3504375 - DNA, 13 bp, Homo sapiens
ccaggtccagctc

SEQ ID NO: 3504376 - DNA, 17 bp, Homo sapiens
ccaggtccagctctgga

SEQ ID NO: 3504377 - DNA, 23 bp, Homo sapiens
ccaggtctctccactgctctcag

SEQ ID NO: 3504378 - DNA, 13 bp, Homo sapiens
ccaggtgcccagc

SEQ ID NO: 3504379 - DNA, 15 bp, Homo sapiens
ccaggtgcccagcta

SEQ ID NO: 3504380 - DNA, 18 bp, Homo sapiens
ccaggtgcctttcaaatt

SEQ ID NO: 3504381 - DNA, 20 bp, Homo sapiens
ccaggtgcctttcaaattta

SEQ ID NO: 3504382 - DNA, 13 bp, Homo sapiens
ccaggtgggagcg

SEQ ID NO: 3504383 - DNA, 20 bp, Homo sapiens
ccaggttcaagcgattctcc

SEQ ID NO: 3504384 - DNA, 23 bp, Homo sapiens
ccaggttcaagcgattctcctgc

SEQ ID NO: 3504385 - DNA, 24 bp, Homo sapiens
ccaggttctccgttagctcctgtg

SEQ ID NO: 3504386 - DNA, 11 bp, Homo sapiens
ccagtaaaatt

SEQ ID NO: 3504387 - DNA, 19 bp, Homo sapiens
ccagtaaaattgccatatt

SEQ ID NO: 3504388 - DNA, 17 bp, Homo sapiens
ccagtaaacagaggagt

SEQ ID NO: 3504389 - DNA, 18 bp, Homo sapiens
ccagtacctcctgtctct

SEQ ID NO: 3504390 - DNA, 17 bp, Homo sapiens
ccagtatgacagaggag

SEQ ID NO: 3504391 - DNA, 17 bp, Homo sapiens
ccagtatttttgctgct

SEQ ID NO: 3504392 - DNA, 16 bp, Homo sapiens
ccagtcaaatctgggc

SEQ ID NO: 3504393 - DNA, 22 bp, Homo sapiens
ccagtcaatgttggttactaaa

SEQ ID NO: 3504394 - DNA, 21 bp, Homo sapiens
ccagtcactgtgagctcccag

SEQ ID NO: 3504395 - DNA, 16 bp, Homo sapiens
ccagtccaggctgccg

SEQ ID NO: 3504396 - DNA, 17 bp, Homo sapiens
ccagtcccaccctgctg

SEQ ID NO: 3504397 - DNA, 20 bp, Homo sapiens
ccagtccccagaagcagaga

SEQ ID NO: 3504398 - DNA, 13 bp, Homo sapiens
ccagtccctgtcc

SEQ ID NO: 3504399 - DNA, 13 bp, Homo sapiens
ccagtcctgccac

SEQ ID NO: 3504400 - DNA, 15 bp, Homo sapiens
ccagtcctgctacct

SEQ ID NO: 3504401 - DNA, 21 bp, Homo sapiens
ccagtcctgctacctcccttg

SEQ ID NO: 3504402 - DNA, 13 bp, Homo sapiens
ccagtccttccac

SEQ ID NO: 3504403 - DNA, 16 bp, Homo sapiens
ccagtctccaccagga

SEQ ID NO: 3504404 - DNA, 20 bp, Homo sapiens
ccagtctccaccaggaacct

SEQ ID NO: 3504405 - DNA, 19 bp, Homo sapiens
ccagtctggaatgcagtgg

SEQ ID NO: 3504406 - DNA, 13 bp, Homo sapiens
ccagtctgtggat

SEQ ID NO: 3504407 - DNA, 21 bp, Homo sapiens
ccagtgaatttttgcaataat

SEQ ID NO: 3504408 - DNA, 15 bp, Homo sapiens
ccagtgacctgagga

SEQ ID NO: 3504409 - DNA, 13 bp, Homo sapiens
ccagtgagatgca

SEQ ID NO: 3504410 - DNA, 22 bp, Homo sapiens
ccagtggaggagttcatggaag

SEQ ID NO: 3504411 - DNA, 13 bp, Homo sapiens
ccagtggctgctg

SEQ ID NO: 3504412 - DNA, 16 bp, Homo sapiens
ccagtggctgctgccc

SEQ ID NO: 3504413 - DNA, 21 bp, Homo sapiens
ccagtggctgctgcccaggcc

SEQ ID NO: 3504414 - DNA, 23 bp, Homo sapiens
ccagtgtgacaaggattgctact

SEQ ID NO: 3504415 - DNA, 11 bp, Homo sapiens
ccagtgttttc

SEQ ID NO: 3504416 - DNA, 16 bp, Homo sapiens
ccagtgttttctttga

SEQ ID NO: 3504417 - DNA, 22 bp, Homo sapiens
ccagttaacgtattagttgcca

SEQ ID NO: 3504418 - DNA, 13 bp, Homo sapiens
ccagttcctatga

SEQ ID NO: 3504419 - DNA, 18 bp, Homo sapiens
ccagttcctatgacacag

SEQ ID NO: 3504420 - DNA, 18 bp, Homo sapiens
ccagtttaacctgatgca

SEQ ID NO: 3504421 - DNA, 18 bp, Homo sapiens
ccagttttatccataatg

SEQ ID NO: 3504422 - DNA, 16 bp, Homo sapiens
ccataaccgctgattc

SEQ ID NO: 3504423 - DNA, 14 bp, Homo sapiens
ccataataaaggtt

SEQ ID NO: 3504424 - DNA, 22 bp, Homo sapiens
ccataataaaggttgtgaatgt

SEQ ID NO: 3504425 - DNA, 21 bp, Homo sapiens
ccataatgatggatttaacag

SEQ ID NO: 3504426 - DNA, 22 bp, Homo sapiens
ccataatgatggatttaacagc

SEQ ID NO: 3504427 - DNA, 14 bp, Homo sapiens
ccatacaccccctc

SEQ ID NO: 3504428 - DNA, 18 bp, Homo sapiens
ccatagatactctcttct

SEQ ID NO: 3504429 - DNA, 18 bp, Homo sapiens
ccatagctgctgccctag

SEQ ID NO: 3504430 - DNA, 19 bp, Homo sapiens
ccatagtaccatttataca

SEQ ID NO: 3504431 - DNA, 14 bp, Homo sapiens
ccatagtccctgcc

SEQ ID NO: 3504432 - DNA, 12 bp, Homo sapiens
ccatatcctggt

SEQ ID NO: 3504433 - DNA, 23 bp, Homo sapiens
ccatattctgttggccagtgtga

SEQ ID NO: 3504434 - DNA, 21 bp, Homo sapiens
ccatattgcacatgtcttaat

SEQ ID NO: 3504435 - DNA, 17 bp, Homo sapiens
ccatcaacaaaaattgt

SEQ ID NO: 3504436 - DNA, 18 bp, Homo sapiens
ccatcaacaaaaattgtc

SEQ ID NO: 3504437 - DNA, 14 bp, Homo sapiens
ccatcagcacccca

SEQ ID NO: 3504438 - DNA, 16 bp, Homo sapiens
ccatcagcaccccagt

SEQ ID NO: 3504439 - DNA, 16 bp, Homo sapiens
ccatcagttagagctg

SEQ ID NO: 3504440 - DNA, 16 bp, Homo sapiens
ccatcatcatgtgtgt

SEQ ID NO: 3504441 - DNA, 15 bp, Homo sapiens
ccatccagcttgcca

SEQ ID NO: 3504442 - DNA, 18 bp, Homo sapiens
ccatccaggttcagcttg

SEQ ID NO: 3504443 - DNA, 19 bp, Homo sapiens
ccatccaggttcagcttgt

SEQ ID NO: 3504444 - DNA, 15 bp, Homo sapiens
ccatccattctggaa

SEQ ID NO: 3504445 - DNA, 14 bp, Homo sapiens
ccatcccccactgc

SEQ ID NO: 3504446 - DNA, 17 bp, Homo sapiens
ccatccccgcagtgtgc

SEQ ID NO: 3504447 - DNA, 21 bp, Homo sapiens
ccatcctaatcatccaatgct

SEQ ID NO: 3504448 - DNA, 22 bp, Homo sapiens
ccatcctaatcatccaatgctc

SEQ ID NO: 3504449 - DNA, 13 bp, Homo sapiens
ccatcctcatctc

SEQ ID NO: 3504450 - DNA, 15 bp, Homo sapiens
ccatcctcatctctc

SEQ ID NO: 3504451 - DNA, 15 bp, Homo sapiens
ccatcctccagcagg

SEQ ID NO: 3504452 - DNA, 16 bp, Homo sapiens
ccatcctccagcaggg

SEQ ID NO: 3504453 - DNA, 17 bp, Homo sapiens
ccatcctccagcaggga

SEQ ID NO: 3504454 - DNA, 18 bp, Homo sapiens
ccatctcaggccagagcc

SEQ ID NO: 3504455 - DNA, 20 bp, Homo sapiens
ccatctcatgaggggagagg

SEQ ID NO: 3504456 - DNA, 21 bp, Homo sapiens
ccatctcatgcccctggctgg

SEQ ID NO: 3504457 - DNA, 23 bp, Homo sapiens
ccatctcccccatcccccactgc

SEQ ID NO: 3504458 - DNA, 16 bp, Homo sapiens
ccatctcccctcagct

SEQ ID NO: 3504459 - DNA, 17 bp, Homo sapiens
ccatctcccctcagctc

SEQ ID NO: 3504460 - DNA, 16 bp, Homo sapiens
ccatctctaccccctc

SEQ ID NO: 3504461 - DNA, 14 bp, Homo sapiens
ccatctctccctcc

SEQ ID NO: 3504462 - DNA, 22 bp, Homo sapiens
ccatctggctgtgacagcctct

SEQ ID NO: 3504463 - DNA, 23 bp, Homo sapiens
ccatctggttaggatggcaggac

SEQ ID NO: 3504464 - DNA, 19 bp, Homo sapiens
ccatctgtaaaggggcagc

SEQ ID NO: 3504465 - DNA, 19 bp, Homo sapiens
ccatctgtcttgccagcca

SEQ ID NO: 3504466 - DNA, 17 bp, Homo sapiens
ccatcttacttggcttt

SEQ ID NO: 3504467 - DNA, 14 bp, Homo sapiens
ccatcttcacccag

SEQ ID NO: 3504468 - DNA, 20 bp, Homo sapiens
ccatcttgcttccctaatct

SEQ ID NO: 3504469 - DNA, 14 bp, Homo sapiens
ccatgacccaggct

SEQ ID NO: 3504470 - DNA, 16 bp, Homo sapiens
ccatgacccaggctgg

SEQ ID NO: 3504471 - DNA, 21 bp, Homo sapiens
ccatgagcctcagcatcctgg

SEQ ID NO: 3504472 - DNA, 23 bp, Homo sapiens
ccatgagcctcagcatcctggca

SEQ ID NO: 3504473 - DNA, 18 bp, Homo sapiens
ccatgatggccaggctga

SEQ ID NO: 3504474 - DNA, 19 bp, Homo sapiens
ccatgattaaccacttcag

SEQ ID NO: 3504475 - DNA, 23 bp, Homo sapiens
ccatgcacaagatgccccaggga

SEQ ID NO: 3504476 - DNA, 21 bp, Homo sapiens
ccatgcaccaggactggctgt

SEQ ID NO: 3504477 - DNA, 19 bp, Homo sapiens
ccatgcctgcaaccttgca

SEQ ID NO: 3504478 - DNA, 16 bp, Homo sapiens
ccatgccttaaaccta

SEQ ID NO: 3504479 - DNA, 20 bp, Homo sapiens
ccatgcgccccctccgccct

SEQ ID NO: 3504480 - DNA, 13 bp, Homo sapiens
ccatgctcatctg

SEQ ID NO: 3504481 - DNA, 15 bp, Homo sapiens
ccatgctcctggccc

SEQ ID NO: 3504482 - DNA, 15 bp, Homo sapiens
ccatgctgaggcctg

SEQ ID NO: 3504483 - DNA, 19 bp, Homo sapiens
ccatggacaggctggctcc

SEQ ID NO: 3504484 - DNA, 18 bp, Homo sapiens
ccatggagccagctccct

SEQ ID NO: 3504485 - DNA, 15 bp, Homo sapiens
ccatggccctcccag

SEQ ID NO: 3504486 - DNA, 13 bp, Homo sapiens
ccatggccctgcc

SEQ ID NO: 3504487 - DNA, 17 bp, Homo sapiens
ccatggctgcacagttg

SEQ ID NO: 3504488 - DNA, 23 bp, Homo sapiens
cccaggcaggtcttgaactcctg

SEQ ID NO: 3504489 - DNA, 18 bp, Homo sapiens
cccaggccagcttcgagc

SEQ ID NO: 3504490 - DNA, 21 bp, Homo sapiens
cccaggcccctgccaccctgg

SEQ ID NO: 3504491 - DNA, 22 bp, Homo sapiens
cccaggcccctgccaccctggg

SEQ ID NO: 3504492 - DNA, 13 bp, Homo sapiens
cccaggccctgcc

SEQ ID NO: 3504493 - DNA, 17 bp, Homo sapiens
cccaggcctgagctgct

SEQ ID NO: 3504494 - DNA, 19 bp, Homo sapiens
cccaggcctgagctgcttc

SEQ ID NO: 3504495 - DNA, 19 bp, Homo sapiens
cccaggctggagtgcagtg

SEQ ID NO: 3504496 - DNA, 13 bp, Homo sapiens
cccaggctgggca

SEQ ID NO: 3504497 - DNA, 15 bp, Homo sapiens
cccagggagcggaaa

SEQ ID NO: 3504498 - DNA, 20 bp, Homo sapiens
cccagggagcggaaagcagc

SEQ ID NO: 3504499 - DNA, 21 bp, Homo sapiens
cccagggagcggaaagcagct

SEQ ID NO: 3504500 - DNA, 15 bp, Homo sapiens
cccagggcaagctcc

SEQ ID NO: 3504501 - DNA, 20 bp, Homo sapiens
cccagggcaagctccgcagg

SEQ ID NO: 3504502 - DNA, 19 bp, Homo sapiens
cccagggcatcttgctggc

SEQ ID NO: 3504503 - DNA, 21 bp, Homo sapiens
cccagggcatcttgctggcta

SEQ ID NO: 3504504 - DNA, 15 bp, Homo sapiens
cccagggcccagagc

SEQ ID NO: 3504505 - DNA, 16 bp, Homo sapiens
cccagggcccagagcc

SEQ ID NO: 3504506 - DNA, 17 bp, Homo sapiens
cccagggcccagagccc

SEQ ID NO: 3504507 - DNA, 19 bp, Homo sapiens
cccagggcccagagcccag

SEQ ID NO: 3504508 - DNA, 19 bp, Homo sapiens
cccagggcctgagcctggc

SEQ ID NO: 3504509 - DNA, 14 bp, Homo sapiens
cccagggctcctgc

SEQ ID NO: 3504510 - DNA, 18 bp, Homo sapiens
cccagggtggagtgcagt

SEQ ID NO: 3504511 - DNA, 20 bp, Homo sapiens
cccagggtggagtgcagtgg

SEQ ID NO: 3504512 - DNA, 15 bp, Homo sapiens
cccaggtctctccac

SEQ ID NO: 3504513 - DNA, 19 bp, Homo sapiens
cccaggtctctccactgct

SEQ ID NO: 3504514 - DNA, 20 bp, Homo sapiens
cccaggtctctccactgctc

SEQ ID NO: 3504515 - DNA, 15 bp, Homo sapiens
cccaggtgcagccag

SEQ ID NO: 3504516 - DNA, 14 bp, Homo sapiens
cccagtccttccac

SEQ ID NO: 3504517 - DNA, 16 bp, Homo sapiens
cccagtccttccacct

SEQ ID NO: 3504518 - DNA, 17 bp, Homo sapiens
cccagtccttccacctc

SEQ ID NO: 3504519 - DNA, 13 bp, Homo sapiens
cccagtcgccctt

SEQ ID NO: 3504520 - DNA, 15 bp, Homo sapiens
cccagtctcctctcc

SEQ ID NO: 3504521 - DNA, 14 bp, Homo sapiens
cccagtgcccccac

SEQ ID NO: 3504522 - DNA, 19 bp, Homo sapiens
cccagtgcccccactgacc

SEQ ID NO: 3504523 - DNA, 20 bp, Homo sapiens
cccagtgcccccactgacca

SEQ ID NO: 3504524 - DNA, 17 bp, Homo sapiens
cccagtgccgagaagga

SEQ ID NO: 3504525 - DNA, 16 bp, Homo sapiens
cccagtggctgctgcc

SEQ ID NO: 3504526 - DNA, 14 bp, Homo sapiens
cccagttcaccctg

SEQ ID NO: 3504527 - DNA, 19 bp, Homo sapiens
cccagttcgcctggagccc

SEQ ID NO: 3504528 - DNA, 20 bp, Homo sapiens
cccatagatactctcttctt

SEQ ID NO: 3504529 - DNA, 13 bp, Homo sapiens
cccatcccacacc

SEQ ID NO: 3504530 - DNA, 19 bp, Homo sapiens
cccatcccccactgccaca

SEQ ID NO: 3504531 - DNA, 16 bp, Homo sapiens
cccatccctgtcttta

SEQ ID NO: 3504532 - DNA, 18 bp, Homo sapiens
cccatcctccagcaggga

SEQ ID NO: 3504533 - DNA, 13 bp, Homo sapiens
cccatctcaggac

SEQ ID NO: 3504534 - DNA, 22 bp, Homo sapiens
cccatctcgctccctcccagga

SEQ ID NO: 3504535 - DNA, 23 bp, Homo sapiens
cccatctctccctcccctgccat

SEQ ID NO: 3504536 - DNA, 21 bp, Homo sapiens
cccatctgcacccccctgggc

SEQ ID NO: 3504537 - DNA, 16 bp, Homo sapiens
cccatctggtcatttg

SEQ ID NO: 3504538 - DNA, 16 bp, Homo sapiens
cccatctgtcggccta

SEQ ID NO: 3504539 - DNA, 16 bp, Homo sapiens
cccatctgtgcattct

SEQ ID NO: 3504540 - DNA, 13 bp, Homo sapiens
cccatcttcaccc

SEQ ID NO: 3504541 - DNA, 18 bp, Homo sapiens
cccatcttcgggaccagg

SEQ ID NO: 3504542 - DNA, 18 bp, Homo sapiens
cccatgacccaggctggg

SEQ ID NO: 3504543 - DNA, 19 bp, Homo sapiens
cccatgacccaggctgggc

SEQ ID NO: 3504544 - DNA, 20 bp, Homo sapiens
cccatgagcctcagcatcct

SEQ ID NO: 3504545 - DNA, 12 bp, Homo sapiens
cccatgcactgt

SEQ ID NO: 3504546 - DNA, 16 bp, Homo sapiens
cccatgcactgtgaag

SEQ ID NO: 3504547 - DNA, 13 bp, Homo sapiens
cccatggaatatt

SEQ ID NO: 3504548 - DNA, 22 bp, Homo sapiens
cccatggacaggctggctccag

SEQ ID NO: 3504549 - DNA, 20 bp, Homo sapiens
cccatggctctatttcttct

SEQ ID NO: 3504550 - DNA, 15 bp, Homo sapiens
cccattcacagagcc

SEQ ID NO: 3504551 - DNA, 14 bp, Homo sapiens
cccattcagacact

SEQ ID NO: 3504552 - DNA, 19 bp, Homo sapiens
cccattctgcctgcccagg

SEQ ID NO: 3504553 - DNA, 21 bp, Homo sapiens
cccattctgcctgcccaggcc

SEQ ID NO: 3504554 - DNA, 22 bp, Homo sapiens
cccattctgcctgcccaggccc

SEQ ID NO: 3504555 - DNA, 14 bp, Homo sapiens
cccattcttttgta

SEQ ID NO: 3504556 - DNA, 17 bp, Homo sapiens
cccattcttttgtaatt

SEQ ID NO: 3504557 - DNA, 22 bp, Homo sapiens
cccattcttttgtaatttaaat

SEQ ID NO: 3504558 - DNA, 14 bp, Homo sapiens
cccattgtccctct

SEQ ID NO: 3504559 - DNA, 20 bp, Homo sapiens
cccatttctagaacatccct

SEQ ID NO: 3504560 - DNA, 16 bp, Homo sapiens
cccatttttgagccaa

SEQ ID NO: 3504561 - DNA, 11 bp, Homo sapiens
ccccaaatccg

SEQ ID NO: 3504562 - DNA, 23 bp, Homo sapiens
ccccaaatccgaacctcctctgt

SEQ ID NO: 3504563 - DNA, 22 bp, Homo sapiens
ccccaacaaaccatccagtgac

SEQ ID NO: 3504564 - DNA, 18 bp, Homo sapiens
ccccaacatataaaataa

SEQ ID NO: 3504565 - DNA, 13 bp, Homo sapiens
ccccacagaactg

SEQ ID NO: 3504566 - DNA, 22 bp, Homo sapiens
ccccacaggccccccgcagcac

SEQ ID NO: 3504567 - DNA, 13 bp, Homo sapiens
ccccaccccaggc

SEQ ID NO: 3504568 - DNA, 16 bp, Homo sapiens
ccccaccccaggccct

SEQ ID NO: 3504569 - DNA, 20 bp, Homo sapiens
ccccacccctgggggctctc

SEQ ID NO: 3504570 - DNA, 18 bp, Homo sapiens
ccccacgagggctggctg

SEQ ID NO: 3504571 - DNA, 21 bp, Homo sapiens
ccccactgacagcctcccacc

SEQ ID NO: 3504572 - DNA, 14 bp, Homo sapiens
ccccactgaccaga

SEQ ID NO: 3504573 - DNA, 12 bp, Homo sapiens
ccccactggact

SEQ ID NO: 3504574 - DNA, 14 bp, Homo sapiens
ccccactggggaaa

SEQ ID NO: 3504575 - DNA, 13 bp, Homo sapiens
ccccacttctgtg

SEQ ID NO: 3504576 - DNA, 16 bp, Homo sapiens
ccccacttgcctcttc

SEQ ID NO: 3504577 - DNA, 21 bp, Homo sapiens
ccccacttgcctcttccttga

SEQ ID NO: 3504578 - DNA, 19 bp, Homo sapiens
ccccagattcttcagcttg

SEQ ID NO: 3504579 - DNA, 20 bp, Homo sapiens
ccccagcaagtgagagctgg

SEQ ID NO: 3504580 - DNA, 22 bp, Homo sapiens
ccccagcaagtgagagctgggt

SEQ ID NO: 3504581 - DNA, 20 bp, Homo sapiens
ccccagcagaaccagcctca

SEQ ID NO: 3504582 - DNA, 19 bp, Homo sapiens
ccccagcattccagcccct

SEQ ID NO: 3504583 - DNA, 23 bp, Homo sapiens
ccccagccagatggactccagcc

SEQ ID NO: 3504584 - DNA, 15 bp, Homo sapiens
ccccagcctccctga

SEQ ID NO: 3504585 - DNA, 11 bp, Homo sapiens
ccccagcctgc

SEQ ID NO: 3504586 - DNA, 17 bp, Homo sapiens
ccccagctaagaacctg

SEQ ID NO: 3504587 - DNA, 17 bp, Homo sapiens
ccccagctactctgatc

SEQ ID NO: 3504588 - DNA, 12 bp, Homo sapiens
ccccaggaagcc

SEQ ID NO: 3504589 - DNA, 21 bp, Homo sapiens
ccccaggaccagctcaggaca

SEQ ID NO: 3504590 - DNA, 15 bp, Homo sapiens
ccccaggactcaccc

SEQ ID NO: 3504591 - DNA, 19 bp, Homo sapiens
ccccaggccccaggaagcc

SEQ ID NO: 3504592 - DNA, 20 bp, Homo sapiens
ccccaggccctgccagagca

SEQ ID NO: 3504593 - DNA, 21 bp, Homo sapiens
ccccaggccctgccagagcag

SEQ ID NO: 3504594 - DNA, 16 bp, Homo sapiens
ccccaggcctgagctg

SEQ ID NO: 3504595 - DNA, 18 bp, Homo sapiens
ccccaggcctgagctgct

SEQ ID NO: 3504596 - DNA, 22 bp, Homo sapiens
ccccaggcctgagctgcttcac

SEQ ID NO: 3504597 - DNA, 22 bp, Homo sapiens
ccccaggcttgtcactagcagc

SEQ ID NO: 3504598 - DNA, 19 bp, Homo sapiens
ccccagggcctgagcctgg

SEQ ID NO: 3504599 - DNA, 21 bp, Homo sapiens
ccccaggtccagctctggagg

SEQ ID NO: 3504600 - DNA, 18 bp, Homo sapiens
ccccaggtctctccactg

SEQ ID NO: 3504601 - DNA, 17 bp, Homo sapiens
ccccagtaaaattgcca

SEQ ID NO: 3504602 - DNA, 15 bp, Homo sapiens
ccccagttcgcctgg

SEQ ID NO: 3504603 - DNA, 13 bp, Homo sapiens
ccccatcagtgct

SEQ ID NO: 3504604 - DNA, 13 bp, Homo sapiens
ccccatcccccac

SEQ ID NO: 3504605 - DNA, 16 bp, Homo sapiens
ccccatcccccactgc

SEQ ID NO: 3504606 - DNA, 12 bp, Homo sapiens
ccccatcctcca

SEQ ID NO: 3504607 - DNA, 14 bp, Homo sapiens
ccccatctcaggcc

SEQ ID NO: 3504608 - DNA, 17 bp, Homo sapiens
ccccatctcaggccaga

SEQ ID NO: 3504609 - DNA, 21 bp, Homo sapiens
ccccatctcatgcccctggct

SEQ ID NO: 3504610 - DNA, 23 bp, Homo sapiens
ccccatctcatgcccctggctgg

SEQ ID NO: 3504611 - DNA, 19 bp, Homo sapiens
ccccatctcccctcagctc

SEQ ID NO: 3504612 - DNA, 22 bp, Homo sapiens
ccccatctcgctccctcccagg

SEQ ID NO: 3504613 - DNA, 12 bp, Homo sapiens
ccccatctctcc

SEQ ID NO: 3504614 - DNA, 16 bp, Homo sapiens
ccccatcttcgggacc

SEQ ID NO: 3504615 - DNA, 18 bp, Homo sapiens
ccccatcttcgggaccag

SEQ ID NO: 3504616 - DNA, 19 bp, Homo sapiens
ccccatgcactgtgaagga

SEQ ID NO: 3504617 - DNA, 15 bp, Homo sapiens
ccccattcacagagc

SEQ ID NO: 3504618 - DNA, 21 bp, Homo sapiens
ccccattctgcctgcccaggc

SEQ ID NO: 3504619 - DNA, 15 bp, Homo sapiens
cccccaacactgagc

SEQ ID NO: 3504620 - DNA, 21 bp, Homo sapiens
cccttttttctgcctccttta

SEQ ID NO: 3504621 - DNA, 13 bp, Homo sapiens
ccgaacctcctct

SEQ ID NO: 3504622 - DNA, 13 bp, Homo sapiens
ccgaagtcttttg

SEQ ID NO: 3504623 - DNA, 20 bp, Homo sapiens
ccgaatagctgggactacag

SEQ ID NO: 3504624 - DNA, 23 bp, Homo sapiens
ccgaatctctttttgctttcgaa

SEQ ID NO: 3504625 - DNA, 15 bp, Homo sapiens
ccgaattgagcacaa

SEQ ID NO: 3504626 - DNA, 16 bp, Homo sapiens
ccgaattgagcacaaa

SEQ ID NO: 3504627 - DNA, 12 bp, Homo sapiens
ccgacatttctt

SEQ ID NO: 3504628 - DNA, 16 bp, Homo sapiens
ccgacatttcttcata

SEQ ID NO: 3504629 - DNA, 18 bp, Homo sapiens
ccgaccagacaccttgac

SEQ ID NO: 3504630 - DNA, 21 bp, Homo sapiens
ccgacccagggttcccgcggg

SEQ ID NO: 3504631 - DNA, 19 bp, Homo sapiens
ccgactctttctgagtgcc

SEQ ID NO: 3504632 - DNA, 21 bp, Homo sapiens
ccgactctttctgagtgcctt

SEQ ID NO: 3504633 - DNA, 19 bp, Homo sapiens
ccgagaagcaagaaagaaa

SEQ ID NO: 3504634 - DNA, 19 bp, Homo sapiens
ccgagaggtgggccagtct

SEQ ID NO: 3504635 - DNA, 21 bp, Homo sapiens
ccgagaggtgggccagtctgt

SEQ ID NO: 3504636 - DNA, 20 bp, Homo sapiens
ccgagatcgtgccattgcac

SEQ ID NO: 3504637 - DNA, 19 bp, Homo sapiens
ccgagattgcaccactgca

SEQ ID NO: 3504638 - DNA, 17 bp, Homo sapiens
ccgaggccttctctgaa

SEQ ID NO: 3504639 - DNA, 14 bp, Homo sapiens
ccgagtagctggga

SEQ ID NO: 3504640 - DNA, 20 bp, Homo sapiens
ccgagtagctgggactacag

SEQ ID NO: 3504641 - DNA, 12 bp, Homo sapiens
ccgagtccaagc

SEQ ID NO: 3504642 - DNA, 13 bp, Homo sapiens
ccgagtccaagct

SEQ ID NO: 3504643 - DNA, 17 bp, Homo sapiens
ccgagtgaactggtctt

SEQ ID NO: 3504644 - DNA, 20 bp, Homo sapiens
ccgagtgaactggtcttcct

SEQ ID NO: 3504645 - DNA, 13 bp, Homo sapiens
ccgatttctgtaa

SEQ ID NO: 3504646 - DNA, 14 bp, Homo sapiens
ccgatttctgtaaa

SEQ ID NO: 3504647 - DNA, 16 bp, Homo sapiens
ccgatttctgtaaact

SEQ ID NO: 3504648 - DNA, 16 bp, Homo sapiens
ccgcaaaccacactgg

SEQ ID NO: 3504649 - DNA, 13 bp, Homo sapiens
ccgcagagctggc

SEQ ID NO: 3504650 - DNA, 12 bp, Homo sapiens
ccgcaggaagct

SEQ ID NO: 3504651 - DNA, 15 bp, Homo sapiens
ccgcagtgtgcacta

SEQ ID NO: 3504652 - DNA, 22 bp, Homo sapiens
ccgcagtgtgcactaaggggcc

SEQ ID NO: 3504653 - DNA, 12 bp, Homo sapiens
ccgccaggcgag

SEQ ID NO: 3504654 - DNA, 22 bp, Homo sapiens
ccgcccagagacccaagctgcc

SEQ ID NO: 3504655 - DNA, 19 bp, Homo sapiens
ccgccccaaagtaaaagaa

SEQ ID NO: 3504656 - DNA, 14 bp, Homo sapiens
ccgccctgccactc

SEQ ID NO: 3504657 - DNA, 15 bp, Homo sapiens
ccgccctgccactca

SEQ ID NO: 3504658 - DNA, 14 bp, Homo sapiens
ccgcctccaggagc

SEQ ID NO: 3504659 - DNA, 17 bp, Homo sapiens
ccgcctgaggccagcct

SEQ ID NO: 3504660 - DNA, 20 bp, Homo sapiens
ccgcctgaggccagcctgcg

SEQ ID NO: 3504661 - DNA, 22 bp, Homo sapiens
ccgcctggatgcggatggccgg

SEQ ID NO: 3504662 - DNA, 15 bp, Homo sapiens
ccgcgccacaggacc

SEQ ID NO: 3504663 - DNA, 21 bp, Homo sapiens
ccgcggggctgtcggcgctgc

SEQ ID NO: 3504664 - DNA, 19 bp, Homo sapiens
ccgcgtcgccctcccaggc

SEQ ID NO: 3504665 - DNA, 22 bp, Homo sapiens
ccgcgtgatcaaagccacactc

SEQ ID NO: 3504666 - DNA, 16 bp, Homo sapiens
ccgctacctccctccc

SEQ ID NO: 3504667 - DNA, 22 bp, Homo sapiens
ccgctgattctcagggtctctg

SEQ ID NO: 3504668 - DNA, 11 bp, Homo sapiens
ccgctgccacc

SEQ ID NO: 3504669 - DNA, 15 bp, Homo sapiens
ccgctgccacccacc

SEQ ID NO: 3504670 - DNA, 20 bp, Homo sapiens
ccgctgccacccacctccct

SEQ ID NO: 3504671 - DNA, 24 bp, Homo sapiens
ccgctgccacccacctccctgcct

SEQ ID NO: 3504672 - DNA, 13 bp, Homo sapiens
ccgctgccccagc

SEQ ID NO: 3504673 - DNA, 23 bp, Homo sapiens
ccgctgcttccaggctgggcagc

SEQ ID NO: 3504674 - DNA, 15 bp, Homo sapiens
ccgcttccccacaga

SEQ ID NO: 3504675 - DNA, 16 bp, Homo sapiens
ccgcttccccacagaa

SEQ ID NO: 3504676 - DNA, 17 bp, Homo sapiens
ccgcttccccacagaac

SEQ ID NO: 3504677 - DNA, 15 bp, Homo sapiens
ccgcttggagcagag

SEQ ID NO: 3504678 - DNA, 19 bp, Homo sapiens
ccgctttctacccagcgag

SEQ ID NO: 3504679 - DNA, 16 bp, Homo sapiens
ccggacttttctgcaa

SEQ ID NO: 3504680 - DNA, 14 bp, Homo sapiens
ccggagaggaccgg

SEQ ID NO: 3504681 - DNA, 22 bp, Homo sapiens
ccggagctgcccctctctgggc

SEQ ID NO: 3504682 - DNA, 23 bp, Homo sapiens
ccggaggccagctatctgcctga

SEQ ID NO: 3504683 - DNA, 19 bp, Homo sapiens
ccggcacagatgctccagg

SEQ ID NO: 3504684 - DNA, 19 bp, Homo sapiens
ccggcacctacatccccag

SEQ ID NO: 3504685 - DNA, 15 bp, Homo sapiens
ccggcagccccagcc

SEQ ID NO: 3504686 - DNA, 21 bp, Homo sapiens
ccggcagggcgggcagagggc

SEQ ID NO: 3504687 - DNA, 23 bp, Homo sapiens
ccggcagggcgggcagagggctg

SEQ ID NO: 3504688 - DNA, 11 bp, Homo sapiens
ccggccagccc

SEQ ID NO: 3504689 - DNA, 13 bp, Homo sapiens
ccggcccctgctg

SEQ ID NO: 3504690 - DNA, 21 bp, Homo sapiens
ccggccctcctaccctgcgcc

SEQ ID NO: 3504691 - DNA, 23 bp, Homo sapiens
ccggcctattgcttgggtctctc

SEQ ID NO: 3504692 - DNA, 17 bp, Homo sapiens
ccggcgagccctgtgga

SEQ ID NO: 3504693 - DNA, 13 bp, Homo sapiens
ccggctccaggct

SEQ ID NO: 3504694 - DNA, 15 bp, Homo sapiens
ccggctccaggctcc

SEQ ID NO: 3504695 - DNA, 12 bp, Homo sapiens
ccggctctgtgg

SEQ ID NO: 3504696 - DNA, 15 bp, Homo sapiens
ccggctgcagaggcc

SEQ ID NO: 3504697 - DNA, 16 bp, Homo sapiens
ccggctgtgctgggag

SEQ ID NO: 3504698 - DNA, 21 bp, Homo sapiens
ccgggaacctccccagcctgc

SEQ ID NO: 3504699 - DNA, 18 bp, Homo sapiens
ccgggctgagggcctgct

SEQ ID NO: 3504700 - DNA, 20 bp, Homo sapiens
ccgggtccccagctccccag

SEQ ID NO: 3504701 - DNA, 14 bp, Homo sapiens
ccgggtctgcctct

SEQ ID NO: 3504702 - DNA, 16 bp, Homo sapiens
ccggtggctgggcaga

SEQ ID NO: 3504703 - DNA, 17 bp, Homo sapiens
ccggttcctgtccctgc

SEQ ID NO: 3504704 - DNA, 18 bp, Homo sapiens
ccgtacaacgtgtcctca

SEQ ID NO: 3504705 - DNA, 17 bp, Homo sapiens
ccgtaggacccaagcag

SEQ ID NO: 3504706 - DNA, 20 bp, Homo sapiens
ccgtcaccacgactggccag

SEQ ID NO: 3504707 - DNA, 14 bp, Homo sapiens
ccgtcctgcctgtg

SEQ ID NO: 3504708 - DNA, 15 bp, Homo sapiens
ccgtcctgcctgtgg

SEQ ID NO: 3504709 - DNA, 18 bp, Homo sapiens
ccgtgaaaacggagctga

SEQ ID NO: 3504710 - DNA, 14 bp, Homo sapiens
ccgtgaggatgtca

SEQ ID NO: 3504711 - DNA, 14 bp, Homo sapiens
ccgtgctgacagct

SEQ ID NO: 3504712 - DNA, 16 bp, Homo sapiens
ccgtgctgacagctgc

SEQ ID NO: 3504713 - DNA, 19 bp, Homo sapiens
ccgtgctgacagctgctcc

SEQ ID NO: 3504714 - DNA, 20 bp, Homo sapiens
ccgtgctgacagctgctcct

SEQ ID NO: 3504715 - DNA, 21 bp, Homo sapiens
ccgtggatggccgtggatgcg

SEQ ID NO: 3504716 - DNA, 11 bp, Homo sapiens
ccgtggcacat

SEQ ID NO: 3504717 - DNA, 13 bp, Homo sapiens
ccgtgggcctggg

SEQ ID NO: 3504718 - DNA, 14 bp, Homo sapiens
ccgtgggctccctg

SEQ ID NO: 3504719 - DNA, 17 bp, Homo sapiens
ccgtggggccgccgcct

SEQ ID NO: 3504720 - DNA, 16 bp, Homo sapiens
ccgtggtccctgagga

SEQ ID NO: 3504721 - DNA, 23 bp, Homo sapiens
ccgtgtgagaagtgaatgctggg

SEQ ID NO: 3504722 - DNA, 13 bp, Homo sapiens
ccgtttgcttttg

SEQ ID NO: 3504723 - DNA, 18 bp, Homo sapiens
cctaaaacaaaagctcat

SEQ ID NO: 3504724 - DNA, 22 bp, Homo sapiens
cctaaaaggaaatctcacccca

SEQ ID NO: 3504725 - DNA, 16 bp, Homo sapiens
cctaaaccaaaaactg

SEQ ID NO: 3504726 - DNA, 13 bp, Homo sapiens
cctaaatccaaag

SEQ ID NO: 3504727 - DNA, 13 bp, Homo sapiens
cctaacttctgta

SEQ ID NO: 3504728 - DNA, 13 bp, Homo sapiens
cctaagaagctct

SEQ ID NO: 3504729 - DNA, 20 bp, Homo sapiens
cctaagcttctagaggctca

SEQ ID NO: 3504730 - DNA, 22 bp, Homo sapiens
cctaaggctgcaaggtttaggc

SEQ ID NO: 3504731 - DNA, 15 bp, Homo sapiens
cctaatccaggcaga

SEQ ID NO: 3504732 - DNA, 13 bp, Homo sapiens
cctaatctctgta

SEQ ID NO: 3504733 - DNA, 20 bp, Homo sapiens
cctaattcagccatgtacag

SEQ ID NO: 3504734 - DNA, 14 bp, Homo sapiens
cctacacactgtca

SEQ ID NO: 3504735 - DNA, 22 bp, Homo sapiens
cctacacactgtcatgcttcat

SEQ ID NO: 3504736 - DNA, 21 bp, Homo sapiens
cctacagttgaaaaacagctg

SEQ ID NO: 3504737 - DNA, 15 bp, Homo sapiens
cctacatccccaggt

SEQ ID NO: 3504738 - DNA, 13 bp, Homo sapiens
cctaccacctccc

SEQ ID NO: 3504739 - DNA, 22 bp, Homo sapiens
cctacccagtccccattttctg

SEQ ID NO: 3504740 - DNA, 14 bp, Homo sapiens
cctacccatccccg

SEQ ID NO: 3504741 - DNA, 21 bp, Homo sapiens
cctaccccctgaaagtgacag

SEQ ID NO: 3504742 - DNA, 16 bp, Homo sapiens
cctaccgacccagggt

SEQ ID NO: 3504743 - DNA, 12 bp, Homo sapiens
cctactaataaa

SEQ ID NO: 3504744 - DNA, 17 bp, Homo sapiens
cctactccgctcactga

SEQ ID NO: 3504745 - DNA, 15 bp, Homo sapiens
cctactttagccact

SEQ ID NO: 3504746 - DNA, 20 bp, Homo sapiens
cctacttttgccacaaggtg

SEQ ID NO: 3504747 - DNA, 16 bp, Homo sapiens
cctacttttggcctca

SEQ ID NO: 3504748 - DNA, 23 bp, Homo sapiens
cctagactttaggctttcagctt

SEQ ID NO: 3504749 - DNA, 17 bp, Homo sapiens
cctagcactttgggagg

SEQ ID NO: 3504750 - DNA, 12 bp, Homo sapiens
cctagcagcacc

SEQ ID NO: 3504751 - DNA, 21 bp, Homo sapiens
cctagcagcaccgttctgtgc

SEQ ID NO: 3504752 - DNA, 14 bp, Homo sapiens
cctagcaggcacag

SEQ ID NO: 3504753 - DNA, 19 bp, Homo sapiens
cctgatcagaccacggctc

SEQ ID NO: 3504754 - DNA, 17 bp, Homo sapiens
cctgatgagatttttaa

SEQ ID NO: 3504755 - DNA, 19 bp, Homo sapiens
cctgatgcttttgtctaat

SEQ ID NO: 3504756 - DNA, 16 bp, Homo sapiens
cctgattcaactaaaa

SEQ ID NO: 3504757 - DNA, 17 bp, Homo sapiens
cctgcaaaaggactctc

SEQ ID NO: 3504758 - DNA, 17 bp, Homo sapiens
cctgcaaacgctgcctg

SEQ ID NO: 3504759 - DNA, 20 bp, Homo sapiens
cctgcactccctcctggagc

SEQ ID NO: 3504760 - DNA, 14 bp, Homo sapiens
cctgcacttacttg

SEQ ID NO: 3504761 - DNA, 17 bp, Homo sapiens
cctgcacttacttgctt

SEQ ID NO: 3504762 - DNA, 19 bp, Homo sapiens
cctgcacttgcagactcta

SEQ ID NO: 3504763 - DNA, 14 bp, Homo sapiens
cctgcagagcacac

SEQ ID NO: 3504764 - DNA, 16 bp, Homo sapiens
cctgcagagcacacag

SEQ ID NO: 3504765 - DNA, 23 bp, Homo sapiens
cctgcagcaggaatatatgtgtg

SEQ ID NO: 3504766 - DNA, 15 bp, Homo sapiens
cctgcaggacctgcc

SEQ ID NO: 3504767 - DNA, 16 bp, Homo sapiens
cctgcaggccaggcca

SEQ ID NO: 3504768 - DNA, 15 bp, Homo sapiens
cctgcagtcatcttg

SEQ ID NO: 3504769 - DNA, 21 bp, Homo sapiens
cctgcagtggggtttcgcagc

SEQ ID NO: 3504770 - DNA, 18 bp, Homo sapiens
cctgcatctgaccagcag

SEQ ID NO: 3504771 - DNA, 15 bp, Homo sapiens
cctgcatctggggcc

SEQ ID NO: 3504772 - DNA, 20 bp, Homo sapiens
cctgcatgtaaacacgcctg

SEQ ID NO: 3504773 - DNA, 15 bp, Homo sapiens
cctgccaccaccctg

SEQ ID NO: 3504774 - DNA, 18 bp, Homo sapiens
cctgccaccaccctgtct

SEQ ID NO: 3504775 - DNA, 13 bp, Homo sapiens
cctgccaccagca

SEQ ID NO: 3504776 - DNA, 14 bp, Homo sapiens
cctgccaccagcat

SEQ ID NO: 3504777 - DNA, 12 bp, Homo sapiens
cctgccaccagg

SEQ ID NO: 3504778 - DNA, 13 bp, Homo sapiens
cctgccaccaggc

SEQ ID NO: 3504779 - DNA, 15 bp, Homo sapiens
cctgccaccaggcca

SEQ ID NO: 3504780 - DNA, 18 bp, Homo sapiens
cctgccaccaggccacct

SEQ ID NO: 3504781 - DNA, 13 bp, Homo sapiens
cctgccaccctgg

SEQ ID NO: 3504782 - DNA, 14 bp, Homo sapiens
cctgccacctcctg

SEQ ID NO: 3504783 - DNA, 16 bp, Homo sapiens
cctgccacctcctgcc

SEQ ID NO: 3504784 - DNA, 14 bp, Homo sapiens
cctgccagagcagg

SEQ ID NO: 3504785 - DNA, 12 bp, Homo sapiens
cctgccagctgc

SEQ ID NO: 3504786 - DNA, 16 bp, Homo sapiens
cctgccagctgcactg

SEQ ID NO: 3504787 - DNA, 18 bp, Homo sapiens
cctgccagctgcactgat

SEQ ID NO: 3504788 - DNA, 13 bp, Homo sapiens
cctgccatagcca

SEQ ID NO: 3504789 - DNA, 16 bp, Homo sapiens
cctgccatgcaagaac

SEQ ID NO: 3504790 - DNA, 20 bp, Homo sapiens
cctgccatggaactgtttcc

SEQ ID NO: 3504791 - DNA, 14 bp, Homo sapiens
cctgcccaggcccc

SEQ ID NO: 3504792 - DNA, 19 bp, Homo sapiens
cctgcccaggcccctgcca

SEQ ID NO: 3504793 - DNA, 22 bp, Homo sapiens
cctgcccaggcccctgccaccc

SEQ ID NO: 3504794 - DNA, 21 bp, Homo sapiens
cctgccccaactctcccctga

SEQ ID NO: 3504795 - DNA, 15 bp, Homo sapiens
cctgcccccaggact

SEQ ID NO: 3504796 - DNA, 17 bp, Homo sapiens
cctgcccccaggactgg

SEQ ID NO: 3504797 - DNA, 18 bp, Homo sapiens
cctgcccccaggactggg

SEQ ID NO: 3504798 - DNA, 22 bp, Homo sapiens
cctgcccccaggactgggccac

SEQ ID NO: 3504799 - DNA, 20 bp, Homo sapiens
cctgcccgtaaacacgcctg

SEQ ID NO: 3504800 - DNA, 23 bp, Homo sapiens
cctgcccgtaaacacgcctgcaa

SEQ ID NO: 3504801 - DNA, 15 bp, Homo sapiens
cctgcccgtgtacat

SEQ ID NO: 3504802 - DNA, 16 bp, Homo sapiens
cctgcccttgtcccac

SEQ ID NO: 3504803 - DNA, 20 bp, Homo sapiens
cctgcccttttttctgcctc

SEQ ID NO: 3504804 - DNA, 22 bp, Homo sapiens
cctgcccttttttctgcctcct

SEQ ID NO: 3504805 - DNA, 13 bp, Homo sapiens
cctgccgcagagc

SEQ ID NO: 3504806 - DNA, 15 bp, Homo sapiens
cctgccgcagagctg

SEQ ID NO: 3504807 - DNA, 16 bp, Homo sapiens
cctgccggagaggaag

SEQ ID NO: 3504808 - DNA, 18 bp, Homo sapiens
cctgccggagaggaagag

SEQ ID NO: 3504809 - DNA, 21 bp, Homo sapiens
cctgccggagaggaagagaca

SEQ ID NO: 3504810 - DNA, 16 bp, Homo sapiens
cctgccgggctgaggg

SEQ ID NO: 3504811 - DNA, 19 bp, Homo sapiens
cctgccgggctgagggcct

SEQ ID NO: 3504812 - DNA, 23 bp, Homo sapiens
cctgccgggctgagggcctgctg

SEQ ID NO: 3504813 - DNA, 13 bp, Homo sapiens
cctgcctcagcct

SEQ ID NO: 3504814 - DNA, 14 bp, Homo sapiens
cctgcctcagcctc

SEQ ID NO: 3504815 - DNA, 15 bp, Homo sapiens
cctgcctcagcctcc

SEQ ID NO: 3504816 - DNA, 16 bp, Homo sapiens
cctgcctcagcctccc

SEQ ID NO: 3504817 - DNA, 20 bp, Homo sapiens
cctgcctccaggaaccacac

SEQ ID NO: 3504818 - DNA, 16 bp, Homo sapiens
cctgcctccttgaaag

SEQ ID NO: 3504819 - DNA, 14 bp, Homo sapiens
cctgcctgtctgcc

SEQ ID NO: 3504820 - DNA, 21 bp, Homo sapiens
cctgccttaccgagagccaaa

SEQ ID NO: 3504821 - DNA, 17 bp, Homo sapiens
cctgccttcctcctggg

SEQ ID NO: 3504822 - DNA, 23 bp, Homo sapiens
cctgccttggagtcgtctggcat

SEQ ID NO: 3504823 - DNA, 16 bp, Homo sapiens
cctgcgccagtcctgc

SEQ ID NO: 3504824 - DNA, 13 bp, Homo sapiens
cctgcgcctgctg

SEQ ID NO: 3504825 - DNA, 14 bp, Homo sapiens
cctgcggcaggact

SEQ ID NO: 3504826 - DNA, 23 bp, Homo sapiens
cctgcgggtgaacaaagcagcca

SEQ ID NO: 3504827 - DNA, 20 bp, Homo sapiens
cctgcgggtggggcttgggg

SEQ ID NO: 3504828 - DNA, 16 bp, Homo sapiens
cctgctactctgttcc

SEQ ID NO: 3504829 - DNA, 13 bp, Homo sapiens
cctgctccagacc

SEQ ID NO: 3504830 - DNA, 16 bp, Homo sapiens
cctgctgcatgccctc

SEQ ID NO: 3504831 - DNA, 20 bp, Homo sapiens
cctgctgcatgccctctcag

SEQ ID NO: 3504832 - DNA, 17 bp, Homo sapiens
cctgctgctgcctgcct

SEQ ID NO: 3504833 - DNA, 15 bp, Homo sapiens
cctgctgctgctcct

SEQ ID NO: 3504834 - DNA, 21 bp, Homo sapiens
cctgctgctgctcctccctct

SEQ ID NO: 3504835 - DNA, 18 bp, Homo sapiens
cctgctgctgtcacctct

SEQ ID NO: 3504836 - DNA, 14 bp, Homo sapiens
cctgctgcttctcc

SEQ ID NO: 3504837 - DNA, 16 bp, Homo sapiens
cctgctgcttctccaa

SEQ ID NO: 3504838 - DNA, 14 bp, Homo sapiens
cctgctggaagccc

SEQ ID NO: 3504839 - DNA, 12 bp, Homo sapiens
cctgctgggccc

SEQ ID NO: 3504840 - DNA, 13 bp, Homo sapiens
cctgctgggcccc

SEQ ID NO: 3504841 - DNA, 20 bp, Homo sapiens
cctgctgtcaagtcccccag

SEQ ID NO: 3504842 - DNA, 17 bp, Homo sapiens
cctgctgtctctctggg

SEQ ID NO: 3504843 - DNA, 21 bp, Homo sapiens
cctgcttgatgggattctgga

SEQ ID NO: 3504844 - DNA, 12 bp, Homo sapiens
cctggaagacag

SEQ ID NO: 3504845 - DNA, 22 bp, Homo sapiens
cctggaagacagagacctcctg

SEQ ID NO: 3504846 - DNA, 14 bp, Homo sapiens
cctggaagagccca

SEQ ID NO: 3504847 - DNA, 23 bp, Homo sapiens
cctggacatgaagattctttccc

SEQ ID NO: 3504848 - DNA, 15 bp, Homo sapiens
cctggacatgcctgt

SEQ ID NO: 3504849 - DNA, 16 bp, Homo sapiens
cctggacatgcctgtc

SEQ ID NO: 3504850 - DNA, 18 bp, Homo sapiens
cctggagactgcccagct

SEQ ID NO: 3504851 - DNA, 15 bp, Homo sapiens
cctggagatcctcct

SEQ ID NO: 3504852 - DNA, 19 bp, Homo sapiens
cctggagatcctcctgcag

SEQ ID NO: 3504853 - DNA, 13 bp, Homo sapiens
cctggagcccaga

SEQ ID NO: 3504854 - DNA, 15 bp, Homo sapiens
cctggagctctgtgg

SEQ ID NO: 3504855 - DNA, 12 bp, Homo sapiens
cctggaggccca

SEQ ID NO: 3504856 - DNA, 14 bp, Homo sapiens
cctggaggcccagt

SEQ ID NO: 3504857 - DNA, 14 bp, Homo sapiens
cctggaggtggctg

SEQ ID NO: 3504858 - DNA, 21 bp, Homo sapiens
cctggaggtggctgagcccct

SEQ ID NO: 3504859 - DNA, 15 bp, Homo sapiens
cctggagtttgggat

SEQ ID NO: 3504860 - DNA, 12 bp, Homo sapiens
cctggatgtctg

SEQ ID NO: 3504861 - DNA, 22 bp, Homo sapiens
cctggcacccggcccctgctgg

SEQ ID NO: 3504862 - DNA, 23 bp, Homo sapiens
cctggcacccggcccctgctggt

SEQ ID NO: 3504863 - DNA, 12 bp, Homo sapiens
cctggcactgga

SEQ ID NO: 3504864 - DNA, 15 bp, Homo sapiens
cctggcactggaccc

SEQ ID NO: 3504865 - DNA, 14 bp, Homo sapiens
cctggcagctcagc

SEQ ID NO: 3504866 - DNA, 17 bp, Homo sapiens
cctggcagctctggaca

SEQ ID NO: 3504867 - DNA, 23 bp, Homo sapiens
cctggcagctctggacagcccca

SEQ ID NO: 3504868 - DNA, 14 bp, Homo sapiens
cctggccaacatgg

SEQ ID NO: 3504869 - DNA, 13 bp, Homo sapiens
cctggccagacac

SEQ ID NO: 3504870 - DNA, 18 bp, Homo sapiens
cctggccagacacaggcc

SEQ ID NO: 3504871 - DNA, 23 bp, Homo sapiens
cctggccagacacaggccctccc

SEQ ID NO: 3504872 - DNA, 21 bp, Homo sapiens
cctggccagatgcaccagccc

SEQ ID NO: 3504873 - DNA, 15 bp, Homo sapiens
cctggccagcctaca

SEQ ID NO: 3504874 - DNA, 15 bp, Homo sapiens
cctggccagggcctg

SEQ ID NO: 3504875 - DNA, 19 bp, Homo sapiens
cctggccagggcctggaag

SEQ ID NO: 3504876 - DNA, 16 bp, Homo sapiens
cctggcccactgcatc

SEQ ID NO: 3504877 - DNA, 13 bp, Homo sapiens
cctggccccagga

SEQ ID NO: 3504878 - DNA, 15 bp, Homo sapiens
cctggccccctgagt

SEQ ID NO: 3504879 - DNA, 18 bp, Homo sapiens
cctggccccgcctgcctg

SEQ ID NO: 3504880 - DNA, 19 bp, Homo sapiens
cctggccgagtccaagctg

SEQ ID NO: 3504881 - DNA, 22 bp, Homo sapiens
cctggcctcaagtgattctcct

SEQ ID NO: 3504882 - DNA, 15 bp, Homo sapiens
cctggcctcccctgc

SEQ ID NO: 3504883 - DNA, 14 bp, Homo sapiens
cctggcctctgtgc

SEQ ID NO: 3504884 - DNA, 23 bp, Homo sapiens
cctggctctgggccgggcctggg

SEQ ID NO: 3504885 - DNA, 17 bp, Homo sapiens
cctgggaaatattccct

SEQ ID NO: 3504886 - DNA, 16 bp, Homo sapiens
ccttcgaaaggccttc

SEQ ID NO: 3504887 - DNA, 14 bp, Homo sapiens
ccttcgctcctgtg

SEQ ID NO: 3504888 - DNA, 18 bp, Homo sapiens
ccttcgctcctgtgtctt

SEQ ID NO: 3504889 - DNA, 20 bp, Homo sapiens
ccttcgcttcttgcctctgt

SEQ ID NO: 3504890 - DNA, 18 bp, Homo sapiens
ccttcggccaaacagaca

SEQ ID NO: 3504891 - DNA, 14 bp, Homo sapiens
ccttcgggctgtgc

SEQ ID NO: 3504892 - DNA, 15 bp, Homo sapiens
ccttcgggctgtgcc

SEQ ID NO: 3504893 - DNA, 17 bp, Homo sapiens
ccttcgtctttcccatg

SEQ ID NO: 3504894 - DNA, 11 bp, Homo sapiens
ccttctcacca

SEQ ID NO: 3504895 - DNA, 16 bp, Homo sapiens
ccttctccctcatttc

SEQ ID NO: 3504896 - DNA, 15 bp, Homo sapiens
ccttctcctcttgta

SEQ ID NO: 3504897 - DNA, 16 bp, Homo sapiens
ccttctctcactgtgt

SEQ ID NO: 3504898 - DNA, 21 bp, Homo sapiens
ccttctctcatctcttagctc

SEQ ID NO: 3504899 - DNA, 12 bp, Homo sapiens
ccttctgctcag

SEQ ID NO: 3504900 - DNA, 19 bp, Homo sapiens
ccttctgtccctcacagca

SEQ ID NO: 3504901 - DNA, 21 bp, Homo sapiens
ccttctgtcctactctgtgtc

SEQ ID NO: 3504902 - DNA, 20 bp, Homo sapiens
ccttctgttttgagttttgt

SEQ ID NO: 3504903 - DNA, 12 bp, Homo sapiens
ccttcttaagat

SEQ ID NO: 3504904 - DNA, 16 bp, Homo sapiens
ccttcttcagggcctg

SEQ ID NO: 3504905 - DNA, 17 bp, Homo sapiens
ccttcttcagggcctgg

SEQ ID NO: 3504906 - DNA, 23 bp, Homo sapiens
ccttctttttctgagacagcttg

SEQ ID NO: 3504907 - DNA, 13 bp, Homo sapiens
ccttgacagggca

SEQ ID NO: 3504908 - DNA, 14 bp, Homo sapiens
ccttgacagggcac

SEQ ID NO: 3504909 - DNA, 17 bp, Homo sapiens
ccttgacagggcacacc

SEQ ID NO: 3504910 - DNA, 18 bp, Homo sapiens
ccttgacagggcacaccg

SEQ ID NO: 3504911 - DNA, 15 bp, Homo sapiens
ccttgaccaggcctg

SEQ ID NO: 3504912 - DNA, 16 bp, Homo sapiens
ccttgaccaggcctgg

SEQ ID NO: 3504913 - DNA, 14 bp, Homo sapiens
ccttgacctttgta

SEQ ID NO: 3504914 - DNA, 15 bp, Homo sapiens
ccttgacctttgtac

SEQ ID NO: 3504915 - DNA, 17 bp, Homo sapiens
ccttgacctttgtacag

SEQ ID NO: 3504916 - DNA, 20 bp, Homo sapiens
ccttgactttgctcctcaca

SEQ ID NO: 3504917 - DNA, 14 bp, Homo sapiens
ccttgagaaacctt

SEQ ID NO: 3504918 - DNA, 21 bp, Homo sapiens
ccttgagagaccaggcaaagc

SEQ ID NO: 3504919 - DNA, 20 bp, Homo sapiens
ccttgagttgattcagctct

SEQ ID NO: 3504920 - DNA, 14 bp, Homo sapiens
ccttgatgactgcc

SEQ ID NO: 3504921 - DNA, 15 bp, Homo sapiens
ccttgatgactgcct

SEQ ID NO: 3504922 - DNA, 17 bp, Homo sapiens
ccttgatgactgccttg

SEQ ID NO: 3504923 - DNA, 23 bp, Homo sapiens
ccttgccagggaggtggaaggac

SEQ ID NO: 3504924 - DNA, 14 bp, Homo sapiens
ccttgcctcctcag

SEQ ID NO: 3504925 - DNA, 12 bp, Homo sapiens
ccttgcctggcc

SEQ ID NO: 3504926 - DNA, 21 bp, Homo sapiens
ccttgcggggataaagagaga

SEQ ID NO: 3504927 - DNA, 15 bp, Homo sapiens
ccttgcttttgcttc

SEQ ID NO: 3504928 - DNA, 21 bp, Homo sapiens
ccttgcttttgcttctagagc

SEQ ID NO: 3504929 - DNA, 15 bp, Homo sapiens
ccttggaggacagtg

SEQ ID NO: 3504930 - DNA, 16 bp, Homo sapiens
ccttggaggacagtgg

SEQ ID NO: 3504931 - DNA, 15 bp, Homo sapiens
ccttggcaccagaca

SEQ ID NO: 3504932 - DNA, 20 bp, Homo sapiens
ccttggcaccagacacccag

SEQ ID NO: 3504933 - DNA, 21 bp, Homo sapiens
ccttggcaccagacacccagg

SEQ ID NO: 3504934 - DNA, 13 bp, Homo sapiens
ccttggccttctc

SEQ ID NO: 3504935 - DNA, 22 bp, Homo sapiens
ccttggccttctcccctcttct

SEQ ID NO: 3504936 - DNA, 12 bp, Homo sapiens
ccttggctcaga

SEQ ID NO: 3504937 - DNA, 15 bp, Homo sapiens
ccttggctcagacat

SEQ ID NO: 3504938 - DNA, 14 bp, Homo sapiens
ccttggctgcaggg

SEQ ID NO: 3504939 - DNA, 13 bp, Homo sapiens
ccttggcttgccc

SEQ ID NO: 3504940 - DNA, 15 bp, Homo sapiens
ccttggcttgcccac

SEQ ID NO: 3504941 - DNA, 12 bp, Homo sapiens
ccttgggctccc

SEQ ID NO: 3504942 - DNA, 15 bp, Homo sapiens
ccttgggggctccca

SEQ ID NO: 3504943 - DNA, 15 bp, Homo sapiens
ccttgggtggcccct

SEQ ID NO: 3504944 - DNA, 16 bp, Homo sapiens
ccttgtggcctgggcc

SEQ ID NO: 3504945 - DNA, 16 bp, Homo sapiens
ccttgttacccatgaa

SEQ ID NO: 3504946 - DNA, 16 bp, Homo sapiens
ccttgttacttctgag

SEQ ID NO: 3504947 - DNA, 19 bp, Homo sapiens
ccttgtttacacataccct

SEQ ID NO: 3504948 - DNA, 21 bp, Homo sapiens
cctttaaaatttttttagaaa

SEQ ID NO: 3504949 - DNA, 22 bp, Homo sapiens
cctttaccctctttgctgcaga

SEQ ID NO: 3504950 - DNA, 15 bp, Homo sapiens
cctttacgtgtttaa

SEQ ID NO: 3504951 - DNA, 20 bp, Homo sapiens
cctttactgaccctggggct

SEQ ID NO: 3504952 - DNA, 19 bp, Homo sapiens
cctttagggttctgcctct

SEQ ID NO: 3504953 - DNA, 14 bp, Homo sapiens
cctttcaaatttag

SEQ ID NO: 3504954 - DNA, 21 bp, Homo sapiens
cctttcaaatttagaaactaa

SEQ ID NO: 3504955 - DNA, 21 bp, Homo sapiens
cctttcacaaaattttattcc

SEQ ID NO: 3504956 - DNA, 23 bp, Homo sapiens
cctttcaccaccccctccttccc

SEQ ID NO: 3504957 - DNA, 19 bp, Homo sapiens
cctttcccaggtgctacac

SEQ ID NO: 3504958 - DNA, 15 bp, Homo sapiens
cctttccccttcctt

SEQ ID NO: 3504959 - DNA, 16 bp, Homo sapiens
cctttccccttccttt

SEQ ID NO: 3504960 - DNA, 16 bp, Homo sapiens
cctttcctacattttc

SEQ ID NO: 3504961 - DNA, 14 bp, Homo sapiens
cctttcgaggcctg

SEQ ID NO: 3504962 - DNA, 15 bp, Homo sapiens
cctttcgaggcctga

SEQ ID NO: 3504963 - DNA, 18 bp, Homo sapiens
cctttctcccctgccccc

SEQ ID NO: 3504964 - DNA, 19 bp, Homo sapiens
cctttctcccctgccccca

SEQ ID NO: 3504965 - DNA, 20 bp, Homo sapiens
cctttctcccctgcccccag

SEQ ID NO: 3504966 - DNA, 20 bp, Homo sapiens
cctttctcttttcccctttc

SEQ ID NO: 3504967 - DNA, 12 bp, Homo sapiens
cctttgaatgta

SEQ ID NO: 3504968 - DNA, 12 bp, Homo sapiens
cctttgagcctg

SEQ ID NO: 3504969 - DNA, 23 bp, Homo sapiens
cctttgcctccagaagcactggg

SEQ ID NO: 3504970 - DNA, 11 bp, Homo sapiens
cctttgctgtc

SEQ ID NO: 3504971 - DNA, 18 bp, Homo sapiens
cctttgctttttcttctc

SEQ ID NO: 3504972 - DNA, 12 bp, Homo sapiens
cctttgggtgtg

SEQ ID NO: 3504973 - DNA, 15 bp, Homo sapiens
cctttggttctggcc

SEQ ID NO: 3504974 - DNA, 22 bp, Homo sapiens
cctttggtttggcctccatcct

SEQ ID NO: 3504975 - DNA, 17 bp, Homo sapiens
ccttttacatactgctg

SEQ ID NO: 3504976 - DNA, 18 bp, Homo sapiens
ccttttacatactgctgt

SEQ ID NO: 3504977 - DNA, 22 bp, Homo sapiens
ccttttatgtagtaattgacat

SEQ ID NO: 3504978 - DNA, 12 bp, Homo sapiens
ccttttctattc

SEQ ID NO: 3504979 - DNA, 18 bp, Homo sapiens
ccttttctgtctctctct

SEQ ID NO: 3504980 - DNA, 17 bp, Homo sapiens
ccttttcttctatgtag

SEQ ID NO: 3504981 - DNA, 21 bp, Homo sapiens
ccttttgaaattaacctctca

SEQ ID NO: 3504982 - DNA, 14 bp, Homo sapiens
cctttttacacttt

SEQ ID NO: 3504983 - DNA, 13 bp, Homo sapiens
cctttttccttcc

SEQ ID NO: 3504984 - DNA, 13 bp, Homo sapiens
ccttttttaaaaa

SEQ ID NO: 3504985 - DNA, 16 bp, Homo sapiens
ccttttttaaaaatgc

SEQ ID NO: 3504986 - DNA, 20 bp, Homo sapiens
ccttttttctgcctccttta

SEQ ID NO: 3504987 - DNA, 22 bp, Homo sapiens
ccttttttgttttttcaaaata

SEQ ID NO: 3504988 - DNA, 13 bp, Homo sapiens
cgaaacagcgctg

SEQ ID NO: 3504989 - DNA, 16 bp, Homo sapiens
cgaaaggatgagcaga

SEQ ID NO: 3504990 - DNA, 14 bp, Homo sapiens
cgaatacaaaattg

SEQ ID NO: 3504991 - DNA, 19 bp, Homo sapiens
cgaatacttttgccctttg

SEQ ID NO: 3504992 - DNA, 16 bp, Homo sapiens
cgaatctctgtgcctt

SEQ ID NO: 3504993 - DNA, 17 bp, Homo sapiens
cgacactgggaggccag

SEQ ID NO: 3504994 - DNA, 22 bp, Homo sapiens
cgaccccaaaggaacactgaca

SEQ ID NO: 3504995 - DNA, 16 bp, Homo sapiens
cgactccgttggccac

SEQ ID NO: 3504996 - DNA, 18 bp, Homo sapiens
cgactctatagactctag

SEQ ID NO: 3504997 - DNA, 15 bp, Homo sapiens
cgactggccagggcc

SEQ ID NO: 3504998 - DNA, 20 bp, Homo sapiens
cgactggccagggccacgct

SEQ ID NO: 3504999 - DNA, 16 bp, Homo sapiens
cgagaactttcatttt

SEQ ID NO: 3505000 - DNA, 15 bp, Homo sapiens
cgagaagcaagaaag

SEQ ID NO: 3505001 - DNA, 20 bp, Homo sapiens
cgagaggtgggccagtctgt

SEQ ID NO: 3505002 - DNA, 23 bp, Homo sapiens
cgagaggtgggccagtctgtgga

SEQ ID NO: 3505003 - DNA, 13 bp, Homo sapiens
cgagcacctccac

SEQ ID NO: 3505004 - DNA, 17 bp, Homo sapiens
cgagcagtcctgcctca

SEQ ID NO: 3505005 - DNA, 23 bp, Homo sapiens
cgagcagtcctgcctcagcctcc

SEQ ID NO: 3505006 - DNA, 20 bp, Homo sapiens
cgagcccctcggctctggag

SEQ ID NO: 3505007 - DNA, 22 bp, Homo sapiens
cgagctctcaaatccctctcca

SEQ ID NO: 3505008 - DNA, 13 bp, Homo sapiens
cgaggacagggag

SEQ ID NO: 3505009 - DNA, 14 bp, Homo sapiens
cgaggacagggagg

SEQ ID NO: 3505010 - DNA, 21 bp, Homo sapiens
cgaggacatgaaactccacct

SEQ ID NO: 3505011 - DNA, 20 bp, Homo sapiens
cgaggaggctccagagggca

SEQ ID NO: 3505012 - DNA, 11 bp, Homo sapiens
cgagggctggc

SEQ ID NO: 3505013 - DNA, 17 bp, Homo sapiens
cgagggctggctggcct

SEQ ID NO: 3505014 - DNA, 12 bp, Homo sapiens
cgagtactgtgg

SEQ ID NO: 3505015 - DNA, 16 bp, Homo sapiens
cgagtagctgggacta

SEQ ID NO: 3505016 - DNA, 17 bp, Homo sapiens
cgagtcacattctgctt

SEQ ID NO: 3505017 - DNA, 18 bp, Homo sapiens
cgagtcattcgttctgtg

SEQ ID NO: 3505018 - DNA, 19 bp, Homo sapiens
cgagtcattcgttctgtgg

SEQ ID NO: 3505019 - DNA, 22 bp, Homo sapiens
cgtggctgcgtgcccctgctgc

SEQ ID NO: 3505020 - DNA, 19 bp, Homo sapiens
cgtgggacggtgcccaagc

SEQ ID NO: 3505021 - DNA, 16 bp, Homo sapiens
cgtggtccctgaggat

SEQ ID NO: 3505022 - DNA, 12 bp, Homo sapiens
cgtgtttgtgtt

SEQ ID NO: 3505023 - DNA, 14 bp, Homo sapiens
cgttagaggaaaaa

SEQ ID NO: 3505024 - DNA, 15 bp, Homo sapiens
cgttagctcctgtgg

SEQ ID NO: 3505025 - DNA, 15 bp, Homo sapiens
cgttcagcagactgg

SEQ ID NO: 3505026 - DNA, 16 bp, Homo sapiens
cgttggagaagcccgt

SEQ ID NO: 3505027 - DNA, 13 bp, Homo sapiens
cgttggtctctgc

SEQ ID NO: 3505028 - DNA, 21 bp, Homo sapiens
cgttgtaaaatatagctgtac

SEQ ID NO: 3505029 - DNA, 22 bp, Homo sapiens
cgtttcagcgactccgttggcc

SEQ ID NO: 3505030 - DNA, 12 bp, Homo sapiens
cgtttgaccaat

SEQ ID NO: 3505031 - DNA, 18 bp, Homo sapiens
cgtttgaccaatttgcac

SEQ ID NO: 3505032 - DNA, 16 bp, Homo sapiens
cgtttgagaagaaaac

SEQ ID NO: 3505033 - DNA, 21 bp, Homo sapiens
cgtttgagaagaaaacatcta

SEQ ID NO: 3505034 - DNA, 17 bp, Homo sapiens
cgtttggaagatcctgt

SEQ ID NO: 3505035 - DNA, 22 bp, Homo sapiens
cgtttggaagatcctgtgagga

SEQ ID NO: 3505036 - DNA, 16 bp, Homo sapiens
cgttttttcctcagtg

SEQ ID NO: 3505037 - DNA, 16 bp, Homo sapiens
ctaaaaaaaaaaaagt

SEQ ID NO: 3505038 - DNA, 17 bp, Homo sapiens
ctaaaaaaaaaaaagta

SEQ ID NO: 3505039 - DNA, 22 bp, Homo sapiens
ctaaaaaagatatattaaaaat

SEQ ID NO: 3505040 - DNA, 13 bp, Homo sapiens
ctaaaaatgcaac

SEQ ID NO: 3505041 - DNA, 20 bp, Homo sapiens
ctaaaacaaaagctcatcca

SEQ ID NO: 3505042 - DNA, 17 bp, Homo sapiens
ctaaaacaataaaattt

SEQ ID NO: 3505043 - DNA, 17 bp, Homo sapiens
ctaaaaccattccattt

SEQ ID NO: 3505044 - DNA, 16 bp, Homo sapiens
ctaaaagatataagtg

SEQ ID NO: 3505045 - DNA, 17 bp, Homo sapiens
ctaaaagatataagtgc

SEQ ID NO: 3505046 - DNA, 19 bp, Homo sapiens
ctaaaagtgggcttgattc

SEQ ID NO: 3505047 - DNA, 23 bp, Homo sapiens
ctaaaagtgggcttgattctgca

SEQ ID NO: 3505048 - DNA, 15 bp, Homo sapiens
ctaaaagtttgagga

SEQ ID NO: 3505049 - DNA, 18 bp, Homo sapiens
ctaaaatagaatatagca

SEQ ID NO: 3505050 - DNA, 18 bp, Homo sapiens
ctaaaatatataatttat

SEQ ID NO: 3505051 - DNA, 14 bp, Homo sapiens
ctaaacagactcat

SEQ ID NO: 3505052 - DNA, 23 bp, Homo sapiens
ctaaaccaaggactgagcaccct

SEQ ID NO: 3505053 - DNA, 19 bp, Homo sapiens
ctaaacccaatccaaatgg

SEQ ID NO: 3505054 - DNA, 12 bp, Homo sapiens
ctaaacctcagt

SEQ ID NO: 3505055 - DNA, 14 bp, Homo sapiens
ctaaactccttcct

SEQ ID NO: 3505056 - DNA, 15 bp, Homo sapiens
ctaaactccttcctg

SEQ ID NO: 3505057 - DNA, 17 bp, Homo sapiens
ctaaactccttcctggc

SEQ ID NO: 3505058 - DNA, 22 bp, Homo sapiens
ctaaactctctttgggaatgtt

SEQ ID NO: 3505059 - DNA, 14 bp, Homo sapiens
ctaaagtgtttagc

SEQ ID NO: 3505060 - DNA, 11 bp, Homo sapiens
ctaaagttata

SEQ ID NO: 3505061 - DNA, 20 bp, Homo sapiens
ctaaataaaagttttacaaa

SEQ ID NO: 3505062 - DNA, 22 bp, Homo sapiens
ctaaataaaagttttacaaagg

SEQ ID NO: 3505063 - DNA, 17 bp, Homo sapiens
ctaaatacttgctccat

SEQ ID NO: 3505064 - DNA, 23 bp, Homo sapiens
ctaaatattcagaatctttgtta

SEQ ID NO: 3505065 - DNA, 14 bp, Homo sapiens
ctaaatccaaagaa

SEQ ID NO: 3505066 - DNA, 15 bp, Homo sapiens
ctaaatccaaagaaa

SEQ ID NO: 3505067 - DNA, 12 bp, Homo sapiens
ctaaatggcctc

SEQ ID NO: 3505068 - DNA, 19 bp, Homo sapiens
ctaaatggcctcatgtggc

SEQ ID NO: 3505069 - DNA, 16 bp, Homo sapiens
ctaaatttattaaata

SEQ ID NO: 3505070 - DNA, 17 bp, Homo sapiens
ctaaatttattaaataa

SEQ ID NO: 3505071 - DNA, 13 bp, Homo sapiens
ctaaattttctga

SEQ ID NO: 3505072 - DNA, 17 bp, Homo sapiens
ctaaccacgctggacct

SEQ ID NO: 3505073 - DNA, 15 bp, Homo sapiens
ctaacctcatcttct

SEQ ID NO: 3505074 - DNA, 13 bp, Homo sapiens
ctaacctcgccct

SEQ ID NO: 3505075 - DNA, 17 bp, Homo sapiens
ctaacctcgccctctcc

SEQ ID NO: 3505076 - DNA, 12 bp, Homo sapiens
ctaactaaactc

SEQ ID NO: 3505077 - DNA, 19 bp, Homo sapiens
ctaactaaactctctttgg

SEQ ID NO: 3505078 - DNA, 19 bp, Homo sapiens
ctaactcagaaacatcagt

SEQ ID NO: 3505079 - DNA, 20 bp, Homo sapiens
ctaactgctacaaatactct

SEQ ID NO: 3505080 - DNA, 13 bp, Homo sapiens
ctaactgtaaatc

SEQ ID NO: 3505081 - DNA, 15 bp, Homo sapiens
ctaagaaaagatttt

SEQ ID NO: 3505082 - DNA, 20 bp, Homo sapiens
ctaagaaaagattttaatca

SEQ ID NO: 3505083 - DNA, 13 bp, Homo sapiens
ctaagaagctctg

SEQ ID NO: 3505084 - DNA, 22 bp, Homo sapiens
ctaagaagctctggccccaggc

SEQ ID NO: 3505085 - DNA, 17 bp, Homo sapiens
ctaagaatacagctttc

SEQ ID NO: 3505086 - DNA, 18 bp, Homo sapiens
ctaagagtgtcctaggag

SEQ ID NO: 3505087 - DNA, 18 bp, Homo sapiens
ctaagagttgagctctcg

SEQ ID NO: 3505088 - DNA, 15 bp, Homo sapiens
ctaagcagaggaggg

SEQ ID NO: 3505089 - DNA, 16 bp, Homo sapiens
ctaagcagaggagggg

SEQ ID NO: 3505090 - DNA, 22 bp, Homo sapiens
ctaagcatatcgtaaagctgtt

SEQ ID NO: 3505091 - DNA, 14 bp, Homo sapiens
ctaagcctgtggct

SEQ ID NO: 3505092 - DNA, 14 bp, Homo sapiens
ctaagcttctagag

SEQ ID NO: 3505093 - DNA, 21 bp, Homo sapiens
ctaagcttctagaggctcatg

SEQ ID NO: 3505094 - DNA, 20 bp, Homo sapiens
ctaaggaggggaaaaaaatg

SEQ ID NO: 3505095 - DNA, 22 bp, Homo sapiens
ctaaggaggggaaaaaaatgtt

SEQ ID NO: 3505096 - DNA, 12 bp, Homo sapiens
ctaaggggcccg

SEQ ID NO: 3505097 - DNA, 23 bp, Homo sapiens
ctaagtacctttcctacattttc

SEQ ID NO: 3505098 - DNA, 20 bp, Homo sapiens
ctaagtgatcctcccacctc

SEQ ID NO: 3505099 - DNA, 13 bp, Homo sapiens
ctaagtttcagtt

SEQ ID NO: 3505100 - DNA, 19 bp, Homo sapiens
ctaagtttcagttgatttt

SEQ ID NO: 3505101 - DNA, 13 bp, Homo sapiens
ctaatagaactca

SEQ ID NO: 3505102 - DNA, 21 bp, Homo sapiens
ctaataggctggggtttttgt

SEQ ID NO: 3505103 - DNA, 15 bp, Homo sapiens
ctaatatcaaatgca

SEQ ID NO: 3505104 - DNA, 23 bp, Homo sapiens
ctaatatcaaatgcagtatattt

SEQ ID NO: 3505105 - DNA, 15 bp, Homo sapiens
ctaatccaatacctc

SEQ ID NO: 3505106 - DNA, 17 bp, Homo sapiens
ctaatccaggcagatcc

SEQ ID NO: 3505107 - DNA, 18 bp, Homo sapiens
ctaatccaggcagatcca

SEQ ID NO: 3505108 - DNA, 20 bp, Homo sapiens
ctaatgaggagagaaaatat

SEQ ID NO: 3505109 - DNA, 23 bp, Homo sapiens
ctaatgaggagagaaaatatatg

SEQ ID NO: 3505110 - DNA, 12 bp, Homo sapiens
ctaatgctcctt

SEQ ID NO: 3505111 - DNA, 18 bp, Homo sapiens
ctaatggcatgagaaata

SEQ ID NO: 3505112 - DNA, 17 bp, Homo sapiens
ctaattaaccttactaa

SEQ ID NO: 3505113 - DNA, 16 bp, Homo sapiens
ctaattatactacttt

SEQ ID NO: 3505114 - DNA, 18 bp, Homo sapiens
ctaattatactactttgt

SEQ ID NO: 3505115 - DNA, 20 bp, Homo sapiens
ctaattcagccatgtacaga

SEQ ID NO: 3505116 - DNA, 16 bp, Homo sapiens
ctaattcttctgtcct

SEQ ID NO: 3505117 - DNA, 13 bp, Homo sapiens
ctaattgacttta

SEQ ID NO: 3505118 - DNA, 14 bp, Homo sapiens
ctaatttaaagaga

SEQ ID NO: 3505119 - DNA, 21 bp, Homo sapiens
ctaatttatcttgtctctggg

SEQ ID NO: 3505120 - DNA, 19 bp, Homo sapiens
ctaatttcaaaatgctttt

SEQ ID NO: 3505121 - DNA, 12 bp, Homo sapiens
ctaatttgcatt

SEQ ID NO: 3505122 - DNA, 19 bp, Homo sapiens
ctaattttacatgtttata

SEQ ID NO: 3505123 - DNA, 20 bp, Homo sapiens
ctaattttacatgtttataa

SEQ ID NO: 3505124 - DNA, 23 bp, Homo sapiens
ctaatttttaagaaattttgcct

SEQ ID NO: 3505125 - DNA, 14 bp, Homo sapiens
ctaatttttgtaat

SEQ ID NO: 3505126 - DNA, 18 bp, Homo sapiens
ctaatttttgtattattt

SEQ ID NO: 3505127 - DNA, 19 bp, Homo sapiens
ctaatttttgtattatttt

SEQ ID NO: 3505128 - DNA, 19 bp, Homo sapiens
ctacaaaaagcataaaaat

SEQ ID NO: 3505129 - DNA, 16 bp, Homo sapiens
ctacaaaataaagctg

SEQ ID NO: 3505130 - DNA, 23 bp, Homo sapiens
ctacacgagatacagaattttat

SEQ ID NO: 3505131 - DNA, 18 bp, Homo sapiens
ctacagaggccatgggcc

SEQ ID NO: 3505132 - DNA, 20 bp, Homo sapiens
ctacagaggccatgggcctc

SEQ ID NO: 3505133 - DNA, 22 bp, Homo sapiens
ctacagaggccatgggcctcct

SEQ ID NO: 3505134 - DNA, 23 bp, Homo sapiens
ctacagatgatagaggattttat

SEQ ID NO: 3505135 - DNA, 14 bp, Homo sapiens
ctacagctatgaag

SEQ ID NO: 3505136 - DNA, 17 bp, Homo sapiens
ctacagctatgaagaaa

SEQ ID NO: 3505137 - DNA, 20 bp, Homo sapiens
ctacagctgttatctttcct

SEQ ID NO: 3505138 - DNA, 19 bp, Homo sapiens
ctacagctttgatccctga

SEQ ID NO: 3505139 - DNA, 15 bp, Homo sapiens
ctacaggcacccacc

SEQ ID NO: 3505140 - DNA, 12 bp, Homo sapiens
ctacagggccaa

SEQ ID NO: 3505141 - DNA, 14 bp, Homo sapiens
ctacaggtgtgagt

SEQ ID NO: 3505142 - DNA, 14 bp, Homo sapiens
ctacagtcaggaaa

SEQ ID NO: 3505143 - DNA, 13 bp, Homo sapiens
ctacagttgaaaa

SEQ ID NO: 3505144 - DNA, 22 bp, Homo sapiens
ctacagttgaaaaacagctgag

SEQ ID NO: 3505145 - DNA, 14 bp, Homo sapiens
ctacatattgtctg

SEQ ID NO: 3505146 - DNA, 16 bp, Homo sapiens
ctacatccccaggtct

SEQ ID NO: 3505147 - DNA, 15 bp, Homo sapiens
ctaccacctccccag

SEQ ID NO: 3505148 - DNA, 16 bp, Homo sapiens
ctaccacctccccagc

SEQ ID NO: 3505149 - DNA, 20 bp, Homo sapiens
ctaccattttacatttctat

SEQ ID NO: 3505150 - DNA, 19 bp, Homo sapiens
ctacccagcgagccctggt

SEQ ID NO: 3505151 - DNA, 20 bp, Homo sapiens
ctacccagcgagccctggtg

SEQ ID NO: 3505152 - DNA, 15 bp, Homo sapiens
ctcactctgtttcct

SEQ ID NO: 3505153 - DNA, 14 bp, Homo sapiens
ctcactgcagcctc

SEQ ID NO: 3505154 - DNA, 15 bp, Homo sapiens
ctcactgcagcctca

SEQ ID NO: 3505155 - DNA, 22 bp, Homo sapiens
ctcactgccatgccagcttatc

SEQ ID NO: 3505156 - DNA, 23 bp, Homo sapiens
ctcactgtgggaaggccagctgc

SEQ ID NO: 3505157 - DNA, 21 bp, Homo sapiens
ctcactgtgttactgctttgc

SEQ ID NO: 3505158 - DNA, 21 bp, Homo sapiens
ctcactgttgaattttctcta

SEQ ID NO: 3505159 - DNA, 14 bp, Homo sapiens
ctcactgttgccca

SEQ ID NO: 3505160 - DNA, 16 bp, Homo sapiens
ctcactgttgcccagg

SEQ ID NO: 3505161 - DNA, 18 bp, Homo sapiens
ctcactgttgcccaggct

SEQ ID NO: 3505162 - DNA, 22 bp, Homo sapiens
ctcactgttgcccaggctggcg

SEQ ID NO: 3505163 - DNA, 19 bp, Homo sapiens
ctcacttttggaaggtgac

SEQ ID NO: 3505164 - DNA, 17 bp, Homo sapiens
ctcagaacttgctgctg

SEQ ID NO: 3505165 - DNA, 23 bp, Homo sapiens
ctcagaacttgctgctgtcttgt

SEQ ID NO: 3505166 - DNA, 15 bp, Homo sapiens
ctcagaatccaaaga

SEQ ID NO: 3505167 - DNA, 11 bp, Homo sapiens
ctcagaatcta

SEQ ID NO: 3505168 - DNA, 12 bp, Homo sapiens
ctcagacatttt

SEQ ID NO: 3505169 - DNA, 14 bp, Homo sapiens
ctcagaccagagaa

SEQ ID NO: 3505170 - DNA, 15 bp, Homo sapiens
ctcagaccagagaag

SEQ ID NO: 3505171 - DNA, 16 bp, Homo sapiens
ctcagaccagctcttc

SEQ ID NO: 3505172 - DNA, 22 bp, Homo sapiens
ctcagagacaggtggcctagca

SEQ ID NO: 3505173 - DNA, 15 bp, Homo sapiens
ctcagagagggcagg

SEQ ID NO: 3505174 - DNA, 13 bp, Homo sapiens
ctcagagtgcaag

SEQ ID NO: 3505175 - DNA, 21 bp, Homo sapiens
ctcagatcagtgtaccatttg

SEQ ID NO: 3505176 - DNA, 10 bp, Homo sapiens
ctcagatcca

SEQ ID NO: 3505177 - DNA, 15 bp, Homo sapiens
ctcagatccagggac

SEQ ID NO: 3505178 - DNA, 16 bp, Homo sapiens
ctcagatccagggaca

SEQ ID NO: 3505179 - DNA, 20 bp, Homo sapiens
ctcagatggaaccgcaggaa

SEQ ID NO: 3505180 - DNA, 20 bp, Homo sapiens
ctcagcaaaagatgcttctc

SEQ ID NO: 3505181 - DNA, 13 bp, Homo sapiens
ctcagcatcctgg

SEQ ID NO: 3505182 - DNA, 21 bp, Homo sapiens
ctcagcatcctggcacccggc

SEQ ID NO: 3505183 - DNA, 13 bp, Homo sapiens
ctcagccagcact

SEQ ID NO: 3505184 - DNA, 12 bp, Homo sapiens
ctcagcccagct

SEQ ID NO: 3505185 - DNA, 20 bp, Homo sapiens
ctcagcccctgatcctgtga

SEQ ID NO: 3505186 - DNA, 15 bp, Homo sapiens
ctcagccctgaccct

SEQ ID NO: 3505187 - DNA, 13 bp, Homo sapiens
ctcagcctcccaa

SEQ ID NO: 3505188 - DNA, 20 bp, Homo sapiens
ctcagcctcccaaccccagg

SEQ ID NO: 3505189 - DNA, 20 bp, Homo sapiens
ctcagcctcccagagtgctg

SEQ ID NO: 3505190 - DNA, 22 bp, Homo sapiens
ctcagcctcccgaatagctggg

SEQ ID NO: 3505191 - DNA, 20 bp, Homo sapiens
ctcagcctggccagacacag

SEQ ID NO: 3505192 - DNA, 18 bp, Homo sapiens
ctcagccttgaaaaacaa

SEQ ID NO: 3505193 - DNA, 20 bp, Homo sapiens
ctcagccttgactatgtcta

SEQ ID NO: 3505194 - DNA, 23 bp, Homo sapiens
ctcagccttgactatgtctagag

SEQ ID NO: 3505195 - DNA, 15 bp, Homo sapiens
ctcagccttgccaga

SEQ ID NO: 3505196 - DNA, 20 bp, Homo sapiens
ctcagccttgccagagatcc

SEQ ID NO: 3505197 - DNA, 13 bp, Homo sapiens
ctcagcggggaca

SEQ ID NO: 3505198 - DNA, 18 bp, Homo sapiens
ctcagcggggacagctcc

SEQ ID NO: 3505199 - DNA, 23 bp, Homo sapiens
ctcagcggggacagctccttctg

SEQ ID NO: 3505200 - DNA, 19 bp, Homo sapiens
ctcagctccccagagtcct

SEQ ID NO: 3505201 - DNA, 14 bp, Homo sapiens
ctcagctcggctca

SEQ ID NO: 3505202 - DNA, 20 bp, Homo sapiens
ctcagctctcagttgcagcc

SEQ ID NO: 3505203 - DNA, 13 bp, Homo sapiens
ctcagctctggtc

SEQ ID NO: 3505204 - DNA, 22 bp, Homo sapiens
ctcagctctggtccaggccctg

SEQ ID NO: 3505205 - DNA, 17 bp, Homo sapiens
ctcagctcttggctcca

SEQ ID NO: 3505206 - DNA, 17 bp, Homo sapiens
ctcagcttccccaacac

SEQ ID NO: 3505207 - DNA, 22 bp, Homo sapiens
ctcagcttccccaacacgcagg

SEQ ID NO: 3505208 - DNA, 12 bp, Homo sapiens
ctcaggaagaac

SEQ ID NO: 3505209 - DNA, 13 bp, Homo sapiens
ctcaggaagaaca

SEQ ID NO: 3505210 - DNA, 12 bp, Homo sapiens
ctcaggacagat

SEQ ID NO: 3505211 - DNA, 18 bp, Homo sapiens
ctcaggacagatgccaca

SEQ ID NO: 3505212 - DNA, 20 bp, Homo sapiens
ctcaggaccaaagctttcat

SEQ ID NO: 3505213 - DNA, 22 bp, Homo sapiens
ctcaggaccaaagctttcatgt

SEQ ID NO: 3505214 - DNA, 12 bp, Homo sapiens
ctcaggaccagg

SEQ ID NO: 3505215 - DNA, 15 bp, Homo sapiens
ctcaggaccaggcaa

SEQ ID NO: 3505216 - DNA, 18 bp, Homo sapiens
ctcaggactcactctgct

SEQ ID NO: 3505217 - DNA, 17 bp, Homo sapiens
ctcaggaggcaggacct

SEQ ID NO: 3505218 - DNA, 13 bp, Homo sapiens
ctcaggatctctt

SEQ ID NO: 3505219 - DNA, 17 bp, Homo sapiens
ctcaggccagagccaag

SEQ ID NO: 3505220 - DNA, 20 bp, Homo sapiens
ctcaggccggcagccccagc

SEQ ID NO: 3505221 - DNA, 21 bp, Homo sapiens
ctcaggccggcagccccagcc

SEQ ID NO: 3505222 - DNA, 23 bp, Homo sapiens
ctcaggccggcagccccagcctg

SEQ ID NO: 3505223 - DNA, 20 bp, Homo sapiens
ctcaggcgatccacctgtct

SEQ ID NO: 3505224 - DNA, 21 bp, Homo sapiens
ctcaggcgggacagtgctgca

SEQ ID NO: 3505225 - DNA, 13 bp, Homo sapiens
ctcaggctctcca

SEQ ID NO: 3505226 - DNA, 16 bp, Homo sapiens
ctcagggaaatggcct

SEQ ID NO: 3505227 - DNA, 17 bp, Homo sapiens
ctcagggaaatggcctt

SEQ ID NO: 3505228 - DNA, 20 bp, Homo sapiens
ctcagggaaatggccttccc

SEQ ID NO: 3505229 - DNA, 13 bp, Homo sapiens
ctcagggccatgc

SEQ ID NO: 3505230 - DNA, 20 bp, Homo sapiens
ctcagggccatgctgaggcc

SEQ ID NO: 3505231 - DNA, 14 bp, Homo sapiens
ctcagggtctctgc

SEQ ID NO: 3505232 - DNA, 17 bp, Homo sapiens
ctcagggtctctgctgc

SEQ ID NO: 3505233 - DNA, 17 bp, Homo sapiens
ctcaggtagaaggttga

SEQ ID NO: 3505234 - DNA, 19 bp, Homo sapiens
ctcaggtgagaagcagagg

SEQ ID NO: 3505235 - DNA, 19 bp, Homo sapiens
ctcaggtgatccacccacc

SEQ ID NO: 3505236 - DNA, 23 bp, Homo sapiens
ctcaggtgatccacccacctcag

SEQ ID NO: 3505237 - DNA, 14 bp, Homo sapiens
ctcaggtgctgtcc

SEQ ID NO: 3505238 - DNA, 19 bp, Homo sapiens
ctcaggtggccatgcctca

SEQ ID NO: 3505239 - DNA, 20 bp, Homo sapiens
ctcaggtggccatgcctcag

SEQ ID NO: 3505240 - DNA, 17 bp, Homo sapiens
ctcaggtgtccctgcac

SEQ ID NO: 3505241 - DNA, 18 bp, Homo sapiens
ctcaggtgtccctgcact

SEQ ID NO: 3505242 - DNA, 23 bp, Homo sapiens
ctcaggtgtccctgcacttgcag

SEQ ID NO: 3505243 - DNA, 19 bp, Homo sapiens
ctcagtaagacgacaagga

SEQ ID NO: 3505244 - DNA, 20 bp, Homo sapiens
ctcagtatgtgggggcttca

SEQ ID NO: 3505245 - DNA, 23 bp, Homo sapiens
ctcagtatgtgggggcttcatct

SEQ ID NO: 3505246 - DNA, 12 bp, Homo sapiens
ctcagtcccaaa

SEQ ID NO: 3505247 - DNA, 14 bp, Homo sapiens
ctcagtctctgagc

SEQ ID NO: 3505248 - DNA, 20 bp, Homo sapiens
ctcagtctctgagcagtgaa

SEQ ID NO: 3505249 - DNA, 13 bp, Homo sapiens
ctcagtgccacta

SEQ ID NO: 3505250 - DNA, 22 bp, Homo sapiens
ctcagtgttttggactccatct

SEQ ID NO: 3505251 - DNA, 18 bp, Homo sapiens
ctcagttaagtgtttcct

SEQ ID NO: 3505252 - DNA, 15 bp, Homo sapiens
ctcagttcagaatca

SEQ ID NO: 3505253 - DNA, 15 bp, Homo sapiens
ctcagttgattttct

SEQ ID NO: 3505254 - DNA, 16 bp, Homo sapiens
ctcagttgattttctg

SEQ ID NO: 3505255 - DNA, 18 bp, Homo sapiens
ctcagttgattttctgga

SEQ ID NO: 3505256 - DNA, 12 bp, Homo sapiens
ctcagttgtgca

SEQ ID NO: 3505257 - DNA, 14 bp, Homo sapiens
ctcataaaaagcaa

SEQ ID NO: 3505258 - DNA, 21 bp, Homo sapiens
ctcataacggatcagaaatac

SEQ ID NO: 3505259 - DNA, 17 bp, Homo sapiens
ctcataagttggaccag

SEQ ID NO: 3505260 - DNA, 23 bp, Homo sapiens
ctcataagttggaccagaggaag

SEQ ID NO: 3505261 - DNA, 13 bp, Homo sapiens
ctcataccatctg

SEQ ID NO: 3505262 - DNA, 16 bp, Homo sapiens
ctcatcactgtggctg

SEQ ID NO: 3505263 - DNA, 21 bp, Homo sapiens
ctcatcactgtggctgtctgg

SEQ ID NO: 3505264 - DNA, 20 bp, Homo sapiens
ctcatcattctctgtctcat

SEQ ID NO: 3505265 - DNA, 14 bp, Homo sapiens
ctcatcatttgtgg

SEQ ID NO: 3505266 - DNA, 22 bp, Homo sapiens
ctcatcccgagcacctccacat

SEQ ID NO: 3505267 - DNA, 22 bp, Homo sapiens
ctcatcctccagtaccttgctt

SEQ ID NO: 3505268 - DNA, 13 bp, Homo sapiens
ctcatcctgcagg

SEQ ID NO: 3505269 - DNA, 14 bp, Homo sapiens
ctcatctatttgga

SEQ ID NO: 3505270 - DNA, 16 bp, Homo sapiens
ctcatctatttggaac

SEQ ID NO: 3505271 - DNA, 15 bp, Homo sapiens
ctcatctctgcctga

SEQ ID NO: 3505272 - DNA, 22 bp, Homo sapiens
ctcatctcttagctcccctcca

SEQ ID NO: 3505273 - DNA, 13 bp, Homo sapiens
ctcatctgctggt

SEQ ID NO: 3505274 - DNA, 14 bp, Homo sapiens
ctcatctgctggtc

SEQ ID NO: 3505275 - DNA, 16 bp, Homo sapiens
ctcatctgctggtccg

SEQ ID NO: 3505276 - DNA, 17 bp, Homo sapiens
ctcatctgtccctccgg

SEQ ID NO: 3505277 - DNA, 18 bp, Homo sapiens
ctcatctgtccctccggg

SEQ ID NO: 3505278 - DNA, 12 bp, Homo sapiens
ctcatgacagcc

SEQ ID NO: 3505279 - DNA, 17 bp, Homo sapiens
ctcatgaggaggggccc

SEQ ID NO: 3505280 - DNA, 15 bp, Homo sapiens
ctcatgaggggagag

SEQ ID NO: 3505281 - DNA, 21 bp, Homo sapiens
ctcatggaaactggccagggg

SEQ ID NO: 3505282 - DNA, 23 bp, Homo sapiens
ctcatggccctgtagttaggcct

SEQ ID NO: 3505283 - DNA, 16 bp, Homo sapiens
ctcatgtgtgcaacag

SEQ ID NO: 3505284 - DNA, 14 bp, Homo sapiens
ctcgatttctccag

SEQ ID NO: 3505285 - DNA, 14 bp, Homo sapiens
ctcgattttgtatc

SEQ ID NO: 3505286 - DNA, 22 bp, Homo sapiens
ctcgcataggacctttccacca

SEQ ID NO: 3505287 - DNA, 22 bp, Homo sapiens
ctcgccaagcaggacagtgctt

SEQ ID NO: 3505288 - DNA, 15 bp, Homo sapiens
ctcgccaaggcctag

SEQ ID NO: 3505289 - DNA, 20 bp, Homo sapiens
ctcgccctgcggtagatggg

SEQ ID NO: 3505290 - DNA, 20 bp, Homo sapiens
ctcgccggaccctctaacct

SEQ ID NO: 3505291 - DNA, 16 bp, Homo sapiens
ctcgctgccagctctg

SEQ ID NO: 3505292 - DNA, 16 bp, Homo sapiens
ctcgctggactctcag

SEQ ID NO: 3505293 - DNA, 19 bp, Homo sapiens
ctcgctggactctcagtct

SEQ ID NO: 3505294 - DNA, 12 bp, Homo sapiens
ctcgctgttgct

SEQ ID NO: 3505295 - DNA, 13 bp, Homo sapiens
ctcgctgttgctg

SEQ ID NO: 3505296 - DNA, 16 bp, Homo sapiens
ctcgctgttgctgaat

SEQ ID NO: 3505297 - DNA, 17 bp, Homo sapiens
ctcggaggaagccccca

SEQ ID NO: 3505298 - DNA, 15 bp, Homo sapiens
ctcggcctcccaaag

SEQ ID NO: 3505299 - DNA, 20 bp, Homo sapiens
ctcggcctcccaaagtgctg

SEQ ID NO: 3505300 - DNA, 20 bp, Homo sapiens
ctcggcttggatcctgggct

SEQ ID NO: 3505301 - DNA, 21 bp, Homo sapiens
ctcggcttggatcctgggctg

SEQ ID NO: 3505302 - DNA, 17 bp, Homo sapiens
ctcggcttttctcagct

SEQ ID NO: 3505303 - DNA, 18 bp, Homo sapiens
ctcgggctggagcctccg

SEQ ID NO: 3505304 - DNA, 19 bp, Homo sapiens
ctcgggctggagcctccga

SEQ ID NO: 3505305 - DNA, 23 bp, Homo sapiens
ctcggtgtggagaagcggctggc

SEQ ID NO: 3505306 - DNA, 15 bp, Homo sapiens
ctcggtttgccaaaa

SEQ ID NO: 3505307 - DNA, 13 bp, Homo sapiens
ctcgtatagcatg

SEQ ID NO: 3505308 - DNA, 14 bp, Homo sapiens
ctcgtatagcatgc

SEQ ID NO: 3505309 - DNA, 20 bp, Homo sapiens
ctcgttgactggctgtgtgt

SEQ ID NO: 3505310 - DNA, 17 bp, Homo sapiens
ctctacaattcctctga

SEQ ID NO: 3505311 - DNA, 18 bp, Homo sapiens
ctctacaccaattaatgt

SEQ ID NO: 3505312 - DNA, 17 bp, Homo sapiens
ctctacagagcttccct

SEQ ID NO: 3505313 - DNA, 18 bp, Homo sapiens
ctctacagagcttccctg

SEQ ID NO: 3505314 - DNA, 22 bp, Homo sapiens
ctctacagagcttccctgactc

SEQ ID NO: 3505315 - DNA, 19 bp, Homo sapiens
ctctacagaggccatgggc

SEQ ID NO: 3505316 - DNA, 20 bp, Homo sapiens
ctctaccatcccctgtagag

SEQ ID NO: 3505317 - DNA, 18 bp, Homo sapiens
ctctacccagggcctgca

SEQ ID NO: 3505318 - DNA, 18 bp, Homo sapiens
ctctacttaatccaatgg

SEQ ID NO: 3505319 - DNA, 13 bp, Homo sapiens
ctctacttcagga

SEQ ID NO: 3505320 - DNA, 18 bp, Homo sapiens
ctctactttgattctgat

SEQ ID NO: 3505321 - DNA, 18 bp, Homo sapiens
ctctagaagtgccatctc

SEQ ID NO: 3505322 - DNA, 15 bp, Homo sapiens
ctctagagccttcag

SEQ ID NO: 3505323 - DNA, 16 bp, Homo sapiens
ctctagatgagctggg

SEQ ID NO: 3505324 - DNA, 23 bp, Homo sapiens
ctctagatgagctgggccggagg

SEQ ID NO: 3505325 - DNA, 17 bp, Homo sapiens
ctctaggctctgccttc

SEQ ID NO: 3505326 - DNA, 14 bp, Homo sapiens
ctctaggctgcccc

SEQ ID NO: 3505327 - DNA, 13 bp, Homo sapiens
ctctaggctgggg

SEQ ID NO: 3505328 - DNA, 14 bp, Homo sapiens
ctctaggctgggga

SEQ ID NO: 3505329 - DNA, 15 bp, Homo sapiens
ctctagttctttgtt

SEQ ID NO: 3505330 - DNA, 15 bp, Homo sapiens
ctctataaaaaatat

SEQ ID NO: 3505331 - DNA, 22 bp, Homo sapiens
ctctatagcagacactaaagac

SEQ ID NO: 3505332 - DNA, 21 bp, Homo sapiens
ctctatcatggtgaaaagctc

SEQ ID NO: 3505333 - DNA, 23 bp, Homo sapiens
ctctatcatttaataatatactt

SEQ ID NO: 3505334 - DNA, 20 bp, Homo sapiens
ctctatgataattacaatac

SEQ ID NO: 3505335 - DNA, 20 bp, Homo sapiens
ctctatgtttacaaatggac

SEQ ID NO: 3505336 - DNA, 17 bp, Homo sapiens
ctctatttatgtttgca

SEQ ID NO: 3505337 - DNA, 23 bp, Homo sapiens
ctctatttcttcttcacatccat

SEQ ID NO: 3505338 - DNA, 14 bp, Homo sapiens
ctctatttgagaat

SEQ ID NO: 3505339 - DNA, 15 bp, Homo sapiens
ctctatttttaatca

SEQ ID NO: 3505340 - DNA, 16 bp, Homo sapiens
ctctcaaatccctctc

SEQ ID NO: 3505341 - DNA, 19 bp, Homo sapiens
ctctcaaccttggccttct

SEQ ID NO: 3505342 - DNA, 20 bp, Homo sapiens
ctctcaaccttggccttctc

SEQ ID NO: 3505343 - DNA, 14 bp, Homo sapiens
ctctcaagtaatat

SEQ ID NO: 3505344 - DNA, 13 bp, Homo sapiens
ctctcacctcagc

SEQ ID NO: 3505345 - DNA, 20 bp, Homo sapiens
ctctcactgtgttactgctt

SEQ ID NO: 3505346 - DNA, 21 bp, Homo sapiens
ctctcagcccctgatcctgtg

SEQ ID NO: 3505347 - DNA, 22 bp, Homo sapiens
ctctcagcccctgatcctgtga

SEQ ID NO: 3505348 - DNA, 22 bp, Homo sapiens
ctctcagcctcccaaccccagg

SEQ ID NO: 3505349 - DNA, 19 bp, Homo sapiens
ctctcagtactttggaggc

SEQ ID NO: 3505350 - DNA, 16 bp, Homo sapiens
ctctcagtctctgagc

SEQ ID NO: 3505351 - DNA, 17 bp, Homo sapiens
ctctcagtctctgagca

SEQ ID NO: 3505352 - DNA, 12 bp, Homo sapiens
ctctcagtgttt

SEQ ID NO: 3505353 - DNA, 22 bp, Homo sapiens
ctctcagtgttttggactccat

SEQ ID NO: 3505354 - DNA, 22 bp, Homo sapiens
ctctcagttgcagccctgctgc

SEQ ID NO: 3505355 - DNA, 19 bp, Homo sapiens
ctctcatcctccagtacct

SEQ ID NO: 3505356 - DNA, 14 bp, Homo sapiens
ctctcatctgaggc

SEQ ID NO: 3505357 - DNA, 20 bp, Homo sapiens
ctctcatgttttcaactgcc

SEQ ID NO: 3505358 - DNA, 15 bp, Homo sapiens
ctctccaaaaatgca

SEQ ID NO: 3505359 - DNA, 21 bp, Homo sapiens
ctctccaactgcctaaggccc

SEQ ID NO: 3505360 - DNA, 12 bp, Homo sapiens
ctctccactgct

SEQ ID NO: 3505361 - DNA, 19 bp, Homo sapiens
ctctccactgctctcagcc

SEQ ID NO: 3505362 - DNA, 18 bp, Homo sapiens
ctctccagcctcagctct

SEQ ID NO: 3505363 - DNA, 14 bp, Homo sapiens
ctctccccagcaag

SEQ ID NO: 3505364 - DNA, 17 bp, Homo sapiens
ctctccccagcccagag

SEQ ID NO: 3505365 - DNA, 19 bp, Homo sapiens
ctctccccagcccagagac

SEQ ID NO: 3505366 - DNA, 18 bp, Homo sapiens
ctctccccaggtccagct

SEQ ID NO: 3505367 - DNA, 13 bp, Homo sapiens
ctctcccccaccc

SEQ ID NO: 3505368 - DNA, 21 bp, Homo sapiens
ctctcccctcagagtgcaagc

SEQ ID NO: 3505369 - DNA, 13 bp, Homo sapiens
ctctccctcccct

SEQ ID NO: 3505370 - DNA, 22 bp, Homo sapiens
ctctccctctaggctctgcctt

SEQ ID NO: 3505371 - DNA, 13 bp, Homo sapiens
ctctccctgaccc

SEQ ID NO: 3505372 - DNA, 13 bp, Homo sapiens
ctctccctgcact

SEQ ID NO: 3505373 - DNA, 12 bp, Homo sapiens
ctctcctcatct

SEQ ID NO: 3505374 - DNA, 20 bp, Homo sapiens
ctctcctcatgttctgcttt

SEQ ID NO: 3505375 - DNA, 17 bp, Homo sapiens
ctctcctccgtggcaca

SEQ ID NO: 3505376 - DNA, 18 bp, Homo sapiens
ctctcctccgtggcacat

SEQ ID NO: 3505377 - DNA, 19 bp, Homo sapiens
ctctcctcctgcccacctg

SEQ ID NO: 3505378 - DNA, 14 bp, Homo sapiens
ctctccttcctgtg

SEQ ID NO: 3505379 - DNA, 15 bp, Homo sapiens
ctctcgcatcttccc

SEQ ID NO: 3505380 - DNA, 20 bp, Homo sapiens
ctctctattgaccaccagtt

SEQ ID NO: 3505381 - DNA, 21 bp, Homo sapiens
ctctctattgaccaccagtta

SEQ ID NO: 3505382 - DNA, 12 bp, Homo sapiens
ctctctccagat

SEQ ID NO: 3505383 - DNA, 12 bp, Homo sapiens
ctctctccattt

SEQ ID NO: 3505384 - DNA, 16 bp, Homo sapiens
ctctctccatttatat

SEQ ID NO: 3505385 - DNA, 14 bp, Homo sapiens
ctctctctgtgggg

SEQ ID NO: 3505386 - DNA, 13 bp, Homo sapiens
ctctctgccctgt

SEQ ID NO: 3505387 - DNA, 16 bp, Homo sapiens
ctctctgccctgtgta

SEQ ID NO: 3505388 - DNA, 16 bp, Homo sapiens
ctctctgggcctcaga

SEQ ID NO: 3505389 - DNA, 23 bp, Homo sapiens
ctctctgtcccttgctgtatgct

SEQ ID NO: 3505390 - DNA, 13 bp, Homo sapiens
ctctctgtggggc

SEQ ID NO: 3505391 - DNA, 16 bp, Homo sapiens
ctctctgtggggctga

SEQ ID NO: 3505392 - DNA, 17 bp, Homo sapiens
ctctctgtggggctgaa

SEQ ID NO: 3505393 - DNA, 23 bp, Homo sapiens
ctctctgtggggctgaattgcca

SEQ ID NO: 3505394 - DNA, 21 bp, Homo sapiens
ctctcttgaaccccaaatgct

SEQ ID NO: 3505395 - DNA, 12 bp, Homo sapiens
ctctgaaacagc

SEQ ID NO: 3505396 - DNA, 13 bp, Homo sapiens
ctctgaaacagct

SEQ ID NO: 3505397 - DNA, 15 bp, Homo sapiens
ctctgaaacagctgc

SEQ ID NO: 3505398 - DNA, 18 bp, Homo sapiens
ctctgaaacagctgcctt

SEQ ID NO: 3505399 - DNA, 17 bp, Homo sapiens
ctctgaaagttgtacat

SEQ ID NO: 3505400 - DNA, 13 bp, Homo sapiens
ctctgaagagtgg

SEQ ID NO: 3505401 - DNA, 18 bp, Homo sapiens
ctctgaagcaaggcggtg

SEQ ID NO: 3505402 - DNA, 22 bp, Homo sapiens
ctctgaaggacattgcggacag

SEQ ID NO: 3505403 - DNA, 23 bp, Homo sapiens
ctctgaagggcatcatgcatctt

SEQ ID NO: 3505404 - DNA, 16 bp, Homo sapiens
ctctgacacacagctc

SEQ ID NO: 3505405 - DNA, 18 bp, Homo sapiens
ctctgacacacagctctg

SEQ ID NO: 3505406 - DNA, 15 bp, Homo sapiens
ctctgactcagggct

SEQ ID NO: 3505407 - DNA, 14 bp, Homo sapiens
ctctgacttctgcc

SEQ ID NO: 3505408 - DNA, 14 bp, Homo sapiens
ctctgacttgggga

SEQ ID NO: 3505409 - DNA, 16 bp, Homo sapiens
ctctgagtatctcctc

SEQ ID NO: 3505410 - DNA, 17 bp, Homo sapiens
ctctgagtcctggccca

SEQ ID NO: 3505411 - DNA, 21 bp, Homo sapiens
ctctgataatatattttcaag

SEQ ID NO: 3505412 - DNA, 22 bp, Homo sapiens
ctctgcaagaattgaagcagga

SEQ ID NO: 3505413 - DNA, 19 bp, Homo sapiens
ctctgcaagtgctcaggga

SEQ ID NO: 3505414 - DNA, 21 bp, Homo sapiens
ctctgcaagtgctcagggaaa

SEQ ID NO: 3505415 - DNA, 22 bp, Homo sapiens
ctctgcaagtgctcagggaaat

SEQ ID NO: 3505416 - DNA, 18 bp, Homo sapiens
ctgagtgccttctgtggg

SEQ ID NO: 3505417 - DNA, 20 bp, Homo sapiens
ctgagtgccttctgtgggga

SEQ ID NO: 3505418 - DNA, 21 bp, Homo sapiens
ctgagtgccttctgtggggac

SEQ ID NO: 3505419 - DNA, 22 bp, Homo sapiens
ctgagtgggggatcacagcctc

SEQ ID NO: 3505420 - DNA, 11 bp, Homo sapiens
ctgagttttcc

SEQ ID NO: 3505421 - DNA, 16 bp, Homo sapiens
ctgataaagcacagct

SEQ ID NO: 3505422 - DNA, 21 bp, Homo sapiens
ctgatatatgtgtttttcaca

SEQ ID NO: 3505423 - DNA, 12 bp, Homo sapiens
ctgatcaaggcc

SEQ ID NO: 3505424 - DNA, 17 bp, Homo sapiens
ctgatcagaccacggct

SEQ ID NO: 3505425 - DNA, 20 bp, Homo sapiens
ctgatcagagccgtggtcct

SEQ ID NO: 3505426 - DNA, 15 bp, Homo sapiens
ctgatccctctacag

SEQ ID NO: 3505427 - DNA, 20 bp, Homo sapiens
ctgatccctctgggggctct

SEQ ID NO: 3505428 - DNA, 16 bp, Homo sapiens
ctgatgcttacatctg

SEQ ID NO: 3505429 - DNA, 17 bp, Homo sapiens
ctgatgcttacatctgg

SEQ ID NO: 3505430 - DNA, 19 bp, Homo sapiens
ctgatgcttttgtctaatt

SEQ ID NO: 3505431 - DNA, 19 bp, Homo sapiens
ctgatggcaggatggcctg

SEQ ID NO: 3505432 - DNA, 18 bp, Homo sapiens
ctgatgggcaacccccag

SEQ ID NO: 3505433 - DNA, 18 bp, Homo sapiens
ctgatgtcaatttctgtg

SEQ ID NO: 3505434 - DNA, 16 bp, Homo sapiens
ctgatgtttacagtgt

SEQ ID NO: 3505435 - DNA, 19 bp, Homo sapiens
ctgattaaatatttgaaga

SEQ ID NO: 3505436 - DNA, 21 bp, Homo sapiens
ctgattaagttgtctaaacaa

SEQ ID NO: 3505437 - DNA, 15 bp, Homo sapiens
ctgattcccaagctc

SEQ ID NO: 3505438 - DNA, 17 bp, Homo sapiens
ctgattcccaagctctg

SEQ ID NO: 3505439 - DNA, 18 bp, Homo sapiens
ctgattcccaagctctgc

SEQ ID NO: 3505440 - DNA, 19 bp, Homo sapiens
ctgattcccaagctctgct

SEQ ID NO: 3505441 - DNA, 15 bp, Homo sapiens
ctgattctcagggtc

SEQ ID NO: 3505442 - DNA, 16 bp, Homo sapiens
ctgatttaggagaagc

SEQ ID NO: 3505443 - DNA, 21 bp, Homo sapiens
ctgatttaggagaagccagga

SEQ ID NO: 3505444 - DNA, 22 bp, Homo sapiens
ctgatttaggagaagccaggaa

SEQ ID NO: 3505445 - DNA, 13 bp, Homo sapiens
ctgcaaaaaatac

SEQ ID NO: 3505446 - DNA, 15 bp, Homo sapiens
ctgcaaaaatattta

SEQ ID NO: 3505447 - DNA, 21 bp, Homo sapiens
ctgcaaaaatatttataaaac

SEQ ID NO: 3505448 - DNA, 18 bp, Homo sapiens
ctgcaaaaggactctcag

SEQ ID NO: 3505449 - DNA, 21 bp, Homo sapiens
ctgcaaaatgaggaatgtata

SEQ ID NO: 3505450 - DNA, 22 bp, Homo sapiens
ctgcaaaatgaggaatgtatat

SEQ ID NO: 3505451 - DNA, 22 bp, Homo sapiens
ctgcaaacaccaacatgttggg

SEQ ID NO: 3505452 - DNA, 17 bp, Homo sapiens
ctgcaaacgctgcctgc

SEQ ID NO: 3505453 - DNA, 19 bp, Homo sapiens
ctgcaaacgctgcctgccc

SEQ ID NO: 3505454 - DNA, 20 bp, Homo sapiens
ctgcaaacgctgcctgccca

SEQ ID NO: 3505455 - DNA, 16 bp, Homo sapiens
ctgcaaaggacagatc

SEQ ID NO: 3505456 - DNA, 22 bp, Homo sapiens
ctgcaaagggtatcaggtgctg

SEQ ID NO: 3505457 - DNA, 21 bp, Homo sapiens
ctgcaacaaaatgtagaatat

SEQ ID NO: 3505458 - DNA, 18 bp, Homo sapiens
ctgcaagaattgaagcag

SEQ ID NO: 3505459 - DNA, 21 bp, Homo sapiens
ctgcaagagccaagttccaaa

SEQ ID NO: 3505460 - DNA, 20 bp, Homo sapiens
ctgcaaggtttaggctggtg

SEQ ID NO: 3505461 - DNA, 18 bp, Homo sapiens
ctgcaagtccttttgtaa

SEQ ID NO: 3505462 - DNA, 15 bp, Homo sapiens
ctgcaagtgctcagg

SEQ ID NO: 3505463 - DNA, 16 bp, Homo sapiens
ctgcaagtgctcaggg

SEQ ID NO: 3505464 - DNA, 19 bp, Homo sapiens
ctgcaagtgctcagggaaa

SEQ ID NO: 3505465 - DNA, 18 bp, Homo sapiens
ctgcaatgtgggcagaga

SEQ ID NO: 3505466 - DNA, 15 bp, Homo sapiens
ctgcaatttctacta

SEQ ID NO: 3505467 - DNA, 13 bp, Homo sapiens
ctgcacaagctgc

SEQ ID NO: 3505468 - DNA, 14 bp, Homo sapiens
ctgcacaagctgca

SEQ ID NO: 3505469 - DNA, 22 bp, Homo sapiens
ctgcacaagctgcaccctcagg

SEQ ID NO: 3505470 - DNA, 10 bp, Homo sapiens
ctgcacagct

SEQ ID NO: 3505471 - DNA, 19 bp, Homo sapiens
ctgcacagcttttccaaaa

SEQ ID NO: 3505472 - DNA, 15 bp, Homo sapiens
ctgcacagttgaagg

SEQ ID NO: 3505473 - DNA, 16 bp, Homo sapiens
ctgcacccccctgggc

SEQ ID NO: 3505474 - DNA, 14 bp, Homo sapiens
ctgcaccctcaggc

SEQ ID NO: 3505475 - DNA, 16 bp, Homo sapiens
ctgcaccctcaggcag

SEQ ID NO: 3505476 - DNA, 17 bp, Homo sapiens
ctgcaccctcaggcagg

SEQ ID NO: 3505477 - DNA, 14 bp, Homo sapiens
ctgcaccgggccac

SEQ ID NO: 3505478 - DNA, 15 bp, Homo sapiens
ctgcaccgggccaca

SEQ ID NO: 3505479 - DNA, 20 bp, Homo sapiens
ctgcaccgggccacagagaa

SEQ ID NO: 3505480 - DNA, 23 bp, Homo sapiens
ctgcaccgggccacagagaaagt

SEQ ID NO: 3505481 - DNA, 14 bp, Homo sapiens
ctgcaccttgccag

SEQ ID NO: 3505482 - DNA, 22 bp, Homo sapiens
ctgcactatagcctaggtgaca

SEQ ID NO: 3505483 - DNA, 16 bp, Homo sapiens
ctgcactccagcctgg

SEQ ID NO: 3505484 - DNA, 17 bp, Homo sapiens
ctgcactccagcctggg

SEQ ID NO: 3505485 - DNA, 17 bp, Homo sapiens
ctgcactgatgctgccc

SEQ ID NO: 3505486 - DNA, 18 bp, Homo sapiens
ctgcactgatgctgcccc

SEQ ID NO: 3505487 - DNA, 21 bp, Homo sapiens
ctgcactgcagccacagggga

SEQ ID NO: 3505488 - DNA, 15 bp, Homo sapiens
ctgcacttacttgct

SEQ ID NO: 3505489 - DNA, 23 bp, Homo sapiens
ctgcacttgcagactctacagag

SEQ ID NO: 3505490 - DNA, 20 bp, Homo sapiens
ctgcagaaggaaaaatgtgt

SEQ ID NO: 3505491 - DNA, 22 bp, Homo sapiens
ctgcagaaggaaaaatgtgtaa

SEQ ID NO: 3505492 - DNA, 22 bp, Homo sapiens
ctgcagaatttgggttctgcct

SEQ ID NO: 3505493 - DNA, 14 bp, Homo sapiens
ctgcagacttccca

SEQ ID NO: 3505494 - DNA, 13 bp, Homo sapiens
ctgcagagcacac

SEQ ID NO: 3505495 - DNA, 15 bp, Homo sapiens
ctgcagagcagatgg

SEQ ID NO: 3505496 - DNA, 11 bp, Homo sapiens
ctgcagaggcc

SEQ ID NO: 3505497 - DNA, 13 bp, Homo sapiens
ctgcagaggccag

SEQ ID NO: 3505498 - DNA, 18 bp, Homo sapiens
ctgcagagtctgccccac

SEQ ID NO: 3505499 - DNA, 17 bp, Homo sapiens
ctgcagatttgggctgg

SEQ ID NO: 3505500 - DNA, 20 bp, Homo sapiens
ctgcagcctcaacctcctgg

SEQ ID NO: 3505501 - DNA, 22 bp, Homo sapiens
ctgcagcctcaacctcctgggc

SEQ ID NO: 3505502 - DNA, 24 bp, Homo sapiens
ctgcagcctcaacctcctgggcta

SEQ ID NO: 3505503 - DNA, 20 bp, Homo sapiens
ctgcagcctttgcctccccg

SEQ ID NO: 3505504 - DNA, 17 bp, Homo sapiens
ctgcagctccctggctt

SEQ ID NO: 3505505 - DNA, 18 bp, Homo sapiens
ctgcagctccctggcttc

SEQ ID NO: 3505506 - DNA, 14 bp, Homo sapiens
ctgcaggaatcttt

SEQ ID NO: 3505507 - DNA, 14 bp, Homo sapiens
ctgcaggacctgcc

SEQ ID NO: 3505508 - DNA, 16 bp, Homo sapiens
ctgcaggacctgcctg

SEQ ID NO: 3505509 - DNA, 18 bp, Homo sapiens
ctgcaggacctgcctgta

SEQ ID NO: 3505510 - DNA, 22 bp, Homo sapiens
ctgcaggacttctgcctgaacc

SEQ ID NO: 3505511 - DNA, 12 bp, Homo sapiens
ctgcaggcaggg

SEQ ID NO: 3505512 - DNA, 15 bp, Homo sapiens
ctgcaggccctggcc

SEQ ID NO: 3505513 - DNA, 19 bp, Homo sapiens
ctgcaggccctggcctccc

SEQ ID NO: 3505514 - DNA, 23 bp, Homo sapiens
ctgcaggcctaggtgcagctcct

SEQ ID NO: 3505515 - DNA, 12 bp, Homo sapiens
ctgcagggaaaa

SEQ ID NO: 3505516 - DNA, 22 bp, Homo sapiens
ctgcagggaaaattatttgcat

SEQ ID NO: 3505517 - DNA, 23 bp, Homo sapiens
ctgcagggaaaattatttgcata

SEQ ID NO: 3505518 - DNA, 18 bp, Homo sapiens
ctgcagggccgccaggga

SEQ ID NO: 3505519 - DNA, 17 bp, Homo sapiens
ctgcaggtgagcagaca

SEQ ID NO: 3505520 - DNA, 17 bp, Homo sapiens
ctgcagtaaatctttta

SEQ ID NO: 3505521 - DNA, 17 bp, Homo sapiens
ctgcagtcaacagttca

SEQ ID NO: 3505522 - DNA, 15 bp, Homo sapiens
ctgcagtgtgccccc

SEQ ID NO: 3505523 - DNA, 20 bp, Homo sapiens
ctgcataagtgaaaatctta

SEQ ID NO: 3505524 - DNA, 15 bp, Homo sapiens
ctgcataccaacctg

SEQ ID NO: 3505525 - DNA, 20 bp, Homo sapiens
ctgcatcacccaatcaataa

SEQ ID NO: 3505526 - DNA, 22 bp, Homo sapiens
ctgcatctattctttgtaccat

SEQ ID NO: 3505527 - DNA, 16 bp, Homo sapiens
ctgcatctgaccagca

SEQ ID NO: 3505528 - DNA, 20 bp, Homo sapiens
ctgcatctgaccagcagcgc

SEQ ID NO: 3505529 - DNA, 22 bp, Homo sapiens
ctgcatctgaccagcagcgcct

SEQ ID NO: 3505530 - DNA, 20 bp, Homo sapiens
ctgcatgatgtttgcccaaa

SEQ ID NO: 3505531 - DNA, 16 bp, Homo sapiens
ctgcatgccctctcag

SEQ ID NO: 3505532 - DNA, 20 bp, Homo sapiens
ctgcatgccctctcaggccg

SEQ ID NO: 3505533 - DNA, 13 bp, Homo sapiens
ctgcatgctgctg

SEQ ID NO: 3505534 - DNA, 24 bp, Homo sapiens
ctgcatgtactagtcctctagaaa

SEQ ID NO: 3505535 - DNA, 21 bp, Homo sapiens
ctgcattaccgcgttgtaaaa

SEQ ID NO: 3505536 - DNA, 20 bp, Homo sapiens
ctgcattcttaacaaactct

SEQ ID NO: 3505537 - DNA, 18 bp, Homo sapiens
ctgcattgggagcatcca

SEQ ID NO: 3505538 - DNA, 17 bp, Homo sapiens
ctgcatttttctgcaga

SEQ ID NO: 3505539 - DNA, 15 bp, Homo sapiens
ctgccaatccttaaa

SEQ ID NO: 3505540 - DNA, 22 bp, Homo sapiens
ctgccacagcctcccctgccag

SEQ ID NO: 3505541 - DNA, 18 bp, Homo sapiens
ctgccaccaccctgtctt

SEQ ID NO: 3505542 - DNA, 12 bp, Homo sapiens
ctgccaccagca

SEQ ID NO: 3505543 - DNA, 16 bp, Homo sapiens
ctgccaccagcatcca

SEQ ID NO: 3505544 - DNA, 14 bp, Homo sapiens
ctgccacccacctc

SEQ ID NO: 3505545 - DNA, 19 bp, Homo sapiens
ctgccacccacctccctgc

SEQ ID NO: 3505546 - DNA, 12 bp, Homo sapiens
ctgccaccccta

SEQ ID NO: 3505547 - DNA, 13 bp, Homo sapiens
ctggagtggccac

SEQ ID NO: 3505548 - DNA, 23 bp, Homo sapiens
ctggagtggccactaagcagagg

SEQ ID NO: 3505549 - DNA, 15 bp, Homo sapiens
ctggagttgatctgg

SEQ ID NO: 3505550 - DNA, 20 bp, Homo sapiens
ctggagttgatctggaaccc

SEQ ID NO: 3505551 - DNA, 22 bp, Homo sapiens
ctggagttgatctggaacccag

SEQ ID NO: 3505552 - DNA, 20 bp, Homo sapiens
ctggagtttgggatccctgt

SEQ ID NO: 3505553 - DNA, 16 bp, Homo sapiens
ctggatgctccttcca

SEQ ID NO: 3505554 - DNA, 12 bp, Homo sapiens
ctggatgtctga

SEQ ID NO: 3505555 - DNA, 14 bp, Homo sapiens
ctggattcccagga

SEQ ID NO: 3505556 - DNA, 21 bp, Homo sapiens
ctggattccccatctcaggcc

SEQ ID NO: 3505557 - DNA, 13 bp, Homo sapiens
ctggattttgtca

SEQ ID NO: 3505558 - DNA, 21 bp, Homo sapiens
ctggcaaaaggatctttgtgg

SEQ ID NO: 3505559 - DNA, 23 bp, Homo sapiens
ctggcaaaaggatctttgtggcc

SEQ ID NO: 3505560 - DNA, 19 bp, Homo sapiens
ctggcaaagcttttagaaa

SEQ ID NO: 3505561 - DNA, 14 bp, Homo sapiens
ctggcaagaatgtg

SEQ ID NO: 3505562 - DNA, 16 bp, Homo sapiens
ctggcacccggcccct

SEQ ID NO: 3505563 - DNA, 21 bp, Homo sapiens
ctggcacccggcccctgctgg

SEQ ID NO: 3505564 - DNA, 22 bp, Homo sapiens
ctggcacccggcccctgctggt

SEQ ID NO: 3505565 - DNA, 20 bp, Homo sapiens
ctggcactgactgggcatag

SEQ ID NO: 3505566 - DNA, 17 bp, Homo sapiens
ctggcactggaccccag

SEQ ID NO: 3505567 - DNA, 15 bp, Homo sapiens
ctggcagactgtgta

SEQ ID NO: 3505568 - DNA, 11 bp, Homo sapiens
ctggcagccca

SEQ ID NO: 3505569 - DNA, 14 bp, Homo sapiens
ctggcagcctccca

SEQ ID NO: 3505570 - DNA, 23 bp, Homo sapiens
ctggcagcctcccatccagggcc

SEQ ID NO: 3505571 - DNA, 20 bp, Homo sapiens
ctggcagctctggacagccc

SEQ ID NO: 3505572 - DNA, 12 bp, Homo sapiens
ctggcaggtcct

SEQ ID NO: 3505573 - DNA, 15 bp, Homo sapiens
ctggcagtttaaaaa

SEQ ID NO: 3505574 - DNA, 20 bp, Homo sapiens
ctggcatcgcaccattctga

SEQ ID NO: 3505575 - DNA, 17 bp, Homo sapiens
ctggcatgatccaagca

SEQ ID NO: 3505576 - DNA, 19 bp, Homo sapiens
ctggccaaagagcctttcc

SEQ ID NO: 3505577 - DNA, 21 bp, Homo sapiens
ctggccaaagagcctttccaa

SEQ ID NO: 3505578 - DNA, 16 bp, Homo sapiens
ctggccaaatagcaaa

SEQ ID NO: 3505579 - DNA, 18 bp, Homo sapiens
ctggccaaatagcaaaga

SEQ ID NO: 3505580 - DNA, 17 bp, Homo sapiens
ctggccaacatggtaaa

SEQ ID NO: 3505581 - DNA, 13 bp, Homo sapiens
ctggccaagggcc

SEQ ID NO: 3505582 - DNA, 15 bp, Homo sapiens
ctggccaccccatct

SEQ ID NO: 3505583 - DNA, 15 bp, Homo sapiens
ctggccagacacagg

SEQ ID NO: 3505584 - DNA, 16 bp, Homo sapiens
ctggccagatgcacca

SEQ ID NO: 3505585 - DNA, 20 bp, Homo sapiens
ctggccagatgcaccagccc

SEQ ID NO: 3505586 - DNA, 14 bp, Homo sapiens
ctggccagggcctg

SEQ ID NO: 3505587 - DNA, 23 bp, Homo sapiens
ctggccagggcctggaagacaga

SEQ ID NO: 3505588 - DNA, 15 bp, Homo sapiens
ctggccagtccaggc

SEQ ID NO: 3505589 - DNA, 16 bp, Homo sapiens
ctggccagtccaggct

SEQ ID NO: 3505590 - DNA, 21 bp, Homo sapiens
ctggccagtccaggctgccgt

SEQ ID NO: 3505591 - DNA, 12 bp, Homo sapiens
ctggcccactgc

SEQ ID NO: 3505592 - DNA, 11 bp, Homo sapiens
ctggcccaggg

SEQ ID NO: 3505593 - DNA, 15 bp, Homo sapiens
ctggcccagggccca

SEQ ID NO: 3505594 - DNA, 19 bp, Homo sapiens
ctggcccagggcccagagc

SEQ ID NO: 3505595 - DNA, 20 bp, Homo sapiens
ctggcccagggcccagagcc

SEQ ID NO: 3505596 - DNA, 17 bp, Homo sapiens
ctggccccatggtcagc

SEQ ID NO: 3505597 - DNA, 14 bp, Homo sapiens
ctggccccgcctgc

SEQ ID NO: 3505598 - DNA, 20 bp, Homo sapiens
ctggccccgcctgcctgcca

SEQ ID NO: 3505599 - DNA, 13 bp, Homo sapiens
ctggccctagact

SEQ ID NO: 3505600 - DNA, 14 bp, Homo sapiens
ctggccgcctccag

SEQ ID NO: 3505601 - DNA, 23 bp, Homo sapiens
ctggccggctccagtttccccat

SEQ ID NO: 3505602 - DNA, 14 bp, Homo sapiens
ctggcctcccacag

SEQ ID NO: 3505603 - DNA, 21 bp, Homo sapiens
ctggcctcccctgccaccagg

SEQ ID NO: 3505604 - DNA, 15 bp, Homo sapiens
ctggcctccttcccc

SEQ ID NO: 3505605 - DNA, 14 bp, Homo sapiens
ctggcctctgtgcc

SEQ ID NO: 3505606 - DNA, 15 bp, Homo sapiens
ctggcctctgtgcct

SEQ ID NO: 3505607 - DNA, 20 bp, Homo sapiens
ctggcctctgtgccttcttt

SEQ ID NO: 3505608 - DNA, 15 bp, Homo sapiens
ctggcctgagagtca

SEQ ID NO: 3505609 - DNA, 23 bp, Homo sapiens
ctggcctgagagtcagctctctg

SEQ ID NO: 3505610 - DNA, 20 bp, Homo sapiens
ctggcgacagttttccttct

SEQ ID NO: 3505611 - DNA, 23 bp, Homo sapiens
ctggcgagtgaatgccagtgtgc

SEQ ID NO: 3505612 - DNA, 23 bp, Homo sapiens
ctggcgcagaacgaaccttggcc

SEQ ID NO: 3505613 - DNA, 24 bp, Homo sapiens
ctggcgcagaacgaaccttggcct

SEQ ID NO: 3505614 - DNA, 18 bp, Homo sapiens
ctggcgtcatgcaaagtc

SEQ ID NO: 3505615 - DNA, 14 bp, Homo sapiens
ctggcgtgcagtgg

SEQ ID NO: 3505616 - DNA, 14 bp, Homo sapiens
ctggctccagatgc

SEQ ID NO: 3505617 - DNA, 21 bp, Homo sapiens
ctggctccagatgcagggcag

SEQ ID NO: 3505618 - DNA, 17 bp, Homo sapiens
ctggctccagtgaaact

SEQ ID NO: 3505619 - DNA, 12 bp, Homo sapiens
ctggctccctct

SEQ ID NO: 3505620 - DNA, 15 bp, Homo sapiens
ctggctccttcacca

SEQ ID NO: 3505621 - DNA, 19 bp, Homo sapiens
ctggctccttcaccacccc

SEQ ID NO: 3505622 - DNA, 13 bp, Homo sapiens
ctggctctgagcg

SEQ ID NO: 3505623 - DNA, 21 bp, Homo sapiens
ctggctctgagcgcctccatc

SEQ ID NO: 3505624 - DNA, 14 bp, Homo sapiens
ctggctctgggccg

SEQ ID NO: 3505625 - DNA, 21 bp, Homo sapiens
ctggctctgttcggcctttgg

SEQ ID NO: 3505626 - DNA, 23 bp, Homo sapiens
ctggctgggacgtggctcagcca

SEQ ID NO: 3505627 - DNA, 19 bp, Homo sapiens
ctggctgtgtaaccttggg

SEQ ID NO: 3505628 - DNA, 20 bp, Homo sapiens
ctggctgtgtaaccttgggt

SEQ ID NO: 3505629 - DNA, 17 bp, Homo sapiens
ctggctgttggctgggg

SEQ ID NO: 3505630 - DNA, 12 bp, Homo sapiens
ctggcttctggc

SEQ ID NO: 3505631 - DNA, 17 bp, Homo sapiens
ctggcttctgtggggcc

SEQ ID NO: 3505632 - DNA, 19 bp, Homo sapiens
ctggcttctgtggggcccc

SEQ ID NO: 3505633 - DNA, 13 bp, Homo sapiens
ctggcttggccta

SEQ ID NO: 3505634 - DNA, 15 bp, Homo sapiens
ctgggaaacagaggc

SEQ ID NO: 3505635 - DNA, 20 bp, Homo sapiens
ctgggaactcacctggggct

SEQ ID NO: 3505636 - DNA, 17 bp, Homo sapiens
ctgggaactcatctggt

SEQ ID NO: 3505637 - DNA, 17 bp, Homo sapiens
ctgggaccgatgcagta

SEQ ID NO: 3505638 - DNA, 21 bp, Homo sapiens
ctgggacgtggctcagccagc

SEQ ID NO: 3505639 - DNA, 21 bp, Homo sapiens
ctgggactacaggcacccacc

SEQ ID NO: 3505640 - DNA, 16 bp, Homo sapiens
ctgggactcagccttc

SEQ ID NO: 3505641 - DNA, 15 bp, Homo sapiens
ctgggactccaggtc

SEQ ID NO: 3505642 - DNA, 17 bp, Homo sapiens
ctgggacttccatgcct

SEQ ID NO: 3505643 - DNA, 12 bp, Homo sapiens
ctgggagaaaat

SEQ ID NO: 3505644 - DNA, 21 bp, Homo sapiens
ctgggagaaaatcatcaagaa

SEQ ID NO: 3505645 - DNA, 13 bp, Homo sapiens
ctgggagaaatct

SEQ ID NO: 3505646 - DNA, 16 bp, Homo sapiens
ctgggagctccactct

SEQ ID NO: 3505647 - DNA, 21 bp, Homo sapiens
ctgggagctccactctgcttc

SEQ ID NO: 3505648 - DNA, 14 bp, Homo sapiens
ctgggaggagcccc

SEQ ID NO: 3505649 - DNA, 14 bp, Homo sapiens
ctgggaggccagtg

SEQ ID NO: 3505650 - DNA, 13 bp, Homo sapiens
ctgggagggcagc

SEQ ID NO: 3505651 - DNA, 20 bp, Homo sapiens
ctgggagggcagcagggcta

SEQ ID NO: 3505652 - DNA, 21 bp, Homo sapiens
ctgggaggttggtttaatgca

SEQ ID NO: 3505653 - DNA, 16 bp, Homo sapiens
ctgggagtgagctggt

SEQ ID NO: 3505654 - DNA, 18 bp, Homo sapiens
ctgggataatgcccatgg

SEQ ID NO: 3505655 - DNA, 15 bp, Homo sapiens
ctgggatcacaggtg

SEQ ID NO: 3505656 - DNA, 17 bp, Homo sapiens
ctgggatcctaagggct

SEQ ID NO: 3505657 - DNA, 22 bp, Homo sapiens
ctgggcacacgcctcccactgg

SEQ ID NO: 3505658 - DNA, 20 bp, Homo sapiens
ctgggccattctccacagca

SEQ ID NO: 3505659 - DNA, 11 bp, Homo sapiens
ctgggccctct

SEQ ID NO: 3505660 - DNA, 16 bp, Homo sapiens
ctgggccctgagccag

SEQ ID NO: 3505661 - DNA, 14 bp, Homo sapiens
ctgggccctgggct

SEQ ID NO: 3505662 - DNA, 15 bp, Homo sapiens
ctgggccctgggctg

SEQ ID NO: 3505663 - DNA, 24 bp, Homo sapiens
ctgggccgtatctccggctcccag

SEQ ID NO: 3505664 - DNA, 20 bp, Homo sapiens
ctgggcctggcagctcagct

SEQ ID NO: 3505665 - DNA, 14 bp, Homo sapiens
ctgggctaccccac

SEQ ID NO: 3505666 - DNA, 20 bp, Homo sapiens
ctgggctagaggctgagcac

SEQ ID NO: 3505667 - DNA, 21 bp, Homo sapiens
ctgggctcccgggccccacag

SEQ ID NO: 3505668 - DNA, 15 bp, Homo sapiens
ctgggctcctccagg

SEQ ID NO: 3505669 - DNA, 12 bp, Homo sapiens
ctgggctgaggg

SEQ ID NO: 3505670 - DNA, 18 bp, Homo sapiens
ctgggctgagggagcctg

SEQ ID NO: 3505671 - DNA, 14 bp, Homo sapiens
ctgggctgcagaga

SEQ ID NO: 3505672 - DNA, 17 bp, Homo sapiens
ctgggcttcagtggcag

SEQ ID NO: 3505673 - DNA, 22 bp, Homo sapiens
ctgggcttcagtggcagctgct

SEQ ID NO: 3505674 - DNA, 23 bp, Homo sapiens
ctgggcttcagtggcagctgctt

SEQ ID NO: 3505675 - DNA, 24 bp, Homo sapiens
ctgggcttcagtggcagctgcttt

SEQ ID NO: 3505676 - DNA, 20 bp, Homo sapiens
ctgggcttggggcttcctaa

SEQ ID NO: 3505677 - DNA, 22 bp, Homo sapiens
ctggggaaaggggacaaggaag

SEQ ID NO: 3505678 - DNA, 12 bp, Homo sapiens
ctggggaaggag

SEQ ID NO: 3505679 - DNA, 10 bp, Homo sapiens
ctgtgtcttt

SEQ ID NO: 3505680 - DNA, 17 bp, Homo sapiens
ctgtgtgctgactgaac

SEQ ID NO: 3505681 - DNA, 18 bp, Homo sapiens
ctgtgtgtgcgcctacag

SEQ ID NO: 3505682 - DNA, 14 bp, Homo sapiens
ctgtgtgtgtgaat

SEQ ID NO: 3505683 - DNA, 17 bp, Homo sapiens
ctgtgtgtgtgaatgaa

SEQ ID NO: 3505684 - DNA, 21 bp, Homo sapiens
ctgtgtgtgtgaatgaacact

SEQ ID NO: 3505685 - DNA, 13 bp, Homo sapiens
ctgtgtgttgcca

SEQ ID NO: 3505686 - DNA, 19 bp, Homo sapiens
ctgtgtgttgccacaggac

SEQ ID NO: 3505687 - DNA, 22 bp, Homo sapiens
ctgtgtgttgccacaggacaca

SEQ ID NO: 3505688 - DNA, 22 bp, Homo sapiens
ctgtgttactgctttgcaaaga

SEQ ID NO: 3505689 - DNA, 14 bp, Homo sapiens
ctgtgttcaggata

SEQ ID NO: 3505690 - DNA, 19 bp, Homo sapiens
ctgtgttgccaagctccaa

SEQ ID NO: 3505691 - DNA, 20 bp, Homo sapiens
ctgttaactttcatgctaca

SEQ ID NO: 3505692 - DNA, 17 bp, Homo sapiens
ctgttactgtcttcagt

SEQ ID NO: 3505693 - DNA, 15 bp, Homo sapiens
ctgttagcagacagg

SEQ ID NO: 3505694 - DNA, 14 bp, Homo sapiens
ctgttagggccttg

SEQ ID NO: 3505695 - DNA, 20 bp, Homo sapiens
ctgttattatatttgacatg

SEQ ID NO: 3505696 - DNA, 22 bp, Homo sapiens
ctgttcaaacccagtcttgtgg

SEQ ID NO: 3505697 - DNA, 21 bp, Homo sapiens
ctgttcaagagcacacttggc

SEQ ID NO: 3505698 - DNA, 17 bp, Homo sapiens
ctgttcaatgtttaatg

SEQ ID NO: 3505699 - DNA, 13 bp, Homo sapiens
ctgttcagctcca

SEQ ID NO: 3505700 - DNA, 14 bp, Homo sapiens
ctgttcagctccag

SEQ ID NO: 3505701 - DNA, 22 bp, Homo sapiens
ctgttcagctccagctcaccag

SEQ ID NO: 3505702 - DNA, 16 bp, Homo sapiens
ctgttcagtaataaaa

SEQ ID NO: 3505703 - DNA, 12 bp, Homo sapiens
ctgttccccctg

SEQ ID NO: 3505704 - DNA, 16 bp, Homo sapiens
ctgttcccccttcaca

SEQ ID NO: 3505705 - DNA, 21 bp, Homo sapiens
ctgttctcttgggaactgaac

SEQ ID NO: 3505706 - DNA, 18 bp, Homo sapiens
ctgttctgggactccagg

SEQ ID NO: 3505707 - DNA, 17 bp, Homo sapiens
ctgttgacatatttaat

SEQ ID NO: 3505708 - DNA, 17 bp, Homo sapiens
ctgttgagcatcacaga

SEQ ID NO: 3505709 - DNA, 17 bp, Homo sapiens
ctgttgctaacacacag

SEQ ID NO: 3505710 - DNA, 15 bp, Homo sapiens
ctgttgctgaatagg

SEQ ID NO: 3505711 - DNA, 19 bp, Homo sapiens
ctgttggcaggctggccag

SEQ ID NO: 3505712 - DNA, 15 bp, Homo sapiens
ctgttggccagtgtg

SEQ ID NO: 3505713 - DNA, 22 bp, Homo sapiens
ctgttggctgggggcctcagtg

SEQ ID NO: 3505714 - DNA, 17 bp, Homo sapiens
ctgttgtacaatcatgt

SEQ ID NO: 3505715 - DNA, 18 bp, Homo sapiens
ctgttgtacaatcatgtt

SEQ ID NO: 3505716 - DNA, 20 bp, Homo sapiens
ctgttgtacaatcatgttct

SEQ ID NO: 3505717 - DNA, 15 bp, Homo sapiens
ctgtttactgcaagg

SEQ ID NO: 3505718 - DNA, 18 bp, Homo sapiens
ctgtttaggttcccctgt

SEQ ID NO: 3505719 - DNA, 20 bp, Homo sapiens
ctgtttaggttcccctgtca

SEQ ID NO: 3505720 - DNA, 23 bp, Homo sapiens
ctgtttattgaaagaattatcct

SEQ ID NO: 3505721 - DNA, 21 bp, Homo sapiens
ctgtttcccagcagtggactc

SEQ ID NO: 3505722 - DNA, 17 bp, Homo sapiens
ctgtttgcttcaccgtg

SEQ ID NO: 3505723 - DNA, 18 bp, Homo sapiens
ctgtttgcttcaccgtgg

SEQ ID NO: 3505724 - DNA, 12 bp, Homo sapiens
ctgtttggactg

SEQ ID NO: 3505725 - DNA, 13 bp, Homo sapiens
ctgtttgttattg

SEQ ID NO: 3505726 - DNA, 17 bp, Homo sapiens
ctgttttcctcccttct

SEQ ID NO: 3505727 - DNA, 20 bp, Homo sapiens
ctgttttcctcccttctgct

SEQ ID NO: 3505728 - DNA, 23 bp, Homo sapiens
ctgttttcctcccttctgctact

SEQ ID NO: 3505729 - DNA, 13 bp, Homo sapiens
ctgttttctcttg

SEQ ID NO: 3505730 - DNA, 14 bp, Homo sapiens
ctgttttctcttga

SEQ ID NO: 3505731 - DNA, 17 bp, Homo sapiens
ctgttttgaaggcaaaa

SEQ ID NO: 3505732 - DNA, 23 bp, Homo sapiens
ctgttttgagttttgtagcagtg

SEQ ID NO: 3505733 - DNA, 20 bp, Homo sapiens
ctgttttgtggtcagctgta

SEQ ID NO: 3505734 - DNA, 21 bp, Homo sapiens
ctgttttgtttggcaaggaaa

SEQ ID NO: 3505735 - DNA, 16 bp, Homo sapiens
ctgtttttaagctgtt

SEQ ID NO: 3505736 - DNA, 18 bp, Homo sapiens
ctgtttttaagctgtttc

SEQ ID NO: 3505737 - DNA, 18 bp, Homo sapiens
ctgtttttattagccaat

SEQ ID NO: 3505738 - DNA, 16 bp, Homo sapiens
ctgtttttttttcatt

SEQ ID NO: 3505739 - DNA, 22 bp, Homo sapiens
cttaaaaatattttttctgtac

SEQ ID NO: 3505740 - DNA, 22 bp, Homo sapiens
cttaaaaatcacactgtaaata

SEQ ID NO: 3505741 - DNA, 22 bp, Homo sapiens
cttaaaaatgttttttcatgtg

SEQ ID NO: 3505742 - DNA, 14 bp, Homo sapiens
cttaaaacaacact

SEQ ID NO: 3505743 - DNA, 17 bp, Homo sapiens
cttaaaagagctcagac

SEQ ID NO: 3505744 - DNA, 20 bp, Homo sapiens
cttaaaatgtactctccttt

SEQ ID NO: 3505745 - DNA, 13 bp, Homo sapiens
cttaaacaaaaat

SEQ ID NO: 3505746 - DNA, 19 bp, Homo sapiens
cttaaacaaaaattaaaat

SEQ ID NO: 3505747 - DNA, 18 bp, Homo sapiens
cttaaccagatggttgtg

SEQ ID NO: 3505748 - DNA, 17 bp, Homo sapiens
cttaactccttccagtg

SEQ ID NO: 3505749 - DNA, 18 bp, Homo sapiens
cttaagagaatattttaa

SEQ ID NO: 3505750 - DNA, 14 bp, Homo sapiens
cttaagcaaaagaa

SEQ ID NO: 3505751 - DNA, 18 bp, Homo sapiens
cttaagcaaaagaaaaag

SEQ ID NO: 3505752 - DNA, 12 bp, Homo sapiens
cttaagcaaagg

SEQ ID NO: 3505753 - DNA, 22 bp, Homo sapiens
cttaagcaaaggggacagctgt

SEQ ID NO: 3505754 - DNA, 21 bp, Homo sapiens
cttaaggaacatctctgcttt

SEQ ID NO: 3505755 - DNA, 21 bp, Homo sapiens
cttaaggtgtagccacaccag

SEQ ID NO: 3505756 - DNA, 14 bp, Homo sapiens
cttaatcattttca

SEQ ID NO: 3505757 - DNA, 20 bp, Homo sapiens
cttaatcattttcattccta

SEQ ID NO: 3505758 - DNA, 15 bp, Homo sapiens
cttaatgaagtttga

SEQ ID NO: 3505759 - DNA, 17 bp, Homo sapiens
cttaatgaagtttgaat

SEQ ID NO: 3505760 - DNA, 20 bp, Homo sapiens
cttaatgtgattactgctct

SEQ ID NO: 3505761 - DNA, 11 bp, Homo sapiens
cttacacccac

SEQ ID NO: 3505762 - DNA, 14 bp, Homo sapiens
cttacagctgggtg

SEQ ID NO: 3505763 - DNA, 22 bp, Homo sapiens
cttacatgtataaagtgattga

SEQ ID NO: 3505764 - DNA, 14 bp, Homo sapiens
cttacatgttttct

SEQ ID NO: 3505765 - DNA, 21 bp, Homo sapiens
cttacatgttttctttgcttt

SEQ ID NO: 3505766 - DNA, 20 bp, Homo sapiens
cttacattctctaataagaa

SEQ ID NO: 3505767 - DNA, 21 bp, Homo sapiens
cttacattctctaataagaaa

SEQ ID NO: 3505768 - DNA, 23 bp, Homo sapiens
cttacattctctaataagaaaac

SEQ ID NO: 3505769 - DNA, 15 bp, Homo sapiens
cttaccgagagccaa

SEQ ID NO: 3505770 - DNA, 13 bp, Homo sapiens
cttacctcggtgc

SEQ ID NO: 3505771 - DNA, 19 bp, Homo sapiens
cttacctcggtgccttcct

SEQ ID NO: 3505772 - DNA, 18 bp, Homo sapiens
cttactatgatctcagga

SEQ ID NO: 3505773 - DNA, 16 bp, Homo sapiens
cttactctttcctatt

SEQ ID NO: 3505774 - DNA, 16 bp, Homo sapiens
cttactgtaagacatt

SEQ ID NO: 3505775 - DNA, 16 bp, Homo sapiens
cttactgtagcctcag

SEQ ID NO: 3505776 - DNA, 17 bp, Homo sapiens
cttactgtagcctcaga

SEQ ID NO: 3505777 - DNA, 18 bp, Homo sapiens
cttacttggctttttact

SEQ ID NO: 3505778 - DNA, 15 bp, Homo sapiens
cttagaaaattcaag

SEQ ID NO: 3505779 - DNA, 15 bp, Homo sapiens
cttagaacattttaa

SEQ ID NO: 3505780 - DNA, 17 bp, Homo sapiens
cttagaagtcacacagt

SEQ ID NO: 3505781 - DNA, 18 bp, Homo sapiens
cttagaatgcatctcatc

SEQ ID NO: 3505782 - DNA, 11 bp, Homo sapiens
cttagagcagt

SEQ ID NO: 3505783 - DNA, 14 bp, Homo sapiens
cttagatgttctaa

SEQ ID NO: 3505784 - DNA, 22 bp, Homo sapiens
cttagccatttttcaaagcaat

SEQ ID NO: 3505785 - DNA, 18 bp, Homo sapiens
cttagcttcaggaacctc

SEQ ID NO: 3505786 - DNA, 19 bp, Homo sapiens
cttaggcatgactgtagaa

SEQ ID NO: 3505787 - DNA, 23 bp, Homo sapiens
cttaggccttcctctctccagat

SEQ ID NO: 3505788 - DNA, 16 bp, Homo sapiens
cttaggctgctgggat

SEQ ID NO: 3505789 - DNA, 16 bp, Homo sapiens
cttaggggctgctgac

SEQ ID NO: 3505790 - DNA, 23 bp, Homo sapiens
cttaggttggcaaaaaggcagga

SEQ ID NO: 3505791 - DNA, 21 bp, Homo sapiens
cttaggttgtagcagaaagga

SEQ ID NO: 3505792 - DNA, 16 bp, Homo sapiens
cttagtagattaaaaa

SEQ ID NO: 3505793 - DNA, 22 bp, Homo sapiens
cttagtttgtgtgttgtctctt

SEQ ID NO: 3505794 - DNA, 18 bp, Homo sapiens
cttatactgtacaataaa

SEQ ID NO: 3505795 - DNA, 14 bp, Homo sapiens
cttatagaatattt

SEQ ID NO: 3505796 - DNA, 16 bp, Homo sapiens
cttatagaatatttat

SEQ ID NO: 3505797 - DNA, 16 bp, Homo sapiens
cttatagtttgggctt

SEQ ID NO: 3505798 - DNA, 16 bp, Homo sapiens
cttatccctgcccatt

SEQ ID NO: 3505799 - DNA, 22 bp, Homo sapiens
cttatccctgcccatttcatat

SEQ ID NO: 3505800 - DNA, 21 bp, Homo sapiens
cttatcctagcacatgcttca

SEQ ID NO: 3505801 - DNA, 13 bp, Homo sapiens
cttatccttcctc

SEQ ID NO: 3505802 - DNA, 14 bp, Homo sapiens
cttatctccaagac

SEQ ID NO: 3505803 - DNA, 16 bp, Homo sapiens
cttatctccaagacca

SEQ ID NO: 3505804 - DNA, 18 bp, Homo sapiens
cttatctccacaacctct

SEQ ID NO: 3505805 - DNA, 12 bp, Homo sapiens
cttatctctttt

SEQ ID NO: 3505806 - DNA, 14 bp, Homo sapiens
cttatctgtgctca

SEQ ID NO: 3505807 - DNA, 22 bp, Homo sapiens
cttatctgtgctcaggactcag

SEQ ID NO: 3505808 - DNA, 19 bp, Homo sapiens
cttatgaatgatttgcata

SEQ ID NO: 3505809 - DNA, 20 bp, Homo sapiens
cttatgaatgatttgcatat

SEQ ID NO: 3505810 - DNA, 17 bp, Homo sapiens
cttatggaattgatttg

SEQ ID NO: 3505811 - DNA, 13 bp, Homo sapiens
cttgattctgcag

SEQ ID NO: 3505812 - DNA, 21 bp, Homo sapiens
cttgattctgcagtaaatctt

SEQ ID NO: 3505813 - DNA, 19 bp, Homo sapiens
cttgatttaaacacacaga

SEQ ID NO: 3505814 - DNA, 15 bp, Homo sapiens
cttgcaatggcagcc

SEQ ID NO: 3505815 - DNA, 18 bp, Homo sapiens
cttgcagctaaggagggg

SEQ ID NO: 3505816 - DNA, 14 bp, Homo sapiens
cttgcattgtgaca

SEQ ID NO: 3505817 - DNA, 16 bp, Homo sapiens
cttgccacccccagtt

SEQ ID NO: 3505818 - DNA, 16 bp, Homo sapiens
cttgccagagatccaa

SEQ ID NO: 3505819 - DNA, 20 bp, Homo sapiens
cttgccagggaggtggaagg

SEQ ID NO: 3505820 - DNA, 15 bp, Homo sapiens
cttgccatgtgactc

SEQ ID NO: 3505821 - DNA, 22 bp, Homo sapiens
cttgccccactctgcctgcctg

SEQ ID NO: 3505822 - DNA, 23 bp, Homo sapiens
cttgccccctgcccgtgtacata

SEQ ID NO: 3505823 - DNA, 19 bp, Homo sapiens
cttgcctctgtccccttct

SEQ ID NO: 3505824 - DNA, 16 bp, Homo sapiens
cttgcctctgtgctgt

SEQ ID NO: 3505825 - DNA, 13 bp, Homo sapiens
cttgcctcttcct

SEQ ID NO: 3505826 - DNA, 16 bp, Homo sapiens
cttgcctcttccttga

SEQ ID NO: 3505827 - DNA, 13 bp, Homo sapiens
cttgcctgcaggc

SEQ ID NO: 3505828 - DNA, 20 bp, Homo sapiens
cttgccttattagagtgtct

SEQ ID NO: 3505829 - DNA, 20 bp, Homo sapiens
cttgccttcctaagcctgtg

SEQ ID NO: 3505830 - DNA, 17 bp, Homo sapiens
cttgcctttcgaggcct

SEQ ID NO: 3505831 - DNA, 18 bp, Homo sapiens
cttgcctttcgaggcctg

SEQ ID NO: 3505832 - DNA, 17 bp, Homo sapiens
cttgctatattgcccag

SEQ ID NO: 3505833 - DNA, 12 bp, Homo sapiens
cttgctctgctg

SEQ ID NO: 3505834 - DNA, 13 bp, Homo sapiens
cttgctctgctga

SEQ ID NO: 3505835 - DNA, 14 bp, Homo sapiens
cttgctctgctgac

SEQ ID NO: 3505836 - DNA, 19 bp, Homo sapiens
cttgctctgtttgtggggt

SEQ ID NO: 3505837 - DNA, 22 bp, Homo sapiens
cttgctggctacgcctcttctg

SEQ ID NO: 3505838 - DNA, 17 bp, Homo sapiens
cttgcttccctaatcta

SEQ ID NO: 3505839 - DNA, 14 bp, Homo sapiens
cttgcttcttactg

SEQ ID NO: 3505840 - DNA, 19 bp, Homo sapiens
cttgcttcttactgataat

SEQ ID NO: 3505841 - DNA, 20 bp, Homo sapiens
cttgcttcttactgataatt

SEQ ID NO: 3505842 - DNA, 13 bp, Homo sapiens
cttgctttcttta

SEQ ID NO: 3505843 - DNA, 20 bp, Homo sapiens
cttggaagctccgctttcta

SEQ ID NO: 3505844 - DNA, 22 bp, Homo sapiens
cttggaagggggctcttttact

SEQ ID NO: 3505845 - DNA, 17 bp, Homo sapiens
cttggacatcagtgttt

SEQ ID NO: 3505846 - DNA, 15 bp, Homo sapiens
cttggacatcctcct

SEQ ID NO: 3505847 - DNA, 21 bp, Homo sapiens
cttggacatcctcctcccacc

SEQ ID NO: 3505848 - DNA, 16 bp, Homo sapiens
cttggaccagatctaa

SEQ ID NO: 3505849 - DNA, 22 bp, Homo sapiens
cttggactattataatttaatg

SEQ ID NO: 3505850 - DNA, 14 bp, Homo sapiens
cttggagctgagca

SEQ ID NO: 3505851 - DNA, 16 bp, Homo sapiens
cttggcatcagctggc

SEQ ID NO: 3505852 - DNA, 14 bp, Homo sapiens
cttggcattccgca

SEQ ID NO: 3505853 - DNA, 17 bp, Homo sapiens
cttggcctgatcagacc

SEQ ID NO: 3505854 - DNA, 12 bp, Homo sapiens
cttggcctgggc

SEQ ID NO: 3505855 - DNA, 22 bp, Homo sapiens
cttggccttctcccctcttctg

SEQ ID NO: 3505856 - DNA, 18 bp, Homo sapiens
cttggctcgaatctctgt

SEQ ID NO: 3505857 - DNA, 21 bp, Homo sapiens
cttggctcgaatctctgtgcc

SEQ ID NO: 3505858 - DNA, 22 bp, Homo sapiens
cttggctcgaatctctgtgcct

SEQ ID NO: 3505859 - DNA, 13 bp, Homo sapiens
cttggctgcaggg

SEQ ID NO: 3505860 - DNA, 10 bp, Homo sapiens
cttgggagcc

SEQ ID NO: 3505861 - DNA, 15 bp, Homo sapiens
cttgggaggccccac

SEQ ID NO: 3505862 - DNA, 13 bp, Homo sapiens
cttgggcagagct

SEQ ID NO: 3505863 - DNA, 22 bp, Homo sapiens
cttgggcagagctggctctgag

SEQ ID NO: 3505864 - DNA, 23 bp, Homo sapiens
cttgggcagagctggctctgagc

SEQ ID NO: 3505865 - DNA, 14 bp, Homo sapiens
cttgggccaagcca

SEQ ID NO: 3505866 - DNA, 17 bp, Homo sapiens
cttgggccaagccagct

SEQ ID NO: 3505867 - DNA, 21 bp, Homo sapiens
cttgggccaagccagctgcct

SEQ ID NO: 3505868 - DNA, 18 bp, Homo sapiens
cttgggccactgtgaaga

SEQ ID NO: 3505869 - DNA, 16 bp, Homo sapiens
cttgggccctttgagt

SEQ ID NO: 3505870 - DNA, 19 bp, Homo sapiens
cttgggccctttgagtgca

SEQ ID NO: 3505871 - DNA, 21 bp, Homo sapiens
cttgggctccctgtaacctct

SEQ ID NO: 3505872 - DNA, 23 bp, Homo sapiens
cttggggcaacattgttcacctt

SEQ ID NO: 3505873 - DNA, 14 bp, Homo sapiens
cttggggcaggcag

SEQ ID NO: 3505874 - DNA, 15 bp, Homo sapiens
cttggggcaggcagt

SEQ ID NO: 3505875 - DNA, 13 bp, Homo sapiens
cttggggccttga

SEQ ID NO: 3505876 - DNA, 18 bp, Homo sapiens
cttggggctcacacacct

SEQ ID NO: 3505877 - DNA, 14 bp, Homo sapiens
cttggggcttccta

SEQ ID NO: 3505878 - DNA, 19 bp, Homo sapiens
cttgggggctcccagggca

SEQ ID NO: 3505879 - DNA, 15 bp, Homo sapiens
cttggggggctgagg

SEQ ID NO: 3505880 - DNA, 18 bp, Homo sapiens
cttgggggggtggccgct

SEQ ID NO: 3505881 - DNA, 19 bp, Homo sapiens
cttgggggggtggccgctg

SEQ ID NO: 3505882 - DNA, 23 bp, Homo sapiens
cttgggggttcaggcccggcagg

SEQ ID NO: 3505883 - DNA, 14 bp, Homo sapiens
cttgggtctctctc

SEQ ID NO: 3505884 - DNA, 18 bp, Homo sapiens
cttgggtctctctccatt

SEQ ID NO: 3505885 - DNA, 16 bp, Homo sapiens
cttggttcccccactg

SEQ ID NO: 3505886 - DNA, 14 bp, Homo sapiens
cttggttgaggaaa

SEQ ID NO: 3505887 - DNA, 16 bp, Homo sapiens
cttggttgaggaaaca

SEQ ID NO: 3505888 - DNA, 16 bp, Homo sapiens
cttgtaaataaagccc

SEQ ID NO: 3505889 - DNA, 17 bp, Homo sapiens
cttgtaaataaagccct

SEQ ID NO: 3505890 - DNA, 19 bp, Homo sapiens
cttgtaaataaagccctgg

SEQ ID NO: 3505891 - DNA, 21 bp, Homo sapiens
cttgtaaatagctcaggtgtc

SEQ ID NO: 3505892 - DNA, 15 bp, Homo sapiens
cttgtaaggctttga

SEQ ID NO: 3505893 - DNA, 22 bp, Homo sapiens
cttgtagcgactaaactagatt

SEQ ID NO: 3505894 - DNA, 23 bp, Homo sapiens
cttgtattaaactcttcacaaaa

SEQ ID NO: 3505895 - DNA, 19 bp, Homo sapiens
cttgtcaagcctgtgcaaa

SEQ ID NO: 3505896 - DNA, 16 bp, Homo sapiens
cttgtcactagcagct

SEQ ID NO: 3505897 - DNA, 18 bp, Homo sapiens
cttgtcactagcagctgc

SEQ ID NO: 3505898 - DNA, 16 bp, Homo sapiens
cttgtcccactcaagc

SEQ ID NO: 3505899 - DNA, 21 bp, Homo sapiens
cttgtcccactcaagccaagc

SEQ ID NO: 3505900 - DNA, 21 bp, Homo sapiens
cttgtcccctcctcactccct

SEQ ID NO: 3505901 - DNA, 21 bp, Homo sapiens
cttgtccggaggatattaaaa

SEQ ID NO: 3505902 - DNA, 17 bp, Homo sapiens
cttgtctcaatgctcat

SEQ ID NO: 3505903 - DNA, 19 bp, Homo sapiens
cttgtctcaatgctcataa

SEQ ID NO: 3505904 - DNA, 13 bp, Homo sapiens
cttgtctctgggc

SEQ ID NO: 3505905 - DNA, 13 bp, Homo sapiens
cttgtctgtagat

SEQ ID NO: 3505906 - DNA, 17 bp, Homo sapiens
cttgtgaggaaagtcat

SEQ ID NO: 3505907 - DNA, 18 bp, Homo sapiens
cttgtggacacagctctt

SEQ ID NO: 3505908 - DNA, 19 bp, Homo sapiens
cttgttacccatgaaaaac

SEQ ID NO: 3505909 - DNA, 17 bp, Homo sapiens
cttgttacttctgaggt

SEQ ID NO: 3505910 - DNA, 13 bp, Homo sapiens
cttgttatttata

SEQ ID NO: 3505911 - DNA, 15 bp, Homo sapiens
cttgttatttataac

SEQ ID NO: 3505912 - DNA, 16 bp, Homo sapiens
cttgttcattttgagt

SEQ ID NO: 3505913 - DNA, 15 bp, Homo sapiens
cttgttccaaggcca

SEQ ID NO: 3505914 - DNA, 21 bp, Homo sapiens
cttgttccccactgacagcct

SEQ ID NO: 3505915 - DNA, 16 bp, Homo sapiens
cttgttctgagattca

SEQ ID NO: 3505916 - DNA, 17 bp, Homo sapiens
cttgttctgtcactcag

SEQ ID NO: 3505917 - DNA, 23 bp, Homo sapiens
cttgttgctgagtctgcagatga

SEQ ID NO: 3505918 - DNA, 21 bp, Homo sapiens
cttgttgctttgttgcactga

SEQ ID NO: 3505919 - DNA, 13 bp, Homo sapiens
cttgtttgcactg

SEQ ID NO: 3505920 - DNA, 15 bp, Homo sapiens
cttgtttgcactgtg

SEQ ID NO: 3505921 - DNA, 18 bp, Homo sapiens
cttgtttgctcacctggg

SEQ ID NO: 3505922 - DNA, 19 bp, Homo sapiens
cttgtttgctcacctgggg

SEQ ID NO: 3505923 - DNA, 20 bp, Homo sapiens
cttgtttgctcacctggggt

SEQ ID NO: 3505924 - DNA, 14 bp, Homo sapiens
cttgttttccaaag

SEQ ID NO: 3505925 - DNA, 16 bp, Homo sapiens
cttgtttttgcacatg

SEQ ID NO: 3505926 - DNA, 15 bp, Homo sapiens
ctttaaaagagagag

SEQ ID NO: 3505927 - DNA, 21 bp, Homo sapiens
ctttaaaatgtaaagccatgc

SEQ ID NO: 3505928 - DNA, 21 bp, Homo sapiens
ctttaaaatttttttagaaag

SEQ ID NO: 3505929 - DNA, 23 bp, Homo sapiens
ctttaaagtgactaatggcatga

SEQ ID NO: 3505930 - DNA, 19 bp, Homo sapiens
ctttaactccctttttaca

SEQ ID NO: 3505931 - DNA, 21 bp, Homo sapiens
ctttaactccctttttacact

SEQ ID NO: 3505932 - DNA, 22 bp, Homo sapiens
ctttaactccctttttacactt

SEQ ID NO: 3505933 - DNA, 22 bp, Homo sapiens
ctttaactgagggctgatcttt

SEQ ID NO: 3505934 - DNA, 18 bp, Homo sapiens
ctttaactggaaggctgc

SEQ ID NO: 3505935 - DNA, 14 bp, Homo sapiens
ctttaagaggacat

SEQ ID NO: 3505936 - DNA, 17 bp, Homo sapiens
ctttaagtgcacaacat

SEQ ID NO: 3505937 - DNA, 12 bp, Homo sapiens
ctttaatgcttt

SEQ ID NO: 3505938 - DNA, 19 bp, Homo sapiens
ctttaatgtcacaggcagg

SEQ ID NO: 3505939 - DNA, 18 bp, Homo sapiens
ctttaatgttttaactct

SEQ ID NO: 3505940 - DNA, 22 bp, Homo sapiens
ctttaatgttttaactcttttg

SEQ ID NO: 3505941 - DNA, 13 bp, Homo sapiens
ctttacaaatatt

SEQ ID NO: 3505942 - DNA, 19 bp, Homo sapiens
ctttaccctctttgctgca

SEQ ID NO: 3505943 - DNA, 14 bp, Homo sapiens
cttttaaaagacaa

SEQ ID NO: 3505944 - DNA, 13 bp, Homo sapiens
cttttaaaatgca

SEQ ID NO: 3505945 - DNA, 19 bp, Homo sapiens
cttttaaaatgcaatgtaa

SEQ ID NO: 3505946 - DNA, 12 bp, Homo sapiens
cttttaaacaca

SEQ ID NO: 3505947 - DNA, 16 bp, Homo sapiens
cttttaagtaaggtcc

SEQ ID NO: 3505948 - DNA, 13 bp, Homo sapiens
cttttaatgaaaa

SEQ ID NO: 3505949 - DNA, 14 bp, Homo sapiens
cttttacctgctgc

SEQ ID NO: 3505950 - DNA, 15 bp, Homo sapiens
cttttacctgctgct

SEQ ID NO: 3505951 - DNA, 18 bp, Homo sapiens
cttttactacagctatga

SEQ ID NO: 3505952 - DNA, 20 bp, Homo sapiens
cttttatactctttctgtat

SEQ ID NO: 3505953 - DNA, 19 bp, Homo sapiens
cttttataggtgagaaaaa

SEQ ID NO: 3505954 - DNA, 20 bp, Homo sapiens
cttttataggtgagaaaaaa

SEQ ID NO: 3505955 - DNA, 14 bp, Homo sapiens
cttttatatttgta

SEQ ID NO: 3505956 - DNA, 15 bp, Homo sapiens
cttttatgtagtaat

SEQ ID NO: 3505957 - DNA, 22 bp, Homo sapiens
cttttatgtagtaattgacatg

SEQ ID NO: 3505958 - DNA, 23 bp, Homo sapiens
cttttatgtagtaattgacatgt

SEQ ID NO: 3505959 - DNA, 15 bp, Homo sapiens
cttttcaaaacattt

SEQ ID NO: 3505960 - DNA, 12 bp, Homo sapiens
cttttcaccttt

SEQ ID NO: 3505961 - DNA, 19 bp, Homo sapiens
cttttccactccattgtcg

SEQ ID NO: 3505962 - DNA, 16 bp, Homo sapiens
cttttccattatgctg

SEQ ID NO: 3505963 - DNA, 15 bp, Homo sapiens
cttttcccctttcct

SEQ ID NO: 3505964 - DNA, 22 bp, Homo sapiens
cttttcccctttcctgtcccac

SEQ ID NO: 3505965 - DNA, 18 bp, Homo sapiens
cttttccctgtacttttc

SEQ ID NO: 3505966 - DNA, 21 bp, Homo sapiens
cttttccttggggcaggcagt

SEQ ID NO: 3505967 - DNA, 14 bp, Homo sapiens
cttttcgcctttcc

SEQ ID NO: 3505968 - DNA, 23 bp, Homo sapiens
cttttctgtccgagctttgaaaa

SEQ ID NO: 3505969 - DNA, 12 bp, Homo sapiens
cttttctgtttc

SEQ ID NO: 3505970 - DNA, 17 bp, Homo sapiens
cttttctttaaagaagt

SEQ ID NO: 3505971 - DNA, 13 bp, Homo sapiens
cttttgaacccag

SEQ ID NO: 3505972 - DNA, 14 bp, Homo sapiens
cttttgaacccagg

SEQ ID NO: 3505973 - DNA, 17 bp, Homo sapiens
cttttgaggctctctca

SEQ ID NO: 3505974 - DNA, 18 bp, Homo sapiens
cttttgcagaagagggtg

SEQ ID NO: 3505975 - DNA, 15 bp, Homo sapiens
cttttgtatgtaaat

SEQ ID NO: 3505976 - DNA, 20 bp, Homo sapiens
cttttgtatgtaaatgtgca

SEQ ID NO: 3505977 - DNA, 17 bp, Homo sapiens
cttttgtctatgggact

SEQ ID NO: 3505978 - DNA, 20 bp, Homo sapiens
cttttgtttccttttttccc

SEQ ID NO: 3505979 - DNA, 22 bp, Homo sapiens
ctttttaaggacactggggtct

SEQ ID NO: 3505980 - DNA, 11 bp, Homo sapiens
ctttttacatt

SEQ ID NO: 3505981 - DNA, 13 bp, Homo sapiens
ctttttattgaat

SEQ ID NO: 3505982 - DNA, 19 bp, Homo sapiens
ctttttattgaatctattt

SEQ ID NO: 3505983 - DNA, 13 bp, Homo sapiens
ctttttattgcct

SEQ ID NO: 3505984 - DNA, 15 bp, Homo sapiens
ctttttattgccttc

SEQ ID NO: 3505985 - DNA, 21 bp, Homo sapiens
ctttttatttctaaagttgta

SEQ ID NO: 3505986 - DNA, 13 bp, Homo sapiens
ctttttatttctg

SEQ ID NO: 3505987 - DNA, 16 bp, Homo sapiens
ctttttatttctgcat

SEQ ID NO: 3505988 - DNA, 16 bp, Homo sapiens
ctttttcatcccctta

SEQ ID NO: 3505989 - DNA, 22 bp, Homo sapiens
ctttttcgccaaactgtctctg

SEQ ID NO: 3505990 - DNA, 23 bp, Homo sapiens
ctttttcgccaaactgtctctgc

SEQ ID NO: 3505991 - DNA, 20 bp, Homo sapiens
ctttttctaatgaggagaga

SEQ ID NO: 3505992 - DNA, 22 bp, Homo sapiens
ctttttctaatgaggagagaaa

SEQ ID NO: 3505993 - DNA, 16 bp, Homo sapiens
ctttttcttgtattca

SEQ ID NO: 3505994 - DNA, 12 bp, Homo sapiens
ctttttgaagtg

SEQ ID NO: 3505995 - DNA, 17 bp, Homo sapiens
ctttttgttgtaaaaca

SEQ ID NO: 3505996 - DNA, 21 bp, Homo sapiens
ctttttgttgtaaaacaaaat

SEQ ID NO: 3505997 - DNA, 14 bp, Homo sapiens
ctttttgtttgttt

SEQ ID NO: 3505998 - DNA, 17 bp, Homo sapiens
cttttttaaatattttc

SEQ ID NO: 3505999 - DNA, 21 bp, Homo sapiens
cttttttcacggaagttttca

SEQ ID NO: 3506000 - DNA, 14 bp, Homo sapiens
cttttttctgcctc

SEQ ID NO: 3506001 - DNA, 16 bp, Homo sapiens
cttttttctgcctcct

SEQ ID NO: 3506002 - DNA, 21 bp, Homo sapiens
cttttttgtacataaataaga

SEQ ID NO: 3506003 - DNA, 16 bp, Homo sapiens
cttttttgttgttttg

SEQ ID NO: 3506004 - DNA, 17 bp, Homo sapiens
ctttttttaactggtga

SEQ ID NO: 3506005 - DNA, 16 bp, Homo sapiens
ctttttttccttttta

SEQ ID NO: 3506006 - DNA, 15 bp, Homo sapiens
cttttttttctttaa

SEQ ID NO: 3506007 - DNA, 13 bp, Homo sapiens
gaaaaaaatgttg

SEQ ID NO: 3506008 - DNA, 17 bp, Homo sapiens
gaaaaaataacacacat

SEQ ID NO: 3506009 - DNA, 16 bp, Homo sapiens
gaaaaactgagacagg

SEQ ID NO: 3506010 - DNA, 16 bp, Homo sapiens
gaaaaagaaaaaatat

SEQ ID NO: 3506011 - DNA, 12 bp, Homo sapiens
gaaaaagaaatg

SEQ ID NO: 3506012 - DNA, 21 bp, Homo sapiens
gaaaaagaacatgcagtttga

SEQ ID NO: 3506013 - DNA, 22 bp, Homo sapiens
gaaaaagcagtaactgacaact

SEQ ID NO: 3506014 - DNA, 12 bp, Homo sapiens
gaaaaaggagga

SEQ ID NO: 3506015 - DNA, 18 bp, Homo sapiens
gaaaaagttaatgcttaa

SEQ ID NO: 3506016 - DNA, 20 bp, Homo sapiens
gaaaaagttaatgcttaaga

SEQ ID NO: 3506017 - DNA, 16 bp, Homo sapiens
gaaaaatatcttggcc

SEQ ID NO: 3506018 - DNA, 20 bp, Homo sapiens
gaaaaattcagcaaaccatt

SEQ ID NO: 3506019 - DNA, 13 bp, Homo sapiens
gaaaacaaaactg

SEQ ID NO: 3506020 - DNA, 22 bp, Homo sapiens
gaaaacaataacgataaaagac

SEQ ID NO: 3506021 - DNA, 13 bp, Homo sapiens
gaaaacctctcct

SEQ ID NO: 3506022 - DNA, 13 bp, Homo sapiens
gaaaacgaagctc

SEQ ID NO: 3506023 - DNA, 13 bp, Homo sapiens
gaaaacggagctg

SEQ ID NO: 3506024 - DNA, 15 bp, Homo sapiens
gaaaagaaagaagtt

SEQ ID NO: 3506025 - DNA, 17 bp, Homo sapiens
gaaaagattttaatcaa

SEQ ID NO: 3506026 - DNA, 19 bp, Homo sapiens
gaaaagcagttctggatgg

SEQ ID NO: 3506027 - DNA, 18 bp, Homo sapiens
gaaaagcggacatcagct

SEQ ID NO: 3506028 - DNA, 24 bp, Homo sapiens
gaaaagctagtgtacctcctctca

SEQ ID NO: 3506029 - DNA, 17 bp, Homo sapiens
gaaaagctgctgacagt

SEQ ID NO: 3506030 - DNA, 12 bp, Homo sapiens
gaaaaggaatca

SEQ ID NO: 3506031 - DNA, 19 bp, Homo sapiens
gaaaagtgcatatttatcc

SEQ ID NO: 3506032 - DNA, 19 bp, Homo sapiens
gaaaataacaataaaagac

SEQ ID NO: 3506033 - DNA, 18 bp, Homo sapiens
gaaaataagaatagaaat

SEQ ID NO: 3506034 - DNA, 18 bp, Homo sapiens
gaaaataatgtaattgta

SEQ ID NO: 3506035 - DNA, 13 bp, Homo sapiens
gaaaatagattag

SEQ ID NO: 3506036 - DNA, 19 bp, Homo sapiens
gaaaataggcaggaagccc

SEQ ID NO: 3506037 - DNA, 20 bp, Homo sapiens
gaaaatcagcctgctccagc

SEQ ID NO: 3506038 - DNA, 16 bp, Homo sapiens
gaaaatcatcaagaag

SEQ ID NO: 3506039 - DNA, 22 bp, Homo sapiens
gaaaatctagaggaaaagaaag

SEQ ID NO: 3506040 - DNA, 18 bp, Homo sapiens
gaaaatcttataatttaa

SEQ ID NO: 3506041 - DNA, 19 bp, Homo sapiens
gaaaatcttataatttaaa

SEQ ID NO: 3506042 - DNA, 21 bp, Homo sapiens
gaaaatgcattgtatcgatgt

SEQ ID NO: 3506043 - DNA, 15 bp, Homo sapiens
gaaaatggaaccagg

SEQ ID NO: 3506044 - DNA, 18 bp, Homo sapiens
gaaaatggtccaggagaa

SEQ ID NO: 3506045 - DNA, 20 bp, Homo sapiens
gaaaatgttgagaatcccaa

SEQ ID NO: 3506046 - DNA, 21 bp, Homo sapiens
gaaaatttgttattttgcaac

SEQ ID NO: 3506047 - DNA, 18 bp, Homo sapiens
gaaacagctaatgggaca

SEQ ID NO: 3506048 - DNA, 12 bp, Homo sapiens
gaaacagctgcc

SEQ ID NO: 3506049 - DNA, 14 bp, Homo sapiens
gaaacagctgcctt

SEQ ID NO: 3506050 - DNA, 15 bp, Homo sapiens
gaaacagctgcctta

SEQ ID NO: 3506051 - DNA, 16 bp, Homo sapiens
gaaacagctgccttag

SEQ ID NO: 3506052 - DNA, 22 bp, Homo sapiens
gaaacagctgccttagcttcag

SEQ ID NO: 3506053 - DNA, 16 bp, Homo sapiens
gaaacatcactggggt

SEQ ID NO: 3506054 - DNA, 19 bp, Homo sapiens
gaaacatcagttactctga

SEQ ID NO: 3506055 - DNA, 19 bp, Homo sapiens
gaaacatccatattgcaca

SEQ ID NO: 3506056 - DNA, 17 bp, Homo sapiens
gaaaccacagctgctgg

SEQ ID NO: 3506057 - DNA, 18 bp, Homo sapiens
gaaaccacagctgctgga

SEQ ID NO: 3506058 - DNA, 20 bp, Homo sapiens
gaaaccacagctgctggaga

SEQ ID NO: 3506059 - DNA, 21 bp, Homo sapiens
gaaacccaccagcctaagaag

SEQ ID NO: 3506060 - DNA, 16 bp, Homo sapiens
gaaacccgacagaggg

SEQ ID NO: 3506061 - DNA, 21 bp, Homo sapiens
gaaacctacacactgtcatgc

SEQ ID NO: 3506062 - DNA, 13 bp, Homo sapiens
gaaacgctacctc

SEQ ID NO: 3506063 - DNA, 21 bp, Homo sapiens
gaaacgctacctctctgtccc

SEQ ID NO: 3506064 - DNA, 21 bp, Homo sapiens
gaaactaattgactttagaaa

SEQ ID NO: 3506065 - DNA, 23 bp, Homo sapiens
gaaactactgcctttagaaaata

SEQ ID NO: 3506066 - DNA, 13 bp, Homo sapiens
gaaactggccagg

SEQ ID NO: 3506067 - DNA, 21 bp, Homo sapiens
gaaactgttcccacctgctgg

SEQ ID NO: 3506068 - DNA, 22 bp, Homo sapiens
gaaactgttcccacctgctgga

SEQ ID NO: 3506069 - DNA, 12 bp, Homo sapiens
gaaacttggctc

SEQ ID NO: 3506070 - DNA, 21 bp, Homo sapiens
gaaagaaacccgacagaggga

SEQ ID NO: 3506071 - DNA, 17 bp, Homo sapiens
gaaagaaagaagactgt

SEQ ID NO: 3506072 - DNA, 22 bp, Homo sapiens
gaaagaaagttgcacggctgct

SEQ ID NO: 3506073 - DNA, 22 bp, Homo sapiens
gaaagaactgtcatgtaaacat

SEQ ID NO: 3506074 - DNA, 14 bp, Homo sapiens
gaaagaagactgtg

SEQ ID NO: 3506075 - DNA, 16 bp, Homo sapiens
gaatctggagaccagg

SEQ ID NO: 3506076 - DNA, 19 bp, Homo sapiens
gaatctgtgggtctgggag

SEQ ID NO: 3506077 - DNA, 15 bp, Homo sapiens
gaatcttggtttgcc

SEQ ID NO: 3506078 - DNA, 14 bp, Homo sapiens
gaatcttgtctcaa

SEQ ID NO: 3506079 - DNA, 19 bp, Homo sapiens
gaatctttattgagaaaga

SEQ ID NO: 3506080 - DNA, 22 bp, Homo sapiens
gaatctttattgagaaagagca

SEQ ID NO: 3506081 - DNA, 19 bp, Homo sapiens
gaatgaaagggcccagaga

SEQ ID NO: 3506082 - DNA, 22 bp, Homo sapiens
gaatgaacccctggctccttca

SEQ ID NO: 3506083 - DNA, 14 bp, Homo sapiens
gaatgagaaatgga

SEQ ID NO: 3506084 - DNA, 19 bp, Homo sapiens
gaatgagaatgtgccatgt

SEQ ID NO: 3506085 - DNA, 21 bp, Homo sapiens
gaatgagaatgtgccatgtat

SEQ ID NO: 3506086 - DNA, 17 bp, Homo sapiens
gaatgagagcgacacag

SEQ ID NO: 3506087 - DNA, 23 bp, Homo sapiens
gaatgattctaatttttaagcaa

SEQ ID NO: 3506088 - DNA, 14 bp, Homo sapiens
gaatgatttgcata

SEQ ID NO: 3506089 - DNA, 22 bp, Homo sapiens
gaatgcagtctgtccaggctcg

SEQ ID NO: 3506090 - DNA, 11 bp, Homo sapiens
gaatgcagtgg

SEQ ID NO: 3506091 - DNA, 16 bp, Homo sapiens
gaatgcctgagtgcct

SEQ ID NO: 3506092 - DNA, 13 bp, Homo sapiens
gaatgctgggact

SEQ ID NO: 3506093 - DNA, 16 bp, Homo sapiens
gaatgctgggactcag

SEQ ID NO: 3506094 - DNA, 18 bp, Homo sapiens
gaatgctgggactcagcc

SEQ ID NO: 3506095 - DNA, 13 bp, Homo sapiens
gaatgctgtacat

SEQ ID NO: 3506096 - DNA, 14 bp, Homo sapiens
gaatgctgtacatc

SEQ ID NO: 3506097 - DNA, 15 bp, Homo sapiens
gaatgctgtacatct

SEQ ID NO: 3506098 - DNA, 17 bp, Homo sapiens
gaatgctgtacatctat

SEQ ID NO: 3506099 - DNA, 19 bp, Homo sapiens
gaatgtaaccaatcctact

SEQ ID NO: 3506100 - DNA, 14 bp, Homo sapiens
gaatgtactctgtt

SEQ ID NO: 3506101 - DNA, 15 bp, Homo sapiens
gaatgtgccatgtat

SEQ ID NO: 3506102 - DNA, 22 bp, Homo sapiens
gaatgtgtttcaaaaccatgcc

SEQ ID NO: 3506103 - DNA, 21 bp, Homo sapiens
gaatgttaaataaattgtata

SEQ ID NO: 3506104 - DNA, 17 bp, Homo sapiens
gaatgttacattgtttg

SEQ ID NO: 3506105 - DNA, 16 bp, Homo sapiens
gaatgttactgcctta

SEQ ID NO: 3506106 - DNA, 14 bp, Homo sapiens
gaatgttggataag

SEQ ID NO: 3506107 - DNA, 17 bp, Homo sapiens
gaatgtttgcctctgcc

SEQ ID NO: 3506108 - DNA, 14 bp, Homo sapiens
gaatgtttgtctca

SEQ ID NO: 3506109 - DNA, 16 bp, Homo sapiens
gaatgttttaaattct

SEQ ID NO: 3506110 - DNA, 22 bp, Homo sapiens
gaattacatgtaaaacattatc

SEQ ID NO: 3506111 - DNA, 23 bp, Homo sapiens
gaattcagaagacccctgactca

SEQ ID NO: 3506112 - DNA, 12 bp, Homo sapiens
gaattccaaagc

SEQ ID NO: 3506113 - DNA, 18 bp, Homo sapiens
gaattcctaacttttcaa

SEQ ID NO: 3506114 - DNA, 17 bp, Homo sapiens
gaattcctagaattaaa

SEQ ID NO: 3506115 - DNA, 13 bp, Homo sapiens
gaattccttcgaa

SEQ ID NO: 3506116 - DNA, 14 bp, Homo sapiens
gaattcttctgtta

SEQ ID NO: 3506117 - DNA, 22 bp, Homo sapiens
gaattgaggggattaatatgaa

SEQ ID NO: 3506118 - DNA, 17 bp, Homo sapiens
gaattgatttgcattga

SEQ ID NO: 3506119 - DNA, 15 bp, Homo sapiens
gaattgcgttggtct

SEQ ID NO: 3506120 - DNA, 16 bp, Homo sapiens
gaatttaggtttttat

SEQ ID NO: 3506121 - DNA, 23 bp, Homo sapiens
gaatttattcaattcctctggga

SEQ ID NO: 3506122 - DNA, 15 bp, Homo sapiens
gaatttcccaggacc

SEQ ID NO: 3506123 - DNA, 22 bp, Homo sapiens
gaatttcccaggaccctgaagg

SEQ ID NO: 3506124 - DNA, 17 bp, Homo sapiens
gaatttgagtgctctga

SEQ ID NO: 3506125 - DNA, 13 bp, Homo sapiens
gaatttgcaaagt

SEQ ID NO: 3506126 - DNA, 15 bp, Homo sapiens
gaatttgcaaagtac

SEQ ID NO: 3506127 - DNA, 16 bp, Homo sapiens
gaattttcaaggcctt

SEQ ID NO: 3506128 - DNA, 18 bp, Homo sapiens
gaattttcaaggccttca

SEQ ID NO: 3506129 - DNA, 22 bp, Homo sapiens
gaattttctttttaataaaaag

SEQ ID NO: 3506130 - DNA, 20 bp, Homo sapiens
gaattttgttctctgggaga

SEQ ID NO: 3506131 - DNA, 18 bp, Homo sapiens
gaatttttaaaataaact

SEQ ID NO: 3506132 - DNA, 13 bp, Homo sapiens
gaatttttgcaat

SEQ ID NO: 3506133 - DNA, 19 bp, Homo sapiens
gaatttttgcaataatgca

SEQ ID NO: 3506134 - DNA, 20 bp, Homo sapiens
gaatttttgcaataatgcag

SEQ ID NO: 3506135 - DNA, 20 bp, Homo sapiens
gaatttttttcatcttctct

SEQ ID NO: 3506136 - DNA, 19 bp, Homo sapiens
gaatttttttctgcacagc

SEQ ID NO: 3506137 - DNA, 13 bp, Homo sapiens
gacaaagaacctt

SEQ ID NO: 3506138 - DNA, 17 bp, Homo sapiens
gacaaaggacatttgtt

SEQ ID NO: 3506139 - DNA, 15 bp, Homo sapiens
gacaaatcaaagcag

SEQ ID NO: 3506140 - DNA, 19 bp, Homo sapiens
gacaaattacaaaaggctc

SEQ ID NO: 3506141 - DNA, 14 bp, Homo sapiens
gacaaattctgttt

SEQ ID NO: 3506142 - DNA, 16 bp, Homo sapiens
gacaaattctgtttct

SEQ ID NO: 3506143 - DNA, 16 bp, Homo sapiens
gacaaattgcacagaa

SEQ ID NO: 3506144 - DNA, 23 bp, Homo sapiens
gacaacaggttttcaccatagcc

SEQ ID NO: 3506145 - DNA, 12 bp, Homo sapiens
gacaactggcag

SEQ ID NO: 3506146 - DNA, 13 bp, Homo sapiens
gacaactggcagg

SEQ ID NO: 3506147 - DNA, 18 bp, Homo sapiens
gacaactggcaggcaggc

SEQ ID NO: 3506148 - DNA, 19 bp, Homo sapiens
gacaagacttcagtatgtt

SEQ ID NO: 3506149 - DNA, 16 bp, Homo sapiens
gacaagccagaacttg

SEQ ID NO: 3506150 - DNA, 16 bp, Homo sapiens
gacaaggaaaaaataa

SEQ ID NO: 3506151 - DNA, 17 bp, Homo sapiens
gacaaggaaaggcaaat

SEQ ID NO: 3506152 - DNA, 22 bp, Homo sapiens
gacaaggattgctactgtccta

SEQ ID NO: 3506153 - DNA, 12 bp, Homo sapiens
gacaaggccagc

SEQ ID NO: 3506154 - DNA, 14 bp, Homo sapiens
gacaaggtcacctg

SEQ ID NO: 3506155 - DNA, 16 bp, Homo sapiens
gacaaggtcacctggg

SEQ ID NO: 3506156 - DNA, 15 bp, Homo sapiens
gacaagtggactcag

SEQ ID NO: 3506157 - DNA, 13 bp, Homo sapiens
gacaagtgtcttt

SEQ ID NO: 3506158 - DNA, 14 bp, Homo sapiens
gacaagtgtctttt

SEQ ID NO: 3506159 - DNA, 19 bp, Homo sapiens
gacaataatttcaggtttt

SEQ ID NO: 3506160 - DNA, 13 bp, Homo sapiens
gacaatcactgcc

SEQ ID NO: 3506161 - DNA, 14 bp, Homo sapiens
gacaatcactgcca

SEQ ID NO: 3506162 - DNA, 20 bp, Homo sapiens
gacaatcatgaaatatgcat

SEQ ID NO: 3506163 - DNA, 21 bp, Homo sapiens
gacaatcatgaaatatgcatc

SEQ ID NO: 3506164 - DNA, 19 bp, Homo sapiens
gacaatgtctgcagccctg

SEQ ID NO: 3506165 - DNA, 12 bp, Homo sapiens
gacaattctgca

SEQ ID NO: 3506166 - DNA, 16 bp, Homo sapiens
gacaattctgcatgta

SEQ ID NO: 3506167 - DNA, 13 bp, Homo sapiens
gacaattctgttt

SEQ ID NO: 3506168 - DNA, 14 bp, Homo sapiens
gacacaaacctgcc

SEQ ID NO: 3506169 - DNA, 17 bp, Homo sapiens
gacacacagctctgtcc

SEQ ID NO: 3506170 - DNA, 18 bp, Homo sapiens
gacacacagctctgtcct

SEQ ID NO: 3506171 - DNA, 15 bp, Homo sapiens
gacacagatgaaaca

SEQ ID NO: 3506172 - DNA, 20 bp, Homo sapiens
gacacagctcttctccaggc

SEQ ID NO: 3506173 - DNA, 17 bp, Homo sapiens
gacacaggccctccctg

SEQ ID NO: 3506174 - DNA, 15 bp, Homo sapiens
gacacatatgagggg

SEQ ID NO: 3506175 - DNA, 18 bp, Homo sapiens
gacacccaagagggctgc

SEQ ID NO: 3506176 - DNA, 13 bp, Homo sapiens
gacaccctcaacc

SEQ ID NO: 3506177 - DNA, 12 bp, Homo sapiens
gacacctgggag

SEQ ID NO: 3506178 - DNA, 17 bp, Homo sapiens
gacaccttgacagggca

SEQ ID NO: 3506179 - DNA, 12 bp, Homo sapiens
gacacctttcat

SEQ ID NO: 3506180 - DNA, 19 bp, Homo sapiens
gacaccttttttcaacagt

SEQ ID NO: 3506181 - DNA, 16 bp, Homo sapiens
gacactaaccacgctg

SEQ ID NO: 3506182 - DNA, 20 bp, Homo sapiens
gacactaaccacgctggacc

SEQ ID NO: 3506183 - DNA, 21 bp, Homo sapiens
gacactaaccacgctggacct

SEQ ID NO: 3506184 - DNA, 19 bp, Homo sapiens
gacactcagaccagagaag

SEQ ID NO: 3506185 - DNA, 16 bp, Homo sapiens
gacactccccgaagtc

SEQ ID NO: 3506186 - DNA, 15 bp, Homo sapiens
gacactcccttgggc

SEQ ID NO: 3506187 - DNA, 21 bp, Homo sapiens
gacactctataagattccaaa

SEQ ID NO: 3506188 - DNA, 14 bp, Homo sapiens
gacactgtttcctg

SEQ ID NO: 3506189 - DNA, 15 bp, Homo sapiens
gacactgtttcctga

SEQ ID NO: 3506190 - DNA, 21 bp, Homo sapiens
gacacttcatggaccaagaat

SEQ ID NO: 3506191 - DNA, 18 bp, Homo sapiens
gacacttccattgtttaa

SEQ ID NO: 3506192 - DNA, 13 bp, Homo sapiens
gacagacacacac

SEQ ID NO: 3506193 - DNA, 15 bp, Homo sapiens
gacagacacaggccc

SEQ ID NO: 3506194 - DNA, 20 bp, Homo sapiens
gacagacacaggcccggctc

SEQ ID NO: 3506195 - DNA, 17 bp, Homo sapiens
gacagaccctctgccgc

SEQ ID NO: 3506196 - DNA, 17 bp, Homo sapiens
gacagagaaacagacag

SEQ ID NO: 3506197 - DNA, 15 bp, Homo sapiens
gacagagacctcctg

SEQ ID NO: 3506198 - DNA, 14 bp, Homo sapiens
gacagagagagaga

SEQ ID NO: 3506199 - DNA, 15 bp, Homo sapiens
gacagagaggactgt

SEQ ID NO: 3506200 - DNA, 21 bp, Homo sapiens
gacagagcaagtgagaccctg

SEQ ID NO: 3506201 - DNA, 14 bp, Homo sapiens
gacagaggaggatg

SEQ ID NO: 3506202 - DNA, 12 bp, Homo sapiens
gacagaggcagc

SEQ ID NO: 3506203 - DNA, 13 bp, Homo sapiens
gacagaggcccca

SEQ ID NO: 3506204 - DNA, 16 bp, Homo sapiens
gacagagggaagaaaa

SEQ ID NO: 3506205 - DNA, 19 bp, Homo sapiens
gacagagtgagactctgtc

SEQ ID NO: 3506206 - DNA, 16 bp, Homo sapiens
gacagatgaggctttc

SEQ ID NO: 3506207 - DNA, 14 bp, Homo sapiens
gacagccacggcca

SEQ ID NO: 3506208 - DNA, 19 bp, Homo sapiens
gacagccacggccaggcca

SEQ ID NO: 3506209 - DNA, 17 bp, Homo sapiens
gactaaaagatataagt

SEQ ID NO: 3506210 - DNA, 19 bp, Homo sapiens
gactaaaagatataagtgc

SEQ ID NO: 3506211 - DNA, 23 bp, Homo sapiens
gactaaaagatataagtgctgta

SEQ ID NO: 3506212 - DNA, 14 bp, Homo sapiens
gactaatggcatga

SEQ ID NO: 3506213 - DNA, 16 bp, Homo sapiens
gactaatggcatgaga

SEQ ID NO: 3506214 - DNA, 13 bp, Homo sapiens
gactaatttcaaa

SEQ ID NO: 3506215 - DNA, 23 bp, Homo sapiens
gactaattttacatgtttataaa

SEQ ID NO: 3506216 - DNA, 12 bp, Homo sapiens
gactacaggcac

SEQ ID NO: 3506217 - DNA, 18 bp, Homo sapiens
gactacaggtgtgagtca

SEQ ID NO: 3506218 - DNA, 21 bp, Homo sapiens
gactacaggtgtgagtcacca

SEQ ID NO: 3506219 - DNA, 18 bp, Homo sapiens
gactacagtcaggaaagg

SEQ ID NO: 3506220 - DNA, 20 bp, Homo sapiens
gactagagggacctctccca

SEQ ID NO: 3506221 - DNA, 23 bp, Homo sapiens
gactagagggacctctcccaggg

SEQ ID NO: 3506222 - DNA, 14 bp, Homo sapiens
gactagatgatgga

SEQ ID NO: 3506223 - DNA, 16 bp, Homo sapiens
gactagatgatggatg

SEQ ID NO: 3506224 - DNA, 21 bp, Homo sapiens
gactagatgatggatgccaat

SEQ ID NO: 3506225 - DNA, 13 bp, Homo sapiens
gactatcagccca

SEQ ID NO: 3506226 - DNA, 17 bp, Homo sapiens
gactcaatgcactgaca

SEQ ID NO: 3506227 - DNA, 18 bp, Homo sapiens
gactcacaacctgaacct

SEQ ID NO: 3506228 - DNA, 23 bp, Homo sapiens
gactcaccctcataccatctgct

SEQ ID NO: 3506229 - DNA, 17 bp, Homo sapiens
gactcagaagcctctgg

SEQ ID NO: 3506230 - DNA, 18 bp, Homo sapiens
gactcagacattggcacc

SEQ ID NO: 3506231 - DNA, 12 bp, Homo sapiens
gactcagccttc

SEQ ID NO: 3506232 - DNA, 20 bp, Homo sapiens
gactcagccttcagacagag

SEQ ID NO: 3506233 - DNA, 17 bp, Homo sapiens
gactcagctccccagag

SEQ ID NO: 3506234 - DNA, 12 bp, Homo sapiens
gactcagggcag

SEQ ID NO: 3506235 - DNA, 19 bp, Homo sapiens
gactcagggctcctgggtt

SEQ ID NO: 3506236 - DNA, 14 bp, Homo sapiens
gactcatcatttgt

SEQ ID NO: 3506237 - DNA, 15 bp, Homo sapiens
gactcatgaggaggg

SEQ ID NO: 3506238 - DNA, 17 bp, Homo sapiens
gactccactcaaagagg

SEQ ID NO: 3506239 - DNA, 20 bp, Homo sapiens
gactccagcctgcctggcag

SEQ ID NO: 3506240 - DNA, 19 bp, Homo sapiens
gactccaggcccaaggctc

SEQ ID NO: 3506241 - DNA, 21 bp, Homo sapiens
gactccatctctcatcctcca

SEQ ID NO: 3506242 - DNA, 13 bp, Homo sapiens
gactcccattcct

SEQ ID NO: 3506243 - DNA, 22 bp, Homo sapiens
gactcccattcctgaagaacca

SEQ ID NO: 3506244 - DNA, 17 bp, Homo sapiens
gactccgcctgaggcca

SEQ ID NO: 3506245 - DNA, 18 bp, Homo sapiens
gactccgcctgaggccag

SEQ ID NO: 3506246 - DNA, 17 bp, Homo sapiens
gactccggctgtgctgg

SEQ ID NO: 3506247 - DNA, 17 bp, Homo sapiens
gactcctaggcaggaca

SEQ ID NO: 3506248 - DNA, 19 bp, Homo sapiens
gactcctaggcaggacatg

SEQ ID NO: 3506249 - DNA, 16 bp, Homo sapiens
gactcgagaactttca

SEQ ID NO: 3506250 - DNA, 19 bp, Homo sapiens
gactcgagaactttcattt

SEQ ID NO: 3506251 - DNA, 13 bp, Homo sapiens
gactcggtttctc

SEQ ID NO: 3506252 - DNA, 18 bp, Homo sapiens
gactctcagtctctgagc

SEQ ID NO: 3506253 - DNA, 12 bp, Homo sapiens
gactctccaggg

SEQ ID NO: 3506254 - DNA, 24 bp, Homo sapiens
gactctccaggggtcctaggcctc

SEQ ID NO: 3506255 - DNA, 14 bp, Homo sapiens
gactctggaagatt

SEQ ID NO: 3506256 - DNA, 16 bp, Homo sapiens
gactctggcaaagctt

SEQ ID NO: 3506257 - DNA, 18 bp, Homo sapiens
gactctgggtccttcctg

SEQ ID NO: 3506258 - DNA, 17 bp, Homo sapiens
gactcttctctcaacct

SEQ ID NO: 3506259 - DNA, 21 bp, Homo sapiens
gactctttctgagtgccttct

SEQ ID NO: 3506260 - DNA, 21 bp, Homo sapiens
gactgaatgggatcatgaaag

SEQ ID NO: 3506261 - DNA, 22 bp, Homo sapiens
gactgacctggtccacagggca

SEQ ID NO: 3506262 - DNA, 23 bp, Homo sapiens
gactgacctggtccacagggcac

SEQ ID NO: 3506263 - DNA, 15 bp, Homo sapiens
gactgatcaggacct

SEQ ID NO: 3506264 - DNA, 15 bp, Homo sapiens
gactgcccggcaggg

SEQ ID NO: 3506265 - DNA, 20 bp, Homo sapiens
gactgctcagaacttgctgc

SEQ ID NO: 3506266 - DNA, 15 bp, Homo sapiens
gactggaacactaga

SEQ ID NO: 3506267 - DNA, 15 bp, Homo sapiens
gactggaagcacagc

SEQ ID NO: 3506268 - DNA, 20 bp, Homo sapiens
gactggaagctaatttgcat

SEQ ID NO: 3506269 - DNA, 14 bp, Homo sapiens
gactggaccagaca

SEQ ID NO: 3506270 - DNA, 20 bp, Homo sapiens
gactggatgtccagagctgg

SEQ ID NO: 3506271 - DNA, 12 bp, Homo sapiens
gactgggctctg

SEQ ID NO: 3506272 - DNA, 15 bp, Homo sapiens
gactgggctctggct

SEQ ID NO: 3506273 - DNA, 14 bp, Homo sapiens
gactgggctgaggg

SEQ ID NO: 3506274 - DNA, 15 bp, Homo sapiens
gactgggctgaggga

SEQ ID NO: 3506275 - DNA, 21 bp, Homo sapiens
gactgggctgagggagcctgg

SEQ ID NO: 3506276 - DNA, 10 bp, Homo sapiens
gactggtgcc

SEQ ID NO: 3506277 - DNA, 22 bp, Homo sapiens
gactggtgttatcaccgtgggc

SEQ ID NO: 3506278 - DNA, 23 bp, Homo sapiens
gactgtagggagggcggcagggg

SEQ ID NO: 3506279 - DNA, 21 bp, Homo sapiens
gactgtgagactgagagggct

SEQ ID NO: 3506280 - DNA, 21 bp, Homo sapiens
gacttcagtatgttgtcaaag

SEQ ID NO: 3506281 - DNA, 15 bp, Homo sapiens
gacttccatgcctta

SEQ ID NO: 3506282 - DNA, 18 bp, Homo sapiens
gacttcccagctaggaag

SEQ ID NO: 3506283 - DNA, 14 bp, Homo sapiens
gacttcccctgcct

SEQ ID NO: 3506284 - DNA, 21 bp, Homo sapiens
gacttccctaacacttacccc

SEQ ID NO: 3506285 - DNA, 18 bp, Homo sapiens
gacttcctgtccagctcc

SEQ ID NO: 3506286 - DNA, 21 bp, Homo sapiens
gacttcctgtccagctccaac

SEQ ID NO: 3506287 - DNA, 20 bp, Homo sapiens
gacttccttgagacacggag

SEQ ID NO: 3506288 - DNA, 17 bp, Homo sapiens
gacttcggggtagaggc

SEQ ID NO: 3506289 - DNA, 19 bp, Homo sapiens
gacttcggggtagaggctg

SEQ ID NO: 3506290 - DNA, 13 bp, Homo sapiens
gacttctgcctgg

SEQ ID NO: 3506291 - DNA, 14 bp, Homo sapiens
gacttctgcctgga

SEQ ID NO: 3506292 - DNA, 17 bp, Homo sapiens
gacttctgcctggagac

SEQ ID NO: 3506293 - DNA, 16 bp, Homo sapiens
gacttgcacagggatt

SEQ ID NO: 3506294 - DNA, 23 bp, Homo sapiens
gacttgccatgtgactctggctt

SEQ ID NO: 3506295 - DNA, 15 bp, Homo sapiens
gacttggcccctgcc

SEQ ID NO: 3506296 - DNA, 15 bp, Homo sapiens
gacttgtttttgcac

SEQ ID NO: 3506297 - DNA, 16 bp, Homo sapiens
gacttgtttttgcaca

SEQ ID NO: 3506298 - DNA, 15 bp, Homo sapiens
gactttaatttatgt

SEQ ID NO: 3506299 - DNA, 14 bp, Homo sapiens
gactttctctgtgt

SEQ ID NO: 3506300 - DNA, 15 bp, Homo sapiens
gactttctgcctgga

SEQ ID NO: 3506301 - DNA, 18 bp, Homo sapiens
gactttctgcctggagtg

SEQ ID NO: 3506302 - DNA, 21 bp, Homo sapiens
gacttttctttgtggcttcct

SEQ ID NO: 3506303 - DNA, 24 bp, Homo sapiens
gagaaaaaagtcaccattctgcat

SEQ ID NO: 3506304 - DNA, 11 bp, Homo sapiens
gagaaaatata

SEQ ID NO: 3506305 - DNA, 16 bp, Homo sapiens
gagaaaatatatgtat

SEQ ID NO: 3506306 - DNA, 11 bp, Homo sapiens
gagaaaatcat

SEQ ID NO: 3506307 - DNA, 16 bp, Homo sapiens
gagaaaatcatcaaga

SEQ ID NO: 3506308 - DNA, 14 bp, Homo sapiens
gagaaacagacaga

SEQ ID NO: 3506309 - DNA, 18 bp, Homo sapiens
gagaaacccaccagccta

SEQ ID NO: 3506310 - DNA, 19 bp, Homo sapiens
gagaaaccctaaaaagaga

SEQ ID NO: 3506311 - DNA, 22 bp, Homo sapiens
gagaaaccctaaaaagagaaga

SEQ ID NO: 3506312 - DNA, 16 bp, Homo sapiens
gagaaagaggaagctt

SEQ ID NO: 3506313 - DNA, 17 bp, Homo sapiens
gagaaaggggagcccac

SEQ ID NO: 3506314 - DNA, 22 bp, Homo sapiens
gagaaagtacttctccaccctg

SEQ ID NO: 3506315 - DNA, 13 bp, Homo sapiens
gagaacaaagatg

SEQ ID NO: 3506316 - DNA, 12 bp, Homo sapiens
gagaacaggact

SEQ ID NO: 3506317 - DNA, 16 bp, Homo sapiens
gagaacattttactgt

SEQ ID NO: 3506318 - DNA, 17 bp, Homo sapiens
gagaaccaaatctggaa

SEQ ID NO: 3506319 - DNA, 18 bp, Homo sapiens
gagaacctaagtttcagt

SEQ ID NO: 3506320 - DNA, 22 bp, Homo sapiens
gagaacctcacgcacctcccat

SEQ ID NO: 3506321 - DNA, 15 bp, Homo sapiens
gagaactttattttg

SEQ ID NO: 3506322 - DNA, 23 bp, Homo sapiens
gagaagcaagaaagaaacccgac

SEQ ID NO: 3506323 - DNA, 20 bp, Homo sapiens
gagaagccacaggcctgaga

SEQ ID NO: 3506324 - DNA, 12 bp, Homo sapiens
gagaagccagga

SEQ ID NO: 3506325 - DNA, 14 bp, Homo sapiens
gagaagcccgtgtg

SEQ ID NO: 3506326 - DNA, 16 bp, Homo sapiens
gagaagcccgtgtgag

SEQ ID NO: 3506327 - DNA, 16 bp, Homo sapiens
gagaagcggctggcag

SEQ ID NO: 3506328 - DNA, 12 bp, Homo sapiens
gagaaggaagcc

SEQ ID NO: 3506329 - DNA, 13 bp, Homo sapiens
gagaaggctatgt

SEQ ID NO: 3506330 - DNA, 18 bp, Homo sapiens
gagaaggtgcctgccata

SEQ ID NO: 3506331 - DNA, 15 bp, Homo sapiens
gagaagtctggtcag

SEQ ID NO: 3506332 - DNA, 16 bp, Homo sapiens
gagaagtctggtcaga

SEQ ID NO: 3506333 - DNA, 21 bp, Homo sapiens
gagaagtctggtcagagccac

SEQ ID NO: 3506334 - DNA, 19 bp, Homo sapiens
gagaagtgaatgctgggac

SEQ ID NO: 3506335 - DNA, 23 bp, Homo sapiens
gagaatattagctttactgtttg

SEQ ID NO: 3506336 - DNA, 13 bp, Homo sapiens
gagaatctttatt

SEQ ID NO: 3506337 - DNA, 15 bp, Homo sapiens
gagaatgaaagggcc

SEQ ID NO: 3506338 - DNA, 14 bp, Homo sapiens
gagaatgagaaatg

SEQ ID NO: 3506339 - DNA, 13 bp, Homo sapiens
gagaatgctgtca

SEQ ID NO: 3506340 - DNA, 15 bp, Homo sapiens
gagaatgtaagaact

SEQ ID NO: 3506341 - DNA, 16 bp, Homo sapiens
gagaatgtaagaacta

SEQ ID NO: 3506342 - DNA, 13 bp, Homo sapiens
gatactttacatg

SEQ ID NO: 3506343 - DNA, 13 bp, Homo sapiens
gatagaaatgcca

SEQ ID NO: 3506344 - DNA, 14 bp, Homo sapiens
gatagaaatgccaa

SEQ ID NO: 3506345 - DNA, 23 bp, Homo sapiens
gatagagactggaacactagaca

SEQ ID NO: 3506346 - DNA, 16 bp, Homo sapiens
gatagatgctggccca

SEQ ID NO: 3506347 - DNA, 21 bp, Homo sapiens
gatagatgctggcccagggcc

SEQ ID NO: 3506348 - DNA, 16 bp, Homo sapiens
gatagctaactgtaaa

SEQ ID NO: 3506349 - DNA, 19 bp, Homo sapiens
gatagctaactgtaaatca

SEQ ID NO: 3506350 - DNA, 17 bp, Homo sapiens
gataggtcagtgcaaat

SEQ ID NO: 3506351 - DNA, 17 bp, Homo sapiens
gataggttaataaagat

SEQ ID NO: 3506352 - DNA, 18 bp, Homo sapiens
gatataagtgctgtataa

SEQ ID NO: 3506353 - DNA, 23 bp, Homo sapiens
gatataagtgctgtataaaatca

SEQ ID NO: 3506354 - DNA, 16 bp, Homo sapiens
gatataatctttcaaa

SEQ ID NO: 3506355 - DNA, 17 bp, Homo sapiens
gatatactctagatgaa

SEQ ID NO: 3506356 - DNA, 20 bp, Homo sapiens
gatatatgtgtttttcacat

SEQ ID NO: 3506357 - DNA, 14 bp, Homo sapiens
gatatattaaaaat

SEQ ID NO: 3506358 - DNA, 17 bp, Homo sapiens
gatatattaaaaatata

SEQ ID NO: 3506359 - DNA, 21 bp, Homo sapiens
gatatattaaaaatataaaac

SEQ ID NO: 3506360 - DNA, 22 bp, Homo sapiens
gatatattaaaaatataaaact

SEQ ID NO: 3506361 - DNA, 15 bp, Homo sapiens
gatatccattctttc

SEQ ID NO: 3506362 - DNA, 15 bp, Homo sapiens
gatatcttcagttta

SEQ ID NO: 3506363 - DNA, 17 bp, Homo sapiens
gatatcttcagtttaat

SEQ ID NO: 3506364 - DNA, 13 bp, Homo sapiens
gatattaaaatgc

SEQ ID NO: 3506365 - DNA, 16 bp, Homo sapiens
gatattaaaatgctag

SEQ ID NO: 3506366 - DNA, 22 bp, Homo sapiens
gatatttccctcccctggggac

SEQ ID NO: 3506367 - DNA, 13 bp, Homo sapiens
gatattttccata

SEQ ID NO: 3506368 - DNA, 14 bp, Homo sapiens
gatattttccatat

SEQ ID NO: 3506369 - DNA, 19 bp, Homo sapiens
gatattttccatatattgg

SEQ ID NO: 3506370 - DNA, 16 bp, Homo sapiens
gatcaacatcttttct

SEQ ID NO: 3506371 - DNA, 23 bp, Homo sapiens
gatcaaccccttcgctcctgtgt

SEQ ID NO: 3506372 - DNA, 22 bp, Homo sapiens
gatcaaggccttattggaaagc

SEQ ID NO: 3506373 - DNA, 17 bp, Homo sapiens
gatcaagtcctttgtga

SEQ ID NO: 3506374 - DNA, 17 bp, Homo sapiens
gatcacaacgtgcattg

SEQ ID NO: 3506375 - DNA, 16 bp, Homo sapiens
gatcacagcagcttct

SEQ ID NO: 3506376 - DNA, 15 bp, Homo sapiens
gatcacggctcactg

SEQ ID NO: 3506377 - DNA, 20 bp, Homo sapiens
gatcacggctcactgcagcc

SEQ ID NO: 3506378 - DNA, 23 bp, Homo sapiens
gatcacggctcactgcagcctca

SEQ ID NO: 3506379 - DNA, 13 bp, Homo sapiens
gatcactgccaga

SEQ ID NO: 3506380 - DNA, 18 bp, Homo sapiens
gatcagaaaaatggagca

SEQ ID NO: 3506381 - DNA, 15 bp, Homo sapiens
gatcagaaatacaga

SEQ ID NO: 3506382 - DNA, 23 bp, Homo sapiens
gatcagagccgtggtcctttggg

SEQ ID NO: 3506383 - DNA, 15 bp, Homo sapiens
gatcagattgcatgt

SEQ ID NO: 3506384 - DNA, 20 bp, Homo sapiens
gatcagtgtaccatttgcct

SEQ ID NO: 3506385 - DNA, 11 bp, Homo sapiens
gatcagtgttg

SEQ ID NO: 3506386 - DNA, 13 bp, Homo sapiens
gatcatccactgt

SEQ ID NO: 3506387 - DNA, 14 bp, Homo sapiens
gatcatcgccagag

SEQ ID NO: 3506388 - DNA, 13 bp, Homo sapiens
gatcatgtacttt

SEQ ID NO: 3506389 - DNA, 19 bp, Homo sapiens
gatcatgtactttttagta

SEQ ID NO: 3506390 - DNA, 20 bp, Homo sapiens
gatccaaaagaagcccccag

SEQ ID NO: 3506391 - DNA, 22 bp, Homo sapiens
gatccaaaagaagcccccagct

SEQ ID NO: 3506392 - DNA, 21 bp, Homo sapiens
gatccaagctggtcccactca

SEQ ID NO: 3506393 - DNA, 20 bp, Homo sapiens
gatccacccacctcagcctc

SEQ ID NO: 3506394 - DNA, 18 bp, Homo sapiens
gatccacctgtctcagcc

SEQ ID NO: 3506395 - DNA, 13 bp, Homo sapiens
gatccagcctggg

SEQ ID NO: 3506396 - DNA, 21 bp, Homo sapiens
gatccagcctggggtctggag

SEQ ID NO: 3506397 - DNA, 13 bp, Homo sapiens
gatccagggacag

SEQ ID NO: 3506398 - DNA, 24 bp, Homo sapiens
gatcccatcttgataagaccacca

SEQ ID NO: 3506399 - DNA, 14 bp, Homo sapiens
gatccctctctgga

SEQ ID NO: 3506400 - DNA, 18 bp, Homo sapiens
gatccgactgctttggac

SEQ ID NO: 3506401 - DNA, 20 bp, Homo sapiens
gatccgactgctttggacct

SEQ ID NO: 3506402 - DNA, 17 bp, Homo sapiens
gatccgtttgaccaatt

SEQ ID NO: 3506403 - DNA, 18 bp, Homo sapiens
gatcctaagggctcaccg

SEQ ID NO: 3506404 - DNA, 20 bp, Homo sapiens
gatcctcccacctcagcctc

SEQ ID NO: 3506405 - DNA, 21 bp, Homo sapiens
gatcctcccacctcagcctcc

SEQ ID NO: 3506406 - DNA, 21 bp, Homo sapiens
gatcctcctgcagaccacgcc

SEQ ID NO: 3506407 - DNA, 15 bp, Homo sapiens
gatcctctcacctca

SEQ ID NO: 3506408 - DNA, 16 bp, Homo sapiens
gatcctctcacctcag

SEQ ID NO: 3506409 - DNA, 19 bp, Homo sapiens
gatcctctcacctcagcct

SEQ ID NO: 3506410 - DNA, 16 bp, Homo sapiens
gatcctggaggcccag

SEQ ID NO: 3506411 - DNA, 17 bp, Homo sapiens
gatcctggaggcccagt

SEQ ID NO: 3506412 - DNA, 12 bp, Homo sapiens
gatcctgtgaag

SEQ ID NO: 3506413 - DNA, 18 bp, Homo sapiens
gatctagaataatcttgc

SEQ ID NO: 3506414 - DNA, 21 bp, Homo sapiens
gatctcatggaaactggccag

SEQ ID NO: 3506415 - DNA, 22 bp, Homo sapiens
gatctcatggaaactggccagg

SEQ ID NO: 3506416 - DNA, 21 bp, Homo sapiens
gatctcattggacccttccat

SEQ ID NO: 3506417 - DNA, 20 bp, Homo sapiens
gatctctgcagggccgccag

SEQ ID NO: 3506418 - DNA, 17 bp, Homo sapiens
gatctgacatgattcct

SEQ ID NO: 3506419 - DNA, 20 bp, Homo sapiens
gatctgcaggggtctgggag

SEQ ID NO: 3506420 - DNA, 15 bp, Homo sapiens
gatctggaacccaga

SEQ ID NO: 3506421 - DNA, 18 bp, Homo sapiens
gatctggaacccagactc

SEQ ID NO: 3506422 - DNA, 20 bp, Homo sapiens
gatctggaacccagactcag

SEQ ID NO: 3506423 - DNA, 19 bp, Homo sapiens
gatctggaacctcagcctg

SEQ ID NO: 3506424 - DNA, 23 bp, Homo sapiens
gatctggaccgtcccctgcccac

SEQ ID NO: 3506425 - DNA, 17 bp, Homo sapiens
gatctgttttgaaggca

SEQ ID NO: 3506426 - DNA, 20 bp, Homo sapiens
gatctgttttgaaggcaaaa

SEQ ID NO: 3506427 - DNA, 15 bp, Homo sapiens
gatcttaatataaat

SEQ ID NO: 3506428 - DNA, 16 bp, Homo sapiens
gatcttaatataaatt

SEQ ID NO: 3506429 - DNA, 16 bp, Homo sapiens
gatctttgtggccaag

SEQ ID NO: 3506430 - DNA, 15 bp, Homo sapiens
gatgaaatgaggtca

SEQ ID NO: 3506431 - DNA, 16 bp, Homo sapiens
gatgaagttttacatt

SEQ ID NO: 3506432 - DNA, 22 bp, Homo sapiens
gatgaagttttacattgttgag

SEQ ID NO: 3506433 - DNA, 23 bp, Homo sapiens
gatgaagttttacattgttgagc

SEQ ID NO: 3506434 - DNA, 22 bp, Homo sapiens
gatgacagtgctctaggctgcc

SEQ ID NO: 3506435 - DNA, 19 bp, Homo sapiens
gatgactgccttgcctcct

SEQ ID NO: 3506436 - DNA, 15 bp, Homo sapiens
gatgagccctcagaa

SEQ ID NO: 3506437 - DNA, 19 bp, Homo sapiens
gatgagccctcagaaccct

SEQ ID NO: 3506438 - DNA, 22 bp, Homo sapiens
gatgagccctcagaacccttgg

SEQ ID NO: 3506439 - DNA, 16 bp, Homo sapiens
gatgagctctacccag

SEQ ID NO: 3506440 - DNA, 20 bp, Homo sapiens
gatgataagttcctttcctt

SEQ ID NO: 3506441 - DNA, 18 bp, Homo sapiens
gatgatacatccaaagca

SEQ ID NO: 3506442 - DNA, 23 bp, Homo sapiens
gatgataggttaataaagatgat

SEQ ID NO: 3506443 - DNA, 13 bp, Homo sapiens
gatgatcctaggc

SEQ ID NO: 3506444 - DNA, 14 bp, Homo sapiens
gatgatctttgcag

SEQ ID NO: 3506445 - DNA, 21 bp, Homo sapiens
gatgatctttgcagacaggca

SEQ ID NO: 3506446 - DNA, 21 bp, Homo sapiens
gatgatggtcttcagcctctt

SEQ ID NO: 3506447 - DNA, 13 bp, Homo sapiens
gatgattcaagcc

SEQ ID NO: 3506448 - DNA, 22 bp, Homo sapiens
gatgcaaactgtgcttctctat

SEQ ID NO: 3506449 - DNA, 16 bp, Homo sapiens
gatgcaccaccaagcc

SEQ ID NO: 3506450 - DNA, 13 bp, Homo sapiens
gatgcaccagccc

SEQ ID NO: 3506451 - DNA, 15 bp, Homo sapiens
gatgcaccagccctt

SEQ ID NO: 3506452 - DNA, 14 bp, Homo sapiens
gatgcagctcaaga

SEQ ID NO: 3506453 - DNA, 14 bp, Homo sapiens
gatgcatgtctttt

SEQ ID NO: 3506454 - DNA, 21 bp, Homo sapiens
gatgcatgttttccagctcct

SEQ ID NO: 3506455 - DNA, 19 bp, Homo sapiens
gatgccaatattaaatctg

SEQ ID NO: 3506456 - DNA, 19 bp, Homo sapiens
gatgccctggaggtggctg

SEQ ID NO: 3506457 - DNA, 18 bp, Homo sapiens
gatgccgaggtaaaagtt

SEQ ID NO: 3506458 - DNA, 18 bp, Homo sapiens
gatgcctacttttggcct

SEQ ID NO: 3506459 - DNA, 20 bp, Homo sapiens
gatgcctacttttggcctca

SEQ ID NO: 3506460 - DNA, 15 bp, Homo sapiens
gatgcctggtggcag

SEQ ID NO: 3506461 - DNA, 20 bp, Homo sapiens
gatgcctggtggcagctgcg

SEQ ID NO: 3506462 - DNA, 14 bp, Homo sapiens
gatgctccttgggc

SEQ ID NO: 3506463 - DNA, 21 bp, Homo sapiens
gatgctccttgggccctttga

SEQ ID NO: 3506464 - DNA, 16 bp, Homo sapiens
gatgctgccggcacag

SEQ ID NO: 3506465 - DNA, 18 bp, Homo sapiens
gatgctggatgctccttc

SEQ ID NO: 3506466 - DNA, 21 bp, Homo sapiens
gatgctggcccagggcccaga

SEQ ID NO: 3506467 - DNA, 21 bp, Homo sapiens
gatgctgggcacttcatctga

SEQ ID NO: 3506468 - DNA, 23 bp, Homo sapiens
gatgctgggcacttcatctgatc

SEQ ID NO: 3506469 - DNA, 15 bp, Homo sapiens
gatgcttttaacaga

SEQ ID NO: 3506470 - DNA, 17 bp, Homo sapiens
gatggaacacggccaca

SEQ ID NO: 3506471 - DNA, 12 bp, Homo sapiens
gatggacagact

SEQ ID NO: 3506472 - DNA, 21 bp, Homo sapiens
gatggacagagaactttattt

SEQ ID NO: 3506473 - DNA, 21 bp, Homo sapiens
gcagggggggaaatgcattta

SEQ ID NO: 3506474 - DNA, 23 bp, Homo sapiens
gcaggggtctgggagtcaggccc

SEQ ID NO: 3506475 - DNA, 18 bp, Homo sapiens
gcaggggtggctgcctca

SEQ ID NO: 3506476 - DNA, 21 bp, Homo sapiens
gcagggtcctcttctgggcct

SEQ ID NO: 3506477 - DNA, 20 bp, Homo sapiens
gcagggtctgggcaggactc

SEQ ID NO: 3506478 - DNA, 22 bp, Homo sapiens
gcaggtccagggtttgagttca

SEQ ID NO: 3506479 - DNA, 18 bp, Homo sapiens
gcaggtgctggagcactg

SEQ ID NO: 3506480 - DNA, 20 bp, Homo sapiens
gcaggtgctggagcactggg

SEQ ID NO: 3506481 - DNA, 17 bp, Homo sapiens
gcaggtggggagactgg

SEQ ID NO: 3506482 - DNA, 18 bp, Homo sapiens
gcaggttcccaagctcag

SEQ ID NO: 3506483 - DNA, 21 bp, Homo sapiens
gcagtcaacagttcaaagaag

SEQ ID NO: 3506484 - DNA, 24 bp, Homo sapiens
gcagtcacgtggaggagcagtgca

SEQ ID NO: 3506485 - DNA, 23 bp, Homo sapiens
gcagtcatcttgaccaagcagga

SEQ ID NO: 3506486 - DNA, 16 bp, Homo sapiens
gcagtccagccagctc

SEQ ID NO: 3506487 - DNA, 18 bp, Homo sapiens
gcagtcctgcctcagcct

SEQ ID NO: 3506488 - DNA, 13 bp, Homo sapiens
gcagtcctggagc

SEQ ID NO: 3506489 - DNA, 15 bp, Homo sapiens
gcagtcgtgcctgtg

SEQ ID NO: 3506490 - DNA, 17 bp, Homo sapiens
gcagtcgtgcctgtgtc

SEQ ID NO: 3506491 - DNA, 20 bp, Homo sapiens
gcagtctctttattttacta

SEQ ID NO: 3506492 - DNA, 20 bp, Homo sapiens
gcagtgaatgattcagtgtt

SEQ ID NO: 3506493 - DNA, 21 bp, Homo sapiens
gcagtgatgctggatgctcct

SEQ ID NO: 3506494 - DNA, 15 bp, Homo sapiens
gcagtgcaggcacag

SEQ ID NO: 3506495 - DNA, 13 bp, Homo sapiens
gcagtgccttgca

SEQ ID NO: 3506496 - DNA, 19 bp, Homo sapiens
gcagtgctcgctgttgctg

SEQ ID NO: 3506497 - DNA, 14 bp, Homo sapiens
gcagtggactcaga

SEQ ID NO: 3506498 - DNA, 23 bp, Homo sapiens
gcagtggaggtggggtgtttggg

SEQ ID NO: 3506499 - DNA, 21 bp, Homo sapiens
gcagtggggtttcgcagcctg

SEQ ID NO: 3506500 - DNA, 20 bp, Homo sapiens
gcagtggtgcgatctgggtt

SEQ ID NO: 3506501 - DNA, 12 bp, Homo sapiens
gcagtgtgaaaa

SEQ ID NO: 3506502 - DNA, 21 bp, Homo sapiens
gcagtgtgaggccagggcaga

SEQ ID NO: 3506503 - DNA, 20 bp, Homo sapiens
gcagtgtgcactaaggggcc

SEQ ID NO: 3506504 - DNA, 18 bp, Homo sapiens
gcagttcatccgcactgt

SEQ ID NO: 3506505 - DNA, 15 bp, Homo sapiens
gcagttctgatgctt

SEQ ID NO: 3506506 - DNA, 17 bp, Homo sapiens
gcagttctgatgcttac

SEQ ID NO: 3506507 - DNA, 14 bp, Homo sapiens
gcagttggccagag

SEQ ID NO: 3506508 - DNA, 20 bp, Homo sapiens
gcagtttcagagatggacag

SEQ ID NO: 3506509 - DNA, 16 bp, Homo sapiens
gcagtttctgtcctgc

SEQ ID NO: 3506510 - DNA, 21 bp, Homo sapiens
gcagtttgaaattctgaattt

SEQ ID NO: 3506511 - DNA, 17 bp, Homo sapiens
gcagttttcaagtcaaa

SEQ ID NO: 3506512 - DNA, 13 bp, Homo sapiens
gcatacaatctga

SEQ ID NO: 3506513 - DNA, 23 bp, Homo sapiens
gcataccaggttttacacttgca

SEQ ID NO: 3506514 - DNA, 20 bp, Homo sapiens
gcatacgagagcagaggtct

SEQ ID NO: 3506515 - DNA, 14 bp, Homo sapiens
gcatatctgccttt

SEQ ID NO: 3506516 - DNA, 20 bp, Homo sapiens
gcatatgaaaggagagcatc

SEQ ID NO: 3506517 - DNA, 14 bp, Homo sapiens
gcatatgttgaata

SEQ ID NO: 3506518 - DNA, 15 bp, Homo sapiens
gcatcacctccacca

SEQ ID NO: 3506519 - DNA, 18 bp, Homo sapiens
gcatcaccttaggcaggg

SEQ ID NO: 3506520 - DNA, 22 bp, Homo sapiens
gcatcaccttaggcagggaagt

SEQ ID NO: 3506521 - DNA, 22 bp, Homo sapiens
gcatccacttctttcagcagac

SEQ ID NO: 3506522 - DNA, 15 bp, Homo sapiens
gcatccgcaggtgct

SEQ ID NO: 3506523 - DNA, 16 bp, Homo sapiens
gcatccgcaggtgctg

SEQ ID NO: 3506524 - DNA, 11 bp, Homo sapiens
gcatcctctga

SEQ ID NO: 3506525 - DNA, 14 bp, Homo sapiens
gcatcctctgactc

SEQ ID NO: 3506526 - DNA, 13 bp, Homo sapiens
gcatcctggcacc

SEQ ID NO: 3506527 - DNA, 14 bp, Homo sapiens
gcatcctggcaccc

SEQ ID NO: 3506528 - DNA, 15 bp, Homo sapiens
gcatcggcctagggc

SEQ ID NO: 3506529 - DNA, 15 bp, Homo sapiens
gcatctaagcccatg

SEQ ID NO: 3506530 - DNA, 21 bp, Homo sapiens
gcatctacttgccagaaccaa

SEQ ID NO: 3506531 - DNA, 19 bp, Homo sapiens
gcatctcaatggaaacatc

SEQ ID NO: 3506532 - DNA, 17 bp, Homo sapiens
gcatctctgtactttgc

SEQ ID NO: 3506533 - DNA, 20 bp, Homo sapiens
gcatctggggcccatactgg

SEQ ID NO: 3506534 - DNA, 23 bp, Homo sapiens
gcatctgtataagtaagaaaata

SEQ ID NO: 3506535 - DNA, 13 bp, Homo sapiens
gcatctgtttatt

SEQ ID NO: 3506536 - DNA, 16 bp, Homo sapiens
gcatcttactgaaggt

SEQ ID NO: 3506537 - DNA, 19 bp, Homo sapiens
gcatgacaactactttaag

SEQ ID NO: 3506538 - DNA, 23 bp, Homo sapiens
gcatgatagacacatatgagggg

SEQ ID NO: 3506539 - DNA, 22 bp, Homo sapiens
gcatgatgtttgcccaaaattt

SEQ ID NO: 3506540 - DNA, 16 bp, Homo sapiens
gcatgcactgttcccc

SEQ ID NO: 3506541 - DNA, 15 bp, Homo sapiens
gcatgccctctcagg

SEQ ID NO: 3506542 - DNA, 21 bp, Homo sapiens
gcatggaaggggcttctggac

SEQ ID NO: 3506543 - DNA, 12 bp, Homo sapiens
gcatggagctgg

SEQ ID NO: 3506544 - DNA, 15 bp, Homo sapiens
gcatggagctggccg

SEQ ID NO: 3506545 - DNA, 18 bp, Homo sapiens
gcatgggggaccccttcc

SEQ ID NO: 3506546 - DNA, 16 bp, Homo sapiens
gcatgggtcgggagag

SEQ ID NO: 3506547 - DNA, 19 bp, Homo sapiens
gcatgggtcgggagagggg

SEQ ID NO: 3506548 - DNA, 16 bp, Homo sapiens
gcatggtgccccagga

SEQ ID NO: 3506549 - DNA, 19 bp, Homo sapiens
gcatgtaaacacgcctgca

SEQ ID NO: 3506550 - DNA, 19 bp, Homo sapiens
gcatgtaatcccagctact

SEQ ID NO: 3506551 - DNA, 18 bp, Homo sapiens
gcatgttttccagctcct

SEQ ID NO: 3506552 - DNA, 19 bp, Homo sapiens
gcattaaatataatatgca

SEQ ID NO: 3506553 - DNA, 19 bp, Homo sapiens
gcattaccgcgttgtaaaa

SEQ ID NO: 3506554 - DNA, 19 bp, Homo sapiens
gcattatataccatttatc

SEQ ID NO: 3506555 - DNA, 15 bp, Homo sapiens
gcattattgcattat

SEQ ID NO: 3506556 - DNA, 23 bp, Homo sapiens
gcattcagtccgcctggccggct

SEQ ID NO: 3506557 - DNA, 12 bp, Homo sapiens
gcattccagccc

SEQ ID NO: 3506558 - DNA, 17 bp, Homo sapiens
gcattcttggttggctg

SEQ ID NO: 3506559 - DNA, 20 bp, Homo sapiens
gcattcttttaaaagacaag

SEQ ID NO: 3506560 - DNA, 21 bp, Homo sapiens
gcattcttttaaaagacaaga

SEQ ID NO: 3506561 - DNA, 18 bp, Homo sapiens
gcattgaacacaaactgt

SEQ ID NO: 3506562 - DNA, 21 bp, Homo sapiens
gcattgaacacaaactgtaaa

SEQ ID NO: 3506563 - DNA, 23 bp, Homo sapiens
gcattgaccgcgactaatttcaa

SEQ ID NO: 3506564 - DNA, 16 bp, Homo sapiens
gcattgatggggaagg

SEQ ID NO: 3506565 - DNA, 17 bp, Homo sapiens
gcattgatggggaagga

SEQ ID NO: 3506566 - DNA, 16 bp, Homo sapiens
gcattgccaagggctt

SEQ ID NO: 3506567 - DNA, 16 bp, Homo sapiens
gcattgctggactctg

SEQ ID NO: 3506568 - DNA, 15 bp, Homo sapiens
gcatttactttgtgt

SEQ ID NO: 3506569 - DNA, 16 bp, Homo sapiens
gcatttagctgtattc

SEQ ID NO: 3506570 - DNA, 17 bp, Homo sapiens
gcatttatagatcattt

SEQ ID NO: 3506571 - DNA, 18 bp, Homo sapiens
gcatttatagatcatttc

SEQ ID NO: 3506572 - DNA, 20 bp, Homo sapiens
gcatttcacaaaacagcctt

SEQ ID NO: 3506573 - DNA, 13 bp, Homo sapiens
gcatttgaatgca

SEQ ID NO: 3506574 - DNA, 16 bp, Homo sapiens
gcatttggattggggt

SEQ ID NO: 3506575 - DNA, 22 bp, Homo sapiens
gcatttggattggggtccctct

SEQ ID NO: 3506576 - DNA, 18 bp, Homo sapiens
gcattttccagcactttg

SEQ ID NO: 3506577 - DNA, 23 bp, Homo sapiens
gcattttgtatttgtctaactgg

SEQ ID NO: 3506578 - DNA, 23 bp, Homo sapiens
gcattttgtttggtattgtattt

SEQ ID NO: 3506579 - DNA, 12 bp, Homo sapiens
gcatttttctgc

SEQ ID NO: 3506580 - DNA, 13 bp, Homo sapiens
gcattttttatga

SEQ ID NO: 3506581 - DNA, 14 bp, Homo sapiens
gccaaaaaaagaca

SEQ ID NO: 3506582 - DNA, 16 bp, Homo sapiens
gccaaaaaaagacagg

SEQ ID NO: 3506583 - DNA, 19 bp, Homo sapiens
gccaaaaaggatacataat

SEQ ID NO: 3506584 - DNA, 15 bp, Homo sapiens
gccaaaagctgctca

SEQ ID NO: 3506585 - DNA, 11 bp, Homo sapiens
gccaaactgtc

SEQ ID NO: 3506586 - DNA, 15 bp, Homo sapiens
gccaaagagcctttc

SEQ ID NO: 3506587 - DNA, 22 bp, Homo sapiens
gccaaagagcctttccaaagag

SEQ ID NO: 3506588 - DNA, 19 bp, Homo sapiens
gccaaagggaaatatcatt

SEQ ID NO: 3506589 - DNA, 20 bp, Homo sapiens
gccaacacgcacctgcctca

SEQ ID NO: 3506590 - DNA, 15 bp, Homo sapiens
gccaacactgtgggt

SEQ ID NO: 3506591 - DNA, 19 bp, Homo sapiens
gccaacagaagcttccatt

SEQ ID NO: 3506592 - DNA, 13 bp, Homo sapiens
gccaacccttctc

SEQ ID NO: 3506593 - DNA, 23 bp, Homo sapiens
gccaacccttctcctcttgtaaa

SEQ ID NO: 3506594 - DNA, 17 bp, Homo sapiens
gccaactagcccctggg

SEQ ID NO: 3506595 - DNA, 19 bp, Homo sapiens
gccaagaaagatgtatata

SEQ ID NO: 3506596 - DNA, 16 bp, Homo sapiens
gccaagacacagcagg

SEQ ID NO: 3506597 - DNA, 15 bp, Homo sapiens
gccaagcactgtgct

SEQ ID NO: 3506598 - DNA, 23 bp, Homo sapiens
gccaagcactgtgctcagggcta

SEQ ID NO: 3506599 - DNA, 14 bp, Homo sapiens
gccaagcagccaag

SEQ ID NO: 3506600 - DNA, 13 bp, Homo sapiens
gccaagccagctg

SEQ ID NO: 3506601 - DNA, 14 bp, Homo sapiens
gccaagccagctgc

SEQ ID NO: 3506602 - DNA, 20 bp, Homo sapiens
gccaagctcaggaccaggca

SEQ ID NO: 3506603 - DNA, 23 bp, Homo sapiens
gccaagctcaggaccaggcaatg

SEQ ID NO: 3506604 - DNA, 12 bp, Homo sapiens
gcctgtggctgt

SEQ ID NO: 3506605 - DNA, 19 bp, Homo sapiens
gcctgtgtccatgcgctca

SEQ ID NO: 3506606 - DNA, 20 bp, Homo sapiens
gcctgtgtccatgcgctcag

SEQ ID NO: 3506607 - DNA, 23 bp, Homo sapiens
gcctgtgtggccacttctgtcca

SEQ ID NO: 3506608 - DNA, 14 bp, Homo sapiens
gcctgttcagctcc

SEQ ID NO: 3506609 - DNA, 15 bp, Homo sapiens
gcctgttcagctcca

SEQ ID NO: 3506610 - DNA, 17 bp, Homo sapiens
gcctgttcagctccagc

SEQ ID NO: 3506611 - DNA, 19 bp, Homo sapiens
gcctgttcagctccagctc

SEQ ID NO: 3506612 - DNA, 20 bp, Homo sapiens
gccttaaacctacctcccac

SEQ ID NO: 3506613 - DNA, 18 bp, Homo sapiens
gccttagaagtcacacag

SEQ ID NO: 3506614 - DNA, 22 bp, Homo sapiens
gccttagccatgatctgcaggg

SEQ ID NO: 3506615 - DNA, 12 bp, Homo sapiens
gccttagcttca

SEQ ID NO: 3506616 - DNA, 14 bp, Homo sapiens
gccttagcttcagg

SEQ ID NO: 3506617 - DNA, 15 bp, Homo sapiens
gccttagcttcagga

SEQ ID NO: 3506618 - DNA, 12 bp, Homo sapiens
gccttccagatc

SEQ ID NO: 3506619 - DNA, 21 bp, Homo sapiens
gccttccagatcctctctggg

SEQ ID NO: 3506620 - DNA, 23 bp, Homo sapiens
gccttccagatcctctctggggc

SEQ ID NO: 3506621 - DNA, 19 bp, Homo sapiens
gccttccagggatttgcct

SEQ ID NO: 3506622 - DNA, 21 bp, Homo sapiens
gccttccagggatttgcctca

SEQ ID NO: 3506623 - DNA, 22 bp, Homo sapiens
gccttcccgccggaggccagct

SEQ ID NO: 3506624 - DNA, 15 bp, Homo sapiens
gccttcctaagcctg

SEQ ID NO: 3506625 - DNA, 17 bp, Homo sapiens
gccttcctcctgggccc

SEQ ID NO: 3506626 - DNA, 13 bp, Homo sapiens
gccttcctctctc

SEQ ID NO: 3506627 - DNA, 16 bp, Homo sapiens
gccttcctctctccag

SEQ ID NO: 3506628 - DNA, 16 bp, Homo sapiens
gccttcgaggtcagag

SEQ ID NO: 3506629 - DNA, 13 bp, Homo sapiens
gccttctcaccag

SEQ ID NO: 3506630 - DNA, 16 bp, Homo sapiens
gccttctcaccagctg

SEQ ID NO: 3506631 - DNA, 22 bp, Homo sapiens
gccttctcaccagctgcaaagt

SEQ ID NO: 3506632 - DNA, 23 bp, Homo sapiens
gccttctcaccagctgcaaagtg

SEQ ID NO: 3506633 - DNA, 14 bp, Homo sapiens
gccttctcccctct

SEQ ID NO: 3506634 - DNA, 18 bp, Homo sapiens
gccttctcccctcttctg

SEQ ID NO: 3506635 - DNA, 20 bp, Homo sapiens
gccttctcccctcttctgag

SEQ ID NO: 3506636 - DNA, 16 bp, Homo sapiens
gccttctctgaaggac

SEQ ID NO: 3506637 - DNA, 19 bp, Homo sapiens
gccttctgtggggactccg

SEQ ID NO: 3506638 - DNA, 17 bp, Homo sapiens
gccttcttcagggcctg

SEQ ID NO: 3506639 - DNA, 19 bp, Homo sapiens
gccttcttcagggcctggt

SEQ ID NO: 3506640 - DNA, 22 bp, Homo sapiens
gccttcttttgattatgttttt

SEQ ID NO: 3506641 - DNA, 14 bp, Homo sapiens
gccttgaattgtct

SEQ ID NO: 3506642 - DNA, 15 bp, Homo sapiens
gccttgaattgtcta

SEQ ID NO: 3506643 - DNA, 15 bp, Homo sapiens
gccttgatgactgcc

SEQ ID NO: 3506644 - DNA, 16 bp, Homo sapiens
gccttgcctcctcagt

SEQ ID NO: 3506645 - DNA, 14 bp, Homo sapiens
gccttggctcagac

SEQ ID NO: 3506646 - DNA, 12 bp, Homo sapiens
gccttgggagcc

SEQ ID NO: 3506647 - DNA, 13 bp, Homo sapiens
gcctttattgtgt

SEQ ID NO: 3506648 - DNA, 18 bp, Homo sapiens
gcctttcccaactctagc

SEQ ID NO: 3506649 - DNA, 19 bp, Homo sapiens
gcctttcccaactctagct

SEQ ID NO: 3506650 - DNA, 14 bp, Homo sapiens
gcctttcctcaaaa

SEQ ID NO: 3506651 - DNA, 20 bp, Homo sapiens
gcctttcctcaaaactggag

SEQ ID NO: 3506652 - DNA, 23 bp, Homo sapiens
gcctttccttttcgcctttcctc

SEQ ID NO: 3506653 - DNA, 15 bp, Homo sapiens
gcctttcgaggcctg

SEQ ID NO: 3506654 - DNA, 16 bp, Homo sapiens
gcctttcgaggcctga

SEQ ID NO: 3506655 - DNA, 20 bp, Homo sapiens
gcctttgaatgttaattttt

SEQ ID NO: 3506656 - DNA, 18 bp, Homo sapiens
gcgacactgggaggccag

SEQ ID NO: 3506657 - DNA, 22 bp, Homo sapiens
gcgacgttagtcgtgagctctt

SEQ ID NO: 3506658 - DNA, 17 bp, Homo sapiens
gcgactaaactagattt

SEQ ID NO: 3506659 - DNA, 21 bp, Homo sapiens
gcgactaatttcaaaatgctt

SEQ ID NO: 3506660 - DNA, 23 bp, Homo sapiens
gcgactaatttcaaaatgctttt

SEQ ID NO: 3506661 - DNA, 19 bp, Homo sapiens
gcgactccgttggccactc

SEQ ID NO: 3506662 - DNA, 21 bp, Homo sapiens
gcgactctatagactctagga

SEQ ID NO: 3506663 - DNA, 14 bp, Homo sapiens
gcgactttctgcct

SEQ ID NO: 3506664 - DNA, 16 bp, Homo sapiens
gcgactttctgcctgg

SEQ ID NO: 3506665 - DNA, 23 bp, Homo sapiens
gcgagctctcaaatccctctcca

SEQ ID NO: 3506666 - DNA, 19 bp, Homo sapiens
gcgaggagatgctccttgg

SEQ ID NO: 3506667 - DNA, 16 bp, Homo sapiens
gcgaggaggctccaga

SEQ ID NO: 3506668 - DNA, 18 bp, Homo sapiens
gcgaggaggctccagagg

SEQ ID NO: 3506669 - DNA, 22 bp, Homo sapiens
gcgagtgaatgccagtgtgctg

SEQ ID NO: 3506670 - DNA, 13 bp, Homo sapiens
gcgattctcctgc

SEQ ID NO: 3506671 - DNA, 23 bp, Homo sapiens
gcgattcttctgcttcagcctcc

SEQ ID NO: 3506672 - DNA, 22 bp, Homo sapiens
gcgcaaagggcatgggtcggga

SEQ ID NO: 3506673 - DNA, 20 bp, Homo sapiens
gcgcaactggagccagcaac

SEQ ID NO: 3506674 - DNA, 14 bp, Homo sapiens
gcgcagccccatct

SEQ ID NO: 3506675 - DNA, 14 bp, Homo sapiens
gcgcagtgccttgc

SEQ ID NO: 3506676 - DNA, 19 bp, Homo sapiens
gcgcatgtaatcccagcta

SEQ ID NO: 3506677 - DNA, 21 bp, Homo sapiens
gcgcatgtaatcccagctact

SEQ ID NO: 3506678 - DNA, 22 bp, Homo sapiens
gcgccaggatggaacacggcca

SEQ ID NO: 3506679 - DNA, 15 bp, Homo sapiens
gcgccaggctgacca

SEQ ID NO: 3506680 - DNA, 14 bp, Homo sapiens
gcgccagtcctgct

SEQ ID NO: 3506681 - DNA, 21 bp, Homo sapiens
gcgccccctccgccctgccac

SEQ ID NO: 3506682 - DNA, 22 bp, Homo sapiens
gcgcccctagccggttcctgtc

SEQ ID NO: 3506683 - DNA, 18 bp, Homo sapiens
gcgcctacaggagtgagc

SEQ ID NO: 3506684 - DNA, 21 bp, Homo sapiens
gcgcctacaggagtgagcact

SEQ ID NO: 3506685 - DNA, 16 bp, Homo sapiens
gcgcctgcccctccca

SEQ ID NO: 3506686 - DNA, 12 bp, Homo sapiens
gcgcctgtgacc

SEQ ID NO: 3506687 - DNA, 21 bp, Homo sapiens
gcgcgcatgtaatcccagcta

SEQ ID NO: 3506688 - DNA, 23 bp, Homo sapiens
gcgcgcatgtaatcccagctact

SEQ ID NO: 3506689 - DNA, 17 bp, Homo sapiens
gcgctcaataggaccag

SEQ ID NO: 3506690 - DNA, 16 bp, Homo sapiens
gcgctcagggccatgc

SEQ ID NO: 3506691 - DNA, 22 bp, Homo sapiens
gcgctcagggccatgctgaggc

SEQ ID NO: 3506692 - DNA, 21 bp, Homo sapiens
gcgctcctgccgcagagctgg

SEQ ID NO: 3506693 - DNA, 20 bp, Homo sapiens
gcgctgggcacttccctgct

SEQ ID NO: 3506694 - DNA, 21 bp, Homo sapiens
gcgctgtttttgttgtgtgtg

SEQ ID NO: 3506695 - DNA, 22 bp, Homo sapiens
gcgctgtttttgttgtgtgtgc

SEQ ID NO: 3506696 - DNA, 19 bp, Homo sapiens
gcggcaggactgcagagca

SEQ ID NO: 3506697 - DNA, 16 bp, Homo sapiens
gcggcaggggcctgga

SEQ ID NO: 3506698 - DNA, 14 bp, Homo sapiens
gcggccagagccga

SEQ ID NO: 3506699 - DNA, 13 bp, Homo sapiens
gcggctgcctcca

SEQ ID NO: 3506700 - DNA, 21 bp, Homo sapiens
gcgggaggatgttctgggaca

SEQ ID NO: 3506701 - DNA, 19 bp, Homo sapiens
gcgggcagagggctggagg

SEQ ID NO: 3506702 - DNA, 15 bp, Homo sapiens
gcgggcgcgtgagtg

SEQ ID NO: 3506703 - DNA, 21 bp, Homo sapiens
gcgggtgaacaaagcagccac

SEQ ID NO: 3506704 - DNA, 22 bp, Homo sapiens
gcgggtgaacaaagcagccacg

SEQ ID NO: 3506705 - DNA, 20 bp, Homo sapiens
gcggtccacccaggagcccc

SEQ ID NO: 3506706 - DNA, 18 bp, Homo sapiens
gcggtgctgtcctcaggt

SEQ ID NO: 3506707 - DNA, 12 bp, Homo sapiens
gcgtacacagag

SEQ ID NO: 3506708 - DNA, 14 bp, Homo sapiens
gcgtacacagagaa

SEQ ID NO: 3506709 - DNA, 14 bp, Homo sapiens
gcgtacaggctggc

SEQ ID NO: 3506710 - DNA, 15 bp, Homo sapiens
gcgtcctcctctgtg

SEQ ID NO: 3506711 - DNA, 16 bp, Homo sapiens
gcgtcctcctctgtga

SEQ ID NO: 3506712 - DNA, 19 bp, Homo sapiens
gcgtcctgtccacacccag

SEQ ID NO: 3506713 - DNA, 17 bp, Homo sapiens
gcgtcgccctcccaggc

SEQ ID NO: 3506714 - DNA, 15 bp, Homo sapiens
gcgtgaaggccgaga

SEQ ID NO: 3506715 - DNA, 16 bp, Homo sapiens
gcgtgaaggccgagaa

SEQ ID NO: 3506716 - DNA, 15 bp, Homo sapiens
gcgtgagccactgca

SEQ ID NO: 3506717 - DNA, 20 bp, Homo sapiens
gcgtgatcaaagccacactc

SEQ ID NO: 3506718 - DNA, 22 bp, Homo sapiens
gcgttaaaggctcgattttgta

SEQ ID NO: 3506719 - DNA, 18 bp, Homo sapiens
gcgttatgaagagctaat

SEQ ID NO: 3506720 - DNA, 20 bp, Homo sapiens
gcgttgtaaaatatagctgt

SEQ ID NO: 3506721 - DNA, 13 bp, Homo sapiens
gctaaaaagcaac

SEQ ID NO: 3506722 - DNA, 18 bp, Homo sapiens
gctaaaacaccttggctt

SEQ ID NO: 3506723 - DNA, 23 bp, Homo sapiens
gctaaactccttcctggcctgag

SEQ ID NO: 3506724 - DNA, 16 bp, Homo sapiens
gctaaatgtgaatgat

SEQ ID NO: 3506725 - DNA, 22 bp, Homo sapiens
gctaaattactcaggaagaaca

SEQ ID NO: 3506726 - DNA, 16 bp, Homo sapiens
gctaactgtaaatcat

SEQ ID NO: 3506727 - DNA, 23 bp, Homo sapiens
gctaagaacctggaacttgggga

SEQ ID NO: 3506728 - DNA, 22 bp, Homo sapiens
gctaaggaggggaaaaaaatgt

SEQ ID NO: 3506729 - DNA, 21 bp, Homo sapiens
gctaaggcgtggagctgcctg

SEQ ID NO: 3506730 - DNA, 22 bp, Homo sapiens
gctaaggcgtggagctgcctga

SEQ ID NO: 3506731 - DNA, 22 bp, Homo sapiens
gctaagtgatcctcccacctca

SEQ ID NO: 3506732 - DNA, 23 bp, Homo sapiens
gctaagtgatcctcccacctcag

SEQ ID NO: 3506733 - DNA, 13 bp, Homo sapiens
gctaagtgtgaac

SEQ ID NO: 3506734 - DNA, 15 bp, Homo sapiens
gctaatgggacacta

SEQ ID NO: 3506735 - DNA, 19 bp, Homo sapiens
gctgcccctctctgggcct

SEQ ID NO: 3506736 - DNA, 17 bp, Homo sapiens
gctgcccctggctctga

SEQ ID NO: 3506737 - DNA, 21 bp, Homo sapiens
gctgcctcatttagagaggaa

SEQ ID NO: 3506738 - DNA, 21 bp, Homo sapiens
gctgcctcccctctccttcct

SEQ ID NO: 3506739 - DNA, 21 bp, Homo sapiens
gctgcctctacctgacactcc

SEQ ID NO: 3506740 - DNA, 15 bp, Homo sapiens
gctgcctgcccacac

SEQ ID NO: 3506741 - DNA, 12 bp, Homo sapiens
gctgcctgttca

SEQ ID NO: 3506742 - DNA, 22 bp, Homo sapiens
gctgcctgttcagctccagctc

SEQ ID NO: 3506743 - DNA, 14 bp, Homo sapiens
gctgccttggctca

SEQ ID NO: 3506744 - DNA, 16 bp, Homo sapiens
gctgccttggctcaga

SEQ ID NO: 3506745 - DNA, 19 bp, Homo sapiens
gctgccttggctcagacat

SEQ ID NO: 3506746 - DNA, 17 bp, Homo sapiens
gctgcggcgtacaggct

SEQ ID NO: 3506747 - DNA, 18 bp, Homo sapiens
gctgcggcgtacaggctg

SEQ ID NO: 3506748 - DNA, 19 bp, Homo sapiens
gctgcggtccacccaggag

SEQ ID NO: 3506749 - DNA, 21 bp, Homo sapiens
gctgctcagggaaaagcagct

SEQ ID NO: 3506750 - DNA, 16 bp, Homo sapiens
gctgctccccagcagc

SEQ ID NO: 3506751 - DNA, 21 bp, Homo sapiens
gctgctcctagagggaggggc

SEQ ID NO: 3506752 - DNA, 22 bp, Homo sapiens
gctgctcctccctctgacccag

SEQ ID NO: 3506753 - DNA, 14 bp, Homo sapiens
gctgctctgagcca

SEQ ID NO: 3506754 - DNA, 15 bp, Homo sapiens
gctgctgaaggctca

SEQ ID NO: 3506755 - DNA, 19 bp, Homo sapiens
gctgctgacctccacagct

SEQ ID NO: 3506756 - DNA, 12 bp, Homo sapiens
gctgctgcctgc

SEQ ID NO: 3506757 - DNA, 15 bp, Homo sapiens
gctgctgctcctccc

SEQ ID NO: 3506758 - DNA, 15 bp, Homo sapiens
gctgctgggatggtg

SEQ ID NO: 3506759 - DNA, 16 bp, Homo sapiens
gctgctgtcacctctc

SEQ ID NO: 3506760 - DNA, 21 bp, Homo sapiens
gctgctgtcacctctcccacg

SEQ ID NO: 3506761 - DNA, 17 bp, Homo sapiens
gctgctgtccagtgcct

SEQ ID NO: 3506762 - DNA, 16 bp, Homo sapiens
gctgcttcactaggga

SEQ ID NO: 3506763 - DNA, 14 bp, Homo sapiens
gctgcttcctcctg

SEQ ID NO: 3506764 - DNA, 23 bp, Homo sapiens
gctgcttttccttggggcaggca

SEQ ID NO: 3506765 - DNA, 17 bp, Homo sapiens
gctggaaaataatactg

SEQ ID NO: 3506766 - DNA, 22 bp, Homo sapiens
gctggaaaataatactgctgag

SEQ ID NO: 3506767 - DNA, 16 bp, Homo sapiens
gctggaacagattcac

SEQ ID NO: 3506768 - DNA, 18 bp, Homo sapiens
gctggagaaatcttgaat

SEQ ID NO: 3506769 - DNA, 21 bp, Homo sapiens
gctggagcactgggctcccgg

SEQ ID NO: 3506770 - DNA, 15 bp, Homo sapiens
gctggaggcccaggc

SEQ ID NO: 3506771 - DNA, 20 bp, Homo sapiens
gctggaggcccaggctggga

SEQ ID NO: 3506772 - DNA, 12 bp, Homo sapiens
gctggagtgagg

SEQ ID NO: 3506773 - DNA, 14 bp, Homo sapiens
gctggagtgcagtg

SEQ ID NO: 3506774 - DNA, 22 bp, Homo sapiens
gctggagtgcagtgagccgaga

SEQ ID NO: 3506775 - DNA, 15 bp, Homo sapiens
gctggagttgtcact

SEQ ID NO: 3506776 - DNA, 16 bp, Homo sapiens
gctggagtttcatgta

SEQ ID NO: 3506777 - DNA, 20 bp, Homo sapiens
gctggatgagaatttgagtg

SEQ ID NO: 3506778 - DNA, 14 bp, Homo sapiens
gctggcaacacaga

SEQ ID NO: 3506779 - DNA, 13 bp, Homo sapiens
gctggcagcagag

SEQ ID NO: 3506780 - DNA, 21 bp, Homo sapiens
gctggcatgatccaagcaaga

SEQ ID NO: 3506781 - DNA, 14 bp, Homo sapiens
gctggcccagccaa

SEQ ID NO: 3506782 - DNA, 17 bp, Homo sapiens
gctggcccagggcccag

SEQ ID NO: 3506783 - DNA, 23 bp, Homo sapiens
gctggccccgccgcctggtactc

SEQ ID NO: 3506784 - DNA, 24 bp, Homo sapiens
gctggccccgccgcctggtactca

SEQ ID NO: 3506785 - DNA, 15 bp, Homo sapiens
gctggcgtgcagtgg

SEQ ID NO: 3506786 - DNA, 14 bp, Homo sapiens
gctggctccagatg

SEQ ID NO: 3506787 - DNA, 21 bp, Homo sapiens
gctggctccagatgcagggca

SEQ ID NO: 3506788 - DNA, 14 bp, Homo sapiens
gctggctggcctca

SEQ ID NO: 3506789 - DNA, 13 bp, Homo sapiens
gctggctggggtg

SEQ ID NO: 3506790 - DNA, 16 bp, Homo sapiens
gctggctgttggctgg

SEQ ID NO: 3506791 - DNA, 18 bp, Homo sapiens
gctggctgttggctgggg

SEQ ID NO: 3506792 - DNA, 23 bp, Homo sapiens
gctggctgttggctgggggcctc

SEQ ID NO: 3506793 - DNA, 15 bp, Homo sapiens
gctggcttttctgtt

SEQ ID NO: 3506794 - DNA, 18 bp, Homo sapiens
gctggcttttctgtttcc

SEQ ID NO: 3506795 - DNA, 18 bp, Homo sapiens
gctgggaactcacctggg

SEQ ID NO: 3506796 - DNA, 21 bp, Homo sapiens
gctgggaactcacctggggct

SEQ ID NO: 3506797 - DNA, 20 bp, Homo sapiens
gctgggactacaggcaccca

SEQ ID NO: 3506798 - DNA, 19 bp, Homo sapiens
gctgggactacaggtgtga

SEQ ID NO: 3506799 - DNA, 16 bp, Homo sapiens
gctgggactcagcctt

SEQ ID NO: 3506800 - DNA, 22 bp, Homo sapiens
gctgggaggagcccctggacat

SEQ ID NO: 3506801 - DNA, 13 bp, Homo sapiens
gctgggcacttcc

SEQ ID NO: 3506802 - DNA, 14 bp, Homo sapiens
gctgggcacttccc

SEQ ID NO: 3506803 - DNA, 15 bp, Homo sapiens
gctgggccctctctt

SEQ ID NO: 3506804 - DNA, 18 bp, Homo sapiens
gctgggcttcagtggcag

SEQ ID NO: 3506805 - DNA, 19 bp, Homo sapiens
gctgggcttcagtggcagc

SEQ ID NO: 3506806 - DNA, 22 bp, Homo sapiens
gctgggcttcagtggcagctgc

SEQ ID NO: 3506807 - DNA, 20 bp, Homo sapiens
gctggggaagtcctctgggt

SEQ ID NO: 3506808 - DNA, 18 bp, Homo sapiens
gctggggccaccctggcc

SEQ ID NO: 3506809 - DNA, 20 bp, Homo sapiens
gctggggccaccctggcccg

SEQ ID NO: 3506810 - DNA, 17 bp, Homo sapiens
gctggggccggggctga

SEQ ID NO: 3506811 - DNA, 13 bp, Homo sapiens
gctgggggcctca

SEQ ID NO: 3506812 - DNA, 15 bp, Homo sapiens
gctgggggtgggcca

SEQ ID NO: 3506813 - DNA, 14 bp, Homo sapiens
gctggggtggcctg

SEQ ID NO: 3506814 - DNA, 18 bp, Homo sapiens
gctggggtggcctgtgtg

SEQ ID NO: 3506815 - DNA, 19 bp, Homo sapiens
gctgggtattaccatgtaa

SEQ ID NO: 3506816 - DNA, 17 bp, Homo sapiens
gctgggtggcactgcca

SEQ ID NO: 3506817 - DNA, 16 bp, Homo sapiens
gctgggttcatttgtg

SEQ ID NO: 3506818 - DNA, 14 bp, Homo sapiens
gctgggttggaggg

SEQ ID NO: 3506819 - DNA, 22 bp, Homo sapiens
gctggtcaaacaaactctctga

SEQ ID NO: 3506820 - DNA, 15 bp, Homo sapiens
gctggtcccactcag

SEQ ID NO: 3506821 - DNA, 22 bp, Homo sapiens
gctgtacatctattttggattg

SEQ ID NO: 3506822 - DNA, 20 bp, Homo sapiens
gctgtagtcctcataaaaag

SEQ ID NO: 3506823 - DNA, 14 bp, Homo sapiens
gctgtatcttgttt

SEQ ID NO: 3506824 - DNA, 15 bp, Homo sapiens
gctgtatgctgatca
